United States Patent 9,587,003 (MODIFIED POLYNUCLEOTIDES FOR THE PRODUCTION OF ONCOLOGY-RELATED PROTEINS AND PEPTIDES) - sequence listing, part 16

SEQ ID NO: 27171 - DNA, 3483 bp, Artificial Sequence
  Description of Artificial Sequence: Synthetic coding sequence
taaaccaatgaagacagtcccattatagagtattaccctcccgactttaagaccgaccttaacgggaagcagcaggagtgggaagcagtggtgctcatcccctttatagacgagcggctgctggaggccatggagacctgcaaccacagtttgaaaaaagaagagagaaaaagaaaccaacactccgagtgtttaatgtgctggtatgatagagatacggaattcatttatccaagtccatggcctgagaagttccctgccatcgaacgctgttgcactcgctataaaatcatttctcttgacgcctggagagtggacattaacaagaacaaaatcactcggattgaccaaaaggcattatacttttgcggttttcctaccctgaagcacatcaggcacaagttcttcttgaaaaaaagtggggtccaagtctttcagcagtcctcaaggggcgaaaatatgatgctggaaattctggtggacgcggagtctgatgaactgaccgttgaaaatgttgccagctcagttttagggaaatccgtctttgtgaattggcctcacctcgaggaggctagagtcgtggcagtctccgacggtgagacaaagttttaccttgaagaaccgccaggcactcagaaactctattccggccgaaccgcccctccatccaaagttgttcacctgggcgacaaggagcagtctaactgggccaaagaagttcaagggattagcgaacactacttgcgcaggaaaggaattataatcaatgaaacatccgcagtggtgtacgcccagctgctgacggggcgtaaataccaaattaaccagaatggcgaggtacgactagagaaacaatggagtaagcaagttgtgcccttcgtgtaccagaccatagtcaaggatattagagcattcgatagtcgcttcagcaacatcaaaactctagacgatcttttccctctgagatctatggtgttcatgctgggcacaccttattatggttgcactggtgaggtccaggattctggggatgtgatcaccgaagggagaattcgcgtaatcttctcaatcccgtgtgagcctaatctggacgccctgatccagaaccaacacaagtacagtatcaaatacaaccctggatacgtactcgcctctcggctaggagtgtcagggtacctggtctctcggttcactggaagcatcttcattggcagggggtctcggagaaatcctcacggcgaccacaaggccaatgtgggcctaaatctcaagtttaacaaaaaaaacgaggaagtcccgggttataccaaaaaggtcggctccgagtggatgtactccagcgctgccgaacagctgctagctgaatacctcgagagagcacccgagctcttttcctacattgccaagaattcacaagaagacgtgttttatgaagacgacatttggccaggcgagaatgagaacggagctgagaaggtgcaggaaatcataacttggctcaagggccaccctgtctcaaccctctctcggtcaagctgtgacctccaaattctcgatgccgctattgtggaaaaaatagaagaagaagtggagaaatgtaagcaaagaaaaaacaacaaaaaagtgcgtgtcaccgtcaaacctcatctactctacaggcccctcgagcagcagcatggtgtgatcccagacagagacgccgagttttgtctgtttgatcgggtggtcaatgtgagggaaaatttcagcgtgcccgtcggcctacgaggaaccatcatcggaatcaagggagctaatagggaggccgatgttctgtttgaagtcctgtttgatgaagaatttcccggagggctgacaattaggtgcagcccaggaagaggttatcgcctcccaacttctgccctggtgaacctgtcgcatggctcgcggtcagaaactggaaaccaaaagttgaccgctatcgtgaagccccagcccgcagtgcatcagcatagctcctcctcttcagtttcatctggtcacctgggagccttgaatcactccccccagagcctgtttgtacccacacaagttcctaccaaagatgatgacgagttttgcaatatctggcagtccctgcagggttctgggaagatgcagtattttcaaccaacgatccaggagaagggtgcagtgctgcctcaggagatcagccaagtaaatcagcaccacaaaagcgggtttaacgataatagtgtcaagtaccagcagcggaagcacgatcctcatcggaagttcaaggaggaatgtaagagcccaaaagcagaatgttggtctcagaaaatgagtaataagcagccaaattccggtattgagaatttcctggcatccctgaatatttcaaaggagaacgaggtgcagagctctcaccatggggagcccccatcagaagagcacctgtccccccagtctttcgccatgaaggggacaaggatgctaaaggagatactgaaaattgacggctccaacaccgtcgaccataagaatgaaatcaaacagattgctaatgagatccctgtgagctcaaataggcgggacgagtatggtctgccatcgcagcctaagcagaacaagaagctggcctcttatatgaacaaaccacattctgccaatgaatatcacaatgtgcagagcatggacaatatgtgttggccagcaccatcacagattccacccgtctcgaccccagtgactgagctctcacgcatttgctccttggtgggaatgccacagcccgatttttccttcctgaggatgccccagaccatgactgtgtgccaggtgaagctgagtaacggcctgctcgtccatggaccacagtgccattccgaaaatgaggccaaggaaaaggctgccttatttgccttgcagcaattaggcagtctcgggatgaacttccccctgcccagccaggtgtttgcgaactatccctctgcggtgcccccaggaaccatccctccagcattccctcctcccacagccaatatcatgccctcgtcctcccacttattcgggtcgatgccatggggacccagcgtgcctgtcccaggcaaaccgttccaccacaccttgtattcgggtacaatgccgatggctgggggtatccccggtggtgtacacaatcagttcattcccctgcaggtcacaaaaaagagagtggccaacaaaaagaactttgagaacaaagaggcacagtcctcgcaggcaactcctgttcagacaagccagcccgactcttctaacatcgtcaaagtgagtcccagagagtcttcttctgcctctctgaaaagctcccccatcgcgcagcccgcttcaagttttcaagtcgaaaccgcttcccaggggcactccatttcccatcataagagcacacctatttctagctcacggagaaagagccgcaagctggctgtgaacttcggcgtgtctaaaccgtccgagtag

SEQ ID NO: 27172 - DNA, 1233 bp, Artificial Sequence
  Description of Artificial Sequence: Synthetic coding sequence
atgcctgctcgggctctcctacccaggaggatggggcatcgaaccctggcctcaactcccgcactgtgggccagtataccttgtccccgttcggaactcaggcttgacctggtcctgccgagcggacagtcattcagatggagggaacaatcacccgcacattggagcggggttctggccgaccaggtctggacactgacccagacagaggaacagctccactgtaccgtgtacaggggcgacaaatcacaggcttctagacccacacccgatgaactagaggccgttcgcaagtactttcaactagacgtgaccctagcacagctgtaccaccattggggttctgtggactcacacttccaggaagttgcccagaagtttcagggtgttcgtctgttacgccaggaccctattgaatgcctgtttagctttatttgcagcagtaataataatatcgctagaattactggtatggtggaaaggctatgccaggcttttgggcctcgattgatacaactagacgacgtcacataccatggcttccccagcttgcaggccctcgccggtcccgaagtagaggcccatctgcggaaattaggactaggctatcgcgctcgatacgtttcagcctccgcgagagctatcctggaggagcaggggggactggcatggctgcagcagctcagggagagctcctacgaggaggcacataaagcactctgtatcctgcccggagtcggtaccaaagtcgctgattgcatttgcctgatggcattggataaacctcaggccgtgcccgtagacgtgcatatgtggcacattgcccagcgcgactatagctggcatcctactactagccaggcaaagggaccctcccctcagacaaataaggaactggggaatttcttcaggtctttgtggggcccttatgcaggctgggcgcaagctacaccccctagttacagatgctgctctgttcccacatgcgctaaccctgccatgctgcgatcccaccagcagtccgcagaacgcgtccccaagggtagaaaagcgaggtggggaaccttagacaaagaaatccctcaggctcccagtccgcctttccccacttctttatcaccctcacccccttccctgatgctggggagagggcttccagtcactacctccaaggcccgacacccccagatcaagcagtcggtttgtaccacacgctggggtggtggatattag

SEQ ID NO: 27173 - DNA, 1071 bp, Artificial Sequence
  Description of Artificial Sequence: Synthetic coding sequence
atgcccgcaagagcattattgccccgtaggatgggccatagaacattggcatctaccccggctctgtgggccagcattccatgccctagatcagagctccgtctagacttggtgctacctagtggccaatcattccggtggcgggagcaatcgccagcacactggtccggcgtgctagctgatcaagtgtggacactgactcagactgaggaacagctccactgcacagtgtacaggggggacaagtcccaggcatcgcgacccacacccgacgagctggaagcagttcgcaaatatttccagctcgatgtgaccttagcacagctgtaccaccactggggaagcgttgactcccattttcaggaggttgcccaaaagtttcagggagtgcgactgctgagacaggatccaattgagtgtctgttttccttcatatgctcatccaacaataacatcgcacgaataacaggcatggtggaacggctctgccaggctttcggtccgcgtctcattcagctggacgatgtcacatatcatggctttccttctttacaggcgcttgccggacccgaggtcgaggcccatctgaggaaattgggcctaggatatagagccagatatgttagtgcaagtgccagagccattttagaggagcaagggggattggcttggcttcagcagctgcgcgagtctagttatgaggaggcccacaaagccttgtgcattttacccggagtaggaacgaaggtcgccgattgcatatgcctgatggccctagacaagccccaggccgtgccggtggatgtccacatgtggcatatcgcgcaacgggactactcctggcacccaactacaagtcaagcaaaaggtccttctccccagaccaacaaagagctcggtaatttttttcgctcactgtgggggccatatgcgggttgggctcaagccctgtgtcaagttattaccaccttcatgaccttccttggaccgcacagattggatcaaatgccccctgaagagctccagacgtccagtagtagactaggcggtcccccatggcagtgcatatag

SEQ ID NO: 27174 - DNA, 1275 bp, Artificial Sequence
  Description of Artificial Sequence: Synthetic coding sequence
atgcccgctcgcgctctgcttccgcgaagaatgggacataggaccctcgccagtacacccgcactgtgggcttcaatcccttgccctaggtctgagctcaggctggacctggtactgccaagcggacagtctttcaggtggagggagcagagtcctgcccactggtccggagttttagctgatcaggtgtggacactgactcagacggaagagcagttgcactgcaccgtgtatagaggggataaatcccaagccagtaggccgactccggatgagctggaagctgtgcgaaagtacttccaactagacgtaacgctcgcccagctctatcatcattgggggagcgtggacagccatttccaagaggtggcccaaaaattccagggcgtccgccttctgcgtcaggatcctattgagtgcctcttttcctttatctgtagcagcaataacaatattgccagaattaccggtatggtcgagcgcctctgccaggccttcggccctcgtctaatacaacttgacgatgtgacataccatggttttccatcactccaagctttagcaggacccgaggtagaagcccacctgcgcaaacttggcttgggctatcgcgctcgatacgtgtcagccagtgctagagccattctggaggagcaaggtggcctggcctggcttcagcagctgagagaaagctcttacgaggaagcgcataaagctttatgcatactccctggcgttggcactaaggtggctgactgtatctgtctcatggctcttgataaaccacaggctgtaccagtggatgttcacatgtggcatattgctcaacgagactactcctggcacccaacaaccagccaggccaaaggaccctcaccccagacgaacaaggaacttgggaattttttcagatccctttgggggccatacgccggatgggcacaggccggtttattgggcaacgcctttgacggccatcagttgttgcgcccattgatcttttgccaggatcacctgcgagaaggcccaccaattggccgtggagattcgcaaggagaagagctcgagcctcagcttccctctagcctatcatccattccgtatggcttctgcgaccactgttggaccaaggacgttgatgacccaccattggtaacccatccaagtcccggaagccgagacgggcatatgactcaggcatggcctgtgaaggtggtgagcccattagcaaccgtgatcggtcacgtgatgcaggcatctttgcttgctctctag

SEQ ID NO: 27175 - DNA, 975 bp, Artificial Sequence
  Description of Artificial Sequence: Synthetic coding sequence
atgccagccagagctctgctgcctagaaggatggggcatagaactttggcctccaccccagctctgtgggcctccatcccttgtcctcggtccgagctgaggcttgatctagtactcccgagcggacagtctttccgttggcgcgagcagtcccctgcccactggtctggggtgctggcagaccaggtgtggactttgacacaaacggaagagcagctccattgcacggtgtaccgcggagacaagagccaggcttcccgccctacaccggacgaactcgaagctgtgcggaagtattttcagctggatgttacgctggctcagctttatcatcactggggcagcgtggattctcatttccaggaagtggcccagaaatttcagggtgtgaggctcctacgccaggatccaattgaatgtttgttttctttcatttgttcttctaacaacaacattgcaaggatcacagggatggttgaacggttgtgccaggcctttggccctcggctgatacagttggatgatgtgacgtatcacggcttcccatccctacaggcacttgccggacctgaagtcgaagcacacctgagaaaactgggcctgggctatcgcgcacggtatgtgtcggcttcggctcgggctattctggaggagcagggaggactggcatggcttcagcagctgcgcgaatcttcctacgaggaggctcataaggcactgtgcatactgcccggtgtcggcacaaaagtagcagattgtatttgccttatggccttggacaagccccaggcagtaccggtcgacgtgcatatgtggcacatcgcccaacgcgattattcttggcaccccaccacgtctcaggccaaaggacctagccctcagacgaataaggagctgggtaacttcttccgctccttatggggcccatacgcagggtgggctcaagctgtgtcagtgcctcggtgtcctccatag

SEQ ID NO: 27176 - DNA, 594 bp, Artificial Sequence
  Description of Artificial Sequence: Synthetic coding sequence
atggtggaacgtctgtgtcaggcgtttggccctcgtctgatccagcttgacgatgtgacgtaccacggctttccctcgttgcaagctttggcgggacccgaagtggaggcccatctccgtaagctgggactaggatatagagctcgctatgtctccgcctctgcacgcgcaatcctcgaggaacaggggggactggcatggctccagcagctccgcgaaagctcatatgaagaggcacataaggctctttgtatactccctggtgtggggacaaaagaaaccttcagtggggcttgtggagatctcatgctcgcgggaccaaaaaggtgctgtagtgtgccaacctgcgccaaccccgctatgctgcgctctcatcagcagtcggctgaacgtgtgcccaaaggtcggaaagctcgctggggcacacttgataaggagatcccccaagcccctagccctccatttcccacatctctgtcgccttcgccccctagtcttatgttgggcagaggtttgcccgtgactacctctaaagctcggcatccccagattaagcaaagcgtgtgcacaacacggtggggcggaggatactag

SEQ ID NO: 27177 - DNA, 1038 bp, Artificial Sequence
  Description of Artificial Sequence: Synthetic coding sequence
atgcccgctagggctttactgcctcggaggatgggccatcgtaccctcgcatccactccagccctgtgggcgtcaatcccgtgtccaaggtcagagctccgcttagacctcgtgttaccctctggacagtccttccgatggcgcgagcagtctcctgcccactggagcggtgtgctcgctgatcaggtatggactttaacacagacagaggagcagctgcactgcaccgtttatagaggagacaaatctcaggcgagccgcccaacacccgacgaactcgaagcagtacggaagtatttccagctggatgtgacactcgcccagctgtaccatcattggggctcagttgactcacacttccaggaggtcgcccagaagtttcagggggttcgtctgctgcgccaggatcctatcgaatgcttattctcatttatttgttcgagtaacaataacattgcgagaataacagggatggtggaaaggctgtgtcaggcttttggcccacggctgatccagctcgatgacgtcacatatcatgggttcccttctctacaggctctagccggacctgaggtggaagcccatctgcgtaagctaggattgggataccgcgcacgatacgtttctgcctctgctcgtgcaattctggaggagcagggcggacttgcctggctgcagcagctgagagagtcttcctatgaggaagctcataaagcattgtgcatacttccaggggtcggcacaaaggtggccgattgtatctgtctgatggctctcgacaaaccccaggccgtgcctgtagacgtgcatatgtggcacatcgcccagagagactatagctggcaccccacaacttcgcaggccaagggacccagtcctcagacaaataaagagcttgggaatttctttagaagcctttggggcccatacgcaggctgggcacaggcagtcctgttcagcgcggacttacgtcagagtagacatgctcaggaacccccagcaaagcgtcggaagggctccaaaggccctgaaggctag

SEQ ID NO: 27178 - DNA, 1074 bp, Artificial Sequence
  Description of Artificial Sequence: Synthetic coding sequence
atgccagcgagagctctcctgcctcgaagaatgggacacaggactttagcatcaacacctgccctgtgggcgagtatcccgtgccctagaagcgagctccgtttagatctcgtcctccctagtggtcagagtttcaggtggagagagcagagtcccgctcattggtcaggcgttttagctgatcaagtatggaccctgacccaaacagaagagcaactacattgcaccgtgtataggggagacaaatcccaggcctctcggcctactccggacgaactggaggccgtacgtaaatattttcagttggacgtgaccctggcccagctttaccaccactggggatctgtagatagtcactttcaggaagtggctcagaagtttcaaggagtccgcctgttgcgacaggatcctatcgaatgtctgtttagctttatctgttcctcaaacaacaacatagcacggattaccggaatggttgagagactatgtcaggccttcgggccaaggcttattcagctcgacgatgtgacttatcacggcttcccgagccttcaagctcttgccggtccagaggtggaagcccatctgcgaaagctgggtctaggctatcgcgcaagatatgtctccgccagcgcacgggcaatattagaggaacaagggggactagcatggctccaacagctgcgagaaagttcctacgaagaggcgcacaaagccctgtgtatactgccaggcgtggggacgaaggggctcctgggcaacgctttcgatggccaccagcttcttcggcctctgatcttctgccaggaccatctgcgagaaggccctccaattgggaggggggactctcagggcgaagaacttgagccccaacttccttcgagcttgagctcaataccctacggattctgtgatcattgctggactaaggatgtcgacgacccccctctggtgacccacccctctccaggttctagagatggtcacatgacacaggcgtggccagtaaaggtggtcagtcccttagctacagtgatcggacacgtcatgcaagccagcttgctcgccttatag

SEQ ID NO: 27179 - DNA, 588 bp, Artificial Sequence
  Description of Artificial Sequence: Synthetic coding sequence
atgcccgcacgggctttgctgccccgaagaatggggcaccgaacgctcgcgtctacaccggcactgtgggcaagtattccttgtccacggtccgaacttaggctcgacctcgtgctgccaagcggacagtctttccggtggagggagcagtcaccagctcactggtcaggcgtcctagccgatcaagtctggaccctcacgcaaaccgaagaacagttgcactgcaccgtgtacaggggggacaagagccaggcctcaaggcctacccccgacgagctggaggccgtgaggaagtactttcagctcgatgtcactctggctcaactctaccatcattggggatcagtggactctcacttccaggaagtggcccagaagtttcaaggtgtgagactactgaggcaggatccgattgaatgcttattctcatttatttgttcctccaacaacaatatcgcacggatcactggaatggtagagagactctgccaagctttcggccctaggctgatccaattggatgacgtgacttaccacggcttcccaagcctgcaggctttggctggacccccttggcaatgcatatag

SEQ ID NO: 27180 - DNA, 969 bp, Artificial Sequence
  Description of Artificial Sequence: Synthetic coding sequence
atgccggcaagagcactactgccacggcgaatgggtcaccggactctggcaagcacgcccgcactgtgggcttccataccttgtcccaggtccgaactccggctggacttggttctgccctccggacagtccttcaggtggcgcgagcagtccccagctcattggtcgggcgtgctagccgaccaggtgtggactcttacgcagaccgaagaacagctccattgtaccgtttacaggggtgacaaaagccaggccagtcggcctacaccggacgaactagaagcggttcgcaaatattttcaacttgatgttacgctggcacagttatatcatcactgggggagtgtagattcccattttcaggaggttgcccaaaagtttcagggtgtgcggttgctaaggcaagatccaattgagtgcttgttctcctttatttgctcctctaataataatattgctcgtatcaccgggatggtagagcgtctttgccaggccttcggccctcgcctgatccaactggacgatgtgacataccatggatttccttcactgcaagccctggctggacccgaggttgaggctcatctgcgcaaactcggcttgggctaccgcgctaggtatgtctcagcctctgccagagccatcctggaggagcaaggcggtcttgcttggctgcaacagctgcgcgaatctagctacgaggaggctcataaggctttatgtattttacctggagtgggcaccaaggtagcagactgcatttgcctgatggcactggataaaccccaagctgtgcctgtggacgtgcacatgtggcacatagcccagagggactacagctggcatccaaccacatcccaggccaagggtcctagcccccagaccaataaggaactggggaatttcttccggtcactgtggggtccttacgccggttgggcacaagctgccggatcagacgcgtcttag

SEQ ID NO: 27181 - DNA, 6806 bp, Artificial Sequence
  Description of Artificial Sequence: Synthetic coding sequence
atgagtgggttgcacctggtaaaacagggacgcgacaggaaaaagatagatagccaaagagattttacagttgcctctcctgcagagttcgtgactcgctttgggggtaacaaagtgattgagaaagtgctcattgctaacaatggcatagccgctgttaagtgcatgcgctcaatcaggagatggagttatgagatgttcagaaacgagagggcaatccgcttcgtcgttatggtgacgcccgaagacctgaaagccaacgccgagtacatcaaaatggctgatcactacgttcccgtgcctggcggacccaataataacaattacgctaacgtcgagctcatactcgatatcgccaaacggatccccgtgcaagccgtctgggccggttggggccacgcgtccgaaaatcccaagttgccggaactcctgctcaaaaacggcatcgccttcatggggcctccttctcaggccatgtgggccctgggagacaagatcgcatcctccatcgtcgcccaaactgcaggcattcctaccctcccttggagcgggtctgggctccgagtggattggcaagaaaatgacttcagcaagagaatcttgaatgtacctcaggaattgtacgagaagggatatgtgaaggatgtggatgatggtctgcaagctgcagaggaagtcggctatccagtgatgatcaaagctagcgaggggggaggagggaaaggcatacggaaggttaataacgccgacgacttccccaacctctttagacaggtccaggcggaagtgcctggtagccctatattcgtgatgagactggctaaacagagccgacatctggaggtccagatcctggcggaccagtatggcaacgccatcagtctgttcggacgggactgctccgtccagcggagacaccagaagattattgaggaggctcccgcaaccattgctacacccgctgtatttgaacacatggaacaatgcgctgtgaaactcgctaagatggtgggctacgtgtctgccggtacggtggagtacctgtactcgcaggatggatctttttattttcttgagctgaaccccaggctgcaggtcgaacacccctgtaccgagatggtggccgacgtgaacctccccgcagcccagctccagatagctatgggcattcccctgtaccggattaaggacatcagaatgatgtacggagtgtctccatggggtgattcccccattgattttgaggactctgcccacgtgccttgcccgagaggccatgttatcgccgcaaggatcaccagcgagaatcctgatgagggtttcaagccgtcttcaggtaccgtacaggaattaaatttcaggtccaacaaaaacgtgtgggggtatttctctgtggccgctgcaggcggattgcatgaatttgctgatagtcagttcggacattgcttctcatggggcgagaatcgggaggaggccatttccaatatggtggtggcgttaaaggaattgagtatccgaggggacttcaggacaaccgtggaatatttaatcaagttgttggagacagaatcctttcagatgaatagaattgatactggttggttagataggctgattgccgagaaagtgcaagctgagcgaccagacaccatgctcggtgtcgtctgcggagcactgcatgttgccgatgtgagtctgaggaatagtgtgagcaatttcctgcacagcctggagcggggtcaagtacttcctgcgcatactctgctgaacaccgtggatgttgagctaatctacgaaggcgtgaaatacgtgctcaaagtgaccaggcagagccccaactcatacgtcgtgattatgaacggcagttgcgtggaggttgacgttcacagactgtccgacggcggtcttttgctctcctatgatggcagtagctatacgacatacatgaaggaggaggtcgacaggtaccgtataacaattggcaacaaaacatgtgtttttgagaaggagaatgaccccagtgtgatgcggtccccgagtgccggaaaactcattcagtacatagtcgaagacggaggacacgtgttcgctgggcaatgttatgccgaaatagaagtgatgaagatggtgatgaccttgaccgctgtcgaaagtgggtgcatacattatgtgaagagaccaggtgcagcccttgatcctggatgtgtgctggctaagatgcagctcgacaacccaagtaaagtgcaacaagcagaacttcacactggttccctgcccagaatccagagcaccgcactccgcggagaaaaactgcatcgcgtctttcactatgtactggacaacctggtgaatgtaatgaatgggtattgcctgcctgatccttttttctcttctaaggtgaaggactgggtcgagagattgatgaagacactgcgagatccctctctgcccttactggaacttcaagacattatgacctcagtgtcaggccgaattcctccaaatgtggaaaaaagcatcaagaaagagatggcccagtatgcatccaatataaccagcgtactctgtcagtttcctagccaacagatagcaaacattctggactctcacgctgccaccctgaatcgcaagtctgaaagggaagtgttcttcatgaatacgcagtcgatcgttcagctcgtacagaggtaccgaagtggaatcagaggacacatgaaagccgtggtgatggatcttctaaggcagtacctcagggttgagacacaatttcagaatggacactacgataaatgcgtgttcgctctgcgggaggagaacaagtcagacatgaacacagtcctcaattatattttcagccacgcccaggtgacaaagaagaatcttctcgtcaccatgttgattgaccagctgtgcggcagagatccaacactgacagatgagctcctgaacattctcacggaattgacacagctgtcaaaaactaccaatgccaaggtagcccttagagccaggcaggtcctgattgccagtcatcttccctcttacgagctccgtcacaaccaggtggaaagtatctttctgtctgcaattgatatgtacgggcatcaattttgcatcgagaacctccagaagctgattctaagtgagactagcatttttgatgtgcttcccaactttttctatcacagcaaccaggtagtccgcatggctgcgttggaagtgtatgtccggcgagcatacatcgcctacgaattgaattcagtccagcacaggcagctgaaggacaacacttgtgttgtggagttccagtttatgttacctacgagtcatcctaatcggggtaacatcccgacgctgaaccgtatgtctttttcctcgaatctcaaccactacgggatgacccatgtcgccagcgtaagcgatgtgctgctagataactcatttacacctccctgtcagcgaatgggaggaatggtgtctttccgtacattcgaggacttcgtgagaatcttcgacgaggtaatggggtgcttttccgacagtccgcctcagagcccaacctttcccgaagcaggtcatactagcctctacgatgaggataaagtgcccagagacgaacccatccatatcctaaatgttgccattaaaaccgactgtgacatcgaggacgatagattggctgcaatgttccgggagttcacccagcagaataaagccacattggtggaccatggtatcagacggctcacatttctagtcgctcagaaggattttcggaaacaagtgaactatgaggtggaccgaaggttccatcgagagttccctaaattctttaccttccgggctagggacaagtttgaggaggacagaatttacagacatctggagcccgcactggcctttcagttggaacttaatcgtatgagaaatttcgacctgactgccatcccttgtgccaatcacaaaatgcacctctacctgggcgctgctaaagttgaagtgggtacagaagtgactgactatagatttttcgttcgcgcaataattagacactctgacctcgtgacaaaagaggctagtttcgagtacttacaaaatgagggggagaggctgttgcttgaggcaatggacgaactcgaagtggccttcaataacaccaatgtacggactgactgcaatcacatcttcctaaatttcgtccctaccgtaatcatggacccctccaaaattgaggagtcagtccggtcgatggtcatgaggtatggctcacggctgtggaagctcagagtgcttcaggccgagctgaaaatcaacattagactgacaccaacaggcaaggctattcctattcggctgttcttgaccaacgagtccggctactatctagacatatccctttacaaagaggtgactgactctcggactgctcagatcatgttccaggcatacggggacaagcaggggcctctgcatgggatgttgattaacactccttatgtcaccaaggacctgcttcagtctaaaagatttcaggcccagtccctaggcacaacctatatatacgacatccctgagatgtttaggcagtcccttattaaactttgggagagtatgagcacacaggccttcttgccatccccgcctttaccaagcgacatgctcacatatactgagctggtcctggacgatcagggccagttagtgcatatgaacagactacccggaggcaacgaaattggaatggtcgcctggaagatgacattcaaatctccagagtatccagagggcagggacatcattgtgataggtaatgatatcacctaccgcattggatcctttgggcctcaagaagacttactgttcctccgcgcatctgaactggcacgcgctgaggggatcccaaggatatacgtcagtgctaattctggtgccaggatcggcctggctgaggagatcaggcacatgtttcacgtcgcttgggtggaccccgaggacccctataagggataccgatatttatacctcacaccacaggactataaaagagtttctgcactaaactctgttcactgtgagcacgtcgaggacgagggagagtctcgatataaaatcacagacattatcggaaaggaggagggaataggacccgaaaacctcaggggctccggcatgatagcaggcgagtccagtctagcttataatgaaatcatcacaatttctcttgtgacatgcagagctatcggcattggggcatacctggtgcggctgggacaaagaactatccaagtggagaactctcaccttatcctgaccggggcaggagccctgaataaggtgctgggcagggaggtatataccagcaataaccagctcgggggaatccagattatgcacaacaacggagtcacacactgtacggtgtgtgatgattttgaaggggtgttcacagtgctccattggctgtcctatatgcccaaatccgtgcactcgagcgttccgctgctgaactcgaaggacccaattgatcggattatcgaatttgtgcccactaaaactccgtatgaccccagatggatgctcgcaggcagaccccaccctacccagaaggggcagtggttatctggcttcttcgactacggttccttctccgaaatcatgcagccctgggcccagaccgtggtggtcggacgggcaaggttgggcggaatccctgttggcgtcgtggccgtggagactcggactgtcgaattgtccatcccagcagatcccgctaatctggactccgaggctaagatcatacagcaggctgggcaggtgtggtttccggattcagcctttaaaacctatcaggccatcaaagactttaatagagagggccttccactaatggtctttgccaactggcggggtttcagtggtggcatgaaggacatgtacgaccaggtcctcaaatttggggcttacattgtcgatgggctgcgggagtgctgtcagcccgtcctcgtttacatacctccacaagcggagttaagggggggtagttgggtcgtcatcgactcatcaattaatcctagacatatggaaatgtatgccgacagggaatctcggggatcagtcctggagccagaaggcacagtagaaatcaaattccggaggaaggacttggttaagacaatgcggagagtggaccctgtctatatacatttggccgaaaggctggggacacctgaactgtccaccgccgaacggaaggaattggagaataagctgaaggagcgcgaagagttcctcattcctatatatcaccaagtcgctgtgcaattcgcagatctccacgatacccccggacgaatgcaggaaaagggcgtcatctctgacattctagactggaaaacatctcgcacattcttttactggaggcttcgcaggttgctgctcgaagacttggtgaagaagaaaatccacaatgcaaatcccgagctaacagatggacagatccaagccatgctacgccgttggtttgtggaagtggaagggaccgtaaaggcatacgtgtgggacaataataaagacttagccgaatggctggaaaagcagctgaccgaagaggacggcgtccattccgtgattgaggaaaacatcaagtgtatttctagagactatgttctcaaacagatcaggtccttggtccaagctaatcctgaagtggctatggacagtatcatccacatgacacagcatatctcgccaacgcagagagctgaggtgattagaatcctctccactatggattctcctagtactta

SEQ ID NO: 27182 - DNA, 7151 bp, Artificial Sequence
  Description of Artificial Sequence: Synthetic coding sequence
atgtggtggtccaccctgatgagcattctgcgagccagatctttctggaagtggatcagcacccagaccgtaagaatcatccgcgcagttcgggcacatttcggcggaatcatggacgagccatccccactggcccagccactggagctcaaccagcattccagatttattataggatcggttagtgaagacaatagcgaggatgagatatctaatctggtaaaattggatctcttggaagagaaagaaggatctctgagcccggctagcgtcggctctgatacgctctcggacctcggcatatcaagtttacaggatggcctggccttacatatcagatcctctatgagcggcctgcacctcgtcaagcagggcagggacaggaaaaagattgattcccagagagatttcacagtggcttctcccgcagaattcgtaactagatttgggggaaacaaggtaatcgagaaggtcctgattgctaataatggcatagcagcggttaaatgtatgcgaagtataagaagatggagctacgagatgttccggaacgaacgggcaattcggttcgtggtgatggtgactcccgaagacttaaaggcaaacgccgaatatatcaagatggcagaccactacgtgccggttcctgggggacctaataacaacaactatgccaacgtcgagttgatccttgacatcgccaagaggatcccggttcaagctgtgtgggccggatggggtcatgcgtccgaaaacccaaaactgcccgaacttctgctgaaaaacgggattgcatttatgggacctccatctcaagccatgtgggccctcggagacaaaattgccagctccattgtagctcaaacggcgggtatccctacgctgccgtggagtgggtctggacttcgtgtggactggcaagagaatgacttctcaaaaagaattcttaatgtaccacaggaactgtatgaaaaaggatacgtgaaggacgttgatgatggcctacaagctgcagaggaagtgggctaccccgtcatgatcaaggcaagcgagggcggtgggggaaagggcataaggaaggttaataatgcggacgactttcccaacttatttagacaagtgcaggcagaggtgccaggctcccccatttttgtcatgcggctcgcaaagcaatcccgccacctggaggtccagatcctcgcagaccagtacggcaacgcgatctctctcttcggtagggactgctcagttcaacgaaggcaccagaaaatcatagaggaggccccagccacaatagctacacccgctgtgttcgaacacatggagcagtgcgccgtcaaactagcaaaaatggtgggatacgtttcagccggaaccgtcgagtatttatattcccaagacggcagcttctactttctggaactgaatcccagactgcaggtcgagcatccctgcacagaaatggttgccgacgtcaaccttcccgctgctcaactgcagatcgccatgggcatccctctgtaccgcataaaagacattcgaatgatgtacggggtctccccttggggagattccccgattgattttgaggacagtgctcatgttccatgcccaagggggcatgtgattgcagctaggatcacatctgagaatcccgatgaggggttcaaaccatctagcggcaccgtacaggaactgaattttcgctccaacaaaaacgtgtggggctatttctcggtagccgcagcgggtggcctccacgagttcgctgacagccaattcggacactgcttctcatggggtgagaacagggaagaggccattagcaatatggttgtggccttgaaggaactgagcatcagaggcgatttcaggaccactgtagaatacctgatcaaactgctcgaaacggaatcttttcagatgaatcgtatagacacgggctggctcgaccgcctgatcgccgaaaaggtacaggcagagaggccggacacaatgcttggcgtggtgtgtggcgcactccatgtcgcagatgtgtcattacgaaattcggtcagtaatttcctgcacagtctagaacggggacaggttctgccagctcatacgttgttaaatacggtagatgtcgagttaatctatgagggagtcaagtatgtgctcaaagtcacacggcaaagtcctaattcctatgtagtcattatgaatggcagctgcgttgaggtggacgtacataggcttagtgatggaggtctgctgctcagttatgatggaagctcctataccacttatatgaaggaagaggtggataggtatcggataaccattggcaacaaaacgtgcgttttcgagaaagaaaatgatcccagcgtcatgcggtctccaagcgctggcaaacttatccagtacatcgtcgaggacgggggacacgtcttcgcgggacagtgctatgcagagatcgaagtgatgaagatggtcatgaccctcactgccgtggagagcggttgtatacactacgtgaagcgaccgggagctgcactggaccccggatgcgtcctggcaaagatgcagctggacaacccaagcaaagtgcagcaggccgagctgcacactggatcattaccaaggatccaaagcacagcactgagaggcgaaaaactgcatagagtattccactatgtcctagacaacctggtgaacgtcatgaatgggtattgtttgccagacccattcttcagctccaaggtgaaggattgggttgagcggctaatgaaaacactcagggatccgagtctgcccctcttagaattgcaggacatcatgacaagtgtgtccgggagaattccgccaaatgtcgagaagtctataaagaaggagatggcacagtatgcaagcaacattactagtgtgctgtgccaatttccttcacagcagatcgcgaatatactcgattctcatgcggcaaccctgaacagaaagtccgaacgagaggtgttttttatgaacacccagtctatcgtgcagctggtgcagagatatcggtctggcatccgtggacacatgaaagccgtcgttatggacttacttcgccagtacctgagagtggagacacaatttcagaacggtcattacgataaatgtgtgttcgctcttagggaggagaacaagtccgatatgaacacagtcctgaattatatattttcacacgcacaggtgactaagaagaatctgctggttacaatgctcatcgaccaattgtgcggcagggatccaacccttaccgatgagctgctcaacatcctaactgagctgacccagttgtcaaagaccactaatgccaaagtggctctcagggctaggcaggtgctgattgcgtcccatctgccaagctacgaactgagacacaaccaggtggagtctatttttctttccgcgatagacatgtatggccatcagttctgcattgagaacttgcagaagttgatcctgtctgaaacaagtattttcgatgtgcttccaaatttcttttaccactccaaccaggtcgttagaatggcagccctggaggtctatgtgagacgggcatatattgcttacgagctgaattcagtccagcatagacagttgaaggacaatacctgtgtagtagaatttcagttcatgctgcctacttctcaccccaatcgcggaaacattccaacgctgaaccggatgtctttttcctcaaatttaaaccattatgggatgacccacgtggcctccgtctccgacgtgctgctcgataatagctttacccctccctgtcagaggatgggcggtatggtgtccttccggacatttgaggactttgtccggatcttcgacgaagtgatggggtgcttttctgattcaccaccccaatctcccacctttcctgaagctgggcacacctcattatatgacgaagacaaggtccctagagacgagcctatccacatcctcaatgtcgccattaagacagattgtgatatcgaagatgaccggttggcagccatgtttcgggagttcacacagcaaaataaggccactcttgttgaccacggcattcggagactcacctttttggtggctcagaaagattttagaaaacaagtgaactacgaagttgatcggaggtttcaccgcgaatttccaaagttttttaccttcagggctagagataagttcgaagaagatcgcatataccgccacctggaaccggcactggcttttcagttggaacttaacaggatgcggaattttgatctgaccgcaatcccatgtgccaatcacaagatgcatttgtatttaggggctgcgaaggttgaggtgggaaccgaggtgactgattaccgcttctttgtgcgagctatcatccggcattctgacctggttaccaaggaagcatcctttgaatatctgcaaaatgaaggcgagcggctcctgctcgaggccatggatgaactggaggtggcttttaacaatacaaatgtccggaccgactgcaatcacatcttcctgaactttgtcccaacagttatcatggacccttccaagatcgaagagtccgtgcggtccatggtgatgcgttacgggtcacgactttggaagcttcgagtactgcaggcagaactgaaaatcaatatacgtctgaccccgacggggaaagcaatccctatacggctgttcttgacgaatgagagcggatactacctggacatcagtctctacaaggaggtgaccgacagccgcactgctcagattatgttccaggcttatggcgataagcagggccctctgcacggtatgctcatcaacacaccatatgtcactaaagaccttctgcagtccaagaggtttcaggcccagagcctgggcactacctatatctatgacattcccgaaatgttccggcagtcattgatcaagttgtgggagtctatgtccacacaggcctttttaccaagccctcctttgccaagtgatatgcttacatataccgagctggtccttgatgatcagggccagctagtgcacatgaacagactcccagggggaaacgagatcgggatggtggcgtggaagatgactttcaagtccccagagtacccagagggacgcgacattattgtcatcggcaacgacatcacttatcgaatcggcagtttcggaccacaggaagacctgttatttctccgtgcttctgagctcgcacgtgctgaaggaatccctcgcatatatgtgagcgctaatagtggagccagaatcgggttggccgaggaaattcgacacatgttccatgtcgcctgggtggatcctgaggatccgtacaagggctaccggtacctctacttgaccccccaggattacaaacgcgtgagcgccttaaattccgtccactgtgaacatgtggaggatgagggtgaaagtagatacaagattacagatataatcggaaaggaagagggtataggcccagaaaacctccgcggtagcggaatgattgctggggagagcagcctggcctataatgagatcatcacaatctcactagtaacctgccgtgccataggcataggagcctacctcgtccgtctgggacagcgcaccatccaggtggagaattcacacctgatcctcacaggggcaggggcacttaataaggtgctgggccgagaagtgtatacctcaaacaaccagctcggaggcatacagatcatgcataacaacggagtgacccactgcacggtttgcgacgattttgaaggggttttcacagtcctccactggctctcatacatgcctaaaagcgtccactcctcggttcccctgttaaactccaaggatcccatcgaccgaatcatcgaatttgtgcccaccaagacaccgtatgaccctaggtggatgttggcagggagaccgcaccccacacagaagggacagtggctcagcggattttttgattacgggagtttcagcgagatcatgcaaccatgggcgcagactgtcgttgtgggccgagcaagactgggcggtataccagttggagtggtggccgttgagacccggaccgtggaactgtccattccagccgacccagcgaatctggattctgaggctaagattatccagcaagcagggcaagtgtggtttcccgatagcgcgttcaagacctaccaggctataaaagactttaaccgggaaggccttccacttatggtttttgcaaactggaggggattctcagggggaatgaaagatatgtacgatcaggtccttaagtttggagcttatatcgtagatggtttgcgggagtgctgccaacccgtgttagtgtatatcccaccacaggccgagcttcggggagggagttgggtggtcatcgactcttctatcaaccctcgtcacatggaaatgtatgcggacagggagagtcggggttctgtgctcgaacctgaggggacggtagagattaaattcagaaggaaggaccttgtgaaaactatgagaagggttgatccggtgtacattcacctcgcagaacgactggggactcccgagctctccacagcagagagaaaagagctagagaacaaactgaaggaacgcgaagaatttctgattccaatctaccaccaggttgctgtccagtttgccgatctacatgacacacccggacgtatgcaagaaaaaggcgtgataagcgatattctggattggaagacctcccggacattcttttattggcggttacggcgactgctgctggaggacctggtgaagaaaaagattcataacgccaaccccgagctcacagatggacagattcaggctatgctcagacggtggttcgtggaagtagaggggaccgtcaaagcgtacgtctgggacaacaacaaagatctggcagagtggcttgagaagcaacttacggaggaagacggtgtccactctgtaattgaagaaaatatcaagtgtatttcccgggattatgtgctgaaacaaattcggagtctggtacaggcaaatcctgaagttgctatggattccataatccacatgacacaacacatcagccctacccagcgggcagaggttatacgcatactatcgacgatggactccccaagtactta

SEQ ID NO: 27183 - DNA, 6866 bp, Artificial Sequence
  Description of Artificial Sequence: Synthetic coding sequence
atggaggggtccccagaggagaacaaggagatgagatattatatgcttcagaggagctctatgtctggcctgcatctggtaaagcaggggcgagatcggaagaagattgactctcagagagatttcaccgtggccagcccagcagaattcgtgaccaggtttggcggtaacaaggtgattgagaaagtgctgattgcgaataatggtatcgcagcggtcaagtgcatgcgatctattagacgctggtcttatgagatgttccggaatgagcgcgctatacgattcgtggttatggtgacacctgaggatctgaaagcgaacgccgagtatattaagatggcagatcactacgtccctgttcctggaggtcccaataataacaactatgccaacgtagaattgatcctcgacatcgccaagagaattcccgtgcaagccgtttgggctggatggggtcacgcgtccgaaaatcctaaattgccagaactgcttctgaagaacggcattgccttcatgggaccaccatcccaggcaatgtgggctctgggagacaaaatcgccagcagtattgtggcccagaccgcgggaattcccaccctaccctggagcggatccggcttgagagtggattggcaggagaacgattttagcaaaagaatcctgaatgtgccgcaggaactttatgagaagggctacgtgaaggacgtcgatgacggtctgcaagcggctgaggaagtcggctatccagttatgattaaggcgtctgaaggtgggggagggaaggggatacgcaaggtcaacaacgcagacgactttcctaatttatttcggcaagtacaggctgaggtccccggaagccccatcttcgttatgcggttggctaagcagagccgtcacctcgaggtgcagatccttgcagatcaatatggcaacgctatcagcctgtttggaagggattgttccgtccaacgacgacatcaaaagattatcgaggaagctcctgcgaccattgcaaccccggcagtgttcgaacacatggaacagtgtgctgttaagctcgctaagatggtaggctacgtttcagctgggaccgtggaatatctgtactcacaggacgggagtttctatttccttgaacttaaccctcggctgcaggtggaacatccctgtactgagatggtggctgatgtcaatctgccggctgctcagctgcagatcgccatgggaattccactgtatcggataaaggatatccggatgatgtatggagtttcaccctggggggacagcccaatagatttcgaggactccgcccacgtcccctgtccgaggggccatgtcatcgccgctagaattactagcgagaacccagacgagggctttaaaccctcttcagggaccgtgcaggaactaaattttcgctctaacaaaaatgtctggggctatttttccgtggccgctgctggcggtcttcatgagtttgcagacagtcagtttggtcattgcttctcgtggggggagaacagagaagaggcaatttcaaacatggtggtggcgcttaaagaactcagcatcaggggtgactttcgaactaccgtcgaatacctaatcaagttgcttgaaacagagagtttccagatgaataggatcgacacgggatggctcgaccgcttgattgccgaaaaagtgcaggctgaacgacccgacacaatgctgggcgtggtgtgtggagccttacatgtcgcggacgtgtctttgagaaacagtgtgagcaactttttacacagcttggaaagggggcaggtcctgccagcccataccctgctgaacaccgtcgacgtggagctgatttatgagggcgtaaagtatgtcttaaaggtgacacggcagagccctaactcctatgtagtgatcatgaatggaagttgcgtggaggtcgatgtacatcgattgagcgacggcggactcctgctgtcctatgatggttcttcctacaccacatatatgaaggaagaagtcgaccgatatcggattactattggaaacaagacatgcgtgtttgagaaagaaaatgacccctccgtaatgagaagcccaagcgccggaaaattgattcagtatatagtcgaggacggcggacatgtgtttgcagggcagtgctatgcagagattgaggtaatgaaaatggtcatgactctcaccgcagtcgaatccggctgtattcactacgtgaaaaggccaggagctgctttagaccctggctgtgtactcgccaagatgcagctggataacccctctaaggtccaacaagctgaattgcacactggttccttgcctagaatacagagcaccgcgctacgaggggagaaactgcacagggtctttcactatgtcttggataatctagtgaacgtgatgaatggctattgtctgccagatccttttttctcctctaaagtaaaagattgggtggagagacttatgaagacactccgagatcctagcttacccttgctggagctgcaagatatcatgacttcagtgtctgggaggatacccccaaatgtggaaaaatctattaaaaaagagatggcacagtatgcatctaatattacatccgtactctgtcagttccccagtcagcagattgcaaatattctcgactcacacgccgcaaccttgaatcggaagtcagaacgcgaggtgttcttcatgaacacacaatccatcgtgcagcttgtgcagagatacagaagcgggattcgcggacacatgaaggccgtggttatggacctgctccggcagtaccttcgggtggaaacgcagttccaaaacggtcactatgataagtgtgtatttgcacttagagaggaaaataaatccgatatgaataccgtgctgaattatatcttctcccacgctcaggtcacaaagaaaaacctgcttgttaccatgctgatcgaccaattatgtggccgagatcctaccctcactgatgagctcctgaacatcctcacagagctgacacagttgagtaaaacaacgaacgcaaaagtagcattgcgagccaggcaggtcctaattgcatcgcatttgcccagctatgaactgcgccataatcaggtcgaaagtattttcctcagcgccatagacatgtacggacatcagttctgcatcgagaatctccagaaactgattttgtcagagacctctatctttgacgttctgccaaacttcttttaccactccaaccaggtagtgaggatggccgctcttgaggtgtacgtccgaagggcatatattgcatacgagttgaacagtgtgcaacaccggcagctcaaagataatacatgcgtcgtcgaatttcagttcatgctcccgactagccatccaaacagaggcaacatcccgactctcaatcgaatgagtttttcaagcaaccttaatcactacggaatgacacatgtggcaagcgtctccgacgtcttgctggacaattctttcaccccaccttgtcaacgaatgggcggaatggtgtctttccgcactttcgaagacttcgttcgcatctttgacgaggtcatggggtgtttctcagatagccccccacaaagcccgacgtttccggaagccggacatacctcactatacgacgaggacaaagtgcctagggacgaaccaattcacatcttgaacgtggctatcaaaaccgactgtgatatcgaggacgatcgtctcgcagccatgtttcgcgaatttacacaacagaataaggcgaccctcgtcgaccacgggatccggaggctgacctttctggtggcacagaaagatttcaggaagcaagtcaactatgaagtggaccgtaggtttcaccgggaatttccgaaattttttacatttcgagcaagggacaagtttgaagaagacaggatttaccgccaccttgaaccagctctcgcttttcaactggagctcaatagaatgcgcaattttgacctcacagctatcccctgtgctaatcacaagatgcacctttatctgggagccgctaaagtggaggtggggacagaagtcaccgattaccggttctttgtgcgggctatcattaggcactctgacctggtgaccaaggaagcctcttttgaatatctgcagaacgaaggagagaggctgctgctcgaggcaatggatgaactggaggtagctttcaataacaccaatgttcgcactgactgtaaccacatttttttgaacttcgtgcccactgtaatcatggaccctagcaaaattgaagaatctgtacgctcgatggtaatgcgctacgggagcaggctttggaagctgcgagtcctgcaggccgagttaaagattaatattcgcctcacaccaacaggtaaagcgatacctatccgactgtttctcacaaatgagtcaggatactacttggacatctccctttataaagaagtcactgacagccggaccgcccagataatgtttcaagcatacggcgacaagcaaggacctctccatggtatgcttatcaacaccccctacgtcactaaggatcttctgcagtctaagcgttttcaagctcagtctctagggacaacctacatttacgatatacctgaaatgtttaggcagagcctcatcaagctttgggaaagtatgtctactcaagccttcctgccctcccccccactgccttccgacatgcttacttacacagagctggtgctggatgaccaagggcagttggtgcacatgaaccgcttaccagggggtaatgaaatcggaatggtagcatggaagatgacattcaagagccctgaatacccggaggggagagacattatcgtcatcggcaacgacataacttatcggatagggtcttttggtccccaggaggacctgttattcctgcgcgcttctgaattggctcgtgcagaaggcattcccaggatttatgtgtccgccaattccggtgccaggatcggcttagcagaggagattcgccatatgttccatgtggcttgggtggaccccgaggatccctacaagggatatcgctatctgtacttaacacctcaggattataaacgggtgtcagcccttaactcggtacactgcgaacacgtcgaagacgagggtgagagccggtacaagattaccgacattatcggcaaggaagagggaatagggccagaaaacctccggggatccgggatgattgccggagagagttccctggcgtacaacgagataatcaccatcagtttggtgacatgtcgggcaattgggataggtgcgtacttagtgaggttaggccagagaactatccaggttgagaactctcacctaatcttgactggagctggcgctctgaataaagtgctgggtagggaggtttacacatccaacaatcaacttggaggtattcagatcatgcacaataacggagtgactcactgcacagtttgtgatgactttgaaggcgtttttactgtgcttcactggctgtcctacatgcccaaatccgtgcactcatctgtccctctacttaactccaaggatcctatcgaccgcattatagagtttgttccaactaaaaccccctacgaccctaggtggatgctggctggacggcctcaccctactcaaaaggggcagtggctgtcaggctttttcgattacgggagtttcagtgaaattatgcagccttgggcccagaccgtcgtcgtgggcagagcgaggttggggggtataccagtcggcgtggtggccgtggagacaaggactgtggagctctccatacccgcagatccagccaacctagactccgaagctaagattatccaacaagctggacaggtctggtttcctgactcggctttcaagacatatcaggcgattaaagattttaaccgagaagggctccccctgatggtctttgccaactggagggggttctcaggcggaatgaaggacatgtacgatcaagtgttgaaattcggggcttacattgtggacggcctgagggagtgctgtcagcccgtgttggtttatattccacctcaggccgaactccggggagggagctgggtggtcattgattcatctatcaaccccagacacatggagatgtacgcagatagagagagccgcggatcagtgctagaaccagaggggactgtcgagatcaagttcaggagaaaagacctggtcaaaactatgagacgcgttgaccccgtttatatccacttggccgaaagactggggacccccgaactgagcacggctgaacgtaaggagctggagaataagctgaaggagcgcgaggagtttctcattccaatctatcaccaggtcgccgtccagttcgcagatctgcacgacactcctggacgcatgcaggaaaagggggttattagtgatatcttggattggaaaacgagcagaaccttcttttattggcggctgcggcgactgctgttggaggacctcgtcaagaaaaagattcacaatgctaaccctgagctaaccgatgggcagattcaggccatgctgcgtcgctggttcgttgaggtagagggaactgtcaaggcttatgtctgggacaacaacaaggacctggcagaatggttggagaagcaactcacagaggaggatggagttcactcagtaatagaggaaaacatcaaatgtatctcaagagattacgtgttgaagcagatcaggtctttagtgcaggctaaccctgaggtcgccatggatagtatcatccatatgacacagcacatcagtcccacacagagagcagaggtcatcaggatactgtctacgatggattccccttccaccta

SEQ ID NO: 27184 - DNA, 1419 bp, Artificial Sequence
  Description of Artificial Sequence: Synthetic coding sequence
atgcacaataacggtgtgactcactgtaccgtgtgtgatgatttcgagggggtgttcaccgtcctccactggctgtcttatatgcccaaatcggtgcactccagcgtgcctctcctgaatagcaaggaccctattgatcgtataatcgagttcgtgcccacaaaaaccccatatgaccccaggtggatgttagctggtcgcccacaccccacccagaaaggtcagtggctcagcgggtttttcgattacggatcctttagtgaaataatgcagccctgggctcaaacagtggttgtaggacgggcaaggttaggcggaattccggtgggtgtcgttgcagtcgaaacaagaacagttgaactgagcattccagccgatccagcgaatctggatagcgaggccaagatcattcagcaggccggtcaggtctggtttcccgatagtgcttttaaaacatatcaggccataaaggacttcaatagagaaggtctcccactgatggttttcgcaaattggcggggatttagcgggggaatgaaggacatgtatgatcaggtgctcaagttcggcgcttacatcgtggacggtctcagagagtgttgtcagcctgtgttggtttacataccacctcaggccgaactgaggggcggtagctgggttgtgattgattcttcaatcaatcccaggcacatggaaatgtacgccgatcgcgagtcccgaggatctgtgctggagccagagggtaccgttgaaattaaatttcgtcgtaaggacttagtcaaaaccatgcggagagtggacccagtgtatatccatttagcagagcgcctgggaacacctgagctcagtaccgctgagcgaaaggaactggagaacaaactcaaagaacgagaggaatttctcattccaatctatcaccaagtggcagtccagtttgcggatctgcatgacactcccggtcggatgcaagaaaaaggcgtgatctctgacatccttgactggaagacaagccggacttttttttactggcggctccgcaggctgttgttagaagacctggttaaaaagaagatccataacgcgaatcctgagctgactgatgggcagatccaagccatgctccggcgatggtttgttgaagtggaaggaacagtcaaagcctacgtgtgggataataacaaagacctagctgagtggctggaaaaacaactgaccgaggaggatggggtgcattctgtgatcgaggaaaatattaagtgcatctccagggattatgttttaaagcaaatcaggtcgctggtgcaagcgaaccctgaagtggcaatggattccattatacacatgacacaacacattagcccaactcagagagctgaggtgattcggatcttaagcactatggattccccatccacctag

SEQ ID NO: 27185 - DNA, 129 bp, Artificial Sequence
  Description of Artificial Sequence: Synthetic coding sequence
atgtccggtctgcacctcgtgaagcagggtagagaccggaagaagatagacagtcagcgcgacttcacagtggcttcccctgccgagttcgtgactagatttggcggaaataaggttattgaaaaatag

SEQ ID NO: 27186 - DNA, 7040 bp, Artificial Sequence
  Description of Artificial Sequence: Synthetic coding sequence
atggatgaaccctccccacttgcccaaccgcttgaactcaaccagcacagtcgatttattataggaagcgtcagtgaggacaactcagaggacgagatcagcaacctggtcaagctggatttattagaggaaaaggaggggtcactttcgcctgcaagcgtgggtagcgatacattgtctgacctggggattagctctctccaggatgggcttgccctacatatccggagctccatgagtggcctccatctcgtgaaacagggcagagataggaagaagattgacagtcagcgagactttaccgtggcgtcacccgctgagttcgtgacccgatttgggggtaataaagttatcgagaaggtgctgattgcaaataatggcattgccgctgtcaagtgtatgcgctcaatccgtcgctggtcttacgaaatgttccggaatgaacgagcgatacgttttgtggttatggtgactcccgaggacctgaaagccaacgcagagtacattaagatggctgaccactacgtcccagtgccaggcggtcctaacaacaataattatgccaatgtggagctcattctggatattgctaagagaatcccggttcaggcggtatgggccggatgggggcacgctagcgagaatccgaaactccctgagctgttactaaaaaacggcatcgcctttatgggcccaccaagccaagctatgtgggccctgggagataagatcgccagctctatcgtcgcccagaccgccggaatccctaccctgccttggtctggaagcggcctgagggttgattggcaagagaacgacttttcaaagcggatactcaatgtaccacaggagctatacgaaaagggatacgtaaaggacgtcgacgacggactccaagccgctgaggaagtcggataccctgtgatgattaaagccagcgaaggaggcggtggcaaggggataaggaaggtgaataatgccgatgactttccaaatctctttaggcaggtgcaggctgaggttcctgggtccccaatctttgttatgagattagccaagcaatcgcggcaccttgaagtacaaatcctcgctgaccaatatggaaatgccataagcctgtttggaagagattgttctgtccaacggaggcatcagaagattatcgaggaggctcccgctacaatcgcgactccagcagtgttcgaacacatggagcagtgtgccgtgaagctagccaagatggtgggatatgtatcggccggtaccgtggagtatttgtattctcaggacggaagtttttactttctggagctgaatcctaggttgcaagtagagcatccatgcaccgagatggtggctgatgtgaacttgcccgcagcgcagttgcagatcgctatgggtatccccctttacagaatcaaagatattagaatgatgtatggtgttagtccgtggggagactcacctatcgattttgaagatagcgctcacgttccctgtcccaggggacacgttatcgccgcacgcattacctccgaaaatcctgacgaagggttcaagccttcttccggcaccgttcaggaactgaatttcagatctaacaagaatgtgtggggatacttcagcgttgcggcagccggtggcctacacgagtttgctgatagccagttcggccactgctttagttggggggagaatagggaggaggccatttcgaatatggtcgtggcactgaaggaactgagtatcagaggcgattttcggaccaccgtggaatacttgatcaaactgctcgagaccgagagtttccaaatgaatcgcatcgatacaggatggctagaccgtcttattgccgagaaagttcaagccgaacggcctgataccatgctgggagttgtgtgcggcgctctgcatgttgccgacgtaagtctgcgcaacagtgtctccaacttcctgcacagcctggagaggggacaggtactgcctgcacatacactgcttaataccgttgatgtcgagttgatctatgagggtgttaaatatgtcttgaaagtgactcggcaaagcccaaatagctatgttgtgataatgaacggctcatgcgtggaagtggacgttcacaggctttctgatggaggtttgctgctcagttacgacggctcctcatacacaacatacatgaaagaagaagtggatcgttataggatcacgatcggaaacaagacatgcgtctttgagaaagaaaatgatccaagcgtcatgagaagccccagtgccggaaagctcatccaatatattgtggaagatggagggcacgtgtttgcagggcagtgctatgcagagatagaggtcatgaaaatggtgatgaccctcaccgccgtagagtccggctgcattcactacgtgaaacgaccaggcgctgctctcgatccagggtgcgtgttagctaagatgcagcttgacaacccgagcaaggtgcagcaggccgagctgcacacggggtccctgcctaggatacaatctacagccctgcgtggcgagaaactccacagagtgtttcactatgtgttggataacctggtgaacgtgatgaacgggtactgtcttcccgatccattcttctcttctaaggtgaaagactgggtagagcggctcatgaagactctccgcgatccaagccttccactgcttgaactgcaggacatcatgacttccgtctccggccgaattcctcctaatgtggaaaagtctatcaagaaagagatggcacagtatgcaagtaatattacctctgtcctctgtcagttcccgtcccagcagattgcaaacatcctcgacagtcatgccgcaactctgaatcggaaaagcgaaagagaggttttttttatgaacacacagagtatagtccagctggtacagcgttaccgatctggaattcgtggacacatgaaagctgtggtgatggacttgctcagacagtatctgcgcgtcgagacccagttccagaatggccactacgacaaatgcgtcttcgccctgcgcgaggaaaacaagtcagacatgaacacagtattgaactacatcttctctcacgcacaggtcactaagaagaatctcctagtgacaatgttgatcgatcagctgtgtggaagagaccccaccctcactgacgagctcctgaatattctgaccgagctgacccagctctcaaagaccaccaacgctaaggtcgcccttcgcgcaagacaggtcttgatcgcttctcatctaccttcgtatgagctgagacataaccaggtggaatctatattcctgagtgcgatcgatatgtatggtcatcagttttgtatcgagaaccttcaaaaactgattctgagcgagacttcaatcttcgatgtgctgcctaacttcttttaccattccaaccaggtggtccggatggctgcactcgaggtgtacgtccgacgcgcttacattgcctacgaactcaacagcgttcagcaccgtcaacttaaggataatacttgcgttgttgaatttcagttcatgctgccaaccagtcaccctaatcgcggaaatataccaaccctgaatcgcatgagtttctcctcgaatttaaatcattatggtatgacacatgtggcctccgtttccgacgtccttcttgataactcctttaccccgccttgccagcgtatgggtggcatggtgtcctttagaaccttcgaagactttgtcaggatcttcgacgaagtcatgggctgtttttccgattcacccccacaaagtcctacttttcccgaagccggtcacacgtcattgtatgatgaggataaggtgccccgagatgaacccatccacatcctgaacgttgccatcaagaccgattgcgacatcgaggacgatcgactggctgcaatgtttcgcgagttcactcaacagaacaaggcaacactcgtcgaccatgggatcaggaggctgacctttcttgtggctcagaaagatttcagaaaacaggttaattatgaggtggaccgaagattccacagagagttccccaagttttttaccttccgcgctcgggataagtttgaagaggatcgaatatacagacacctggaacccgcacttgcctttcaattggagctgaatcgaatgagaaatttcgatcttacagccatcccgtgcgccaaccataagatgcacctctacctgggtgctgcaaaggtagaggtgggtacagaagtgacagattatcgctttttcgtgagagctatcataaggcactcagacctggtgactaaagaagcttccttcgagtatctgcagaatgagggagagcgattactgctggaggctatggatgagctggaggtcgccttcaacaacaccaatgtcagaaccgattgcaatcatatttttcttaattttgtaccaactgttatcatggacccttccaaaatagaagagtctgtgagatccatggtaatgagatacgggtccaggctgtggaaattgcgtgtgttgcaagctgagctcaaaatcaatattcggctgacaccaactggcaaggcgatccctatcagactttttttgaccaacgaatcagggtactacctcgacatctcattgtacaaggaggtaacagactctcgtactgcacagataatgttccaggcttacggtgataagcaaggaccactccacggcatgctgataaataccccctacgtgaccaaagacctgcttcagtcaaaacggttccaagcccagagtctaggaactacctacatctacgatattcctgaaatgtttagacagtctttgattaaactctgggaatctatgagcactcaggcgtttcttccctcccctccactgccctcagacatgttgacttacactgaactggtgctggatgatcagggtcagcttgtgcacatgaatcggcttcccggtggcaacgagatcggtatggtagcatggaagatgaccttcaagtctcccgaatacccggaaggaagggatatcatagtaatcggtaatgatatcacgtatagaatcggctcctttgggccacaagaggatctactgttcttgcgtgcttccgagctggcgagagcagaagggattccgaggatttatgtcagtgccaacagtggtgcccgaatcggcctcgccgaggagatcagacacatgttccacgtcgcatgggtggatcccgaagatccttataaaggttataggtatttgtatttgaccccccaagactacaagcgagtgagtgcacttaactccgtccattgcgagcacgttgaggatgaaggcgagtcccgatataagatcactgatatcattggaaaagaggagggcattggcccagagaacctacgaggttctggcatgattgccggagagagcagccttgcatataacgaaattataaccataagtctggttacttgcagagcaatcggaattggtgcctatctggttcgcctggggcagcgaactatacaggtcgaaaactctcatctcatcctaaccggcgctggtgccctgaacaaagttttggggagagaggtctacacaagcaacaaccaattggggggtattcagattatgcacaacaacggcgttactcattgcacggtctgtgacgacttcgaaggggtctttactgttctgcactggctaagttatatgcccaagagcgtccatagttctgtgccgctgctcaattcaaaggaccccatcgataggattatagaatttgtccccacaaagacgccctacgacccgagatggatgcttgccggtcgaccccaccctacgcaaaagggccaatggttgagcggcttcttcgattacggcagtttttctgaaataatgcagccttgggctcagacagtggtggtaggccgagcccgtctgggcggaatacccgtgggcgtcgtggcagtggaaaccaggaccgtcgaactctccatcccagcggatccagctaacctggactcggaggcgaagattattcagcaggcgggacaggtgtggttccccgatagcgcgttcaagacctaccaggccatcaaagattttaaccgcgagggtttgcccctgatggtgtttgcgaactggcggggattttcgggcggaatgaaggatatgtacgaccaggtcctcaagtttggagcttacattgttgacggactgagagagtgttgccagccagtgcttgtgtacatcccgcctcaagccgaactgcgcggagggtcttgggtggtgattgatagctctatcaatcccaggcacatggagatgtatgcagatagggaatccagagggtccgtgttggagcctgaagggactgtagaaataaaattccggagaaaggacttagttaagacgatgcgcagggtggaccctgtctatatacaccttgccgagcggctcggaacacctgagcttagtacagcagaaagaaaggagttggaaaacaaacttaaagaacgggaggagttccttatccctatataccaccaggtggccgtgcagtttgctgacttgcatgacacacccggtcgcatgcaggaaaagggggtgatatccgacattctcgattggaagacatcacgaaccttcttctattggcggctacgccgtctacttctggaggatctcgtgaaaaagaaaattcataatgcaaatcctgaactgaccgacggacagattcaggctatgctgcggaggtggtttgtcgaggtggaaggcacagtcaaggcctatgtctgggataacaacaaggatctggccgagtggttagaaaagcaattaacagaggaagatggcgtgcattccgtaatcgaagaaaatataaaatgcatatcccgggattacgtgctgaagcaaatcaggagcctggtgcaggccaacccagaggttgccatggactctatcatccacatgacccagcacatttcacccacccaaagggccgaagtgatccggatactgtctacaatggacagcccaagcacata

SEQ ID NO: 27187 - DNA, 129 bp, Artificial Sequence
  Description of Artificial Sequence: Synthetic coding sequence
atgagtgggctccatctagtcaagcagggcagagacagaaagaagatcgacagccagcgagactttacagtggcttcacctgcagaatttgttacccggttcgggggtaacaaggtcatagaaaaatag

SEQ ID NO: 27188 - DNA, 234 bp, Artificial Sequence
  Description of Artificial Sequence: Synthetic coding sequence
atggatgagcctagtcctctggctcagccacttgagctgaaccaacactctagatttattattgggagtgtgtctgaggacaacagcgaggatgagatctccaatctggttaaactcgacctgctggaagagaaagagggaagcctgtccccagcgtctgtgggctccgatactttgtcggacctcggtatcagcagtcttcaggatgggctggcactgcacatcagactctag

SEQ ID NO: 27189 - DNA, 3138 bp, Artificial Sequence
  Description of Artificial Sequence: Synthetic coding sequence
atgggctgttttagcgacagtccaccacagtctcccacattccccgaggcgggacacacgagtctgtatgacgaggacaaagtccccagggacgaaccaatccatattttaaatgtagctattaagaccgattgtgatattgaagatgatcgactggccgcaatgttccgcgaattcacccaacagaacaaggcaaccctcgttgatcatggaatccggagactgacctttcttgttgctcagaaggatttcagaaaacaagtcaactacgaggtcgatcggagattccatagggagttcccgaaattctttactttccgggctcgcgacaagtttgaagaggacaggatctatcggcatctggagcctgcccttgctttccagctggagctgaacaggatgaggaattttgatctgaccgccataccatgtgcaaaccataaaatgcacctatatctcggtgcggcaaaagtcgaagttggaactgaggtgacagattatagattttttgttcgggcaattatcagacattcagatctggtgactaaagaggcgagctttgaatatttgcagaatgagggggagcgattacttcttgaggcaatggatgagctggaggtggctttcaataatactaatgttcggactgactgcaatcacatctttctcaactttgtgcccacggtgatcatggatccatcaaaaatcgaggagtctgtaagatctatggtgatgcggtatggatcacgtttgtggaaattgcgtgtcctccaggctgagctgaagatcaatattcggctcacccctaccgggaaggctataccaatacggcttttcttgacgaacgagtccggctactatctcgacatcagtctatacaaagaagttacagacagccgcacagctcagattatgtttcaggcttacggagataagcaaggacccttgcacggcatgctcattaatactccttacgttactaaggatcttctacagtccaagcgttttcaggcccagagccttggcactacttatatttacgacatacctgagatgtttaggcagattggaatggtggcctggaagatgaccttcaagtccccagagtacccggaaggaagagatataatagtcataggtaacgatataacatacagaatagggtcatttggccctcaggaggacctcctctttctgcgggctagtgaattggctagagccgaagggatacctcgcatctacgtcagcgcaaatagtggcgcaaggatcggccttgccgaggaaataaggcatatgttccatgtagcttgggtcgatcccgaagacccatataaaggatataggtatctatacctgactccccaagactacaagcgggtctccgctctgaatagtgtccattgcgagcacgtggaggatgaaggcgaaagtaggtacaagattacagatatcattggtaaagaagagggaatcggccctgagaaccttcgtggcagtggaatgattgccggagagtcatcattggcatacaatgagatcattactatttcattagtaacctgtcgcgcaatcggcatcggagcctatctggtgagattggggcagcgaacaatacaggtcgaaaactcgcatctgattctgactggggcaggcgctctaaacaaagttctgggcagagaggtgtacacttcaaacaaccaactaggaggaatacagataatgcacaataacggtgtcacccattgcaccgtctgcgacgatttcgaaggcgttttcaccgtgcttcattggctgagttacatgcccaagtctgtgcattctagcgtgccccttctgaattcaaaagaccccattgaccggattattgagtttgtcccaaccaagaccccgtacgatccaaggtggatgttggctggcagaccgcaccccacccagaaggggcagtggctcagcggattttttgactatgggagcttcagtgaaatcatgcagccatgggctcagactgtggtagttggacgcgctaggttggggggtatccccgttggggtggtggccgtggaaacgaggactgtggagctgtccattcctgcagaccctgccaacctcgattcagaagctaaaatcattcaacaggcaggtcaagtgtggtttcctgactcagcttttaaaacctatcaggcaattaaggatttcaatagggagggacttccgctgatggtgtttgcaaattggcgcggttttagtggcggaatgaaggacatgtacgaccaggtgttaaagtttggggcatacattgtggatggcctcagggagtgttgccagcccgtgttggtctacatccccccacaagccgagctgagaggtggctcatgggtcgtcattgacagtagtatcaatccacgccatatggagatgtatgccgatcgtgagtctcggggatccgtcctagagcccgaggggacagtagaaatcaaatttcgcagaaaagacctggtcaagacaatgcgcagagtcgaccccgtctacatccatctggctgaaagactcgggacccccgagcttagcacggctgagagaaaagaactggagaacaagctgaaggagagagaggagttcctgattcctatataccaccaggtagccgtgcagtttgctgacctgcatgatacacccggaagaatgcaggaaaaaggagtcataagcgacatactagattggaagacttccagaacctttttctactggagactccggagactgttgctggaagatctcgtgaaaaagaagattcacaatgctaatcccgagttgacagacggtcaaatccaggcgatgctgagacgatggttcgtcgaagttgaaggcacagtcaaagcttatgtctgggacaacaacaaagacctggccgaatggctggagaaacagcttacagaagaggacggggtgcattctgtgatcgaagagaacataaagtgcatatcgcgcgactacgtactgaaacagatcaggtcactggtccaggccaaccccgaggtcgcgatggatagcataattcacatgacacaacacatttcccctacccagcgtgctgaagtcatccgcattctctcaacaatggactcccctagtacctag

SEQ ID NO: 27190 - DNA, 363 bp, Artificial Sequence
  Description of Artificial Sequence: Synthetic coding sequence
atggatgagcccagccctctcgctcagcccttggagttaaaccagcattccagatttatcattggatccgtgtctgaggacaattctgaggatgagatttccaacctggttaagctggatctactcgaagaaaaggaagggagcctgagccccgctagcgtcggaagcgacaccctgagcgatctcggaatcagttctttacaggacggcctggcacttcacatcaggtccagcatgtccggattacacctggtgaagcaggggcgagatagaaagaagatagacagccagcgagattttacagtcgcatctcctgcagaatttgttactagattcggaggtaacaaagtgattgagaaatag

SEQ ID NO: 27191 - DNA, 7112 bp, Artificial Sequence
  Description of Artificial Sequence: Synthetic coding sequence
tccttttggaaatggatctccacccagacagtgcgtattattagggctgtcagggcccacttcggtggcatcatggatgagccctcacccctggcccaacccctggagctcaaccaacacagcaggttcataatcgggtcagtgagtgaggacaattctgaagacgagatctcaaatctggttaagctggacctcttagaagagaaggagggcagtcttagccctgccagtgtaggctctgataccctcagcgacttgggaatcagcagtctgcaggacggcctggcccttcacatcaggtccagcatgagcgggctacacctggtgaaacaagggagggaccgcaagaaaattgacagccaacgagattttacggtggcgagtcccgctgagtttgtgactcggtttggcggaaataaggtgatagagaaagtcctgatcgctaacaacgggatcgctgcagtgaagtgtatgcgcagcataagacgctggtcgtacgagatgttccggaatgagcgcgctatccggttcgtggtgatggttacccctgaggacctaaaggcaaacgcggagtatatcaagatggcagaccactacgtcccagtgcccggagggcctaacaacaataattatgccaatgtcgagctcatccttgacattgcaaagcggatccctgtgcaggccgtatgggccggttggggccatgcttctgaaaatccaaaattgcccgagctgctcctgaaaaacggcattgccttcatgggccctcccagtcaggcaatgtgggcattaggtgacaaaatcgcgagttctatcgtcgcccagaccgctggcattcctactttgccatggtccgggagcggcttgagggttgattggcaggagaatgacttcagcaagcgaattctaaacgtgccgcaggaactgtatgaaaagggttacgtgaaagacgtggacgacggactgcaggctgcagaggaggtgggatacccagtaatgattaaggcatctgaggggggaggcggaaaaggaataaggaaggtaaacaacgccgacgacttccctaacttgttccgccaggtccaggcagaagtccctggcagtccgatcttcgtgatgaggctcgcaaaacagtctcggcacctcgaggtccagattttggccgaccagtacggcaacgcaatctccctgtttggcagagattgctctgtgcagcgacgacatcaaaagatcatagaggaagccccagctactatagccacccccgcagtgtttgaacacatggagcagtgtgccgttaaactcgctaagatggtggggtacgtgtccgccggtaccgtcgaatacctttactcccaggacggctcattttattttctggagctcaacccgaggctccaggtagaacacccttgtacagaaatggtggccgatgttaatttgcccgctgcccagttgcagatcgccatggggatccccctatatcgtattaaagatatcaggatgatgtatggggtgtcgccctggggggattcaccaattgactttgaggattctgcccatgtgccatgtcccagaggccacgtcatcgcagctcgcatcacttccgaaaaccccgatgaaggcttcaagcctagttccggaacagtgcaagaactgaacttccgtagcaacaagaatgtctggggctatttctcagttgccgctgcaggaggcttgcacgaattcgctgatagtcaatttggccattgcttcagctggggcgagaacagggaggaagctatcagcaacatggtggtggcgctgaaagaactctccatcagaggggacttccggaccactgttgagtatctgattaaacttttggagacagaaagcttccaaatgaaccgaatcgacaccgggtggctggaccgcttgatagcggaaaaggttcaggcagagcgccctgatactatgctgggtgtcgtgtgcggagccctgcacgttgcggacgtttccctgcggaactctgtgtccaacttcctccactccctcgaacgtggacaagtattgccagcccacactctgctcaacaccgtggacgtcgaactcatttacgagggagttaagtacgtcttgaaagtgacccgacagagtcccaattcttacgtagtaatcatgaacgggtcttgcgtcgaggttgatgtccacaggctgtctgatgggggactgctgctgtcttatgatggtagtagctataccacatacatgaaagaagaggtagatcgttatcgcatcacaataggcaacaaaacctgcgtcttcgagaaagagaacgatccttccgtaatgagatccccgtccgccggaaaattaatacagtatatcgtcgaagatggtggacacgtgttcgccggtcagtgttacgccgagatagaggtcatgaagatggttatgaccttaacagccgtcgaatcggggtgcattcactatgtcaagcgccctggagccgctctcgatcccggatgcgtcctggccaagatgcagctggataatcccagtaaggtgcagcaggcagaactgcataccggctctttgcccaggatccaaagcacagccctgaggggcgagaaactccacagagtattccactatgtgctggacaacctggttaacgtcatgaacggctactgtctgccggatccttttttttcctctaaggtgaaagactgggtagagagactgatgaaaacccttcgcgatccctctctccccctgctggagctgcaggacatcatgacgtccgtgagtggacgcatccccccaaacgtcgagaaaagtatcaaaaaggagatggcccagtacgcctcgaatattacctctgttctctgtcagtttcctagtcaacaaatagccaacatcttggatagccacgccgcaacgctgaaccggaagtcagagagggaagtattttttatgaatacccaatcaatcgttcaactggtgcagagatacaggtctggcatccgaggccacatgaaggctgtggtgatggatctcctgagacaatatctgcgagttgaaacacagttccagaatggacattacgataaatgcgtgttcgctctgcgagaggagaataagagtgatatgaacaccgtcctgaattacatcttttcacacgcgcaggtgacgaagaagaatttgctggtgaccatgttgatcgaccagttatgtggccgagatcctaccctcacggatgagctcctgaatattctgacagagttgactcagttgtcgaagactaccaatgcaaaggtggcattgcgggctcgccaggttttgatcgcctcccatctgccctcatatgagctgcggcataatcaagtggagagcatcttcctttctgctattgacatgtacggccatcagttctgtatagaaaacctccagaagctgatcctgtccgagactagcatctttgatgtcctgcccaactttttctaccactctaaccaggtggtcaggatggcagcattggaagtgtacgtgcgaagagcatatatagcctacgaactgaatagcgtgcagcataggcagctcaaggataacacctgcgtcgtggagttccagtttatgctgcccacctcacacccgaacagggggaacatccctacgctgaatcggatgtctttctcgagtaacctaaatcattatgggatgacgcatgttgccagtgtcagtgacgtcctcctggacaacagctttacgccaccatgtcaaagaatggggggaatggtctcgtttagaacctttgaggactttgtgcggatcttcgacgaggtgatgggctgcttctccgactcaccccctcagtctcctacattccccgaagctggccacaccagtctctacgatgaggacaaggtaccaagagatgagcctatccatatcctgaacgtcgccatcaagaccgattgcgacattgaggacgaccggctcgccgcaatgtttagagagtttacacagcagaataaggccaccctagttgatcatggtatccggaggctgacattcctggtcgcccagaaggatttccggaaacaggtcaactacgaagtggatcgacgattccaccgcgagttccctaaattctttacctttcgggctcgcgataaatttgaagaggatcgaatctacagacacctggaacccgcattggccttccagctggaactgaatcggatgagaaattttgatttgacggctataccctgtgccaatcacaaaatgcacctttacctcggcgcagcaaaggttgaagtgggcaccgaggtcactgactaccggttctttgttcgggctataatcagacattcagatctggtgacaaaagaggcttcgtttgaatatctgcagaatgagggggagcgcttactgctcgaggctatggacgaattagaagtcgccttcaataatacgaacgttagaacggactgcaatcacatctttttgaacttcgtgccaactgtaattatggacccgtctaagattgaggagtccgtacgatcaatggtgatgaggtatggtagccgcctgtggaaactccgggttctccaggcggaactgaagatcaacatacgccttactccgaccggtaaggcaatccccattaggctgtttttgactaacgagagcggctactatttggatattagcctgtataaagaagtgacagatagtcgcacggcccagatcatgttccaggcttacggcgacaaacaaggacccttgcatggtatgctgatcaatacaccttacgtaacgaaggacttgcttcaatctaagagattccaggcccagagtctgggcacaacctacatctatgatattcccgagatgttccgccagtctttgatcaagctctgggagagtatgtctacccaggctttcctcccctctccaccattgcctagcgacatgctgacctacacggagctggttctggacgatcaggggcaattggttcatatgaatagactaccaggtgggaacgaaataggcatggtggcctggaagatgacatttaaaagtcccgagtaccccgaaggcagggatataatcgtgataggcaacgatatcacctacagaattggctcatttggaccacaggaggatctcctgttcctaagggcatcagagctggctcgcgcagaaggaattccaagaatttatgtgagtgcaaatagcggggcacgtatcggtttggctgaagagatcaggcatatgtttcacgttgcctgggtggaccccgaggatccatataagggctaccggtacttgtacctcacacctcaggattataaacgcgtttctgcccttaattccgtccactgcgagcatgttgaggacgaaggagaaagtagatacaagattacggacattattggcaaggaagaaggtattggcccagaaaacctgcggggatctggcatgatcgccggagaaagctcacttgcctacaatgagatcatcacaatctcattggtaacctgtagggccatcgggatcggagcgtatcttgtccgacttggtcaacgcacaatccaggtggagaactcccacttgatcctgacgggggcaggcgctcttaacaaggtacttggacgggaggtgtacacctctaacaatcagctaggaggcattcaaataatgcacaacaatggcgttacccactgcaccgtatgcgatgactttgagggcgtcttcaccgtgctgcattggctgagttatatgcccaagtcagtgcattcttccgtgccacttctgaatagtaaggatcctatcgatcgcatcattgagttcgtacccaccaagacaccctacgatcccagatggatgctggcaggcagaccccaccccacgcagaaaggccagtggctttcaggttttttcgactatgggagcttctctgagatcatgcaaccatgggcacaaactgttgtggtaggaagagccagacttggcggaatcccagtcggtgtcgtggcggtggaaaccaggaccgtggaactgtccatccccgcagaccctgcgaacttagattccgaggctaagataatccagcaagccggtcaggtctggtttccggattcggctttcaaaacctatcaggctattaaagacttcaatagggagggactgcccctgatggtgttcgctaattggcggggatttagcggtggtatgaaggatatgtacgatcaggttcttaagtttggagcgtatattgttgatggcctgcgggaatgttgtcagccggttttggtgtatattcctccacaagcagagttgcgcggaggcagttgggtcgtgattgacagtagcatcaacccccgacacatggaaatgtacgccgatcgagagagtaggggttccgttctggagcccgaaggaacagtggaaatcaaattccggaggaaggacctcgttaaaacgatgcgcagagtagacccagtctacatacacttagcagaacgcttgggcactcctgaactgtccacggctgaacgaaaggagcttgagaacaagctaaaagaacgcgaagagtttctcatccctatctatcaccaggtggccgtgcagtttgcagacctccatgatacacctggcaggatgcaagagaaaggcgtaatttctgatatccttgattggaaaacaagcaggacatttttctactggaggctgcggagactgctgctcgaagaccttgtgaaaaaaaaaatacacaacgctaatcctgagctgaccgacggacaaatccaggccatgctgcgcaggtggtttgtggaagtagaaggaactgtaaaagcctacgtgtgggataataataaggacctggcggaatggctcgaaaagcagttgacagaggaggatggagtgcactcagtgatcgaggagaacattaaatgcatttcgcgggattatgttctgaagcaaatccgctccctcgtgcaggccaatcccgaggtggccatggactcgataatacatatgactcagcatatttcacccactcaacgggcagaagtaattcgcatcttatctacaatggacagtccttccaccta

SEQ ID NO: 27192 - DNA, 777 bp, Artificial Sequence
  Description of Artificial Sequence: Synthetic coding sequence
atgtctggtcttcaccttgtgaagcagggtagggatcgtaaaaaaatcgattctcaaagggacttcacagtggcatcccctgctgagttcgtcacacgttttggcggaaacaaggtcattgagaaggtgttgatcgcaaacaacggcatcgctgccgttaagtgtatgaggagcattagaagatggagctatgagatgtttcgaaatgagcgcgcaatcaggtttgtagtgatggtgacccctgaggatctcaaagccaatgccgaatacattaagatggcagaccattacgtgcctgtgcctggtggcccaaataacaacaattacgccaatgttgagcttatactcgatatcgccaagcggatcccagtgcaagccgtgtgggccggttgggggcacgcctcagaaaatcccaagttgccagagttactgctcaagaatggaattgccttcatgggtcccccatcacaggccatgtgggcgttgggcgataagattgcttcttcaatagtcgctcaaactgctggcattcccaccttgccgtggagtggaagtggactgagggtcgactggcaggaaaacgatttctccaagcgcatattgaacgttcctcaggagttatatgagaaaggttacgtgaaagacgtagacgacggtttgcaagccgcagaagaggtgggttaccctgtaatgattaaagcctcagaaggaggtggaggtaaagggatccgcaaagtaaacaacgccgatgatttccccaacctgttcaggcagtag

SEQ ID NO: 27193 - DNA, 144 bp, Artificial Sequence
  Description of Artificial Sequence: Synthetic coding sequence
atggatgagccttcccccctcgctcagccgctggagctcaatcagcactccagatttatcataggttcggtgtccgaagacaactctgaagatgaaatttcaaatctagtgaagctagatctgcttgaagaaaaggagggctag

SEQ ID NO: 27194 - DNA, 2679 bp, Artificial Sequence
  Description of Artificial Sequence: Synthetic coding sequence
atggatcactacgattcacagcagacgaacgactatatgcaaccagaagaagactgggatagggatctgcttctggacccagcttgggagaagcagcagcgtaagaccttcactgcttggtgtaacagtcatctccggaaagcaggtacccagatagaaaacattgaagaagacttcagagatggtctgaagctgatgctgctcctggaggtgatcagcggggagaggctggcaaagcctgagaggggcaagatgcgcgtgcataaaataagtaacgtaaataaggctctggacttcatcgcaagtaagggagtgaaattagtatcgatcggggctgaggaaattgtggatggtaatgtaaagatgacactcgggatgatctggaccatcatccttcggtttgccattcaagatattagcgtggaggaaacgtccgcaaaagagggactgctgctctggtgccaaagaaaaaccgcaccatataaaaatgtcaatatccagaattttcacatctcatggaaggacggattgggattctgtgctctgatccaccgccatcgcccagaactgatcgactatggcaagttaaggaaagacgatcctctcacgaatttgaataccgctttcgatgttgcagaaaagtacttggacatcccaaagatgttagatgctgaagacattgtggggaccgctaggccagacgaaaaagcgatcatgacttacgtatcgtctttttaccatgcattttcaggcgctcagaaagcggagacggctgctaaccggatttgcaaggtgttggcggtaaaccaagagaatgagcagctcatggaggattacgagaagctggcttctgaccttcttgagtggatacggcgaacgatcccctggcttgagaatcgggtacctgagaatactatgcatgccatgcagcaaaagttggaagacttccgcgactacaggcgcctgcacaagccaccaaaagtgcaggagaagtgtcaactcgaaattaattttaacacattacagacaaaattacgtctgtctaatcgacccgctttcatgccttccgaaggacgaatggtaagtgacatcaataatgcttggggatgtctcgagcaagttgagaagggatacgaggaatggctgctgaacgagattagacggttggagagactggaccatctggcagagaagtttaggcagaaggctagtatccacgaagcatggactgacggaaaagaagccatgttgcgccagaaggactacgaaacggcaacactgtctgaaattaaggcgcttctgaagaaacacgaagcttttgagtcggacttagctgcacaccaagaccgggtcgagcaaatcgccgcaattgcacaagagctgaacgaattagattactacgatagtccttcagttaatgctcgctgccagaagatctgtgaccagtgggacaatcttggcgcactaacacagaagcgaagagaagccctcgaaaggacagagaagctattagagactatcgaccagctttacctggagtacgcaaaacgagcagccccatttaacaattggatggagggcgctatggaggatttgcaggatacattcatcgttcacactattgaggaaatacaggggcttactacagcacacgagcagtttaaggccactctcccagatgctgataaggagcggttggctattctggggattcataacgaggtctccaaaatcgttcagacatatcacgtgaacatggccggtaccaacccttacactacaattaccccccaagaaattaacggtaagtgggaccatgttcgtcaactggtgcccagacgggaccaggcactgacagaggagcatgctaggcagcagcacaatgaaagactcaggaaacagtttggtgcccaagcaaatgtcatcggtccttggatccaaactaaaatggaagagattgggaggatctcgatagagatgcacggcacactcgaggatcagttgtcccacctccgccaatatgaaaaaagcattgtgaactataaacccaaaattgaccagctggagggagaccaccaactgattcaggaagccctgatattcgataacaaacacacaaattacacaatggaacacatcagggtcggctgggaacagttattgactaccatagccagaacgatcaatgaggtggagaatcagattctgaccagggatgctaagggcataagtcaggagcagatgaacgagttcagagcttctttcaatcattttgatagagaccacagcggcacactggggccagaagagttcaaggcttgcctgatttctttgggatatgacatcggcaacgacccccagggcgaggctgaatttgccaggattatgagtatcgtagacccgaaccgcctgggggtggtgaccttccaggcgttcatagatttcatgtcccgggagacagcagacacagatacagctgaccaagtcatggcatctttcaagattctcgctggcgacaagaactacatcacgatggatgaacttcgtcgtgagctccccccagatcaggccgagtactgtatcgctcgtatggccccttacaccggcccagactcagtccctggagccctagattatatgagtttctccacagctctttatggggagtctgacctgtag

SEQ ID NO: 27195 - DNA, 2745 bp, Artificial Sequence
  Description of Artificial Sequence: Synthetic coding sequence
atggatcattacgattcccaacagacgaatgactacatgcagcctgaggaagattgggacagggatctgcttctcgatcctgcttgggagaaacagcagaggaaaacctttacagcctggtgtaattcccacctgcgcaaagcaggcacccaaattgaaaacatagaggaagacttccgggacggactcaagttgatgctcctgctcgaggttatttctggggaacggttggccaaacctgaacgcggaaagatgagagttcataagatttccaatgtcaataaagctcttgattttattgcttccaagggagtaaaactggttagtattggcgctgaagagatcgttgatgggaacgtgaagatgaccctgggcatgatatggacaatcattctacgtttcgccatccaggacatttccgtagaagagaccagcgccaaggaaggcctgcttctgtggtgccagcggaagacagccccatacaaaaacgttaatattcagaactttcacatcagttggaaagacggcctcggcttctgcgccctgatccaccggcaccgccctgagctgatcgactatggtaagctccggaaagacgacccactcaccaatctcaacacagcattcgatgtggctgaaaaatacttggatattccaaaaatgctggacgcagaagacattgtgggcaccgcccgaccagatgaaaaagccattatgacgtacgtgtcatctttctatcatgccttctccggcgctcagaaagcagagaccgcagcaaatagaatttgcaaggtgctggctgtaaaccaggagaatgaacagctgatggaagactacgagaagctggcctcagacctgctagagtggatccgtcggacaatcccctggttggagaatagggtgcccgagaacacaatgcacgccatgcagcagaaactcgaggactttcgggactatcgaaggttgcacaaaccgcctaaagtccaagaaaaatgtcagctggagatcaactttaatactctgcagaccaaattgcgcctctccaaccgacctgctttcatgccgagcgagggaagaatggtgagcgatatcaataatgcatggggctgcttagaacaggtcgaaaagggctacgaagagtggttactcaacgaaattaggcgtctggagcgccttgaccacctcgccgaaaaattcagacaaaaggcctccatacacgaggcttggacggatggcaaagaagctatgctccggcagaaagactacgagaccgcaaccctgagcgagatcaaagcgctcctcaaaaaacacgaggcctttgaatccgaccttgccgctcaccaggaccgggtggagcagattgccgctattgcgcaggagctgaatgaactagactattacgactctccatccgtcaatgcacgctgtcagaaaatatgcgaccaatgggacaatcttggcgcacttacccaaaagcgccgtgaggcccttgagcggaccgaaaaactgctcgaaacgattgatcagctgtacttggagtatgccaaaagggccgcacccttcaataactggatggagggggctatggaagatctccaggataccttcatcgtccacacgatcgaagaaatccagggacttacgaccgcccacgaacagttcaaagcgactctgcctgatgcagacaaggaacgtttggccattctgggtatccacaacgaagttagcaagattgtccaaacctaccatgttaatatggctggaactaatccttataccactataacgccccaggaaattaacggcaagtgggatcatgtccggcagctggtgccccgtcgagaccaggctctgaccgaagagcatgccagacagcaacataacgagcgtctgagaaaacaattcggtgctcaagcaaacgtgatcggcccatggatacagactaagatggaagaaataggtagaatctctatagagatgcacggaaccctcgaggaccagctcagtcatctgcgccagtatgagaagtctatcgtcaattataaacctaaaattgaccagcttgaaggagaccaccagctgatccaggaggcgctgatttttgacaacaaacacaccaattacaccatggagcacattagggtgggatgggagcagcttctcactactatcgccaggaccatcaatgaagtagagaaccagatcctgacgcgagacgctaaaggcataagccaggagcaaatgaatgaattccgtgcctcctttaatcatttcgatagagatcatagcggaaccctaggtcctgaggagttcaaggcctgtctcatttccttaggctacgacattggcaatgacccccaaaagaagactggcatgatggatactgatgactttagagcatgtctcatctccatggggtataacatgggcgaagcagaatttgccagaatcatgtctatcgttgatcccaacaggctgggcgttgtcacatttcaggccttcatcgacttcatgagcagggagaccgcagacactgacaccgccgatcaggtgatggcctcttttaaaatccttgcaggagacaagaactacatcactatggatgagctgcggagagaactccctcctgatcaggccgagtactgcatcgccagaatggctccctacaccggacctgactccgtcccgggagctcttgattatatgtctttctccacagccctgtacggggagtctgatctttag

SEQ ID NO: 27196 - DNA, 2664 bp, Artificial Sequence
  Description of Artificial Sequence: Synthetic coding sequence
atggatcactacgactcacagcaaaccaatgattatatgcagcccgaggaggactgggacagggatctacttctagaccctgcttgggagaagcagcagcgcaaaacatttaccgcatggtgtaatagtcacctacgtaaggctgggacccagattgagaatatcgaggaagatttccgtgacgggctgaaactgatgttgctcctggaggtaatcagcggggagaggctagctaaaccggaacgcggtaagatgcgagtgcacaagatttcaaatgtgaacaaggctcttgatttcatcgccagcaagggtgtcaagcttgtgtcaatcggggctgaggagattgtggacggcaacgtgaagatgacgctggggatgatctggacaatcatactgcgtttcgctattcaggacattagcgtggaagagaccagtgctaaggaggggcttcttctctggtgccagaggaagaccgccccttacaaaaatgtgaacatacagaatttccatatatcatggaaggacgggctgggattctgcgctcttatacatagacatcgccctgaactcatcgattacgggaagctccgaaaggatgacccactcacgaaccttaatactgcctttgacgtcgctgaaaagtatctggatattccaaagatgctggacgcggaggatattgtcggaaccgcccgtcctgatgaaaaggcgataatgacatacgtttcttcattttaccacgccttttcaggtgcccagaaagctgaaaccgcagccaacagaatctgcaaagtgctggctgtgaatcaagaaaatgaacaattaatggaggactatgaaaagctcgcgtccgaccttctagagtggatccgacgaactatcccttggctcgagaatcgggtgcccgagaacacgatgcacgctatgcagcagaagctcgaggactttagagattacagacgattacataagccaccaaaggtgcaggagaagtgtcagctcgagatcaactttaatacgctgcagactaagttgaggctcagtaatagacctgcattcatgccctcagaaggtaggatggtctccgacattaacaacgcctgggggtgcctggagcaggtggagaaaggctacgaggaatggctgctaaacgagatccgtcggttggaacgtctagaccatcttgcggagaagttccgacagaaagcgtccattcacgaagcatggacagacgggaaggaggccatgctcaggcagaaggactatgagacagccacactgagtgagataaaggcccttttgaagaaacatgaggcctttgagtccgatctggccgctcatcaggatcgggttgagcagatcgccgctattgcgcaggaattgaatgaactggactattatgactcaccctctgtgaacgccaggtgccagaaaatttgcgaccagtgggacaacttgggcgctttaacccaaaaacgtcgagaagccctggagcggaccgaaaaactcctggaaacaatcgatcaactctacctcgaatatgccaaacgtgctgctccttttaacaactggatggaaggcgctatggaggaccttcaggatacttttatcgtgcatactatagaggagatccagggtctgacgactgcccacgaacagttcaaagcgacactccccgacgctgacaaggaacggcttgccatactgggtatacacaatgaggtgtctaaaatcgtccagacctaccacgtgaacatggccggtaccaacccttatacaacaataaccccccaggaaattaatggtaaatgggaccacgtgagacaattagttccaaggcgcgaccaggccctcacggaggagcatgcgagacagcagcacaacgagagactgcgaaaacaatttggtgcacaggcgaacgttattgggccatggattcagactaaaatggaagaaatcggtagaatttcaattgaaatgcatgggacgctcgaagaccagctgagccatctgagacagtacgaaaagtcaatagtaaactataaacccaaaatcgaccagctggaaggggatcatcagctgatccaggaagcattaatttttgacaacaagcatacaaattatacgatggaacacatccgagtagggtgggagcagctgctgaccactattgcacggacaattaatgaagtggaaaaccagatcctgactcgggatgccaagggtatcagtcaagaacagatgaatgaattccgggcatccttcaatcactttgatcgcaagaagaccggaatgatggacactgatgacttccgcgcatgcctcatctccatgggctacaacatgggcgaggccgagttcgccaggattatgtccatagtggatcctaaccgactgggggtggtgacattccaggctttcatcgactttatgtcacgcgaaacagcggacacagatacagctgaccaagtgatggcctcctttaagattctcgccggagataaaaactacattaccatggacgagctgaggagggaactcccccctgatcaggctgaatattgcatagcaaggatggctccttacaccggacccgactcagtgcctggggctctagattatatgtccttttcaacggcactgtatggggagagcgatctctag

SEQ ID NO: 27197 - DNA, 2736 bp, Artificial Sequence
  Description of Artificial Sequence: Synthetic coding sequence
atggtggactatcatgctgccaaccaaagctaccagtacggaccaagctcagccggaaatggtgcaggaggaggagggtccatgggcgactacatggctcaagaggatgattgggaccgggatctgctcctagatcctgcctgggaaaaacagcagcgcaagacctttaccgcctggtgcaatagccatttgagaaaagccggaacccaaatcgaaaatatcgatgaggattttcgcgacggactgaagctgatgttgctcctggaagtgatatcaggagaacgcctaccaaaaccagaaagaggaaaaatgcgcgttcataaaattaataatgtcaacaaggctctcgacttcatcgctagcaagggtgtgaaactggtttctatcggagcggaagaaatcgtggacggcaacgccaaaatgacacttggaatgatctggaccataatactccggttcgccattcaagacatttccgtcgaagagacaagcgccaaagaggggctcctcttgtggtgtcagcgcaagacggccccttacaaaaatgttaacgtgcagaactttcatataagttggaaagacggcttggcattcaacgcactcatccacaggcatagacccgagctcattgaatacgacaaactgcgaaaggacgaccctgtcacgaacctaaacaatgcttttgaggtggccgagaaatatctggacatcccaaagatgttagatgcagaagacatcgtgaatacggccagacctgatgagaaggccatcatgacttacgtctcatccttctatcacgcgttctcaggagcccagaaggctgagactgctgcaaaccgcatctgcaaggtgctggctgtgaaccaggaaaatgagcacctgatggaggattacgagaagctagccagtgatctcctggaatggattcgacgtacaataccatggctcgaggacagggtcccgcagaagactatccaggagatgcagcagaagctggaagattttcgcgactatcgcagggtccacaaacctccgaaagtacaggaaaagtgccagctggaaatcaacttcaacacactgcagacgaaacttcgcctgtccaatagacctgcattcatgccatcggagggaaagatggtctccgatattaacaatggttggcagcatttggagcaagccgagaaaggatatgaggagtggctgctaaatgagatccggcgactggaaagactggaccatctggcagagaaattccggcaaaaagcatccatacacgaggcatggaccgacggtaaagaggccatgctcaaacatcgagattatgaaacagcgaccttgtctgacataaaggcattgatccgtaagcatgaagcctttgaatccgatctcgcagcacaccaggatagggttgaacagatagccgcaatcgctcaggagttgaacgaacttgactattacgacagccacaacgtgaataccagatgccagaagatttgtgatcagtgggatgctctcggttctctgacccatagtaggcgcgaagccctggaaaagaccgagaagcagctggaagctatagatcagctgcacctggagtacgctaaaagagccgctcctttcaataactggatggaaagcgccatggaagacctgcaggacatgttcattgtgcacactattgaggagatcgaaggcctgatttctgcgcacgatcagtttaagtcgaccctacctgatgccgacagggaacgggaagctatcctggccattcataaagaggcccaacggatcgctgagagcaaccacatcaagctgagcggttccaacccctatacaaccgtaacgccccagattataaacagtaagtgggaaaaggtgcagcaactggtgcccaaaagagatcacgctctcctagaggagcaatctaaacaacagtctaacgaacatctcaggcgccagttcgccagtcaggctaatgtcgtgggtccctggatccagacaaagatggaagagattggacgaatcagcattgaaatgaacggcaccttggaggatcagctttcccacctcaaacagtacgagagaagtatcgtggattacaagccaaacctcgacctcctcgagcagcagcatcagttgatacaggaagccctgatttttgacaacaagcacacaaactacaccatggagcacatacgtgtaggttgggagcagctgctgactaccatcgctaggaccattaatgaggtggagaatcagatcctcacaagagatgcaaaaggtatcagccaggagcagatgcaggagtttagagcttcatttaatcatttcgacaaagaccatggcggagctctcggcccagaggagtttaaagcttgtttgatttcccttgggtacgatgttgaaaatgatagacagggagaggccgaattcaacaggataatgtctctcgtggaccctaaccactcaggattggttaccttccaagcttttatcgacttcatgtctcgagaaactactgacacagacacagccgaccaagtgatagcctcctttaaggtgttggcaggcgataaaaatttcattacagctgaggagcttcgcagggaattgccaccggatcaggccgaatactgtattgccaggatggcaccttaccagggcccagacgctgtgcctggcgcactggactataagtctttttcaacggcactctatggtgaaagtgatctctag

SEQ ID NO: 27198 - DNA, 2079 bp, Artificial Sequence
  Description of Artificial Sequence: Synthetic coding sequence
atggtcgattaccacgcagcgaaccagtcgtatcagtatggccctagctcggctggcaatggtgcaggcggtggaggctctatgggcgactatatggcacaggaagatgactgggaccgcgacctccttttagacccggcttgggagaagcagcagcgcaaggcagagaccgctgctaatcggatctgcaaagtgctagccgtcaatcaggagaatgaacacctcatggaagattacgagaagctcgcctccgacctgttggagtggatccgccgaaccatcccctggcttgaggaccgggtgcctcagaagactatccaagaaatgcagcaaaagctggaggatttccgggactacaggagggtgcacaagcctcctaaggtgcaggagaagtgccagctagagatcaatttcaatactttgcaaacaaagcttcgtctttcgaataggcctgcatttatgccgtctgaaggaaagatggtatccgatattaataatggatggcagcatctagaacaagcagagaaggggtatgaagagtggttgctcaatgagatcaggcgccttgagcgactcgaccatctggccgaaaagtttcgacagaaagcatctattcatgaggcttggacggacggcaaggaggcgatgctgaagcatcgggactacgagacagcaactctgtccgacataaaggccctgatccggaagcacgaggcattcgagagcgacctcgcagctcaccaggacagagtggagcagattgctgcaattgcccaggagctgaacgaactcgattactacgacagccataatgtcaacacccgctgtcagaagatatgcgatcaatgggacgcactgggatctctgactcacagtcgcagagaggccctggaaaagactgagaagcaactcgaagcgattgatcagcttcatctcgaatacgccaagagggccgcacctttcaataattggatggaatccgctatggaagaccttcaggacatgtttattgtgcacactatagaggagatagaggggctcatctccgcacacgatcagtttaaatctacattacccgatgccgatcgggaacgggaagccattctggctatacacaaagaggcgcagcggattgccgagagtaaccatatcaagttatctgggtccaacccatataccacagtgacccctcagattatcaattcaaagtgggagaaagtgcagcagctagtgccaaaacgcgatcatgccctgttagaggagcaatcaaagcagcagagcaacgagcacctccggcgacagttcgcctctcaagcaaacgtcgtggggccttggatacagaccaagatggaagaaatagggaggatttccattgaaatgaatgggacactcgaggaccagttgagtcacttgaagcagtacgaacgctccatagtcgactacaagccgaatctggacctgctggagcagcagcatcagctgatccaggaggcccttatcttcgacaacaagcacacaaattacacaatggagcacattcgcgtgggctgggagcagctgctgaccacaatcgcacgtaccatcaatgaggtggaaaatcaaatcttgacaagagatgcaaagggaataagccaagagcaaatgcaggagtttagggcatcctttaaccactttgacaaggaccatggcggagccctgggtcccgaggagttcaaagcatgcctcatctcgctgggttatgatgtggagaacgacaggcagggtgaggccgaattcaaccggattatgagccttgtagaccccaatcattccggcttggtgacgtttcaggcatttatcgactttatgagcagagagaccacggataccgataccgcagatcaggttatcgcatcattcaaggtgctagcaggagataaaaatttcatcaccgctgaggaactcaggcgagaactgccgccagaccaggccgaatattgtatcgccaggatggccccttaccaaggccctgacgcagtgcccggtgcccttgactacaaatccttctccaccgccctgtatggggagagcgatttgtag

SEQ ID NO: 27199 - DNA, 1566 bp, Artificial Sequence
  Description of Artificial Sequence: Synthetic coding sequence
atggtcgactatcacgccgcaaaccaatcctaccagtacggaccatccagcgccggtaatggggcaggtggcggtgggagtatgggtgactatatggctcaagaggacgactgggaccgcgacttgcttcttgatcctgcctgggaaaagcaacagcgtaaaacctttaccgcctggtgcaactcgcacctgagaaaggccggtactcagattgaaaatattgatgaagacttcagagatggtctgaagctgatgctgcttctcgaggtgcatgaattggactattatgactcacacaacgtgaacacccgctgtcagaagatctgcgatcagtgggacgctctgggaagcttgacacacagccgccgagaggcccttgagaaaacggagaagcagctcgaagccatcgatcaactccatttggagtacgccaagcgggctgcccctttcaacaactggatggaatcggctatggaagatctgcaagatatgttcattgttcacacaatcgaagagatcgagggcttgatctcagcacacgaccagttcaaatccactcttccagacgcagatcgcgagcgtgaagccatcctagccattcacaaggaagcacagcgcatagccgagtccaaccatatcaagctgagcggaagcaatccttataccaccgtgaccccccagatcatcaatagcaagtgggaaaaggttcagcagctggttcccaagcgggatcacgctttgctggaagagcaatcaaagcaacagagcaatgagcacctcagacggcaatttgcctcacaagcaaatgtggtcgggccatggattcaaaccaagatggaggagatcggtaggatctcaattgaaatgaacgggaccttggaggaccagttatcacatctcaaacaatacgagcgaagcatcgttgattacaagccaaatctggacctgcttgaacagcagcatcagcttattcaggaggctttgatcttcgacaataagcacactaactacaccatggagcatatacgcgtgggatgggagcagctactgactaccattgcgcgaaccatcaacgaagtcgagaatcagatcctcacccgcgatgctaagggaatatcgcaggaacagatgcaagagtttagggcttcgttcaatcatttcgataaagatcacggcggtgcactggggccagaggagttcaaggcttgtctgatttcgctaggctatgacgtggagaacgacagacagggggaggctgagtttaatagaattatgtcgctagtagaccctaatcacagtgggcttgtcacctttcaggcgttcattgacttcatgagccgagagactacagatacggatacagcggaccaggttatcgcaagcttcaaggttttagccggagataagaacttcatcacggccgaggaactgagaagagagcttccacccgatcaggcggagtattgtatcgctcgcatggctccataccaggggcctgatgcagttcctggagccctcgactacaagagcttctccaccgcgctgtacggagaaagcgatctgtag

SEQ ID NO: 27200 - DNA, 1689 bp, Artificial Sequence
  Description of Artificial Sequence: Synthetic coding sequence
atggtcgactaccacgcggcaaatcagtcctaccagtatggtcccagctctgcaggcaacggtgctggtggaggtggatcaatgggggactatatggctcaggaagacgactgggatcgggacctgttgctagacccagcctgggagaagcagcagcggaaaacatttactgcctggtgcaacagtcaccttcgaaaagccggtactcagatcgagaacatcgacgaggactttagggatggtttaaagcttatgttacttctggaggtaatatctggcgaaaggttacctaagccggagcggggaaaaatgcgagttcacaaaatcaataatgtgaataaagccctggactttatcgcttccaaaggagtgaaactcgtatccataggcgctgaagagatcgtggacggcaacgccaagatgacacttgggatgatttggactattatacttcgatttgccatacaggatattagcgtggaggagacctcagcaaaagagggactactactctggtgccagcgcaagactgcaccttacaagaacgtgaacgtgcaaaacttccatatcagctggaaagacggcctggccttcaacgccctgattcatcgccaccgccctgagctgatagaatatgacaaactgaggaaagacgatcctgtgacaaacctcaacaatgcctttgaagtggctgaaaaatacttggacatccccaagatgctcgatgccgaagatatcgtgaatacagctcggcctgatgagaaggccatcatgacatatgtcagctctttttaccacgcattttctggagctcagaaggctgaaaccgccgcaaataggatctgtaaggtcctggccgtcaatcaggagaacgagcacctgatggaagactatgagaaactggcctctgatctcttagagtggataagacggaccataccctggctggaggatcgcgttccccagaaaaccatccaagagatgcagcagaagctggaggattttcgcgactaccgtagggtgcataaaccaccaaaggtgcaggaaaagtgccaactagagatcaactttaatacgcttcagactaaactgagactgtcaaacaggcctgcgttcatgccgtctgagggcaagatggtctccgacatcaacaacggctggcagcatctggaacaagccgaaaaggggtacgaggagtggctgctgaatgaaattagaaggctggaaagactggatcacctcgccgagaaattccggcagaaggcctcaatccacgaagcgtggacagatggcaaggaggccatgttgaagcaccgggactacgaaacagccacattgagcgacatcaaagccctgatcagaaagcatgaggcatttgagtccgatctcgcagcccaccaagatagagttgaacagattgcggctatcgcgcaagagctcaacgaattagactattatgattcccacaatgtcaacaccccagatggtctccaagaaggccctggtcaaccccactctcccatacctcccctgtgtatttacgctaaacatagcttgcagtcttctggggtcggaggatgggcgggacggggatggggaaggctgagcccgctgtcactgtgcggactggctcgcaggtttcccaggcccggatggggtgacttgggccctgctctcctcgtgtggtag

SEQ ID NO: 27201 - DNA, 1518 bp, Artificial Sequence
  Description of Artificial Sequence: Synthetic coding sequence
atgaaatttaagttgcacgtcaactccgcccgacaatataaagatttgtggaacatgtctgatgacaaacctttcctctgtaccgcccctggatgcggacagaggtttacaaatgaagatcacctggcagtgcataagcacaagcatgagatgacgctcaagtttggccctgcgaggaacgatagtgtaatagtcgcagaccaaacacctacccccacaagatttctaaagaactgtgaagaagtcggcctcttcaacgaattggcttcccctttcgaaaacgagtttaaaaaggccagtgaagatgacattaagaaaatgcccctggacttgtccccacttgctactccaattattagatctaagatcgaggagccctctgtcgtggaaaccacccaccaggattcacctttgccccaccccgaatctaccacgtctgatgaaaaggaggtgccactcgctcagactgcccaacccacctctgctattgtgcggccagccagtttgcaagtaccgaatgttttactgacgtcgagcgattcttccgtcatcattcaacaggccgttccttctcctactagcagtaccgtcattacacaggcgccaagctccaacagaccaatagtcccagtgcccggtccatttccgcttctgttgcatctgcctaatggtcaaacaatgccagtggcaatcccagcttcaattacctcgtcgaacgttcatgtgccagcggctgtgcctttggtacggcctgtcaccatggtccctagcgtgccgggaattcccggaccctcctcaccccagcccgttcagtcagaggccaaaatgagacttaaggccgcactgacccagcaacaccctcctgtcaccaatggtgacacagttaagggtcatgggagtggcctggtccggacgcagagcgaggagtctaggcctcagagcctgcaacagcccgcaacctctactactgagactcccgctagtcctgcacacactactcctcagacccagtccacatcggggcgtagaaggcgcgctgcaaatgaggacccagatgagaaacggaggaaatttttggagcgcaatagagcagccgcatctcggtgtaggcagaagcgtaaggtatgggtgcagtccctcgaaaagaaagcagaggatctttccagtctgaatggtcaactgcaatcagaggttaccctcctgaggaacgaggtggctcagctcaagcaacttttgttggctcataaggattgccctgtcacagccatgcagaaaaagtctggctaccacaccgccgacaaggatgatagttccgaggacatcagcgtcccctcatcaccacacaccgaagccatccagcatagttcagtgtccactagtaacggagtcagcagtacgagcaaagccgaggcagtcgcgacgtccgtccttacgcagatggccgaccagtctacagaaccagctttaagtcaaatcgttatggccccttcttcacagtcccagccttcaggatcgtag

SEQ ID NO: 27202 - DNA, 1344 bp, Artificial Sequence
  Description of Artificial Sequence: Synthetic coding sequence
atgtattgcgcgtggatgtggcccgaccagacacccactccaacacgctttctcaaaaattgtgaagaggtagggctttttaatgagctggcgtcaccatttgaaaacgaattcaaaaaagcttcggaagacgacattaagaagatgccattggatcttagcccactggccacgccaattattagaagcaagatcgaagagccatccgtggtcgagacaacgcatcaagatagccctcttccccatcctgagtccaccacatctgacgagaaagaggtacctctggcgcagacggcccagcctacctctgcaatcgtgagacctgccagcttgcaggtgcccaatgtcctgttgacctctagcgactctagcgtgattattcagcaggctgtcccaagcccaacgtcttcaaccgtgataactcaagcaccctcttcgaataggcccattgtgccagtgccaggcccattcccactgctccttcaccttcctaatggccagaccatgcctgtggcgattccagcctctattacctctagtaacgttcacgtccccgcagcagtgcctctcgtccgacccgtcacaatggtaccctctgtccctggtatacccggtccgtcctcaccccagccagtccagtccgaggctaagatgcgtcttaaagccgctctcacccagcagcaccccccagtcacgaatggcgatacggtgaaagggcatggaagcggcctggtgcgcacccagagcgaggagagtaggccacaaagcctgcagcagcctgctactagcacaaccgagactcccgcttctccagcacacactactccgcagacccaaagcacgtctgggaggagaagacgggctgcaaacgaggacccagatgaaaagagacggaagttcctggagcggaacagggccgctgccagtcggtgtaggcagaaacggaaagtttgggtgcaatcgcttgagaagaaggcagaggatctgagctcgctgaatgggcagctccaaagtgaggtcactttactccgcaatgaggtggctcagttaaaacagctcttgctcgcccacaaggactgccccgttactgcaatgcagaaaaagtctgggtatcatacggccgataaagacgactccagtgaagacatctctgtgccaagcagcccacataccgaggcgatccagcacagttccgtcagtacaagcaatggcgtttcatcgactagtaaagccgaggcagtggcgacaagcgtactcacccaaatggctgatcagtctacagagcccgctttgagtcagatcgtgatggcgccttcctctcaaagccagcctagtggaagttag

SEQ ID NO: 27203 - DNA, 381 bp, Artificial Sequence
  Description of Artificial Sequence: Synthetic coding sequence
atgagtgatgataagcccttcttatgcaccgctccaggctgcgggcagagtgaggtcactctcctgcgaaacgaggttgctcaactcaaacaattgcttctcgcccataaggattgtccagtgaccgcgatgcagaagaagtccggctaccacacagcggataaagatgatagctccgaggatattagcgtgcctagctccccccacacagaagctatccagcactcaagtgtatctacatcgaacggggtctcgagcacgagtaaggccgaggccgtagccacctcagtcctgacccagatggctgaccaatcgacggagcctgcccttagccaaattgtgatggccccttcctcccagtcgcagccaagtggttcttag

SEQ ID NO: 27204 - DNA, 1518 bp, Artificial Sequence
  Description of Artificial Sequence: Synthetic coding sequence
atgaagttcaaattacatgtgaattccgcacgccagtacaaagatctgtggaacatgtcagacgataagcccttcctgtgtacagcgccagggtgtggccaaaggttcacaaacgaagatcatctggccgtgcataagcacaaacacgaaatgacattaaagttcggtcccgctaggaacgactctgtaatcgtggccgaccaaactccaaccccaaccagattcctcaagaactgtgaggaggtaggattatttaacgaactcgcatccccctttgagaacgagttcaagaaagcatcagaggatgatataaaaaaaatgcccctcgacctcagcccactggccaccccaatcatcagaagcaagatagaggaaccgtccgtcgtggaaacgactcaccaggattccccactgccccatcctgaatctaccactagcgatgagaaggaggttcccttagcccagacagctcagccaacatcagctatcgttcgcccagcgtcattacaggttcccaatgtgctcctgacatcttctgattcatctgtcatcattcaacaggcagtgccatccccaacctcaagcactgtgattacacaagccccatcatctaataggcctatcgtccctgtccccggacccttccctcttcttctgcacctccctaacggacagaccatgcctgtcgctatacccgcaagtattacatcgagcaacgtccatgtcccagcagcggtccctctagtgcgacccgttaccatggtgcccagtgtcccaggtattcccggtccctcttcaccccagcctgtgcagagtgaagctaaaatgcgactgaaagccgcactgactcaacagcatccacctgtaacgaatggggataccgtgaaaggccatgggagtggcctggtacggacacagtcagaggagtctcgacctcagtcattgcagcaaccagccaccagtaccaccgaaaccccggcatccccggcacacacgaccccccagacacagtccacctcagggaggagacgacgggctgctaacgaagaccctgatgaaaaacggaggaagttcttggagcgaaaccgcgcagcggcatctcggtgtcgacagaagagaaaggtgtgggtacagagtcttgaaaagaaggccgaagatctgtcttctctgaatggccagctccagagtgaagtgacgttactgaggaacgaggttgcacaattaaagcagcttctcttagcccacaaggattgtcccgtgacagccatgcaaaagaaatccggctatcacaccgccgacaaggacgattcatctgaggacatttctgtgccttcatcgccgcacacagaggctatccagcactcatcagtgtcaacatctaacggcgtgtcctccactagtaaagccgaagccgtcgcaacatcagtgctaacccagatggcagaccagagtactgaacccgctctgtcgcagatcgtaatggctccttcctcgcagtcccaacccagtggttcttag

SEQ ID NO: 27205 - DNA, 1344 bp, Artificial Sequence
  Description of Artificial Sequence: Synthetic coding sequence
atgtattgtgcgtggatgtggccagatcagaccccaactcctacaaggtttctgaagaattgtgaggaggtgggcctttttaatgagctggcctcccccttcgaaaatgagttcaagaaggcaagtgaggatgatattaaaaaaatgcccttggatctcagtcctctcgcaacccccattatccggtcaaaaatcgaggagccatccgtggtagagaccacacatcaagacagcccccttccacatcctgagtcaacaacatcagacgaaaaagaggtacctctggctcagactgctcaaccgacttcagcaatcgtacggccagcaagcctccaagtgcccaatgtgctacttacttccagcgattcttccgttatcattcagcaagctgtgccgtcgcccacctcttccacagtcatcactcaggccccaagttctaataggccaattgtccccgtccccggtccttttcccctgctgttacacctgcccaacgggcagactatgcccgtagcaattccagcttcaattacgagcagtaacgtgcatgtgccggctgccgtgccactggtcagacctgtgaccatggtgcctagcgttcccggaatccccggtccgtcgtctccccaaccggttcagtctgaagccaagatgagactcaaagccgctctcacacagcagcaccccccagtgacaaacggagacacggttaagggccatggctctggactagtccggacccagagcgaggagtctaggccgcagagcttgcagcagcccgcaacatcaaccacagagactcccgctagcccagcccataccaccccgcaaactcagagtacgagtgggagacggcgtcgtgccgcaaacgaggaccccgacgagaagaggaggaagttcttagagagaaatagagcagccgcaagtcgctgcagacagaagcggaaggtctgggtgcagtccctcgagaagaaagcagaggacctgtcctccctgaacggacagttgcaaagtgaggtgaccttactccgtaatgaggttgcccagcttaaacaattgttactggcccacaaagattgtccagtaacagctatgcagaaaaaatcaggctaccacaccgccgataaagatgattcctccgaggatatctccgttccttcttccccccatacggaagcaattcagcactcatccgtgagcacttccaatggcgttagctctaccagtaaagccgaggcagtggctacttccgtgctcacccagatggcagaccagagtacagagcccgctctatcccagatcgtgatggccccttcctctcaatcccaaccatcgggcagctag

SEQ ID NO: 27206 - DNA, 630 bp, Artificial Sequence
  Description of Artificial Sequence: Synthetic coding sequence
atgaaatttaaactgcacgtcaattcagctcgacagtacaaagacctctggaacatgagtgatgataagccatttctttgcaccgccccaggctgcgggcagaggtttacgaacgaagatcacctcgcagtacataaacacaaacatgaaatgaccttgaaatttggaccggctcgcaacgactctgtgattgtcgcagatcaaacacctacccctacccggtttcttaaaaattgtgaagaggtaggcctgttcaatgaattggctagtccttttgagaatgagtttaagaaggccagcgaagatgacatcaaaaaaatgcctttagatctatcacctctcgctaccccaatcatccggtccaaaattgaggagcctagtgtcgtagagacaactcaccaggactccccactgccccaccccgagagtactaccagtgacgaaaaggaagtccctctggcacagacagcccaacctacgtcagcaatcgtccggcctgcttccctgcaggtgccaaatgtgctgttgacctcctcagattccagcgtcattatccagcaagcagtcccttccccaacatcctctacagtcattacacaggcgcctagttccaataggccaatcgtatag

SEQ ID NO: 27207 - DNA, 1188 bp, Artificial Sequence
  Description of Artificial Sequence: Synthetic coding sequence
atgaagtttaaattacatgtaaattccgctcggcaatataaggacctctggaatatgagcgacgataagccttttttgtgtaccgcacccggttgtggccaacgttttactaacgaggatcatctggctgtccacaaacacaagcacgagatgacactgaagttcgggcctgcgcgtaatgactccgtaatagtggccgaccagactcctacccctacccgattcctgaaaaactgtgaagaagtggggctctttaacgagctcgcctcaccctttgagaatgaatttaagaaggcctcagaggacgacatcaaaaagatgccgctggatctgtctccactggccacccccataattcggtccaaaatcgaggagccttcagtggtagaaacaacccaccaagacagccccctgccccatcccgaatctaccactagcgacgaaaaagaggtgccactagcgcagactgcacaacctacttctgccatcgtgaggccggctagcctacaggtccctaacgtgctgttaacttcttcagacagctccgtgattattcaacaggccgtcccttctcctacaagctctaccgtgatcacccaagccccttcttccaaccggccaatcgtccctgtacccggaccctttccactccttctacacctccctaacggacagacaatgcctgttgcaataccggctagcattacatcctccaacgtccatgtgcccgcagccgtgccgctggtgagaccagtcacgatggttccaagtgtccctgggataccagggccttcgtcaccgcagcccgtgcagtccgaagccaagatgagactgaaggcggcacttacccagcagcaccctccagtcacaaatggcgatacagtcaaaggtcatgggtcaggcctggtgagaactcaatcggaggagtctagaccgcagtcgctgcagcaacccgcaacttccaccaccgagacccccgcatcccctgctcacactacccctcagacacagagcaccagcggtagaagacgcagagccgcaaacgaagatccggacgaaaaaaggcgaaaatttttggaacgaaacagggccgctgcttctcgctgtcgtcagaaacgcaaagtttgggttcagtcgctggagaagaaggctgaggacttgtcctctttgaatggacaactccagtag

SEQ ID NO: 27208 - DNA, 714 bp, Artificial Sequence
  Description of Artificial Sequence: Synthetic coding sequence
atgaagttcaagttgcacgtgaattccgcccgacagtataaggacctgtggaacatgtccgatgataaaccattcctgtgcaccgcccctggctgtggacagaggttcacaaatgaagaccacctggccgtacacaagcacaagcatgaaatgaccctaaaatttggaccagccagaaatgactctgtgatcgttgcggaccaaacccccactcccacaaggtttttgaagaactgtgaggaggttggacttttcaatgaactggcatctccctttgaaaacgagtttaaaaaggcatcggaggatgacattaagaagatgccacttgacctaagccccctggcaacacctatcattcggtctaagattgaggaaccgagtgtggtggaaaccacacatcaggactccccactcccacatcccgaatctacgacctccgatgagaaagaggtaccgcttgctcagaccgcacagcccactagtgcaatcgttcgcccagcaagcttgcaggtgcccaacgttctcctcacctcgtccgacagttcagtgatcatccagcaagcagtcccatcccccacaagctcaacagtcatcacacaggcaccaagctctaacaggccaatcgtttcctttgaccagagtccctggtgcctggtcttccaggagagccaggtgttgccgttacctaatcagtactcccagaagcagaaatag

SEQ ID NO: 27209 - DNA, 1464 bp, Artificial Sequence
  Description of Artificial Sequence: Synthetic coding sequence
atgtctgacgacaaaccgtttctctgcacagcgcctggatgcggccagagatttacaaacgaagaccacctagcagtacataagcacaagcacgagatgaccctgaagttcggtccagctcgcaacgactcagtgattgtggctgaccaaacccctacccctacccggttcttgaagaattgtgaagaggtgggactgtttaatgagttagctagcccattcgaaaacgaattcaaaaaagctagcgaggatgatatcaagaagatgccgctcgacctgagccctctagcaacaccgattatcaggtccaaaatcgaggagcctagcgttgtggagaccacccatcaggatagtccactcccccaccccgagagtactacctctgacgagaaggaggtacctctggctcaaacagcccagccaacctcagctattgtgcgcccagctagcttgcaagtccctaatgtgctgctaaccagctccgattcaagcgtgatcatccagcaggccgtgccctccccgacgtcctctacagtgattactcaggcacctagttccaaccgaccaatcgtgcccgttccaggtcctttcccattgctgctgcacctgcccaacgggcagacaatgccagtcgcaattcctgccagcatcactagctctaacgtacacgtgcctgcggcagttcccctggtgcggcctgtcactatggtgcccagcgtaccaggcattcctggccctagcagtccacaacctgtgcaatccgaggctaaaatgcggttgaaggcagccctaactcagcagcatccaccagtgaccaatggagatacggttaaaggacacgggagtggcctggtgagaacacagagcgaggaatcccgcccacaatctctccagcaaccagcaacatctacaacggagacccctgcttcacctgctcataccaccccgcaaacacagtccacatctgggaggcggagacgcgcagcgaatgaggaccctgacgagaagaggaggaaatttttagagcgcaaccgggctgctgctagtcgctgccgccagaagcgtaaagtttgggttcagtctctggagaagaaagcggaggaccttagctcgctgaacgggcagctgcagtccgaagtcaccctcttgagaaacgaagtcgcccagttgaagcagctcctactggcccacaaggactgtccagtgacggctatgcagaagaagagtgggtaccacactgccgacaaagatgatagcagcgaagatatctcagtcccatcctccccccatacagaggccatccagcattccagcgtgtctacatccaacggagtcagttcaacaagcaaggcagaagctgtggcaacgtcagtcctcactcagatggcagatcagtccaccgaaccggctttaagccagatcgtgatggcaccatcctcacagagccaacccagcggctcctag

SEQ ID NO: 27210 - DNA, 1188 bp, Artificial Sequence
  Description of Artificial Sequence: Synthetic coding sequence
atgaagttcaagctccacgtgaactcagccagacagtacaaggacctctggaacatgagtgatgataaaccgttcctgtgcacagctccagggtgtggtcaacgctttacaaatgaagaccatcttgcggtgcacaaacacaaacacgagatgaccttaaagttcggaccagccagaaacgattccgtcatagtggctgatcaaacgcctacaccaacgcgctttcttaagaattgtgaggaggttgggctattcaacgaactcgcgtctccttttgagaacgagttcaaaaaagcctccgaggatgacataaagaagatgcccctcgatcttagtccgctggctacccctatcattcggagtaaaattgaggaaccgtccgttgttgagaccacccaccaggacagtcccctaccacatcctgaaagcacaaccagtgacgagaaggaggtacccctggctcagactgctcagccaacatctgctatagtccgcccagcgagtctgcaggttcctaacgttctcctcacatccagtgatagtagtgtgatcattcagcaggccgtcccaagccctacaagcagtactgtgatcacccaagccccatcctccaataggcctattgtgccggtccctgggccttttccacttcttctgcacttgccgaatggccaaactatgccagtggcaattcctgccagtattacttctagtaacgtgcatgtgcccgcagcagttccccttgttagacctgtcacaatggttccctccgtacctggtattccaggcccaagctctccacagcctgtccagtctgaagccaaaatgaggttgaaagcagccctcacacaacagcatcctcctgtaactaatggggatactgtcaagggccacgggtccggccttgtgcgcacccagtccgaagaatctcggcctcaaagtttgcagcagccagcaacaagcactacagagacgcctgctagcccggctcatacgactccccaaacccaatctaccagtggacgccgaagaagagctgccaacgaggaccccgacgagaaaagaagaaagttcctggagaggaatagagcagccgctagtcgttgccgccaaaagaggaaagtctgggtgcagtcgttagagaaaaaagctgaggatctgtcctccttgaacggccagctccagtag

SEQ ID NO: 27211 - DNA, 1188 bp, Artificial Sequence
  Description of Artificial Sequence: Synthetic coding sequence
atgaaatttaagctgcacgtaaacagtgctcgacagtataaggacctttggaatatgtccgacgacaagccattcctttgcactgcaccagggtgcggacagcggttcacaaacgaagatcacctggccgtgcacaaacacaaacacgaaatgaccttaaagtttgggcctgcgaggaatgactccgtgattgtggccgaccagacaccgactcccacacgattcctgaaaaattgcgaggaagttggcttgtttaatgagctggcttcacctttcgaaaacgagtttaaaaaggcatccgaggacgacatcaaaaaaatgcctctagatttgagtcctctcgctacaccaattattagaagtaaaatcgaagaaccatcagtcgtggagacaacgcaccaggacagtccccttccccatccagagagcaccacgtccgatgaaaaagaggtcccactcgcccagaccgcccagccaacctcagctatagtaagaccagccagcctccaggtgcccaacgtgcttctgacatccagtgactcttcagttatcatccagcaggccgtgccaagcccaaccagcagtaccgtcatcacccaggctccttccagcaatcgacccatcgtgcctgtgccaggcccatttcccttgcttctgcacctgcctaatggccagaccatgccagtggccataccggcatcgatcacaagctccaacgttcacgtgcccgctgctgtgccactggtgcgccctgtgaccatggtaccttcagtgccaggcattcccggaccaagctcgccccagccagtgcagtctgaggccaaaatgagacttaaagctgctcttacccaacaacaccctccggtgaccaacggggatactgttaaagggcatggctcgggattggtcaggactcagagtgaagagagccgaccccagtcattgcagcagcctgcaacaagcaccactgaaactcccgcaagccctgcccacacaaccccccagacccaatccacatccggaaggagaagacgggcagccaatgaagatcccgatgagaagcggcgaaaattccttgagagaaatcgagccgcagcctcacgatgtcgacagaagaggaaggtgtgggtccaatccctggaaaaaaaggccgaagatctttcgagtctgaatggccaactgcaatag

SEQ ID NO: 27212 - DNA, 660 bp, Artificial Sequence
  Description of Artificial Sequence: Synthetic coding sequence
atgagtgatgataaaccttttctctgtaccgccccaggatgcgggcagcgatttactaacgaggaccatctggcagtacacaaacacaagcacgagatgaccctgaagtttggaccagccaggaacgacagcgttatcgtcgcagaccagacgccaacccctacaagattcttgaaaaattgcgaagaggtgggcttgtttaacgagttggcctcacccttcgagaacgagtttaaaaaagcttcagaggatgacataaagaaaatgcccttagatttaagcccgctggccacccctattattcgatccaaaattgaggagcctagcgtggtggaaacgacacatcaggattcgcccttgcctcatcctgagtctactaccagcgatgagaaagaagtccccttagcacagaccgcgcaacccacctcggcaatcgtgcgcccagccagtctgcaggttcccaacgtactcctgacttcatctgactcgagcgtgattatccagcaagcggtgcccagccccacgagcagcactgtaataacccaggctccctcctctaacaggccaattgtctcgttcgatcagtctccttggtgtctcgtgttccaagagtctcaggtgctgccgctgcccaatcagtattctcagaagcagaagtag

SEQ ID NO: 27213 - DNA, 1134 bp, Artificial Sequence
  Description of Artificial Sequence: Synthetic coding sequence
atgagcgacgacaaacccttcctctgtaccgctcccggatgtggccagcgcttcacgaacgaagatcatctggcagtacacaagcataagcatgaaatgactctgaaatttggcccagccaggaacgacagcgtgatcgtagcagatcagactccaaccccgacacggtttttaaagaattgtgaggaagttgggctcttcaacgagctggcctctccatttgaaaatgagtttaaaaaagccagcgaagatgacattaaaaagatgccgctggatctcagtcctctggcgacgcctattatcagaagtaaaatagaagagccttcagtggtagaaaccacacaccaggattctcccttgcctcaccccgagagtaccacttcagacgaaaaagaagtgcctctggcacaaaccgcgcagccaacttcagccatcgtccgacctgcctcactccaggtgcctaatgtactgctgacttctagcgactcctcagttatcatccagcaggccgtaccaagtccgaccagttccacagtgattactcaggcccctagctccaaccgccctatcgtgcctgtgccaggcccattccctctcctgctacacctgccgaatggtcagaccatgccagtggctatccccgcatcaattacctcctctaacgtgcacgtgcccgctgcggtcccactggtcagaccggtgacaatggtgcctagtgtccctggcatccctggcccatcctcacctcaaccagtccagagtgaggccaagatgaggttgaaggccgctctgacacaacagcatcctccagtaactaatggcgatacagtcaagggacatggctcgggattggttcgcacacagagcgaggagtcaaggccacaaagcctgcagcagcccgctaccagcaccacagaaacacctgcctcccctgcccataccactccccagacccagtccacaagtgggagaagacgcagagctgctaatgaggatccagacgaaaagaggagaaagtttctggaacgcaacagagccgctgcgagccgctgtaggcagaagcgaaaagtgtgggtgcagtccctggaaaagaaggccgaagatctgagcagcttgaatggccagctgcagtag

SEQ ID NO: 27214 - DNA, 1449 bp, Artificial Sequence
  Description of Artificial Sequence: Synthetic coding sequence
atgaagttcaagctgcatgtgaactcagcccgacagtataaagacctttggaatatgtccgatgacaagccatttctttgcaccgcaccgggttgtggtcagcggttcactaatgaagaccaccttgccgaccagactcctactcctactcgtttcctcaagaattgtgaggaggttggtttgttcaatgagttggcctcccccttcgagaacgaattcaagaaagcgagcgaagacgacataaaaaagatgccgcttgatttatccccacttgccactccgatcatccgctcgaagattgaagagcctagcgtggttgagaccacgcatcaagacagccctctccctcaccctgagagtacaacgtccgacgaaaaagaagtaccgctagctcagaccgcacagccgacgtccgccatcgttcggcctgctagcctgcaggtgccaaacgttctgctcacatcatccgactcttccgtcatcatccagcaggctgtgcccagccccacatctagtactgtcataacacaagccccttcatcaaatagaccaatagtgcctgtcccaggcccatttccgttacttctgcatctgcctaacggccaaacaatgcccgtcgccatccccgcttccatcacatcctctaatgtgcatgtgccagcggctgtacctttggtgcggccagttacaatggtcccgtccgtcccaggcatcccaggaccctcctccccccagcccgtgcagagtgaagccaaaatgagacttaaagctgccctcacacagcagcacccgccagtgactaacggtgacaccgttaagggacacgggagcggcttggtgcgtacccaatctgaggaatctcggccacagagccttcagcagcccgctacatcaaccactgagactccagcctctcccgcacatacaacacctcaaactcagtcaacctcagggagaagaagaagggccgcaaatgaggaccccgatgagaaacgcagaaagtttctcgagcgcaatcgcgcagccgcttcaaggtgtagacaaaagcggaaagtgtgggtgcagtcacttgagaagaaagctgaggacctgagcagcctgaacggccagttgcagagcgaggtcacactgttgcgcaacgaggtcgcacagcttaagcaattattacttgcgcataaggattgtcctgtgaccgctatgcagaagaagtctggctaccacaccgcggacaaggacgactctagtgaagatatatccgttccatcatcaccccacaccgaagcaattcaacattcctccgtgagtacatcaaacggagtgtcaagtaccagtaaagccgaggctgtggctacgtctgtcctgacccagatggcggatcagtcaacggagccagctctgagccagattgttatggcaccaagctctcagagtcagcctagtggcagctag

SEQ ID NO: 27215 - DNA, 2136 bp, Artificial Sequence
  Description of Artificial Sequence: Synthetic coding sequence
atgaagttgaaactcaacgtgctcacaatcatcctcctgccggtgcatctgctcattactatatattctgctctcatttttattccctggtactttctgaccaacgccaaaaaaaaaaacgctatggctaagcggatcaaagccaaacccacttctgataagccaggttccccctatagatctgtaacccatttcgatagcctcgcagttatagatatccccggtgcagatacactggataagctcttcgatcatgccgtttcgaaatttgggaagaaggattccctcggaactcgggagatcctcagtgaggagaatgaaatgcagcccaacggaaaggtgttcaaaaaactgatcctcggcaattataagtggatgaactacctggaagtgaaccggagagttaataattttggaagcggcctgactgcactgggtctcaagccgaagaacaccattgccatcttttgtgagacgagagctgaatggatgattgctgcacagacctgtttcaagtacaacttcccactggtcacactatacgccacactcggcaaggaggcggtggttcatggcctcaatgagtcagaggcatcctatttgatcacctccgtggaactgctggaatctaagctgaagacggcccttttagacatatcctgcgttaaacacattatctatgtggataacaaggctattaataaggctgagtacccggaaggttttgagatccactcaatgcagagtgtggaagaattggggtccaatccagagaacctggggattcccccatccaggccaactccaagtgacatggctatagtcatgtatacatctggatccaccggccgtccaaaaggtgtgatgatgcatcatagtaacttgatcgctggtatgacggggcagtgcgagagaataccaggactagggcctaaagacacatatatcgggtacctgccactggcacatgtccttgagctgaccgccgaaatatcctgttttacctacggttgtcgtattggctactctagccccttgacactgagtgatcaatccagcaaaatcaagaagggcagtaaaggagattgcactgtgctgaagcctacactgatggcagccgtgcctgaaattatggacagaatctacaagaacgtcatgagcaaggtccaggaaatgaactacatccagaaaacactcttcaagatcggatacgactacaagcttgagcaaatcaaaaagggctatgatgcccctttatgtaatctcttgttgtttaagaaggtaaaagccctgctggggggtaacgtgagaatgatgctgtcggggggagcccctctgagcccacagacacaccgattcatgaacgtctgcttttgctgtcctatcggccaaggctacggactgacagaaagctgtggcgctggcaccgtgacagaggtaaccgattacacgactgggagagtaggtgctcccttaatctgctgtgaaatcaaattgaaagattggcaggaaggcggatacaccattaatgacaagccgaaccctcgcggagagattgtcatcggcggtcaaaatatttccatgggatattttaaaaatgaggaaaaaactgcagaagattactccgtggacgaaaacggccagcgctggttctgcaccggggatatcggcgagtttcatccagatgggtgtctccagattatagaccgaaagaaagatttggtgaagcttcaggccggagagtacgtgtcattgggaaaggtcgaggccgctctgaagaattgtcctcttatcgataacatttgtgcatttgccaagagtgatcagtcctatgtaatctcatttgtggtgccaaatcagaagagactgaccctactcgctcagcagaagggagtggaaggtacctgggtagacatttgcaacaaccctgccatggaggccgagattctgaaagagattagggaagctgccaacgccatgaaactggagcggtttgagataccaatcaaggtgcggcttagcccggaaccttggacacctgaaacgggcctcgtgactgatgcatttaaactaaagagaaaggagttgcgtaaccactatctcaaggatatcgagaggatgtatggcggtaaatag

SEQ ID NO: 27216 - DNA, 2013 bp, Artificial Sequence
  Description of Artificial Sequence: Synthetic coding sequence
atggccaagcgcataaaggccaagccaactagtgataagcctggatctccttaccggagtgtgacacatttcgattctctggccgtgatcgatattccaggcgcagataccctcgataaactcttcgaccatgcggtgagtaaatttggcaagaaggacagtctcggcacaagagagattttatcagaggaaaacgaaatgcagcctaacggaaaggtgttcaagaagttgatcctggggaactataaatggatgaactacctcgaggttaatcgcagggtgaataattttggcagcgggctaactgcgttgggccttaaaccaaaaaatacaatagctatcttctgcgaaacccgcgcagaatggatgatcgcggctcagacatgctttaagtataatttcccactggtcaccctgtacgcaaccctgggcaaggaggctgtagtccacggtctgaacgagagcgaagctagttacttgatcacctcagtggagcttcttgaatctaagctcaaaaccgccttattagatattagctgtgtgaaacatatcatctatgtagacaataaagccattaataaagcagagtatcctgaagggttcgagatccattcaatgcagtcagtggaagaactagggagcaacccggagaatctaggcattcccccaagccgcccaaccccatctgacatggccatcgtcatgtacacgtctggttcaactggcagaccaaagggggtgatgatgcaccacagcaatcttattgccggtatgacgggccagtgcgagcgaatcccaggactcggtcccaaggatacctatattggatatctaccgttagcacacgtactggaattgacagcggagattagctgctttacctatggctgtcggattggttactcctccccacttacattgtcagaccagagttccaaaatcaaaaagggctccaaaggggactgcactgtcctgaagcccactcttatggccgcagtgccagagatcatggatcgtatttataaaaatgtaatgtcaaaggtgcaggaaatgaattacatccagaagacactgttcaagattggatacgactacaagttggagcagataaagaagggatatgacgctccattgtgtaacttgcttctgttcaaaaaggtcaaagccctgcttggcggaaacgtgaggatgatgctatccggtggagcacccctttcccctcagacacatcggttcatgaatgtgtgtttttgctgtcctataggtcagggctacgggttaacagaaagctgcggggcagggacggtgactgaggtgactgattatacaaccgggagagttggcgcaccactgatctgctgcgaaattaagttgaaagattggcaagaagggggttataccatcaacgacaaaccaaacccacggggagagatcgtgataggaggccagaatatttctatgggttatttcaaaaatgaggaaaaaacagcagaggactactctgtagacgaaaatggacagagatggttttgtacaggggatatcggtgagttccaccccgatggatgcctgcagatcatagatcggaaaaaggatcttgttaagctccaggccggagagtatgtgagtcttggaaaggtggaagccgcactaaagaactgcccactcatagataatatctgtgcttttgccaaatctgatcagtcctacgttatctccttcgtggtgcctaaccagaagaggctaaccctgttggcccagcagaaaggcgtggagggcacctgggtagacatctgtaataaccctgccatggaggcggaaatccttaaagaaatacgggaggccgcaaacgcgatgaagctagagcgttttgagatccccattaaagtgcggctcagtcctgaaccatggacccctgagaccgggttagtgaccgatgcctttaagttgaaacgcaaagagctgaggaatcactatctaaaggatattgagcgcatgtacggcggaaaatag

SEQ ID NO: 27217 - DNA, 2136 bp, Artificial Sequence
  Description of Artificial Sequence: Synthetic coding sequence
atgaaactaaaactgaatgtgttaacaatcatactgctgccagtccacctccttatcacaatttacagcgcactgatttttattccatggtattttttaactaacgccaaaaagaaaaatgcaatggccaagagaatcaaggcgaagcctaccagtgataagccaggatccccttatagatcagttacccattttgattccctcgcagtcatagatatcccaggggctgacacattagacaagctgttcgatcatgccgtaagcaaattcgggaaaaaggatagtttgggaacaagggagattctgagtgaagagaacgaaatgcaaccaaatgggaaagtgttcaaaaagttaattttaggcaactacaagtggatgaattacctggaagtcaatcgcagggtgaataatttcggtagcgggctcaccgccttgggtctaaaacccaagaacaccatcgctatcttctgcgaaacacgggcagaatggatgatcgctgcccagacatgctttaaatataatttccctcttgttacgctctatgctacattgggcaaggaggccgtagttcatggcctcaacgagtccgaggcttcttatcttattaccagtgtagaactgctggagagcaagctcaagactgctctgctggacattagttgtgtgaagcacatcatctacgtggacaacaaggccatcaataaggccgagtatcctgaagggttcgagatccacagcatgcagtctgtcgaggagctcggatcgaaccccgaaaatttaggcattcccccatcaagaccgacacccagcgatatggccatcgtcatgtatacttctgggagcaccggaaggccaaaaggggtgatgatgcaccacagcaacctcattgccggaatgactgggcagtgtgagaggatcccaggactggggcctaaagacacgtacattggctacctgcctctggctcatgtcctagagttgacggcggaaattagctgttttacttatggctgccggattggctatagttctcctttaacactcagcgaccaatcaagtaagatcaagaaagggagtaagggtgattgtactgttctaaagcccactcttatggccgcagtgcctgaaattatggatagaatttacaagaatgtgatgtccaaggtgcaggagatgaactatatccagaaaacactgttcaaaattggttatgattacaagctagaacaaattaaaaagggttatgacgcaccattatgcaatttgcttctctttaagaaggtgaaggcacttctgggcggaaacgtacgaatgatgttatctggaggggcaccactaagccctcagacacaccgtttcatgaacgtctgcttctgctgccctatcggacaaggttacggcttgaccgaaagctgtggagcgggaactgtgactgaggtgaccgattataccacgggtagagtcggcgctccacttatttgctgcgaaatcaagcttaaggactggcaagaggggggatacactattaatgataagcctaatcccaggggagagattgtcatagggggtcagaacatttccatgggctacttcaagaacgaagaaaaaaccgccgaggattattcagtcgacgagaatggccagcggtggttctgcaccggcgatatcggtgaattccaccctgacggctgtctccagatcatcgaccgaaagaaggacctggtgaaattgcaagcaggggagtacgtgagtttgggaaaggtcgaagctgctctaaaaaattgccccttgatagacaacatttgcgcctttgcaaaatccgatcagagctacgtgatcagcttcgtggtcccaaatcagaagaggctcactctgctggcgcagcaaaagggagtggaaggcacctgggtcgacatctgcaataatcctgctatggaggccgagatccttaaggagatccgagaggccgctaatgcgatgaaattagagagatttgaaatccccatcaaggtgcgtctgagtcccgagccctggacccctgaaacagggcttgtaactgacgccttcaagttgaagaggaaagagcttagaaatcactacctgaaggatatcgagagaatgtacggaggaaagtag

SEQ ID NO: 27218 - DNA, 165 bp, Artificial Sequence
  Description of Artificial Sequence: Synthetic coding sequence
atgaagctcaagctcaatgttctgactatcatccttctccctgttcacctcttgataaccatttattcggcattgatattcattccatggtacttcttgactaacgctaaaaagaagaacgccatggctaagcgaatcaaagccaagccaacatccgacaagtag

SEQ ID NO: 27219 - DNA, 438 bp, Artificial Sequence
  Description of Artificial Sequence: Synthetic coding sequence
atgaaactgaagcttaacgtgctaacaataatcctcctccctgtgcatctcctgatcacaatatattccgccctcatttttattccttggtacttcttgactaacgctaagaagaaaaatgctatggcaaaacgcataaaggcaaagccgacgagcgataagccaggttccccgtaccgttccgtgacccacttcgactcactggctgtgatcgatatccccggtgctgacaccctggacaagctgtttgatcacgccgtaagtaagttcggaaaaaaggatagcctgggaacgcgggaaatactaagtgaggagaacgaaatgcaacccaatggcaaggtatttaagaagttaatcttgggcaattataaatggatgaattacctcgaggtcaatcggagagttaataattttggcagcgggttgaccgctctctag

SEQ ID NO: 27220 - DNA, 381 bp, Artificial Sequence
  Description of Artificial Sequence: Synthetic coding sequence
atgaaactcaaactcaatgtactgactatcatacttctgccggtccatctccttatcaccatctactccgcgctgatctttatcccctggtatttcctgaccaacgcaaaaaaaaagaatgcaatggcgaaacgaataaaggctaaaccaacttccgataaacctggctctccctaccgttccgtcacccattttgacagccttgccgttatagatattcccggagctgacaccttggacaaactgttcgaccacgctgtgagtaaatttgggaagaaggacagtctcggaacccgtgaaattctttcagaggagaacgaaatgcagcctaatggcaaggtgtttaaaaagctgattctgggaaattacaaatggatgtag

SEQ ID NO: 27221 - DNA, 465 bp, Artificial Sequence
  Description of Artificial Sequence: Synthetic coding sequence
atggcgaagcgaatcaaggctaaaccaacctctgataaacccggttcaccttatagatctgtcacacacttcgattctctcgcagtgatagacatacccggtgcagatacacttgataaactctttgaccatgccgtctcaaagtttgggaagaaagactcacttggaacacgggaaatccttagtgaagaaaatgagatgcagcccaatggaaaagtgtttaaaaaactgatattaggcaactacaagtggatgaattatttggaggtgaaccgtcgtgtgaacaatttcggaagtggccttaccgctctcgggcttaagcccaaaaacactatcgcgatattctgcgagacacgtgccgagtggatgattgccgcacaaacctgttttaaatacaatttccctctggtgacgctttacgccacattgggcaaagaggcggttgtgcacggactgaatgagtag

SEQ ID NO: 27222 - DNA, 387 bp, Artificial Sequence
  Description of Artificial Sequence: Synthetic coding sequence
atgaaactcaaacttaatgtactgactatcatcctgctgcctgttcacttgctgattactatctacagtgctttgatattcatcccctggtacttcctgaccaatgccaagaagaagaatgctatggcgaagcgaattaaagcaaaacccacctcggacaaaccaggaagcccttatcgctccgtcactcatttcgactccctggctgtcatcgatattcctggagcagataccctggacaaactcttcgaccacgcagtgagtaaatttggcaagaaagacagcctcggcacgcgcgaaatcctgtcggaggagaacgaaatgcagcctaatggcaaagtgttcaagaagttgatccttggcaattacaaatggatgaattattag

SEQ ID NO: 27223 - DNA, 2475 bp, Artificial Sequence
  Description of Artificial Sequence: Synthetic coding sequence
atgcgtcagagcttactctttctcacttcagtcgtccctttcgtgctggccccacgccctcccgacgacccaggctttggacctcaccagaggttggaaaaactggacagtttgctgtccgactacgacattctctccctatctaatatccagcaacactccgtgcggaagagagatctgcagactagcacacacgtcgagacactcttaaccttcagtgcactaaagcgtcacttcaagctttacctcacatcatctacggaaaggttctctcagaattttaaagtggtggttgtagatggcaaaaacgagtccgagtatacggttaagtggcaggacttttttaccggacacgtcgttggcgaacctgactcacgcgtactggcccatatccgggatgatgacgtgataatcaggatcaatacggatggagccgagtataacatcgagccactctggaggttcgtgaacgatactaaagataagcgcatgctggtgtataagtctgaggatatcaaaaacgtgtcgcgtctgcagtcacctaaagtctgcggctatctcaaagttgacaacgaggaactgctcccaaaagggctcgtcgatcgggagcccccagaggagcttgtccaccgtgtgaagaggagggcagacccagaccctatgaaaaacacctgtaagctattggtcgtggcagatcataggttctatcgctacatgggtcgcggagaggagtcaaccaccactaattacctgatcgagctgatcgatcgcgtcgacgatatttacaggaacacaagctgggacaacgccggattcaagggttatggaattcagatcgagcagatccgaattctcaaatccccacaggaagtgaaacccggagaaaagcactataacatggccaagtcgtacccgaacgaggagaaagacgcctgggatgtcaagatgttgctcgagcagtttagctttgatatcgccgaggaggcaagcaaggtatgcctggcccatctcttcacataccaagacttcgatatgggcacccttggactcgcctacgtaggctcgccaagagcgaattcccatgggggagtctgtcctaaagcctattactcaccggtagggaagaaaaacatttacctcaactcgggactgacctccacaaagaattacggtaagaccatactgacaaaagaggcagacttggtgaccacacacgagttaggtcacaacttcggtgcggaacacgatccggacggtctggctgaatgtgcgcctaatgaggatcagggtggcaaatatgtcatgtatcccattgctgtcagcggcgaccatgaaaataacaagatgttctccaattgtagtaagcaatccatctataaaactattgaaagtaaggcccaggagtgcttccaagagaggtcgaataaagtatgcgggaattccagggtggacgaaggtgaggaatgtgacccagggatcatgtatttgaacaacgatacctgctgtaattccgattgtactcttaaagagggggtgcagtgctccgatcggaacagcccatgctgcaagaattgccagttcgagaccgcccagaagaagtgccaggaggccatcaacgccacctgcaaaggagtgtcatactgcacagggaattcatccgaatgccccccacccggaaatgctgaagacgataccgtatgcctcgacctcgggaagtgcaaggacgggaagtgtattcccttctgcgaacgggagcaacagcttgagagctgcgcctgcaacgagacagacaacagctgcaaggtgtgttgtcgcgacctcagcggacggtgtgtcccatatgtcgacgcagagcagaaaaaccttttcttacgtaaaggaaaaccttgcactgtcggattttgtgacatgaacggcaaatgtgagaaacgggtacaagatgtcattgagagattctgggactttatagatcagctttctatcaacacttttggtaagttcctggcagacaacatcgttggttccgttctggtattctcccttatcttctggatcccgttctccattctcgtgcactgtgtggataagaaactggacaagcagtatgagtcactgtcgttattccatccctcaaatgtggaaatgctcagttcgatggattcagcttctgtgcgaattattaaaccctttccagcacctcaaacccccggacgcctgcaacccgctcccgtgatccctagcgcacccgcagctccaaaactggaccaccagagaatggatacaattcaggaagatccgagtacagacagccacatggacgaagatggattcgaaaaagatccgtttcctaattcttccacagcagccaagtcattcgaagatttgactgatcatccagtgactcggtccgagaaggccgcttcttttaagttacagaggcagaatcgggttgactccaaagagacggagtgctag

SEQ ID NO: 27224 - DNA, 777 bp, Artificial Sequence
  Description of Artificial Sequence: Synthetic coding sequence
atgagacagtctctgttatttttgacatccgtagtccctttcgtcctggctccaaggcccccagatgaccccggattcgggcctcaccagcgtcttgaaaagctagattccctactctcagattacgatattctaagccttagtaacatccagcagcattctgtaagaaagagggacctccaaacatcaactcatgtggaaaccctactcacattttcagccctgaagaggcactttaagctgtacctgacctcatccacggagagattttctcaaaatttcaaagtcgtcgttgttgacggcaagaacgaatcagaatacactgttaaatggcaggattttttcacgggtcacgtcgtgggcgagccagacagcagggttttggcccacataagggatgacgatgtgattattcgaatcaacaccgatggcgctgagtataatattgagcccctttggcggtttgtgaatgacaccaaggataaaaggatgctggtttacaaatctgaagatatcaagaacgttagccgtcttcagagtcctaaagtctgcggctatttaaaagttgataacgaggagttgctgccaaaagggctggtggatcgggagcccccagaggagctcgtgcatcgggtgaagcggagggcggaccccgaccctatgaagaacacctgcaaactgctggtcgtggccgaccatcgcttttatcggtacatgggtcgcggagaggagtctactaccaccaactatttgatccatacagatagggccaactag

SEQ ID NO: 27225 - DNA, 2499 bp, Artificial Sequence
  Description of Artificial Sequence: Synthetic coding sequence
atgaagccccctggcagctcctcaaggcagcctccattggctggttgctcattagcaggcgcttcatgcggcccacaaagagggcctgcaggctccgtgcctgcttccgcgccagcaagaacgcccccatgccgacttctgctggttctgttgctattgccaccactggccgcaagctcacgaccacgtgcgtggggcgctgctgcaccaagcgcaccacactggaatgagacagccgaaaaaaatttgggagtattagcggacgaggacaataccttacaacaaaatagcagttctaacatctcctactccaacgccatgcagaaagaaattacgttacccagccggctcatctactacatcaatcaggactcagaatctccatatcacgtgctggacacaaaagcgagacaccaacagaagcacaacaaagcagtccatctggcccaagcttctttccagatagaggcattcggatccaaattcattctcgatttaatcctgaataatggcctcctctcatctgactatgtcgagatccactacgagaacggaaaacctcaatatagcaagggcggagaacactgttattatcacgggtcaatcaggggtgtgaaggactcaaaagtggccctttcaacctgcaatggcttacatggcatgtttgaggatgatacattcgtctacatgattgaaccactggagctagtccacgatgagaagagtaccggacggccacatatcatccagaaaacactggcgggtcagtattctaagcaaatgaagaacctgaccatggaaagaggagaccaatggccatttctgagcgagctgcaatggcttaaacgtaggaagcgggctgtgaatcccagcaggggtatttttgaagagatgaagtacctggaattgatgatcgtcaatgaccacaaaacctacaaaaagcaccgctcttcacatgctcatacaaataacttcgcaaaaagcgtggtcaacctggtggacagtatctataaagaacagctgaacacacgggttgtgctggttgccgttgagacctggacagaaaaagaccagatagatattactaccaacccagtgcagatgctccatgaattttcaaagtatagacaacgcataaaacagcacgccgacgccgtccacctgattagccgagtaaccttccactataaacggtcctcactgtcatactttggtggagtatgttcccgtactcgcggagtgggggtgaacgagtatggactccccatggcagtagcacaggttttatcccaatccctcgcacaaaatctgggcattcagtgggaaccgtcaagccgcaaacccaagtgcgattgcacagaatcatggggaggatgtattatggaggaaaccggggtaagccattcaaggaaatttagcaaatgctctattcttgaatatagggatttcctgcagaggggaggaggggcatgcctgttcaaccgacctactaaattgttcgagccaacggagtgcgggaacgggtacgtggaagctggtgaggagtgcgactgtggttttcacgtcgagtgctacggtctctgctgcaagaaatgcagtctaagcaatggtgcacactgtagcgatggcccatgttgtaacaacaccagctgtctgttccaacccagagggtacgagtgcagagatgcagtaaatgaatgtgacatcaccgagtactgtactggtgatagcggacagtgtccacctaacctccacaaacaggatgggtatgcctgcaatcaaaatcagggacgctgctataacggcgagtgtaagactcgggataaccaatgccagtatatctggggtacaaaggcggcagggagcgacaaattctgctacgagaagttgaatacggagggaacggaaaaggggaattgtgggaaggacggcgatcgatggatccaatgctccaagcacgatgtcttctgtggattcctgctttgtaccaacctgaccagggctcctaggattggccagctccaaggagaaataattccaacctctttctaccaccagggcagagtgatcgactgcagtggcgctcacgtcgtcctcgacgacgataccgatgttggctatgtggaggacggcactccttgtggaccaagtatgatgtgcctggacaggaaatgcctgcagattcaggctctgaacatgtctagctgtccacttgactccaaagggaaagtctgctccgggcacggcgtgtgcagtaacgaagctacttgtatatgcgacttcacttgggccggaactgattgctccatccgagatcctgtgcgaaacctccacccaccaaaggacgagggaccgaagggaccatcggcaacaaacttgatcattggcagtattgctggcgctattcttgtggccgctatagtccttggaggtaccgggtgggggttcaagaacgttaagaagagacgcttcgaccccacccagcagggcccaatttag

SEQ ID NO: 27226 - DNA, 2499 bp, Artificial Sequence
  Description of Artificial Sequence: Synthetic coding sequence
atgaagcccccaggatcttcgtctaggcagccaccgctggcgggatgttcacttgccggtgcgtcatgtggacctcaaaggggccctgccggatctgtccccgcatctgctccagctcgcacacctccgtgcaggcttctgctcgtcttgctgctgcttcctccactggccgctagttcgcgccctcgcgcttggggggcagctgccccttctgctccccactggaatgaaaccgcagagaagaacctgggggtcctcgccgacgaggataacacactgcagcagaatagctctagtaacatttcctatagtaacgctatgcagaaggaaatcaccttaccttccagacttatttactatattaatcaggacagcgagtcgccctatcatgtgttagatacgaaggctcgacatcagcaaaagcataacaaggctgtccatctcgcccaagcaagcttccagattgaagcatttggctcaaaatttattctggatctgatcctgaacaatggcttgctgagttcggactatgtagaaatccactacgagaatggcaagccccagtactccaaaggcggtgaacactgctattaccacggatcaattagaggagtcaaggattccaaggtggcactgtctacttgtaacggtctgcatgggatgtttgaggacgataccttcgtgtacatgatagagccactggaactagtccacgacgagaaaagcacagggcgtccacatatcattcaaaagacactagccggacagtattctaagcagatgaagaatcttacaatggagcggggtgaccagtggccctttttgagtgaattgcagtggcttaaacggagaaagagagccgtcaacccatctaggggcatattcgaagagatgaagtacctggagctcatgatcgtgaatgatcacaagacctataagaagcacagatcttcccatgcacatacaaacaacttcgcaaagagcgtggtgaacttggtggattcaatctacaaagagcagctaaacacgcgcgtcgttctggtggctgttgagacttggacagaaaaggaccagattgatattactacaaatcctgtgcagatgctacacgaattcagcaaatatagacagcgtatcaagcagcacgctgacgccgtgcacttgatcagccgggtgaccttccattacaaaagaagcagcctgtcttattttgggggtgtgtgtagtcgcacacgtggggtgggagtcaatgaatatggtcttccaatggcagtggcccaagtcttatcccaatctctcgctcagaatctgggcattcagtgggagccatcgagcaggaagcccaagtgcgactgcacagagagctggggcggttgtatcatggaggaaactggggtctcccactcaagaaagttttcaaagtgctccatcttagagtacagggactttctgcaaagagggggtggggcatgtctgttcaaccggcctacgaagctgttcgaaccaaccgaatgcgggaatggatacgtcgaggcaggtgaagaatgtgattgcggattccacgtcgaatgctacggtttgtgctgtaagaagtgtagcctttctaatggagcacattgctctgatggtccatgctgtaataatacctcgtgtctgtttcagcccaggggctatgagtgccgagatgctgtcaacgaatgcgacataaccgaatactgtactggagacagtggacagtgcccaccaaacctgcacaagcaagacggttacgcgtgcaaccagaatcaggggcgttgctataacggtgaatgcaagaccagagacaaccagtgtcagtacatctgggggaccaaggccgcagggtctgacaagttctgttacgagaaacttaacaccgagggcaccgagaagggaaattgtggaaaggatggggatcggtggatccagtgctctaagcacgatgtgttttgtggtttcctgctgtgtacaaaccttaccagggcgcctagaatcggccagttgcagggcgaaattattcccacgtcattctaccaccagggcagggtgatcgattgctctggagcccatgtcgtccttgacgacgacacagacgtgggatacgtcgaagacggaaccccatgtggcccaagcatgatgtgtctagatagaaagtgcctgcagattcaggcgctgaatatgtcctcatgcccactggacagcaaggggaaagtttgcagcgggcacggtgtgtgcagcaacgaggccacatgcatctgtgactttacatgggccggaacagattgctccataagagaccctgttcgcaatctgcatccccctaaagacgaaggcccaaaggtcaacatggcaacctccaggttgataggagccgtagccggtactattcttgctctcggggtgatattcggcggaacgggttggggcatcgagaatgtaaagaagcggagatttgatccaacccagcaggggcctatttag

SEQ ID NO: 27227 - DNA, 2499 bp, Artificial Sequence
  Description of Artificial Sequence: Synthetic coding sequence
atgaaacctcccggaagttcaagtcggcaaccccctttggcaggatgcagtctggccggagctagctgtggtccccagcgcggtcccgctggttccgtgccagcgtcagcgccagcacgtactccaccttgtaggttgcttctggtgctccttcttctgccaccccttgcggcaagctctaggcccagggcctggggcgctgccgcaccgagtgcccctcattggaatgaaaccgccgagaaaaaccttggggtattagctgacgaggacaacacactccaacaaaactcaagctctaacatctcatattccaacgctatgcagaaagagatcacccttccgtccaggctgatctactacatcaatcaggactccgaaagcccctaccatgtgctggatacgaaagctcgccaccagcaaaagcacaacaaagccgtacatctggctcaggcctcatttcagattgaagcatttggttctaagttcattcttgatctaatactgaacaacgggttactgtccagtgattatgtcgaaatccattatgagaacggtaagccccagtactctaaagggggtgaacactgctactatcacggttccatcagaggggtgaaagacagtaaggttgctttgtcaacatgcaatggcctgcacggaatgtttgaggatgacacattcgtgtatatgattgagcctctggagctggtacacgacgagaagtctactggcaggcctcacatcatacaaaagactctggctggtcagtactctaagcagatgaagaacttaactatggagcggggagatcagtggccctttctgtccgagctgcaatggctgaagagacgaaagcgagccgtcaacccttcccggggaatttttgaagaaatgaagtacctcgaattaatgatcgtgaatgaccataagacctataaaaagcaccggagctcccacgcacacacgaataattttgccaagtcagtggtcaatcttgtcgattcaatatataaggagcaattgaacacaagagttgtactggtagccgttgagacgtggaccgagaaagaccagatcgacatcactaccaaccccgttcagatgttgcacgaattcagtaagtaccgtcaaagaataaaacagcacgcagacgctgtgcacctgatttctcgcgtcacctttcactataagcggtcaagcctctcttatttcggtggcgtgtgctcaagaaccagaggggtcggagtcaacgaatatgggctaccaatggcagtcgctcaggtgctcagtcaatcactcgctcaaaacctaggcatccagtgggagccctcatcacgcaaacccaaatgcgattgtaccgagtcctggggtggctgcatcatggaggagacaggagtgagtcattcccgcaagttttccaaatgttcaatcctggaatacagggacttcctccagagaggcggtggggcttgtttatttaatcgaccgacaaaactgtttgaacccacagaatgcgggaatggatatgtggaggcaggcgaagagtgcgactgcggcttccacgtcgaatgctatgggctgtgttgtaaaaagtgctcactctctaatggcgctcactgtagcgacggaccctgttgcaacaacacatcttgtctcttccagcctaggggatatgaatgcagagacgcagtgaacgaatgcgacattaccgagtattgtaccggggatagcggccagtgtcccccaaaccttcataaacaggacggctacgcttgtaatcagaatcaggggagatgctacaacggtgagtgtaagacccgcgacaaccagtgtcagtatatatggggtactaaggcggcaggctctgacaagttctgttacgagaaactcaatactgaggggaccgaaaagggaaactgcggaaaagacggtgaccgctggattcagtgtagtaaacacgacgtgttctgcgggtttctgctctgcactaaccttacacgcgctccacggattggccagctgcagggagaaataatcccgactagcttttaccaccagggtcgggttattgattgtagtggagcccacgtcgttctggatgatgatacggatgttggctacgtagaggatggaactccttgtggccctagtatgatgtgcctcgacaggaaatgtctacagatacaggcactgaacatgagttcttgtcctttagactcgaagggtaaggtgtgctctggccatggcgtgtgttctaacgaagctacatgcatatgcgatttcacatgggccggaactgactgctccattcgggacccagtccgtaatctacatccgccaaaggacgaagggcctaaggagatgtcccggcgagaagggtccattctcttaagtaaagccccttctgagagcgccgcactggacggccacaggctagcactgctagacagcggatacgacatcctcgccgcagtgctgctggagctgttatccctgtag

SEQ ID NO: 27228 - DNA, 2100 bp, Artificial Sequence
  Description of Artificial Sequence: Synthetic coding sequence
atgcagaaggaaatcaccctgccatctcgactcatctattatatcaaccaggattccgagtctccatatcacgttctagacactaaggccaggcatcagcagaaacacaacaaagccgtgcacctagcccaggcttctttccaaattgaagcatttggatctaagttcattcttgacctcatcttaaacaacggtcttcttagctctgactacgtggaaattcattatgagaatggaaagccccagtattcaaaaggcggagagcattgctattaccacggatcaatccggggagtcaaggatagtaaagttgctctctctacatgcaatggccttcatggtatgttcgaagacgatacattcgtgtatatgatcgagcccctagagctagtccacgacgagaaatccaccggccgacctcacataattcaaaaaacgctggcgggacagtatagcaagcagatgaagaacctcacaatggagagaggggatcaatggccctttctttccgagctgcagtggctaaagagacggaagagggccgtcaatccttcccgaggcatctttgaagagatgaagtatctggagctgatgattgtgaatgatcataaaacttacaagaagcatcgttcaagtcacgcacacaccaataactttgcgaagtcggtagttaacctcgtggacagcatttacaaagagcagctaaacacaagggtggtcttggtggccgtagagacctggacagaaaaagatcaaatcgacatcacgactaaccctgtccaaatgctccacgagtttagtaaataccggcaacgcatcaagcagcacgccgacgctgtgcacctgatttccagagtcacatttcattacaagaggtcctcgttgagctactttggaggagtctgctctcgtacccgaggtgtgggggtaaatgagtatggactgcccatggccgtggcacaagtgctcagccagagtctcgcacagaacctgggcatccaatgggagccgtcctctagaaagccaaaatgcgactgcactgagagctggggaggttgtattatggaagaaactggtgtgtctcactccagaaagttttccaaatgtagcattttagaatatcgggactttctgcagcgcggtgggggtgcctgcctctttaatagacccaccaagctgttcgaacctacagagtgcggaaacggctacgtggaggctggtgaagagtgtgactgcggcttccacgtcgaatgctatggcttatgttgtaagaagtgctccctgtctaacggagcccactgttcagatgggccttgttgtaacaatacgtcgtgtctgttccagcccagagggtacgaatgtcgggatgcagttaatgaatgcgatatcactgagtattgtaccggcgattccggtcagtgtcccccaaacctgcataaacaggatggctacgcttgcaatcaaaaccagggcagatgttacaatggggaatgcaagacgcgcgacaatcagtgtcaatatatatggggcaccaaagccgctggctctgataaattctgctatgagaagctgaacaccgaaggcactgaaaagggtaactgcgggaaagatggcgaccgatggatccaatgcagcaaacacgatgttttctgtggttttttattgtgtactaacctgacccgggcaccaagaatcggccagctacagggggaaattatacccacatcattttaccaccagggccgtgtgattgactgttccggcgctcacgttgttctggatgacgacactgatgttggttatgttgaggacggcaccccgtgtggacccagcatgatgtgcctggacagaaaatgcctacagatccaggctctcaatatgtcttcgtgccctttagattcaaaggacgagggccctaaagcctgttttctaaagcgaactaagtgtaaatcttatcctaaacataggaagtgccaggaggaaaaggtcagatcttatagtgcacgccctcacctcaatcagttacggtggatggacacagctctgcattgttggatcttgggcatgacgtattcccagcagtgctattggaactattag

SEQ ID NO: 27229 - DNA, 324 bp, Artificial Sequence
  Description of Artificial Sequence: Synthetic coding sequence
taacagatccaggccctgaacatgtcctcctgcccactggacagtaagggaaaagtgtgctccggccatggcgtatgttctaatgaggccacatgcatttgcgattttacttgggccggaactgattgttccattcgggacccagtccgcaaccttcaccctcccaaggacgaggggcctaaggaaatgagcaggcgggagggatccattcttctttccaaagcgccttcagagagtgccgcactggacggacacagattagctctgttagatagtggatatgatattctggccgcagtgcttttggaactgctctctctgtag

SEQ ID NO: 27230 - DNA, 8532 bp, Artificial Sequence
  Description of Artificial Sequence: Synthetic coding sequence
atggctgcagcctcatatgatcagttgctgaagcaggtggaagcactgaagatggagaacagtaatttgcgccaagaactggaggataactcaaaccacttgaccaaactcgagacagaagccagtaacatgaaggaagtacttaaacaacttcagggttccatcgaggatgaggctatggccagtagcggccagatcgacctccttgaaaggctcaaggagctgaatctggattctagtaattttccaggggtaaagttaaggagcaaaatgagtctgagatcgtacgggagcagagagggctcggtttcatcgcgctcaggcgagtgttcaccagtgccaatgggatcttttccccgaagggggtttgtgaacggctctagagaatccaccggctacctcgaggaattagagaaagaaagatcactgctgctggcagacctagataaggaggaaaaggaaaaagactggtactacgcccagttgcagaatctcaccaaaagaatcgactctttgcctcttaccgagaatttcagcctacaaactgacatgaccaggaggcaacttgagtatgaagccaggcaaattagggttgcgatggaagagcagctgggtacttgccaggatatggagaagcgagcccagcgtaggatcgcaaggatacagcaaatagaaaaggacatccttcggatcaggcagcttttgcagtcgcaagcaacagaagcggaacgaagctcacagaacaagcacgagacaggcagccatgatgcggagcgacagaatgaaggccagggagtgggcgagataaacatggccacctcgggcaatggccagggtagcacaacaagaatggatcacgaaacagcgtcagtgttatcatcgagttccactcacagcgctcctcgtaggttaacctctcatctaggaacaaaagtcgaaatggtctacagtctacttagcatgctggggacacatgataaagacgacatgagcagaacgctattggcaatgagttcctcacaggatagctgcatttccatgagacagtccggttgtctccctttactgatccagttactgcacggcaatgataaggattccgtgttactaggtaacagtagaggatccaaagaggctagggcaagagcaagcgccgctcttcacaacataattcattcacagccggacgacaaaaggggcagaagggagatccgggtacttcatctactggagcagatacgggcttactgcgagacctgctgggagtggcaggaggcacatgaacctgggatggaccaggacaagaaccctatgcccgctcccgtagagcatcagatatgtccggcagtctgcgtgcttatgaagctgtcattcgatgaagagcaccggcatgctatgaatgagctgggcggtctccaggcaatagccgagttgttgcaggtggattgtgagatgtacggtctgaccaatgatcactatagcatcaccctgcgcagatatgccggaatggctttaacgaatctcaccttcggggacgttgcaaacaaagccaccctgtgctcgatgaaagggtgtatgcgagcgctggttgcccagctcaagtctgaatccgaagatctgcagcaggtcatagcttctgttctgaggaacctttcttggcgggctgatgtcaactcaaaaaagaccctgcgtgaggtgggtagcgtcaaagctcttatggagtgcgcgttagaggtcaagaaagagagtaccttgaagagcgtcctgtctgcgctgtggaacctcagcgctcactgtactgaaaataaggcagacatttgcgcagtagatggcgcactcgcgttccttgttggcaccctcacttataggagccagacaaacaccttggccattattgaatctggcggaggaatcctaaggaatgtgtcctccctgatcgccacaaacgaggatcacaggcagatcttgcgagagaataattgtctccaaactctcctgcaacatttaaaatcccactcgctcaccatagtgtccaatgcatgtggcacactgtggaatcttagcgctagaaatccaaaggaccaagaagcattatgggacatgggcgctgtcagtatgctcaaaaacttgattcactccaagcacaagatgattgctatgggctctgccgctgccctgagaaacttgatggcaaaccgtcccgctaagtacaaggacgcaaatattatgtcccccggaagctcactgccgtcacttcacgttaggaagcaaaaggcactcgaagccgagttggacgctcagcacctcagcgagacgttcgataacatcgacaacctgtcgcccaaggcttcccatagatcaaaacagcgccataaacagtccctgtacggagactatgtgttcgataccaatcgacacgatgataaccgcagcgataattttaacaccggtaacatgactgtcttgagtccgtatctcaacaccacagtactgccgtcctcttcatcgtctcggggatcccttgactcttcccgaagtgagaaggacagaagccttgagcgggagagggggattggtctgggcaattatcaccccgcaaccgaaaatccagggacaagtagtaagaggggcctgcagataagcacaactgctgcccaaatcgctaaggttatggaggaagtgtccgccattcatacttcgcaggaggatcgctccagcggtagtacaactgaattgcactgtgtcaccgacgagcgcaatgctctccgtaggtctagtgccgcacacactcactctaatacatataacttcaccaagtccgagaacagtaaccgaacgtgttctatgccttatgcaaaactagagtataagaggtcgtcgaacgattccttgaattctgtttctagcagtgacggctacggcaagcgtggacagatgaagccatccattgagagttacagcgaagacgacgaatcaaagttttgtagctatggccaataccctgccgacctggcccataagatccattcagccaatcacatggacgataatgatggcgagctcgatactcctattaactattccctcaagtatagtgatgagcagctcaacagcggtaggcaatccccttcccagaacgaacgatgggctagacccaaacacattatagaggacgagattaaacagagtgaacagcgccagtcccgcaaccagagcactacttatccagtctatacagagtcaaccgacgacaagcacctaaagttccagcctcactttggacaacaggagtgcgtgtccccctataggagccgaggtgccaacggctcagaaactaatagagtgggcagcaaccacgggatcaatcagaacgttagtcagagcctttgccaggaagatgattatgaggacgacaaacccactaactattccgagcggtattctgaagaggagcagcacgaggaggaggagcggccaaccaactactcaattaagtataacgaagagaagcgacatgtcgaccagccaatcgactacagtcttaaatacgccacagacattccaagtagccagaaacaaagttttagctttagcaagagcagctccggtcaatcgtcaaaaaccgaacatatgtcaagctcttcagagaatacgtccacccccagcagtaatgccaagagacagaaccaactgcatccttcgtctgctcagagccgttcaggacagcctcagaaagccgctacatgcaaagtttcatccatcaaccaagagactattcagacctattgcgtcgaggacacccccatttgtttcagccgctgtagctctctgagctcactgtcatctgccgaggacgaaataggatgtaaccagacgacccaggaggccgactcggccaatactttgcagatcgccgaaatcaaggaaaaaataggcacgcgctcggcagaggaccccgtgagcgaagttcccgcagtttctcaacatccaagaaccaagtcttcacgcctacaggggagttccctgtcatcagaatccgcacggcataaagccgtcgagttctctagtggtgcaaagtctcccagtaagtcaggggcacagactccaaagtcccctcccgaacattacgtgcaggagacgccactgatgttttctcgatgtacgtcagtgagcagcctggattcctttgagtccaggagcatcgccagcagtgtgcaaagcgagccctgtagcggaatggtgtccgggatcattagcccttcggaccttcccgactcgccagggcaaaccatgcctccttcccgctcgaaaacacctcctcctccacctcagaccgcacagaccaaacgcgaggttcctaaaaataaggctccgaccgcagagaagcgtgaaagcggccctaagcaggccgctgtaaacgctgctgtgcagcgtgtgcaagtgcttccggatgccgatacgctcttacatttcgctacagagagtacccccgatgggttctcttgcagctcgtctctgtccgccctctcactggatgagccgtttattcagaaagatgtggaactaaggatcatgccgcctgtgcaggagaacgacaacggcaatgagaccgaatcagaacagccaaaagagagtaatgaaaatcaggagaaagaagccgagaagacgattgatagtgagaaggacctgctggatgactcggacgatgatgacatagagatactggaagagtgcatcatcagcgctatgccaaccaaatcctctaggaaggccaaaaagccagcacagacagcatcgaaattgcccccacctgtggcacggaaaccaagccagctgccagtgtacaagttgcttccttcccagaacaggctccaaccacagaagcatgtgagcttcacgccaggagacgacatgccacgggtgtactgcgttgaaggcactccaattaatttttcaacagccacttctctctcggacctgactattgagtccccccctaatgaactggctgcaggcgagggcgtccgcggaggcgcacagtctggcgaatttgagaagcgtgatacaattcccacggaagggagatctaccgacgaggcgcagggcggaaagacaagttcagtgaccattcccgaactcgacgataataaggcagaggaaggagacatcctcgcagaatgcattaacagcgctatgcccaaggggaagagccacaaaccattccgagtaaagaaaatcatggaccaggtgcaacaagccagcgcctcctcctctgcccctaacaaaaaccagctcgacggaaagaaaaagaagcccacctccccagtcaagccaattccccagaacaccgaataccgaacacgcgttaggaagaacgccgacagtaaaaataatttgaatgccgagcgcgtgttctccgacaataaggattccaagaagcagaaccttaagaataacagcaaagtctttaatgataagctgccgaataatgaggacagagtgcggggtagcttcgcgttcgatagcccgcatcactacactcccatagaaggcacaccttactgtttctcacgtaatgattccctgtcttccttggattttgacgacgatgacgtggacctgtccagagagaaagccgagctgagaaaggccaaggaaaataaggagagcgaagccaaggtaacaagtcacacagagttgacatcgaatcaacaatccgcaaacaaaacccaggcaatcgctaagcaacccataaatagggggcagcctaaaccaattctgcaaaagcagagtactttcccccagtcctctaaagatatacccgaccgcggtgccgcaactgatgagaaacttcagaatttcgccattgagaacaccccagtctgtttctcccacaattcatccctatcaagcctcagtgatatcgaccaggagaataataataaagaaaatgagccaattaaggaaacggagccaccggatagtcagggcgaacccagtaaaccacaggccagtgggtacgcccctaaatcatttcacgtggaagataccccagtgtgttttagtaggaatagctccctctcatccctcagcatcgactcagaggacgacttgctgcaggaatgcatcagtagcgcaatgcccaagaagaagaagccatcaagattgaagggcgataacgagaaacatagtcccagaaacatgggcggaatactgggcgaagatctcaccctcgacctgaaggatatccaacgcccagacagtgagcatggacttagccccgattctgaaaattttgattggaaggccatccaagagggtgccaattcaattgtttcttcacttcaccaggctgcagcagctgcctgtctatcacgacaggcctcatcggacagcgactcgatcctgtcccttaagagcggcattagcttaggctcgccttttcacctcactccagatcaggaggaaaaacccttcacaagcaacaagggcccacgtattctaaaaccaggtgaaaagtccacattggaaaccaagaagatcgagtcagagagtaaggggattaaggggggaaaaaaggtttataagtccttgattactggcaaagttcgctcaaactcagaaatttcgggccagatgaagcagcctttacaggcaaacatgccatcaatttctcggggaagaacaatgatacacatcccgggtgtgcggaacagctcctctagcacctctccagtgagcaagaagggaccacctctgaagaccccggctagtaagtccccttctgaggggcagaccgccacaacctcaccaagaggggcaaagccctctgttaagtccgagctctcccccgtggccagacaaaccagccagattggcggttcctcaaaagctccctccaggagtggcagcagggacagcactccaagccggccagcgcaacagcctctcagccgccctatccaatcacccggaagaaactccatcagtcctgggagaaacgggatttctcctcctaacaagctctcacagctgcctaggaccagtagtccatcgaccgcttccacaaagtcctcgggcagtggcaaaatgagttataccagcccaggacgccaaatgtcacaacaaaatctgactaagcagaccgggcttagtaaaaatgcgagctcgatcccccgttccgaatccgcctccaaagggctcaatcagatgaacaacggcaacggggcaaataagaaggtggaactttcccggatgtcatctaccaagtcctctggcagcgaaagcgaccgatcagaacgtcctgtgcttgttcgccagtctacatttataaaagaggctccttctccgacgcttcgcagaaagcttgaggagtcagcctcatttgaatcgctgtctccgagttccaggccagccagccccactcgttctcaggctcagactcccgttctgagcccatccctgcccgatatgtcactaagtacccacagctccgtccaggccggtgggtggagaaaacttccacctaatttgtcccccacaatcgagtataacgatggcagacctgcaaaacgccacgatatcgcacggtcgcactccgagtcgcccagtcgcctgcccattaataggagcgggacttggaagcgcgagcacagcaagcactccagctccttaccgagggtgtccacgtggcggcgtaccggatcttcatcctctattctctccgccagctcagaatctagcgaaaaggcaaagtccgaggatgaaaagcacgtgaatagcatcagtggaactaagcagtccaaagagaaccaagtctcagctaaggggacttggcggaagattaaggaaaatgaattcagtcctacaaattccacctcacaaacagtgagctctggcgcaaccaacggcgctgaatccaaaacccttatctatcagatggcccctgccgtgtcgaagacagaggacgtgtgggtgagaatagaagattgccccataaacaatcctaggtccggacgcagcccaactgggaacactcctcctgtgattgacagtgtgagcgagaaggccaaccctaacataaaagacagtaaggataatcaggccaagcagaatgtaggtaacgggtctgtccccatgcgcaccgtaggactggagaatagactcaactcatttattcaggtggacgcccctgaccagaagggaactgagataaagcccggacagaacaatccagttccagtctctgaaacaaacgagagcagcatcgtggagcgaacgccatttagcagttcatccagtagcaaacactcttcaccttccggtactgtggccgctcgcgtgaccccattcaactacaatccatccccaaggaagtccagtgctgactcgacgtctgcaaggccctctcaaattcccacacccgtgaataacaacaccaaaaaaagggatagtaaaaccgactccacagagagttcaggcactcaaagcccaaagaggcacagcggttcatacttggtgacctcagtctaa

SEQ ID NO: 27231 - DNA, 8531 bp, Artificial Sequence
  Description of Artificial Sequence: Synthetic coding sequence
atggccgctgctagctatgatcagctgctgaagcaggtagaggcgttgaagatggagaatagtaacctacgccaagaacttgaagataattccaaccatctcaccaaactggagaccgaggctagtaacatgaaggaggttctaaagcagctacagggttcgatcgaggatgaagcaatggcctcttcagggcaaattgatcttctcgaacggctcaaggagttaaatcttgatagttctaactttcccggtgtgaagctgaggtcgaagatgtctctgcgatcatacggttccagggaaggatctgtctcctctcgctccggtgagtgcagcccggtgcccatgggctcatttccaaggaggggatttgttaacggtagccgggaatctactggctacctggaagagttggagaaagaaaggagtctgttactggccgacctagacaaggaggagaaggagaaagattggtattacgcgcagctccagaatctgacaaaacgcatcgactcactccccttaaccgagaatttcagtctgcagaccgatatgactcggaggcagctggaatatgaggcccgtcagatccgggtcgccatggaggagcagctggggacatgccaagacatggagaaacgagctcagcggcgaattgccaggattcaacagattgagaaggatatcctgcggatccgacagttgttgcagtcccaggccaccgaagcagagcggagctctcagaataaacacgagactggaagccatgatgcggagaggcagaatgaaggccaaggggttggggagatcaacatggccacatcagggaatggccagggaagcacaaccagaatggatcacgaaaccgccagcgtgttgtccagcagctctacacatagtgcacctcgaagattaacaagccacttgggaacaaaagtcgagatggtgtactcattactgagcatgctaggcacacatgacaaggatgatatgtcaaggacgctgttggcgatgtcttctagccaagactcatgcattagcatgcgacagtctggctgccttcctttactgatccaactgttgcatggcaacgacaaagattcagttctcttgggaaattctagggggagtaaggaagcaagagcacgtgcttccgctgcactgcataacatcatccacagtcagcccgacgacaagaggggcaggcgggaaattcgggtcttgcatctgcttgaacagataagggcttactgtgagacctgctgggagtggcaggaggctcatgaaccaggtatggaccaggacaagaatccaatgccagctcctgtggagcatcagatatgtccagctgtgtgcgtgctgatgaaactgtctttcgatgaagaacaccggcatgcaatgaatgagctgggcggactccaggctatcgcggaactgttacaggttgactgcgagatgtacggactgaccaatgaccactattccatcaccttacgacggtacgcgggaatggctctcacaaatctgacgttcggagacgtcgctaataaagccaccctgtgtagcatgaagggatgtatgcgcgctctggtggcccagctgaagtccgaaagcgaggatctccaacaggtcatcgcctcagtactccggaacttatcttggagggcagatgttaactccaagaagactctccgggaagtagggtctgtgaaggccctgatggaatgcgcactggaggtcaagaaggagtccactctcaagtcagttttgagcgcactatggaacctatcggcgcactgtactgagaacaaagctgatatttgcgcagtggacggtgccctcgcttttttggtgggcacgttgacctaccggagccaaaccaatacactggccatcatcgagtcagggggaggaatcctgaggaacgtgtccagcctaattgcaaccaacgaagaccaccggcagatcctgagggaaaacaattgtctacaaaccctcctccagcatctgaagtcacacagtctgacaattgtgtctaacgcgtgtgggactttgtggaacctgtctgccagaaatcccaaagaccaggaagcactgtgggacatgggagctgtgtcaatgctaaagaacctgatccacagcaagcacaagatgattgccatgggctccgctgccgctctgagaaacctgatggctaacaggcccgctaaatataaggacgcgaatataatgagtcccggttccagcctccctagcctgcatgtgagaaagcaaaaggccctggaggctgaactggacgcacaacatctgagcgaaacatttgacaacatagataacctctcccccaaagctagccatagatccaaacagcgacataagcagagcttatatggcgattatgtgttcgatacaaaccgacacgatgacaacaggagtgataattttaatactgggaacatgaccgtactttccccatatctcaatacaacagtgctgccctctagtagtagctcacgaggctcccttgacagttcccgctcagaaaaagataggtcactggagcgagagaggggaattgggctgggcaactatcaccccgctaccgaaaatccagggacatctagtaaacggggtttgcagatctctaccactgccgctcaaattgcaaaagtaatggaagaggtgtctgctattcatacctcacaggaggatcggtcttccggctccaccacggaactgcactgcgtcacggatgaacggaacgctctgagaaggtcttccgcggcacacacacacagtaacacatataatttcacaaagagcgagaattcaaacagaacttgttctatgccatatgcaaagctcgaatataaaagatcgtccaatgatagtcttaattctgtatcgtcatctgacgggtatggaaaacgcggacagatgaaaccttccatagagtcctattctgaggacgatgagtctaagttctgtagttacggccagtatcctgcagaccttgcccacaaaatccactcagctaatcatatggacgataacgacggggaactagacactcctatcaactattcactgaagtactctgacgaacagctcaattccggtcggcagagcccatcccagaacgagagatgggcgagaccaaaacacatcatcgaggacgaaatcaagcagtcagagcagcggcagagccggaatcagagcacgacataccccgtgtacactgaatctacagatgataaacaccttaaattccaaccacatttcggtcagcaggagtgtgtgtctccgtaccgatctcgcggtgcgaacgggtctgaaacgaatagggtgggctctaatcacggcatcaaccagaatgtctcacagagcctctgccaggaggacgactatgaagatgacaagccgacaaattatagtgagaggtacagcgaggaagaacagcacgaagaagaagaaagaccaaccaactatagtatcaagtataatgaagaaaagcgccacgtcgaccagcctatcgactattctctcaaatatgccaccgacattccgagctcccagaaacaaagttttagttttagtaaatccagttccgggcagagcagcaagactgagcacatgtcgtcgtcttccgaaaacacatctacacccagtagcaacgccaagagacaaaaccagttgcatccctccagcgcgcagtcgcgctcaggtcagccacaaaaagctgcgacttgcaaggtctcaagcatcaatcaggagaccatccaaacctactgtgtcgaggacactcctatttgtttctcaagatgttccagcctctccagcctctctagtgctgaggacgagatcggttgcaaccagaccacgcaggaagccgactctgcaaacaccttgcagatagcagagatcaaagagaagatcgggacacgctccgcggaggatcccgtgagcgaagtgccggcagttagtcagcatcctcgcactaaatcttcccgattgcagggttcttccctgtcctcagaatcagcacgccacaaagcggtcgagttttcctccggcgctaagagtccttctaagtctggggctcaaactccaaaaagcccgccagagcattacgtccaggagactccattaatgttttcccgctgtacaagcgtttctagcctagacagcttcgagtccaggtcaattgcttcttcggtccaatccgagccctgctccggaatggtctcaggaattatcagtccttccgacttaccagattcacccggacagaccatgcccccatcacgctctaagactcctccccctccccctcagacagcccagactaaacgcgaggtgcctaaaaacaaagcaccaactgcggagaagcgagagagtggacccaagcaagccgcagtgaacgctgccgtgcagagagtccaagttctgcccgacgccgacacgctgctgcactttgccacagagtcaacccctgacggattttcgtgctctagctccctgtccgcattatctttggatgaaccatttattcagaaggacgttgagttaaggataatgcctcctgtgcaggagaatgataatggcaacgagacagagagcgagcagccaaaagagtcaaatgagaatcaggaaaaggaggcagaaaaaacaattgatagtgagaaggacctgctggacgattccgacgatgacgatattgagatcttggaggagtgcataatatccgccatgcccactaaatcttccagaaaggcaaaaaagcccgctcaaaccgcctccaaactgccaccacctgtggcaagaaagcctagtcaattgccggtttataagctgctgccttcacagaatcgcttgcaaccgcagaagcatgtctcgtttacaccaggtgatgatatgcccagggtttattgtgtggagggtacgcccataaacttcagtacagccacttctctgagtgatctgaccattgaatctcctcctaatgagcttgcggctggggagggggtcaggggaggagcccagtccggtgaattcgagaaacgagatacaatcccaacggagggacgatcgactgatgaggcacagggcggaaagacttcatcagtaaccatcccggagctcgacgacaacaaggccgaggagggcgatatcttggcagaatgcatcaacagcgccatgccaaaaggtaagtctcacaagccctttcgggtgaagaaaatcatggatcaagtgcagcaagcttccgccagctcgtccgcgccaaataaaaaccaactggatggcaagaaaaaaaagccaacctcacccgtcaaaccgattccacagaatacagagtatcgtaccagagtacgcaagaatgccgactccaaaaataacttaaacgccgagagagttttttcagataacaaagattccaagaaacaaaatttgaagaacaacagtaaagtgtttaatgacaaactgcctaacaacgaagatcgagtccgcggatcattcgctttcgattcaccccaccactataccccaatagagggtacgccctattgcttcagtcgcaatgacagtttgagtagtttagatttcgatgatgacgacgtggacctgagcagagagaaggcagagcttcggaaagccaaggagaacaaggaatccgaagcaaaggttaccagtcacaccgaactgacatccaaccagcaatctgcaaacaagactcaggctatagccaagcagcccatcaaccgagggcagcctaagcccattctccagaagcagagtaccttcccacagtcgagtaaggatataccagaccggggtgctgcaaccgatgaaaagctgcagaatttcgcgatcgaaaatacgccagtctgtttctcccataatagttccctctcctccttatcggatatcgatcaggagaacaataacaaggaaaacgagcccatcaaggaaaccgagccccctgattctcagggcgaaccaagtaagccccaggccagcgggtatgcacccaagtccttccacgttgaggacacgcctgtttgcttctcgcgcaactcctcacttagctccctaagtattgacagtgaagatgacctactgcaggaatgtatttccagcgccatgcccaagaagaagaaaccttcccgtcttaagggtgacaatgagaagcactcccctagaaatatggggggaattttgggcgaggacttgactttggatttgaaagacattcagcgccctgactctgagcatgggctgagccctgactccgaaaacttcgattggaaagccattcaggaaggagctaactcaatcgtgagcagtctgcaccaggcggctgccgcagcatgtctgtcacgccaggcctccagcgatagcgactctatcctgagcctcaaatcagggatctcactcggttccccttttcatcttaccccggaccaggaggagaagcccttcacatccaataaaggcccacgaatcttgaaaccaggagagaaatcaactcttgagactaagaagattgaatcagaaagcaagggcataaaagggggtaagaaagtgtacaaaagtttaatcacaggcaaagtgcggtccaattcagagatctctggtcaaatgaagcagccattgcaggccaatatgccttcaatctctaggggcaggactatgattcatatcccaggagtgcgaaactcgagcagttctacttcgccagtgtcaaaaaaaggcccacctttgaaaactcctgcctctaagtctccttccgaaggacagaccgcaacaacctctccgagaggcgctaagccctccgtcaagtcagagctatctcctgtggctcgccagacctcccagatcggtgggagcagtaaggcaccatctcgcagcggcagccgagactcaaccccgtctaggcctgcgcagcagccccttagcaggccaattcagtcgcccggaagaaattcaatctcgccaggcagaaatgggatcagccctccaaataaactcagccaactgccaagaacatcatctccgagcaccgcctctactaagtccagcggtagtgggaagatgagctacacttctcccggaagacaaatgtcgcagcagaatttaaccaaacaaacaggactctcaaagaacgcttcctcaatccctcgaagcgagagcgcctctaagggcttgaaccagatgaataacggaaacggggctaataaaaaggtggagctgtctcggatgagttctacgaagtcaagcggaagtgaatctgacaggtctgagcggccagttttggttagacaatccacattcatcaaggaagcaccatcccccacactacgaaggaagctcgaggaatcagccagcttcgaaagcctgtccccttctagccgacctgcgagcccaacacggtcccaagcgcagacccccgttctgagtccttccctgcctgatatgtcactctccacccattcttcggtgcaagccggaggctggcggaagttgccacccaacttatcccctaccattgagtataacgacggtcggccagcaaagcgccatgacatagccaggtcccacagcgagtctcctagcagactccccatcaatcgaagtggaacctggaagcgtgagcactctaagcattctagtagtctcccaagagtttcaacgtggaggcgaactggcagcagcagctcaattctgagtgcctccagtgaaagctcagaaaaggcgaagtcagaggatgagaagcacgtgaactcaattagcggcaccaaacagtccaaggaaaaccaggtgtccgcgaagggtacttggcggaagattaaggagaacgagttcagtcctacaaatagcacctctcagacagtgtcaagtggagcaactaacggggcagagagcaagacgcttatatatcagatggcacctgctgtctcaaagactgaggatgtctgggtcagaattgaggactgtcccattaacaatcctcgctcagggcgatctcctaccggcaacacgcctcctgtgatcgattcagtgtctgaaaaggctaaccccaacatcaaagactccaaggacaatcaggccaaacagaacgtgggaaacggcagcgtccccatgcgcacagtcgggctggagaaccgtctgaacagttttatacaggtggacgcccctgatcagaagggcacagagatcaagccaggtcagaacaatcccgtcccagtgtcagagactaacgagtcgagtatcgtggaacgcacacctttttcatcgagctcaagctccaaacattcttctccctccggaactgtggctgccagagtaacgccttttaattataacccatctcctaggaagagtagcgctgattctacttcagctagacccagccagattccaactcccgtgaacaataacactaagaagcgggatagtaaaaccgattctacggagtccagcggcactcagagtcccaagcgacacagtggaagctacctagttaccagtgttta

SEQ ID NO: 27232 - DNA, 8531 bp, Artificial Sequence
  Description of Artificial Sequence: Synthetic coding sequence
atggccgctgcctcctacgaccagcttctcaagcaggtggaggctttaaaaatggaaaatagcaacttgaggcaggagctggaagacaacagcaatcacctaaccaagctggaaaccgaggcctcaaacatgaaagaggtgctaaaacagctccaaggctcaattgaggacgaggccatggctagttctggccaaatcgatctcctggagcgcttgaaagaactgaatctcgacagctcaaatttccctggcgttaagctgcggtcaaagatgtcattgcgcagctatgggagtcgggaaggcagcgtgagttctcgaagtggggaatgttcacctgtgcctatggggtcattcccgcgtcgcggattcgtcaatggcagccgtgagagtactggttatctagaggagttagagaaagagagatctctcctcctagccgacttggacaaggaggaaaaagagaaggactggtattacgcccagctccagaatttgaccaagcgcatagacagtctccctctgaccgaaaatttcagcctccagaccgacatgacaaggaggcagctggagtacgaagcgaggcagattcgggttgccatggaggaacagctgggcacgtgtcaggatatggaaaaacgcgcacaaaggagaatcgcaaggattcagcaaatcgaaaaggacattcttcgaatcagacagttgctacagagtcaggcaacagaggcggaacggtcctctcagaataagcacgaaactggcagccacgatgccgaacgtcagaacgaagggcagggagtcggcgagataaatatggccaccagcggaaatgggcaggggagcacaacgcgtatggatcatgagacagcctcagtcctgtctagcagctcaacacattcagcacctcggagacttacgagtcatcttggcacgaaggtggaaatggtgtacagtctactgtctatgctgggcacccatgacaaggatgacatgagcagaactctgttagcaatgagcagttctcaggacagctgtattagcatgaggcagtcgggctgtcttcccttgctcattcagctcttgcatggcaacgacaaagatagtgttttgttaggaaacagccggggatcgaaggaagccagggcccgtgcaagcgcagcgctgcataatatcattcactcacaaccagacgacaaacgaggtaggcgagaaattagagtccttcacctcctcgagcagatcagggcctactgcgaaacttgctgggagtggcaggaggctcacgagcctggcatggaccaggataaaaacccaatgcccgcacctgtggaacaccagatctgcccggcagtgtgtgtgctgatgaaactctcctttgacgaagaacatagacacgcaatgaatgagttaggaggactccaggcgatagctgagctcctgcaggtcgattgtgagatgtacgggctcaccaacgatcattacagtattacactgagaagatacgcgggtatggcactcacaaacctcaccttcggcgacgtggccaataaagcgaccctttgcagtatgaaggggtgcatgcgtgcactcgttgctcaattgaagagcgagtccgaagatctccagcaggtaatcgcatcagtgttaaggaatctttcctggcgtgctgatgtcaactccaagaagacgctgagggaagtgggttcagttaaagccttgatggaatgtgccctggaggtcaagaaggaaagtaccctgaaatccgtgttgagtgccctgtggaatctttctgctcactgcaccgaaaataaagcagacatttgcgcagtggatggggctctggctttcctggttggcacccttacatacagatctcagacaaatacactggccatcattgaaagtggcggtggcattctccgtaatgtgagctctctgatagccaccaacgaagatcataggcagatcttgagagagaataattgcctgcagacattgctccagcacctgaaatcacatagtctcactatcgtatccaatgcttgtggcacactttggaacttgtccgcccgtaaccccaaggatcaagaggcactctgggacatgggggcagtgtccatgctgaaaaatctgatccattccaagcataaaatgatcgcaatgggttcagccgctgcactgaggaatctgatggctaatcggccagctaaatacaaagatgctaatatcatgagcccgggatcttcgttaccatctttgcatgtccgaaaacagaaagccctggaggcagaactggacgctcagcacctgtctgagactttcgataacatcgacaacctgtccccgaaggcaagccaccggtccaagcagcgccacaaacaatccctttatggcgactacgtgtttgacaccaaccgtcatgacgacaatcgctctgataattttaacactggaaatatgacagtcctgtccccgtatctgaacactactgtcctccccagcagctcatcatcccgaggctcactcgatagctcaaggtcagagaaagaccgaagcctcgagcgagagaggggcatcggcctcggcaactaccatcccgctaccgaaaatccgggaaccagtagtaagagagggttacaaatctcaacaactgcggcacaaatagcaaaggtaatggaagaggtaagtgctattcacaccagccaggaggatcgctcaagcggatcaacaacagagctacactgcgtaacggacgagagaaacgccctgagacgctcaagcgcagctcacactcattccaatacatataattttaccaagagtgagaatagtaatcgtacttgcagcatgccctatgccaagctggagtataagcggtcaagtaatgacagcctgaattctgtgtcaagctctgatggatatggtaaacggggacagatgaaaccaagtattgaatcatattccgaggacgatgagtccaagttttgttcgtacgggcagtacccggctgatctggcccataaaattcattccgccaatcatatggatgataacgacggtgaactcgataccccaattaactactctttgaagtacagcgatgagcagctgaacagcggacgccaatcaccatctcagaacgagaggtgggcaagacccaagcatattatcgaagacgagattaagcagagcgagcagagacagagtagaaatcaaagcacaacctatcctgtctatacagagtccacagatgataagcatctgaagtttcaacctcattttggccaacaagagtgcgtgagtccctataggtctcggggagctaacggtagtgagaccaacagggtgggctctaaccacggcatcaaccaaaacgtcagccagtccctgtgtcaagaggatgattatgaggacgacaagcccaccaattatagcgagaggtattcggaggaggagcaacatgaggaagaagagcgtcctacaaattactctattaaatacaatgaagagaaaaggcatgttgatcagcccatcgactatagtttgaaatacgccacagacattccatcgagccaaaagcagtcattctccttctccaagtcatcgagcgggcagtcctcaaaaactgagcacatgtcgtccagcagtgagaatacatctaccccatcatctaacgccaaacgccagaaccaactgcatccaagctccgcacagtcccggtcaggtcagcctcagaaggcggcaacatgtaaagtctcatctattaaccaggagacaattcagacctattgcgttgaggacacccctatctgtttttctaggtgttcttctctgtcctccctctccagtgcagaggatgagatcggctgcaatcaaacaacacaggaagccgactctgccaacaccctgcaaatcgccgagataaaggagaagatcggaacgagatctgccgaggatccggtgtcagaagtgccagcagtctcccagcaccctaggaccaagtcgtcaaggctgcaagggtcatcactgtcttccgagtccgcccgacacaaagcagttgagttctcatccggggctaaatcaccctccaaatctggagcgcaaacaccaaaatcacctccagaacattacgtgcaggagactcccctaatgttttctcggtgtacctccgtgtctagcctggactctttcgaaagccggagtattgcgagctcagtgcagtccgagccctgtagcggcatggtatctgggatcataagcccctctgatctcccagattcacccggacagaccatgccgccttcaagatctaaaacaccacctcccccacctcagacagcacaaactaaacgcgaggtgcccaagaataaggcaccaacggctgaaaagagggagtccggcccaaagcaggccgcagtgaacgccgctgtgcagcgcgtgcaggttctgcccgacgcagatactctgctccacttcgccacagagagcacgcctgatggcttttcttgctcgtcctcgctgtctgccctttctctggacgagccttttatacaaaaagatgtcgagctacgaattatgccacctgttcaggagaacgacaacgggaacgagactgagagcgaacagcccaaggaatcaaatgaaaatcaagagaaggaggcggagaagacaatcgactccgagaaggacctcctggatgacagtgacgacgacgatattgaaatactcgaagaatgcatcatttccgccatgccaaccaagagctcgcggaaagcgaagaaacccgctcagacagcctctaagcttcctccccctgtggccagaaagccatctcagctaccagtctataaacttctgccgtcgcaaaaccggctacagccacaaaagcacgtgagcttcacccccggtgacgatatgcctcgggtttactgcgtggagggtacaccaatcaacttctctacagctacgtctctctccgatctcactatcgagtcaccgccaaacgagttggctgcaggtgagggtgtccgaggcggtgcacagtccggagaattcgaaaaaagagacacaatccctaccgaaggacggtccactgatgaagctcagggtggcaagaccagttcggttacaatccctgagctggacgacaataaagcagaggagggggatatcctcgctgaatgcataaattctgccatgcccaagggtaagagccataagcctttcagagtgaaaaagatcatggaccaggtgcaacaagcctcagcctcaagttcagcacctaacaaaaatcaattggacggtaaaaagaagaagccaacttcacctgtcaaaccgatcccgcagaatactgaatatcggactagagttcgcaagaacgcagacagcaaaaacaatctgaacgcagagcgagttttttccgacaacaaagattctaaaaaacagaacctcaagaacaatagcaaggtctttaatgacaagttgccgaacaacgaggatcgagttcgaggatcgttcgcattcgactcccctcaccattacacacctatcgaagggactccttactgctttagccgcaacgacagtctctcctccctggacttcgatgacgacgatgtcgacttgtcccgcgaaaaagccgagctgcgcaaagccaaggagaataaggagtctgaagcaaaggtgactagtcatacagaactgacatcaaatcaacagagcgctaacaagacacaggcaattgcaaagcagcccatcaatcgtggccagcccaaaccaatcctgcagaaacagagcacgtttccccagtccagtaaagacattccggaccggggagccgctaccgacgagaagctgcaaaacttcgctatagagaatacgcccgtgtgcttcagccacaattcctcactttcttccctcagtgatatcgaccaggagaataataacaaggagaacgagcccattaaggagactgaaccccctgattcgcaaggggaaccctctaaaccacaagcaagcgggtacgctccaaagtcatttcatgttgaagacacccccgtgtgcttcagcagaaactcatccctatcctctctcagcatcgacagcgaggacgacctacttcaagagtgcatctcctcggcaatgcccaagaagaaaaaaccatctcggctgaaaggagacaacgagaagcattctcctagaaatatggggggaattcttggtgaggacctgacgttggacttgaaagacattcagagacctgattcagaacacgggctaagtcctgattccgaaaacttcgactggaaggcaatccaggagggtgccaattctatcgtgagctctctacaccaggccgcagctgcagcctgtctgtcacgccaggccagttctgatagtgatagtattttgagtctgaagtctggtatctcattgggttctccttttcatctgactcccgatcaagaggagaagccgtttacctcaaacaaggggcctcggatcctcaagcccggtgaaaagagtaccctggaaacaaagaagatagagagcgagagcaagggcattaagggtgggaaaaaggtctataagagcttgataaccggtaaagtgcgaagtaactctgagatatctggccagatgaagcaaccactgcaggccaatatgcccagcatctcccgaggcaggacgatgatacatatacccggtgttcggaatagttccagcagtaccagccctgtctcgaagaaaggtcctccattgaagactcccgcatcgaaatccccatccgaggggcagacagctactactagtccacgcggagccaagccaagtgtgaaatcagagctgagtcctgtggcgagacaaacttcacagattgggggttcgagcaaggccccaagtaggtctggatctagagatagtacaccaagccgccctgcccagcagccattgagtcggccaattcagagccctgggcgtaactccatctcccctgggcgtaacgggatctcccccccaaataaattatcccagctgccaagaacctcatcccccagcacggccagtacgaagtcatccggaagtggcaagatgtcatatacaagccctggccgacagatgagccaacaaaatttgacaaagcagacgggactgagcaagaatgcatccagtatccccaggtccgagagtgcctccaagggtctgaaccagatgaacaacggcaacggagctaacaagaaagtggagctctcccgcatgagcagcacaaaatcatctggatctgaatctgatcgcagtgagcgtcccgtcctcgtccggcaaagcacatttattaaggaggctccctctcctaccctccgcaggaagctagaagagtcagcctcctttgaatccctgtccccatcaagccgcccagcaagccccacacgctctcaggcccagactccagttctcagtccctctctcccggacatgtcattgagcacacactctagcgttcaagctggtggttggcggaagttgcctcctaacctcagcccgacaatcgagtacaatgatgggcgacctgcaaagagacatgatatcgcgcgttcacactccgagtcaccatctcgcttgcctattaataggagtggcacatggaaacgagagcattcaaaacacagttcatcgctgcctcgcgtgagcacctggaggcgaacaggctccagctcctccattttgtctgcatccagtgaatcctctgagaaggcaaaaagcgaagatgagaagcatgtgaatagcatctcggggaccaaacagtccaaagagaaccaggtctcagccaaggggacatggcgaaagatcaaagagaatgaattcagccccacaaactcaacatcccaaacagtgagcagcggtgcgaccaacggtgccgaatcaaagacattgatttaccagatggcgcctgctgtatctaagaccgaggacgtatgggttaggatcgaagactgccctatcaataaccccagatcagggagaagccctaccggcaatacacctcctgtcattgatagtgtctccgaaaaggcgaatccaaacattaaggattctaaagataatcaggccaaacagaatgtcggcaacgggagtgttcctatgcgaacggttggcctggagaataggttgaatagcttcatccaggtggacgcgccagaccagaagggtactgagataaaacccggacagaataatcccgtgcctgtctccgagaccaatgagagctccattgtcgaacggacaccatttagctcctcaagttcctctaagcactccagcccttcaggaacagtcgcagccagggtgacgccttttaactataatccgtcaccaaggaaatctagcgctgatagcacatcggccaggccaagtcagattcccacacccgttaacaataacactaagaagagggatagcaaaaccgatagcacggagtccagtgggacacagagtcctaagcgccattcggggtcgtatctagttacatcggtgta

SEQ ID NO: 27233 - DNA, 864 bp, Artificial Sequence
  Description of Artificial Sequence: Synthetic coding sequence
atggccgcagcctcctatgatcagcttttgaaacaggtagaggctctcaaaatggagaattcgaacctgcgacaggagctggaagacaatagcaatcaccttacgaaacttgagactgaagcaagcaatatgaaggaggtgctgaaacagcttcaaggatcaatcgaggatgaggctatggcatcaagcggacagattgaccttcttgagcgactgaaagaattgaatttagactccagtaattttcccggagttaagttgagatctaaaatgagcctcaggtcttatggatcccgcgagggctcagtgagtagccgcagcggcgagtgcagccctgtgcccatgggctccttcccaagacgcggattcgtgaacggctcaagagaatcaaccggttacctggaagagttggagaaggagcggagccttctcctcgctgacctggacaaagaggagaaagaaaaggactggtattatgcgcaactccagaacctgacaaagagaatcgactctctgcctcttacagagaatttcagccttcagacggacatgacacgcaggcaactcgagtatgaagcaaggcagattcgtgtggccatggaggagcagctggggacgtgccaagacatggaaaaaagagcccagaggaggattgcacgaatccagcagattgagaaagatatcttaagaatccgccagctattgcagtctcaggctaccgaagctgagcggagtagccagaacaaacacgagaccggatcccatgacgcagagcgccagaacgaggggcagggcgtgggcgaaatcaacatggctacctccggaaacggacaaatagagaagatgcgcatgttcgaatgttag

SEQ ID NO: 27234 - DNA, 357 bp, Artificial Sequence
  Description of Artificial Sequence: Synthetic coding sequence
atggcagctgcttcctatgatcagctcttaaaacaagtcgaggcattaaaaatggagaattctaatcttcgccaggagctcgaggacaacagcaaccatctcacaaaactcgagaccgaagcctcaaacatgaaggaggtactgaagcagctgcaaggaagcatcgaggacgaggccatggcaagctctgggcaaatcgatctgctggagaggctcaaggaactcaatttagattccagcaacttccctggagtgaagttgcgttctaagatgtccctgaggtcttacggatctcgtgagggatctgtaagctcacggagtggcgaatgcagccccgtgcctatggggagcttctag

SEQ ID NO: 27235 - DNA, 3918 bp, Artificial Sequence
  Description of Artificial Sequence: Synthetic coding sequence
atggccgcagcttcttacgatcaacttctgaaacaagtcgaagcgctcaagatggaaaactctaacctcaggcaagagctagaagacaacagtaaccaccttactaaactggagaccgaagcttcaaacatgaaggaagttctcaagcagcttcaaggatccatcgaagacgaggccatggcctcctcgggccaaatcgacttactggaacgcttgaaagagctgaacctggactcatctaatttcccaggcgtgaaactgcggtccaaaatgagtctgcggagttacggatcccgcgaagggagcgtgtcttccaggtctggggagtgttccccagtccctatgggatctttcccaaggagagggttcgtgaacgggagccgcgagtccaccgggtacctcgaggaacttgaaaaggagaggagcctcctattggctgacctggacaaggaagaaaaggaaaaagattggtattatgcacaactgcaaaatctgaccaagagaatagactcactccccctgaccgaaaatttctctctccagactgatatgaccagacgccagctggagtacgaggctcggcagatcagagttgccatggaggagcagctggggacttgtcaggacatggagaagcgagcccaacgcaggatcgcaaggatccagcagatcgagaaagacatcctgcggattcgccagctgttacaatcccaagcaacagaagccgagagatcttcgcagaacaagcatgaaactggcagccatgacgctgagcgccagaacgagggacagggggtcggggagatcaatatggctacgtcagggaatggtcaggggtcgacaacgcggatggaccatgagaccgccagcgttctcagctcatctagcactcatagtgctccacggagacttacatcccacctcgggacaaaggttgagatggtgtattcactgctttccatgttgggcacccacgacaaagatgacatgagtagaactctgcttgccatgtcctcctcacaggacagctgtatctcaatgagacagtctgggtgcctacccttgctgatacaactgctgcatggcaacgataaggactcagtgttgcttggcaactccagaggtagtaaggaggcgagggcgcgagcatcagctgccctgcacaacattatccactctcagcccgacgataagagagggaggcgcgagatcagggtcctgcatctgctggaacagatccgcgcttactgcgaaacttgttgggagtggcaggaagcacatgagcccggaatggaccaggataaaaaccccatgcccgctcccgtcgagcatcagatctgccctgctgtgtgcgttttgatgaagctgagctttgatgaggaacaccggcatgctatgaacgaactgggtggtctgcaggcaattgcagagctactccaggtggattgtgagatgtatggtcttactaatgaccactattccatcacactaaggcgttatgctggaatggcacttaccaacctcacgtttggcgatgtggccaataaggccacgctatgcagtatgaaagggtgtatgcgggcacttgtcgcacagctcaagagtgagtctgaggatcttcagcaggtgatagcaagcgtgttgagaaatctgagctggagggccgatgtgaactcgaagaagaccctgcgcgaagtgggtagcgtcaaggcccttatggagtgtgcactggaggttaaaaaagagagtactctcaagtccgttctttcagctctctggaacctgtccgctcactgcacagaaaacaaagcggatatctgcgccgtggacggggcacttgccttcctggtgggaactctgacataccgttctcagactaatacactggccattatagagagtggaggagggattctgaggaacgtgagtagcctcatagcaacaaacgaagaccatcggcaaatcttgcgcgagaacaactgtctgcagaccctccttcagcacttgaaatctcactctttgacaatcgttagcaacgcatgtggaaccctctggaatttgtcagcccgaaacccaaaggaccaggaggccttgtgggacatgggcgctgtttctatgctcaagaacctgattcattcgaagcacaagatgatagctatgggaagtgctgcggctttgcgcaatctgatggcaaaccgccctgccaagtacaaagatgcaaacatcatgtcaccaggtagtagcctaccttccttacacgtgagaaagcagaaagcgctggaggctgagcttgatgcgcagcatctgagcgaaaccttcgacaatatcgataacctcagccccaaggcatcgcaccgctcgaaacaacgccataaacagagcttatacggcgactacgtttttgatacaaatcggcatgacgacaaccgctccgataacttcaacacaggtaacatgactgtgctgtccccatatttgaatacaaccgtactccctagtagcagctcgtcacgtggcagtctcgactcatctaggtctgagaaggatcgaagcctggaaagagaaaggggaattggactgggaaactatcaccctgccacagaaaacccagggacatctagcaagcgcggactgcagattagcactaccgccgcacaaattgccaaagtgatggaagaggttagcgccatccacacaagtcaggaagaccggtcctctggatctaccactgaactgcattgcgtcaccgatgagcggaatgcactgcggagaagctccgcggcacacacccatagcaacacctataacttcactaagtccgaaaactctaataggacctgtagtatgccatacgccaagctcgagtataaacggagttccaacgattccctgaattccgttagtagctctgacggatacggaaagagggggcaaatgaaacctagtatcgagagttactccgaagacgatgagtctaaattctgttcatacggccaatatccagcggacctggctcacaagattcacagcgccaatcatatggatgataacgacggggaactggacactcccattaactattcactcaaatattcagatgaacaacttaatagcggcagacagtccccttcacagaatgagcgctgggcacgaccaaagcacattattgaagatgaaattaagcagagtgaacagaggcagtcgcgtaaccagtcgacaacttaccctgtgtacacggagagtaccgacgacaaacacctgaaatttcaacctcacttcggccagcaagagtgtgtttcaccttacagatcaaggggtgccaacggttccgagacgaatcgggtgggcagtaatcacgggattaaccagaatgtttcgcagtccctgtgtcaagaagacgattatgaagatgacaagcccacgaactactcggaaagatatagtgaggaagagcagcatgaagaggaggagcgtccgactaattacagcattaaatataacgaagaaaaacgccacgtggaccagcctattgactactccctgaaatatgctacggatataccaagctctcagaagcagtctttctcatttagcaagagcagtagtgggcagagtagcaaaactgagcatatgagtagttcgagtgaaaacacctctactccgtcttcaaatgctaaaaggcagaaccagttgcatccaagtagcgctcagtctcgttccggacaaccacaaaaggccgctacgtgtaaagtgagttcaattaatcaagagaccattcagacatactgcgtcgaagatacccccatctgcttctccagatgtagctcactgtcctctctgtcaagcgctgaggacgaaatcggctgcaaccaaacaacgcaggaggcagactctgccaacacacttcaaatcgcctag

SEQ ID NO: 27236 - DNA, 2796 bp, Artificial Sequence
  Description of Artificial Sequence: Synthetic coding sequence
atggccgagatcaaggagaagatctgtgactacctgttcaatgtgtctgactcctctgctttgaatctcgcaaagaatatcggccttacaaaggcccgtgatatcaacgccgtgctgatcgatatggagcggcaaggtgatgtgtatcgacagggaacaacacctcctatttggcacctgactgacaagaaacgggaacggatgcagatcaagaggaacactaatagtgtgcccgaaacggcccctgcggctatcccggaaactaaacgaaacgctgagttcctgacctgcaacatccctacctccaacgcctccaataacatggtcactaccgaaaaggtagaaaatggtcaagaacctgtgatcaagctggagaatcgccaggaggcccgtccggaacccgcaagactcaagccccctgtgcactataacggaccctctaaagccggatacgtcgattttgagaacggacagtgggctacagatgatatcccggacgacctgaactccattagggctgcccctggggaattcagggccataatggagatgccatccttttattcacatggacttccacgctgtagcccgtacaagaagcttacggagtgtcagttgaagaaccccattagtggcctgctcgaatatgctcagttcgcaagccagacgtgtgaatttaacatgatcgaacaaagtggccctccccacgaacctagattcaagtttcaagtcgtgattaacggtcgagaattccctccagccgaggccggttctaagaaagtggcaaagcaggacgcagcaatgaaggccatgacaattctcctggaggaagctaaggcaaaggattctggcaagagcgaagagtcttctcactactccactgagaaggagtctgagaagaccgccgaatcacagacaccgactccgagtgctacctcattcttttcgggcaagtctcctgtgaccacacttcttgaatgcatgcataagctaggcaattcctgcgagttcaggttgctgagtaaagaaggccctgctcacgagccgaagttccagtactgcgttgctgtaggagcacagacttttcccagcgtgagtgccccaagtaaaaaggtggcaaagcagatggctgctgaggaagccatgaaagcgttacatggcgaagcgactaatagcatggcaagcgacaaccaaccggaaggcatgatcagcgagagcctcgataacctcgaaagtatgatgcctaacaaagtgagaaaaatcggcgagctcgttcgctacctcaataccaatccagtcgggggacttctcgagtacgcccgatcacacgggtttgccgctgagttcaagctggtcgatcagtcaggcccaccacacgaacccaagtttgtgtaccaagccaaggtcggagggagatggtttcccgctgtgtgcgcccactctaaaaagcaaggaaagcaggaggcagcggatgctgcattacgtgtacttatcggggagaacgaaaaagcagagcgcatgggcttcaccgaggtcacccctgtgacaggcgcttcgctgagaaggaccatgctcctgcttagcagaagtccggaagcccagcccaagacactccctctcacggggtccaccttccatgaccagatcgccatgctgtctcatcgttgctttaataccctaactaattcctttcaaccatccttactggggagaaagatcttagccgcaatcataatgaaaaaggactctgaagacatgggcgttgtggttagcttgggcacgggcaatagatgcgttaagggagattccctgagccttaagggcgagactgtcaacgattgccacgctgagataatcagccgtcggggatttattaggtttctttacagcgaactgatgaaatacaactcgcaaaccgctaaagatagtattttcgagccagccaaagggggtgaaaagctccagatcaagaaaaccgtgagcttccatctctatatttccacagcgccatgtggagatggcgctcttttcgacaaaagctgctcagacagagctatggagagcacagaaagcagacactaccctgtgtttgagaacccaaaacaagggaagctgcgcaccaaggtggagaacggtgaggggaccatacccgtggagagttccgacatagttcccacttgggacggcattagactgggggagcggttaaggaccatgagttgctcagacaaaatccttagatggaacgtgctgggcctacagggagcactactgacacatttcttgcagccaatttatctgaaatcagtgaccctgggttatctcttctcccaggggcatctgactcgagctatttgctgccgtgtgacacgagatggctcagcttttgaggacggcctgaggcatccgttcattgtgaaccatccaaaggtggggagggtctcaatatatgatagcaaacggcaaagtggcaaaacgaaggaaacatctgtcaactggtgcctagcagatggctatgacctcgagattttagatggtacacggggaacagtagacgggccaaggaatgaactgagcagagtgagcaagaagaatatctttctgctgttcaagaagttgtgttcattccggtataggcgcgatctgcttaggctctcctacggcgaggcgaagaaggccgcaagagactatgaaactgctaagaactatttcaagaaggggctaaaagatatgggttacggaaactggataagcaagccacaggaggaaaagaatttttacctctgccctgtatag

SEQ ID NO: 27237 - DNA, 3681 bp, Artificial Sequence
  Description of Artificial Sequence: Synthetic coding sequence
atgaacccacgccagggatactcgctgtcaggatattacacgcatcctttccagggatatgaacatcggcagttgcgttatcagcagcccggtccaggctctagcccctccagcttcctgctaaaacagatagaattcttaaaggggcagttacccgaggctcccgtgattggtaagcagactcccagcctgccccctagtctgcccggacttaggcctcgatttcccgtgctccttgcatccagcacccggggtcgacaggtggacatccgcggtgtcccgaggggcgtgcacttaagaagccagggcctgcagcggggatttcagcacccatcccctagaggcaggtctcttcctcagcgtggcgttgattgcctctcgtcgcatttccaagagctttccatctatcaggaccaggaacaacggatccttaaatttctggaggaactgggagaaggcaaggccactactgcccacgacctgagtggtaaactgggcaccccaaagaaggagattaatcgcgtcctgtactcgctggctaagaaggggaagcttcagaaggaggccggaactccccctctgtggaaaattgctgtgtcaacacaggcctggaaccagcactccggcgtagttagaccagacgggcacagtcaaggcgctccaaatagcgatccgtccctggaacctgaagaccggaactcgacctccgtctccgaggacctcctggagcctttcatagcggtctcagcacaggcatggaaccagcactccggagtcgtgcgtccagattcccactcacagggctctcctaatagtgacccgggtttggagcccgaggactcaaactctacctcagcactggaggaccctttggagtttttagacatggccgagattaaagagaagatctgcgattacctgtttaacgtgtccgattcttctgccctgaacctagcgaagaatattggcctgactaaggccagggatattaatgccgtactgatcgacatggagcgacagggggacgtgtatcgccagggaacgactccacccatttggcaccttacggacaaaaagagagaacgaatgcagattaagcgcaacaccaattcagtccccgagaccgctcccgctgcaattcccgagaccaagcgcaacgccgaattcctgacctgcaacattccgacgagcaacgcatcaaacaatatggtgacaactgagaaagttgaaaacgggcaggaacccgtgatcaaactagagaatcgtcaggaggcacggcctgagcccgctcgtttaaagcccccagtccactacaacggtccttctaaggcaggctacgtggattttgagaatggccagtgggccacagacgatattcccgatgaccttaactcaattagagctgcgccaggcgaattccgtgcgatcatggagatgccttccttttacagccatggtttgcctagatgttccccttacaagaagctgactgagtgccagcttaaaaaccctatctctggcttacttgaatatgcacaattcgcttcccagacttgtgagttcaatatgattgagcagtcagggccacctcatgaacccaggtttaaattccaggttgtcataaacgggagagaattcccccctgccgaggccggtagcaaaaaagtggccaaacaggacgcagctatgaaagcaatgacaattctgctggaagaggctaaagctaaggacagcggcaagagtgaggaaagcagccattatagcacagagaaagagagcgaaaagacagcagagagtcagacgcctacaccctcagccacttcgttcttttccggcaaatcgccagtgaccactctgctcgaatgcatgcacaaactgggcaactcctgcgagtttcggctcttgagcaaagaaggacccgctcacgagcccaaattccagtactgcgttgcagtgggcgctcagacattccctagtgtgtctgccccttccaagaaggtggcaaagcaaatggcagcggaggaagccatgaaggcactccacggcgaggctacaaacagcatggcctccgataatcagccagagggtatgatctcggagagcctggacaatctcgagtcaatgatgccaaacaaagttcgcaaaatcggtgagctggttaggtacctcaacaccaatcctgtgggcggactactggagtatgcaaggagtcatggattcgccgctgaattcaagttggttgatcagtctgggcctccccatgaacccaagttcgtgtatcaggcaaaggtgggcggtagatggttccctgccgtgtgtgctcatagtaagaaacagggcaaacaggaagccgcagacgcggctttgcgggtgttgattggggagaacgaaaaagcagaaagaatggggttcacagaagtcactcctgttaccggcgcatccctgaggagaaccatgttgttattgtctcggagcccagaggcccagccgaagacactgccactcactggctcaacgtttcacgaccaaatcgctatgctgtcccaccgctgttttaacaccttgactaactcctttcagccgtccttattgggcaggaagatcctggccgctatcataatgaaaaaagattctgaagacatgggtgtggtagtgtctctgggtactgggaatagatgtgtcaagggggactcgctctctctcaagggcgagaccgtaaatgactgccacgcagaaatcattagccgtcgaggttttattaggttcttatattcagaactgatgaagtacaatagccaaaccgccaaagacagtatctttgagccagcgaaggggggagaaaaactgcagataaagaagacggtctcatttcatttgtatatttctaccgcaccctgtggggacggggcattatttgacaagtcttgttcagaccgggcaatggagtcaactgaatctaggcactatcctgtgtttgagaatcccaaacagggaaagcttaggactaaagtggaaaacggtgaaggcactatccccgtagaaagttctgatatagttccaacctgggatgggattaggctcggagaacgcctgcggaccatgagttgctccgacaagatccttcggtggaatgttctaggattgcagggcgcattgctcactcacttcttgcaacctatatacttgaaatccgtaactttgggctacctattcagtcaaggccatttgaccagggccatctgttgtcgggtgactcgcgatggaagcgcgtttgaggacggcctcagacacccattcatcgtcaatcaccccaaggtgggacgcgttagtatttacgattctaaacgacagtctggcaagactaaagaaacctcagtcaattggtgcctcgccgatggatatgaccttgagatactggacggtacccggggaactgttgatggcccacgcaacgagttatcacgggtctctaaaaagaatatttttctgctttttaagaagctgtgctcgttcagataccgacgggatctgttgcgcctgagctacggagaggctaaaaaagccgcaagggattacgaaaccgctaagaactacttcaagaagggcctcaaagatatggggtacggaaactggataagcaagcctcaagaagagaagaatttttacctgtgccctgtttag

SEQ ID NO: 27238 - DNA, 3588 bp, Artificial Sequence
  Description of Artificial Sequence: Synthetic coding sequence
gggtactctctgtctgggtattatacccacccatttcaagggtacgagcatagacagcttcggtatcagcagcctgggcctgggtctagtcccagctctttcctgctgaagcagattgagtttttgaaaggtcagctgcctgaggccccagtcataggaaaacagacaccaagtctgcccccatcgctacccggacttcgcccacggtttccagtcctgcttgcaagctcaacccgcggtcgccaagtggatattagaggtgtaccccgtggggtccatctgcgcagccagggcctgcaaagagggttccaacacccaagccccaggggtcgcagtttgccacagcgcggtgtggattgcctatctagtcactttcaggagctttccatatatcaagatcaggagcagcggatcctgaagttcttagaggagctaggggagggtaaggcaaccaccgcccacgatttgtccggcaaactggggactccaaagaaggaaatcaatcgggtgctctatagtctggcaaaaaagggaaagctccagaaagaagcaggaacacctcccctgtggaagatcgccgtcagcacgcaagcgtggaaccagcactcaggcgtcgtgcggccagacggccacagccagggcgctccaaatagtgatcccagcctcgagccagaggaccgcaactcaacctccgtgtctgaagacttactcgagcctttcatagcggtcagcgcccaggcttggaaccagcattcgggggtcgtgcggccagacagccatagtcagggttctcccaactccgacccaggtctagaacccgaggactctaactcaacttctgctctggaggatcccctagagtttttagacatggccgaaatcaaagagaagatatgtgactatcttttcaatgtgtcagattccagcgctttaaatctcgcgaagaatataggtctgacgaaggctcgcgatatcaacgccgtcctgatcgacatggagaggcaaggtgacgtgtatagacagggaacgactccccctatctggcacctcaccgacaaaaagagggaacgcatgcagatcaagcggaatactaattctgtaccagagactgcccctgccgctatccccgaaactaagagaaacgccgagtttctcacatgcaacattccaacttcaaacgcatccaataatatggtgacaactgagaaggtggaaaatggacaagagcccgtcatcaaactggaaaacaggcaggaggccaggcctgagccagcacgcctgaagccaccggtgcattacaatgggcctagcaaggcaggctacgtggactttgaaaacggacaatgggctacggacgacattcccgacgaccttaattcaattcgggctgcccctggcgaattcagggctatcatggagatgccttctttctacagtcatggactcccccgttgctctccttacaagaaactcactgagtgccagctaaagaaccctatcagcggactcctcgaatatgcacagttcgcttctcagacttgtgagttcaatatgattgagcagagtggcccaccgcatgagcctcgcttcaagttccaagtggtgattaatggcagggaattccccccagccgaggccggaagcaagaaagtggcaaagcaggatgccgcaatgaaggccatgactatcctgttggaggaggccaaggccaaggactcgggtaaatccgaagagtcctcacattattcaactgaaaaggagagtgaaaagacagcagagagtcaaaccccaacccccagtgctacgtcgttctttagcggcaagtcccccgtcacgacgctgctcgagtgcatgcataaactgggaaattcctgtgaatttcgtttgctgtctaaggagggccctgcgcatgaacctaaatttcagtactgtgtcgcggtgggtgcccagaccttccctagcgtttccgcaccaagtaagaaggtcgcgaagcagatggctgccgaggaagcaatgaaggctttgcatggcgaagctacaaactccatggcaagtgataatcaacccgaaggcatgatatccgaaagcctcgacaacctcgagtctatgatgccaaacaaggtgaggaagatcggcgagctggtgaggtacctcaatacaaacccagtcgggggactgcttgagtatgctaggtcccacggatttgccgcagaatttaagctggtagatcagagcggtccgcctcacgaaccaaagttcgtatatcaggcaaaagtgggaggacgctggttcccggctgtgtgcgcacacagcaaaaaacaggggaagcaggaagccgctgacgctgccctgagggtgctgatcggagagaacgaaaaggccgaacgcatgggatttacagaactgcccctgactggatcgactttccacgatcagatcgcaatgctgtcacatcggtgcttcaatacactaaccaattctttccagccttcgctccttggcagaaagatactggccgctattattatgaaaaaggactcagaagacatgggcgtggtggtgagcctgggcactggaaacagatgcgttaagggcgacagcctcagtttaaagggtgaaaccgtgaatgactgtcacgcagagatcatctctagacgtggtttcataaggttcctgtattctgaactcatgaagtacaatagccagacagcaaaagattccattttcgagccagccaaagggggagagaagctccagattaagaaaaccgtctcatttcacctatatatcagcaccgctccatgtggtgacggtgcactgttcgataagtcatgttccgacagagctatggaaagtacagagagcaggcattatcccgtgttcgaaaaccctaagcagggtaagctcaggaccaaagtggagaacggggaaggaacaattccagtcgaaagctctgatatcgttccaacatgggacgggattcgactcggcgaacgcctacgcactatgtcatgtagcgacaagattctgcgctggaatgttctcggcctacagggcgcattactgacacacttcctgcagcctatctacctgaaatcagtgaccttgggctacctgttcagccaggggcacctgacgagggctatatgctgtcgcgtgacacgggatggcagcgctttcgaggacggacttaggcatccgttcatcgttaaccaccctaaggttggaagagtttccatttatgattcgaaacggcagagtggaaaaactaaggagactagcgtgaattggtgcctggctgacggttacgatctggagatcctggacggcacaaggggaaccgtggacggtccacgcaatgagctaagccgggtgtctaaaaaaaatatctttctgttatttaaaaaactgtgtagctttagataccggagagatctgctgagactgtcctacggggaggccaagaaagcagctagagattatgagaccgctaaaaactactttaaaaagggcctaaaagatatgggatacggtaactggataagtaagccacaggaagaaaaaaatttttatctgtgtccggtgtag

SEQ ID NO: 27239 - DNA, 528 bp, Artificial Sequence
  Description of Artificial Sequence: Synthetic coding sequence
atgggcaaagtgctgagcaaaatttttggtaataaggagatgcggatcctgatgttaggtctggacgccgctggcaagacaacgattttatacaaactcaaactcggccagagtgtgaccacaatccctacagtaggatttaacgtcgagaccgttacctataagaatgtgaaattcaacgtgtgggacgttggaggccaggataagatacgaccgctttggaggcactactatactggaacacaggggctcattttcgtcgtcgattgcgccgatcgtgacagaatagatgaggcgagacaggagctgcatagaattataaacgacagggaaatgagggacgcgattatcctcatcttcgccaacaagcaggacttgcctgacgcaatgaagccacacgagatacaggagaagctgggattaacccgaatccgagacaggaattggtacgtacagccatcatgcgccaccagcggtgatggtttgtatgagggactgacctggctgacctcaaactacaaatcctag

SEQ ID NO: 27240 - DNA, 1398 bp, Artificial Sequence
  Description of Artificial Sequence: Synthetic coding sequence
atgtttaggcaagagcagccactggcggagggctcttttgctccaatgggaagcctacaaccggacgccggtaacgcctcatggaacggcactgaagcccctgggggaggagcccgtgccaccccttacagtctacaggtgactctcacccttgtctgtctcgctggcctgctcatgttgctaacagtgtttggcaacgttttagtcataatcgccgtatttacctctcgggctcttaaagcgccacagaacttatttttggtatccctcgcctccgctgacattctagttgctacactggtaatcccttttagtctcgctaatgaggtgatgggatattggtactttggtaaggcttggtgtgagatctaccttgctctagatgtgctcttttgtacgtcatctatcgtacacctatgcgccatttcactagataggtattggtcaatcacacaggccattgagtacaacctgaagagaaccccccgtaggataaaggctataatcataacggtttgggttatctctgctgtcatcagttttccaccactcattagcatcgaaaagaagggtgggggtggcggaccccagcctgctgagcctcgttgcgaaatcaacgaccagaagtggtacgtgatctcatcctgtataggatccttcttcgccccatgcctgatcatgatcctggtctacgtgcggatctaccaaatcgctaaacggcgtacaagggtgccgcctagtcgcagaggaccagacgctgtggcggcacctccaggtggcacagagaggagacccaatggcctgggccctgaaagatcggccggacccggtggagccgaggcagaacccctgcccacccaactcaacggggctcctggagaacccgctcctgcaggccctcgtgatacagatgcccttgatctcgaagagtcctctagttccgaccacgccgaacggcctcctggaccacggaggcctgagcgaggccctcgagggaagggtaaagcacgggctagccaggtgaagccgggagactctctgccacgcagaggaccaggagcgaccggaattggaacacccgctgctggaccaggggaggagcgagtgggcgctgcaaaggctagtaggtggcgaggcaggcagaacagggaaaagcgattcacatttgtgttggccgtggtgattggtgtcttcgtcgtctgctggtttccttttttcttcacatacaccctcacagccgtcgggtgtagtgtaccccgtaccctttttaagttctttttctggtttggttactgtaacagcagcctgaatccagtgatctacaccattttcaatcacgattttagacgtgcctttaaaaagattctttgccggggagaccgcaagcgcattgtttag

SEQ ID NO: 27241 - DNA, 285 bp, Artificial Sequence
  Description of Artificial Sequence: Synthetic coding sequence
atggccccactgaagatgcttgctcttgtgacccttctcttgggagcaagtctacagcatattcatgcggctcggggtaccaacgttggcagggaatgctgtttggaatatttcaagggtgctattccactacgcaaattgaaaacttggtaccagactagcgaggattgttctcgagatgcaattgtctttgtgactgtccagggaagagccatatgctctgatcccaataacaaacgcgtaaaaaatgcagtgaaatatctgcagtcacttgaaagatcctag

SEQ ID NO: 27242 - DNA, 1635 bp, Artificial Sequence
  Description of Artificial Sequence: Synthetic coding sequence
atgccaggccgttgtcagtccgatgccgcaatgagggtaaacggtccagcaagccgggctccagcgggatggacttcggggagcttgcacacagggccaagggctgggagaccacgagcacaggcgaggggcgttcgaggcaggggcttactactgaggcctcggcctgccaaggaactccctctgccccgtaagggaggcgcttgggcacccgctggaaatccaggacctttacatcccctgggggttgcggtcggaatggcgggaagcggacggttagtgctgagaccctggatcagggaactgattctggggtccgagacaccatcttcacctcgtgctggccagctgctggaagtgcttcaggacgctgaggccgcagtcgcagggccatcacacgccccagataccagtgacgttggggctactctactggtgagtgacggcacccacagcgtgcggtgtctggtaaccagggaagctttggacacatcagactgggaagaaaaggagttcggctttagggggacagagggcaggctgctactccttcaggactgcggagttcatgtgcaggtcgcagaaggcggagcgcctgccgagttttacctgcaggtcgatcggttcagtctgcttccgaccgaacagcccaggcttcgggtgccaggctgtaaccaggatttggacgtgcagaaaaagctgtatgattgtctagaagagcacctctcagagtcaacatctagtaatgccggactgagcctgtcccagcttctcgatgaaatgcgtgaagatcaagagcatcaaggtgctctggtctgcctcgcggagagctgcctgaccctagaagggccttgtaccgcacctcccgtcacgcattgggcagcctctcggtgtaaagcgaccggtgaagctgtgtataccgtgccttcatccatgttatgcatctcggagaacgaccaactgatcctctcgagtctcgggccttgccagcgcacccaaggtccagaactcccacccccagaccctgccctccaggatcttagtctcaccctaattgcctcccccccttcttcccccagctcctccggaactcctgccttgccaggccatatgagtagtgaggaatcagggaccagtattagtttgctccccgcactcagcctggccgcaccggacccaggtcagaggagcagcagccagccctcccctgctatttgctccgcgccagctaccctcacaccaagatctccacacgcttctcgcacacccagttcccctctgcagtcatgtacaccttcactgtccccccgtagtcacgtccctagtccacatcaggcactggtcaccaggccccagaaaccctctttggaattcaaggagttcgtcggcctcccttgtaagaatcgacctccattcccaaggacaggtgccacccgtggagcacaagaaccgtgctcggtgtgggaaccaccaaaacggcacagagacggtagcgcctttcagtatgaatatgagcctccctgtacaagcctatgcgcgcgtgttcaagccgtgcgactgccaccccagttgatggcatgggcactgcacttcctgatggatgcccaacctggctccgagccaacccccatgtag

SEQ ID NO: 27243 - DNA, 558 bp, Artificial Sequence
  Description of Artificial Sequence: Synthetic coding sequence
atgaaactcgtgtctgtggccctgatgtatctaggttcactcgcttttttgggggctgatactgcacgcttggatgtcgcctctgaatttaggaagaagtggaataaatgggctctgagcagagggaaaagagagctcaggatgagctcaagctatccaactggactggccgatgtgaaagcgggacccgcacagaccctcatccgcccacaggatatgaagggagcgagccgttctccagaagacagctcaccagacgcagcccgaattagagtcaagagataccggcaatccatgaacaactttcagggactgcgctcctttggctgcagatttggaacctgcaccgtgcagaaacttgctcaccagatctaccagtttacggacaaggataaggataatgtggcgcctaggtctaagatctcacctcagggatacggccgacgtaggagacggagcctgcccgaggctggcccaggccgaaccctggtcagcagtaagccacaggctcacggcgctcctgcccctccttctgggagtgccccacatttcctgtag

SEQ ID NO: 27244 - DNA, 558 bp, Artificial Sequence
  Description of Artificial Sequence: Synthetic coding sequence
atgaagttggtgtcagtcgccttaatgtacctggggtctctggctttcttaggtgcagacacagcacgattggacgttgccagtgagttcagaaaaaaatggaacaaatgggctctgagcagggggaagagagaactgcgtatgtctagctcttaccctactggattagctgacgtcaaagccggacccgcacaaacccttattcgcccacaagacatgaagggggcatctagatccccagaggattctagtcccgacgccgcacggatccgggtcaaaagataccgacagtctatgaacaattttcagggattaaggtcgttcggttgccggtttggcacatgcaccgtccagaagctggcacaccagatatatcagttcactgacaaggacaaagacaacgtagctcctcggagtaagatctccccccaaggatatggtaggagaaggaggcgaagtctcccagaggcaggtcccggaagaacactggtttcttctaaacctcaggctcatggcgctcctgccccaccctctggctccgctcctcatttcctgtag

SEQ ID NO: 27245 - DNA, 558 bp, Artificial Sequence
  Description of Artificial Sequence: Synthetic coding sequence
atgaaactggtgtctgtggccctaatgtatctgggcagcctagccttcttgggggctgacaccgcaagattagacgtggctagtgagttccgcaaaaaatggaacaagtgggctctgtctaggggaaagagagaattacgaatgagttcatcctaccccaccggcctggcggatgtgaaggccggaccggcacagaccttgatccgacctcaagatatgaagggcgcaagtcggtcccctgaggactcatcccccgacgccgctcggatcagggtcaaacgctatcgccagtccatgaataattttcaggggttacgctcttttggctgccgttttggcacctgtacggttcagaaattagctcaccagatctaccagtttacagacaaagataaagacaatgttgccccacggtctaaaattagcccacaaggctatggacgaagaaggcggaggtctctgcccgaagccggtccaggcaggactctggtgtctagcaagccgcaggcacatggcgcaccagccccaccctctggtagcgcccctcactttttgtag

SEQ ID NO: 27246 - DNA, 702 bp, Artificial Sequence
  Description of Artificial Sequence: Synthetic coding sequence
atggccgcaggtactgcagtaggtgcctgggtgctggtgctgagcctgtggggggctgtcgtgggtgcccaaaatattactgcaaggataggcgagcctttggtgctgaagtgcaaaggtgcaccgaaaaaacctccacaacgcctcgagtggaagttgaatacgggtaggactgaggcctggaaggtcttgtctccgcaggggggaggcccatgggacagtgtcgccagggttttgccaaattcctccctgtttctaccggcagttggtatccaggatgagggcatcttccgatgtcaggcaatgaaccggaacggcaaagaaacaaagtccaactaccgcgtccgagtgtaccagataccaggaaaacccgagattgtcgatagcgcttctgagctcactgcgggagtcccaaacaaagtcgtggaggaatctcgacgaagccgaaagaggccttgtgagcaggaagtggggacctgtgtgtctgaggggagctatccagccggaacactgtcgtggcacctagatggtaagccgctagtgccgaacgagaagggcgttagcgtgaaagagcagactcgaagacatcctgagacaggccttttcaccctacagagcgaacttatggtgaccccagccagaggtggcgatccgagaccaactttttcttgctcttttagtccaggcctacctaggcattag

SEQ ID NO: 27247 - DNA, 1029 bp, Artificial Sequence
  Description of Artificial Sequence: Synthetic coding sequence
atggcggctggcaccgccgtgggagcgtgggtcctggtactttccttgtggggggcagtggtcggcgcacagaatattacggcgaggattggcgaacccctcgtcttgaaatgcaaaggcgctcccaaaaaaccccctcagcggctggagtggaaactcggcggtggaccctgggacagcgtggcccgtgttctgcctaactcttccctgtttctgcctgccgtcgggattcaagacgaaggtatatttaggtgtcaagccatgaacagaaacggtaaagagaccaaaagcaattaccgagtccgagtgtaccagatacccggtaagccagaaatcgtcgacagcgcttcggagttgacggctggagtgccaaataaggtggggacctgcgtgagcgagggctcataccctgctggaactctgagctggcaccttgacggcaaacctctggttcccaatgagaaaggtgttagcgtcaaggagcagacaagaagacatcccgagaccggactgtttactttacagagcgaactcatggttacaccggcaagagggggtgatcccagacctacatttagttgctccttctcccccggattgccccgtcacagagccctccgtaccgccccaatccagccaagagtctgggaaccagtacctcttgaggaagtccagcttgtcgtggaacccgaggggggagccgtggcgcctggagggaccgtaactcttacctgcgaggtacccgctcagcccagcccacagatccattggatgaaagacgtctcggatctggagaggggcgcaggccgaacacgcaggggtggcgcaaattgccgtctctgtggccgtatcagggcaggaaactccagtcccggtcccggagatcctggtaggcccggtgatagtaggccagcacactggggacatttggtggcaaaggcggctactcctagacgaggggaagaaggccctagaaaacccggaggccgagggggtgcttgtaggacggaaagcgtgggtggtacctag

SEQ ID NO: 27248 - DNA, 1044 bp, Artificial Sequence
  Description of Artificial Sequence: Synthetic coding sequence
atggccgcagggactgctgtcggagcctgggtgctggtcctgtcactgtggggggcagtcgtcggagcacaaaatatcacagccagaattggggaacctctggtgttaaaatgcaaaggggcaccgaagaaaccccctcagagactcgaatggaaactcaataccggcagaacggaggcatggaaggtcctgtccccccagggagggggaccctgggattccgttgcacgtgtgttgccaaacagcagcctctttctgcctgccgttggtatccaagacgagggtatcttcaggtgccaggccatgaaccgtaacggtaaggagaccaagagcaattatcgggttcgagtttatcagattccagggaaaccagaaattgtagactctgcatccgagctgactgctggcgttccaaataaggtgggcacctgtgtgtcagagggaagctatccagctggaacactctcatggcatcttgacggcaaacctctcgttccaaacgagaagggcgtttctgtcaaggaacagacgcgtcgccacccagaaaccggtttgttcacattacagtcggagctgatggtaactcccgctcgaggcggagacccgcgacccacctttagttgcagtttttccccgggtctgccacggcatagagccctgcgtacggccccaatccagccaagggtctgggagccagtccccctagaggaagttcaactcgtagtggagcccgagggcggagcagtcgctccgggaggtaccgtgactctgacctgtgaagttcctgcccaaccttctccccagatccactggatgaaggatggtgtgccattgcctctgccccctagccccgtcctgattctccctgaaatcggacctcaggaccagggtacttactcttgtgtggctactcattcctcccatggaccgcaagagtctagggctgtgtcaatttcaattatcgaaccaggagaggagggcccaactgcaggtgagggatttgacaaagtgcgagaggccgaggatagccctcagcatatgtag

SEQ ID NO: 27249 - DNA, 1215 bp, Artificial Sequence
  Description of Artificial Sequence: Synthetic coding sequence
atggcagctggaaccgcagtcggggcttgggtgctagtgctcagtctgtggggcgcagtcgttggggctcagaatattactgccaggatcggggagccgctggtcctgaagtgtaagggcgcaccgaaaaagccccctcagcggctcgaatggaagcttaacactggcagaaccgaagcatggaaggtactatccccacagggcggtgggccatgggattctgttgctcgcgtgctgcccaattcctccctgttcctccctgctgtgggcattcaagacgagggtatcttcaggtgccaagctatgaaccgtaacggtaaagagactaagtccaactatagggttcgcgtctaccagattccaggcaaacccgagatagtggactccgcttcggagttgaccgccggagttcccaataaggtgggaacatgcgtctcagaaggttcatatccagctggcaccctctcctggcacctagacggaaaaccactcgtccctaacgaaaaaggagtcagtgtaaaagaacaaacacgcaggcacccagaaacgggcctgttcacattgcaatcagagctgatggtgacgccggctcggggaggggaccctcgacccacattctcctgcagctttagccctgggctgccaagacaccgggcattgcggacagctccaatacagcccagggtgtgggagccagtccctttggaggaggtccaactggtagttgaaccggaaggcggtgcagtggcccctggcggtaccgtaaccctcacctgtgaggtccccgctcagccctctccacagatccattggatgaaggatggagtgcctttgcctctgccgccaagccccgtgctgatcttgccagaaatcggcccacaggaccaaggcacctatagctgtgtcgcgacacacagctcccacgggccacaagagtcccgcgctgtgagcatctcgatcattgagccaggcgaggagggcccaaccgctggaagcgtgggtggctcaggcctcgggaccctagctcttgcactggggattctaggagggctcggcactgctgccttgctcatcggcgttatactatggcagcgtcgccagaggaggggtgaagaaagaaaagcgcctgagaaccaggaggaagaggaggaacgagccgagctgaaccagagtgaggaacctgaagctggggagagctctacggggggaccctag

SEQ ID NO: 27250 - DNA, 705 bp, Artificial Sequence
  Description of Artificial Sequence: Synthetic coding sequence
atggcagccggtactgctgtgggcgcttgggtgctcgttctctccctgtggggggctgtagtgggtgcgcagaatattacagctcggattggggaaccgctggtcctgaagtgcaaaggcgcacctaaaaaaccacctcaaagactcgagtggaagctgaacaccggtcgcactgaggcttggaaagtgctgtcgccccagggaggtgggccttgggattccgtcgccagagtgctccccaatagcagcctgttcctaccagcagtggggatccaagacgagggtatctttagatgtcaggcaatgaaccggaatgggaaagaaacaaagtcaaattacaggagcctccgaacatttacaatcaccgcctcggattggatattccccccatctgaaatccctggaaaaccggaaattgtggactctgcgagcgaactcacagcgggtgtgcccaacaaggtggggacctgtgtgtccgagggtagctacccagcaggcacactgagctggcatctggacgggaagcccctggtgcctaacgaaaagggcgtttccgtgaaagaacagactcgcagacatcctgagacgggactgtttaccctccagtcagagcttatggtgactcctgcacgtggcggagaccccaggccaacctttagctgtagcttttctccaggcctcccacgccacagggcacttcgctag

SEQ ID NO: 27251 - DNA, 402 bp, Artificial Sequence
  Description of Artificial Sequence: Synthetic coding sequence
atgaaggacggcgtccctctgcccctgcccccatcacccgttctgatcctgccagagattgggccacaggaccaggggacctacagctgtgtcgcaacccacagctcacatggcccacaggagagtcgcgctgtctctatctccatcattgaacccggagaagaagggcctactgcaggcagcgtcggaggatctggccttgggactctggccctggccctcggcatcctgggcggacttggaactgccgcattgctcattggtgtcatactgtggcagcgcaggcagcgacgtggcgaagagcgcaaagcccctgagaatcaagaagaagaagaggagagggcagagctaaaccagagcgaagaacccgaggcgggtgaatcctctaccggcggtccctag

SEQ ID NO: 27252 - DNA, 1308 bp, Artificial Sequence
  Description of Artificial Sequence: Synthetic coding sequence
atgggagccggtgagagggttcaggcccctccgagagctgaggctacagccggacggggtgccgacagggctcgcaccctggaggggtcccgtatggctgcaggcactgccgtcggcgcatgggtactcgtgctgagtctgtggggggctgtggtgggagctcagaacattactgctcgaataggtgaaccgctggtattgaagtgcaaaggtgccccaaaaaaaccaccacagcggttggagtggaaacttaacacaggacggaccgaggcctggaaagtgctgtccccacagggaggtggtccatgggactcggtggctcgcgtgttgcccaacagtagtctgttcctgcccgcagttggcatccaggatgagggtatcttccggtgccaggccatgaaccgaaacggcaaggaaacaaagtctaattaccgagtgcgggtgtatcagatacccggaaagccggagattgtggacagcgcttccgaattgaccgccggagttccaaacaaagtcggcacgtgcgtctccgaggggtcataccccgctggtaccctgtcttggcacctggacggaaagccactcgtccccaatgagaaaggcgtcagtgtcaaagaacagacccgaagacatccagaaaccggactcttcacccttcagtccgagctgatggtaacccccgctagaggtggtgaccctcgccctaccttttcttgttcattcagtcctggcctgccacgccatagagcgctgcggaccgcacccattcagccaagggtttgggaaccagtgcccttggaggaggtgcagttagttgtcgaacccgagggtggcgcagtggcgcctggcggaaccgttacactgacatgcgaggtgcctgcgcagccttctcctcagattcattggatgaaagacggtgtccccctgcctctccctccaagcccagtcctgatcctcccagagatcggcccacaggatcaggggacctattcatgcgtggctactcactcatcgcatgggccacaagaaagccgagccgtctcaattagcatcatagagcccggtgaggaaggccctactgccggtagcgtgggcggatccggcctcggcactctggcactggcgctcgggattctgggaggtttaggaacagcagcactgctgatcggagtgatactgtggcagagacggcagagaagaggtgaggagagaaaagcaccggaaaatcaggaggaagaagaggagcgtgccgagctgaaccagagtgaggagcccgaggcaggggaatccagcaccggcggaccctag

SEQ ID NO: 27253 - DNA, 387 bp, Artificial Sequence
  Description of Artificial Sequence: Synthetic coding sequence
atggctgcgggaacagcagtgggtgcatgggtgttagtcctgagcctttggggtgcagtggttggggctcagaatattaccgcccgtatcggtgagccccttgtgctgaaatgcaaaggagcccctaagaagccacctcagaggctggagtggaaactgaacactggtaggaccgaggcatggaaagtactcagtcctcaggggggtgggccatgggactctgtagctagggttttgcccaatagtagcctgtttctgccggctgttgggattcaggacgaaggaatatttagatgtcaggccatgaaccggaacgggaaggaaacgaaaagcaattatcgtgttagggtatatcaatttgagaacctgcacaactatagcctttag

SEQ ID NO: 27254 - DNA, 462 bp, Artificial Sequence
  Description of Artificial Sequence: Synthetic coding sequence
atggcagctgggaccgcagtaggcgcatgggtgcttgtgctaagtctgtggggggcagtggtaggagcacagaatataacggccagaatcggggagccactagtgttgaagtgtaagggggctcctaaaaagcctccgcagagactcgaatggaagctgaataccggacgcacagaggcctggaaagttttgtctccccaggggggaggaccctgggactccgtggcacgggtcctgccaaactcctccctgttcttgcctgcggtcggtattcaggatgaaggtatcttgggtggcctcggcacagcagcactgcttatcggcgtgattctttggcagagaaggcagaggcggggtgaagagcggaaagcaccagagaaccaggaggaggaggaggaacgggctgaattgaatcagagcgaagagcccgaggcaggggaatccagcacgggagggccatag

SEQ ID NO: 27255 - DNA, 885 bp, Artificial Sequence
  Description of Artificial Sequence: Synthetic coding sequence
atgaacagaaacgggaaggaaacaaagagcaactatcgtgtgcgcgtttaccaaattcccggtaaacccgagatcgttgacagcgccagcgaacttactgctggcgttcctaacaaggtgggcacctgtgtaagtgagggcagctaccccgctggtacactctcctggcaccttgacggcaagccactcgtgcctaatgagaagggggtgtcagtgaaagagcagactagaagacatcccgagaccggcctatttactctccagagtgaactgatggtgacacccgcacgaggcggagacccccgaccaactttctcttgttcctttagtccgggactaccacgccacagagcccttcggaccgccccaatccagcccagagtctgggagccagtgcctctggaggaggtacagctggtcgtggaacccgaggggggtgcagtggcacctggcggaactgtgactctgacatgcgaggtgcctgcccagccctctccacaaatccactggatgaaggacggggtccccctgcccctcccaccctcacctgtgctcattctgcccgagattgggcctcaggaccagggcacctactcctgtgtggccactcatagctctcatggccctcaggagagccgggcagtttccattagcatcattggaagcgtggggggaagcgggttgggcactctggccctggcgttgggaatactggggggactagggactgccgctctgctgatcggcgtcattctctggcagcggagacagcggcgaggcgaagagcggaaagcccctgagaatcaggaagaggaggaggagcgggcagagctaaaccaaagcgaagaaccagaggccggagagtcctctactggcggaccgtag

SEQ ID NO: 27256 - DNA, 366 bp, Artificial Sequence
  Description of Artificial Sequence: Synthetic coding sequence
atggccgcaggcaccgcggtgggcgcttgggtcctcgtgctgagcttgtggggggcagttgtaggagctcagaatatcaccgccagaatcggcgaacctcttgtgttgaagtgtaaaggagctcccaagaaacctccccagcgactcgagtggaaattaaataccggtcggaccgaggcctggaaggtgctcagccctcagggcggtggcccatgggacagtgtagcacgggttttgcccaacagtagcttgttccttcctgccgtgggtatccaggacgagggcatcttccggtgtcaagcaatgaatcgtaacggcaaggaaacaaaatcaaattggtggtggtcacagaaggttgagcagtag

SEQ ID NO: 27257 - DNA, 1092 bp, Artificial Sequence
  Description of Artificial Sequence: Synthetic coding sequence
atggcagccggaaccgcagtgggagcatgggttttggtcctctcactctggggtgcagtggttggcgcacagaatattaccgcaagaatcggcgaacccctggtcctgaagtgcaagggagcaccaaagaaaccaccgcagaggctcgaatggaagttaaatactggcagaacggaagcttggaaggtgctgagtccgcagggagggggaccgtgggatagtgtcgcacgcgttctgcccaattcttctctgtttcttccagccgttggcatccaggatgaaggaattttcaggtgccaagctatgaaccgaaacggcaaggagactaaatctaactaccgggtgcgtgtataccaaattcctggaaagcccgagattgttgactccgcatctgaactcaccgctggcgttcccaataaggttgttgaagaaagcaggcgtagtcgaaagcgcccatgcgaacaagaggtgggtacatgtgtgtcggaggggagctaccctgcaggtaccttgtcatggcatcttgacgggaagcccctggttcccaacgagaaaggggtgtcagtaaaagaacagacaagacgccacccagaaactggcctgttcacgctccagtcagagctgatggtaactcctgcacggggtggcgaccccaggcctacgttcagctgttctttcagccccggactcccccgacaccgggcactgagaacggcgccaatccagccgcgagtctgggagccggtgccactggaggaagtccagctagtcgtggaacctgagggaggcgcagtggcccctggcggtacagttaccctgacctgcgaggtgccagcccagccgagcccgcaaatccattggatgaaggatggtgtgccgctgcccttaccgccttctcccgtgctaattctgcctgagattggccctcaggaccagggaacctactcgtgtgttgcaacccacagctcacatggccctcaggaaagccgggcagttagcatcagcatcatcgagccgggtgaggagggaccaaccgctggggaagggtttgataaggtccgggaggctgaggatagtccacaacatatgtag

SEQ ID NO: 27258 - DNA, 3633 bp, Artificial Sequence
  Description of Artificial Sequence: Synthetic coding sequence
atggccgctcaaagttccctttataacgatgacagaaatctcctgagaatccgggaaaaggaaagacgaaaccaggaggcccatcaggaaaaagaggcatttccggaaaagattcccctgttcggtgaaccctataagaccgctaagggtgatgagttgagtagccgaattcagaacatgctcgggaactacgaggaggtaaaggagtttttatcgacgaagagccatactcataggctggacgcaagtgagaaccgactgggaaagcccaaataccctctgatcccggacaaggggtcgtcgatcccatcctcttcatttcacacatctgtacaccaccagagtatccatacccccgctagtggacctctgtccgttggcaatattagccacaatcctaagatggcacagcccaggacagaaccaatgccctccctccatgccaaatcttgcgggccaccagactcccagcatctgacacaggaccggctagggcaggaagggttcgggtctagccaccacaagaagggggatcggagggcagacggagaccattgtgcatctgtcacagacagtgcccctgagagggaactttcccccctcatctctttgccttccccagtgccacctttaagccctatccatagcaaccagcagactttgccaaggacccaggggagcagcaaagtgcacggatccagcaataactccaaaggttactgcccagccaaaagcccaaaggatttggctgtgaaggttcacgacaaggaaaccccccaggattcgcttgtcgctccagcccagcctccctcccagaccttcccccctccctcgctacctagtaagagtgtagccatgcagcagaagccgaccgcttacgttagacccatggatggacaggaccaggcgccatcagagagccctgagttgaaacctctcccagaagattatcggcaacagacattcgagaagacggatttaaaggttccagcgaaggccaagttgactaagctcaagatgccttcacagtctgtggagcaaacgtatagcaacgaagtgcactgtgtagaggaaattctcaaagaaatgacccacagctggcccccaccgcttaccgctatccacaccccctcaactgctgagccttcgaagtttccctttccgaccaaagatagtcagcacgtgtcgagtgtcacccagaatcagaaacagtatgatacaagcagcaaaactcacagtaatagccagcaaggtacctcctccatgctggaggatgatttgcagttgtctgatagcgaggatagcgattccgagcagacacctgagaaacctccctcctcgtccgctcctccatccgccccacaatctttgccagagcctgttgcttctgcgcactccagtagtgctgaaagcgaaagcacatccgatagcgatagttcatctgatagtgagtcagagtcttcaagctcagacagcgaggagaacgaaccactcgagaccccagccccagagcctgaaccgcctacaactaacaaatggcagctggataattggttaacaaaggtctcccagcccgcagcgccacctgaggggcctaggtccacggaaccccctcgaagacatcccgagagtaaaggttctagcgacagtgcaaccagtcaagaacacagcgagagcaaggatccaccgcctaagtcctcttccaaagcaccacgagcccctccagaggcacctcacccaggaaaaagatcttgtcaaaaaagcccggcacagcaggaacctccacagcgacaaactgtcggcacaaagcagccgaaaaagcctgttaaagcctccgctagagcaggtagtcgcacttcactgcagggagagcgcgaaccgggactcctgccatacggatctcgtgaccagacttcaaaggacaaacctaaggtgaaaactaagggacggcctagagcggcagcatcaaacgagccaaaaccagccgttcccccatcatcggaaaagaagaagcataaatcctctctgcctgccccttctaaagcactaagtggccctgagccagccaaggacaacgtcgaagatagaacccctgagcatttcgcgcttgtgcctctgacggaatcccagggaccccctcacagcggatccggcagtcgcaccagtggctgtcgccaggctgtggttgtccaggaggatagccggaaagatcgactgccactgcctttgcgtgacacaaaactcctatccccactgcgggatactcctccaccccagagtttgatggtaaagattaccctggaccttcttagcaggatacctcagccccctgggaaagggtcgagacaaaggaaagctgaagataagcagccgcctgccggtaagaagcactccagtgagaaacgttcctccgatagcagcagtaaattagccaagaaaaggaagggcgaagccgaacgagattgcgacaataagaaaattcgattggaaaaggaaattaagagccagagctcctcctcttcatccagccacaaggagagctcaaagaccaagccatcacgaccaagcagccagtcatcgaagaaggagatgctgccccctcccccagtttcatcttcatcccaaaaaccagcaaaacctgccctgaaacgctctaggagagaggctgacacttgcggtcaagatccgccaaaatcagcctccagcacgaaatcaaaccataaggattccagtattccaaagcagaggagggttgagggcaaagggtctagaagctcatctgagcataagggttcatccggtgatactgccaatccctttcccgttccttcattacccaatgggaacagcaaaccaggtaagccccaagtcaagttcgataaacagcaggctgatctccacatgcgcgaggcgaagaaaatgaagcagaaggcggagctcatgacagatcgcgtcggtaaggccttcaaatatttggaggcggtccttagcttcatcgagtgtggcattgcaacagagagcgaatcacagagtagtaagagtgcttactccgtgtatagcgaaaccgtcgacttgattaagttcataatgtccttaaaatccttttccgacgctaccgcccctacacaggagaagatattcgctgtcctgtgcatgcggtgtcaaagtatcctgaatatggctatgttccgctgcaaaaaggacatcgccatcaagtatagccggacccttaataaacactttgagtccagcagtaaagtggcccaggccccaagcccctgcattgccagcaccggaacaccatcccctctttcacccatgcccagccctgcttcctccgttgggtcacagtccagcgccggttcagtcggctcgagtggggtagccgctaccatatccacccccgttaccattcagaatatgaccagctcgtatgtcacaatcaccagtcatgtcttaacggccttcgatctgtgggagcaggccgaagcactcactaggaagaataaggagttcttcgcacgtctgtccaccaatgtgtgtaccttggcactgaactcatcccttgtcgacctggtacattacacaaggcagggcttccagcagctgcaggaactaaccaaaaccccatag

SEQ ID NO: 27259 - DNA, 1266 bp, Artificial Sequence
  Description of Artificial Sequence: Synthetic coding sequence
atggcctttacagaacgggtcaacagctcagggaatagcctgtataacgacgatcggaaccttttgagaattcgggagaaagagagacgtaatcaggaggctcaccaggaaaaagaagcgtttccagagaagatccctctctttggcgaaccttacaagaccgcaaagggcgatgaactaagcagcagaatccagaatatgttaggtaactacgaggaggttaaagagtttctgagcacgaagagccacacacacagactggacgccagcgagaaccgcctgggaaagcctaaataccccctaatcccggataaggggagctccatcccttcttcctctttccacacatctgttcaccaccaatcgatccatacccccgctagtggaccactcagcgtcggaaatatcagtcataatcccaaaatggcccagccacgcacggagccaatgccctcactgcacgctaagagttgtggacccccagattctcagcatctcacacaggaccggctggggcaagaaggttttgggagcagccatcataaaaagggcgatcgcagggctgacggggaccactgcgcaagcgtgaccgattcggcccctgagagggaactgagtcccttgataagcctaccctcccctgttcccccactgtcccctattcatagcaaccagcagactcttcctagaactcaagggagttccaaggtgcacggaagcagtaataacagcaaggggtattgtccagctaaaagcccgaaggaccttgcagttaaagttcatgataaggaaaccccccaggactccctcgtcgcgcctgcacagcctccgtcgcaaacgtttcccccacctagcctacccagcaagtcggtcgcaatgcagcagaagccaaccgcatatgtcaggccgatggacggacaggaccaggcaccctccgagagtccagagctaaaacccttacctgaggattatcgccagcaaactttcgagaagacagatttaaaagtgccggcaaaggctaaactgaccaaactgaagatgccttctcagtctgtggagcagacctactccaacgaagtgcactgcgtggaggaaattttgaaagacagccagcatgtctccagcgtgacacaaaatcagaagcagtacgatacctctagtaagactcatagcaattcccaacaaggcacaagttccatgctggaagacgatctgcagctgtctgactcagaagactcagattccgaacagacacctgcgccttag

SEQ ID NO: 27260 - DNA, 3657 bp, Artificial Sequence
  Description of Artificial Sequence: Synthetic coding sequence
atggcatttactgagagggtaaatagtagcggcaatagtctgtacaacgatgatcgtaatctgctcaggattagagagaaagagcgacgaaaccaggaggctcatcaggaaaaagaggccttcccagaaaagatccctctgttcggagagccatacaaaacggccaagggagatgagctatcctccagaatccagaatatgcttggcaattatgaggaagtcaaggagtttctctctacaaaatctcatactcataggctggatgctagtgagaatcgcctggggaaaccaaagtatccgctgataccagataaaggctcatcaattccctcatccagcttccatacttccgttcaccatcaatccattcacactcccgcaagcgggccactctcggtcggcaacatttcacataatcctaagatggcccagcctcgcactgaaccgatgccgtccctgcatgccaaaagctgtggacctcccgatagccaacacctcacacaggataggttaggtcaagagggctttggctcctcccaccacaagaagggcgacaggcgtgctgacggtgaccattgtgcgtccgttactgacagtgctcctgaaagggaactgagtcctctcatcagcttgccttccccagtgccacccctgagccccattcacagtaatcagcagaccctgcctagaactcaggggtcaagtaaggtccacgggtccagtaacaacagcaaagggtattgtcccgcaaagagccctaaagacctcgccgtgaaggtacacgataaagaaaccccacaggactctctcgtggccccagcccagccaccctcccagaccttccctccaccttccctaccctcaaagagtgtcgccatgcagcaaaaacccactgcttatgtgcgaccaatggatggtcaggatcaggctccaagcgagtcaccagagctgaagcccctgccggaggactaccgccagcagacgttcgaaaaaaccgatctgaaagtacccgctaaggccaagctgacgaagctcaaaatgccttctcagtcggttgagcagacctactctaacgaggttcattgcgttgaagaaattctcaaagagatgacgcattcatggccgcctccccttacagcaattcacacgccctcaacagcagaaccctctaaatttccattcccaactaaggattcccagcacgtatcttctgtaactcagaaccagaagcaatatgacaccagctcgaagacacatagcaactcccagcaagggactagctcaatgctggaggatgacctgcagctgagtgactctgaggattccgactcggaacaaactccagagaaacctccgtctagttccgcccctccatccgcaccgcagtctctgcctgaaccagtggcgtccgcacactcgagttccgccgagtctgaaagtacaagtgattccgacagtagctccgattcagaatccgaatcttcttcctcagactcagaagaaaatgagcctcttgaaacccctgcaccagaacccgaacccccaaccaccaacaagtggcagctagataactggctgacaaaggtgagtcagcctgcggctccacctgaaggacccagatccactgagccgcctcggaggcaccccgagtccaaggggtcttcggactccgccacctctcaggagcactccgagtcgaaagaccccccaccaaagtcttcaagcaaggctcccagagctccccctgaggctcctcatccaggtaagcggagttgccagaaaagtcccgctcaacaggagccaccccagcgacagacagtggggaccaaacagccaaaaaaacctgtgaaagccagtgcaagagctggaagccgcacaagtttgcagggagaaagagagcctggtctgctcccgtacggatcccgtgaccagacttccaaagacaagcctaaggtgaaaacgaagggaagaccgagggcggcagcctctaacgagccaaagcctgctgtacccccaagctccgaaaaaaaaaagcataagtcatctctgcccgcaccctcaaaggccttgtcaggacccgaaccggctaaggataacgtggaagacagaacaccagagcatttcgcccttgtgccattgacagagagtcaagggccaccccactccgggtcaggctcaaggactagcggatgccgtcaggccgtagtggtgcaggaagactctcgaaaagatagattgcccttgcccctgcgtgacacgaaactcctgagtcccctaagggacacaccaccaccgcagtcactgatggtgaaaatcaccctcgatctcctgagccgtatccctcaaccgcctggcaaaggatcacgacagaggaaggccgaggacaagcagccaccagcaggcaagaaacattcaagcgagaagcgcagctccgatagttcttccaagttggcgaagaaaagaaagggcgaagccgaacgggactgcgacaataagaagatccggcttgagaaggagattaagagccagtcttcttcaagctcctcctcccacaaggagtcgtctaaaaccaaacccagccggcctagttctcagtctagcaagaaagaaatgttaccaccgccacctgttagcagtagcagtcagaaacctgctaagcccgctcttaagagaagcagaagagaagctgatacctgcggacaggaccccccaaaaagcgcctcgtcaaccaaatccaatcataaagattcttccatccctaagcagcgaagagtggaaggcaaggggtctaggtcatcgagtgagcacaagggttcttccggcgacaccgcaaacccgtttccggtgcctagtttgccaaacgggaattctaaaccaggcaaaccccaggtgaaattcgacaaacagcaagccgatctgcacatgagggaagccaagaaaatgaagcagaaagcggagctaatgacagatagagtggggaaagcgttcaaatacttggaagcagtgctgtccttcatcgagtgtggtatagcgacggaaagcgagagccaatcaagcaagagtgcctatagtgtctattccgaaacagtggaccttattaagttcattatgtccttgaagtctttctctgatgccacagctcctactcaggaaaagatctttgctgtcttatgcatgcgctgccagtccatcttaaatatggctatgtttagatgtaaaaaagacatagccatcaagtactctaggacgctcaataagcattttgagtcatcctccaaggtggctcaggctccctccccctgtatcgcacgatccactggtacccccagtccgctgtcacctatgcccagcccagcgtcatccgtgggcagccagtccagtgcgggaagtgttgggtcatctggtgtggctgcaaccatcagtacaccggtgacaatacagaatatgacctcatcctatgtgactataacaagccacgtgttgacggcattcgacttgtgggagcaggcggaagcgctgacccggaagaacaaagagttctttgcacggttgtctaccaatgtctgcacgttggcccttaatagctcattggtcgatctggttcattatacaaggcagggctttcagcagttacaggaactgacaaaaaccccttag

SEQ ID NO: 27261 - DNA, 1221 bp, Artificial Sequence
  Description of Artificial Sequence: Synthetic coding sequence
atggcgttcacagagagagtgaatagctcaggtaattctctctacaatgatgaccgcaacttgctgcgcattcgggagaaggagcgacggaatcaagaagcccaccaagagaaagaagcatttccggagaaaattccgctgttcggcgagccttacaagacggccaaaggagatgaattgtctagcagaattcagaatatgcttggtaactacgaggaggtaaaagagttcctttcaactaaatctcatactcatcgtctggatgctagcgaaaaccggcttggtaagccaaaataccctctgattccagacaaggggagctcgatcccgtcctcttcctttcacacttccgtgcaccatcaaagtatccatactcctgcatcagggccactctcagtaggcaatatctctcacaatcccaaaatggctcagcctcgcacagaaccaatgccctctctccacgccaagagttgtggccctccggactctcaacatctcacacaggatcgtctgggtcaggaagggttcggcagctcacatcacaagaagggagaccgcagggcagatggagatcactgcgccagcgtcactgactcagctcctgaaagagagctttccccactcatatctctgccgtcaccagtgccgcctctgtccccaatccactcaaaccaacagacactaccgaggacccagggcagtagcaaggtccatggttctagcaataattcaaagggctactgccctgccaaaagtccgaaggatcttgctgttaaagtgcatgacaaggaaacaccgcaggatagcctagtcgcaccagcccagcccccatcccaaacgtttccccctcctagtctcccctcgaaatccgttgctatgcagcagaagcctaccgcctatgtgcgcccaatggatgggcaggatcaggccccttccgagtcacccgagctgaaacctctaccagaggattataggcagcagacattcgaaaaaaccgatctaaaggtccctgccaaggctaagctcacaaaactcaagatgccgtcccaatccgtggaaacctacagcaatgaagtccactgcgttgaagagattttaaaggagatgacgcactcttggcctcctcccctcaccgctattcacacccctagcacggcagagccttccaaatttccctttcccaccaaagattctcagcacgtaagttctgtgactcagtag

SEQ ID NO: 27262 - DNA, 1473 bp, Artificial Sequence
  Description of Artificial Sequence: Synthetic coding sequence
atgcccagccagagcgtcgagcagacatacagcaatgaggttcattgcgtggaagaaatcctcaaggaaatgacacacagctggccgcctccccttaccgccattcacacccccagcactgcagaaccatctaagttcccctttcccacaaaggatagtcaacatgtgtcaagcgtgacacagaaccagaaacaatatgatacatcaagtaagacacactccaactcccaacagggtacctctagtatgctggaggacgatctgcagcttagcgactccgaggatagcgactccgagcagactcctgagaagcctcctcacctccatttgcaggtgttacactccccttttcagaaccagtggcaccaacacattcccgctgttcaatcccaaaaggctcccgtcacgcagacggtgccacagactcagcgagctagagcagtgcaagactccgaagagaacgagcctctggagactcctgcccctgagccagaaccccctacgacaaacaaatggcagttggacaactggctaactaaggttagccagccagcggctccgcctgagggtcctcgaagcaccgagccacccaggaggcaccccgagtcaaaagggagttccgactccgccacatctcaggaacatagtgaatcaaaggatcccccacccaaaagtagtagcaaggcccctagagcgccacccgaagccccacatcccggaaagagatcctgtcaaaaatctcctgctcagcaagaacccccacaacgacagactgttgggacaaaacagcccaaaaagcctgtgaaggcttcagctagagcgggatcgaggacctcattgcagggcgagcgcgagccagggctcctgccctatggcagtcgggaccaaacaagtaaggataaacccaaagttaagacaaaagggcgacctcgggcagcagcttctaatgaacccaaacctgccgtgcctccaagcagcgagaagaagaagcacaagtccagcctgcctgcgccaagcaaggcactgagcggacccgagccagccaaggacaacgtggaggatcgcaccccagagcacttcgccctggtcccactgaccgagtcccaaggacccccacacagtgggagcgggagccgcacgagcggctgcaggcaggcagttgtagttcaggaagactccaggaaggataggctgcccctgcctcttcgtgacaccaagcttctatcaccactgcgggacacccccccacctcagagcctcatggttaagataacattagacctgctctcccgcattccacaacctccgggaaagggctctagacaaaggaaagccgaagataaacagcctcccgcaggcaaaaagcatagctccgagaagaggtcatccgactcttcatcaaaattggcaaagaagcggaaaggtgaagctgaacgcgattgtgataataagaagatccgattggagaaatag

SEQ ID NO: 27263 - DNA, 2550 bp, Artificial Sequence
  Description of Artificial Sequence: Synthetic coding sequence
atgacacattcctggccgcctcccctgacagccatccacacacccagcaccgctgaaccaagtaaatttcctttccccactaaagatagtcagcacgtgtcgtcggtaactcagaaccaaaaacagtacgatacatctagcaagactcacagtaactcacagcaggggactagcagtatgctggaagacgacctgcagctgtcagactccgaagatagtgacagcgagcagacacccgaaaagcccccaagttccagcgctccacctagtgccccacagtcacttccagagcctgtggcctctgcacacagctcctccgccgagagcgagtctacctcagacagtgatagcagctctgactccgaatctgaatcatcctcctcagacagtgaggagaacgagcctttggagacccccgcacccgagccagaacctcccactacaaacaaatggcaattggataattggctgaccaaggtcagccagcccgctgctccgcctgagggaccgcgaagtaccgaaccgccaaggcgccaccctgaatccaagggttcatctgactctgctacctcccaggagcacagcgagagcaaagacccccctcccaagagcagctctaaggcaccaagagcaccccctgaagcaccgcatccaggcaagagaagttgtcagaagtctccagctcagcaggaaccaccacagagacagaccgtggggactaaacaaccaaaaaaaccggtcaaggcctctgcacgcgcagggtctcgcacgagtttacagggcgaacgcgaaccaggcctcctcccctacggatcacgggaccagacaagcaaggacaaacccaaggtgaaaacgaaaggcagaccgagagcggcagcgagcaacgagccaaagcccgcagtaccaccgagctccgagaaaaaaaaacacaagagcagcctacctgctcccagcaaagctttgtctggacccgaaccggcaaaggacaatgtggaggaccgaacacccgaacacttcgcccttgtacctttgactgaatcccagggtccccctcatagcggatcagggtcacggacttcaggctgccggcaggccgtggtggtccaagaggatagcaggaaggaccggctgccacttccactgcgggatacaaagttgctgagtccccttcgcgatactcctcctccccaatctctgatggtcaagatcacattagatttgctgtcccgtattccacaacctcctggaaaaggttccagacagcgtaaagcggaagacaagcagcctccggctggcaaaaagcacagctccgaaaagcgcagctccgattcttctagtaagctggctaagaagagaaagggagaggctgaacgggattgtgataacaaaaaaatccgacttgagaaggaaataaaatcacagtcaagcagctcatcctcatcacataaggaatcttccaagacaaagccttctaggcccagcagtcagagcagcaagaaggaaatgctgccgccaccgccagtttctagttcctctcagaagcctgctaaacccgcactgaagcggtctcgacgtgaggctgacacatgtgggcaggatccccctaaatctgcttccagcaccaaatcaaatcacaaagactctagcattccaaaacaacgacgagtggaaggaaagggttcaagaagctccagtgagcataaaggctcctctggcgacactgctaatcctttccctgttccaagtctccctaatgggaattcaaagccaggaaagccacaggttaagttcgacaagcaacaggccgacttgcacatgagggaagccaaaaaaatgaaacagaaagccgagctgatgactgatagggtgggcaaggctttcaagtacctggaggctgtgttatcttttatcgagtgcggaatcgccactgagtcagagagccagagctccaagtcggcttattcagtgtacagcgagaccgtggatttgatcaagtttatcatgagccttaagagtttttcggacgcaacagctcccacccaggaaaagattttcgctgtgttgtgtatgcgatgtcagagtattttgaatatggcaatgtttcgatgtaagaaagacattgcaataaagtactcgcgcaccctcaacaagcattttgagtcctctagcaaagtcgctcaggccccttccccttgtattgcaagaagtactggaacgccttcccctctgagtccaatgccgagtcctgcctcatctgtcggatcccaatcgtccgccggaagcgtgggtagctctggtgtcgctgccacgatctctactcctgtcacaatacagaatatgacaagctcctatgtcacaatcacatctcatgttctgacagcttttgacctctgggagcaggctgaggccctgacgaggaagaacaaagaattcttcgcacggctgtctactaacgtgtgtactcttgcactcaacagctccctggtggaccttgtgcactacaccagacaggggtttcagcagctgcaggagcttaccaagacaccatag

SEQ ID NO: 27264 - DNA, 2376 bp, Artificial Sequence
  Description of Artificial Sequence: Synthetic coding sequence
atgccagacatgcatttcaaagctcctaagatatctatgccagacgtcgacttacatctgaaaggacctaaggtcaagggtgacgtcgatgtatccgtgccaaagctggagggtgacttaaccgggcctagcgtgggagtggaggtgccagatgtggagttggagtgcccggacgccaagctgaaggggcctaaattcaagatgcccgaaatgcatttcaaaacccccaagattagcatgccggatgtagacttacacctgaagggtccaaaggtgaagggagacatggatgtgagcgtaccaaaagtcgaaggagagatgaaagttccagacgtggacatcaaaggacctaagatggacatcgatgccccagacgttgacgtgcatggaccagactggcatctgaaaatgccaaaaatgaagatgcccaaatttagtatgccgggatttaaggcagaaggaccagaggtagatgttaatttaccaaaggccgacgtcgtggtaagcggacctaaggtcgacgtggaagtgcctgacgtgtcattagagggcccagaaggaaaactcaagggacctaagttgaaaatgcctgagatgcacttcaaggccccaaagatcagtatgcctgatgtcgacctccacctcaagggacccaaagtgaagggagatgttgacgtgtcgctgcccaaactcgagggcgatcttacagggccttccgtggatgttgaggtaccagatgtggagctcgagtgtcctgatgcaaagctgaaagggccaaaatttaagatgccggagatgcacttcaagacccccaaaatctccatgccggatgtgaatctcaatctgaaaggacccaaagttaagggcgacatggatgtctccgtccctaaggtcgaaggagaaatgaaagttcccgatgtggatattcggggtccaaaagtagacatcgacgccccagacgtagacgtgcacggcccagattggcaccttaagatgccaaaaatgaaaatgcctaagttctctatgcctggcttcaagggcgagggccctgaagtggatgtcaatctgccaaaagcagatgtggacgtaagcgggcctaaggtggatgtggaggttcccgacgtctccctggaggggcctgagggtaagctgaagggacctaaattcaaaatgcctgagatgcactttaaaacgcctaagatttctatgccagacgtggatttcaatctaaaaggtcctaaaattaagggcgatgtggatgtcagtgcacccaagttagaaggagaactgaagggcccagagctggacgtgaaaggacctaaactcgacgccgatatgccagaagtggcagtcgaaggtcccaatggtaaatggaagacgcctaaattcaaaatgccagacatgcattttaaagcccctaaaatctctatgcccgatcttgatctccacctcaagtcgccaaaggctaaaggcgaagtcgatgttgatgtgccgaaattggagggcgatctgaagggtccccatgttgatgtttccggtcctgacatcgatatcgaaggccctgagggcaagctgaaaggtcctaagttcaagatgcccgatatgcactttaaagccccaaacatcagcatgcccgacgtagatctcaacctcaaagggccaaagatcaaaggtgatgttgacgtgtccgttcctgaagtggagggcaaacttgaggtcccagatatgaatattcgaggacctaaagttgatgtcaacgcgccagacgtccaggccccagactggcacctcaaaatgccgaagatgaagatgcccaagtttagtatgccgggattcaaggctgagggtcctgaggtggatgtgaaccttcccaaggctgacgtagacattagcgggccaaaggtggacattgaaggacccgacgtgaacatcgaaggacctgaaggtaagttaaaaggcccaaaattaaagatgccagaaatgaatatcaaggcgccaaaaatctctatgcccgactttgacttgcatctcaaaggccctaaggttaagggagacgtggacgtgtcgctaccgaaggtagagggagatctaaaaggtcccgaggtcgacatcaagggcccaaaagttgatatcaacgctccggacgtcggcgtccagggtcccgattggcacctcaagatgcctaaggtgaagatgcctaagttttccatgcctggcttcaaaggtgaaggcccagacggggacgttaagttaccaaaagctgacattgatgtctctggaccaaaagtagacatcgaaggtcccgacgtgaatatcgagggccctgaaggtaagctgaaaggtccgaagtttaagatggctcaacgttggtggtag

SEQ ID NO: 27265 - DNA, 450 bp, Artificial Sequence
  Description of Artificial Sequence: Synthetic coding sequence
atggagaaagaggaaaccactagagagctgttacttcctaattggcaggggtctggcagccatgggctgaccatagcccagcgcgacgacggtgtgttcgttcaggaggtgacccagaattccccggctgccaggaccggcgtcgtcaaagagggggaccagatcgtcggtgccactatttacttcgacaatctccagtctggtgaagtcacacagttgcttaacactatggggcaccacacagttggcttaaagttgcaccgaaagggagatcgatctcccgaacccggacagacgtggactagggaggtcttctcttcttgttcaagtgaggtagtgttaaacacaccgcagccatctgccctagagtgtaaggaccaaaataagcagaaggaagcaagctctcaggctggggctgtctctgtttcgacccccaacgccggactgtag

SEQ ID NO: 27266 - DNA, 17673 bp, Artificial Sequence
  Description of Artificial Sequence: Synthetic coding sequence
atggaaaaggaggagaccaccagagagctacttctgcccaattggcaggggtccggctcccatggtctgacgatcgcccagagggacgacggcgtgttcgtgcaggaagtgacccagaacagcccagctgcccgaacaggagtggtgaaggaaggcgatcagatcgtaggcgctacaatatattttgataacctgcagtccggagaggtgactcagttgctcaatacaatgggccatcatactgtcggcttaaagttgcataggaaaggcgacagaagccccgagccaggccaaacgtggacgcgtgaagtgttctctagctgctctagtgaggtggtgctaagcggtgacgacgaagagtaccagcgcatatatactaccaagattaagcccaggctaaaaagtgaggacggcgtagagggcgacctcggagagactcagagtcgaaccattacagtgactagaagagtgaccgcctataccgtcgatgtcactgggagagaaggcgcaaaggatattgacattagcagccccgagtttaaaattaaaatccctcggcatgagttaaccgagattagtaatgtggatgtggagacccagtccggtaagacagttatccggctgccctccggctctggggctgccagtccaactgggtcagctgttgatattcgcgctggggctatatcagccagtggtccagagttgcaaggagcgggacattcaaagctccaggtgacgatgccagggattaaagtgggcggatctggagtgaatgtgaatgccaagggcctggatctcggcggtcgtggaggtgtccaggtccccgctgtggatatcagttcaagcctgggtggcagagctgttgaggtccagggccctagcttggaaagtggtgaccacggcaagattaagttcccaacgatgaaggtccctaaatttggggtgtctactgggcgtgagggacagacaccgaaagctggactcagagtgagcgccccagaagtctcggtagggcataagggaggaaagcctggcctgactatccaggcccctcagctggaagttagcgttccatctgcgaatattgaaggactagaaggtaagctgaagggcccacagattactggaccctccctcgagggtgacttaggattaaagggcgctaagccccagggacatattggagtggacgcaagcgctccgcagattggagggtccattactggcccatcggtggaagttcaggccccagatatcgatgtacaaggacctggctccaagctgaacgtccctaagatgaaagtgccaaaatttagtgtgagcggggcaaaaggcgaggagactggaattgatgtgaccttacctaccggagaggtgactgtccctggggtgagtggggacgtgagcctgccggagatcgccactgggggtctggagggcaagatgaaaggcactaaggtgaagaccccagagatgatcattcagaagccgaagatatccatgcaagacgttgacctgagtctcggctctcccaagctgaagggggatatcaaagtcagcgctcccggtgtgcagggcgacgtgaaaggccctcaggtggccttaaaaggtagtcgggtagacatcgagacacctaacttagaaggaacactgactggcccaaggctcgggtcgcccagcgggaagacaggtacctgtcgtatatcaatgagtgaggtcgatctgaatgttgcagccccaaaggtaaaaggtggtgtggatgtaacccttccacgggttgaagggaaggtgaaagtccccgaagtggacgtccgcggacctaaagtcgatgtgtcggctcctgatgtggaggctcacgggcctgagtggaatcttaaaatgcctaagatgaaaatgcctacattttctacccctggggctaagggggagggacccgatgttcatatgactctgccgaagggtgacatctccatctctgggccaaaggtcaatgtcgaggccccagacgttaacctcgagggactgggcggtaaactgaagggtcctgatgtgaagctccctgacatgagtgtgaagactcccaagatcagcatgcctgatgtggatctgcacgtgaaaggcactaaagttaaaggggagtacgacgtgactgtgcccaaattggagggcgagctgaaagggccaaaggtggatatcgatgcgcctgatgtggatgtacatggaccggattggcaccttaagatgcctaagatgaaaatgcccaagttctctgtccccggattcaaggctgaggggcctgaggtcgacgttaacctgcccaaagccgatgttgatatctctggcccaaagatcgatgtgaccgcgccagacgtgagcatagaggagccagaaggaaagttgaaaggcccaaagtttaagatgcccgaaatgaacattaaagtcccaaagatatctatgcccgatgtggatctccatcttaaaggaccgaacgtgaagggcgaatatgatgtgaccatgcctaaggtcgagagcgagatcaaggtgcccgacgttgagctcaagtcggctaagatggatatagatgtgccagacgtcgaggttcaggggcctgactggcacttaaagatgcctaaaatgaaaatgcccaagttttcaatgcctgggtttaaggccgaaggccctgaggtcgacgtaaatctgcccaaagctgacgtcgacattagcgggccaaaggttggcgtcgaagtcccagatgtaaatatagagggccctgaaggtaagttgaaagggcctaaatttaaaatgcccgaaatgaacatcaaagcccctaagatttctatgcccgatgtggacctgcatatgaaaggacctaaggttaaaggggagtatgacatgacagttccaaagttggaaggagaccttaagggtccaaaggtcgacgtgtctgctcccgacgttgagatgcagggccctgattggaacctgaaaatgcccaaaattaagatgccaaagttcagcatgcccagtctcaagggcgaggggccagagtttgacgtcaacctctcaaaagctaacgtggatatctcggcgccaaaggtggacacaaatgcccctgacctgtctctagagggtcctgaagggaaactgaaggggccaaaatttaagatgccggagatgcatttcagagctccaaaaatgtccctacccgacgtggatctcgatctgaagggaccgaagatgaagggcaacgtggatatcagtgcaccgaagatagaaggtgagatgcaggtccccgatgtggacatacgaggacctaaggttgacattaaagctcctgacgtggagggccagggcctagattggtctctgaaaatacccaaaatgaagatgcccaaattttctatgccgagtttgaaaggtgagggtcccgaggtcgacgtgaatcttcctaaagccgatgtagttgtgagtggaccgaaggtcgacattgaagctcccgacgtaagcctggaaggacccgaagggaagctgaagggaccaaagtttaaaatgccagaaatgcattttaaaactcccaaaatcagcatgcccgacgttgatctccaccttaaaggacctaaggtcaaaggggacgttgacgtgtctgtacctaaagtcgaaggggaaatgaaggtgcctgacgtggagattaaggggcctaagatggatattgatgctcctgacgttgaggtccaggggcctgactggcacctgaagatgcccaagatgaaaatgccaaaattctctatgccaggcttcaagggcgagggaagggaagtggatgttaacctaccaaaggctgacattgacgtcagtggaccaaaggtggacgtcgaggtacccgacgtgtctcttgaaggacctgagggtaagctgaaaggcccaaagtttaagatgcccgaaatgcactttaaggccccaaaaatctctatgccggacgtggatcttaatctgaaggggcctaaactcaagggtgacgtggacgtgtcgctgccagaagtggagggcgaaatgaaagtgccagacgtcgatatcaagggccctaaggtcgatatctccgctccggatgtcgatgtgcacggtcccgattggcacctgaaaatgccaaaggtgaagatgcctaagttttccatgcctgggttcaagggggaagggccagaggttgacgtcaaactgcccaaagcagatgttgacgtctcgggtcccaagatggacgccgaggtccccgatgtcaatatcgaaggccctgacgccaagctgaaaggcccaaagttcaagatgccggagatgtccatcaagcctcagaagataagcattccagatgtaggcctacatctgaaaggcccaaagatgaagggagactacgacgtaaccgttcctaaagtggagggcgaaattaaggccccagatgtcgatatcaaaggtcctaaggtggatattaacgcccctgacgtagaagtacatggtcctgactggcacctgaaaatgcccaaggtaaaaatgcccaagtttagcatgccagggttcaagggtgaggggccagaggtagatatgaatctaccaaaggctgaccttggggtctcaggaccaaaagtggacattgatgtccccgatgtgaaccttgaagcgcctgagggcaagctgaagggtcccaagtttaagatgccgtctatgaatatacagacccataagatatctatgcccgacgtcggtttaaaccttaaagcgccaaagctgaagacagacgtagatgttagtcttcccaaggtggagggtgacctaaaaggaccggaaattgacgtcaaagcccctaagatggatgtgaacgtgggcgacatcgacattgagggccctgaaggcaagttgaaaggtcctaagtttaaaatgcccgagatgcattttaaagcaccgaagatttccatgccagacgtggatctacacttaaagggcccaaaggtgaaaggcgatatggatgtgagcgtccccaaggtggagggcgaaatgaaggtccctgatgtcgatatcaaaggaccaaaggtggatatagatgcgccagatgttgaagtccacgacccggattggcacttgaagatgcctaagatgaaaatgccgaaatttagcatgccgggtttcaaggcagagggtcctgaagtggacgtgaacttacctaaggcggacattgatgtgagtgggccttctgttgacaccgatgccccagacttagatatcgaggggccagaagggaaactgaagggcagcaagttcaaaatgccaaagcttaacattaaggcgcctaaggtttccatgccagacgtggacttgaatcttaaaggacccaaacttaaaggagaaatcgatgcaagcgtccctgaacttgagggcgatctgaggggtccacaggtcgacgtgaaaggaccttttgtggaagcggaggtccctgacgttgacttagaatgcccagatgcgaagctaaaagggccaaaattcaagatgcccgagatgcacttcaaggcacctaaaatctcaatgcccgatgtggaccttcacctcaagggtccaaaagtcaagggggacgctgatgtgagcgtgcccaaactggagggcgacttgaccggacctagcgttggagtggaggtgccagatgtggaactggagtgcccagatgccaaacttaaggggccaaaattcaaaatgcccgacatgcacttcaaagctccaaaaatttccatgcctgacgtcgacttacatcttaagggccctaaggtcaagggcgacgtggatgtgagcgtgccaaaactcgaaggcgatctaaccggccctagcgtaggcgtggaggtgccagacgttgagctggagtgccctgacgccaaactcaaaggaccaaagtttaagatgcctgaaatgcatttcaagacccccaagatttctatgcccgacgtggaccttcatctgaaaggtcctaaagtcaaaggagatatggacgtgtccgtgcccaaagtggagggcgaaatgaaggttcctgatgtggatattaaaggtccgaagatggatatcgatgcaccagacgtggatgtgcatggtcctgactggcatctgaagatgcccaagatgaaaatgcccaaattctctatgcctggattcaaggcagaaggacctgaggttgatgtaaaccttcccaaagcggatgttgtggtaagcggacccaaggttgatgtggaggttccagacgtctccttggagggacctgagggaaagcttaaaggtcctaaactgaaaatgcctgagatgcactttaaagctcctaaaattagcatgccagacgttgaccttcacttgaaagggcctaaggttaagggcgacgtcgacgtgtcactgccgaagttagagggcgacctgaccgggccttccgttgacgtggaagtacccgacgtggagctcgagtgtcctgacgctaaactcaaaggcccaaagttcaagatgcctgagatgcatttcaaaaccccgaaaatatctatgcctgacgttaatctgaacctgaaaggccctaaggttaaaggggatatggacgtgtcagtacctaaggtggaaggggagatgaaggtacctgatgtggacattcgcggacctaaggtcgacatagatgcccctgacgttgatgtccacggacccgactggcacctgaaaatgccaaagatgaaaatgcctaaattctcaatgcctggttttaaaggcgagggaccagaagtggacgtgaatcttcccaaggcagacgtggatgtctcaggccctaaagtggatgttgaagtgccagatgtttcactggaaggacctgagggcaaactgaaaggacctaaatttaagatgccagagatgcatttcaaaactccaaagatcagtatgcccgacgtggattttaatttgaaagggccaaagatcaagggagacgttgacgtctcagcccctaaactcgagggtgaactgaagggtcctgagctcgacgtaaaggggcctaaacttgacgctgatatgcctgaggtggccgtagaagggcctaatggtaagtggaaaacaccgaaatttaagatgcccgatatgcatttcaaggccccaaaaattagtatgccagatctcgatctgcatctcaaatctcctaaagcaaagggggaagtcgacgtggatgttccaaagttagaaggcgacctgaaggggcctcatgtggatgtgagtgggcctgacatcgacatcgaaggccctgagggaaagctgaaaggccctaagttcaaaatgcctgatatgcatttcaaggccccaaatataagcatgcccgatgtcgatctgaaccttaaggggccaaagatcaaaggtgacgtcgacgtgagcgtgccagaggttgaagggaaactcgaagttcctgacatgaatattagaggtccaaaggtggacgtcaatgccccagatgttcaggcccctgactggcaccttaagatgccgaagatgaaaatgccaaagtttagcatgccgggttttaaagccgaagggcctgaagtggacgtcaacctgcccaaagccgacgttgatattagcgggccaaaggtcgacattgaagggccagatgtaaatattgagggaccagagggtaaactcaagggccctaaactgaagatgcccgagatgaacatcaaagccccaaagataagcatgcctgatttcgatcttcacctgaaggggcctaaggttaagggagatgtggatgtgtcgctgcccaaggtggagggcgacctcaagggacccgaagttgacataaaaggtccaaaggttgatatcaacgccccagacgttggcgtccaagggcctgattggcatctgaagatgccaaaggtcaagatgcccaaattttccatgcccggatttaagggggagggcccagatggagacgtgaagctccctaaggcagacatcgatgtgtcgggtcctaaggtggacatcgaaggtccagacgtcaatatcgagggaccggagggaaagctcaaagggccaaaattcaaaatgccagagatgaatatcaaggcacccaaaataagcatgcctgacatagacctcaacttgaaagggccaaaggtcaagggcgatgtggatgtgtcgctgcctaaagtggaaggcgaccttaaaggccctgaggtagacatcaagggcccaaaagtggacatcgacgctcctgacgtggacgtgcatgggccagactggcatttgaagatgccaaaaataaaaatgcccaagatctctatgcctggcttcaaaggcgaagggcctgacgtggatgttaatttaccaaaagccgacattgacgtctctggacctaaagtggacgtggaatgtccagatgtgaatattgaggggccagagggaaagtggaagagtcccaaatttaaaatgccagaaatgcactttaagactccgaaaatctcgatgccagacatcgatctcaacttgactggtcccaagattaaaggcgacgtggacgttacaggacctaaggtggagggggacctgaaaggacctgaagtggaccttaagggccctaaagtcgacatcgatgtgccagacgtgaatgtccaaggcccagactggcacttgaagatgcctaagatgaagatgccaaagttttcaatgccaggcttcaaggctgaaggccctgaggtagatgtaaatctgcccaaagccgatgtggacgtctccgggccaaaagtggatgttgaaggaccagatgtcaacatcgaaggccctgagggcaaactaaaagggcctaaattcaagatgcccgagatgaatatcaaggccccaaagattcccatgccagatttcgaccttcatcttaaggggcctaaggtaaagggggacgtggatattagtctccctaaggtggagggcgatctgaagggccctgaggtggacattcggggaccccaagtggatatagacgtacccgatgtgggggttcagggtccagactggcatctgaagatgcccaaggtgaaaatgccaaagtttagtatgcctgggttcaagggagaaggtcccgacgttgatgtcaatctgcccaaggcagacctggacgtttcaggaccgaaggtggatatcgatgttcctgatgtgaatatcgaaggtccggaaggaaagttgaagggtcctaagttcaagatgcccgagatgaacataaaggccccaaagattagcatgcccgacattgacttaaatctgaaaggcccaaaggtgaaaggcgacatggacgtgagcctgccaaaggtggagggagacatgaaggtcccagacgtcgacattaaaggccctaaagtcgacatcaatgcgcctgacgttgatgtacagggccctgattggcatctgaagatgcccaaaatcaaaatgcctaagatcagcatgccaggctttaagggagagggaccagaagtggatgtgaacctgccaaaagcagacttggacgtcagcggcccaaaggtagacgtggatgttcctgatgtgaacatcgagggtccggatgcaaaactgaaggggccaaagttcaaaatgccggaaatgaatattaaggccccaaagatcagcatgccagatctagatctgaaccttaaggggccaaaaatgaagggagaagtcgatgtgagcttggctaatgttgaaggagatctgaagggccctgcattggacattaaggggcctaaaatagatgtagatgcccctgatattgacattcacggaccagatgccaagttgaaaggcccaaagctgaaaatgccagacatgcacgtgaacatgcctaaaatttctatgcccgagatcgacttgaacctaaaggggagcaaactcaaaggagacgtcgatgtgagcggccctaaactcgaaggagacataaaggcgccttcactggatatcaagggtccagaggtcgacgtgtcaggacctaaattaaacatcgaagggaagagtaagaaatcaagattcaagttaccaaagtttaatttctcagggtctaaagtacagacgccagaggttgacgttaaaggcaagaagcctgacatcgacatcacagggcctaaagttgatatcaacgcaccagatgtggaagtgcagggtaaggtaaaagggagtaaatttaaaatgcctttcctatcaattagcagtccgaaagtttctatgcccgatgtcgagctgaacctaaagagcccgaaggtgaagggcgatctggacattgcaggtcccaatttggagggggactttaagggcccaaaagtagatattaaggctccagaggtcaatctgaacgcaccagacgtagacgtccatggaccggactggaaccttaagatgcccaaaatgaaaatgccaaaattctccgtgagtggactgaaggcggagggccctgatgtggctgttgacctgcctaaaggggatataaatatagagggtccctccatgaatattgagggacccgatctgaatgtagaaggacccgaagggggtctgaaaggacctaagtttaagatgcccgacatgaacatcaaggcccctaagatctctatgcctgatatcgacttgaacctaaaaggacccaaggtgaagggcgacgtggacatctcactcccaaaattagaaggcgacttgaagggcccagaagtcgacatcaaggggccaaaagtcgacatcaacgctcctgacgtggatgtacacggtcccgactggcacctgaaaatgcctaaggtgaaaatgcccaagttcagtatgccgggatttaaaggcgaggggccagaagttgacgtcactcttcctaaggccgacatcgacatctccggccctaatgtcgatgtagacgtgccagacgtgaacatcgaggggcctgacgccaagcttaagggacctaagttcaaaatgcccgaaatgaacatcaaggctccaaaaatttccatgcccgatttcgacctgaatctgaaggggccaaaaatgaaaggtgacgtcgtggtctccttgccaaaggtcgaaggtgaccttaaagggcctgaggtagatattaagggaccaaaggtggatatcgatacacctgatattaatatcgagggaagtgagggcaagttcaagggcccaaagtttaaaattcctgagatgcacctgaaggcccctaaaatctctatgcccgatatagatctgaacctgaaggggccaaaggtaaaaggcgatgtcgacgtaagtcttcctaagatggaaggagacctgaaaggcccagaggtcgacattaagggcccaaaggtggacattaatgcaccagatgtggacgtccaggggcctgattggcaccttaaaatgccaaaggtgaagatgcctaaatttagcatgcccggattcaagggagagggcccagacgttgatgtgaaccttccaaaagccgacctggatgtttccggcccaaaggtcgacatagatgtccccgacgtcaatattgagggacctgaaggaaaactgaaggggccaaagtttaagatgcccgaaatgaatatcaaagccccaaaaatctccatgccagacatagacctcaaccttaaagggccaaaggttaagggggatatggacgtgtcccttcctaaggtggagggggacatgcaggtacccgacctcgatattaaaggtcctaaagtggatatcaatgcccctgatgtggatgtgcggggacctgattggcacctgaaaatgcccaagatcaagatgcccaagatctccatgcccggattcaaaggtgagggtcccgaggtcgacgtaaacctccctaaggcagatctcgatgtgtccggcccaaaagtggacgtggacgtcccggacgtcaacatcgagggcccagatgcaaagctgaaaggaccaaagtttaaaatgcctgaaatgaacatcaaagcgcctaaaattagcatgcctgatttcgatctacacttgaaaggacccaaggttaagggcgacgtggacgtgagcctgcccaagatggagggggatctcaaagcacccgaagtagacatcaaaggccctaaagtggacattgatgctcctgacgtcgatgtacacggaccagattggcatctcaagatgcccaaggttaaaatgccaaagttttcgatgcccggatttaaaggcgaaggtccagaagtggacgtgaatttgccgaaggccgatatcgacgtgagtgggcctaaagtcgacattgatactccagacatcgacatacatgggccagaagggaaacttaaaggtcccaaatttaaaatgcccgacctgcatttgaaggcccctaaaatcagcatgcctgaagtggacctgaacctgaagggcccaaaaatgaagggagatgtggatgtgagcttgcccaaggtggagggagacttgaaggggcctgaagtagatattaagggacctaaagtggatatcgatgtgccagacgtggacgtgcagggcccagactggcacttgaagatgcccaaagtgaagatgcctaagttcagtatgcccggttttaagggagagggtcccgatgtagacgttaacctgcctaaggccgatctcgacgtgagcgggcctaaggtggacatcgatgtgcctgacgtgaacatcgaaggacccgacgcaaaactgaaagggcctaagtttaagatgcccgaaatgaatatcaaggcaccaaaaatctcgatgccagattttgacttacacctgaagggccctaaagtcaaaggcgacgtggatgtgtcacttcccaaggtggagggtgacctgaagggtcccgaggtagatatcaagggcccaaaggtggatattgatgcgcctgatgtggatgtccacggcccagattggcacctgaagatgcccaaggttaagatgcccaagttttcgatgcccggatttaagggggaggggcctgatgtcgatgtgactcttccgaaagccgacatcgagatctcaggtcctaaggtagatattgacgctcccgacgtgtctattgagggtccagatgccaaacttaaaggcccaaaatttaaaatgcccgagatgaatattaaggcaccaaaaattagcatgcccgacattgacttcaaccttaagggacccaaggtgaaaggtgatgtcgacgtttcattacctaaggtcgagggtgatctgaaggggccagagatcgacatcaagggcccttccctagacatcgacactccggacgtgaatatcgagggcccagaagggaaactcaaaggtcctaagttcaaaatgcccgagatgaacattaaagctcccaaaatatccatgcccgatttcgatctgcacctgaaaggccctaaggtgaaaggcgatgtggacgtctctctcccgaaggtggaatctgacctgaagggacccgaggtcgacatcgagggaccagaggggaaattaaagggaccaaagttcaaaatgcccgacgttcactttaagtccccgcaaataagtatgtctgacatcgatctgaacttaaagggcccaaaaataaaaggggacatggatatctctgtacctaaacttgagggtgatcttaaggggccaaaagtagatgtgaaggggccaaaagtcggcatagatacgccggacatagatattcacgggccagaaggcaagcttaagggccctaagttcaagatgccggacctgcatctgaaagccccaaaaatcagtatgcccgaggtggaccttaatctgaagggccctaaagtcaagggggacatggacatcagcctgcctaaggtcgaaggggacttaaagggtcccgaagttgacatcagagaccctaaagtggatatcgacgtgcctgacgtggatgtccagggacccgattggcatcttaaaatgccaaaggttaagatgccaaagttctcaatgcccggtttcaaaggagaagggcctgatgtcgacgtcaacctgcccaaggccgatatcgacgtaagcggaccaaaggtggacgtggacgtgccagatgtaaacatagagggcccagacgccaaattgaagggccctaagttcaaaatgccagagatgagcattaaggcacctaaaatatctatgccggatattgatctaaacctgaagggtcctaaggttaaaggcgatgtggatgtaacactgcctaaagtggaaggggacctgaaaggaccagaggccgacatcaaaggaccaaaggttgacattaatacacctgacgtggatgtgcatgggcctgattggcatctcaaaatgcccaaagtgaagatgccaaaattcagcatgccaggatttaagggcgagggaccagatgtcgacgtctccctcccaaaggctgatatcgatgtatcaggtcccaaggtagacgttgatatcccagatgtgaatattgaaggcccagacgccaagctgaaagggcctaaattcaagatgcctgaaattaatataaaggctccaaaaattagcattcctgatgtagatctggacctcaagggtccgaaggtcaaaggcgattttgacgtcagcgttccaaaggtagaaggaacccttaaggggccagaagtggacctgaagggacctcgacttgacttcgagggacctgacgctaagttaagcggtccatcgctcaaaatgccgtccctagagatctcagctccgaaggtcactgcccctgatgtcgacctgcacctgaaggctcccaagattggtttctctggccctaaactcgagggaggcgaagtcgacctgaagggaccaaaagtggaagccccaagtctcgacgtccatatggacagtcccgatatcaatattgaagggcctgacgtcaagatccctaaattcaagaaacccaagttcggcttcggggcaaaaagcccaaaggccgatatcaagtctccgtctctggatgtgacagttcccgaggccgagctcaacctggagacgcccgagatctctgtgggaggaaaggggaaaaagagtaagtttaagatgccaaaaatacacatgagcggtcctaagatcaaggccaaaaaacagggctttgacctcaatgtcccaggaggggaaatcgacgccagcctaaaagccccagacgtcgacgttaacattgcgggaccggacgctgccctgaaggtggacgtgaagagtcccaagactaagaaaacaatgttcgggaaaatgtacttcccagacgttgaattcgatatcaaatcccccaaattcaaagccgaggcgcctctgccaagtcctaaactggagggcgagttacaggctccagaccttgagttatcactgcccgctatacacgtggagggactcgacattaaagcaaaggctccaaaggtgaaaatgcccgacgtcgatatctcagtccccaaaattgagggggatctcaagggccctaaagtacaagccaacctgggggcaccagatattaacatcgagggactcgacgctaaagtgaaaacgccttcttttgggataagtgctccccaggtaagtatacccgacgtaaacgtgaaccttaagggaccaaagatcaaaggggacgtccccagtgtaggcctcgaaggtccagacgtcgacttacagggtccagaagctaaaataaaattccctaagttttctatgcctaagatcgggatcccgggagtgaaaatggaaggcggaggagctgaggttcacgcacagctgccttctttggaaggagatttgaggggccctgacgtgaagctcgaaggccctgatgtcagcctcaaaggccctggcgtagatctgccctccgtgaatttgtcaatgccaaaagtgtctggcccagacctggacctgaatctgaagggtccatctctgaaaggggatttggacgccagtgtcccatcaatgaaggtgcatgctcccggactgaacctttctggtgttgggggaaaaatgcaagtgggcggtgatggcgtaaaggttccaggaatcgacgcaacaaccaaacttaacgtgggtgcaccagacgtgacactgaggggtccctccctccagggagatctcgcagtgtctggcgatattaaatgccctaaagtttccgttggggcacccgacctctcactggaggcttcagaggggtcaatcaagcttccaaagatgaaactcccacagtttggtatttctaccccgggaagtgatctgcacgtgaatgccaaggggcctcaggtgtcaggcgaactcaagggacctggggtggacgtgaacctaaagggccctcgaatttcagcccctaatgtggatttcaatttagagggacctaaggtgaaaggaagcctcggggctacaggtgagataaagggccctacggtcgggggtggattgcccggtatcggagtccagggcctcgaaggcaatttgcaaatgcctggaatcaagagctcaggctgtgacgtgaatctgccaggagttaatgtcaaactgccgacggggcagattagcggacctgaaatcaagggagggttgaaaggatccgaggtgggttttcacggagccgcacctgacatctcagtcaagggcccagcctttaacatggcttctccggaatccgacttcggaattaacttgaagggacctaagatcaagggcggtgctgatgtctctgggggtgtgagtgcccctgatatctcactgggtgaaggccatttgagcgtgaaaggctctggtggagagtggaagggcccacaggtgtccagtgctctgaacctcgacacttcaaaatttgctggtggtctccacttctcaggcccaaaagtggagggaggcgtcaagggagggcaaattggacttcaagcccctgggctttctgtgagcggtccccaaggtcacctggagtcaggaagcggcaaggtcactttcccaaagatgaagataccgaaattcacattttcaggacgcgaactcgtgggcagggagatgggggtcgacgtgcacttcccaaaggcagaggcctcaattcaagctggcgctggagacggtgagtgggaggagagcgaggtaaaattaaagaagtctaaaataaagatgcctaaattcaacttcagtaagcccaagggcaagggtggagtcaccgggagtccagaggctagcatcagtgggagcaagggggacctcaaatcctctaaagcttccttgggaagtctggaaggtgaggcagaagctgaagcctcgtcaccaaaagggaagttcagcctgttcaaatccaagaagccgagacaccgcagtaacagcttctctgacgagcgtgaattttcaggacccagcactcctacagggaccctggaatttgaaggcggagaggtttctctcgagggcggtaaagttaaagggaagcatggaaagctcaaatttggaacattcgggggactggggagtaagtcaaaaggccattatgaagttacggggagtgacgacgagacaggcaagctccaaggaagcggcgtctcactggcttccaaaaagtcaagactgtccagtagctctagcaatgatagcggcaacaaagtcggaattcaactcccagaggtcgaactatctgtatcaactaagaaggagtag

SEQ ID NO: 27267 - DNA, 372 bp, Artificial Sequence
  Description of Artificial Sequence: Synthetic coding sequence
atggagaaggaggagactactagggaactgttgttaccaaattggcaagggagtgggagtcatggattgactattgcccagagggacgatggagtattcgtacaggaggtgactcagaacagtcccgctgcccgtacaggagtagtgaaggaaggcgaccaaattgttggggctacaatatattttgataacttgcagagtggagaggtcacacaactgcttaacaccatgggtcaccataccgttggcctgaaattgcaccgcaaaggagatcgctcccctgagccaggtcagacttggactcgagaggtcttcagcagctgctcatctgaggtggtgctgtcgggggacgatgaggaatatcagcggtag

SEQ ID NO: 27268 - DNA, 435 bp, Artificial Sequence
  Description of Artificial Sequence: Synthetic coding sequence
atggaaaaggaagagacaaccagagagctgctgttgccaaattggcagggatcaggcagtcatgggttaactatagcacagagagatgacggtgtctttgtccaagaggtgacccagaatagcccggcagcacgcactggagttgtcaaggaaggcgaccagatagttggtgctaccatctacttcgataacctgcagtccggcgaggtcacgcagctgctgaataccatgggtcatcacactgtgggcctcaaactgcaccggaaaggggaccggagcccagaaccaggccagacatggacccgggaggtattttctagttgcagttctgaagtagtcttatcaggagatgatgaggagtatcagcgtatttatactacgaagatcaagccacggttgaagtcagaggatggggtggaaggggatttgggatag

SEQ ID NO: 27269 - DNA, 261 bp, Artificial Sequence
  Description of Artificial Sequence: Synthetic coding sequence
atggagaaagaggaaaccacgagggagcttttactccccaattggcaaggctctgggagccacggattaactatcgctcagcgtgacgacggggtttttgttcaggaagtgacccagaactccccagctgccaggactggggtggtgaaagaaggagaccagatagtcggggctacaatttattttgataacctccagtccggcgaagtgacccagctgctcaacacgatgggacatcacactgttgggctgaagctgtag

SEQ ID NO: 27270 - DNA, 366 bp, Artificial Sequence
  Description of Artificial Sequence: Synthetic coding sequence
atggagaaggaagagacgactcgggagttgctgctccccaactggcaggggagcgggtcacacggcctaacaattgcccagagagatgatggtgtgtttgttcaggaagtgacacagaactctcctgccgctaggactggcgtcgtgaaagaaggagatcaaatagtgggggctacgatttatttcgacaacctgcaaagcggagaagtgacacagctactaaacaccatgggacaccataccgtcgggctgaagctgcaccggaaaggcgacaggagtccagagcctggacagacttggacgagggaggtattctccagttgtagttcagaagtggtcctcaatactcctcagccgtccgcctag

SEQ ID NO: 27271 - DNA, 2904 bp, Artificial Sequence
  Description of Artificial Sequence: Synthetic coding sequence
atggctaaagggttttacatctccaagagcttggggatcctggggattttactcggcgtggccgctgtgtgcaccattattgccttatccgtagtgtactcccaggaaaagaataagaacgcgaacagcagtcccgtggcatcgaccacgcccagcgcttcagcaactactaaccccgcttcagctacaaccttggaccaaagcaaagcttggaacaggtacagattgccaaacaccctcaaaccagattcctacagagttactcttaggccatacctgacaccgaatgatagggggttgtatgtgtttaaaggctcatcaactgtgcgcttcacgtgcaaggaggcaacagacgtaattattatacacagtaagaagttgaattacactctgagccaaggtcacagggttgtacttcggggagttggaggttctcagccccctgatatcgacaagacagaacttgtcgagcccacagaatatctggtggtccacctcaaggggtcactcgtgaaggactcacagtacgaaatggatagcgagtttgaaggcgagttggccgatgacctggctggattctacagaagcgaatacatggagggcaacgtgagaaaggtcgtcgctaccacacagatgcaggcggctgacgcgaggaaaagtttcccttgcttcgatgagccggcaatgaaagccgaattcaacatcacactcatccatcccaaggaccttactgctttgtctaatatgctccccaaggggccttcgacaccactacccgaggaccccaactggaatgtgactgaatttcatactacacccaagatgtctacatacttattggcgttcattgtgtctgaattcgattatgttgaaaagcaagcgtcaaacggtgtattgattagaatctgggcgcgtccctccgccattgccgctggtcacggagattacgctctcaacgtgacaggcccaatcttaaacttcttcgctggccactacgacacaccttatcctctgcccaagtcggaccagattggtctgccggattttaacgcgggtgcaatggagaattgggggctagtcacctaccgggaaaatagcctgctgttcgatcctctgagcagtagctccagtaacaaagaacgtgtggtgactgtgatagctcacgagttggcacaccagtggtttggaaacctggttactatcgagtggtggaatgatctttggctgaacgagggatttgcttcttatgtggagtatctcggtgccgattacgccgagcctacatggaacctgaaggacctaatggtgctgaacgacgtgtatcgggtgatggcagtagacgcactggccagttcccacccgctgtcaacaccggcttctgaaatcaacacaccagctcagatcagtgagctatttgatgccatttcgtattctaagggagcaagtgtgttgaggatgctcagtagttttctgtctgaggacgtgtttaagcaaggccttgcttcctacctccatacttttgcttaccagaacactatctacctcaatctctgggatcacctacaggaggccgttaacaatagatcaatacaactaccgaccaccgttagggatatcatgaataggtggacattacaaatggggttccctgtcattaccgtcgacacaagcacgggtaccttgtctcaggaacactttctcttggacccagattccaatgtgaccagacccagcgagttcaactatgtctggatcgttcctattacctctatcagagacggaagacagcagcaagattactggctgatagacgtgagggcacagaatgatctcttctccacttcggggaatgagtgggtgctgctcaacctgaacgtgaccggctactaccgagtgaactatgatgaggagaattggagaaagattcagacacagctgcaacgcgatcactccgcaatccctgttatcaatagagctcagataatcaatgatgccttcaatctggcatctgcacacaaggtgcccgtaacattagccctgaataatactctgttcctgatagaggagcggcagtatatgccctgggaagccgcactctcgtccctcagttatttcaaactgatgttcgacaggtccgaagtgtatggcccaatgaaaaactatctgaagaagcaggtcaccccgctgtttatccactttcgaaacaatacaaacaattggcgcgagattccagagaatctgatggaccaatactctgaggttaatgcaatcagtactgcttgcagcaatggcgtccctgagtgtgaagaaatggtctctggcctgttcaagcaatggatggaaaaccccaataataatccaatccaccccaacctgagatcgactgtctactgcaacgctattgcacaaggcggagaagaagagtgggactttgcatgggaacagttcaggaacgcaactctagtgaatgaggctgacaaactgagagcggcactggcctgcagcaaagaactgtggattctcaaccgatacctgtcgtacaccctcaacccagatctcatccgcaaacaggacgctacttccactattatttcaattacaaataacgtgatcggccaagggctggtgtgggatttcgtgcagagtaattggaagaaattgtttaatgattatggtgggggtagtttttccttttccaacctgatccaggcagtgacacgtaggttctccactgagtatgaactgcaacaactagaacagtttaagaaagacaatgaggagactggctttggctctggcacccgcgcactggaacaggccttggagaagactaaggcgaacatcaaatgggtgaaagagaataaggaagtggtgcttcagtggtttactgaaaactcaaagtag

SEQ ID NO: 27272 - DNA, 312 bp, Artificial Sequence
  Description of Artificial Sequence: Synthetic coding sequence
atggccaagggattctatatctccaaaagcctgggaattctgggaatactgctgggagtcgcggcagtatgtaccatcatcgctcttagtgttgtttattctcaggaaaagaacaaaaacgcgaacagtagccctgtggcatctaccaccccttcggcttctgccactacgaatcctgcatcggccacaaccttagatcagtccaaggcatggaatcgctatcggctgcctaatacgctgaagcctgattcatatagagtgaccctccgaccttatctgacaccaaacgatcggggactctacgtgttctag

SEQ ID NO: 27273 - DNA, 186 bp, Artificial Sequence
  Description of Artificial Sequence: Synthetic coding sequence
atggctaaggggttctacataagcaagagcctggggatcctgggcattttactcggggtggccgctgtctgtaccattattgcattgtcagttgtctactcccaggagaagaataaaaacgcaaactcctcccctgtcgcatcaactacaccgtccgcgtctgcgacaaccaaccccgcaagctag

SEQ ID NO: 27274 - DNA, 381 bp, Artificial Sequence
  Description of Artificial Sequence: Synthetic coding sequence
atgaaccagaacacagataagatctcaggcagcggatccaattctgatatgatggagaatagtaaagaggagggcaccagttcttccgaaaagtccaaatcctctggctcctccagatcgaaacgcaagccctctattgtgacaaagtacgtggagagtgacgacgagaaacccctcgacgacgaaacagttaacgaagacgctagcaatgaaaattcagaaaacgatataacaatgcagtcccttcccaaggggaccgtgatcgtgcagcctgagccagtgcttaatgaggataaagatgactttaagggcccagagttccgctccagatccaagatgaaaacggagaatctaaagaagcgtggcggaaaatacaagtag

SEQ ID NO: 27275 - DNA, 7478 bp, Artificial Sequence
  Description of Artificial Sequence: Synthetic coding sequence
atgacagccgagccgatgtctgaaagcaaacttaacaccctggtccaaaagctccatgattttctggcccacagctccgaggaatctgaggagacatcctctccccctcgccttgcgatgaatcagaacacagacaagatcagcggcagcggcagtaactccgacatgatggaaaacagtaaagaagagggcacgtcaagttccgaaaagtctaagtcctccggatcttcccgttctaaacggaagccctctatagtgaccaagtacgtcgaaagtgatgacgagaaacctttggatgacgagacggtcaatgaggacgccagcaacgaaaacagcgagaatgacattacaatgcagagcctgcctaaagggactgtgatagtgcaacccgagccggtcctaaacgaagacaaagacgatttcaagggcccagaattccggtctagatcaaagatgaagacagagaatctgaagaaacgcggtgaggatggcctgcacgggatcgttagttgtaccgcctgcggccagcaggttaaccacttccaaaaggattccatataccgacaccctagcctgcaagtgcttatctgtaaaaactgttttaaatattatatgagcgatgatatctctcgcgactctgacggcatggacgagcagtgccgctggtgtgcagagggcggaaatctgatctgctgcgacttctgccacaacgctttctgcaaaaaatgtatccttcgaaatttgggcagaaaggaattgagtactatcatggacgagaataaccagtggtactgctatatatgccatcccgaacctttgctagacctcgtgaccgcatgtaacagcgtgttcgaaaaccttgagcagctgctgcagcagaataaaaagaaaattaaagtggattccgaaaagtccaataaggtgtatgagcacacctctaggtttagcccaaagaagaccagcagcaactgtaatggggaagagaaaaaactggacgacagttgttctggttccgtgacgtactcatactccgcactgattgtgcccaaggagatgattaagaaggctaaaaaactgatcgagaccacggctaatatgaacagcagttacgttaagtttctgaaacaggccacggataattccgaaatcagttccgctactaagcttaggcaactgaaggctttcaagagcgtcttagcagacatcaagaaggcccacttggccctcgaggaggatctgaatagcgagttcagggcgatggatgctgtgaacaaagagaagaacaccaaggagcacaaggtgattgatgccaagtttgaaaccaaggctagaaagggggaaaaaccttgcgcattggagaaaaaggatatcagtaaatccgaagccaaactgtctaggaagcaggttgacagtgagcacatgcaccagaatgtcccaacagaagagcaaaggactaacaagtccaccggtggggaacacaagaaaagcgacaggaaggaggagccccaatacgaaccggctaatacaagcgaggacctcgacatggatattgtgagcgtgccctcgagcgtgccagaggacatttttgagaatctggaaaccgctatggaggtgcagagcagtgtggaccatcagggggacggctcatctggcaccgagcaggaggtggaatcctcatcggtgaaactcaacatatccagcaaagataacaggggcggaattaaatcaaagaccacggctaaggttaccaaggaactctatgtgaaacttactcccgtcagtttgtctaattctccaatcaagggtgcagattgtcaggaagtcccccaggataaggacggatataagagttgcggtctgaaccccaagctggaaaaatgcggactgggtcaggagaattcagacaatgagcacctggtggagaatgaagtctcacttctcttggaggagagcgatctccgcagatccccaagagtgaaaaccacaccactgcgaaggccgacagagaccaacccggttaccagtaatagtgacgaagagtgtaatgagactgtgaaagaaaagcagaagctctcagtgcctgttcgaaaaaaagacaaacgcaactctagtgattccgctatagacaacccaaagccgaacaagttaccaaagtccaaacagagtgagactgtggaccagaatagcgactctgacgaaatgcttgctatactcaaggaagttagtcgaatgtctcatagcagctcttcagacaccgacattaatgaaattcataccaatcacaagaccctgtatgatttgaaaacacaggctggtaaagacgataagggcaagagaaagcgaaagagctccactagtggaagcgacttcgacaccaagaagggtaagtctgccaagagcagtataatatcaaaaaagaaacgtcaaacgcagtccgaatcatccaattatgactctgagctggagaaggagatcaagtcaatgagtaagatcggagccgctaggaccacgaagaagagaataccaaataccaaagattttgatagcagcgaagacgagaagcactcgaagaaggggatggataatcagggacacaaaaatctcaagacatcccaggagggttcgtccgatgacgcggagcgtaagcaggaacgcgagacattttcatctgcggaggggacggttgacaaagacacaactataatggagctccgggatcgcttgcccaaaaaacagcaggccagtgcatcaactgacggagtagataagctgtcaggaaaggagcaaagcttcactagtcttgaagtcagaaaagtggctgaaacaaaggagaaatccaagcacctaaagaccaaaacgtgcaaaaaagtgcaggacggactgagcgacattgcagaaaagttcctcaagaaagaccagtctgatgagactagtgaggatgacaaaaagcagtccaagaaggggactgaagagaaaaagaagcctagtgatttcaaaaagaaggtaatcaaaatggagcagcaatacgaatctagctcagatgggaccgaaaaactacccgagagagaggagatctgtcactttccaaagggaatcaaacagatcaagaacggcaccaccgacggggagaagaagtccaaaaagattagggataaaacatctaagaagaaggatgagctgagcgactatgcagaaaagtccacgggtaaaggggattcttgcgatagtagtgaagataaaaagtctaaaaatggcgcttacgggagggaaaaaaagaggtgcaagctgctgggaaaatcatctagaaagcgccaagactgctcctcttctgacaccgagaaatattctatgaaagaagacggctgtaattccagcgacaaaagacttaaaagaattgaactccgggaaagacgcaacctttcatctaaacggaacactaaagaaatacaatcaggctcctcaagttcggacgccgaggaaagttctgaggacaacaagaaaaagaagcagcggacaagttctaaaaaaaaagccgttatcgtgaaggaaaagaaaagaaacagtttgcggacgtcaaccaaacggaaacaggctgatatcacctcctcatccagctccgatattgaagacgatgaccagaattcgatcggcgaagggagttctgatgagcagaaaatcaagccggtcacagaaaacctggtcctgagttctcataccggtttttgtcagtcgtctggtgacgaggccttgtctaagagtgttccggtcaccgtcgatgatgacgacgatgacaacgatcccgaaaaccggatcgccaaaaagatgctgcttgaagagatcaaagctaatctctcaagtgatgaagatggctcttcagatgatgagccagaggagggaaaaaagcggactggcaagcagaacgaagagaatccgggagacgaggaggcaaaaaatcaggtgaactctgagtcagactctgacagcgaggaaagcaagaaacccagatatcggcatcgcctcctccgccataagctgaccgttagtgacggagagtcaggtgaggagaagaagaccaagcccaaggagcacaaggaggtgaagggtcgcaacaggaggaaagttagtagtgaagactccgaggattcagactttcaggaatccggcgtgagtgaggaagtcagtgaatcggaggatgaacagcgtcctcggactcgttccgctaaaaaggctgagttagaggagaaccagaggtcctataagcaaaaaaagaagagacgacgcattaaggtccaggaggattcttcgagtgaaaataaaagcaattcagaggaggaagaagaagagaaggaagaagaggaagaggaggaggaagaggaggaggaggaggaggaggacgagaatgatgactcaaagagccctgggaaaggacgcaaaaagatcagaaagattttgaaagacgataagctacgcacagaaacacagaatgccctcaaggaagaagaggaacggagaaagaggatagcggagagggaaagggagcgtgagaaactccgagaggtgatagaaatcgaagacgcatcccccacaaagtgtcctattacaaccaaactagtgctcgatgaagatgaagagacaaaagagcctctagtccaggtgcaccggaacatggtcattaagttaaagcctcatcaagtggatggggtccagttcatgtgggactgttgttgcgaatcagtaaagaaaacgaaaaagagcccagggtctggctgcattctcgcccactgtatggggcttggaaagacacttcaggtggttagctttttacacaccgtgctgctgtgcgacaagctggactttagcacagcactggtggtctgtcctctcaatacagctttgaactggatgaatgagttcgagaaatggcaagaggggttgaaggacgacgagaaactagaagtgagtgagctggccaccgtaaaacggccacaggagcgtagctacatgctgcaacgctggcaggaagacggcggtgtcatgatcattggatatgaaatgtatcgcaaccttgctcaggggagaaatgtaaaatcgaggaagctaaaggaaatttttaacaaagctttggtagaccctggaccagactttgttgtgtgcgacgagggccacatcctcaaaaacgaagcctcagctgtgtctaaagctatgaattcaatccgctccaggaggagaataatcctcactgggacacctttgcagaacaatctgatcgaatatcattgcatggttaacttcatcaaagagaatctgttgggatccataaaggagtttagaaatagatttataaatccaatccagaatggccagtgcgctgactccacaatggtcgatgttagggtcatgaagaagagggcacatattctttatgaaatgctagccggatgtgtccagcgcaaagactataccgctttgaccaagtttctgcctcctaagcacgagtacgtgctggctgttcggatgacgagcatccagtgtaagctctaccaatattacctggaccatttgaccggcgtgggaaacaattccgaggggggaagagggaaggccggtgctaagttatttcaggacttccagatgcttagtcgaatctggacgcatccatggtgcctgcagctggattacatctctaaggagaacaagggatacttcgacgaggattccatggacgagttcatagcctcagacagcgatgaaacctcaatgtccctctcatcagatgactataccaaaaagaagaagaagggtaagaagggcaagaaagattccagcagtagcggcagcggatctgataacgacgtagaggttatcaaggtctggaatagtaggagccggggaggcggagaaggcaatgtggatgagaccgggaacaatccatctgtttctcttaaattggaagaatcaaaggccaccagcagctcaaacccatcttcacctgcaccagattggtataaagattttgtgactgacgccgatgccgaggtgctggagcatagtggcaagatggtcttacttttcgaaattctgaggatggccgaggaaatcggggacaaggtactggtgttctcccaaagtctgattagtctggacctgatcgaggactttctggagttggcttcgagggagaaaaccgaggacaaagataaacccctgatctataaaggggaagggaagtggctgagaaatatcgactactatcgtctggatggctctacaacggcacagtcacgcaagaagtgggctgaagagttcaatgatgaaactaatgtacggggacggctgtttattataagcactaaagccggttctctgggtatcaacctggtggctgcgaaccgagtgattatcttcgatgctagttggaatccctcgtacgacatccagagcatcttccgcgtataccggttcgggcagacaaaaccagtctatgtgtatcgcttcctggctcagggcacaatggaggacaagatatacgacagacaagtgaccaagcagagcctgtctttcagagtggtggaccagcagcaggtggaacggcactttacgatgaacgagcttactgaactctatacctttgagccagacttgctggacgatccgaatagtgaaaaaaaaaagaagcgcgatactcctatgcttccaaaagacactatcctcgcggaactgctccagatccacaaggaacacattgtcgggtaccacgaacacgatagtttactagaccataaagaggaggaagagctgactgaggaggaacggaaagctgcttgggcagaatatgaggccgaaaaaaaggggttaacgatgagattcaatattccaacaggaactaacttgccgcctgtctctttcaattctcaaacaccttatatccctttcaatctgggcgctctgtccgcaatgtccaatcagcaactggaagatctgattaaccagggtcgcgagaaggtggttgaggcaacaaatagtgtcactgccgtccgtattcagcctttggaggatatcatttctgccgtctggaaagaaaacatgaacttgagcgaggcccaggttcaagcccttgccctttcccgccaggcctcccaggaactggacgtgaagcgtcgggaggcgatctataatgacgtgctgactaaacaacagatgctgatttcttgcgttcagaggattctgatgaaccggcgattacagcaacagtacaatcaacaacaacagcagcagatgacttatcagcaggccacattgggtcatctgatgatgcccaagcctcctaatctcattatgaaccccagcaattatcagcagatagacatgcggggtatgtaccagccagtggccggtggcatgcagcccccacccctgcagcgggctccacctcccatgaggtccaagaacccaggtccgagccagggaaaaagcatgta

SEQ ID NO: 27276 - DNA, 7364 bp, Artificial Sequence
  Description of Artificial Sequence: Synthetic coding sequence
atgaccgcagagcccatgagcgagtctaagttgaacactcttgtgcaaaagctccacgattttcttgcacactccagtgaggagagcgaagagacatccagtcctccacggctggccatgaaccagaacacggacaagatcagtggcagtgggagtaattccgacatgatggagaatagtaaagaggagggcacatcctccagtgagaaatccaagagctctgggtccagtcgctctaaacgaaagccatctatcgttaccaagtacgtggaaagcgatgacgagaagcctctggatgacgaaacagtgaatgaagacgccagtaacgaaaacagtgagaacgatatcacaatgcagagcctgcctaaagaggacgggctgcatggtattgtaagttgcaccgcatgcgggcaacaggtgaaccactttcagaaggacagcatttaccgtcacccgagccttcaggtgcttatttgcaaaaattgcttcaagtactacatgagcgacgatatttcacgggattccgacgggatggatgaacagtgtcgatggtgcgctgagggcggaaacctcatttgctgtgacttttgccacaatgccttctgcaagaagtgtatcttacgtaacctcggcagaaaagaactttccactattatggatgaaaacaatcagtggtactgctacatttgtcatccagagcctttgctcgacttggtcaccgcttgtaatagtgtgtttgagaacctcgagcagctcctgcagcagaacaagaagaagatcaaggtggactctgagaaatctaataaggtgtacgaacatacgtctcggttctctcccaaaaagacttcctcgaattgtaatggggaagaaaaaaaattggacgatagttgttccggctctgttacttacagctacagtgctctgatagtccctaaggagatgatcaagaaggctaaaaagctgattgaaacaaccgccaacatgaactcatcctacgtcaaattcctcaaacaggccaccgataactcagagatcagttctgctaccaagcttcgacaactcaaggccttcaagtcggtcctggccgatatcaaaaaggcccatctcgcactcgaggaggacctgaactccgagtttcgagctatggatgccgtcaataaagagaagaacaccaaagagcacaaggtgattgacgctaaattcgagacaaaagccaggaaaggggaaaaaccatgtgcccttgagaagaaggatattagcaaatctgaggcgaagctcagtagaaaacaggtggattcagagcatatgcatcagaatgttcctactgaagaacagaggactaataagagcacaggtggcgagcacaaaaagtcagaccgcaaagaggagcctcagtacgagccagctaacacatccgaagacctagacatggacatagtgtctgttcctagttcagttccagaagatatttttgagaatctggaaaccgccatggaagtgcagtcctcagtcgatcaccaaggtgatggttcctctggcacagagcaggaggtcgaaagcagcagcgtgaaactgaacatatccagcaaggataacaggggtggcatcaaatccaaaaccaccgccaaggtcaccaaggagctgtatgtgaagcttacacctgttagtcttagcaattcaccaattaagggtgcagattgccaagaggtacctcaggacaaggatgggtataagagctgtggtctcaacccgaaactggagaaatgtggcctgggccaggagaactccgataacgagcatctcgtcgaaaacgaagtctccttgctgctggaggaatcagacctccggagatcgcccagagtgaagacaacaccactgagacggcctaccgaaacaaaccctgtaacctctaactccgatgaagaatgtaatgaaacggttaaagagaagcagaagctgagtgtgcctgtgcgcaaaaaagataaaaggaacagctccgatagtgcaatcgacaatccgaagcccaataagttgcctaagagcaagcagagcgagaccgtggatcaaaattcagatagtgatgagatgctggccattttgaaggaagtgagcagaatgtctcactctagctcaagtgataccgacattaacgagatacatactaatcacaaaactttatacgatttgaagacccaagcgggaaaagacgataagggtaagcggaaaagaaaaagtagtacatctggctccgactttgatacaaagaagggtaaatctgccaagagcagcatcatatcaaagaaaaagagacagacacagtctgagtcctctaattatgattcagagctggaaaaggagattaagtcaatgtccaagattggagccgctagaactacaaaaaagcggatccctaatactaaggactttgatagttccgaggatgaaaagcattccaagaagggcatggacaatcagggccacaagaatctgaagacctctcaggaaggaagtagcgatgatgcagagcgaaagcaggagagggagacattttcatcagccgaaggcaccgtagacaaagacacgacaatcatggaactgcgcgatagattgccaaaaaagcagcaggcctctgcctctaccgatggggtggacaaactgagcggaaaagagcaatccttcacttccttagaggtgaggaaggtcgctgagactaaggagaagagcaaacacctcaagacaaagacatgtaaaaaagtacaggacggtctgtcagacatcgctgagaaatttttaaaaaaggatcagtctgatgaaacttcagaggacgataagaaacaatccaaaaaggggacagaagagaagaaaaagccatccgattttaaaaaaaaggtcatcaagatggagcaacaatacgagtcttcaagcgatggtactgaaaagctcccggagagagaggagatttgccactttccaaagggaatcaagcagatcaagaacggcactacagatggtgaaaaaaagagcaaaaagatccgcgacaaaacctctaagaagaaggacgaactgtccgattatgccgaaaagagcacaggaaaaggcgactcttgcgactcatccgaggacaagaaaagtaagaacggggcttacggccgagaaaagaagcgatgcaaattgttggggaagtcttctaggaaacgacaagactgctcgtcctctgatacggagaaatattccatgaaagaggatggctgcaattctagcgataaacggcttaagagaatagaattacgggaaaggcgcaacctgagttccaagagaaataccaaggagatccaatcagggtcaagctccagtgacgcagaggagtcttctgaggacaacaaaaagaagaaacagaggacctcttcaaagaaaaaagcagtcatcgtgaaagagaagaagcgaaattcccttagaactagcacaaagcgaaaacaggcagatatcacctcaagttcctcctcagatatcgaagatgacgaccaaaactctattggcgagggctcctctgacgaacagaaaatcaagcccgttaccgagaaccttgtcctgtcctcccataccggcttctgtcagagcagcggcgatgaggctctatccaagagcgtgccggtgacagttgatgacgatgacgatgataacgatcctgagaatcggattgctaagaagatgctgctggaggagataaaggcaaacctgtccagtgacgaggacggctcttcagatgatgagcccgaggaggggaagaagaggacaggaaaacagaacgaagagaaccccggagatgaagaggccaaaaaccaggtaaactctgagagcgacagcgactccgaagaaagtaagaagcccaggtaccggcacagactgctccgccataaacttactgtatccgacggcgaatctggtgaggagaaaaaaacaaaaccaaaggaacacaaagaggtgaaaggtcgtaacaggcgaaaggtgtcgtctgaggactccgaggactctgacttccaggaatctggagtgtctgaagaagtatctgaatcggaggatgagcaacgcccacgaacccgctcagccaagaaggcggaactggaagagaatcaacggtcctacaagcagaaaaaaaaaaggcggagaataaaggtgcaggaggactcgtcgtcagaaaataagagcaattctgaggaagaagaagaggagaaagaggaggaagaggaggaagaggaagaagaggaggaagaggaagaagacgagaacgatgatagcaaatcccctggcaaaggccgaaagaaaatccgcaagatcctgaaagatgataagctcaggaccgagacccagaatgccctcaaggaagaggaagagaggaggaagaggatagcagagagagaacgcgagcgcgagaaactacgagaggtaatcgagattgaggacgccagcccaactaagtgtcccatcaccacaaagctggtgctggatgaggacgaggagacaaaggagcccctggtgcaggttcatcgaaacatggtgattaaactcaagccacaccaggttgacggggtgcaattcatgtgggactgttgttgcgaatccgtcaagaaaaccaaaaagtcaccaggctcaggatgtattcttgcccactgtatgggcctggggaaaaccctccaggtcgtgtcattcttacacaccgtcttgttgtgcgataaactcgatttctctacagcgcttgtcgtttgccccttaaacaccgctcttaactggatgaacgagttcgagaaatggcaggaagggctgaaggacgacgagaaacttgaagtcagtgagctggcgaccgtaaagcgacctcaggagcgctcctatatgctgcagcgatggcaggaggatggcggagtgatgattataggatatgagatgtaccggaatctggcccagggcagaaacgtgaagagcagaaagctgaaagagatctttaataaggctctagtggaccctggacctgatttcgttgtatgcgacgagggtcacatcctgaagaacgaggcgagtgccgtctccaaggctatgaacagcatccgaagcagacgcaggattattctgacagggacccccctgcagaataaccttatcgaataccattgcatggttaacttcattaaagagaatcttctggggtctattaaagagttcaggaacaggtttataaatccaatacagaacggccaatgcgcggactcaaccatggtcgacgttagagtgatgaaaaagagagctcacatactctatgagatgctcgccggatgcgtgcagcgcaaggactataccgcactcacgaaattccttccccctaagcatgagtacgtgcttgcagtcagaatgaccagtattcaatgtaaactgtaccagtactaccttgaccacctcaccggagtgggaaacaattcagagggcggacggggtaaggccggtgctaaactgtttcaggatttccagatgctgtcccgcatctggacacatccatggtgcctgcagctggattatataagtaaggagaacaagggttatttcgatgaagactctatggacgaattcatcgccagcgactccgatgaaacctcaatgtcactttcatcagatgattataccaaaaagaaaaaaaaaggtaagaagggtaaaaaggattcaagttcctctggatctggcagcgataacgacgttgaggtcattaaagtctggaatagccgatcgcgtggaggcggagagggcaatgtcgacgagaccggtaataatccatcagtatcactgaagcttgaagagtcaaaagctacttcctcttcgaacccctcctccccggcacctgactggtataaagacttcgtgaccgacgccgacgctgaggtgctcgagcatagcggtaagatggtcctgctatttgagattctgcgtatggccgaagagattggagacaaggtgctggtgttcagccagtctctcatctcgctcgacttaattgaggatttcttggagctggccagcagggaaaaaacagaggataaggataaaccgctaatttacaaaggcgaaggtaagtggctcagaaatatagattactacaggcttgatggctctactactgctcagtcacgtaagaagtgggcagaggagtttaacgatgagacgaatgtcaggggcagactctttatcatcagtactaaagctggcagtctgggcataaacttggtcgcagccaatagggttattatttttgacgccagctggaaccctagttatgatattcagagtatctttcgggtgtacagattcggccagacaaaacccgtatacgtataccgattcctggctcaggggacaatggaagacaaaatttacgaccgccaggtaacaaaacagtctctaagttttcgtgtggtcgatcagcaacaagtcgagagacatttcactatgaacgaattaacagagctgtacacattcgagccagacctgctcgacgacccaaattctgaaaagaaaaaaaaaagagatacacctatgcttccgaaggataccatcctggccgagctgctgcaaatccacaaggaacatattgtgggatatcatgagcacgactctcttttagatcacaaagaagaggaggagcttacagaagaggagcgtaaagccgcatgggcagaatatgaggctgagaagaaggggctaaccatgaggttcaacatccctactggcaccaacctgccaccagttagtttcaacagtcaaactccatacattccctttaatctgggcgctctgtctgccatgtccaatcaacaactagaggacctgatcaaccagggcagagagaaggtcgtcgaggccacaaactccgtgaccgcagtcaggatccagccccttgaagacattatctccgccgtgtggaaagaaaacatgaacctgtcagaggctcaagtgcaggctctggctttatcccggcaggcctcccaggaactcgacgtgaagcggagggaggctatctacaatgacgtgctaacaaaacagcagatgctcatctcatgtgtgcagaggatcctcatgaacagacgcttgcagcaacaatacaatcagcagcagcagcaacaaatgacctaccagcaggcaactcttggccacttaatgatgcccaaaccccctaacctgatcatgaatccctcaaattatcagcagatcgacatgagagggatgtaccagcccgtggctggagggatgcaacctccacccctacaaagggccccacctcccatgcgctccaagaaccccggaccatcacaggggaaatctatgta

SEQ ID NO: 27277 - DNA, 369 bp, Artificial Sequence
  Description of Artificial Sequence: Synthetic coding sequence
attaactataatagggacaaaatctccggcagcgggtccaactccgacatgatggaaaactcaaaggaggaggggacaagctcctccgaaaaaagcaaatcctccggaagctctaggtcaaagcgtaagccatctattgttactaaatatgtggagagcgacgatgagaagccgctcgacgatgaaacagtgaacgaagatgcatctaacgagaacagtgaaaatgacataacaatgcaaagcctgcccaaaggcactgtgatcgttcagcccgagcctgtgctgaatgaggacaaggatgactttaagggccctgagttccggtctcggagcaaaatgaaaacagagaatctcaaaaaaagaggctag

SEQ ID NO: 27278 - DNA, 4038 bp, Artificial Sequence
  Description of Artificial Sequence: Synthetic coding sequence
atgtccgagtcgaagttaaatactctcgtccaaaagctacatgacttcctggcacattcctcagaggaatccgaggagacgtcatctccaccccgtctggcaatgaatcagaatacagacaagattagtggttctggttctaactccgatatgatggaaaattctaaggaagaagggaccagcagttcagaaaagtcaaaaagttctgggtcttcccgtagtaagcggaagccctccatcgtgacgaagtacgtagaaagtgatgacgagaagccgctggatgacgaaactgttaacgaggatgccagtaacgagaacagcgagaacgacattacgatgcagagtctgccaaaagacggactgcacgggatagtctcatgtacagcctgtggtcagcaggtcaatcacttccagaaagacagcatctatcggcacccctccctacaggtgctaatctgcaagaattgttttaagtattacatgagtgacgacatttcaagagatagtgatggaatggatgagcaatgccgttggtgcgctgaggggggaaatttgatatgttgtgatttttgccataacgctttctgcaagaagtgtattctcaggaatctggggagaaaggaactatcaaccattatggatgaaaacaatcaatggtactgttatatttgccacccggagcccctcttggatctcgtaacggcctgtaattccgtgtttgagaacctcgagcagctcttacagcaaaataagaaaaagatcaaagtagacagcgagaaaagcaacaaagtatatgaacataccagccgtttctccccgaagaagacatcatccaactgcaacggtgaggagaaaaaattagacgattcctgcagtggctccgtgacttattcttacagcgcacttatcgtgcccaaagaaatgataaaaaaggcgaagaaattaattgaaactacagcgaatatgaacagctcatacgtgaaatttttgaagcaggccaccgataactcagagatctcttcggctactaaactgagacagttgaaggcgtttaaatccgtgctggccgatattaagaaggctcacttggccctggaagaggacctgaactcagaattccgagctatggatgccgtgaataaagaaaagaacacgaaagaacacaaggtgatcgatgccaagtttgagaccaaggcaaggaagggcgagaagccgtgcgcccttgaaaaaaaagacatcagcaaatcggaggcaaaactcagcaggaagcaggtggattctgagcatatgcaccagaatgtaccaaccgaagagcagcggactaataagtcaacgggtggcgaacacaagaagtcggataggaaagaggaaccgcagtatgagccggcaaataccagcgaggatctggacatggacatcgtgtcggttcccagctctgtgcccgaggacatattcgagaacctggaaaccgccatggaggtccagtcttccgtggaccaccagggtgatggcagctctgggactgaacaggaggttgagagctcttcggtgaaactgaatatttccagcaaagacaaccggggaggtgcggattgccaggaagtgccccaagacaaagacgggtataagagttgtggactgaacccgaagctcgagaagtgtggcctcgggcaggagaatagcgacaatgaacacttggtggagaacgaagtaagtcttttgcttgaggaaagtgatctccgtcgttcaccacgcgtgaaaacaacccccctgcggaggcccaccgagacgaaccccgttaccagcaactccgatgaggagtgtaatgaaaccgtgaaagagaagcaaaagctttccgtgcctgtgagaaagaaggataagcgcaacagcagtgactcagctattgacaacccgaaaccgaacaaactccccaaatcaaagcagtcagaaacagtggaccagaactctgactccgatgaaatgctcgctattcttaaggaggtgagtagaatgtcccacagcagctcttcggataccgatatcaacgaaatacatacaaatcacaaaactctgtatgacttaaaaactcaggcaggcaaagatgacaagggaaagcgtaaacgtaagtctagtactagcggcagcgacttcgataccaaaaaaggtaagtcagcaaagtcctctatcatttctaaaaagaagcgccagacccagtctgagtcaagcaattatgattccgagttagagaaagagattaaatctatgtctaagataggcgcagcacgcacaacgaaaaagagaatccccaacacaaaggacttcgatagcagtgaggatgagaaacacagtaagaaaggaatggacaaccaggggcacaagaatctaaaaacttcgcaggaaggatcctctgatgatgcggagaggaaacaagagagagagacattttcaagcgctgaggggacagtggataaagacactacaatcatggaactgcgcgacaggctccctaagaaacagcaggcgtctgcgagcaccgacggcgttgacaagcttagcggaaaggaacagtctttcaccagcttagaagttcgcaaggttgccgagaccaaagaaaaatcaaaacatctgaagacaaaaacgtgtaaaaaggtgcaggatggactctcagacattgcggagaaatttctgaagaaggaccaatcagatgagacatccgaagacgacaagaaacaatctaagaaaggcactgaagaaaagaaaaagcccagtgatttcaagaaaaaggtaattaagatggaacaacagtatgaaagttcttccgacggaaccgagaagctgccagagagggaagagatctgtcattttccaaaaggtattaaacagataaaaaacggcaccacagacggagagaagaagtcaaagaagatcagagataagacctccaagaagaaggacgagttgtcggactatgccgagaagtccactgggaaaggagactcttgtgacagctctgaggataagaagagtaaaaacggtgcctatgggcgtgagaagaaacggtgtaagttactaggcaaatcttctcggaaaaggcaggactgctcaagtagcgacactgagaaatattccatgaaggaagacgggtgtaattcatctgacaagcgactcaagcgcattgagctgcgagagaggaggaatttgtctagcaagaggaacacaaaggaaatacaatccggatccagctcatccgacgccgaggagtccagcgaggataataagaagaagaagcaacgcacatcgagtaaaaagaaagccgtgattgtgaaagagaaaaaacgtaattctctgaggactagcactaaacgcaagcaagcagacatcacaagcagttctagctcagatattgaggatgacgaccagaatagcataggtgagggctcaagcgatgagcagaagataaagccagttacagagaatcttgtgctgagttcccacacaggtttctgccaaagtagcggcgacgaggcactcagcaagtctgtgccagttactgtcgatgacgatgacgatgataacgaccccgaaaacagaattgcaaagaagatgcttctggaggaaataaaggcaaacctttcatccgacgaagacggctcatctgatgacgagcccgaagaagggaagaagcgtactggcaagcagaatgaggagaatccaggagacgaagaggcgaagaatcaggtgaatagtgagtctgactctgacagcgaggaaagtaaaaaaccgagatatcgccaccgactgctgcggcataaacttaccgttagtgacggggagtcgggcgaggagaaaaagacgaaacccaaagagcataaagaggttaaggggagaaacagacggaaagtcagttcagaagattcggaagactcagacttccaggagtctggagtgtctgaggaagtgagtgagagcgaggacgagcagcgcccaagaactaggtccgctaaaaaagcagaacttgaggaaaatcagaggtcgtag

SEQ ID NO: 27279 - DNA, 483 bp, Artificial Sequence
  Description of Artificial Sequence: Synthetic coding sequence
tgacccgactttgtagtgtgcgatgaagggcacattttaaaaaatgaggccagtgcagttagcaaggcaatgaactccatccggtcccgcaggcgcattattctgaccggcacacccctgcaaaacaacctgatcgagtaccattgcatggtcaattttatcaaagaaaacttgctgggttccataaaagagtttcgcaaccgatttattaatcctattcagaatggacagtgcgccgacagcactatggtcgatgtgcgtgtaatgaagaaacgggctcacatcctatacgaaatgttggctggttgcgttcagcggaaggactacactgcactgacaaagttcctgccaccgaaacatgagtacgtcttggcagtacggatgacctctatacaatgtaaactttatcagtattatcttgaccatctcactgtgctccacctcaataagatggggatgctgaaatcaattaagtacttttag

SEQ ID NO: 27280 - DNA, 2514 bp, Artificial Sequence
  Description of Artificial Sequence: Synthetic coding sequence
atgaatcacttggagggctccgcagaggtggaagtgacagacgaggcagcaggcggtgaggtgaacgaatccgttgaggccgatctggagcaccctgaagtcgaagaggaacagcagcagcctcctcagcagcagcattatgtgggacgtcaccaacgagggcgtgctctcgaggacctcagagcgcagcttgggcaggaagaggaagaaagaggagaatgtctggctcgttcggctagcactgaaagtggctttcacaatcacaccgacaccgccgagggggacgtgattgccgctgccagagatggttacgacgctgagcgggcacaggaccctgaggacgagagcgcttatgcggtgcagtataggccagaagccgaggaatatactgagcaggccgaggccgagcacgccgaggccactcacagaagggcgctaccaaaccacctgcacttccacagtctggagcacgaagaggcaatgaatgccgcttattctggttacgtgtacactcaccggttgtttcatcggggagaggacgagccctactctgaaccttatgctgactatggaggcctccaggagcacgtctacgaggaaatcggcgacgcccctgagctggacgcacgggacggactgagactgtacgaacaggaacgggacgaagccgctgcctatcgccaggaggctctgggcgctcgcctccatcattacgatgaaagatctgacggagaatctgactcacccgagaaggaagctgagtttgccccataccctaggatggactcttacgagcaggaggaagacatagaccagattgttgccgaagtcaagcagagtatgagttcccagagcctcgacaaggcagcggaggacatgccagaagctgaacaagatttggagcggcctccaacccccgcagggggacggccagacagtcccggactgcaggccccagccggacagcaacgcgctgtgggtccagcgggtggcggtgaggccggtcagagatacagtaaagagaagagagatgctatcagtcttgccataaaagatatcaaggaagcaatcgaggaggttaagactagaacaattaggtctccatatacccccgacgagccaaaggagcccatttgggttatgaggcaagacatttcgcctacacgtgactgcgacgaccagcggccaatggatggcgacagcccttcgccaggaagttcttcaccgctgggagctgaaagctcctccacttccctacatccaagtgaccccgtggaagcttccacgaataaagagtctcgcaaaagccttgcctctttccccacctatgtggaggtgcccggtccatgtgatccagaggatctgatcgacgggattatctttgcagccaactatctgggcagcacccaacttttatccgataagacaccttccaaaaacgttaggatgatgcaggctcaagaagctgtcagtcggataaagatggcacaaaaactggccaagtcccggaaaaaggcacctgagggcgagagccaaccaatgaccgaagtggatctgttcatctccacccagagaatcaaggtgctgaatgcagacactcaggagacgatgatggaccatcccctgaggactatctcctacattgccgatatcggcaatattgtggtgttgatggcacgaagacgaatgccgagatccaattcccaggaaaatgtggaggccagtcacccaagccaggatggcaagcgccagtataaaatgatctgtcacgtgttcgagtcagaggatgctcagcttattgctcagagtataggccaggccttttctgttgcctaccaggagtttttgagggcaaatggcataaacccggaagacctttcccagaaggaatattcagatctcctgaatactcaagacatgtacaacgatgacttgattcacttctctaagtccgagaattgcaaagacgtgttcatcgaaaaacagaaaggagagattcttggggtggtcatcgtggaaagtgggtggggcagtattctgcctaccgtgattatcgctaacatgatgcacggaggacctgcagagaagtctggaaagctgaatatcggtgatcaaatcatgtccatcaatggtacttccctcgtcggccttcccctttctacctgccaaagcatcatcaaagggctgaaaaatcagtcccgggtcaaactgaatattgtgaggtgtccccctgtcactactgtgttgatcagaaggccagatctcaggtatcagctgggattctctgtgcagaacggtattatctgctccttgatgcggggaggcatcgctgagcgcggtggcgtccgagtgggccatagaatcatcgaaattaatggtcagtccgtagtcgctactcctcatgaaaaaatcgttcatatcctgagcaacgccgtgggagagattcacatgaaaaccatgccggctgccatgtacaggctccttaccgctcaagaacagcctgtgtacatctag

SEQ ID NO: 27281 - DNA, 2469 bp, Artificial Sequence
  Description of Artificial Sequence: Synthetic coding sequence
atggcagccgctgtggttgttgccgaaggcgacagcgactcacgaccaggacaagagttgctggtggcgtggaacaccgtttccactggactggttcccccagcagctctggggctggtgagcagccggacttctggcgctgtgccccctaaggaggaggaactgagagcggcagtggaagtgctccgcggtcacggcttgcatagtgtcctcgaggaatggtttgtcgaagtcttacagaatgacctgcaagcaaatattagccccgaattttggaatgcaatatcacagtgtgaaaactcagccgatgaaccacagtgtctattgctgcttctggacgccttcggacttctggaatctcgcctggacccctatctccgcagtctcgagctccttgaaaagtggacccggcttggcttgctcatgggaaccggagcccagggcctgcgcgaggaagtgcacacgatgctccgcggagtgttatttttctccactcctcgtacgtttcaggagatgattcaaaggctatacggttgcttcctgcgagtgtacatgcagtctaaacgcaagggtgagggagggactgaccctgagctcgagggagaactggatagccggtatgcaaggcgtcgctattatcggctgcttcaatcccccttatgtgcaggatgtagcagcgacaagcaacagtgctggtgccgacaggcgctggagcagttccaccagctgagtcaagtgctgcaccgcttatccttactcgaacgggtgtctgccgaagccgtgaccacaactctgcatcaggtgactagagagaggatggaagacaggtgccgaggcgagtacgagcgcagcttcctaagggagtttcacaagtggatagagcgcgttgtcggctggctcggcaaggtcttcctgcaagacgggccagctaggccagcaagccccgaagccggtaacacgcttcgccgatggagatgtcacgttcaacgattcttttatcgcatttacgccagcctgagaattgaggagttgttcagcatcgttagagacttccctgactcccgaccagcgatcgaagatctgaaatactgtctcgaacgtacggatcagcgccagcaattacttgtaagcctcaaggccgcattagaaacgaggctgctgcaccctggcgtgaacacatgcgacataataacattatatatttcagctatcaaggctttgagggtcttggacccctccatggtaatcctggaagtggcgtgtgagcccattagacggtacttgcggactcgagaggacaccgttcggcaaatcgtcgctggacttaccggcgatagtgatggcacgggggatctggcagtggaactctccaagacagacccagcaagcttggagacaggccaggacagcgaagacgactccggcgagcccgaggattgggtgccggaccctgttgatgccgaccctgggaagtcaagttccaaacgcagatcctccgatatcatttccctgctagtcagcatctacggttcgaaggacttattcatcaatgaatatcgtagtctcttggccgacaggttgctgcatcagtttagtttttcccccgaacgtgaaattcggaacgtcgagcttctgaagctcaggttcggagaagctccaatgcacttctgtgaagtgatgcttaaagacatggccgacagcaggcgcatcaacgccaacattcgagaagaggacgagaagcgccctgccgaggagcagcctccctttggtgtgtacgcggtgattctgtctagcgagttttggcccccttttaaggatgagaagttagaggttcctgaggatattagagccgcactcgaagcatactgcaaaaaatacgagcagttaaaagctatgcgaacattatcttggaaacacacactcggcctggtcaccatggacgtcgagttagcagaccgtactctctcggttgctgtcaccccagtccaggcggtgatactgctatattttcaggatcaggcgagctggaccctggaggagctgtccaaagctgtgaaaatgcccgttgctctcctgagacgtagaatgagcgtttggttgcaacagggagtcctgagggaggagccgccagggaccttcagcgttatcgaggaggaacggccacaggacagagacaatatggttcttatcgattccgacgatgagagtgacagtggcatggcctcacaggctgaccaaaaggaagaggagctcctgctcttttggacgtatattcaagctatgttgacaaatctggaaagcctgtcgcttgacagaatctacaatatgttgcgcatgttcgtggtgacaggtccagccctcgccgagattgatctccaggagcttcagggctatctgcagaaaaaggtccgcgaccagcagctggtctactctgctggggtttataggttgccgaagaattgttcatag

SEQ ID NO: 27282 - DNA, 4863 bp, Artificial Sequence
  Description of Artificial Sequence: Synthetic coding sequence
atgggtgctattggtctgctgtggctgctgcctttattattgtccacggcagccgtcggatctggaatgggcacaggacagcgtgccggtagtcccgcagctggcccacctctgcagccacgtgaacctctgagctacagtaggttgcagcgaaaaagtctggccgtcgactttgtcgtaccgagcctgttccgggtttacgccagagacctgttgctgcccccatcttcctctgagctgaaggctggacggcctgaggctcgagggtctcttgccctagactgcgccccactgctgaggttgctggggcctgctcccggtgtgtcctggactgccggatcccctgcgcctgctgaggcacgcacattgagcagagtgctcaaggggggttctgtgagaaagcttaggcgggcaaaacagctggtactggagctgggtgaggaagccattcttgaggggtgtgtcggcccacccggtgaagctgcagtgggactgcttcagtttaacctgtctgagctttttagttggtggatccgtcagggcgaggggcgtcttagaatcagactgatgcccgaaaaaaaagccagcgaagtggggagggagggcagactctcagccgcaattagggcgtcacagccacgactgctgttccagatttttggcaccggacattctagtttggagagcccaactaatatgccgagcccctctccagactatttcacttggaatctgacttggataatgaaggacagcttcccattcttgtctcaccgcagcaggtatggtctcgaatgtagctttgatttcccatgtgaactcgagtattctcctcctcttcacgatctgaggaaccaatcctggagttggaggcgcatcccttcagaagaggcatcccagatggatctgctcgacggcccaggagcagaaagaagcaaggagatgccgagaggatccttcctgctgctaaacacttctgctgatagtaagcatactattctttctccttggatgcgctcttcaagcgagcattgcacactggccgtgtctgtacatcggcatctccagccaagcggccgatacatagcacagcttctaccacataatgaagcagcccgtgaaatcttgctaatgcccacacctgggaaacacggttggactgtgctgcaggggagaataggcagaccagacaatccttttcgcgtggcccttgagtatatcagcagcggcaaccggagcctttcggcggttgatttcttcgccctgaaaaactgttctgagggaacaagtcccggatccaagatggctctacagtcctcattcacatgttggaacggaaccgtgctccagctcggccaagcgtgtgacttccatcaggactgcgcccagggggaggacgaatctcagatgtgtcgaaaacttccagtgggcttttattgcaactttgaggacggtttctgcggctggacccaggggacacttagcccacataccccccagtggcaggttcgtaccttgaaggacgccaggttccaggatcaccaggaccatgccctcctgctatcgaccaccgatgtaccggctagcgagtctgctacggtgacaagtgcaacttttcccgcaccaatcaagagcagcccctgtgaacttcgcatgtcctggctgatccggggtgtgttaagggggaacgtgtctttggttctagtggaaaacaagaccggcaaagagcaaggaagaatggtctggcacgtcgctgcctatgagggcctttctctatggcaatggatggtgttgcccctgcttgatgtgtctgaccgcttctggctccagatggtcgcctggtgggggcagggatccagggccatagtggcattcgacaatataagcatctctttggattgctaccttacgattagtggagaggacaaaattcttcaaaacacagctcccaagagtaggaacttgtttgaaagaaaccctaacaaggagcttaagcccggtgagaactctcccagacagacaccgatattcgaccccaccgtccattggcttttcactacctgtggcgcatctggtccacatggcccaactcaggcacagtgtaacaatgcttatcagaatagtaacctgtctgtagaagtggggtcagaaggtcccctgaagggcatccagatctggaaggtgcccgcaaccgacacgtactcaatcagcggctatggagctgctgggggaaaaggaggaaaaaacaccatgatgcggtcccatggagtgagcgtgctaggtatcttcaatctggaaaaggatgatatgctctacatcttggtgggccagcagggtgaagatgcgtgtccatcaacgaaccagttgatccagaaagtgtgtatcggagaaaacaacgtcatcgaagaggagatccgggtgaaccgctctgttcacgaatgggctggcggaggtggagggggagggggtgccacctatgtatttaaaatgaaagacggagttccggtcccccttattatagcggcagggggtggcggtcgcgcttacggcgctaaaaccgatactttccaccctgagaggcttgagaacaacagctccgttctggggttgaatggtaattccggcgcagccggaggtgggggaggctggaatgacaacacctcactgctctgggctggtaagtcactgcaagagggcgctactggcggtcattcatgtccccaggctatgaaaaagtgggggtgggaaactagagggggttttggcggaggagggggaggctgcagtagcgggggtggcggagggggttatatcggtgggaacgcagcttccaacaatgatcctgagatggacggggaagacggggtgtcgttcatttccccattgggaattctgtatacccctgcgctcaaagtcatggaggggcacggcgaggtcaacatcaagcactatcttaattgtagccattgcgaggtcgacgagtgtcatatggaccctgaatctcataaggtaatttgtttctgtgatcatggcacagtgttagccgaagacggtgtgtcttgcatcgtgtccccaacaccagagcctcacttacctcttagtttaattctctctgtggtgacatcagctctggtggctgccctggtgcttgcattttcagggattatgatcgtctaccgcagaaaacaccaggagctgcaggctatgcagatggagcttcagtcccccgaatataaattgtctaaactgagaaccagcactataatgactgattacaatcctaactattgtttcgcaggtaagaccagtagcatttctgatcttaaagaggtgccaagaaaaaacattacactgatccgcggattgggccatggtgccttcggtgaggtgtatgagggccaagtgtctggtatgcccaacgatcccagcccactgcaggtagctgtaaagacattacctgaggtgtgcagcgaacaggacgaactggacttccttatggaggctctaatcatttctaaattcaaccatcagaatatcgtgcgttgtataggtgtgagtctgcagagccttcctcggttcattctccttgagctcatggcaggcggtgaccttaagtccttccttcgggaaactcgacctaggcccagccaaccttcatccctcgctatgctcgatctgctccacgtggccagggacatcgcctgcggctgtcagtaccttgaggaaaatcacttcatccatagggatatcgcagccagaaattgcttactgacgtgccccggtcctggaagagttgccaaaatcggcgattttggtatggcgagagatatttacagagcatcctattataggaaggggggatgcgcaatgttacccgtcaagtggatgcccccagaggcattcatggagggtatatttacgagcaagacggacacttggagtttcggcgttcttctctgggagatcttctcattggggtatatgccgtatccttccaaatccaatcaggaggttcttgagttcgtaacctccgggggtcgtatggaccccccaaagaattgccctggccctgtgtatagaatcatgacccagtgttggcaacatcagcccgaagaccgtccaaatttcgccatcatcttggagcgtatagagtactgcacccaggatcctgacgtgattaatacggccttacccattgagtatggtcctttggtcgaagaggaggagaaggtgccagtgcgacccaaggatcctgaaggcgtccccccattactggtgtctcagcaggcaaagcgagaggaagagaggtccccagccgctccaccccctttgccaacaacttcttctggaaaagccgctaaaaagccaacagcagccgaaattagcgtgagggtaccgagggggccagcagtcgaaggcggtcatgtaaatatggccttttctcagagcaatccccctagcgaactgcacaaggtgcacggctccagaaataagcccacaagcctttggaacccgacttatgggtcatggttcaccgagaaaccaactaaaaaaaataacccaattgccaagaaggaaccccacgataggggaaaccttgggcttgagggatcctgtacagtccctccaaacgttgcgactggcagactgcccggtgcaagccttctactggagccctcttcattaaccgcgaatatgaaggaggtgcccctgttccgtctcagacacttcccttgcggaaatgtgaattacggctatcagcaacagggccttccactggaagctgcaaccgcccctggagccggtcattacgaggacacaatcctgaaatccaagaatagcatgaaccaacccggtccatag

SEQ ID NO: 27283 - DNA, 1353 bp, Artificial Sequence
  Description of Artificial Sequence: Synthetic coding sequence
atgggtgccatcggtttgctctggctgcttcccctgttactgtccacagccgctgtggggtcagggatgggcaccgggcagcgtgctggcagccccgcagccggaccccctttacagcccagggagcctttatcttactcccggctccaacggaagtcattggcggtcgatttcgtcgtcccaagcctattccgggtctacgccagagatttactgcttccaccttctagcagtgagctcaaggcaggcaggcccgaagccagggggagtctggcactcgattgcgcacctctccttcgcctgctgggccctgccccaggagtgagttggactgctggcagcccagctcccgcagaagctaggactttgtcccgcgtgctcaaaggcggaagtgtgaggaaactcagacgcgctaaacaactagttctggagttgggcgaagaggccatcctggagggctgtgtcggaccacctggggaagcagctgtggggttgcttcagtttaatctgtctgaattgttttcctggtggatcagacagggtgagggcagattgcgcattcgcctcatgcccgaaaagaaggccagtgaagtgggccgagaaggcaggctttccgccgcaatcagggcatcacagcctaggcttctgttccaaatctttggaaccggacatagcagtctagaatcaccaaccaatatgccttcaccttctcctgattactttacctggaatctgacctggatcatgaaggacagcttcccgtttttaagtcacaggagcaggtatggtaaggaacggtcccctgcagcccctcctcctttgcctactacttcctcagggaaggcggctaagaaaccaacagccgctgagatttcggttagggtgcctcgaggtccagccgttgaaggtggtcatgtgaacatggcgttctcccagtcaaaccccccttccgaactgcacaaggtccacgggtccaggaacaagccaacatccttatggaatcctacctatggaagttggttcacagaaaaacccaccaaaaaaaataatcctatcgccaaaaaggagccgcatgaccggggaaatttaggtctggagggtagttgtactgtgccacccaacgttgccacaggcagattgcccggtgctagcctactgcttgaaccttcctcactcacggccaatatgaaggaagtccccctcttcagattgaggcactttccttgtggcaacgttaactatgggtaccagcaacaaggcctgcccctggaggccgctaccgccccaggcgcaggccattatgaggatacgattctgaagtctaaaaactcaatgaaccagcctgggccttag

SEQ ID NO: 27284 - DNA, 1935 bp, Artificial Sequence
  Description of Artificial Sequence: Synthetic coding sequence
atggaggtccagcttggactagggcgtgtgtatcccaggcctccatcgaaaacgtatcggggagccttccagaacttgttccagtcagtgcgagaggtcatacagaatcccggacctcgccatccggaggctgctagcgcagctcctcctggcgcttcactattgcttctgcagcagcaacagcagcagcagcaacagcagcagcagcagcagcagcaacagcagcagcagcagcagcaagaaaccagccctcgacaacagcaacagcaacagggagaggacggatccccacaggcccacaggcggggacccaccggctacttagtcctcgatgaagagcagcagccatcccaaccacagtcggccctggagtgtcaccctgagcgaggctgcgtgccagagccgggagctgcagtggcggcatctaaaggcttgccacagcaactacccgcacctccagatgaggacgactccgccgctccgtccacgctgtctcttttaggaccaacattcccgggactgtccagttgcagcgcagatctgaaagacattctgagcgaagcgagtacaatgcaattgctccagcagcagcagcaagaggcagtatctgaaggtagctcctccggcagagcccgtgaagcctcgggggcacccacttcaagcaaggacaactacttgggcggaacttccaccatctctgacaacgctaaggagctgtgtaaggcagtgtcagtctccatggggctgggcgtcgaagcgctggaacacctaagcccgggagaacaattgaggggtgactgtatgtatgctcccttgttgggcgtacccccagcggtccgacctactccttgtgcacccctggccgagtgtaaaggttctctgttggacgattccgcaggcaagtctacagaagataccgccgaatacagcccctttaaaggtggttatacaaaaggcctcgaaggagaaagcctgggctgtagtgggtcagcagctgctggctcaagcggcacattggaactcccctcaaccctgagtctgtacaaaagtggtgcactcgatgaggcggcagcatatcaaagccgcgactattataattttcccttggctctcgccggtccgccaccccctccacccccaccccaccctcatgctaggatcaagctcgagaatcccctcgactacggaagtgcatgggcagccgctgcagcccaatgcaggtacggcgacttggcctcgctgcacggagccggtgccgctgggccaggctctggctccccgtcggcggctgcgtcttcttcctggcacacgttgttcaccgctgaagaaggacaactgtacggtccttgtggtggaggcggtggcggtggcggtggtggtggagggggagggggtggtgggggaggcggaggcggaggggaagcaggtgcagtggcaccatacggatatactcgacctcctcagggtctggccggtcaggagtccgactttaccgcccctgatgtctggtatccaggaggcatggtgagcagggtcccctacccttcacccacatgtgtcaaatctgaaatggggccatggatggattcttattccggaccatacggggatatgcgactggagacggccagagatcacgtgctaccgatcgactactactttccaccccaaaagacctgtttaatctgtggcgatgaggctagcggttgtcactacggggcattgacttgcggttcttgtaaagtgtttttcaaacgggcagctgagggcaaacagaagtatctgtgcgcgtcccgaaacgactgtactatagataaattcagacgaaagaactgtccatcctgtcggctgaggaaatgctacgaagccggaatgacgctgggggagaagtttcgcgtcggtaactgtaagcacctgaaaatgaccagaccatag

SEQ ID NO: 27285 - DNA, 1803 bp, Artificial Sequence
  Description of Artificial Sequence: Synthetic coding sequence
atggaggtgcaattgggccttggacgcgtgtacccaagaccgcctagcaagacctaccgaggggcatttcaaaatctctttcaatccgttcgggaggttattcaaaatccgggacccaggcatccagaggctgcctcggcggcaccaccaggagccagcctgctcttactacagcaacaacagcagcagcagcagcagcagcaacagcagcagcagcagcagcagcagcaacagcagcaagaaaccagcccccgacagcagcagcaacagcagggcgaggatgggtcgccccaggcacatcgccgtggtcctaccggctatttggtgttggatgaagaacagcaaccatctcagccccaatcagcgctggaatgccatcctgagcgaggctgcgtgccagaacctggcgctgccgttgcggcatcaaaaggtctgcctcagcaactgccagcaccaccagacgaggacgatagtgctgcgccatccacgctgagcctactcgggccaaccttcccgggactatcgtcctgctccgccgatctgaaagacatcctaagcgaagcctccactatgcaactgctgcagcaacaacagcaagaggccgtttctgaaggcagcagttcaggacgagccagagaggccagtggcgcaccgacatcgtccaaggataactacttggggggtacttcaacaatctctgacaacgctaaagaactgtgcaaagctgtctctgtctctatgggactcggcgtcgaagcactggagcacctgagtcctggcgaacagctgcgtggcgattgcatgtacgcccctttgctcggtgttcctcctgccgttcgtccaactccctgtgcacccctcgctgagtgcaagggatctctgctggatgactcggctggcaagagcaccgaggatactgccgaatactcgcccttcaagggcggttacactaagggtttggaaggcgagtctctcggatgctccggttctgctgcagcaggaagttcaggaactctggagttgccttcaactctcagcctgtataagagtggagcattggacgaggccgctgcctaccagagccgcgattactacaacttcccactggccttggcaggacctcctcccccaccgccacccccacacccacacgccagaattaagctggagaaccctctggattatgggtccgcctgggcagccgctgcagcacagtgcaggtacggcgatctggccagtctgcacggggctggcgcagcaggcccaggatccggtagcccgagcgctgccgcttcgagcagctggcacactctgtttaccgcagaagaaggccagctctatggaccctgcggcggaggagggggaggcggtgggggaggcggtggtggtgggggaggcggagggggaggtggcggaggtgaagcaggcgcagtggcaccatatggctacaccagacctccccaaggcttagctggccaggaaagcgacttcacagcacctgatgtgtggtatccgggtggcatggttagcagggttccctacccttcaccaacctgtgtgaagtcagaaatgggtccatggatggattcctactcaggtccctatggagatatgagactggaaaccgctcgcgatcacgtgctaccaatagactattattttcccccacagaagacttgtcttatttgcggagacgaagcttccggttgtcattacggagcattgacctgcggcagctgtaaggtgttttttaagagggcagccgaaggcttcttccgcatgaataaactgaaggagtcctag

SEQ ID NO: 27286 - DNA, 444 bp, Artificial Sequence
  Description of Artificial Sequence: Synthetic coding sequence
atggtgatgggactgggagtgctgctgctcgtcttcgtcctcggactaggcctcacacctcctaccctcgcccaagacaatagtaggtacactcatttcctcacacagcattacgacgccaagccacagggccgtgatgatcgctactgtgagtccataatgaggcggagagggctgactagtccttgtaaagatatcaatacctttattcatgggaacaaacgatccataaaagctatttgcgaaaataagaatggcaatcctcatagggagaacctgcgcattagcaagagttctttccaagtcacaacttgtaaactccacgggggatccccttggccgccatgccaatatcgtgcaaccgctggctttaggaatgttgttgtggcttgtgaaaatggactcccagtccacctcgaccaaagcatcttccggagaccatag

SEQ ID NO: 27287 - DNA, 444 bp, Artificial Sequence
  Description of Artificial Sequence: Synthetic coding sequence
atggtaatgggattgggcgtgctgttgctcgtgtttgtccttgggctggggctgactccacctactttggctcaggacaatagtaggtatactcacttcttgacccagcactacgacgctaagccgcagggaagagatgaccggtattgtgaatcgatcatgcgcaggaggggacttacaagcccttgtaaggacattaacacttttatccatggaaacaagagaagcatcaaggccatctgcgagaacaagaacgggaacccacatcgagagaatttgagaatctccaaaagttcattccaagttaccacatgcaaattgcacggcggatctccctggcccccatgtcagtacagggctacagccggattcaggaacgtggtagttgcctgtgagaacggacttcctgtgcatctggatcaatccatatttaggcgaccctag

SEQ ID NO: 27288 - DNA, 1494 bp, Artificial Sequence
  Description of Artificial Sequence: Synthetic coding sequence
atgacagtgttcttatcctttgcatttctggctgctatcttgacacatataggctgctcgaatcagaggcggtcgccagaaaacagcgggaggcgctacaatagaatccaacacggccagtgtgcctacacgtttatcctgccagagcatgacggcaactgtcgggagtccacgacagatcagtacaacacaaatgcgcttcagagggatgccccacacgttgagcccgattttagttcgcaaaagttgcagcacctggaacacgtgatggaaaattatacacagtggctccaaaagctcgaaaactacatcgttgaaaacatgaagtccgagatggctcagattcagcagaatgctgtgcagaaccacactgctaccatgcttgaaattggcacatcacttctgtcacagaccgctgagcagaccagaaaactcacagatgtggagacccaggtgctgaaccagacctcgcgattagaaattcagctcctggagaactcattgtccacttataagttggagaaacagcttctgcagcaaaccaacgagattctgaagattcatgagaagaattccttactggagcacaagatccttgaaatggagggaaaacataaggaggaactcgatacacttaaggaagaaaaggaaaacctgcagggactggtgaccaggcagacttatatcatccaagaactagaaaaacagttaaatcgggcaactaccaacaacagtgtgctgcagaaacagcagcttgagttgatggacaccgtgcataatttagtgaatttgtgcacaaaggaagtcctcctcaagggaggcaaacgagaagaagagaagccctttagggactgcgccgacgtctaccaggcgggattcaacaagtctggcatctacactatttatatcaataacatgcccgaacctaaaaaggtcttctgcaatatggatgtgaacggcggagggtggacagtgattcagcatagagaggacggctccctggatttccaacgtggctggaaggaatacaagatgggctttggcaaccccagcggcgagtactggctggggaacgagttcattttcgcaattacctcccagaggcagtatatgctgcggatcgagctgatggactgggaaggtaatagagcctacagccaatacgataggttccatatcgggaatgaaaagcaaaattacagattatacctcaaggggcacaccggcaccgctggcaagcaaagctctctgattctccacggagctgacttttccacgaaagacgccgataatgacaactgtatgtgtaaatgcgccttgatgttaacagggggatggtggttcgacgcgtgcggccctagcaacctgaatggaatgttttatacagctggccagaaccacggcaaattgaatggcatcaaatggcattacttcaagggtccaagttatagtctgcgatccactactatgatgattcgccctctggatttttag

SEQ ID NO: 27289 - DNA, 459 bp, Artificial Sequence
  Description of Artificial Sequence: Synthetic coding sequence
accgtgtccaacctgctggagcataagatactcgagatggagggtaagcacaaagaggagctggataccctcaaagaggaaaaggagaacctgcaagggctggtgacacggcagacatatatcatacaagagctagaaaagcagctgaatcgggcaactactaataattctgtcttgcagaagcagcaactggagttgatggacacagtgcacaaccttgtcaacttgtgtacaaaagagggtgtactgctgaagggtggaaaacgagaggaggaaaaacctttccgagattgcgctgatgtttatcaagctggatttaacaagagcggaatatataccatctatattaacaacatgcctgaaccaaagaaagtcttttgcaatatggatgttaacggaggcggttggaccgtcattcagcacagggaggacggctctctcgacttccagaggggctag

SEQ ID NO: 27290 - DNA, 1497 bp, Artificial Sequence
  Description of Artificial Sequence: Synthetic coding sequence
atgacggttttcctttcgttcgccttcctagctgctatacttactcatatcggctgctcaaaccaaaggcgtagtccagagaattccggacggaggtacaatcgcatccagcatggacagtgcgcctatacttttatccttcctgaacatgatggaaactgcagggagagtaccacagaccagtataatacaaatgcccttcagagggatgcaccacatgtcgagcctgacttcagttctcagaagctgcagcatttggagcacgtaatggagaactacacccagtggctgcagaaattggagaattacatcgtggaaaacatgaaaagcgagatggcacaaattcagcaaaatgccgtgcagaatcatacggccacaatgctggaaataggcacctccctgctcagtcaaaccgccgagcagacccgcaagctgaccgacgtagaaacgcaggtgctgaaccaaacgtcccgtctagagatacagctgcttgagaacagcctatccacttataagttggagaagcagctgttacagcagacaaatgaaattctgaagattcacgagaagaatagcctgctcgaacacaaaatcctggaaatggaaggtaaacataaggaagaacttgacacgttgaaggaggaaaaagagaacctgcaaggcctcgtaaccagacagacttatatcattcaggagttagaaaaacaacttaaccgcgctacaaccaacaatagcgtgttgcaaaagcagcagctggaactcatggacaccgtccataatctggttaacctttgcacgaaggagggtgtgctgcttaagggtggtaaaagagaagaggaaaagccttttagggactgcgcggacgtatatcaggcaggcttcaacaagtctggcatttacacaatttatatcaacaatatgccagagccaaagaaggttttctgcaacatggatgtgaacggcggaggttggacagtcatccagcatcgggaggatggatctctcgactttcagcgcggttggaaggagtacaaaatgggcttcgggaatccgagtggtgaatattggctggggaatgagttcatctttgccattacttctcagagacagtatatgttgaggattgagctaatggactgggagggcaacagggcttactctcagtacgaccgattccacatcggcaacgaaaaacaaaactaccgactctatctgaagggccacaccggcactgcaggtaagcaaagtagtctcattctccacggcgcagacttcagtaccaaggacgcagataacgataactgtatgtgcaagtgtgccttaatgctgacgggaggctggtggttcgacgcctgtggccctagtaacctcaatggcatgttctacaccgccggtcagaaccacggcaaactgaacggtatcaagtggcactatttcaaagggccatcctatagcctgaggagcacaacgatgatgattcgccctctcgacttctag

SEQ ID NO: 27291 - DNA, 894 bp, Artificial Sequence
  Description of Artificial Sequence: Synthetic coding sequence
atggaaggcaagcacaaggaagaactggacactctcaaagaagagaaagaaaatctacaggggttggtgacaagacagacgtatatcatccaggagctcgaaaaacagttgaacagagccaccaccaacaattctgtactccaaaagcaacagctggagctgatggatacagttcacaacctggttaatctgtgtaccaaggaggtgttactgaaagggggaaaacgtgaggaggaaaaaccctttagagattgcgctgatgtatatcaggccggattcaataagagtggcatatacaccatctacatcaataatatgccagaacctaaaaaagtgttctgtaacatggacgtgaatggaggcggttggaccgtcatccagcacagggaagatgggtcactcgacttccagcgcggatggaaagaatacaaaatgggattcggcaatcccagtggcgaatattggctgggtaacgagtttattttcgccataaccagccaaagacaatacatgttgcggattgagctcatggattgggaaggcaatagagcctacagccagtacgaccggttccacattggcaatgaaaagcagaattacaggttgtacttaaaaggacatacgggcacagccggaaaacagtcctccctaatacttcacggtgctgacttctcaactaaggatgctgacaacgataattgcatgtgtaagtgcgcactaatgttgacggggggatggtggttcgacgcatgtggtccctctaaccttaatgggatgttttatactgctgggcagaaccacggcaagctgaatggaatcaagtggcattattttaagggaccttcttacagtttgaggagcaccacaatgatgattcgcccactcgatttttag

SEQ ID NO: 27292 - DNA, 897 bp, Artificial Sequence
  Description of Artificial Sequence: Synthetic coding sequence
atggaaggcaaacataaagaagagctggataccctgaaagaggagaaagagaatttacagggattggttacccgtcagacctacatcattcaggagcttgagaagcagctgaatcgggctactactaacaattctgtgcttcaaaagcagcagcttgagttgatggataccgtacacaacctggtcaacctgtgtactaaggaaggggttctactgaaaggcggtaaacgggaggaagaaaaaccattccgagattgtgctgatgtatatcaggccggatttaataaaagcggtatttatacaatttacatcaataacatgcccgagcccaagaaagtgttctgcaatatggatgtgaatggaggaggctggaccgttatccagcacagagaggacggcagcttagactttcagagagggtggaaggagtacaagatgggattcggtaatccctcgggtgagtactggctaggaaatgaattcatattcgccattacctcacagagacaatacatgcttcgcatagagttaatggactgggagggcaatagagcctacagccagtacgaccgctttcacattggaaacgagaaacagaactatcggctgtacctgaagggacacacgggaacagcaggcaagcagagttcgctcatcctgcatggagcagacttctctactaaggacgcggacaacgataattgcatgtgtaagtgcgctcttatgctcacaggcggatggtggttcgacgcctgtggtccttctaatctgaacggcatgttctacaccgctggccagaaccacggtaagctgaacggcattaagtggcattatttcaagggaccctcatactcactccgaagcacgacaatgatgatcagacccttggacttttag

SEQ ID NO: 27293 - DNA, 1491 bp, Artificial Sequence
  Description of Artificial Sequence: Synthetic coding sequence
atgtggcagattgtctttttcaccctcagctgcgacctggtgctggcggcagcttacaacaacttccgcaaatcaatggacagtatcgggaagaaacagtaccaagttcaacacgggagttgtagttatacgttcctcctgcctgagatggataactgccgttcatcttcttccccatacgtatccaatgctgtccagagagacgcaccccttgagtacgacgactctgtgcagagactacaagtcctggaaaacattatggaaaataatacgcagtggctgatgaagctggaaaactatattcaggataacatgaaaaaggaaatggttgagatacagcagaacgctgtgcagaatcagactgctgttatgattgagattggcacaaatctgctgaaccagaccgcggagcagaccagaaagctcacagacgtggaagcccaagtgctgaatcaaaccacccgcctggagctgcagttactggaacattccctctcgactaataagctcgaaaagcagatcctggaccagactagtgaaattaataagctgcaggacaaaaattcttttctagaaaagaaagtcctggcaatggaggataagcacatcatccaactgcagtccataaaggaggagaaagaccagctccaggtgctagtgtcaaaacagaactccattatagaggaactcgaaaaaaagatcgtcaccgccacggtgaacaatagtgtgctgcagaagcagcagcacgatcttatggagaccgttaataatctgctgactatgatgtccacttccaatagcgcaaaagaccccacagtggccaaagaagagcagatttcattcagggattgtgctgaggtattcaagagtggccataccactaacggcatttacacattgacattccccaatagcacagaggagatcaaggcctattgtgatatggaagcgggaggcggaggctggactatcatacagcgtcgagaggatggctcagtcgatttccagcggacatggaaggaatataaggtgggctttggaaacccctctggtgagtactggctgggcaatgagtttgtgtcacagttgaccaaccagcagaggtatgtgctaaaaattcacctcaaggactgggagggcaatgaggcttatagtctctacgaacacttctacctgtccagcgaggaactgaattatcgcatccacctaaaggggctgacaggaacagcgggtaaaatttcatcgatttcccagccgggtaatgacttttccactaaggatggggacaatgacaagtgcatctgtaagtgctcacaaatgttgaccggagggtggtggtttgacgcatgtggtcctagtaacctgaatggaatgtactatccacagcggcagaacaccaataaattcaatggtataaagtggtactattggaaaggctccgggtattccctgaaagcgacaacaatgatgattcgccctgcagatttctag

SEQ ID NO: 27294 - DNA, 1488 bp, Artificial Sequence
  Description of Artificial Sequence: Synthetic coding sequence
atgtggcagattgtgttttttacccttagctgcgatctggtcctggcagcagcttataacaattttcgcaagtcaatggatagcatcggcaaaaagcagtaccaggttcagcatggttcatgctcgtatacgttccttttaccggagatggacaattgtcggtcaagcagttccccttacgtttccaacgctgttcagagagacgcgccactcgagtatgacgattctgtgcagcgcttgcaagtcctggaaaatatcatggagaacaatactcagtggcttatgaaactggaaaattatatacaggacaacatgaagaaagagatggtcgaaatccaacagaacgccgttcagaatcagaccgcggtgatgatcgagatcggcaccaatttgctcaatcagaccgctgagcaaactagaaagctcaccgacgtggaagcccaagtgctgaaccagaccacacgtctggagctgcagcttctggaacacagcttgagtacgaacaaacttgaaaagcagattctcgaccagaccagcgaaataaataaactgcaggacaagaattcattcctggaaaaaaaggtgctcgccatggaagataagcatatcatccaattgcagagcatcaaggaagagaaggaccagctccaagtactcgtgtcaaaacagaatagtatcattgaagagcttgagaagaagattgtgactgcaacagtcaacaacagcgtcctccagaaacagcagcatgacctaatggaaacagtgaataacctcctgactatgatgtctaccagcaattccaaggacccgacagtggccaaagaggagcagatttcttttagggattgcgcagaagtgtttaaatcgggccatacaaccaacggcatttatactctgacattcccaaattcgacggaggaaattaaggcttattgcgatatggaagcgggtggaggcggatggacgatcattcaaagacgggaagatggatcagtggacttccagagaacctggaaagagtacaaagttggtttcgggaatccgagcggcgagtattggctgggaaacgagttcgtttcccagttgaccaatcaacaacgatacgttttgaaaattcacctcaaagactgggagggaaacgaagcttactctctctacgagcacttttatctctcttccgaagaattaaactacagaatccacttaaagggtctgaccgggaccgcagggaaaatcagcagcatcagccaacccggtaatgacttctctaccaaagatggcgataatgataagtgcatctgcaagtgttcccagatgctaactggaggatggtggtttgatgcttgcgggcctagtaacctcaacggaatgtactacccacagagacaaaacaccaataaattcaatggcattaagtggtactactggaaggggagcggttacagccttaaagctacgaccatgatgatacgacccgctgacttctag

SEQ ID NO: 27295 - DNA, 1335 bp, Artificial Sequence
  Description of Artificial Sequence: Synthetic coding sequence
atgtggcagatcgtgtttttcacgctgtcttgcgacctggtgctggccgcagcctataataacttccggaagtcaatggatagcattggcaaaaaacaatatcaggttcagcacggaagttgctcctacaccttcttgctcccagaaatggataactgcagaagctctagctctccgtatgtctccaacgccgttcagcgagacgcacccctcgagtatgacgatagcgtccagaggctgcaagtgctggaaaatataatggaaaacaacacacagtggcttatgaaagtgcttaatcaaacgacgcgactcgaattgcagttactggagcatagtctctcgaccaacaaactggagaaacagatccttgatcagacgagcgaaattaataagctccaggacaaaaactctttccttgagaagaaggtgttagctatggaggataagcacatcatccagcttcagagcattaaggaggaaaaggaccagttgcaggtgcttgtgtcaaagcaaaattctatcattgaagaactcgagaagaagattgtgaccgccacagtgaacaactcagtcctgcagaaacagcagcatgacttaatggagactgtgaacaacttactaactatgatgagcacgagcaacagcgctaaggacccgacagtagccaaagaggaacagatctctttcagggactgtgctgaggtcttcaaaagtggccataccaccaacggaatatacacgctgacatttcctaacagcaccgaggagatcaaggcatattgcgacatggaggccggtggcggagggtggacaatcattcagagacgcgaggatggatcagtcgattttcagcggacctggaaggagtacaaagtcgggttcggcaacccgagtggtgagtattggttaggtaacgaattcgtgtcccagctgaccaaccagcagcgttacgttctgaagattcatttaaaagactgggaaggcaacgaggcctattctctttacgaacacttttaccttagcagtgaggagctcaactatcgcattcatctgaagggactaacaggcactgctggtaagattagttccatttcccagcccggtaacgacttttctaccaaagacggcgacaacgataagtgtatttgtaagtgttcccagatgttgacgggcggatggtggttcgacgcttgtggacctagcaatctgaatgggatgtactatcctcaacgccagaataccaacaaatttaacgggattaagtggtactattggaagggatctgggtacagtttgaaagcaaccaccatgatgatacgtccagccgacttctag

SEQ ID NO: 27296 - DNA, 1221 bp, Artificial Sequence
  Description of Artificial Sequence: Synthetic coding sequence
atgagcggtgcgcctactgccggagcggcactaatgctatgtgctgccacagccgtcctgctcagtgctcagggtggtcccgtgcagtccaaaagtccgaggtttgcatcctgggacgagatgaacgtgttggcccatggactgctgcaactgggtcaggggctcagagagcacgcggagcgtacccggtctcagttgtcagcccttgaacgcaggctctccgcgtgtgggtctgcatgtcaggggaccgaaggatccacagatttgccgctggcaccggagtcccgagtggatcctgaggtcctccactctcttcagactcagctcaaggcacagaattcccggatccagcagctcttccacaaggtcgcccaacagcagcgtcatctcgaaaaacagcacctcagaatccaacaccttcagtcgcagtttggcctgctggatcataaacatctggatcatgaggtcgctaagccggcacgcaggaaaaggttgccagaaatggctcagccggtggatccagcccataacgtcagccgactgcatcggctgccacgggattgtcaggagctgtttcaggtgggtgaacgccagtccggcctgttcgaaatccagccacagggatcaccacccttccttgtgaactgcaagatgactagcgatggcggatggacggtcattcagagaaggcatgatggcagcgtcgatttcaaccgaccctgggaggcatataaagctggatttggcgatccgcatggggaattctggttggggttagagaaagtccatagtatcactggggacaggaactcaaggctggcggtccaactcagagattgggacggaaatgccgagctgctgcagtttagtgtccatctgggtggcgaggatactgcctattctctgcagctcacggcaccagtggcaggacagctcggagccacaaccgtgccacctagtggattgagcgtccctttctctacatgggatcaggatcatgatctcaggcgagacaagaattgcgccaagtctctgagcggcggatggtggttcggcacgtgttctcatagcaacctgaacgggcagtatttcagaagtatccctcaacagcgtcagaaactgaagaagggaatcttctggaagacctggcgcggaagatactatccactgcaggcaactacaatgcttatccagcctatggctgcggaggcagcaagctag

SEQ ID NO: 27297 - DNA, 1107 bp, Artificial Sequence
  Description of Artificial Sequence: Synthetic coding sequence
atgtctggcgctcctaccgccggagcggctttaatgctgtgcgcagccacagcagtcctgctgtccgcccaggggggtcccgtccagagcaagtctccgagattcgcctcatgggacgagatgaacgttctcgcccatggtctcctgcaattgggacaggggcttcgggagcatgcagaacggacccgatctcagctgtccgccctggaacggagactgagcgcctgtgggtcagcctgtcaagggactgagggatcgactgatctgcctctggccccagagagccgagtggaccccgaggtgctgcacagtcttcagacccagctcaaggcccagaattcacgcattcagcagctctttcataaggtggcccagcagcaaaggcatctcgagaaacagcacttgcgcatacaacaccttcagtctcagttcggccttctcgatcacaagcaccttgatcacgaggtggctaagcctgcgcgtcgcaaacgactgcctgaaatggcccagccggtggacccagctcacaatgtgtctcgacttcaccatggcggttggacggtgatccagaggagacacgacggctcagtagacttcaaccgtccctgggaagcatacaaggccggtttcggcgatccacacggggaattttggctgggcctggagaaagtacactccatcaccggagaccgcaactcacggttggctgttcaacttagagactgggacgggaatgcagagctcttgcaattctctgtccacctgggaggcgaggacacagcctactccttacagctcactgcgccagtggcaggtcaactgggggcaactaccgttccaccaagcggtctgagcgtgccgtttagtacatgggaccaggatcacgacctgagacgagataagaattgcgccaagagcctgtccggcggttggtggttcggcacctgtagtcacagcaatctgaacggtcaatattttagatcaataccccagcagaggcaaaaactcaagaagggaatattttggaaaacttggcgcggtagatactacccacttcaagccaccacaatgcttatccagcccatggcggctgaggcagcttcttag

SEQ ID NO: 27298 - DNA, 720 bp, Artificial Sequence
  Description of Artificial Sequence: Synthetic coding sequence
atggctcagccagtggacccagcccacaacgtctctaggctgcacaggttaccacgtgactgtcaggagctctttcaggtgggtgagcgccagtccggtcttttcgaaattcaaccacaggggagccctcccttcctcgttaattgtaaaatgacatcagatggcggatggaccgtgatccagcgaaggcacgacggatcagtcgattttaatcgtccctgggaagcctacaaggccggtttcggcgatccgcatggtgagttttggctggggctggagaaggtccacagcattacaggagatagaaactcccgtctcgctgtgcagttacgggactgggatggcaacgcggagttattgcagttttctgtgcacctcggtggcgaggataccgcatattccttgcagctgaccgcaccagtcgctggccagctaggagcaacgacggtccctccttcgggcctcagtgtgcctttctcgacctgggatcaggaccacgatctccggcgtgataaaaattgcgccaaatccctttctggagggtggtggtttgggacatgctcacattcaaacttgaacggccagtatttccggagtattccccagcagagacagaagctaaagaagggtattttttggaaaacttggcgaggccgatactaccctctccaggctaccacaatgctaattcaacccatggcagccgaagccgcaagctag

SEQ ID NO: 27299 - DNA, 837 bp, Artificial Sequence
  Description of Artificial Sequence: Synthetic coding sequence
atggagcccagagctgccgacggttgtttcctcggggatgtggggttctgggttgagaggactccagtgcacgaagccgcacagagaggcgaatctctccagctgcagcagctgatagagagtggggcttgcgtgaatcaggtcaccgttgattccatcacccctctgcatgctgcctccctgcagggccaggcacgctgcgtgcagctcctgctggctgcgggagcccaggtcgacgccaggaatatcgacggtagtactccactgtgcgacgcctgtgcgtctgggagtattgagtgtgtgaagctcctcctgtcgtatggtgctaaagtcaatcccccattgtacaccgcctcacccctccacgaggcgtgcatgagtggatcttccgaatgcgtgcggctattgatcgatgttggagctaatctcgaagctcacgactgccacttcgggactcccctccatgtcgcttgcgccagagagcacctggattgtgttaaggtgcttctgaacgctggcgcaaacgtgaacgcagcaaagcttcacgagaccgctctgcaccatgcggctaaggtgaagaacgtcgatctgatcgagatgctgatcgaattcgggggtaacatctacgcgcgagacaatcggggaaagaagccctctgattacacttggagtagcagtgcgcctgctaaatgttttgaatactacgagaaaacaccgctgacactctcgcagctttgcagggtaaatctgcgtaaggctaccggtgtgaggggtctggaaaagattgcgaagctgaacatcccaccaaggctgatagattatctgtcgtacaactag

SEQ ID NO: 27300 - DNA, 396 bp, Artificial Sequence
  Description of Artificial Sequence: Synthetic coding sequence
atggaaaaaatacccgtgtccgcgtttctcctgttagtggccctctcctacacgttggccagggatacgacggttaagcccggagcaaagaaggacactaaggacagtcggccaaagttgcctcagactctaagcaggggttggggcgatcagctgatctggactcaaacatacgaagaagccctctataaaagcaaaacctcgaataaacccttaatgataatccatcacctggacgagtgcccccactcccaggccctgaaaaaagtgttcgccgaaaacaaggagatacagaagctggctgagcaattcgtactattaaatctggtctacgaaactaccgataagcacttgtcgcctgatggccagtacgtcccgagaattatgttcgtctag

SEQ ID NO: 27301 - DNA, 528 bp, Artificial Sequence
  Description of Artificial Sequence: Synthetic coding sequence
atggagaagattccagtcagtgccttcctgctcctggtggcactgtcgtacactctcgcacgcgacaccacagtgaaacctggcgcaaaaaaagacacgaaggactctcgacccaaactgccccagactctgtcccggggatggggggatcagctgatctggacacagacatacgaggaggcgctttacaagagcaaaacttccaacaagcctctcatgattatccaccacctggatgagtgcccacacagccaggcactcaagaaggtgttcgctgagaacaaggagattcagaaactcgccgagcaatttgtgctgctaaatctcgtgtacgaaactaccgataagcacctttcacccgatggacagtacgttcctcgtattatgttcgtcgaccctagcttaaccgtgcgcgctgacatcacagggagatactccaaccggctgtacgcatacgaacctgccgacactgctctgctgctggacaatatgaagaaggctctcaaactcctcaagactgaactgtag

SEQ ID NO: 27302 - DNA, 588 bp, Artificial Sequence
  Description of Artificial Sequence: Synthetic coding sequence
atgagtaattacacagatgccgagtcaagcttttcaaaacaagagattatcagagtggcaatggagaagattccagtctcagcttttctgctcctggtagcgctgtcctacaccttggccagagataccaccgtcaagcccggagccaaaaaggacaccaaggattctaggcctaagttgcctcagacactgtcccggggatggggcgaccagctgatatggacacagacatatgaagaggccttgtataagtcaaagacttcgaacaaacccctgatgatcattcatcatttggacgaatgcccacactcccaggccctgaaaaaggttttcgctgaaaataaggaaatccaaaagctggccgaacagtttgtcctgctgaacctggtctacgaaacaaccgacaaacacctctctcccgacggacagtatgtgccacgaattatgttcgttgacccctcgctgaccgtgcgtgcagatatcaccggacgatatagtaatcgcctttatgcgtacgagcccgcagatacagctctgcttctcgataacatgaaaaaagcgctgaagctccttaaaactgagctgtag

SEQ ID NO: 27303 - DNA, 1251 bp, Artificial Sequence
  Description of Artificial Sequence: Synthetic coding sequence
atgtggcccacacgtaggctggtaaccattaagcgctcaggcgttgacggacctcacttccccctttccctatccacttgcctctttggcaggtatgagaacgaatccctccagaacggtcgcaagtccacagagttccctcgaaagatcagggaacaagagccggctcggagagtctcaagaagtagcttctcgtctgaccccgacgagtccgaggggattcctctcaaaagaagacgggtgagctttgggggtcacctgcgccctgaacttttcgatgagaatctgcctcctaataccccactaaaaaggggcgaagcccctactaaaagaaaaagtttggtgatgcatacaccccctgtgctgaagaaaatcataaaggaacagccccagccgagtggtaaacaggagagcgggagcgagattcacgttgaggtcaaggcgcagagtcttgtgatttcgcctccggctccgtccccccgtaaaactcccgtggcctcagatcaaaggagacggtcctgtaaaaccgcacccgcttcgtcatcgaaatctcagaccgaggtacctaagcggggaggcagaaagtccgggaatcttccctccaaacgggtttcaatctctcgcagccagcacgatatcctgcagatgatctgcagtaagcggcgaagtggcgcttctgaggccaatctaatcgtggcaaagtcctgggccgatgtcgtgaagctaggcgctaaacagacacaaacaaaggtgattaagcatggtccacagaggtctatgaataaacggcagagaagacccgcaacgccaaagaagcctgtgggcgaagttcactcccagttcagcactggccacgcaaacagtccttgcaccatcattatcggtaaagcgcacaccgagaaggtgcatgtaccagcacgaccttacagggtgctgaataacttcatctccaaccagaaaatggacttcaaagaggacttgagtggtattgccgaaatgttcaaaactcccgtcaaagagcagccccagctcaccagtacgtgtcatatagccatcagcaattccgaaaatctactcgggaagcagtttcaaggaactgattccggcgaagagcccttgctgccgacctcggagagcttcggcggaaacgtgttctttagcgcacagaatgcagctaagcagcccagtgataagtgttccgcctcccctcccctgcgccgtcaatgtatccgtgagaacgggaacgtctag

SEQ ID NO: 27304 - DNA, 8690 bp, Artificial Sequence
  Description of Artificial Sequence: Synthetic coding sequence
atgtggccgacaaggcgcttagtgacaatcaagcggtccggcgtggacggtccacacttccctctatctctgtccacatgtctcttcgggaggggtattgaatgcgatatacggatccaactccctgtcgtgtccaaacagcactgcaaaattgagatccacgaacaggaagctatcctgcacaacttctcgtcaactaaccccacccaggtgaatggaagcgtgatcgatgagccagtgagacttaagcatggagacgtgatcactatcatcgataggtcattccgctacgaaaacgaatccttgcaaaatggaaggaagtccaccgagtttccacggaagatacgggagcaagagcccgctaggcgggtctcaagaagcagcttttccagtgacccagatgaaagtgaaggaatccccctgaaaaggagacgagtttcattcggtgggcatctccggcctgaattatttgacgagaacctgcctcctaacacaccgcttaagcggggagaggcacctactaaacgcaaatcactggtgatgcatactccgcctgtgctcaagaagatcattaaagagcagccccagccaagcgggaaacaggagtcagggtctgagatacacgttgaagttaaggctcaatctttggtcattagcccacctgcgccaagtccgagaaagacccccgtggcttccgaccagcgtagacgttcctgcaagaccgcccctgcttcatcctctaagagccagacagaagtgccaaaaagagggggtaggaagtcaggaaatttaccaagtaaacgggtgtctatctctcgctcccagcacgatatactccagatgatatgtagcaaacggaggtccggagcttccgaggctaatttgatagtggctaaaagttgggccgacgtggttaaactcggagccaagcagactcagaccaaagtaattaagcacggaccccagaggtctatgaacaaaagacaaagacggcctgcgacacccaaaaagcctgttggtgaggtccacagtcagttctccacagggcatgcaaatagtccctgcaccatcataattgggaaggcacacacggaaaaggtgcacgtgcctgctcggccatatcgggtactcaataactttattagtaatcagaagatggattttaaagaagacctctctggaatcgctgagatgttcaaaactcccgtgaaagagcagccgcagcttacgagtacttgccatatcgcaatctccaattcagaaaacctactgggcaagcagtttcaaggaaccgacagcggcgaggagcccctgttgcctacctccgagtcgtttggcggaaacgttttctttagcgcccagaatgccgctaagcagccctccgacaagtgctcggcctcaccgcctttgagacgccagtgcataagggaaaatggtaacgtggctaaaacacccaggaacacctacaaaatgacgtcattggaaactaaaacttcagataccgagacggagccgagcaaaactgtttcgactgcaaaccggagcggcagatccaccgaattcaggaatatccagaagctgcccgtcgagagcaagtcagaggagacaaatacggagatagtcgaatgcattctaaagcgtgggcagaaggccactctcctgcaacagcgacgcgagggggagatgaaggaaatcgagcgaccattcgaaacatataaagaaaacattgagctgaaagagaacgatgagaagatgaaggctatgaagcgatcgcggacttggggccagaagtgcgctcccatgtccgatcttacggacttgaaatcactgccagacacagagctgatgaaggatacagccagggggcagaaccttctgcagacccaagatcatgcgaaagctcccaaatccgagaagggtaagatcactaaaatgccctgccaatcgctgcagcctgaaccgatcaatacacctacacacacaaagcagcagctgaaggccagcctagggaaagtaggagtaaaagaagaacttctggccgtaggcaagttcacgcgtacatccggcgagactacacatacacatcgagagcccgcaggcgacgggaagtctattagaacattcaaggaaagccccaaacaaatcctggacccagcagctcgagtgacaggtatgaaaaagtggcctcgcactcccaaagaggaggcccagtccctggaggatttggctggcttcaaggaactctttcagacgcccggaccctccgaggagagcatgaccgacgagaagaccaccaagatcgcgtgcaagagtccacctcccgaatctgttgacactcccacctcaaccaagcaatggccaaaaaggtctctcaggaaggctgacgtggaagaggaattccttgcactgaggaaattaactcctagcgctggcaaagcaatgcttactcccaagcctgcaggcggagacgaaaaggacatcaaagcgttcatgggcacacctgtccagaaactcgatctcgccggaacactccctggctcaaagagacagctccaaaccccaaaggagaaagctcaagccctggaggatctggcgggattcaaagaactgtttcaaaccccagggcataccgaggaactggtagcagctggcaaaacgactaaaatcccatgcgactccccgcagtcagatccagtggataccccaacttctactaagcaaaggcccaagcgaagtatcagaaaagcagacgttgaaggagagctgctcgcatgtcgaaatctgatgccctcagcgggaaaggctatgcacacacccaaaccctccgtgggcgaagagaaagatataatcatctttgtgggaactcccgtgcagaaactggacctaaccgaaaatctaactggcagcaaacgcaggccacagacacctaaagaagaggcccaagctctggaggatctgacgggcttcaaggaactgtttcagaccccaggtcacactgaagaggccgtagccgcaggcaaaaccacaaagatgccatgtgagagttctccccctgagtctgctgatactcccacaagcacacgccgacaaccgaagaccccgctggaaaaacgagacgttcagaaggaattaagcgcacttaagaaactcacgcaaacgtccggcgaaactacccatacagacaaggtgccaggtggagaggataaatcaataaacgctttcagggaaactgctaaacagaagcttgatcctgcggcttccgttaccggatccaagcgccatccaaagactaaggagaaggcccagccactagaggatttagcgggacttaaagagttatttcaaactccagtttgcacagataagcccacaacacatgaaaagacaaccaagatagcatgcaggagtcagcccgaccctgtggatacccccacctccagcaaaccacagtccaaaagatctttgcgcaaggtggacgtggaagaggagttttttgcccttaggaagcgcaccccatctgcgggaaaagcgatgcacactccaaagccagctgtcagtggtgagaaaaacatttatgcctttatgggcacacccgtccagaaactggaccttacagagaacttgacaggctcgaagaggcgcttgcagaccccgaaagagaaggcccaggctctggaagacctcgccggatttaaagagcttttccagaccagagggcataccgaagagagcatgaccaatgacaagacggccaaagttgcgtgcaaatctagccagccagatccagacaaaaatcccgctagctcgaaacggaggttaaagactagcctcgggaaagtcggggtcaaggaggagctgctggccgtgggtaaactaacgcaaacctccggagagacaacacacactcacactgaacctaccggagacggcaagtctatgaaagcattcatggaatctcctaagcagatcctggatagcgccgcttccctgactgggagcaagcggcaactgcggaccccaaagggcaagagcgaggtgcccgaggacctagccggattcatcgagctgtttcagacgccatcccacacaaaggagtctatgaccaacgagaagacaaccaaggtgtcctaccgggcaagtcagcctgacttggttgacacccccaccagttcgaagccccaacccaagcggtccttgcgtaaagccgatactgaggaggagttcctggcattcagaaagcagaccccgtctgccggaaaggccatgcatacccccaagccagccgtcggcgaagagaaggacataaatacgttccttggcacaccagtgcaaaaactggaccagccaggcaacttgcccggatccaataggaggttgcaaacaagaaaagagaaggcacaggctttagaggaactcactggctttagagaactcttccagactccatgcaccgataatcctaccacggacgagaagacaacaaagaagattttgtgcaaaagcccccagtccgaccctgccgacacacctactaacaccaagcagcgtcccaaaagatcactaaaaaaggcagatgtcgaagaagagttcctggcctttcgcaaattaaccccttctgccggtaaagctatgcatacacctaaagctgccgtgggtgaggagaaagacatcaatacgtttgtcggtactcccgtggagaaactagatctgctaggaaatctccctggatccaagcggcgtcctcagactcccaaggagaaggccaaggccctggaggatctggccggattcaaagaactgttccagactcccggacacactgaagaaagtatgactgacgataaaataacagaggtctcatgcaagtctcctcaacccgacccagtgaaaacaccaacctccagtaagcagcgtctcaaaatcagtctcgggaaagtcggcgttaaagaggaagtgcttcctgtcggcaaactgacccaaacttccgggaaaacaacccagacccacagagagactgcgggagacggtaaaagcataaaggccttcaaagaaagtgctaagcagatgttggacccagccaactacggtacaggtatggaacgctggcccaggaccccgaaagaggaagcccagtctcttgaggacttggccggttttaaagagctgttccagaccccagaccatactgaggagtcaacaacagatgacaagaccacgaagatagcctgcaaaagcccccctcccgagagcatggacacgccaacatcaactaggagacgccctaagacccccttggggaagcgtgatattgtggaggagctaagcgcactgaaacaactcacacagaccacacatacagacaaggtgccaggcgacgaagacaaaggcatcaacgtatttagagagacagctaagcagaagttagacccagcagctagcgtgacagggtcaaagaggcagccacgaacacctaagggaaaagcacagccactcgaggaccttgcaggacttaaagaactgttccagactcctatttgtaccgataaacccacgacacatgaaaagacgaccaagatcgcttgtcgctccccccagcccgatcctgttggaactcccacaatcttcaaaccacaatcgaaaagatctctgagaaaagccgacgtcgaagaagaaagtctggccctgcgcaagaggactccgtccgtggggaaggcgatggacacccccaaacctgcgggaggtgacgagaaggacatgaaagcatttatgggtacacccgtccaaaaactggacttgcctgggaatctgcctggctctaaaaggtggccccagactccaaaggagaaggcccaggcactggaggatctcgccggatttaaggagctatttcagacaccaggaactgataaacccaccactgatgagaagactactaagatcgcttgtaagtccccacaacccgaccctgtagatacccccgctagcaccaaacagcgccctaaaagaaatctcaggaaagcagatgtagaagaagagttcctagctctgaggaagagaacaccctccgcaggtaaagccatggatacacccaaacctgccgtgagcgatgagaagaacattaacactttcgtggagacacccgtgcagaaactcgatctacttggcaatctgcccggatctaaacgccaaccccagacacccaaggagaaggccgaagcattagaggatctggtcgggttcaaggaactgttccagactcccggtcacacagaagagtcgatgaccgacgataagattaccgaggtctcttgtaaaagccctcaacctgaatcatttaagacgagtagatcttcaaagcagcgcctcaaaatcccactggtgaaggtggacatgaaagaggagccactcgccgtgagcaagcttacacgaacttctggcgagacgacccagactcataccgaacccaccggggacagtaagagcatcaaggctttcaaggagtcgcccaagcaaatcctcgatcccgcagcctcagtgaccggcagccgcagacagctgcgcaccaggaaggagaaagcaagggccctcgaggatcttgtggatttcaaggagctgttcagcgctccagggcatactgaggaaagcatgactatcgacaaaaacactaaaattccctgtaaaagccctcctcctgagctcacagataccgcgacgagtaccaagaggtgcccgaaaactcgccctagaaaggaggtgaaagaagaactctctgccgtggagaggctcacacagacctcggggcaatccacacatacccataaagagccggctagcggtgacgaggggattaaggtgctcaaacagagagcgaaaaagaagcctaaccctgttgaggaagaaccttctaggcggaggccgagggcacccaaggaaaaagcccagccactcgaggacctggccggattcacagaactaagcgaaacatccggacatacacaggaaagtctgactgcgggtaaggccacaaaaatcccctgtgagagtcctcctctggaggtggttgacaccactgcatccaccaagaggcatctgagaaccagagtgcagaaggtccaggttaaagaagagccatcagctgtgaaattcacccagaccagcggcgagaccacagacgccgacaaggagccagcgggtgaggacaagggtatcaaggcgctgaaagagagtgcaaagcagacacccgctcctgctgctagcgtcactggatcacgaagaaggccgagagcccctcgagagtcagctcaggccatcgaagatttggcagggttcaaagaccctgctgccggtcacacagaagaaagtatgactgacgacaaaactactaaaatcccttgcaaatcttccccagagctggaagacacagctaccagcagtaaacggcgacccagaacaagagcgcagaaggtggaagttaaggaagagctgctggcagttggcaagcttacccagacaagcggagaaaccacccatactgacaaagaaccagtgggggaagggaagggcacaaaggcttttaaacaacctgcaaaacgaaagctggacgcagaagatgtcatcggaagcaggcggcagcccagggctcccaaagagaaggctcagccactggaagatttggcctcctttcaggaactgtcccaaacgcccggacatactgaagaattagccaatggtgcagctgacagctttacgtcagcaccaaagcagacccccgattctgggaaacccttgaaaatatcacggagggtgctacgtgcgcctaaggtggagcctgtcggcgacgtcgtgtccacccgagacccagtcaaaagccagtccaaatcaaacacttccttgccaccgcttccattcaaacggggtgggggaaaggacggaagtgtgaccggaacaaagaggctgaggtgtatgccagcccctgaggagatcgttgaggaactgccggcatccaagaagcagagggtggcccctagagccagaggcaagtcaagcgaaccagtggtgatcatgaaacggagtctgcggacctcggctaagcggattgaaccagcggaagagctgaatagtaacgacatgaagaccaacaaggaagagcataagctgcaggactctgttccagagaacaagggtatatcactgagatcccgacggcaaaataaaacagaggcagagcagcagataacagaggtcttcgtactggcagagaggatcgagatcaatcggaacgagaaaaaaccgatgaagacgagcccagagatggacatccagaatccggacgacggcgctcggaagccaatccctcgggacaaggtgactgagaacaaacgctgtttgcgtagtgcaagacagaacgaaagttctcaaccaaaggttgcagaggagagcgggggacaaaaaagcgctaaagtgttgatgcaaaatcagaagggtaaaggggaggccggtaactcagactccatgtgtctaaggtccaggaagaccaaatcccagccagccgcatcaactcttgagagcaaatcagtacagcgtgtgaccagaagcgtgaagagatgcgctgaaaatccaaagaaggcagaggacaatgtgtgtgttaagaagatcagaactcgcagccaccgcgattccgaagacatcta

SEQ ID NO: 27305 - DNA, 9770 bp, Artificial Sequence
  Description of Artificial Sequence: Synthetic coding sequence
atgtggcctactcggcgactggtgacaattaagagatcaggcgtggacggccctcacttcccactgtcactgtctacctgtctttttggcaggggcattgagtgcgatatcaggattcagcttccagtcgtaagcaaacaacactgcaagatcgaaatccacgaacaggaagccatcctgcacaatttttcatcaaccaacccgacgcaggttaacggctcagttatcgatgagcccgtgaggctaaaacacggggatgtcatcaccataatcgatagaagctttagatacgagaacgagagcctgcagaatggtagaaagagcaccgaatttccccgtaaaatcagggagcaggagcctgcccgacgcgtgtctcggtcttctttcagttctgaccccgatgaaaaagctcaggacagcaaagcctatagcaaaattaccgagggtaaagtatcgggcaatccacaggttcacatcaaaaatgtgaaagaggactcaactgccgacgattctaaagactcagtagcccagggtaccacaaacgtccactcttcagagcatgccggtcgcaatgggagaaatgctgctgatcccatctcaggggacttcaaggaaatatccagcgtgaagctagtctccaggtacggcgaacttaagtcagtgccaacaacccaatgcttggacaatagcaagaagaatgagtctcccttttggaagctgtatgaatctgtcaaaaaggagttggatgtgaagtcccagaaggagaacgtgctgcagtactgccgtaagagtgggctccagaccgattatgccaccgagaaagagtccgcggacggtcttcagggtgaaacacagctcctggtgtccaggaagagcagacccaagtctggaggctctggccacgctgtggcagagcccgctagtcctgaacaagaattagaccagaataagggaaagggtcgtgatgtagaatccgtccaaaccccctcaaaggctgtaggagctagtttcccactctacgagcccgctaagatgaagacaccggttcagtattcccagcagcagaactccccacagaaacataagaacaaagatctctacactaccggaagaagagagagcgtgaacctggggaagtcagaaggattcaaagctggggataagaccctgacccctcgaaagctctcaacccgcaaccgaactcccgcaaaggtggaggacgctgccgactcagccaccaaacctgagaaccttagctcaaagacccggggatcaattccaacggacgtcgaggttctgcctacagaaaccgaaattcacaatgagccgttcctgacactgtggttgacacaggtggagcggaagatacagaaggattcgttatccaaaccagagaagctcgggaccaccgctggccagatgtgttctggtctgccaggcctttcctctgtagacattaacaatttcggtgattctatcaacgagagtgaggggattccgctaaagcgtagacgcgtatcctttgggggacacttacgtccagagctgttcgatgagaacttgcccccaaacacccctctgaaaagaggcgaggctcctaccaagcggaaatcccttgtcatgcacactcccccagttctgaaaaaaatcatcaaagagcagccacagccttccggcaaacaggagtcaggcagcgaaatccacgtggaggtcaaagcccaatcacttgtgatcagccccccagctccatcacctcgaaagacccctgtcgcttccgaccagcggcgtcgatcctgcaaaactgctcctgcatcctcctcgaagtctcaaacagaagtgcccaaaagaggcggaaggaagtctgggaatctgccatccaaacgtgtcagcatatcaaggagccagcacgatatcctgcaaatgatttgttctaaaaggcgttctggcgctagcgaggcaaatctgatcgtagctaagtcttgggccgatgtggtcaaattgggcgcaaagcagactcagactaaagtcattaaacatggtccccagcggtccatgaataaacgccagaggaggccagccacccctaagaagccagtcggagaagtgcacagtcagtttagcacaggccacgccaattccccttgtacgattatcatcggtaaagcccatactgagaaagtccacgtgccagcgaggccgtacagagtcttgaataacttcatctcgaatcaaaaaatggatttcaaggaagacctgtcaggcatcgctgagatgttcaagacacccgtcaaggagcaacctcaactcacctcgacgtgccacatagcaatttccaactccgagaacctcctgggcaaacaatttcagggcactgatagtggcgaggagccactacttccgacctctgaaagctttggcggaaacgtgttcttctctgcccaaaatgccgcaaagcagcccagcgacaaatgctccgcatcacctccactgcggagacaatgcatcagagagaatgggaatgtcgccaagaccccacgtaacacctacaagatgacaagcctagagaccaagacatccgataccgagaccgagccctctaagactgtcagtacggctaaccggtcaggcagatcaacagaattccgaaacattcaaaaactgcccgtcgaatcaaagagtgaggaaaccaatactgagatagtcgaatgcatcttgaagcgaggacagaaagcaacattactgcagcagcggagagaaggggagatgaaagaaatcgaacgcccattcgagacatacaaagagaatatcgagctgaaggaaaatgacgaaaagatgaaagcgatgaaacggtcacgcacgtggggtcagaagtgcgccccaatgtcggaccttaccgatcttaagtctcttcccgatacagagctgatgaaggacactgctagggggcagaacctgctgcagactcaagaccatgccaaagctccaaaatccgagaagggtaaaatcaccaaaatgccctgccagtccctacaaccagagcccattaatactccaacccatactaaacagcaactgaaggcctctcttgggaaagtcggggtaaaagaggagctcctggcagtcggtaaatttacgagaaccagcggtgagaccacacatacgcatcgtgaacccgctggcgacgggaaatccatccggacctttaaggagtcgccaaagcagatattggatcccgcagctagagtgacgggaatgaaaaaatggcccaggacacccaaggaggaagctcaaagcctcgaggacttagcaggttttaaagagttgtttcagactccaggtccaagtgaagaatcaatgaccgacgaaaagaccaccaagatcgcctgcaagagtcccccacccgaatccgtggatactcccaccagcaccaagcagtggcccaagcggagcctacgaaaggccgacgtggaggaagaattcctggccctgcgcaaactcacaccgtctgctgggaaagccatgctgacccctaagccggctgggggagatgaaaaggacattaaggcatttatgggcactccagtacagaaactggatctcgccggaacactaccaggctcgaagcgccagctccagaccccaaaagagaaggcccaggccctggaggatttggccggatttaaagaattgtttcagactcctggtcacactgaagaactagtggccgcaggcaagacgaccaagatcccctgcgatagtccccagtcagaccccgtcgacacgccgacaagcaccaagcagcggccaaagaggagtattaggaaggccgatgttgagggagaactgcttgcctgtcgcaatcttatgccaagtgccggaaaggccatgcacactccaaaacctagcgtgggcgaagagaaggatatcattatattcgtggggaccccagtccaaaaactcgacctaacggagaatctgaccgggtcgaaacgtcgcccacaaactcccaaagaggaggctcaggcgctggaagatctgaccggctttaaggagctgttccaaactcccggacacacagaggaggcggtggccgctgggaagactacaaagatgccctgtgaatcctcgcctccagaatccgctgacactcccacgtccactaggcggcaaccgaaaactccgctggaaaaacgagatgtgcagaaggaactgtctgccctgaagaaactgacccagacaagcggagaaaccacacatactgataaggtgccaggtggagaggataagagtatcaatgcattccgagagacagcaaagcagaaactggaccccgctgcatccgtgactggatcgaagagacatcccaaaacaaaagagaaggcacagcctctggaggatctcgcaggccttaaagagcttttccagacccctgtgtgtacggataagcccaccacacacgagaagaccaccaaaatcgcctgcaggtcccagcctgatccggtagacacccctacaagctccaagccacagagcaagcgctcacttcggaaggtcgatgtcgaagaggaattcttcgccctgaggaagcgcactccatctgcaggtaaagccatgcacactccaaagccagcagtctcaggcgaaaagaacatctacgctttcatgggcacccccgtgcagaagctcgatctcacagaaaacctgaccggctcaaagcggcgacttcagaccccaaaagagaaggctcaagcactcgaggaccttgctggctttaaggaactgttccagacaaggggacataccgaggaatcaatgacaaatgataaaacagcaaaggtggcatgcaaatcgagccaaccggatccggataaaaatccggcttcctcaaaacgtcgcctgaagacctctctggggaaggtgggcgtcaaagaggagctgcttgccgtcggtaagttaacccagacgagtggagagactacacatacccacacggaacccactggagatgggaaatccatgaaggctttcatggaatcaccaaagcagatactggactccgcagccagcttgacagggagcaagaggcaactgcggaccccaaagggcaaatccgaagtgcctgaggatctcgctgggttcattgaactcttccagactccatctcatacaaaggagagcatgactaatgaaaagactaccaaggtctcctatagggcctcccagcccgatctggtcgatactcctacatccagcaagccccaacctaagcgctcactgcggaaggccgacaccgaagaggagttcctggccttcagaaagcagaccccttccgcgggtaaagccatgcacacacccaaacccgctgtgggagaggagaaggacataaacaccttcctgggcacaccagtccagaagttggatcagcccggaaacctgccaggatctaacagacggttgcagacccgaaaagagaaagctcaggcactggaggagcttaccgggttcagggagttatttcagaccccatgcaccgataatcctactacagatgagaaaactaccaagaagatcctttgtaagtcaccccaatcagatccagctgacacgcccacaaataccaagcagagacctaagagaagcctcaaaaaggccgacgtcgaagaggaattcctcgcatttcgtaagctcacccctagcgcagggaaagcaatgcatacacctaaggcagcagtaggggaagagaaagatataaacaccttcgttgggactcccgtggagaaactagacctcctaggcaatttacctggcagcaaacgcagacctcagacccccaaagagaaggccaaagctttggaggatctcgcaggctttaaggaactgttccagacgccagggcacaccgaagaatctatgaccgacgataagattaccgaggtctcttgcaaatctccacagccagaccccgtgaagacaccaacttcctcaaagcagcgcttgaagatctccctgggaaaagtgggagtaaaagaagaagtcctgcctgtaggaaagctcactcagacatcaggcaagactacccaaacccaccgggaaaccgccggagatggcaagagtatcaaggcctttaaggaatcagccaaacagatgttagatccggctaactacggcactggtatggaaagatggcccagaactcccaaggaagaggcacagtctctcgaagacctagcaggctttaaagagctctttcaaactccagatcacactgaggaaagtacaactgacgacaaaacaaccaaaattgcttgcaaatcaccaccacccgaaagcatggatacaccaacgtcaacgcgaagaagaccaaagacacctcttggtaaaagggatatagtggaggagttaagtgcgctgaaacagctgacccagaccactcacaccgacaaggtccccggtgatgaggataaaggaatcaatgtcttcagagagaccgctaaacagaaattagatccggcagcttctgtgactggttcaaagagacagccacggacccctaagggtaaggctcagccattagaggatctggctggcctcaaagagttgtttcagacacccatttgcactgacaagccaacgacccacgaaaaaactaccaaaattgcatgtagaagtccacaaccggacccagttggcacaccaaccatcttcaagccccagagcaagagatcgctgaggaaagctgatgtggaggaggagtcgctggcactgcgaaagagaaccccgtcagttgggaaggccatggatactcctaagcctgcgggaggagacgagaaggacatgaaggcatttatgggaacacctgtacagaaattggatctcccgggaaatttacctggcagcaaaaggtggcctcagacacccaaagagaaggcccaagctctggaagacctcgcaggcttcaaagagctgttccagacgccaggtaccgataagccgacaacagatgaaaaaacaacgaagatcgcttgtaaaagtccgcagccggaccctgtggacacgccggcatctacgaaacagcggcctaagcggaaccttaggaaagccgatgttgaggaagagttcctcgcactgcgaaagcgaactccaagtgcaggaaaagccatggacaccccaaaacctgcagttagtgacgaaaagaacatcaacactttcgtggagacgcccgtgcagaagctcgatcttttgggcaacctcccgggatcaaaacggcagcctcaaacgcccaaggagaaagccgaggcactggaggatttggtcggattcaaagagctctttcagacgccaggacacactgaggagtcaatgacagatgacaaaattacagaagtcagctgtaagagccctcagccagagagctttaaaactagcagatcatccaaacagagattgaaaatccccctggttaaggttgatatgaaggaggaacctctggccgtttcaaagcttacgcggacctccggtgaaacgacccaaacccacacggagccaaccggcgattcgaaatccatcaaagcgtttaaagagtcaccaaaacaaattttggatcctgctgcgtcggttacaggcagcaggcgacagctgcggacacgaaaggagaaggccagagctctcgaggacctggtggactttaaggagctctttagcgcaccgggtcacaccgaggagtccatgaccatcgataaaaacaccaagataccctgtaaatccccaccccctgagctcaccgacacagcaacatctacaaagcgctgccccaagacaagaccacgtaaggaggtaaaagaggagctttcggcagtggagcgcttaacacagacgtcggggcagtcaacacatacacacaaggaacccgcaagcggcgatgaagggatcaaggtgctcaagcagcgagctaagaagaaacctaatcctgttgaggaagagccgtcccgacgaaggcccagggcaccaaaagaaaaggcacagccgcttgaggatctggccggattcaccgagcttagcgaaacttcgggtcacacccaggagtccctcactgccggaaaggctacaaaaattccctgcgagtcccctcccctggaggtggtagacactaccgccagcactaaacggcacctgcgcacccgcgttcaaaaggtgcaggtgaaggaggaaccctccgcagtcaagtttactcagacttcgggcgagaccacagatgctgataaggaaccagccggagaagataaagggattaaggcacttaaagagagtgctaagcagacacccgcaccagccgcttccgtgaccgggtcaagacggagaccaagggcacccagggaatcggctcaggccattgaggacctcgccggtttcaaagatcccgcagctggtcacaccgaggaaagcatgaccgacgacaagacgacgaagattccctgcaaatccagccctgagctggaggataccgcgacgagctctaagcggcgaccaagaactagggcccagaaggtggaagtgaaggaagagctcttggccgtgggcaaactgacgcagacaagtggggagacgacccataccgacaaggaaccagttggcgaggggaaaggaacaaaggcctttaaacagccagcgaaacgaaagctggatgccgaagatgtcatagggtcacgcagacaacccagggctcccaaagagaaggcccagccgctggaagacctggcctccttccaggaactgagccagactccaggacacactgaagagctagctaatggcgcagctgacagttttacatccgctcctaagcagactcccgattcaggcaagccgcttaaaatcagtagaagagtgctgcgggcacctaaggtagagcctgtgggagatgttgtttcgactcgtgatcctgtgaaatctcagtctaagagcaacacgtcattaccgcctcttccgttcaaaagagggggtgggaaggatggttctgtgacgggaaccaaaaggctgagatgtatgcctgctccagaagagatcgtggaggagctccccgcttccaaaaagcaaagagtggcccctcgggctcggggaaagtcctcagagccggtggtaattatgaaaagaagcctgagaacatccgccaaaagaattgaaccagccgaagagctaaattccaacgacatgaaaacaaataaggaggagcacaaactgcaggactctgtgcccgaaaataaaggcatttcactgcggagcaggcggcaaaataaaaccgaggccgagcagcagatcacagaagtcttcgtcttggcagagaggatcgagatcaacaggaatgagaaaaagcccatgaaaacttctcccgagatggatatccaaaaccctgacgacggagctcggaagcccattcctagagataaggtcaccgagaataaacggtgtttaaggtcggcccgtcagaatgaaagctcccagcctaaagttgcggaagagagtgggggtcaaaagagtgccaaggtactcatgcaaaatcagaagggtaaaggggaagctgggaattccgactcgatgtgtttacggtcccggaagactaaatcccaacccgctgcatccacattggaatccaagtcggtacagcgcgtcaccagatccgtgaaacgatgcgccgagaacccaaagaaggcagaggacaacgtgtgcgtgaagaagatccgcactaggagtcaccgagatagtgaagacattta

SEQ ID NO: 27306 - DNA, 9767 bp, Artificial Sequence
  Description of Artificial Sequence: Synthetic coding sequence
atgtggccaacacggaggctcgtcacaattaagagaagcggcgtagatggtcctcactttccgcttagcctctctacttgcttgttcggcaggggcatcgagtgcgatattagaatccagctgccagttgtctctaagcagcactgtaagatcgaaatacacgagcaggaagcgatccttcacaacttttcttccactaaccccacccaagtgaacgggtctgttattgacgagcctgtccgcctcaagcacggtgacgtcatcaccataatcgaccggagcttcaggtacgaaaacgaatctctacagaatgggcgaaagagcacagagttcccgagaaaaatccgagagcaggaacccgctcggcgagtgtcccgatccagcttttcatctgaccccgacgaaaaagcgcaggactctaaagcttacagtaaaataaccgaaggcaaggtgtccgggaaccctcaggttcacattaagaacgtcaaagaagattccacagctgacgactcaaaagattccgtcgcacagggcaccactaatgtccattcctctgaacacgctggcaggaacggaagaaacgcggctgatccaatcagcggggatttcaaggaaatcagctcagtgaagctcgtgagccggtacggcgagttgaagagtgtaccgaccacccagtgccttgacaattcaaagaaaaacgagtctcctttctggaaactttacgaaagtgttaaaaaggagctagacgtcaagagccaaaaggaaaatgtcctccagtactgccgaaaatccggcttgcagacggactacgccaccgaaaaggaaagtgcggacggcttgcaaggagagacccagttgttagtgtcccgaaaaagcaggcccaaaagcggcggatccggccatgcagtggctgaacccgcttctcccgagcaagagctggatcagaataaggggaaaggtcgggacgtcgagtcggtgcaaacaccctctaaggcggtgggcgcaagtttcccactgtacgaacctgccaagatgaaaacgcccgtgcaatatagccagcagcagaatagccctcaaaagcacaagaataaagacttatacacaacgggccgaagagagtctgttaaccttggcaaatccgagggattcaaggctggggataagacgctaactcccaggaaactcagcaccagaaatcggactccagcaaaggtcgaagacgctgcggacagcgctacaaagcccgaaaacctcagtagtaaaactcgcggtagcatacctacagacgtcgaggtcttaccgaccgaaaccgagattcataatgaacccttcctaaccctgtggctgacacaggtagagagaaaaatacagaaggatagcctgagtaagcccgaaaagcttggaaccaccgccggacagatgtgtagcggcctcccgggtctcagcagtgttgacataaacaacttcggagacagcatcaatgagtcggaaggaatacctctgaaaagaaggcgcgtgtcattcgggggacaccttcggcctgagttgttcgatgaaaaccttcctccgaatacacctctgaagcgcggtgaggcgccaacaaagcgcaagtctttggtaatgcacactccccctgtgttgaagaaaattatcaaagaacagccccagccctccggtaaacaggagtcgggatccgagatccacgtcgaggtgaaggctcagtcacttgtcatctcaccaccagcccctagcccgagaaagaccccggttgcttctgaccagcgcagacgaagctgcaaaaccgctcctgccagtagctcaaagtcacagaccgaggtgcctaaacggggtggtgagcgcgtggctacatgcctccaacgcgtgtcaatcagtcgcagccagcatgatattttacagatgatatgttcaaaaagacggagtggggcttctgaagccaacctcatcgtagctaagtcctgggccgacgtggtcaaactcggcgctaagcagacgcagacaaaggtgataaaacatggccctcagcggtcaatgaacaaacgccagagacgcccagccacccctaagaagcctgtgggggaagttcactcccagttcagcaccggacatgccaactctccttgtacgatcatcattggcaaggcgcataccgagaaggttcatgttccagctagaccctaccgagtgctcaataatttcataagcaatcaaaaaatggatttcaaggaggacctgtcagggatcgcagaaatgtttaaaactccagtgaaagagcagcctcaactgacgagcacgtgtcacattgccatcagtaacagcgagaatctcctgggcaaacaatttcaaggtacagattcaggagaggaacctctactgcccacaagcgaatcttttggaggaaatgtgttcttctcagcacagaatgcagcaaagcagcccagtgataagtgttcagcctcaccacctttgagacggcagtgtatcagggaaaatgggaatgtggccaaaaccccgagaaacacgtataaaatgacttcattggagacgaaaactagcgacactgagaccgaaccgagtaagacagttagtactgctaaccgttccggcagatcaacagagtttaggaacattcaaaaactccccgtggagtcaaaatccgaagagacaaacactgaaattgtcgagtgtattttgaagcgcggacaaaaagccaccctcctgcagcaacgtagagaaggagagatgaaggagattgagcgacccttcgagacctacaaggaaaatattgagttgaaagagaacgatgaaaaaatgaaagcaatgaagagaagtcgaacctggggacagaaatgcgccccaatgagcgacctgacagacctgaaatctctgccggacaccgagttgatgaaagacaccgccaggggacagaacctgctccagacccaggaccatgccaaggcacccaaaagtgagaaagggaagattaccaaaatgccatgccaatccctacagccagagcctatcaacacaccgacacatacaaagcaacagctgaaagcctcccttgggaaggtgggtgtgaaagaggagctgctggccgttgggaaattcacgagaaccagcggtgagactacacatactcaccgcgaacccgctggagatggcaaatccatccgaaccttcaaagaatcacccaagcagatccttgatccagcagcaagagtgacaggcatgaaaaaatggcctagaacccccaaggaggaagctcagagcctcgaagatctggcagggtttaaggaactattccagacccccggacctagcgaggagtccatgacagatgaaaagacaacaaaaatcgcttgtaaatctccccctccagagagcgtggatacacctacttccacgaagcagtggcctaaaaggagcctcaggaaggcagatgtggaagaggagttcctggcactccgaaaactgacaccctccgccggaaaagcgatgctgacccctaagcctgctgggggtgacgagaaggacattaaagcctttatggggacccctgtgcagaagctggacctcgccggtacccttcccggaagtaaaaggcagctgcaaacccccaaggagaaggcccaggctttggaggaccttgcgggatttaaagagcttttccagacacccggacacactgaagagctggtcgcggcaggcaagaccacgaaaattccgtgcgacagccctcagtctgaccccgttgatacacccactagtaccaaacaacggccaaaaaggtctatccgcaaagctgatgtggaaggagaactgttggcctgcaggaacctaatgccaagtgctggaaaagcgatgcatacgccgaagcccagtgtgggcgaagaaaaagacataatcatttttgttggtacccccgtccagaagctcgatctgactgagaacttaacagggagcaaacgaagaccgcagactcccaaagaggaagcccaggctctagaggacctaacgggatttaaagagctgttccaaacaccaggtcataccgaggaggctgtcgcagccggtaaaaccaccaaaatgccgtgcgagtcttcccctcccgaaagcgccgataccccgacatccactagaagacagcctaagaccccacttgaaaagagagacgtccagaaagagctgagtgcacttaaaaaactgacgcaaacttcgggggaaactactcataccgataaagtaccaggtggggaggataagtcgattaatgcatttcgggagaccgcaaagcaaaagctggacccagctgcctccgtcaccggaagtaagcggcaccctaagactaaggagaaagcccagccactggaagatctcgccggactgaaggaactctttcagactccagtgtgtaccgataaacccacaacccacgagaagaccacaaagatagcctgccgtagtcagcccgatcctgtggacactcctactagctcaaagccccaatccaagaggtcattgcggaaagtggacgttgaggaggagttttttgctctgcgcaagagaaccccctcagctgggaaggccatgcacactccaaaaccagctgtctccggagaaaaaaatatctatgcttttatgggtacccccgtccaaaaactcgacctaaccgagaatctcacaggtagtaagagacgactccaaaccccaaaagaaaaagctcaggccctggaggatttggcaggttttaaggaactgtttcagacccggggacacacagaagagtcaatgacaaacgacaagactgccaaagtcgcttgtaagtcctctcagcccgatcctgacaagaacccagctagcagcaaacgcaggctcaagactagtttgggcaaggtgggcgtgaaagaagagctcctggccgtaggaaaactgactcagacatctggagagacgacccacactcatacggagcctactggggatggtaagtccatgaaggcatttatggagtctccaaagcaaatactggattccgctgcttccctgacgggctctaaaagacagctgcgcacccccaagggcaagtcagaggtacccgaggatctggctggcttcatcgagttgtttcaaacccccagccacacaaaggagagcatgactaatgagaagaccactaaggtgtcttatcgagcgagccagcccgacctcgttgacaccccaacttcctcaaagccacagcccaaacggtcactcagaaaggctgataccgaagaggagtttctagctttccgaaaacagactcctagcgccggtaaggccatgcatactccgaagcccgcagtcggcgaggaaaaagacatcaacacttttttaggcactccagtacagaaacttgaccagcctggcaacctgccaggtagcaaccgcagacttcaaacaagaaaggagaaagctcaggccctggaagaactgacagggtttagagaactgttccagactccctgcaccgacaacccaacaaccgatgagaagactacgaagaagattctttgcaagtcccctcaaagcgacccggctgatacccccaccaacacgaaacaacgaccaaaacgttcgctgaagaaagctgatgtggaagaagaattcttagcatttagaaagctgactccttctgccggtaaggcaatgcacacacccaaggctgcagtcggtgaggaaaaggatataaatacgtttgttggcacccctgtggagaagttggacctgttaggtaatctgcctggcagcaaacggagaccacagacccccaaggagaaagctaaggcactggaggatctcgcagggtttaaagaactctttcagacccccggacacacggaggaatcaatgacagatgacaaaatcacggaggtgagttgcaaatcgcctcagcctgacccagtgaagacacccacatcaagcaagcagcgccttaaaataagccttggtaaagtgggagtgaaagaagaagtgctccccgtaggcaagctgacccaaacaagcggcaagacgactcagactcacagggagactgctggagatgggaagtcgattaaggccttcaaggaaagtgctaagcaaatgttagatcctgctaattacgggacaggcatggaaaggtggccaagaacccccaaggaggaggcacaaagcctcgaggacctcgccggtttcaaagaactattccagacccccgatcacaccgaagagtccactacagacgacaagacaacaaagatagcttgcaaaagcccaccacctgaaagtatggacacccccactagtaccaggaggcgacccaaaacacctctcgggaagcgagacattgtggaggagctatccgcattgaagcagctgacacagaccacgcacaccgacaaagttcccggtgacgaggacaagggaattaacgtgttccgcgaaacagctaaacaaaaactggaccccgcagcctctgtgaccgggtctaagagacagccacggacccccaagggaaaagctcaaccactggaggatctggctgggctcaaggaattgttccagacccccatctgtacagataaacccactacccacgagaaaaccacaaaaatcgcgtgccgcagtccccagccagacccagtcgggaccccaaccatctttaagcctcaaagcaaacgtagtttgaggaaggccgacgtggaggaagagagcctggctctacggaaacggacgccttcggtggggaaggctatggatactcccaagcctgcaggtggggatgagaaggatatgaaagcctttatgggcacccccgtccagaagctggacttaccaggcaatctgccgggttctaagaggtggccccagacacccaaggagaaggctcaggccttggaggatctggccggatttaaggagttgtttcagactcctggtacagataaaccaaccacggacgagaagactactaagatcgcctgcaaaagtcctcagcctgacccggttgacacacctgcgtctactaagcagcggcctaaacgcaacctgcgcaaagccgacgttgaagaagagtttctggccctacgaaagaggacacctagcgctggaaaggctatggatacccctaagccggcagtgagcgacgaaaagaacatcaacaccttcgtcgaaactccagtgcagaagctggacctcctgggcaatctaccaggttccaaacgccagcctcagacacctaaagaaaaggccgaggcgttggaggacctggtcggctttaaagagttgtttcagactccgggacataccgaagagagtatgaccgacgacaaaataactgaggtctcttgcaagtccccccagcctgaatccttcaaaacctcacgcagttctaagcagcgccttaagatcccactggtgaaggtagacatgaaagaagagccacttgccgtgtctaaacttaccaggacaagcggcgaaacgacacagacacatacggagcctacaggggactccaaaagcatcaaggcctttaaggaatcgcctaagcaaatcctcgacccagccgctagtgtcacaggatcccgcagacaactgcgaacacggaaggagaaggcacgggctctggaagacttagttgacttcaaagagctctttagtgcgccaggccataccgaagagtcgatgaccatcgataaaaatactaagatcccttgtaaatcccctccaccagagctgacggacactgccacttccactaagagatgcccgaaaacgcggcctcggaaggaagtgaaggaagagctgagtgcggtcgaaaggctgacgcagacaagtggccagagcacacatacacacaaagaaccagccagcggcgacgaaggcatcaaagtcttgaaacaaagagctaagaagaagccgaaccccgttgaggaggagccaagcagaagaaggccacgggcacccaaagagaaagcacagcccttagaggatttggcgggattcactgagctgtccgaaacctccgggcacacccaggagtccctgacagcagggaaagcaacaaaaatcccttgtgaatcccctcccctggaggttgttgacactactgcgtcgaccaaacgccatctaaggacccgagtgcagaaggtccaagttaaggaggagccaagtgcagttaagttcacgcaaaccagcggagaaacgactgatgctgacaaagagccagcaggtgaggacaagggcatcaaggccctgaaggaatctgcaaagcaaacgccagcccctgcggcttccgttaccggatctcggaggcgcccaagagctcctcgcgaaagtgcgcaggcaattgaagatttagctggattcaaggacccagccgctgggcatacagaagagtctatgactgatgataagacaaccaaaatcccctgcaagagcagtccagaactggaggacactgccactagttccaagcggcgacctaggaccagggcacaaaaggtggaagtgaaggaggagttgctcgcagtaggaaagctgacgcagacatcgggagaaacgactcacacagataaggaacccgtgggagagggaaaggggaccaaggcttttaaacagccggctaagaggaagctcgacgcagaggatgtcattggctcacgccgtcagccccgtgctccaaaagaaaaggcccagccccttgaagacctcgcctcatttcaagagctgtctcagacgcctgggcatacagaagagttggctaatggcgcagccgattcattcacctcggcacccaagcagacccccgactccggcaagcccctgaaaatttcaagacgagtgttaagagctcccaaggtggagcccgtgggagacgtggtgtcaaccagagaccctgtaaagagtcaatcaaagagcaacactagtctcccacctctgcctttcaaacggggaggtggaaaagacggctcggtcactgggaccaaacggctgcggtgtatgcccgcaccagaggaaatcgtcgaggagcttcccgctagcaaaaaacaacgcgtagcccctagagctagaggcaaatcctctgaacctgtggtcatcatgaaacggagcctccgaacttccgccaaacgaatcgaaccggcagaggagctgaacagcaatgacatgaagactaacaaggaggagcacaagctccaagactctgtgcctgagaataaaggaatctcactcagatcgagacgccagaataagacggaggccgagcagcaaattactgaggtgttcgtcttggccgagcgtatagagattaatagaaatgagaaaaagcccatgaaaaccagtccggaaatggatatacagaacccagacgacggagcccgtaaacctatccctcgcgataaggtcaccgaaaataagagatgcctgcgcagcgccagacagaacgaaagcagtcagcccaaggtggcagaagagtccggtggccaaaaatccgctaaggtattgatgcagaatcagaaagggaaaggagaggctggcaactcagacagtatgtgtctgcgaagcaggaaaacgaaatcgcagccagcagcttccactttagaatctaagagcgtgcagcgggtaactagatctgtgaagaggtgtgccgaaaaccccaagaaggcagaggacaacgtctgtgtgaagaagatccgcaccagatcccatcgggacagtgaggatatcta

SEQ ID NO: 27307 - DNA, 141 bp, Artificial Sequence
  Description of Artificial Sequence: Synthetic coding sequence
atgtggccaacgcggcgtctcgtgactattaaaagatctggtgttgacgggccacatttccctttatccctcagtacatgcctcttcggacggcgaaaatgtgtcctccagtgcaccgaatgttctaagacggcaatctag

SEQ ID NO: 27308 - DNA, 1557 bp, Artificial Sequence
  Description of Artificial Sequence: Synthetic coding sequence
atgctgcgtgtggtctcctggaatatcaatgggatcaggcgcccactgcagggcgtcgccaatcaagagccttcaaactgcgcagcggtcgcagtcggcagaattttagacgagctagacgcagacatagtctgtttgcaagagaccaaggtgacacgcgacgctctgactgagccattggctatagttgagggctacaatagttacttctccttctccaggaaccggtccggctacagcggggtggcgaccttctgtaaggacaacgctacacctgtcgctgctgaagagggcctctccgggctgtttgctacccagaatggagacgtggggtgctacggaaacatggacgagttcacgcaggaagagctgcgcgcacttgattccgagggcagagcactgctgacgcaacataagatccgcacttgggagggcaaagagaagacactgacgctcatcaacgtatactgccctcacgctgacccaggacggccagagcgtttggtgtttaaaatgcgattttaccgcttgctgcagatacgagctgaagcgcttttagcggcagggagccacgttatcatcctcggggacttaaacactgcacacagacctattgatcattgggacgctgtgaacctggagtgtttcgaagaagaccccggaaggaagtggatggattccttactgtctaacctggggtgtcagagtgctagccacgtcggaccttttatcgatagctaccgctgctttcagcccaagcaggaaggcgcattcacttgttggagtgcagtgacgggcgcaaggcacctgaactacggaagccgtctcgactatgtgctcggggacagaactctcgtgatcgatacgttccaggctagttttttgctgcctgaagtgatgggatccgatcactgccccgtgggggctgtgttgtctgtgtccagcgttccagccaaacagtgccccccattgtgcactcgctttctcccagaattcgccggaacacagctcaagatcctccgtttcttggtcccccttgaacagagccctgttctcgaacagtctacgctgcagcataataatcaaacgcgggttcagacatgccagaataaagctcaggtgcgatccacccgcccacagccttctcaggttggcagctctcgaggacagaagaatctgaagtcctattttcagccaagcccttcgtgtccgcaggcgtctcctgatattgagcttccaagtttacctttgatgagcgccctgatgaccccaaaaacaccggaggagaaagccgtggctaaagtcgtgaaagggcaggcaaagacttctgaggccaaggatgaaaaggagcttaggactagtttttggaagtccgtgctcgccggtccactacgaacacccctgtgtggcggacatcgggaaccctgcgttatgagaactgtcaagaaaccgggaccgaacctgggccgaaggttttacatgtgtgcacgcccaaggggaccgcctaccgaccccagcagcagatgcaatttctttctatggtcccgcccatcatag

SEQ ID NO: 27309 - DNA, 1191 bp, Artificial Sequence
  Description of Artificial Sequence: Synthetic coding sequence
atgcctcgggtcaaggctgcacaagcaggccgtcagtcaagtgctaagcggcacttagccgagcagttcgccgtgggtgagattataaccgacatggcaaagaaggaatggaaggtcgggctgccaatcggacaagggggattcgggtgtatatatcttgccgacatgaactcgtcagaatctgtcggaagtgatgccccatgcgtcgtgaaagtggaaccctcggacaatggccctctctttacagagctcaagttctaccagcgggctgccaagccggaacagatacagaaatggatacggacccgtaaactgaagtacctcggagtccctaagtactggggcagcggcttacacgataaaaacggtaaatcctaccgatttatgataatggacaggttcggcagtgacttgcagaagatttacgaggctaatgctaagagatttagtagaaaaacggtactgcagttatctctgaggatcctcgacatactggaatacatacatgaacacgagtacgtccacggtgatataaaggcatccaatctactcctgaactacaagaatcccgaccaagtgtacctcgtggattacgggctcgcgtaccgttactgcccagagggtgtgcacaaagaatacaaggaagaccccaagcgttgccatgacggcaccatcgagttcactagtattgacgctcacaacggagtggctccaagccggaggggcgatttggagatcctcgggtattgtatgatccagtggctaacggggcatctgccatgggaggacaatctgaaagacccaaaatacgttcgtgactctaaaattaggtacagggagaacatcgcctctcttatggataagtgtttcccggagaaaaacaagcctggggaaatcgcgaagtatatggagaccgttaaactcctggattataccgaaaagcccctctacgagaatctgagggacatcctgctgcagggactgaaggctattgggtctaaagacgatggcaaactggacttatcggtggtggagaacggaggactaaaagctaagaccataacgaaaaagcgcaaaaaggaaatagaagagtctaaggagcctggcgttgaagacaccgagtggtctaatacacaaaccgaagaggcgatccaaactcggtcccggacccggaaacgggttcagaagtag

SEQ ID NO: 27310 - DNA, 957 bp, Artificial Sequence
  Description of Artificial Sequence: Synthetic coding sequence
atgccgaagcgcggaaagaaaggtgctgtcgctgaggacggggatgaattgcgaacggaacccgaggccaaaaaatccaaaaccgctgccaaaaagaacgataaagaggccgctggggaggggccagccttgtacgaagatcctccagatcagaagacatccccttccggaaaaccagccaccctgaaaatatgctcctggaatgtggacggtttgcgagcatggataaagaagaaggggctggattgggtgaaagaagaagctcccgatattctgtgcctgcaggaaacaaagtgttcagagaacaaattgccagcagagctccaggagctacctggcctaagccatcaatactggtcagcgccatctgacaaggaaggctactccggcgtcggtctgttgagtagacagtgcccacttaaagtttcctatggcattggtgacgaggaacatgaccaggaggggcgtgtcatagtggcagaatttgactcttttgtcctggtgacggcttacgttcccaacgctggacgcggacttgtacgcctcgaatatcggcaacgttgggacgaggcctttcgaaagtttctgaaaggcttggcatcacggaagccacttgtattatgcggggacctcaacgtcgcacacgaagagatcgatctgcggaatccaaaggggaataaaaaaaatgcgggttttactccccaggaacgtcagggcttcggggagttactccaggctgtccctcttgccgacagtttcaggcacctatatccaaatactccttatgcctacactttttggacctacatgatgaacgccagatccaagaatgtcgggtggcggctcgactatttcttactgtcccacagcctgctcccggcattgtgcgactccaaaatccgcagcaaggcgctcggatctgatcactgccccatcaccttgtacctggccctctag

SEQ ID NO: 27311 - DNA, 792 bp, Artificial Sequence
  Description of Artificial Sequence: Synthetic coding sequence
atgccaaaaaggggtaagaagggtgctgtggcagaagatggggatgagttacgaaccgaacccgaggccaagaagagtaagaccgcggctaagaagaacgacaaggaggccgcaggggagggtccggcactgtatgaagatcccccagatcagaaaacctccccgagcggaaaaccggctactctgaagatttgtagctggaatgtggacgggctccgcgcatggatcaagaagaaagggctggactgggttaaggaagaggcacctgacatactgtgtctccaggagacaaaatgctccgagaataaacttcccgcagaactccaggaactccctggacttagccatcaatactggagtgcgccttctgacaaggaagggtattccggtgttggtctgctgagcagacagtgcccacttaaggtctcttacggtattggcgacgaagagcatgaccaggaaggtcgagtgatcgtggcggaattcgatagcttcgtcctggtcactgcatacgtgcccaatgctggtcgtggacttgtgcgccttgagtaccgacaacgctgggacgaagcattccggaagttcctcaagggtctggccagcagaaaaccactagtgctctgcggggacctgaacgtcgcccacgaggagatcgatctgaggaaccctaaaggaaacaaaaagaacgccggtttcacacctcaggaacgccaaggattcggggagctgctgcaagccgtgccactcgctgattctttccgtcatctgtaccccaatacaccctatgcttag

SEQ ID NO: 27312 - DNA, 957 bp, Artificial Sequence
  Description of Artificial Sequence: Synthetic coding sequence
atgcctaaacggggtaagaagggagcggttgcggaggatggtgacgaactgcgcactgagcccgaggctaaaaaaagtaagaccgcagcaaagaaaaatgacaaggaggctgcgggagaagggcctgcactgtatgaggacccccctgatcagaagacttctccatcaggtaaaccggcaacactgaaaatctgctcctggaacgtggatggactgagagcctggattaaaaagaaggggctggactgggtgaaggaggaagctcccgacattttgtgcttgcaggaaaccaaatgttcagagaataagctcccggctgaactacaagaactgccgggtcttagccaccaatattggagtgctccgagtgacaaggagggctattctggcgttggactattgtcgagacaatgtccactcaaggtgtcctacggaatcggggatgaagaacacgaccaggagggcagagtgatcgttgccgaattcgattcctttgttttagtcacagcatacgtccccaatgccggaagggggctggtacggttagaatacaggcaacgatgggatgaagcttttcgaaagttcctgaagggcctggcatctcgaaaaccgctggtgctgtgcggggacctgaatgtagcccacgaggagatcgacctgcgcaatcccaagggcaacaagaagaatgccggtttcacaccccaggagcggcagggctttggggaactcctccaggcagtgccccttgctgactctttccgtcacctttaccctaataccccctatgcctataccttctggacttatatgatgaacgccagaagcaagaacgtgggctggaggctggattactttctcctgagccacagcttgttgcccgctttgtgtgattcaaaaattagaagtaaggcacttgggtctgaccattgcccaataacactgtacttggccctttag

SEQ ID NO: 27313 - DNA, 525 bp, Artificial Sequence
  Description of Artificial Sequence: Synthetic coding sequence
atgccaaagcgcggtaagaaaggcgcagtagcagaggacggagatgaactccgtaccgagcccgaggccaagaaaagcaagacagcggctaaaaagaacgacaaagaagctgccggagagggacctgccctgtacgaggatcctcccgaccagaaaacctcaccctctggaaagcccgcaactttgaagatctgcagctggaatgtggatggtcttagggcgtggattaagaagaaggggcttgactgggtgaaagaggaggcaccagatatcttatgtcttcaggagaccaagtgctctgagaacaaacttcctgccgaattacaggaactccccggactatctcaccagtactggtctgcgccttctgataaggaaggctattcaggagtgggactactgagcaggcagtgcccacttaaggtttcgtacgggattggggacgaagagcacgatcaagaagggagggttattgtcgctgaatttgatagcttcgttctggtcaccgcctatgtccccaattag

SEQ ID NO: 27314 - DNA, 327 bp, Artificial Sequence
  Description of Artificial Sequence: Synthetic coding sequence
atgcccaagcggggaaaaaagggcgctgtagccgaggatggggacgagctgagaacggagcctgaggctaaaaagagtaagaccgccgcaaagaagaacgataaagaagccgcaggggaaggtcctgcactatatgaagatcctcccgaccagaagacaagtccgtcaggaaagccggctactctaaaaatttgtagctggaacgttgacggactccgagcctggattaaaaaaaaaggcctggattgggttaaagaggaagcccctgacattctgtgtcttcaagagactaagtgtagcgagaacaaactcccggctgagctctag

SEQ ID NO: 27315 - DNA, 441 bp, Artificial Sequence
  Description of Artificial Sequence: Synthetic coding sequence
atgcctaagcggggtaagaagggcgcagtcgcagaagatggcgatgaactgaggaccgagccagaggcgaaaaaaagtaaaacagctgccaagaaaaacgataaagaggcggctggcgaagggcctgccctttatgaagaccctcctgaccagaagacctccccctccgggaaaccagcaaccctgaagatatgcagttggaacgtggacgggctccgcgcttggataaagaaaaaaggcctcgactgggtgaaggaagaagctcccgatattttgtgcctccaggaaaccaaatgtagcgaaaacaaactgcctgctgaactgcaagagctccctgggctgagccatcagtactggtccgctccgtccgataaggagggatactctggcgtgggcttgctgagcaggcagtgcccgctgaaggtaagctatggaatatag

SEQ ID NO: 27316 - DNA, 975 bp, Artificial Sequence
  Description of Artificial Sequence: Synthetic coding sequence
atgttccgatgcggtgggctcgcagctggcgctctgaagcagaagctggtcccgctcgtgcgtacagtttgcgtgcggagccctagacagagaaataggcttcccggtaacctattccagcggtggcatgtgccccttgaacttcagatgacaaggcagatggcaagcagcggggcatccggaggcaagatagataacagcgttctggtgctgattgtcggactgtcaactgtaggggcaggcgcatacgcatataagacaatgaaggaggatgagaaacgctacaatgagcggattagcggactgggtttgacgccagaacagaaacaaaagaaagccgcactgtcggcgtccgaaggagaagaggtaccccaggataaggcgcctagtcatgtcccatttttactcatcggcggtggaaccgcagcgtttgcagcggctcggagtataagagcacgtgatcctggagcaagggtgctcattgtgagcgaggacccagagctgccctacatgaggccacctctctccaaggagctctggttctccgatgaccccaatgtgaccaagacccttaggttcaaacagtggaacgggaaggagcgttcaatctattttcagccgccttccttctatgtgagcgcccaggatctgccgcacatcgagaacggcggagttgctgtcttgactggcaaaaaggttgtccagctcgacgtgcgcgataacatggtaaaactcaacgatggtagtcagatcacctatgagaagtgtctcatcgctactggcggaacccctcgatctctgtctgccatagatcgggctggcgctgaagtgaagagccgcacaacactgtttaggaagattggagacttccgctcattagaaaagatttccagagaggtgaaatccataactatcatcgggggaggatttttgggcagcgaattggcttgcgcgcttggccgaaaagacatttag

SEQ ID NO: 27317 - DNA, 1842 bp, Artificial Sequence
  Description of Artificial Sequence: Synthetic coding sequence
atgttccgttgtggtgggttagccgctggcgctctgaagcaaaaattggtcccgctggtgcgaacagtgtgcgtacggagtcccaggcaaagaaatcgcctgcccggtaatcttttccaaaggtggcacgttccccttgagctgcagatgacacgtcaaatggcaagttccggcgcatctgggggtaaaatcgacaacagcgtactggtcctgatagtgggtctgagtacagttggggcaggcgcatacgcctataagactatgaaggaggatgagaagaggtataatgaacgaatctccggcctcggcctgacccctgagcagaaacagaagaaagctgccttgtcggccagtgagggggaagaagtgccacaggacaaggccccttctcatgtccccttcctgctcatcggcggtggtacagcagcctttgctgccgcacgaagtatcagggctcgggatcctggagccagagtgctcatcgtttcagaagacccggagctgccatatatgagaccccctctcagcaaggagctgtggtttagcgatgatcccaacgttaccaagaccctgcgattcaagcagtggaatggaaaagaaagatctatttactttcagccaccatctttttacgtgtccgcccaagaccttccgcatatcgagaacgggggtgtggccgtcctgacaggaaagaaagtggtccaattggacgtgcgtgacaacatggtaaaacttaacgacggatctcagattacttatgagaagtgtctgattgcaaccggcggaaccccaagaagcctttctgcaatcgaccgagctggtgctgaggtgaagtctagaactactctctttcgcaagatcggcgactttcgatccctggagaaaataagccgcgaagttaaatcaatcacgatcatcgggggaggttttctaggctccgagctagcctgcgccctgggcaggaaggccagggcccttggaacggaagtgattcaactctttcccgagaaagggaacatgggaaaaatacttcctgagtacttgagtaattggacaatggagaaagtaagaagagagggtgtgaaagtgatgcctaacgcgattgtgcagagcgtcggggtgtcctccgggaagctactgattaaattaaaggacggaaggaaggtcgaaaccgaccatatcgttgcagcagtgggcctcgaaccgaatgttgaactggccaagacagggggtcttgaaatcgacagcgacttcggagggtttagagtcaacgcggagctgcaggctagaagtaacatctgggtggctggagacgcagcctgcttttacgatataaaactgggtagaaggcgggtggagcaccacgatcacgccgtggtctctggcagactggctggtgagaacatgaccggagctgctaagccttactggcaccagtcgatgttctggtcagacctgggacctgatgtggggtacgaagccattggccttgtggacagtagcctgcctaccgtaggtgtgtttgctaaggccactgcgcaggataacccgaaatccgcaactgagcaatctggaacgggcatccgctctgaatccgagaccgagtcagaagcaagcgaaataacaatcccgccatccacgccagcagtgcctcaggcgcctgtccaaggagaagattatggcaagggagtcatcttttacttgcgggacaaggtcgtggtgggcatcgtgttgtggaatatcttcaacaggatgcctatcgcccgaaagataatcaaggacggcgagcaacatgaggatctcaacgaggtggccaaattgttcaacatacacgaagactag

SEQ ID NO: 27318 - DNA, 1830 bp, Artificial Sequence
  Description of Artificial Sequence: Synthetic coding sequence
atgtttcggtgtggtggacttgctgcaggagcgttgaagcaaaagctggtacccctcgtgcgcacggtctgtgtgcggtctccccgacaaagaaaccgactgcccgtggtacagagccaccacctgggcagcccttccaggagcttggcctctacgggtgcctctggtaaggacggcagcaatttggtgtacttcctcattgtgggcgctacagtgactggggctggcgtgtactacgcctataagactatgaaggaagatgagaagcggtacaacgaacggatttctggcctggggctcactccggagcagaaacaaaagaaagcagcactttccgccagcgagggcgaagaggtgccgcaagacaaggccccaagtcacgtgcctttccttcttattggtggaggtaccgccgcatttgccgcagccagaagcattagggctagagatcccggtgccagagtcctgattgtgtctgaagatcctgaattaccctatatgaggccacccctcagcaaggaactgtggttctcagacgatcctaacgtaaccaagaccctgcgatttaagcaatggaatgggaaagagcggtcaatctacttccaacctcctagtttctatgtgtccgcacaagatctgccccacattgagaacggaggggtggcagtgctcacaggtaagaaggtcgtccaactggatgttagggacaatatggttaaactcaatgatggctcgcagattacatatgagaagtgcttgatcgccacgggtggaactcccagatcactttctgcgattgatcgggctggcgctgaggtgaaatcccgaacgacactcttcaggaaaattggagactttcgatcactggagaagattagcagagaggttaagtcaatcacgatcatagggggagggtttctgggaagtgagctcgcctgcgcgctcggacgcaaggcccgagctctggggacggaagtgatacagctgtttccggagaaaggcaatatgggtaagatcctcccggaatatctgtcaaactggacaatggaaaaagtccggagggagggtgttaaagtgatgccgaatgccatcgtgcaaagtgtgggggtttctagtggcaaattactgattaagctcaaggacggaaggaaggtggagacagatcacatcgtggctgctgttggcctagagcccaacgtagaactggctaagacaggtggcctcgagattgactctgactttggtgggttcagagttaatgccgagctgcaggctcggagtaatatctgggtcgcaggcgacgctgcctgcttttacgacatcaaacttgggcgtcgcagggtcgaacatcacgatcatgccgtggtgtcaggcagactggccggagaaaacatgaccggtgccgctaagccgtactggcaccagtctatgttctggtctgacttgggacctgacgtcggatacgaggcaatcggattggtcgattcctccctgcctaccgttggggtttttgctaaggccactgcccaggataatcccaagagcgccactgagcagtccgggactggcattcgcagcgagagcgaaacagagagcgaagcatccgaaattacaatccctcctagtacaccggctgttccacaagccccagtgcagggagaggactacgggaagggggtcattttctatttacgagacaaggtggtcgtcggcattgtgctctggaacatctttaataggatgcctatcgctcgtaaaataatcaaggacggagagcaacatgaggaccttaacgaggtcgcaaaactgttcaacatccacgaggattag

SEQ ID NO: 27319 - DNA, 981 bp, Artificial Sequence
  Description of Artificial Sequence: Synthetic coding sequence
atgttccgctgcggcggactcgctgccggtgccctcaagcagaaattggtcccactcgttaggaccgtatgcgtacggagtccacgccagcgaaaccgcttacctgcccgtgcactcgggaccgaggtcatacagttgtttcctgagaagggaaatatgggcaagatcttgcctgaatacttgagtaattggaccatggagaaggtacggagggaaggagttaaggtgatgcccaatgctattgtccagtccgtaggtgtgtcttctggcaagcttctgatcaaactgaaggatggacgtaaagtcgagactgatcacatcgtggctgccgtgggcctagagcctaatgtggaactcgcaaagacagggggtttggaaatagactcagatttcggcggatttcgcgttaatgcagaactccaggcaagaagcaacatttgggttgccggagacgccgcttgtttctacgatataaagctgggtagacggcgtgtggagcaccacgaccacgccgtggtgtccgggaggctggcaggagagaacatgactggagcagctaagccctattggcaccagagcatgttctggtccgaccttggtccagacgtcggttatgaagcaatcggactcgtggacagctccctgccaaccgtgggcgtgtttgcgaaagccacagcacaagataatccaaaaagcgctacggagcagtctgggactggtatccggagtgagtctgagactgagtcagaggcgtcggagatcaccattccaccatctacccctgccgtcccacaggccccagttcagggggaagactacggcaaaggggtgattttctaccttagagacaaagtggtagtgggcattgtgctgtggaatattttcaatcgcatgccaattgccagaaagatcatcaaggatggcgaacagcatgaggatcttaacgaagtggctaaactgttcaacattcacgaggactag

SEQ ID NO: 27320 - DNA, 786 bp, Artificial Sequence
  Description of Artificial Sequence: Synthetic coding sequence
atggagaaagtacgcagagagggggtgaaggtaatgccaaacgctatagtccaatcagtcggcgtgagctccggaaagctgctgataaaattgaaagatggaagaaaggtcgaaactgatcacattgtggctgcagtaggattggagcccaatgtggagctagctaaaactggcggtctggaaattgattccgactttggcggatttagagtaaatgcggaattgcaagccagaagcaacatctgggtggccggtgacgctgcatgtttctacgacatcaagttgggtcgcagaagggttgagcaccacgatcacgctgtagtcagcggtcgcctggctggagaaaacatgacaggagcagctaagccgtactggcaccaatccatgttctggagcgacctgggaccagacgttggctacgaggcgatcggtctggtagactcgtctctgccaacagtcggggtgttcgccaaagcaacagcacaggacaaccctaagagcgccacagagcaaagcggtacaggaatccgttcagaatccgaaaccgaaagcgaggcttccgagataacaattcccccatcaacacccgctgtgccacaggccccagttcagggggaggactacggtaagggagtaattttctacctccgcgacaaggtggtggtgggcatcgtgctttggaacatctttaatcggatgcccatcgcaagaaagatcatcaaggatggcgaacagcacgaagatcttaacgaagtggctaagctgtttaatatccatgaggactag

SEQ ID NO: 27321 - DNA, 825 bp, Artificial Sequence
  Description of Artificial Sequence: Synthetic coding sequence
atggggaaaatcctgcccgagtacctgtcaaattggacgatggagaaggtcaggcgcgagggagtaaaagttatgcccaatgccatagttcaaagcgttggtgtaagctcaggcaaacttcttattaaactcaaggatggcaggaaggtggaaacagatcatatagtggccgctgttggtctggagccgaatgtggagttggccaagacaggtggcttggagatcgatagtgacttcggcggtttcagggtaaacgccgaactccaagctagatcaaacatttgggtagctggcgacgcagcgtgtttttacgacataaagctcggccgaaggcgggtggagcatcacgatcatgccgtggtatccggtcgcctggccggagaaaatatgacaggcgctgccaaaccctattggcaccagagcatgttctggtctgatcttggaccagatgtgggctatgaagctatcggcctggttgactcgtcgctgcccactgtgggggtgttcgcaaaggctaccgcccaggacaaccctaaaagcgcaaccgaacagtccggcacaggaattcgttcagaatctgaaaccgaaagcgaagcctctgagataacgattcctcctagtaccccagcggtgccacaagctcccgtgcagggcgaggactatggtaagggagtcatcttctacctccgcgacaaagttgttgtgggaatcgtgctatggaacatcttcaatcgtatgccaattgctaggaagattattaaggatggagaacagcatgaggacctcaatgaagtggccaaactcttcaacattcacgaggactag

SEQ ID NO: 27322 - DNA, 714 bp, Artificial Sequence
  Description of Artificial Sequence: Synthetic coding sequence
atgaaggaggatgaaaagcgttataatgaaagaatctccggcttaggtctgacacctgagcagaagcaaaagaaggccgcactcagtgccagtgagggtgaggaggttccacaagacaaggcgcctagccacgttccatttcttctgatcggtggcggaactgcggcatttgcggcagctcgtagcatccgggcacgagaccctggtgccagagtgttgatcgtgtcagaagatcctgagctcccgtacatgagacctcctctatccaaggagctgtggttcagtgatgaccccaacgtgacaaaaaccctgagattcaagcagtggaatggaaaggaacgttctatctactttcagcctccctcattttacgtgtccgctcaagatcttcctcacattgagaatggaggtgtagcagtgttgaccgggaagaaagtggtccagctggacgtcagggataatatggtcaaacttaatgacggatcgcagataacctatgagaagtgtttgatagctacggggggtactcccagatccctcagtgccatcgatcgcgctggagccgaagttaagtccagaactaccctattccggaagattggagatttccgttctctcgaaaaaattagtcgggaagttaagtccatcaccatcatcggagggggatttcttggatccgagctggcatgcgcccttggacgcaaggatatttag

SEQ ID NO: 27323 - DNA, 1017 bp, Artificial Sequence
  Description of Artificial Sequence: Synthetic coding sequence
atggatgccaaggcacgcaactgtttgctacaacatagagaagcccttgagaaggatattaaaaccagttatataatggaccacatgatctccgatgggttcctaactatctctgaagaggagaaagtaaggaacgaaccaactcagcagcaaagggccgcaatgctcattaagatgatcctgaaaaaagataatgattcatacgtctctttttataacgccctgctgcacgaggggtataaggacctggctgctctcctgcatgacggaattcccgtagtttccagctctagcggaaaggattctgtgtctggaatcaccagctacgtgcgaactgtgctgtgcgaagggggtgtgccccagcgccctgtggttttcgtgacccgcaagaagctcgtgaacgcgatccagcagaagctgtccaagctcaaaggggagcccggttgggtcacaattcacggcatggccggttgcggaaaatcagtgctggccgctgaggccgttcgggaccacagcctcttggagggatgcttccctgggggtgtgcactgggttagcgtgggtaaacaggataagagtgggctgctgatgaaactgcagaatttgtgcaccagactcgatcaggatgaatctttctcccagagactccccttaaacattgaggaagccaaagacagacttcgaattttgatgcttcggaagcaccctaggagtctcctgatccttgacgacgtgtgggatagctgggtgctgaaggcatttgactcccaatgccagatcttgcttaccacaagagacaagagcgtgacggactccgttatggggcctaagtacgtggtccctgtggaatcatccttgggaaaggagaaaggattagagatactctccctgttcgtaaatatgaagaaagccgacttacctgaacaggcccacagtatcatcaaggagtgtaaagtagtggagcgatgccactggggtattctgacggacctcctgcacaaatggaatcagagctag

SEQ ID NO: 27324 - DNA, 3492 bp, Artificial Sequence
  Description of Artificial Sequence: Synthetic coding sequence
atggacgccaaggcaaggaattgtttgctgcagcatagggaagccctggaaaaagatattaagacaagttacattatggatcacatgatatctgatgggtttttgacaatttcagaggaggagaaggtgcggaatgagccgacacagcagcagcgtgccgctatgctgatcaagatgatcctgaaaaaggacaacgatagctatgtgagcttctacaacgccttgctgcatgaagggtataaagatctggcggctctgctccatgatggcatccccgttgtgtcctctagcagcgggaaggatagtgtttctggaattaccagctacgtgaggacagtgctctgtgagggcggtgtgccgcaacgtcccgttgtttttgtcaccaggaaaaaactggtaaatgccattcagcagaagctaagtaagcttaaaggggaaccagggtgggtgacgattcacggcatggcgggttgcggcaaaagcgtcctcgcagcagaagcagtgagagaccattctttgctcgaaggatgcttcccgggaggagtccactgggtgtccgtaggcaaacaagacaaaagcggcctgctgatgaagcttcaaaatctgtgcacaagactcgatcaagatgaatcatttagccagcgactgccactcaatattgaagaggctaaggaccgcctgagaatcctgatgctgcgcaagcatccccgaagtctgctgattcttgacgacgtctgggatagctgggtactgaaagccttcgattcacagtgccaaatcctacttacaacaagggataaatctgttaccgatagcgttatgggaccgaagtacgtggtgcccgtcgagtcttcactgggtaaagagaaggggttggagatcttatctctgtttgtaaacatgaagaaggccgatttacccgagcaggcacatagtatcattaaggaatgtaaaggctcccccctggtggtctcattgattggtgccctgctccgcgatttccctaaccgttgggagtattatcttaagcagctgcaaaataagcagttcaaaagaatccggaagtcttcatcatatgactatgaggcactcgacgaggcaatgtcaatctcggtggagatgctgagagaggacatcaaggattactataccgacctatcaattctccagaaggatgtaaaagtgcccaccaaggtgctgtgcatcctgtgggacatggaaactgaagaggtggaggacattctacaggagttcgtaaataagtcactgctcttttgtgatcgtaatggaaagagctttagatattacctgcacgacttgcaggtggatttcttgactgagaaaaattgtagccagttacaagacctgcacaaaaaaatcattacacaattccagcgctatcaccagcctcatactctatctcctgatcaggaggactgcatgtactggtacaattttctggcctaccatatggcgtcggctaaaatgcataaagaactatgcgcgctgatgttctctctggactggattaaagcaaaaactgagctcgttggacctgcccacctgattcatgagtttgtcgaatacagacacatcctcgatgagaaagactgtgcagtatccgagaatttccaggaattcctctcactgaacggtcacctccttggtcgccagcccttcccaaatatagtgcaactgggtctttgcgaaccagagacatctgaggtatatcagcaagccaaactacaggctaaacaagaggtcgacaatggaatgctatacctggaatggatcaacaaaaaaaacatcaccaacctttcgagactagtagtgaggccgcacacagatgccgtgtatcacgcctgcttcagcgaggatggtcagcgaatagcctcttgtggcgctgacaaaacactgcaagttttcaaggccgagaccggcgagaagctgctagaaattaaagcacacgaggacgaagtgctttgctgtgccttcagcacggacgaccggttcattgccacttgttctgtggataagaaagtcaaaatctggaactcaatgaccggagagctcgtccacacctacgacgagcacagtgaacaggtgaactgttgccatttcacgaatagctcccaccatcttctgctagcaaccggatcctcagattgtttcctcaagttgtgggacctgaaccagaaagaatgccgaaatacaatgttcggtcacaccaactcagtgaaccattgccgcttttctccagacgataaactcttggcgagttgttctgctgatggaacattgaagctgtgggacgctaccagcgcaaacgagaggaagtcaattaacgtgaagcaatttttcctcaatttagaggacccacaggaggacatggaggttatcgttaagtgctgtagttggagcgccgacggggctcgaatcatggtggcagctaaaaacaagatattcctgtggaacactgattctcgatccaaggtggctgattgccgtggtcatctcagctgggtgcacggggtgatgttctcccccgacgggtcatcctttctgactagctcagatgatcagacaatccggctctgggagacaaaaaaagtgtgtaagaactccgcagtgatgttgaagcaggaagtggacgtggttttccaagaaaacgaagtcatggtgctggccgtcgatcatatcagacggctgcaacttatcaatggacgcacaggacaaattgattatcttacagaggcacaagtatcttgttgctgcctatcgccccacctgcagtacatagcttttggcgatgaaaacggcgcaatagaaattctggaacttgtgaataaccggatctttcagagccggttccagcacaaaaagaccgtgtggcacattcagttcactgccgatgagaagaccctaatctcatcttcagatgacgctgagatccaagtgtggaattggcaactggataaatgcatatttctcagaggacaccaggaaactgttaaggatttccgcctactgaaaaattcccggctgctcagctggagcttcgacggaacggtgaaagtgtggaacatcatcaccggcaacaaagagaaggactttgtgtgccaccagggtacagtgctgtcgtgcgacatcagtcatgacgcaactaagttcagcagtacatccgccgataagactgctaagatttggaacgtaagcaacggcgagctgctgcatctttgcgcaccactctccgaagagggtgccgcaactcacgggggttgggtgacagacctctgtttctccccagacggcaagatgctgatctctgccggaggctatataaagtggtggaacgtggtgaccggcgagagcagccagaccttctatacaaatggcacgaacttgaaaaagatccacgtcagcccggatttcaagacatacgtgacagtggacaacttggggattctatatattttgcagaccctggagtag

SEQ ID NO: 27325 - DNA, 3618 bp, Artificial Sequence
  Description of Artificial Sequence: Synthetic coding sequence
atggacgccaaggccaggaattgccttttgcagcatcgggaggcactagaaaaggatataaagacatcatacatcatggaccacatgatctccgatggcttcctcaccatttcagaggaggagaaagttcggaatgagccaactcaacagcaacgggcagcaatgctgatcaaaatgattctgaagaaagacaacgatagttatgtgagtttttataacgcacttctgcatgagggatataaggacctcgccgctcttctgcatgatggaatcccagttgtatcttcttcatcaggaaaggacagtgttagcggtatcacctcctatgtgcggacagtactatgtgagggaggcgtgccacaaagacctgtggtgtttgtgaccagaaaaaagcttgtgaacgcaatacagcagaagctcagcaaactgaagggcgagcccggttgggtgactatccatgggatggctggctgcggtaagagcgtgctcgctgcagaggcggtcagggaccactctcttttggagggatgctttcccggaggcgtacactgggtgagcgtaggtaagcaggataaatcgggattgctcatgaagctgcagaatttgtgtacacgactggaccaggacgagagcttctcacagagactccccctgaacatcgaagaagctaaagatagactcagaatcctgatgttaaggaagcacccaaggagcctgcttatcctggatgacgtttgggattcctgggtgctgaaggcattcgactcacaatgccagattctccttactacccgcgacaagagtgtgacagactctgtgatgggcccaaagtatgtggtgccagtggaatcgtctttggggaaggagaagggactggaaatcctgtctctctttgtgaatatgaagaaggccgacctcccagagcaggctcacagtataatcaaggaatgcaaggggtcccctttggtcgtgtcacttatcggcgctttactgcgcgacttccccaataggtgggaatactacctcaaacagctgcagaataaacagtttaagcgaataagaaaatcctcatcttatgactacgaggctttggacgaggccatgtccattagtgtagaaatgctccgtgaggatattaaagactattatacagatcttagcattttacaaaaggacgtgaaggtgcctaccaaagtcctgtgtatcctgtgggatatggagactgaagaggtagaggatatcctccaggaatttgtgaataagagcctgttattttgtgatcggaacggcaaaagctttcgctactatctgcacgacctgcaggtggactttctgactgagaaaaattgtagtcaactgcaagacttgcataaaaagattattacccagttccagagataccatcagccccacactctgagcccggatcaagaagattgcatgtattggtataatttccttgcctaccatatggccagcgcgaaaatgcacaaggagctgtgcgcactgatgttctcgctcgattggataaaggccaaaactgagttggtgggccctgcacacctcatccacgagtttgtggagtaccgccacattttagatgagaaagattgtgccgttagtgaaaactttcaggagtttctgagcctcaacgggcaccttctgggcaggcagccatttcccaatatcgttcagctagggctatgcgaaccagagaccagcgaagtttatcagcaggccaagctgcaggctaaacaggaagtggacaatggcatgctgtatctggagtggataaataaaaagaatattacgaatttgtcacggctggtggtcaggcctcatacagatgctgtgtaccacgcatgtttctccgaagatgggcaacgcatagcttcctgcggcgctgataaaacattgcaggtattcaaagctgagaccggcgagaagctgctggagatcaaggcacatgaggatgaggtgctgtgctgcgcattcagtaccgatgaccgattcattgcaacctgcagcgtggacaaaaaagtcaagatttggaatagcatgacgggcgaactcgtgcatacatacgacgagcatagtgagcaagtgaattgttgccacttcactaatagtagtcaccatttgttactcgctacaggcagttcagactgctttttgaagctttgggatctcaaccagaaagaatgcagaaacaccatgtttggacatacaaattccgtgaatcattgcaggttctcccctgacgataaactattggcatcttgcagcgcagacggtaccctgaaactgtgggacgcaacgtccgccaatgaaaggaaatccatcaatgtgaagcaattctttctgaacctggaggacccgcaggaggacatggaggtaatcgtcaagtgttgtagctggtccgcagacggtgctagaattatggtagccgcaaagaacaagatcttcctgtggaataccgacagccggtctaaggttgccgactgccgcggtcatttgagttgggttcacggagttatgttcagcccggacggcagctcattcctcactagctccgatgaccaaacaatacggctgtgggaaactaaaaaagtctgtaaaaactctgcggtgatgctgaagcaggaggtggacgtcgtatttcaggaaaatgaagtgatggtattggccgttgatcacatccggaggcttcagctgatcaacggacggactggtcagatagactacctgactgaagcccaagtatcttgctgctgcctatctccacacttacagtacattgcattcggtgatgaaaacggggctatcgaaattctggaattggtgaacaaccgtatcttccagtcccgctttcagcacaaaaagactgtctggcacatccagttcaccgcagacgaaaagacgctgatctcttcttctgatgacgccgagatccaagtgtggaattggcagctggacaaatgcatttttctccgtggtcaccaggagaccgtcaaggactttcgtctgcttaagaacagccgcctgttgagttggtcttttgacggtaccgtcaaggtttggaatataattacgggcaataaggaaaaggacttcgtgtgtcatcaaggtacagtgctatcatgcgacatttcccacgatgctaccaagttttcttctacatccgctgacaagaccgccaaaatatggtctttcgatctgctgctccccttgcacgaactcaggggccataatggttgcgtccgctgttccgcattcagtgttgacagcactctgctggctaccggtgatgataacggcgaaatacgaatctggaacgtaagcaacggcgaacttctccacctgtgcgcaccactatctgaggaaggggctgcaactcacgggggatgggtcaccgatctgtgcttctctccggatggcaagatgctcatatcggcaggcggatatatcaaatggtggaatgtggtgaccggggaaagctctcagacattctatacgaatggtacaaatctcaaaaagatccacgtctcccccgattttaagacctacgttacagtagacaacctcggcatcctgtatatcctgcagaccctggagtag

SEQ ID NO: 27326 - DNA, 3585 bp, Artificial Sequence
  Description of Artificial Sequence: Synthetic coding sequence
atggacgcaaaagccaggaattgtctactccagcacagagaagctctagaaaaagatattaagacttcctatatcatggaccatatgattagcgatggcttcctgacaatctctgaggaggagaaggtgcggaacgagcctacacaacagcaacgtgctgccatgctcataaagatgatccttaaaaaagataatgattcctacgtttccttttataatgcgctgttgcacgagggttacaaggatttggcagctctccttcatgacgggatccctgttgtctccagtagctcagtcagaacagtcctctgcgaaggcggtgtccctcagagacctgtggtattcgtgacccgaaaaaagctggtgaacgcaatccagcaaaagctctccaagttgaaaggcgagccagggtgggtaacgattcacggaatggccggttgtggtaagagcgtcctggccgcagaggccgtcagagaccactcccttcttgagggctgcttcccgggaggcgttcactgggtgtccgtgggaaagcaagataaatccggtctgctcatgaagctccaaaacctttgcacacgattggatcaggacgagtctttttcccagcggctccctctgaatatcgaggaagccaaagatagacttaggatcctaatgttaagaaagcacccccgatcgttactgatcctggatgacgtctgggactcctgggtgcttaaggctttcgactctcaatgccagattcttctcacaacacgagacaagagtgtcaccgattccgtgatggggccaaaatacgtggtaccggtggaatctagcctcgggaaggagaaagggctggaaattctctcactcttcgtgaacatgaaaaaggcggatctgccagaacaggcccattcgatcattaaggaatgcaaaggaagccctcttgtcgtctccttgatcggtgcccttcttagagactttcccaataggtgggaatattatctgaaacagctgcaaaataagcagtttaagcggatcagaaaaagcagctcttacgactacgaggcactagacgaggctatgtccatttcagtcgagatgcttagagaggatataaaggactattatactgacctgtcaattctgcaaaaggacgtcaaagttcccaccaaggtgctgtgtatcctctgggacatggagactgaagaagtggaggatatcctgcaggaatttgtaaacaagagccttttattttgcgaccggaacggaaagtcttttcggtactacctgcatgatttacaggtagactttctgaccgagaagaattgttctcagctccaggatctacacaaaaaaatcatcactcagttccaaagatatcaccagccccacactctatcccccgatcaggaggactgcatgtactggtacaatttcttggcataccacatggcaagcgctaaaatgcacaaggagttgtgcgcgctaatgttctctctcgattggattaaagccaaaactgaactggtaggcccagcccatttgattcatgagtttgttgagtaccgccatattcttgatgagaaggactgtgccgtatctgagaacttccaggagttcctaagcctaaacgggcatctcctaggtcgccagcctttcccaaacattgttcagctgggtctgtgtgagccagagacatccgaggtttaccagcaggctaagcttcaggcaaagcaggaagtcgacaacggtatgctttacttagaatggattaataaaaagaacattacaaacctttctcggctggttgtgcgtcctcataccgacgctgtgtatcacgcttgttttagtgaggatgggcagcgcattgcctcgtgtggtgctgacaagacattgcaagtgtttaaagctgagacaggggagaagttgctagagatcaaggctcatgaggatgaggtgttgtgttgtgctttttccaccgacgacagattcattgccacctgcagtgtggacaaaaaagttaagatctggaactctatgaccggcgagttggtacacacctacgacgagcacagcgaacaggttaactgttgtcatttcacaaattcctcccaccatttgctgctggccaccggttcatcagattgttttctaaagctttgggacttaaaccagaaggagtgtagaaataccatgttcggtcacacaaactcagtcaaccattgtcgtttctcacctgatgataagctcctggcctcttgcagcgctgatggtacactcaaactgtgggacgccaccagcgcaaatgagcgcaagtccatcaacgtaaaacaattcttcctgaatttggaggatccacaggaagatatggaggtcattgtgaagtgttgcagttggtctgccgatggggcacgcatcatggtcgctgcgaaaaataagatctttctttggaacaccgattcccggagcaaggtggctgattgtcgagggcatctcagctgggttcacggtgtgatgttttcacccgacggctcctcctttctgacatcttctgacgatcagacaatccgcctttgggaaacaaagaaagtttgtaagaatagcgcggtcatgctaaaacaggaagtagacgtagtttttcaggagaacgaggttatggtgctcgcggtcgatcacatccgcagactgcaacttattaacggccgaactggccagatcgactacctgacagaggcccaggtgagttgctgttgtctctcgcctcacttgcagtatattgcatttggcgacgagaatggcgctatcgagattctggaactggtgaacaatagaatcttccagagccgattccagcacaagaaaacagtttggcatattcaatttactgcagatgaaaaaactctcatcagcagtagcgacgacgcagaaatccaggtttggaactggcagctggataaatgcatcttcctacgcggtcaccaggaaactgtcaaggactttagattgttgaagaatagccgtctgctcagctggtcattcgatggcaccgtgaaagtctggaacataataactggcaacaaggaaaaggactttgtgtgtcaccagggcacggtcctgagttgcgacatttcacatgacgcgacaaaattttcaagcacttccgctgataaaactgcaaagatctggtcttttgatctgctgctgcccttgcatgagctgcgtgggcacaacggatgtgtgagatgctctgcattttctgtggattcgacgctgcttgcaacaggcgacgacaacggggagattcgtatatggaatgtttctaacggcgagctgctacatctctgtgctccattatcagaggagggggcagcaacacacgggggatgggttacagatctgtgcttcagccccgacggaaagatgctgatatccgctggcggatacataaagtggtggaatgtggtaactggagaatcgtcacaaaccttctacacaaacggaacaaatcttaaaaagattcacgtgtcacccgatttcaaaacctacgttaccgttgacaacctggggatcctatatattctgcagacactcgagtag

SEQ ID NO: 27327 - DNA, 3618 bp, Artificial Sequence
  Description of Artificial Sequence: Synthetic coding sequence
atggatgccaaggccaggaattgcctgctccagcatcgagaggccctggagaaagatatcaagacctcctacatcatggatcatatgatcagcgacggcttcctgacaatttccgaggaggaaaaagtcaggaatgagcccactcagcagcagcgcgctgccatgctaattaagatgatcctgaagaaagataacgactcttatgtatccttctataatgctctcctccacgagggctacaaagatctggctgctctgctgcatgacggcatccccgtcgtgtcttcctcatcaggtaaagactcagtgtccggtatcacttcttacgtgcggaccgtactttgcgaaggaggggtgcctcaacggccagtcgtgttcgtgacgagaaaaaaactcgtcaacgcgatccaacagaaacttagcaagctgaagggtgagcctggctgggttacaatccacgggatggctggttgcggaaaatcagtgctcgcagctgaggctgtgagagaccattccttgttggaggggtgcttcccaggtggcgttcactgggtcagcgtgggtaaacaggataagtcaggattgcttatgaaactgcagaatctgtgcactaggcttgaccaagacgagtcattcagtcaacgcctgccactgaatattgaggaagcaaaagataggcttaggattctcatgcttagaaagcaccctcgatccctcctgattttggatgacgtttgggatagttgggtgttgaaggcctttgattcgcagtgccaaattctactgactacccgtgacaagagcgttaccgacagcgtcatgggcccaaagtacgtcgtgccagttgagtcctcgctgggtaaagagaaagggctggaaatcctgtcactgttcgtgaatatgaaaaaagccgatctgcccgagcaagctcactcgatcatcaaagagtgtaagggcagccccctcgtcgtcagcctgatcggcgcactgctgcgcgatttccccaataggtgggagtattatctgaagcagttgcagaacaaacagtttaagcggatccgtaagagctcgtcctacgattatgaagccctggacgaagctatgtcgatcagcgttgagatgttgagggaagacataaaagattactataccgatttatccatccttcaaaaagatgtgaaggtccccacaaaagtcttgtgtatcctgtgggatatggagaccgaagaagttgaagatatcctgcaggagtttgttaacaagtctctcttgttctgcgacagaaatggcaagtcatttcggtattaccttcacgatctgcaggtggacttccttacggagaaaaactgcagtcaactgcaggatcttcataagaaaataatcacacagttccaacgatatcaccagccacataccctgagtcccgaccaggaggattgcatgtactggtacaacttcctggcttaccacatggcttccgccaagatgcacaaggagctctgtgcactgatgttcagtcttgactggattaaagcgaaaaccgagctggttggacctgcacatctcatccacgagtttgttgaatatagacacatccttgacgaaaaggattgcgcagtttcagaaaattttcaagaatttctgagtctgaatggccacttgttaggtcggcaaccattcccaaacatagttcagctgggactgtgcgaacccgaaactagtgaggtgtaccaacaggcaaagctgcaggctaaacaggaagtcgacaatggcatgctgtacttagagtggataaacaagaagaatatcactaacctgtccagactggtcgtcagacctcacaccgatgccgtatatcacgcctgcttttccgaagacggtcaacgcattgcctcctgcggggcagataagactcttcaggtcttcaaggccgagacgggcgagaagctcctggagattaaagcccatgaggacgaggtcctctgctgcgccttcagcaccgacgataggtttatcgccacttgtagcgtggataagaaagttaagatctggaatagcatgactggtgaactagtccatacttacgatgagcacagcgaacaagtcaattgttgtcattttaccaactcctcacaccatctgttgcttgccaccgggtcctccgattgctttctcaagctttgggacttaaatcagaaggaatgtcgcaacacaatgttcgggcacacaaactccgtcaatcactgtcggttttcaccagacgacaagctgcttgcctcctgctccgctgacggtaccctgaaactctgggacgcgactagtgccaatgagcggaaatcaattaatgtgaaacagttctttcttaatctggaggatccacaggaagacatggaagtgattgtcaagtgttgttcttggtccgctgacggcgcacgcatcatggttgctgctaagaataagattttcttgtggaacactgactccaggtcaaaagtggccgattgccggggacacctttcatgggtgcacggggtgatgtttagtccagacggctcctcattcctgacttcctcagatgatcagactatcaggctctgggagacaaagaaggtctgtaaaaacagcgctgtcatgctgaaacaggaagtggacgtggtcttccaagaaaacgaggtgatggtgctcgccgtggatcatatccgacgtttgcagctgatcaacgggaggacaggccagatagattacctcaccgaagcccaggtgtcctgttgttgcctcagcccccacctgcagtacatcgccttcggggacgagaatggggcaatcgagatcttagaactggtgaataatcgtatcttccaaagccggtttcagcacaagaaaactgtctggcacatccagtttacagctgacgaaaagacccttatcagtagcagcgatgacgctgagattcaggtgtggaactggcagctggataagtgtatatttcttcggggacatcaggagacagtgaaggactttcgcctccttaaaaatagtaggctcttaagctggagctttgatggcacggtgaaggtgtggaacatcattaccgggaataaggagaaggacttcgtgtgccatcagggcacggtcctgtcttgcgacatctcgcatgacgccaccaaatttagcagcacctccgcagacaaaacagcgaagatatggagctttgacctattactcccattgcatgagttgagaggccacaacggttgtgtgagatgctcagctttctcagtggattcaaccctgttagccaccggcgatgataatggcgagattcggatatggaacgtgagcaatggtgagttactgcacttatgcgcccctctgtctgaagagggggcagccactcatggcggatgggtcacagatctgtgcttttctccagatgggaagatgctgatcagtgccggtggctatatcaagtggtggaatgtggtgacgggagaatcctcacagactttttacacaaatggtactaacctgaaaaagatccacgtgtctcccgactttaaaacatacgtaacagtggataaccttggtatcctgtacatcttacagacactggagtag

SEQ ID NO: 27328 - DNA, 3492 bp, Artificial Sequence
  Description of Artificial Sequence: Synthetic coding sequence
atggacgctaaagcaagaaattgcctgcttcagcacagggaagctctggaaaaggatattaagacttcctacataatggaccacatgatcagtgatggatttctaaccattagcgaagaggagaaggttagaaacgagcccacccaacagcagcgggctgccatgctcatcaaaatgatactcaagaaggataacgacagctatgtttctttctacaatgctttgctccatgaaggctacaaggatctcgcagcgctgctgcatgacgggattccagtggtgtcttcttcctctggaaaggatagcgtgagcggcatcacatcttatgtgaggactgtcctgtgtgaggggggagtgccacagcgtcccgtcgtgttcgtgacacggaagaagctggtaaacgcaattcagcagaagctgagcaaactgaaaggggaacctggatgggtcaccatccacggtatggcagggtgcggtaaatcggtgctggctgccgaagcagtccgcgaccatagtctcctggagggatgctttccagggggagttcattgggtctccgttggcaaacaggataaatccggccttctgatgaagctccaaaacctctgtaccaggctggatcaggacgagagctttagccaacggcttcccctcaatatcgaagaggccaaagacaggctgcggatcttaatgttgagaaaacatcccagatctttattaatcctggacgacgtgtgggactcctgggtgctcaaagcattcgacagccagtgtcaaatactgctcactacgcgcgataagtctgttacggatagcgtaatggggcctaaatatgtagtacccgtggagtccagtctgggtaaggagaagggacttgaaatcctctctctttttgtcaacatgaaaaaagcagacctgcctgagcaggcacattcaatcatcaaggagtgtaaggggagtccactggtggtcagcctcattggcgctctcctcagggacttccccaaccgatgggaatactacctcaagcagttgcaaaataagcaattcaaaaggattcgtaaatcttctagttatgattacgaagccctggatgaggccatgtctatttctgttgaaatgttgcgggaggatattaaggactactatacggacctatccatactgcagaaggacgtgaaggtgcctacaaaggtcctgtgtatcctttgggacatggaaaccgaggaggtcgaagacatcctgcaggaatttgtaaacaagtctttacttttttgtgatcgtaacggaaaaagttttaggtactacttacatgacctgcaagtggactttctcactgaaaaaaactgttcacaactgcaggatctgcacaagaagatcattacacaattccagagataccaccaaccgcataccctttcccctgaccaggaggattgcatgtactggtacaatttcttggcctaccatatggctagcgccaagatgcacaaggaactttgcgccctgatgttttccctagactggatcaaggccaaaaccgagctggtcggtcccgcacacctgatccacgagttcgtcgagtacaggcatattcttgacgagaaagattgcgcagtctccgaaaacttccaggagttcctcagtttaaatggccatctcttaggaaggcagcctttcccaaacatcgtccagctgggactttgtgagccagaaacttcggaggtctaccagcaggccaagttacaggccaaacaagaagtggacaacgggatgctgtatctggagtggataaacaagaagaatatcacaaacctgagccgactcgttgtccgaccacataccgatgccgtataccatgcctgtttctccgaggatggccagagaattgcctcttgcggcgcagataagacgctccaggtgttcaaagctgaaacaggggagaagctactagagatcaaggcccacgaagacgaagttttatgctgtgccttttccacagacgatcgcttcattgcaacctgctcggtggataagaaagtgaaaatctggaattcaatgacaggtgaactggttcatacctatgacgagcacagcgaacaggttaattgctgtcactttacaaattcttcacaccatttgctgctggctactggcagttcagattgctttctaaaattatgggacctgaatcagaaggaatgccgtaacacaatgttcggtcacacaaactccgtgaatcattgcaggttcagtcctgacgacaaacttctagcctcttgctcagccgacggtactttgaaactatgggacgcaacatctgcgaacgaacggaaatccatcaacgtgaagcagttcttcctgaatctggaggacccgcaggaggatatggaggtcatagtaaaatgctgttcctggtcagccgacggcgctagaattatggtggctgcgaaaaacaaaatctttctctggaatacagactcccgctccaaagtggcagactgtaggggacatttgtcctgggtgcacggagttatgttctccccagatggaagcagtttcttgactagcagcgatgaccagactattcggttgtgggagaccaagaaggtgtgcaaaaacagtgccgtgatgctgaagcaagaggtagacgtggtgttccaggagaacgaggtgatggtgctggccgtggatcacatccgcagacttcaattgattaacggtagaaccggacaaatcgattacctgactgaggcacaagtgtcttgctgctgtctctctccacacctacagtacatcgcatttggcgatgaaaatggggctatcgagatcctggagctggtaaataatcgcatattccaatcccgctttcagcataagaaaacggtgtggcatatccagttcactgcagatgagaagaccctgatttcttcatcggacgatgccgagatccaggtctggaattggcagttggataagtgcatttttctgcgagggcaccaggaaaccgtgaaagacttcagactgctcaagaactcacgactgctctcatggagttttgatgggacagtaaaagtgtggaacattatcacaggtaacaaggaaaaagatttcgtttgtcatcagggcaccgtcctaagttgcgacatttcccatgacgcgacaaaattctcatctacatccgccgacaagacagccaagatttggaacgtgtcgaacggtgaactcctgcatttatgcgctcctctcagtgaggagggtgcggctacgcacgggggttgggtcactgatctatgtttttcccccgatggcaagatgctgatcagcgctggtggatacatcaaatggtggaatgtcgtgactggcgaaagttctcagactttttacacgaacggtacaaatctgaaaaaaattcacgtgtcccccgatttcaaaacttatgtcacagtggataatctggggattctgtacattcttcaaactcttgagtag

SEQ ID NO: 27329 - DNA, 3714 bp, Artificial Sequence
  Description of Artificial Sequence: Synthetic coding sequence
atggatgccaaggccagaaattgccttctgcagcatcgggaggccctcgagaaagatatcaaaaccagctacattatggaccacatgatttccgatggcttcttgactatcagcgaggaagagaaggtcagaaacgagccaacacagcaacagcgcgcagccatgcttattaaaatgatcctgaaaaaggataacgattcctacgttagcttttacaacgcgctcctccacgagggatataaagatctggccgcactccttcacgatgggatccccgtagttagttcatccagcgtgcggactgtgctgtgcgaaggtggggtgccccagagaccagtcgttttcgtgacaaggaaaaaactggtgaacgccatccagcagaagttatccaaattgaaaggcgagcccggatgggttacaattcacgggatggccggatgcgggaagtcagtgctggctgcagaggcggtgagggatcatagcctacttgaggggtgtttcccagggggagtgcactgggtgtctgtgggaaagcaggacaaatccggtttgctcatgaagctgcagaatctgtgcaccaggttagaccaagacgaatctttcagccaaaggctccccttgaacatcgaagaggcaaaagacaggctcagaatcctgatgctacgcaagcatcccaggtctctcctgatcctggacgatgtttgggactcctgggtgctgaaggcgtttgatagccagtgccaaatccttctgacgaccagagataaatctgtgaccgacagcgtgatgggacccaagtacgtggtgcccgttgaaagtagcctgggtaaagaaaagggtttggagattctgtccctgtttgtgaatatgaagaaggcagatctacccgagcaggcccacagcattatcaaagagtgtaaggggagtccactagtggtgagtttgatcggagccctgcttagggatttccccaaccgctgggaatattatctcaagcagcttcagaataagcagtttaagagaataagaaagagctctagctatgattatgaggccctcgacgaggctatgtcgatctccgtggagatgctgagagaggacatcaaagactactatacagacctctcaatcctgcagaaagacgtgaaagttcccactaaggtgctttgcattctctgggatatggagaccgaagaagtagaagatatactccaggagttcgtgaataaaagtttactgttctgtgacagaaacggcaaatcctttagatattatttacacgaccttcaggtggattttctaacagaaaaaaattgctcacagctacaagacctccacaagaaaattataacacaatttcagaggtatcatcagccacacaccctctcccccgaccaggaagactgcatgtattggtacaatttcctcgcctatcatatggcttccgccaagatgcataaggagctttgcgccttgatgttctcccttgattggattaaggctaagacagagttggtgggccctgcacatctgattcatgagttcgtggaatacagacacatactggatgaaaaggactgcgctgtgtctgagaacttccaggaattcttgtccctgaacgggcacctcctggggagacagccttttcccaacattgtacagctgggactgtgcgaacccgagacctcagaggtctatcaacaggcaaaacttcaagcaaagcaggaggtggataacggcatgctgtatctggagtggatcaataagaaaaacattaccaacctgtcacgactagtggtgagacctcacacagacgccgtgtaccatgcttgctttagtgaagatggccagcggattgccagttgtggagctgataagacactgcaggtgtttaaggctgagactggcgagaagcttctggagatcaaggcacacgaagatgaggtgctctgttgtgcattcagcacggacgatagatttatcgccacctgcagcgtggataaaaaggtcaaaatctggaattccatgacaggagaactcgtgcatacttatgacgagcactccgaacaggtaaactgctgtcacttcaccaactcctctcaccatctgttgctggcgacaggctcttctgactgctttctgaagctgtgggaccttaaccagaaggagtgcaggaatacaatgtttggccatactaattctgtgaaccactgtaggttctcaccagacgataagctgttggcctcatgctcagctgatggaacccttaagctctgggacgctaccagcgctaatgaacgcaaatccattaacgttaagcaattcttcctgaacctcgaggatccccaggaagatatggaagtgatcgtcaagtgttgctcatggagtgctgacggggctaggattatggtggcagccaagaataagattttcctgttcgacattcatacttctggtctgctgggcgagatccataccgggcatcattctactattcagtattgtgacttctctccccaaaaccacctcgccgttgttgccttgagccagtattgcgttgagctgtggaatactgacagcagatcaaaggtagccgactgtagaggccatctaagttgggtgcacggagtgatgttttctcccgatggctcttcatttctcacctcgtcagatgaccagaccatccggctttgggagaccaaaaaagtgtgcaaaaactctgcagtcatgctgaagcaggaggtcgacgtcgtcttccaggagaatgaggtgatggtgctcgctgtggaccatattagacgcttgcagctgatcaatggtcggacagggcagattgactatttgactgaagctcaggtgtcatgctgctgtctctcacctcatcttcagtacatcgcctttggagacgagaacggtgcaatcgagatattggaactggtcaacaaccgcatcttccagtctcgctttcagcataaaaaaacagtgtggcatattcagtttacggccgacgaaaaaacacttattagctccagcgatgatgccgaaatccaggtctggaactggcagctggataagtgcatcttcctaagaggccaccaggagactgtaaaagactttcggctgttaaagaactcaaggctgctcagctggagtttcgacggcacagtgaaggtttggaacatcataacagggaacaaggagaaagattttgtctgccatcaggggaccgtgctctcctgcgacatctcacatgacgctacaaagtttagctcgacatctgccgacaagacggcaaaaatctggtcatttgacctccttcttcccctgcatgaactccggggacataatggctgtgttaggtgcagtgccttttccgttgattctacccttcttgccactggagacgataatggggagatccgcatatggaatgtctcaaatggcgagctgctgcacctatgcgcacccctctccgaagaaggagctgcgacgcatgggggatgggtcacagacctctgtttcagccccgatggaaaaatgctcatcagcgctggtggctatatcaaatggtggaacgtagtgacaggcgagtcatctcagaccttctacacgaacgggaccaatctcaagaaaattcatgtatcgccagacttcaaaacatacgtcaccgttgataatctcggcatactctacattcttcaaaccctggaatag

SEQ ID NO: 27330 - DNA, 3747 bp, Artificial Sequence
  Description of Artificial Sequence: Synthetic coding sequence
atggacgcaaaagcacgaaattgtctgctgcagcaccgcgaggcgctcgagaaggatatcaagacttcatatattatggaccatatgataagcgacggcttcctgaccatttctgaagaggaaaaagtgaggaatgagccaacacagcagcagcgggctgcaatgctgataaagatgattctgaaaaaggacaacgactcctatgtttctttctacaacgccttgcttcacgaggggtacaaagatttagcggctctcctccacgatggaatacctgtggtcagctctagttctgggaaagacagcgtcagcggaatcacctcatacgttaggactgtactctgtgagggcggagtaccccagagacctgttgttttcgtgacaagaaaaaagctggtgaacgcaatacagcaaaagctctcaaaactgaaaggagagccgggttgggtgaccatccacgggatggcaggatgcgggaagtccgttctggctgctgaagcagtgcgtgatcatagtctgctggaagggtgcttccccggtggcgtccactgggtgagtgtgggcaagcaagataagtcagggttgctgatgaagctccaaaacctgtgtactcggctcgatcaggacgaatcctttagccagcgccttccgctcaacatcgaagaagctaaagacaggttgcggatcctgatgctgcggaagcacccaaggtctctgctgatcctcgacgacgtatgggatagctgggtgctgaaagcttttgactctcagtgccagatcctgctgaccactagggacaagtccgtgaccgactctgtcatgggacccaaatatgtcgtcccggtggagtcatcactgggtaaggagaagggcctcgagattttatcactctttgtcaacatgaaaaaggccgatctcccggaacaagcacattcaatcataaaagagtgcaaaggctcaccgctggttgtgagcttgattggtgctcttctgagagatttcccaaatcgctgggaatactatctgaagcagctgcagaataaacagttcaaacgaatccgcaagtccagtagttacgattacgaggccctggacgaggccatgtccatttcagtggagatgttgagggaggacatcaaggactattacacagatctgtccatcctgcagaaggacgtcaaagtccctactaaagtcctgtgcatcctgtgggatatggagaccgaagaagttgaagacatactgcaggagttcgtaaataagtccctgctcttctgcgaccggaatggaaagagtttccgctactacctacatgacttgcaagttgattttctcaccgaaaagaactgtagccaacttcaggatctgcacaagaagatcatcacacagtttcaaaggtatcaccaacctcacacgttgagcccggaccaggaggattgtatgtattggtataatttcttggcctatcacatggcaagcgccaagatgcacaaggaactgtgtgccctcatgttttcactggattggattaaggctaagactgaattagtgggcccagcacatctcatacatgagtttgtggaatacaggcacattctggacgaaaaagattgcgccgtgagtgaaaactttcaggagtttctaagtttgaacgggcatctacttggtaggcagcctttcccgaatattgtccagctgggcctgtgcgagccagaaactagtgaggtctatcagcaggccaaactccaggccaaacaagaggtggacaacggcatgctctacctggaatggattaataagaaaaatataaccaatctgagtcgcctggtggttagaccacataccgatgccgtgtatcacgcatgtttctccgaggacgggcagagaatcgcaagctgtggggcagataagacactgcaggtgtttaaagcagagactggggaaaaattactggagatcaaggcccacgaagatgaggtcctttgctgcgcgttctcgacggacgaccggtttatcgcaacttgctcagtcgataaaaaagtgaagatttggaactcaatgaccggcgagttggtgcacacatacgatgaacacagcgagcaagtcaattgctgccactttactaacagcagccaccaccttctgttggccactggttcctccgactgtttcctgaagttgtgggacctgaaccaaaaagagtgccgaaacacaatgttcgggcatactaactccgtaaatcattgtcggttctcaccggacgataagctactggcatcctgttccgcggacggcacactcaagctttgggatgccacttctgcaaacgaacggaagtctatcaatgtgaagcagtttttcctcaatttggaagatccacaggaggacatggaagtcatcgtgaagtgttgctcctggagtgccgatggggcacggatcatggtcgccgcaaagaataagattttcctgttcgacatccataccagtggcttgctgggggagatccatacaggccaccatagcaccatccagtactgcgacttttctccgcagaatcatctggctgtggtggcacttagccagtattgtgtggagctctggaacaccgacagccgctctaaggtggctgattgccgaggccatttgagctgggtgcacggggtgatgttctcacccgacggctcgagttttttgacttccagcgatgaccagacaatacgcctctgggaaactaagaaagtgtgcaaaaattcagctgtcatgctaaaacaggaggtggatgttgtgttccaggagaacgaagtgatggtcctggccgtagaccacatcaggcgactgcagttgataaatggtagaaccggtcagatagactacctgacagaggctcaggtaagttgttgttgtctcagtccccacctccagtacattgccttcggggacgaaaacggcgctatcgaaatactagaactggtgaataacaggattttccaatccaggttccagcacaagaaaactgtgtggcatatccaattcactgccgacgagaagactttgatttcatcttcagacgacgccgaaatacaagtctggaactggcagctggataagtgcatttttttgcggggtcaccaggagactgtgaaagacttcaggcttttaaagaactcgagactgctttcatggagctttgacggaaccgtcaaggtatggaatataatcactgggaacaaagagaaggactttgtatgccaccaaggcaccgtattaagctgcgacataagtcacgacgccaccaagttttcgtctacatctgccgacaaaacagcaaagatctggtcctttgatctgctcctgccactgcacgagctgagaggccataatgggtgcgtgagatgtagcgccttctcagtcgactccacactgctggccactggtgatgataatggcgagattcgtatatggaacgtgtcgaatggtgaactgctgcacctttgtgccccactgagcgaggaaggcgcagcgacacacgggggttgggtcacagacctctgtttcagccctgatgggaagatgttaatctcagccggaggatatataaaatggtggaatgttgtgacaggcgaatccagccaaacgttttacactaacggcacgaacctaaagaagattcacgtgagccctgatttcaagacgtacgtcacagttgacaacctgggcatactttacatcctgcagacgctggagtag

SEQ ID NO: 27331 - DNA, 1017 bp, Artificial Sequence
  Description of Artificial Sequence: Synthetic coding sequence
atggatgcaaaagcccgtaactgtctgctccagcaccgggaagctcttgagaaggacattaagacatcctatatcatggatcacatgatttctgatgggtttctgactattagcgaggaagaaaaagtgcggaatgaacctacacaacagcagcgtgcggcaatgctgattaaaatgatcctgaagaaggacaatgattcttatgttagcttctataacgcgctcctgcacgagggatataaggacctggccgctctgctccacgacgggatccctgtagtgtcaagttcctcagggaaagacagtgtgagcggcattaccagctatgtgcgtaccgtactctgtgagggaggtgttccccagaggcctgtggtgttcgtaacccgaaaaaagctggttaacgcaatacaacaaaaactgagtaagctgaaaggggaacccggatgggtgaccattcatggtatggctgggtgcggcaagagcgtgctggcagctgaagctgtgagagaccactctctgctcgagggttgttttccgggtggggtccattgggtgagtgtgggaaaacaggacaaaagtgggctgcttatgaagctacagaacttgtgcacccgactagaccaggacgagtcgttttcccagcggctccctctcaatatcgaggaggccaaggaccgcctgcggatacttatgctgcggaagcacccccgatccctgctgatactggatgacgtgtgggattcctgggttctcaaagccttcgatagccaatgccagatccttctgacgacaagagataaaagtgtgactgacagcgtcatggggccaaagtacgtggttccagtggagtcttccctcggcaaagagaagggcttagagattttatctcttttcgtcaatatgaaaaaggctgacctaccagaacaagctcatagtattataaaagaatgcaaggtcgtggaacgatgtcattgggggatcctgaccgacctgctgcacaagtggaaccagtcgtag

SEQ ID NO: 27332 - DNA, 2025 bp, Artificial Sequence
  Description of Artificial Sequence: Synthetic coding sequence
atgccatcttacaccgttacggtcgctaccgggagccagtggttcgccggtactgatgactatatctacctatccctggtaggaagtgcaggttgttccgagaagcacctgttggataagccgttttataatgatttcgagaggggcgctgtagattcttacgatgtcaccgtggatgaagagcttggcgagatacagctggtacgaatagagaagcgaaaatattggttgaatgatgattggtacctcaaatacatcacactgaaaaccccccatggggactatattgaattcccatgttataggtggataacaggggatgtggaggtggtactgagggatggtcgcgcaaagctggccagagatgatcaaattcatatcctcaagcagcatagaagaaaagagctagaaacaagacagaagcaatatagatggatggagtggaaccctgggttccctctcagtattgatgccaagtgtcataaggacctccctagagacattcagttcgactccgaaaaaggcgtagattttgttttaaactatagcaaagcaatggaaaatctctttatcaataggttcatgcatatgttccaaagctcatggaatgacttcgcggacttcgaaaagatttttgtgaagatctctaatactatatcagaaagagtgatgaatcactggcaagaagatttgatgtttggctaccaatttcttaacgggtgcaatcctgtcctgatccgccgttgtacagagcttccagaaaaattgccagtgacaaccgagatggtagagtgctctcttgaaaggcaattgagtctggaacaggaggtccagcagggtaacatttttatagttgacttcgagctcctggacgggattgacgccaataaaactgatccctgcacactccagttcctggcggcacctatatgcctgctttacaaaaacttagcaaacaaaatcgtccctatcgccattcagctcaatcagattccaggcgatgaaaatccaatctttctacccagcgacgcgaagtacgactggctgctggcaaagatatgggtccgctcctctgattttcacgttcatcagaccattacccacctactccgtactcatctcgtttctgaggtatttggtatcgccatgtatagacagttaccagcagtgcacccaatcttcaaactcctggtggctcacgtacggtttacaatcgcgatcaacactaaggccagggagcagctgatctgcgaatgcggactgttcgacaaagcaaacgctacgggcggaggtgggcacgtccagatggttcaacgagcgatgaaagacctgacctacgcctctctctgttttcccgaggctattaaggctcgcggaatggaaagtaaagaagatatcccctactacttctatcgggacgatgggctgctggtctgggaagcaatacggacctttacagcagaagtcgttgacatctactatgaaggggaccaggtggtagaggaggacccagagctacaagattttgtaaacgatgtgtatgtgtacggcatgcggggaagaaagtctagcggctttccgaaatccgtgaaatccagggagcaactgagtgaatatttgacagtggtgatttttactgcgtcagctcaacacgctgctgtgaattttggtcaatacgattggtgctcatggatccccaacgccccaccaacaatgcgggctccacccccaacggcaaagggggtcgtgactattgagcaaatcgttgatacactcccggacagaggccgaagttgttggcaccttggcgcagtttgggccctgtcgcagttccaggagaatgaactgttccttgggatgtatccagaggagcacttcatcgagaagccggtgaaagaggccatggcccgtttccggaaaaatctggaggctatcgtgtccgtgattgctgagcgaaacaaaaaaaagcagctgccatattactatctttcccctgatcgcatcccaaattccgtggccatttag

SEQ ID NO: 27333 - DNA, 1854 bp, Artificial Sequence
  Description of Artificial Sequence: Synthetic coding sequence
atgccctcctacacagtgaccgtggctacaggttcacagtggtttgctggcacagacgactacatttacctctccttggtgggtagtgccggttgtagcgagaagcacctgctcgataagccattctataacgactttgaacgaggcgcagtcgacagttatgacgtcacagtagatgaagaactgggcgaaatacagttagttcgtattgaaaaacgcaaatactggttgaatgacgattggtacctaaagtacatcactcttaagacccctcatggcgattatattgaattcccttgctaccggtggataacaggagatgtcgaagtggtactgagagacggacgtgccaaactagctcgagacgaccaaatacacatcctgaagcagcatcgtagaaaagaattagagacaaggcagaaacagtatcggtggatggaatggaatcccggatttccactttcaatagacgctaagtgccacaaggacttgccacgggatatccagtttgactccgaaaaaggagtggatttcgttcttaattactcaaaggccatggaaaatctgttcatcaaccggttcatgcacatgttccaaagtagttggaatgattttgcagacttcgagaagatctttgtgaaaattagtaacacaatctccgagcgcgtcatgaaccactggcaggaagacctgatgttcggctaccaattcttgaacggttgcaaccctgtgctgatccggagatgtactgagttgccggagaaactcccagtgacgacagagatggtggagtgctccttggagaggcagctttcactcgagcaggaagtccagcagggcaacatatttattgtggatttcgaactgctcgacgggattgacgccaataagacagacccgtgcaccttacagttcctggccgctccaatctgtctactgtacaagaacctcgctaacaagatagttcccatagccatccaactgaaccagattcctggcgacgagaacccgatctttttaccttcggatgcaaaatacgattggctccttgctaagatctgggtgcggtccagtgattttcacgtacaccagactattacacacctcttgaggacccatttagttagtgaggtgttcggtattgcaatgtaccgacagctcccggctgttcatcccatcttcaagctgcttgtggcccacgtgaggtttacaatagctatcaatactaaagcaagggaacagttaatctgcgaatgtgggttgtttgataaggccaacgccaccggtggagggggacacgtgcagatggtacaaagagccatgaaagacctgacgtacgcaagtctgtgtttcccagaggcaattaaagcaaggggcatggagagcaaagaggacattccttattatttttatcgcgacgacggactgctcgtctgggaggcaatccgaaccttcactgcagaggtcgtggacatttactatgagggcgaccaggtcgttgaagaggatcccgagttgcaggattttgttaatgatgtctatgtctacggtatgagaggaagaaaatcatctggattcccgaaaagtgttaagtctagagagcaactgagtgagtatctgaccgtggtgatcttcaccgcaagcgcacaacacgccgcagtgaacttcgggcaactctttctgggtatgtatcctgaagaacattttatcgaaaaacctgtaaaggaagcgatggcccgatttagaaagaacctcgaggcaatcgtatctgtgatcgcagaacggaacaagaagaagcagttgccttattactatctttcgccggaccggataccaaacagcgtggccatctag

SEQ ID NO: 27334 - DNA, 2511 bp, Artificial Sequence
  Description of Artificial Sequence: Synthetic coding sequence
atgcacgcccagcgccagtttgttgtggccgctgtgcgggctgaagtccggcgacatgaggtagccaaacaggcacttaataggctcagaaagttagccgagcgtgtggacgacccggagctgcaggactcaatacaggccagtctagacagtattcgggaggccgtcataaattctcaggaatggaccctcagcagatcaatccccgagctaaggttaggcgtgcttggggacgcacgctcagggaagtcttccctgatacacaggtttctgaccggttcctaccaggtgttggaaaaaacagagtccgagcagtataagaaggaaatgctggttgatggccagacccacctcgtcctgatccgggaggaagcaggtgcccctgatgcaaagttcagcggttgggccgatgctgttatcttcgtcttttctctcgaggatgagaactcctttcaggctgtgtcaagactgcacggtcagctgtccagcctgcgtggggaggggagggggggtttggccctggcactggttggaacacaagaccggatcagcgcttccagtcctcgggtagtgggagatgccagggcaagggccttgtgtgcagacatgaaaaggtgctcctactacgaaacgtgcgccacctatgggctcaatgtagaccgcgtgtttcaggaagtcgcacaaaaagtggtgactcttcggaagcagcagcaactcctggccgcttgtaagtctctaccgagcagtcctagccattcagccgcatccacccctgttgccggacaggcaagtaatgggggacacacctctgattactcctcatctcttcccagtagtcccaatgtggggcaccgagagctccgtgcagaggcggctgccgttgcgggtctaagcactccgggaagcctgcatagggcagccaagagaaggacatcgttgttcgccaacaggcgtggctccgatagcgaaaagcggtctctagattcaaggggtgaaaccacaggcagtggacgggcaattccaattaaacaatcatttcttctgaaaagatccgggaactcactgaacaaggagtggaagaaaaaatacgtcacgctgtcaagtaatggcttcctcctttaccatccaagtattaatgattatatacattcgacccacgggaaagaaatggacctactgcggactacagtgaaagtgccaggcaagcgcccacccagagccattagtgcttttggtccctcagcgagcattaacgggttggtgaaagacatgagcaccgtacagatgggtgaaggcttggaggcaaccacccccatgccctctccatctccatctcctagctcactccagccaccgccagaccagacatcaaagcacctgctcaagccagatcgtaatctcgcacgagctctttctactgattgcacgccttcaggagacctctcccccctgtcacgcgaaccacctcccagccccatggtgaagaaacagcgcaggaaaaagctgacaaccccaagcaaaacagaggggagcgccggacaggccgaggaagaaaattttgagtttctcattgtgagtagtactgggcagacatggcattttgaagccgctagtttcgaagaacgcgatgcttgggtgcaggctattgaaagccagatccttgcctccctgcagtgttgcgaatcatctaaagtgaagcttaggacagattcacagtccgaggccgtggccatacaggccattcggaatgcgaagggtaatagcatttgtgtcgactgtggtgcacctaaccccacctgggctagcctcaacctgggggcactgatctgcatagagtgttctgggatccatagaaatttggggactcatctgtcaagggtgcggtctctggacttggatgattggccacgggaactgactctggtcctcacagctatagggaacgataccgccaaccgtgtctgggaaagcgatacacggggacgggctaaaccatcccgagattcaagcagagaggagagggagtcttggatccgagcgaagtacgaacagctgcttttcctggctccattgtccacctccgaggaaccactgggtaggcagctgtgggccgcagtccaggcacaggacgtggctactgtcctgctgttattggcccacgcaaggcacggaccattagatacgtcagtggaggacccccagttaagaagtcctcttcacctggctgctgaactcgcacatgtggttatcacgcaactgctgctgtggtacggggcagatgtggccgctcgggatgcacaaggaagaacagcgctgttctatgctcgccaggccggatctcagctctgtgcggatatcctccttcagcacgggtgtcccggtgaggggggttccgcagccactaccccctccgccgcaacgaccccatcaattactgcaacaccttcaccccgacgacgttcttccgcggcaagtgtgggtcgcgctgacgcaccagtggccctggtatag

SEQ ID NO: 27335 - DNA, 3579 bp, Artificial Sequence
  Description of Artificial Sequence: Synthetic coding sequence
atgtcccgcggtgccggtgccctccagaggcgtactactacttacctcatatctttgaccctcgtaaaattggagtcagttccacctcccccaccctctccgtccgccgcagcagcaggtgccgcaggcgctcgcggttctgagaccggggacccgggatctcctcgaggcgctgaggaaccaggtaagaagaggcatgaacggctgttccaccgccaagatgccctctggatatcaaccagctccgctggcacaggtggcgctgagcctccagctctctctcccgcacctgcctctccagctcggcctgtgagtcccgcacctggtaggcgcctgagcttatgggcagtgccaccaggacctccactgagcggaggcctgagccctgatcccaagcccggaggggctcctaccagctccagacgccctctgttaagtagcccaagctggggcggtccagagccagagggccgtgcgggaggcggtatcccagggagcagcagtccccacccaggcacaggaagccgtcgacttaaggtggccccaccgcctcccgctccaaagccatgcaagaccgttactacttcaggcgctaaagctggcggaggtaaaggcgcaggcagtagactgtcttggccggagtctgaaggcaaacctcgggtcaaagggtccaagtcctccgctggaaccggggcatccgtgtccgcagccgcaacagccgctgcggcaggcggtggcggaagcaccgcttcaacttccgggggtgtgggggctggtgcaggcgcaagaggcaagctcagtccccgaaaaggaaaaagcaaaacccttgataactcggacctccatcctggccctcccgcaggcagcccccctcctcttacccttccaccaactccaagccccgctactgccgttactgctgcctctgcccagcctccgggtcccgctcctccaatcaccttggaacccccagccccagggttgaagaggggacgggaaggcggtcgagctagtacacgcgatcgcaaaatgcttaagtttataagtgggatttttactaaatctaccggtgggccacccggaagtggacccttgcccggacccccttcactatcgagcgggtctggctcgagggagcttctgggcgctgagctgagagcgagccctaaggccgtaattaacagccaggaatggactctgagtcgttccatcccggaactccgactaggcgtgctcggagatgcccgatccggaaagagctcattaatccatcgcttcctgaccggttcataccaagtgctggaaaagaccgaatcagaacagtacaaaaaagagatgctcgtggatggccagacccacctggttctgatacgtgaggaggcaggcgctcccgatgccaagttcagtggatgggcagatgccgtgatctttgttttctcactggaagatgagaactcattccaggcagttagtcggctgcatggccaactatccagccttcgtggtgaaggtcgcggtgggctcgctttagccttggtgggtacccaggatcggatctcagcaagctcacctcgggttgtgggagacgctagggcacgagctctttgcgctgacatgaagaggtgctcttactacgaaacctgtgcgacttacggtctgaatgtggacagagtttttcaggaggtggcccagaaggtcgtgacgctgagaaagcaacagcagctattagccgcttgcaaaagtctaccgagttcaccttcacattccgccgctagtactcctgttgccggacaggcaagcaatgggggacatacgagtgactacagcagctccctccccagctcccccaatgtggggcacagggagctccgtgcagaggccgcagcagtggccggtttgtccacacctggaagtctgcatcgtgctgccaagagaaggactagtctttttgccaacaggaggggttccgactctgagaagaggtcactggattctcggggtgaaactactggctctggcagagcaatccccataaagcaatcttttctgctgaagaggtccggcaattctttgaataaagaatggaagaaaaagtatgtgacactgtcgtccaatggtttcttgctataccatccttctatcaatgactatatccatagcactcacggcaaggagatggatctactgcgcacaacagttaaggtcccaggaaagagaccacctagggcaatcagcgcttttggaccgtccgcgtcaatcaacgggttagtgaaagatatgtcaactgttcagatgggagaaggtctggaagctacaacccccatgccttcaccctccccctctccctctagcttacagcctccacccgatcagacatcaaagcacctgctaaaaccggatagaaatctcgccagagcgctgagcacggattgcactcccagcggcgatctgagtcctctttctcgcgaaccaccaccttccccaatggtgaagaaacaaagacgcaaaaaactaacaaccccctccaagaccgaaggttcggccggacaggctgaggcaaagcggaaaatgtggaagttaaaatcattcgggagtttgcggaacatctacaaggctgaggaaaactttgagtttctgattgtgtcatccacagggcagacatggcatttcgaggccgctagtttcgaggaacgggacgcttgggtacaggccatagagtctcaaattctcgcatccttacagtgctgtgaaagtagtaaagtgaaacttcgaactgacagccagagtgaggcggtcgctatccaggcaatccggaacgccaaggggaacagtatttgcgttgactgcggtgctcctaaccctacatgggcatccctgaacttgggggcactcatttgtattgagtgttccggcattcaccgaaacctgggtacccacttatcccgagtgagaagcctggatcttgatgattggcctagagagctcactctggtgctgacggctataggcaacgacacggcaaaccgtgtgtgggagagtgacacgcggggacgggctaaaccatcgcgcgactctagccgtgaggaacgcgagtcatggataagggcaaagtacgagcaactcctgttcttggctccactgagtacctccgaggagcccctggggcgtcagctgtgggctgctgttcaagcccaggatgtcgcaacagttcttctgctcctggctcatgctcggcatggtcccttggatacttcagtcgaggacccacaattgcggagcccactacacctggctgcggaattggcgcacgtggtcatcacccaactccttttgtggtatggagctgatgttgcggctagggatgcccaaggacgaaccgccctgttttacgccaggcaggctggctcccagctgtgtgccgacatcctgctgcagcacggatgtccaggtgagggtgggtctgccgcaaccacaccgagtgcagccaccacccccagtataacagcgactcccagccctcggaggcggagctctgccgctagcgtgggacgtgctgacgcccctgtggctctggtctag

SEQ ID NO: 27336 - DNA, 1185 bp, Artificial Sequence
  Description of Artificial Sequence: Synthetic coding sequence
atggatagtcagggacgcaaagttgtggtgtgtgataacggaaccggctttgtgaagtgtggatacgcaggatccaattttcccgagcacatcttccctgcactcgtagggagacccatcatccgatcaacaaccaaggttggaaacattgaaataaaagacctgatggtgggagatgaagcctccgagctgcggagcatgctggaggtgaactacccaatggagaatggcatcgtgagaaactgggatgatatgaagcacctgtgggactacacctttggccctgaaaagttgaacatcgatacaagaaattgcaagattctgctgacagagccccctatgaaccccacaaaaaacagggagaagatcgttgaggtgatgtttgagacatatcaattctctggcgtctatgtggccattcaggcagtgctgacactctatgcccagggactgctgacgggcgtggtagtggactccggcgacggcgtgacacacatctgtcccgtgtacgaaggcttttctctgcctcacttaactcgtagactcgacatcgcgggacgcgacatcacaagatacctgatcaaactgctgctgctccgaggatacgcctttaaccatagcgcagatttcgagacagtacgcatgatcaaggaaaagctgtgctacgtgggctacaacatcgagcaggagcagaaactcgcactcgagacaactgtgctggtcgaatcctacaccctgcctgacggcaggattatcaaagtaggaggtgagcggtttgaggctcccgaggcgctgttccagccacacctgatcaacgtggaaggcgtgggggtcgccgagttactgttcaacacaatccaggcagctgatatcgacacaagatctgagttctacaaacatattgtgctctccggaggaagcacgatgtacccaggactcccaagtaggcttgagagagaacttaaacagctttacctcgagcgagtcctgaagggcgacgttgaaaagctctccaaatttaaaattaggattgaagatcccccacggcgaaagcacatggtttttttaggcggagcagtgctggcagatatcatgaaggataaggataatttttggatgacaagacaggagtatcaggaaaagggagtgcgcgtgcttgaaaagctgggcgtgacggtgaggtag

SEQ ID NO: 27337 - DNA, 1200 bp, Artificial Sequence
  Description of Artificial Sequence: Synthetic coding sequence
atggactcccagggcagaaaggtggtcgtgtgtgataatggaaccggatttgttaagtgtggctacgccggttccaatttcccagagcatatctttcccgcactagtggggaggcctatcatccgatcgaccaccaaagtggggaatatcgaaatcaagaacaataagaagatggatctaatggtgggcgatgaagcaagtgaattgcggagtatgctagaggttaattatccaatggagaatggaattgtccgaaactgggacgatatgaaacacctgtgggattacacgttcggcccagaaaagctcaatattgacactcggaactgcaagattcttctgacagagcctccaatgaacccaacgaagaaccgggagaaaatcgttgaggtaatgttcgaaacctatcaatttagcggagtgtacgtagcaattcaggccgtcctgactctgtacgctcagggactgctcaccggtgtggtcgtggatagtggggacggggtaacccacatttgtccagtgtatgagggcttttccctgccccaccttacaagacggctcgatatagcagggagggatatcacgcgctacctgataaaacttctgttgctcagaggatacgctttcaaccacagcgcagatttcgaaaccgtacgcatgataaaggaaaaactctgctatgtgggctataatatagaacaagaacagaagttagctctggagacgaccgtccttgtggagagctacactctcccagacggtagaataattaaggtcgggggagaacgttttgaagccccagaggccctgttccagccacatcttattaatgttgaaggggtcggggtggctgagctcctgttcaacaccattcaagccgctgacatcgataccagatccgagttctacaaacatattgtcttgagtggcggatctaccatgtatccgggactacctagtcggctagaaagggagctgaagcagctttatctggagcgggtactgaaaggggacgtggagaagctgagtaaatttaaaatcaggattgaggatcccccacgcagaaagcatatggtctttctgggaggtgctgtgctggcggacattatgaaggacaaagataacttctggatgaccaggcaggagtatcaggagaaaggggtgagagtgctagaaaagctgggcgtcacagtgagatag

SEQ ID NO: 27338 - DNA, 1020 bp, Artificial Sequence
  Description of Artificial Sequence: Synthetic coding sequence
atggtgggagacgaggctagcgagcttcgctcgatgcttgaagtcaactacccgatggagaatggcattgtgagaaactgggatgatatgaaacacctgtgggactataccttcggccctgagaagttgaatatcgacactcggaattgcaagattttactcacagagcctccaatgaacccaaccaaaaatcgcgagaaaatcgtggaagtgatgttcgagacttaccagttctccggggtgtacgttgctatccaggctgtgttaaccctgtatgctcaggggctactgaccggggtcgtggtcgactctggcgatggggtcacacacatatgccctgtttatgaagggttctctctgccccacttgacccggaggttggacattgcaggccgagatatcaccaggtatctaattaagctacttctcctgaggggatatgcttttaatcattccgcagattttgagactgtgaggatgattaaagagaaactttgttatgtcggctacaacattgagcaagaacagaaactggctttggaaactactgtcctggtagagagctataccctgccagacgggcgtattattaaagttgggggagaacgattcgaagcacctgaggcactgtttcagccccatctaattaatgtcgagggtgtcggagttgccgagcttctgttcaatactatacaggccgcagatattgatacccggagcgaattctataagcacatagtcttgtcaggaggctccacgatgtaccccggactgcccagtaggctggaaagagagcttaagcagctgtatctggaaagagtgctcaagggtgacgttgagaagctctccaagtttaaaatcagaattgaggatccaccccgacgcaagcacatggtattcctgggaggggcagttctagctgatattatgaaagataaggacaacttctggatgaccagacaagagtaccaagagaagggggtccgggtgctggaaaagcttggggtaactgtgcggtag

SEQ ID NO: 27339 - DNA, 918 bp, Artificial Sequence
  Description of Artificial Sequence: Synthetic coding sequence
atggtcggcgatgaggctagtgagcttaggagcatgctcgaagtgaactacccaatggaaaatggcattgtgaggaattgggacgatatgaaacacctgtgggattatacattcggtccagaaaaactcaacattgataccagaaattgtaaaatcctgcttactgagcccccaatgaatcctactaaaaatagagaaaaaatcgtggaagtgatgttcgaaacttaccagttcagcggtgtgtatgtggccatccaggccgtgctcactctgtatgcacaaggactattgacaggcgttgtcgtcgattcaggggatggggtgacacatatctgtcctgtgtatgaaggttttagcctacctcatctgacgaggaggctggacatagccggaagggatatcacacgttacttaataaaactgcttttactgcgaggatacgcattcaatcattcagctgacttcgaaactgtgagaatgatcaaagagaaactttgctacgttggatataacattgagcaggagcaaaagctggcacttgagactacggtgctcgtggagtcctacaccctgcctgacggcaggatcatcaaggtgggcggtgagcggtttgaagctcctgaggctttgttccaacctcatcttatcaacgtggagggcgtcggggtagctgagttactttttaacaccattcaggccgcagatatcgacaccagaagtgagttctataaacacattgtcttgtcaggtgggtccactatgtacccgggtctgccctcgaggctggagcgcgagctgaagcagctatatcttgaaagagtgttgaaaggtgatgtggaaaagctatcagtttcaatcagtaagtcaacaatcaccaatatcctcttaaagggctacacagtggtgtgcgagtcatag

SEQ ID NO: 27340 - DNA, 1257 bp, Artificial Sequence
  Description of Artificial Sequence: Synthetic coding sequence
atggcagggcgattgcccgcatgtgtggtagattgcggaaccgggtacacaaaactgggatatgctggaaatacagagccccaattcatcatcccatcatgcatagccattaaggagagcgctaaggtgggagaccaagcccagagaagagtgatgaagggcgtggatgacttggacttctttattggggatgaagcaatcgagaagcctacctacgcaaccaagtggccaataagacacggcatagtggaagactgggacctcatggagcgatttatggagcaagtcattttcaaatatctcagagccgaacctgaagaccattactttctgcttaccgagccgccactgaacacccccgagaaccgcgagtatactgctgaaatcatgtttgagagcttcaatgtgccaggactgtacatcgccgtgcaagccgtacttgccctggctgcatcttggacctctagacaggtgggagagagaactttaaccggtactgttatagactcaggggatggggttacccacgttatacccgtcgctgaaggatatgtgattggcagctgcattaagcacatccccatagctggaagagatataacctacttcatccaacagttgctgagggatcgcgaagtgggcatcccaccagaacaatctctggaaacggcgaaggccgttaaagagagatactcttatgtctgccccgacctggtcaaagaatttaacaaatacgataccgacgggagcaagtggattaagcaatacaccggaatcaacgccatatcaaagaaggagtttagcatagatgtggggtacgagcggttcctgggccctgaaattttcttccatccagaattcgcaaatcccgattttacgcagccaattagtgaggtagttgacgaggtgatccaaaactgccccatagacgttagacggcctctctacaagaatattgtcctgagcggcggatctactatgtttagggatttcgggcgacggttgcagagagatttgaaacgcaccgttgatgcgaggctgaaactcagtgaggaattatcaggaggcagactgaagccaaaaccgattgatgtgcaggtcatcacccaccatatgcagcgttacgcggtttggtttggcggaagtatgctggccagtacacccgagttttatcaggtgtgccatacgaagaaggattatgaggagatcggtcctagcatttgtcgacataatcctgtgttcggagtaatgtcctag

SEQ ID NO: 27341 - DNA, 1104 bp, Artificial Sequence
  Description of Artificial Sequence: Synthetic coding sequence
atgaagggtgtcgacgaccttgatttctttatcggagacgaggccatcgagaagccgacgtacgcaaccaagtggccaattcgccacgggatcgtggaggattgggatctgatggaacgttttatggagcaagtgatttttaaatatctgcgggcagaaccagaggatcactattttctcctcaccgaacccccactgaacactcctgagaacagagaatatacggctgagatcatgttcgagagcttcaatgtccctggactctacatcgctgtccaggcagtgctggcactggcagccagttggacctcaagacaggttggagaacggacattgactgggacagttatcgactcaggagacggcgtgacacacgtcatacctgttgctgagggatatgtcatcgggagttgtattaagcatattccaattgccggaagagatataacctacttcatacagcagctcctacgggaccgggaagttggcatccctcccgaacagagcctcgagacagctaaggccgttaaagagcgctattcctatgtctgcccagatctagtgaaagaattcaataagtatgataccgatgggtccaaatggatcaaacagtacacagggatcaacgccatctctaagaaggagtttagtatcgatgttgggtatgagaggtttttaggaccagagattttcttccatcctgagttcgcaaacccagatttcactcagccaatctcggaggtcgtcgatgaagtcatacagaattgccctatagatgtgcgtcggcctctgtacaagaatattgtcttaagtggcggatctactatgttccgagattttggacgcaggttacagcgcgacttgaagcgtactgttgatgcccgtctcaaactcagcgaagagctgagtggcggacgtctgaagcccaaacccattgatgtgcaggttatcacacaccatatgcaacgttacgcagtgtggtttggtggatccatgctcgccagtaccccagagttctaccaggtgtgccacactaagaaggactatgaagagattgggccatcaatctgccgccacaatcccgtctttggtgtcatgtcctag

SEQ ID NO: 27342 - DNA, 1071 bp, Artificial Sequence
  Description of Artificial Sequence: Synthetic coding sequence
atgctggaaatccagaatcatagcttaagtagcctgccgtggcccattcgccacgggatcgtggaggactgggatctcatggagcggtttatggagcaagtcatttttaagtatcttcgggcagagcctgaagaccactacttcctgttgacggagcccccactgaacactcccgagaatagggagtatacggccgaaatcatgttcgaatcattcaatgtgcccggtctatatattgccgtccaagcggtattggcactcgctgcttcatggacaagtcgtcaggtcggtgagagaaccctcactggtaccgtaattgactccggcgacggagtgactcatgtgatcccggtggccgaaggatacgtgatcggctcttgtataaaacatatcccgattgcaggaagagatattacgtattttattcagcagctcctgcgcgatagggaggtgggtattccacctgagcaatccctcgagactgccaaagctgtgaaagagaggtatagttatgtttgtcctgacctggttaaggaatttaacaagtacgataccgatggatctaagtggatcaagcagtacacaggcatcaatgctattagcaaaaaggagttctccatcgacgtaggttatgaacgctttcttggtcctgagattttttttcatcccgagtttgccaaccctgatttcacccaaccaatctccgaggtagtggatgaagtgatacaaaactgccctattgacgtcaggaggcccttatataaaaatatcgttctctctggcggttccactatgttccgcgattttggccgacgactccagagggatttaaaaagaaccgtggacgccaggctcaaactttcagaagagctgtctggaggccgactgaagcccaagcccatcgacgtacaggtgattacccatcacatgcagagatacgcggtatggttcggcggatcaatgcttgcatcaacccctgagttttaccaggtgtgtcatacgaagaaggactatgaagaaatcggtccgagtatttgcagacacaacccggtgtttggagtcatgtcttag

SEQ ID NO: 27343 - DNA, 870 bp, Artificial Sequence
  Description of Artificial Sequence: Synthetic coding sequence
atgtttgagtccttcaatgtgcctgggctgtacatcgctgttcaagctgtgctagcattagccgcatcgtggacatcccgccaggtgggggaaaggacactcacggggactgtgatcgacagcggcgatggcgtcacacacgtaattcccgtggcagaagggtacgtgattggctcctgcataaagcacattcctattgctggaagagacatcacctattttatccagcaactgctaagagaccgggaggtcggcattcctccagaacaaagcctggaaaccgccaaggcagtgaaggagcgctattcctacgtttgcccagacctggtgaaggaattcaacaagtacgataccgacgggagcaaatggatcaagcagtacactggcatcaatgccatctccaagaaagagtttagcatcgacgtcggatatgagaggttcctggggcctgagattttcttccaccctgagttcgccaatcctgatttcacacagccaatcagtgaggtcgttgacgaggtaatccagaactgcccaatagatgttagaagacctttgtataagaatatcgtgttgtccggtggctccaccatgttccgcgacttcgggaggagattacagagggacctcaagaggactgtcgatgcacggctgaaactttcagaggagctatcagggggaaggttgaaacccaagccaattgacgtgcaggtaataacacaccacatgcagcggtacgcagtctggttcggaggcagtatgcttgcctcaactcctgagttctatcaggtctgccacactaagaaggactatgaggagattggcccatccatctgccgccataatccagtatttggggtgatgagctag

SEQ ID NO: 27344 - DNA, 1749 bp, Artificial Sequence
  Description of Artificial Sequence: Synthetic coding sequence
atcgatatagaatcaatggatacagataaagacgatccccacggcaggctcgagtataccgagcaccagggacgcatcaaaaacgccagagaagcgcattctcagattgagaagcggaggcgggataagatgaactccttcattgatgaactcgcatctctggttccgacatgcaacgcaatgtctcgcaagcttgacaaactgaccgttttacgtatggcagtccagcatatgaagaccctgcgcggagctaccaatccgtacaccgaggctaactacaaaccaacatttctttccgatgatgagctcaagcacttgatattgcgcgctgcggatggcttcctgtttgtagttgggtgtgatcggggtaagattctctttgtgtccgagtccgtcttcaagatcttaaactacagccagaacgatctgattggacagtccctgtttgactaccttcaccctaaggatatcgccaaggtgaaggagcagctgagttcttctgatactgcccctcgggaacggcttattgatgcaaaaaccggcctgcctgtgaagaccgacattactccagggccatctaggctctgttccggcgcacgcagaagctttttttgccggatgaaatgcaacaggcctagtgttaaggtggaagataaagattttccgtcgacttgctccaagaagaaggctgatcgaaaatctttttgtactatccattcgacaggctacctaaagtcctggccccctactaagatggggttggacgaggacaatgagccagacaatgaggggtgcaatctgtcatgcctggtagccatcggccgacttcactctcacgtggtgccccaaccggtcaatggtgagattcgggtgaagagtatggaatacgtaagcaggcacgcaattgatgggaagttcgtcttcgttgatcagagggccaccgcgatcctggcctatctgccgcaggagctcctgggcacatcttgttatgaatactttcaccaggatgatatcgggcatctagccgagtgtcaccgacaggtgctccaaacaagggagaagatcaccacgaactgctacaaattcaaaatcaaagacggttcattcataacgctgagatcccgctggttttctttcatgaatccctggactaaggaggtggagtacatcgtaagcaccaacacagtggttctggccaatgttttagaagggggtgacccaactttccctcagttaactgcttctcctcacagcatggactctatgctgccttcaggcgaggggggacctaaacgaactcacccgacagtcccaggcatcccaggtggcaccagagcaggagcaggaaagataggaaggatgatcgccgaagaaatcatggagatccataggattaggggtagttccccctcttcctgtggaagttccccactaaatataacctctacacctccaccagacgcatcctcacccggtgggaaaaagatcctgaatggtggcacgcccgacatcccgagcagtggactgctgagcggacaggcccaggaaaaccccggatacccttactcagactcatcctcgattcttggggagaaccctcacattggaattgacatgatcgataatgaccagggctcctcctcaccaagcaacgacgaagctgctatggctgtcatcatgtctctcttggaagcggatgctgggctgggagggccagttgactttagcgatctgccatggcccctatag

SEQ ID NO: 27345 - DNA, 1527 bp, Artificial Sequence
  Description of Artificial Sequence: Synthetic coding sequence
atggctgaccagcggatggatatttcttcaaccattagcgatttcatgtcgcctgggcctacagacctcctgtcctccagtctgggcactagcggagtagattgtaaccggaaacgcaagggttcatccacagactatcaagaatccatggataccgacaaggatgacccacatgggaggcttgagtacactgagcaccagggtagaattaaaaacgcacgagaggcccacagccagatcgagaaacgccgacgtgacaagatgaactcctttatcgacgagctggcctcccttgtccctacatgtaacgcaatgagtcgtaagctagacaagctaacagtacttagaatggccgtgcagcacatgaaaacacttagaggagctacaaatccctacactgaagcaaactataagcccacattcttgagcgatgacgaattgaagcacctcatattacgggcagctgatggcttccttttcgtggtcgggtgcgatagaggaaagatactcttcgtgagcgagtccgttttcaagatcctaaattattcccagaacgacctgatcggccagagcctgttcgattatttacaccccaaggatatcgccaaggtcaaagaacagctttccagctcagataccgctcctagagaacgactaatcgatgctaagaccggtctgcctgtgaagactgatattacccccggaccatccaggctctgtagcggcgctaggagaagctttttttgcaggatgaagtgcaatagaccatccgttaaagtcgaagacaaagatttcccatctacctgctcgaagaaaaaggtgctgcagaccagagagaagattacgacgaattgttataaatttaagatcaaagatggctcgttcatcaccttacgctcccggtggttctcatttatgaatccatggaccaaggaggttgagtacattgtcagtacgaacacagtggtgctggccaacgtcttagaaggtggtgacccgacattcccccaactgaccgcctctccacattcgatggatagcatgttgccatctggtgagggtggcccaaagagaacccatcccactgtccccggtattccgggaggcactcgcgcaggtgccggaaaaataggacgaatgattgcggaagaaatcatggaaatccatcgcattaggggctcatccccgagctcctgtggttcttcccctctgaatattacatccacgccccctcctgacgcatcatctccaggtggaaagaagatcctgaacgggggtactccggatatcccaagctccggtttgctgtctgggcaagctcaggagaaccccggatacccttactctgactcaagctccatcctgggggaaaacccgcatattggcatcgatatgattgataatgaccagggatcctccagccccagcaatgacgaggctgctatggctgtcattatgagcttgcttgaagccgacgccggactcggcggaccagtggacttctctgacttaccatggccgctgtag

SEQ ID NO: 27346 - DNA, 1878 bp, Artificial Sequence
  Description of Artificial Sequence: Synthetic coding sequence
atggccgaccagcgcatggatatcagcagtacaatttccgatttcatgtcaccgggtcctacggatctgctctccagcagccttgggacatcaggagtagattgcaatcgaaaaaggaaagggagcagcacagattaccaagagtctatggataccgacaaagatgacccacatgggagattagagtatactgaacaccagggcaggattaagaatgcaagggaggctcatagccaaatcgagaagcgccgaagggataaaatgaacagtttcattgacgagctcgcaagccttgttcccacatgcaacgcaatgtctcggaaactggacaaactgacggtcctccgcatggcagtacagcatatgaagaccctacggggagctactaacccgtacacagaggctaactataagccaacattcctgtctgacgacgagctgaagcatctgatattgcgggctgccgacggttttctcttcgtggttggttgcgataggggcaagatcctcttcgtttcagagagcgtgtttaaaatcctgaactattcccagaacgatttgatcgggcagtcgctcttcgactatctccatccaaaggacattgcgaaagtcaaggaacagttgagttcaagcgatacggcacctagggagagactgattgatgcgaaaactggattaccagttaaaacagacattactccagggccaagccgactgtgcagcggcgctcggaggtcctttttctgccggatgaagtgtaatcgtccaagcgttaaagttgaggataaggattttccctctacttgcagtaaaaagaaagatagaaagtctttctgcactatccacagcaccggttaccttaagtcttggccacctactaaaatgggcctggatgaggataacgaacccgacaacgagggctgtaacctcagctgcctggttgcaattgggaggctacattcacacgtggtccctcagccagtcaatggcgagatccgagtcaaaagcatggagtacgttagcaggcacgctatcgatgggaagttcgtgttcgttgatcaacgggcaacggcaatcctggcttacctgcctcaggagctcttgggaaccagctgctacgagtattttcatcaggacgatatcgggcatctggctgaatgtcacagacaggtactacagaccagagaaaaaattaccacaaattgctacaaattcaaaatcaaagacggctctttcatcactcttcggagtagatggttctctttcatgaatccctggaccaaagaggtggagtacatcgttagtactaacacggtggtccttgcaaatgttctggaaggaggggatcccacattcccccagctcaccgcttccccccactccatggattcgatgttgccatcgggtgagggcggacccaagaggactcaccccaccgttccagggattccagggggtactagagccggtgccggaaagatcggaagaatgattgccgaagagatcatggagatacacaggattcgcggaagttccccttctagctgtggcagttctcctttgaatatcacctcaactccccctcccgacgcgtcctcacctggaggcaagaaaatcctgaatggagggactccagacatccccagttccggactgctctcagggcaggcccaggagaacccaggatacccttactcagacagctcctccattttgggcgagaatccccatatcgggatagatatgattgacaatgatcaagggtcttcgtctcccagcaatgacgaagccgcaatggctgtcattatgtcactgctcgaggctgatgccggactcggcggaccagtcgatttctctgatctcccctggcccctctag

SEQ ID NO: 27347 - DNA, 1581 bp, Artificial Sequence
  Description of Artificial Sequence: Synthetic coding sequence
atggcggaccagcggatggatatctcttctacaatttcagacttcatgagccctggtcctacagatctacttagctcctcactgggtacgagtggcgtggactgtaaccgcaagagaaaagggtccagcactgattatcaagaaagcatggataccgacaaggatgaccctcacggacgcctggaatacaccgaacaccaggggcgaatcaagaatgctcgcgaggcacactctcagatcgagaaacgccgacgtgacaagatgaactcgttcattgatgagctggcttctctcgtgccgacctgtaatgccatgtccaggaagcttgacaagcttacagtgctgcgtatggccgtacagcatatgaagacgctgaggggcgctacgaatccttatacagaggcgaactataaacctacatttttgagtgatgatgagctcaagcatctgatcctgagagctgccgacggcttcttattcgtggtggggtgcgacagagggaaaattcttttcgtgtccgagagtgtttttaagatcctgaactacagccaaaatgatctgatcggtcaatcgctctttgattatctgcatcctaaagatatcgccaaagtcaaggagcagttaagcagcagtgatacagccccaagagaacgcctcattgacgcaaaaaccggtctcccagttaagacagatatcacccctggcccatctagactgtgcagcggcgcacgcaggtccttcttctgccgcatgaaatgcaatcgaccttctgtaaaggtcgaggataaagactttccatccacctgcagcaagaaaaaggctgacagaaaaagcttttgtacaatccactcgaccggctacttgaagagctggccacccaccaaaatgggactggacgaggataatgaaccggataatgagggatgtaatctctcatgcctcgtagctattggcaggcttcactctcatgttgtgccacagcctgtgaacggggaaatcagagtaaaatccatggagtatgtctcgcgccatgctatcgatggcaagtttgtgtttgtcgaccagagagcgaccgcgatcctggcctacctacctcaggagctcctaggcacgagttgctacgaatactttcatcaagacgacatcggccacttagccgaatgccacagacaagtccttcagaccagagagaaaatcaccactaactgttacaagttcaaaattaaagacggctctttcattacgttgcgatcgaggtggttctcattcatgaatccctggactaaggaagttgaatacatcgtgagtaccaataccgtggtcctcagccgggtcgacaccggtcacctggggcaggtggaatggtgtacagtactgtcgcgaccagacagtagattcttgattgcaggcatgttcacggaaccgaccagttggaaggctggaacccagccatcccattcctcccagcatccccctaccgcctggactgcctgctgccctctggagaaggtagctcagagaggaccaactcctctgttccaggggttccagggtgagccaggtcttgggcaagagaaatag

SEQ ID NO: 27348 - DNA, 1878 bp, Artificial Sequence
  Description of Artificial Sequence: Synthetic coding sequence
atggcagatcagagaatggatatatcttctactattagtgacttcatgagcccaggccctactgacttactgtcctcatcactcgggaccagtggagtcgattgtaataggaagcgtaagggctcgagcacagattaccaggagtcaatggacaccgataaggacgaccctcacggccgactcgagtacacagagcatcaggggaggattaagaatgctagagaagcacacagtcagatcgaaaaacggagaagagataaaatgaactcttttattgacgagctggcatccctcgtccccacctgtaatgccatgtccaggaaactcgacaagttgactgtgcttaggatggcagtgcagcacatgaagaccctcaggggcgctactaacccctacactgaagctaactacaagcctactttcctatctgatgacgagcttaaacatctgatactgagggctgcagatggctttctgttcgtggtgggatgcgaccggggtaagatcctgtttgtctcagaaagcgtatttaagattttgaattattcacaaaacgacctaatcggacaaagcttgttcgattacctgcatcctaaagatatcgccaaggtgaaggaacagctgtcttcgagtgatactgctccacgtgaacgtctcatcgatgctaaaaccggacttcccgttaagaccgacatcacccctggcccatccagactgtgcagcggggcacgacgctctttcttttgtaggatgaaatgtaatcggccatctgttaaagttgaagataaagacttcccgtccacctgcagtaaaaagaaagacagaaagtctttctgtactatccactcaactggttacctcaaatcgtggcccccaaccaagatgggcctggacgaggacaatgaacccgataatgaaggatgtaatctgtcttgcctggtggctatcggcaggttgcacagtcatgttgttccgcaaccggtgaatggagagattagggtgaaatccatggagtatgtgtctcgacacgcaatcgacggcaaattcgtttttgtagaccaacgagccacagcaattctggcttatcttccccaggaactgctgggtacaagctgctacgagtacttccaccaagatgatatcggccatctagccgagtgtcatcgccaggtcctgcaaacgcgcgagaaaattacaacgaattgttataaatttaaaattaaggacggatccttcattactctgcgctcaagatggttcagctttatgaacccgtggacgaaggaagtggaatacattgtgtccaccaacacggtggtcctggccaatgtgctcgaggggggtgaccctacatttccccagcttacagccagcccgcactcaatggatagcatgctcccatctggcgaaggtgggcctaaacgaacccatccaactgtgcccggtatccccggaggaacaagggcaggcgctgggaaaattgggagaatgatcgcagaagagattatggagatccatagaatacggggaagtagcccaagttcctgcggttccagtcccctgaacattacttccacccctccaccagacgctagcagtcctgggggaaagaagattctgaacggagggacgccagacataccaagtagtggattattgtccgggcaggctcaagagaaccccggatacccctatagcgacagcagtagcattctgggcgagaaccctcacataggcatcgacatgatagacaacgatcagggcagtagctcgcccagcaacgacgaagcagccatggccgtcatcatgtcccttctagaagccgatgctgggctgggaggaccagtcgacttcagcgacttaccctggcctttatag

SEQ ID NO: 27349 - DNA, 1752 bp, Artificial Sequence
  Description of Artificial Sequence: Synthetic coding sequence
atgatcaacattgaaagcatggatactgacaaggatgatccacatggcagactcgaatacacagagcaccaggggaggatcaagaatgcaagagaggcgcacagccagattgagaagcgccgacgggataaaatgaactcattcatagacgagttggcttctctcgtccccacttgtaacgctatgtcccgtaaacttgacaagttgacagtccttcgtatggctgtgcagcacatgaagaccttaagaggggctacaaacccttatacagaggcgaattataagccaacgtttctatccgacgacgagctgaagcacctaattctgagagccgctgacggtttcctctttgtggtaggttgcgataggggaaaaattctgttcgtatcggaatctgtatttaagattctgaactatagccagaatgatctgattgggcagagtctgttcgattacctgcatcctaaggacatcgctaaggtgaaagagcaactgtcatcatcggacacggcccctagagaaaggttaatcgacgccaaaacagggctgcccgttaagaccgatatcactccaggacctagtcgactgtgcagcggcgcaaggaggagcttcttttgtagaatgaaatgcaacagaccctctgtgaaagtcgaggacaaagactttccatctacctgttcaaagaagaaggctgatcggaagtcgttttgcacaattcactcaaccggttaccttaagagttggcctcccacgaagatggggttggatgaggacaacgaacccgacaatgagggctgcaatctctcatgcctggtcgccatcgggcgtctccatagccacgttgtcccccaaccagtcaatggcgaaatccgtgttaagtctatggagtacgtttcgcggcatgcgatagacggcaaatttgtgttcgtggatcagcgggcaactgccattctggcgtacctgccgcaggagctcctcggaacgagttgctatgagtacttccatcaggatgatatcggtcatctggccgaatgtcaccgtcaggtattgcagaccagagagaagatcacgacgaactgctacaagtttaaaatcaaagatggctcttttataactctgagatcccgctggttcagttttatgaatccttggactaaggaagtggaatacatcgtgtcaacaaacacagtcgtcctggctaatgtcctggaaggaggagaccctaccttccctcagctcacagcatctcctcactcaatggactccatgttacccagcggtgaagggggacccaagcggacccacccgactgttccaggtatcccagggggtactagggccggagcgggtaaaatcggacgcatgattgccgaggagattatggagatacaccgaatccggggatcgtctccttcctcctgcggtagcagccctctgaatattacatccactccccctccggacgcaagctctccaggcggaaagaaaatactgaacgggggaacgcctgacattccatcctccggactgctatcagggcaagctcaggaaaatccgggttatccgtacagcgactcctcatccatcctcggcgaaaacccccacattggcattgacatgatagacaacgaccagggtagcagcagcccaagcaatgacgaagccgcaatggccgttatcatgagtctgctcgaggccgacgccggactgggaggccctgttgacttttccgacttgccatggcctctctag

SEQ ID NO: 27350 - DNA, 1881 bp, Artificial Sequence
  Description of Artificial Sequence: Synthetic coding sequence
atggcggatcaaaggatggacattagtagcacaattagcgatttcatgtctcccggaccaactgacctgctgagcagctcgcttgggacatcgggtgtggattgtaaccgcaagcgcaagggcagcagcacagattaccaggaatccatggatactgataaggacgaccctcacggacgattggaatacactgagcaccagggacggatcaagaacgccagggaggcccatagccagattgagaagagacggagagacaaaatgaactccttcattgatgagctggccagccttgtccccacatgtaacgccatgagtagaaagctggataagttgaccgtgcttcgtatggctgttcagcacatgaaaacactcagaggggctaccaatccctataccgaagctaattataagcctacgtttctctctgacgatgaattgaagcacctgatcctccgggctgccgacggtttcctgttcgtggttgggtgcgatcggggaaagattctcttcgtgtccgaatctgttttcaaaatattgaactactctcagaacgatttgatcggacagtctctttttgattacttgcaccctaaagacatcgctaaagttaaggaacagttgtcgtcttccgataccgctccacgggaaagattaatagacgccaagacaggactcccagtcaagaccgacataacgccaggacccagcagactttgttccggcgcaaggcgtagcttcttctgtaggatgaagtgtaatagacctagcgtgaaggtggaggacaaagatttcccctcaacctgtagcaagaagaaagccgataggaaaagtttttgtacaatccactcaactggctatctgaaatcctggccgcctactaagatgggactggacgaggataatgaacctgacaatgagggatgcaatctatcctgcttggtagcaatcgggcgactccattctcacgtggtgccccagcccgtcaacggagaaatcagagttaaatccatggaatacgtctcacgacatgccatcgatggaaagtttgtttttgtggatcagcgggctaccgcgatcctcgcttacctccctcaggaactattgggcacatcatgctatgaatactttcaccaagacgatataggtcacctggctgagtgccataggcaggtgctgcagactagggagaagattacaaccaactgctataagtttaaaatcaaagacggatctttcatcactcttcgcagtcgctggttttccttcatgaacccatggacgaaggaagtcgaatatatcgtgagcacaaacacagtggtcctggctaatgtcttagagggtggagatcctaccttcccccagctcactgccagcccccattccatggatagtatgctaccgtccggagagggcggaccgaaacggacacaccctactgtcccaggtatcccaggtggaacacgggcaggtgctgggaagattggcaggatgattgccgaagagatcatggaaattcatagaatccggggaagcagcccttctagttgcggctcctctcctctcaatattacctctacaccacctccggacgcaagctcacctggaggcaagaagatactgaatgggggaactcctgacatccccagctctggactactgtcaggtcaggcccaggagaatcccggatacccctactctgattcctcaagcattctcggggaaaatccccacattggcatcgacatgatcgacaatgatcagggctcaagctctccctctaacgatgaggctgccatggcagtcataatgtctttattggaggcggatgccggtttaggaggccctgtggacttctcagacctaccatggcctctgtag

SEQ ID NO: 27351 - DNA, 1749 bp, Artificial Sequence
  Description of Artificial Sequence: Synthetic coding sequence
atgatcaacatagagagcatggataccgataaggatgacccacacgggcgactggagtacaccgagcatcagggcagaatcaagaatgccagggaagctcatagccagattgaaaagcggaggagggacaaaatgaattcatttattgatgaactggctagtctagtgcccacatgtaatgccatgagccggaaactggataagttgacagtcctgagaatggctgtccagcatatgaaaactctaagaggagctaccaatccttatactgaggccaactacaaaccaacttttctgtcagatgacgagcttaagcatctgattctcagagctgcagacggattcttgttcgtggtcggatgcgacagaggcaagatcctttttgtgtccgagtctgtctttaaaatacttaactactctcagaacgatcttatcggccagagcctcttcgattacttgcaccctaaggacatcgccaaagtgaaagagcagcttagttccagcgacactgccccacgggaacggttaatcgatgcaaaaactgggctaccagttaagactgacataactccgggacccagccggctgtgctccggagctcgtcgatcctttttctgccggatgaagtgcaatcgcccatccgttaaggtggaggataaggacttccccagcacatgttcaaaaaagaaggaccggaaaagtttttgcacaattcacagcacagggtatctcaagagttggccacctacaaagatgggattggatgaagataacgagcccgacaacgaaggctgtaacctgtcgtgtcttgtggctatcggcaggctacattcccacgtagtgccgcagcccgtaaacggcgaaatccgggtgaaatccatggagtacgttagtagacacgccattgatggtaagttcgtctttgtggatcagcgagcaacggctatcctggcttatcttccacaggaattgctcggcacgtcttgttatgagtattttcaccaagacgatattggtcacctagccgaatgccatagacaggtgttgcagacccgcgagaagatcaccaccaactgctacaaatttaagataaaggacggttcctttattaccctgcggtcacgctggttttccttcatgaatccctggactaaggaggtcgaatatatagttagtactaatactgtcgtgttggctaacgtactggaaggtggggaccccactttcccccaattaactgcatctccacactccatggacagtatgctgccttccggcgagggcggaccaaaacggactcatccgactgttcctggcattcccggtggaacccgggctggcgcaggaaagatcggccgaatgatagcagaggagatcatggagatccatagaatacgcggatcctccccttctagctgtggctcaagtccacttaacatcaccagcactcccccaccggacgcatcgtcgccaggtggcaagaaaatcctcaacggcggtacccctgatatcccatctagtgggcttttatcaggacaggctcaagagaatccaggatacccttatagcgatagcagttccatcctgggagagaacccccatattgggattgacatgattgataatgatcagggctctagtagcccctcgaatgacgaggctgcgatggccgttataatgtccttgctggaggccgatgcaggtctggggggacccgtggacttctccgacttaccatggccactctag

SEQ ID NO: 27352 - DNA, 219 bp, Artificial Sequence
  Description of Artificial Sequence: Synthetic coding sequence
atgatcaatattgagagcatggatacggacaaggatgaccctcatggtaggcttgagtacactgagcaccaaggaagaatcaaaaatgcacgggaagcccactcacagatagagaagcgacgcagagacaagatgaattcttttatcgatgagctagcatccctggtacccacttgcaatgctatgtcaaggaagcttgataagcttactgtcctctag

SEQ ID NO: 27353 - DNA, 231 bp, Artificial Sequence
  Description of Artificial Sequence: Synthetic coding sequence
atggcggaccagcgtatggacatcagcagcacaatctcagatttcatgtcccccggtcccacagatttactgtcatcttctctgggcacgtctggggtcgattgtaaccggaaacggaagggcagctctacagactatcaggaaagcatggatacggacaaggacgaccctcacgggagacttgagtataccgaacaccaaggcaggatcaagaacgcacgcgaggcatag

SEQ ID NO: 27354 - DNA, 72 bp, Artificial Sequence
  Description of Artificial Sequence: Synthetic coding sequence
atggctgaccaaaggatggacattagttccaccatctctgacttcatgtcacccggaccaaccgacctgtag

SEQ ID NO: 27355 - DNA, 408 bp, Artificial Sequence
  Description of Artificial Sequence: Synthetic coding sequence
atggcagatcaaaggatggatatttcatcaaccatcagcgattttatgtcccctggtccgacggatcttctgtcatcatctttgggaacaagtggagtcgactgcaataggaagaggaaggggtccagcacagactaccaagaatcaatggacacagataaggatgaccctcacggacgcctcgagtacaccgaacatcaaggaagaattaagaatgcacgggaagcccacagccagattgaaaagcgaaggcgcgacaagatgaacagctttattgacgaactggcttcactggtgccgacctgcaacgccatgagccgtaagctcgacaaactcaccgtgcttcggatggcagtgcagcatatgaagacccttcgcggagccactaacccgtatacagaggcatag

SEQ ID NO: 27356 - DNA, 141 bp, Artificial Sequence
  Description of Artificial Sequence: Synthetic coding sequence
atgattaacatagagtccatggatacagataaggacgacccacatggcagactcgagtacaccgagcaccaaggaagaattaaaaacgcacgcgaggcccactcccagatcgaaaaaaggcggagggacaagatgaactag

SEQ ID NO: 27357 - DNA, 426 bp, Artificial Sequence
  Description of Artificial Sequence: Synthetic coding sequence
atgatcaacatagagtccatggacacggataaagacgacccgcacgggagactggagtacacagaacatcaaggacgcatcaagaacgcccgagaagcgcacagccagattgagaagaggcgtcgcgacaaaatgaactcgtttatcgacgagctggcctctcttgtcccaacctgtaatgctatgagcagaaaacttgacaaactgacagtgctaaggatggcggttcagcatatgaagaccctcagaggggcaacgaatccctacacagaggctaattataaacctactttcctgtcagacgatgaactgaagcatctgattctcagagcggctgacgggttcctgtttgtggtgggttgtgatagaggtaagatcctcttcgtttcagagtctgtttttaagattctcaattattcccaatag

SEQ ID NO: 27358 - DNA, 306 bp, Artificial Sequence
  Description of Artificial Sequence: Synthetic coding sequence
atggctgaccagaggatggacattagcagcaccatcagcgatttcatgtcacccggaccaacagatttactgtcaagttctttggggaccagcggcgtcgattgtaatcgaaagaggaaaggatctagcaccgattaccaagaatcaatggataccgataaggacgatccacatggccgtctcgagtacacggagcatcagggccgtataaaaaatgccagggaggcccatagccaaattgaaaaaaggcggagagataagatgaatagctttattgatgaattagcatctctggtccctacgtag

SEQ ID NO: 27359 - DNA, 180 bp, Artificial Sequence
  Description of Artificial Sequence: Synthetic coding sequence
atggccgatcagagaatggacatatcttctaccatttctgactttatgtcccctggccctacagatctcctttcttcatctttaggtaccagtggagtggactgcaatcggaagcggaagggctccagtaccgactaccaggaatccatggacaccgacaaggatgatccacatggttag

SEQ ID NO: 27360 - DNA, 1683 bp, Artificial Sequence
  Description of Artificial Sequence: Synthetic coding sequence
atggaaccgctacagcagcagcagcagcagcagcagcaacagcagaaacagcctcaccttgcacccttacagatggacgcccgagaaaagcaagggcagcaaatgagagaggcacagttcctgtacgcacaaaaactagtgacgcagcctaccctgctcagtgctaccgccggacgtcccagtggcagcactcccttgggccctctcgccagggtccccccaactgcagccgtggcccaggttttcgagaggggcaatatgaatagtgaaccagaagaggaggacggcggactagaggacgaagatggcgacgatgaggttgccgaggtggctgagaaagaaacacaagctgccagcaaatattttcacgtccagaaagtggcacgacaggatccacgcgtcgctccgatgtccaaccttctgcccgctccgggactgcctccacacggccaacaagcgaaagaggaccacactaaggacgctagtaaggcctcaccctccgtgtctactgccggacagcctaactggaatttagacgaacagctgaaacaaaacggcggtctggcatggtccgacgatgccgacggcggaaggggaagggagataagccgggattttgccaaactttacgagctcgatggagacccagagagaaaagagttcctggatgatctctttgtgtttatgcagaaacgcggaacgcctatcaaccgaatccctattatggccaagcaaattctcgacctgtacatgctatacaaactggtgacggaaaaaggcggactggttgagattatcaataagaagatttggagagaaattaccaagggtttaaacctcccaaccagtatcacctcagcggcattcactctccgcacacagtacatgaagtatctttacgcctatgaatgcgagaagaaagccttgtcatcccctgctgagttgcaggccgctatcgacgggaacaggcgggagggtaggagaccttcctactcgagcagcctgtttgggtattcgcccgctgctgcaaccgccgctgccgcagccggagcacccgcattgctgagcccccctaagatccgatttccaatactgggcctcggttccagctccggcacgaatacctcctcccctcgaattagcccagcaaccacactgaggaaaggagacggagcacccgtgaccactgttcctgtgcccaaccgcttggcagttcccgtaaccctagcttcacagcaggctggcacccgcaccgctgcactcgaacagttgcgggagcggctcgagtctggggagccggctgagaaaaaagcgtcccgccttagcgaggaggaacaacggctggtgcagcaagcattccagaggaactttttctcgatggctcgccagttacctatgaagatccgcatcaacggcagggaggatcgggctgaggcatccgcggcagctctcaatctgactacaagctctatcggatcgatcaacatgagtgtcgatatcgatggcacaacttatgccggagttctgttcgcccaaaagccagtggtgcatctgatcacagggagtgcaccccagtccctggggagttctgcttctagtagctccagctcccactgctccccttcgcccacgagctccagaggcaccccatccgccgaacctagcacttcatggtctttgtag

SEQ ID NO: 27361 - DNA, 1335 bp, Artificial Sequence
  Description of Artificial Sequence: Synthetic coding sequence
atggagcccttgcagcagcagcaacaacaacagcaacagcagcagaaacaaccccacctggcacccctccagatggacgctcgggagaaacagggccagcagatgagggaagcacagtttctttatgctcagaagctggtgacacagccaacccttctgtccgcaacggcgggtagaccatccggcagcaccccattaggcccactggcgcgagtgccacctacagccgcagtggctcaggtttttgagaggggcaatatgaactcggagcccgaagaggaagatggaggcctggaagacgaggacggagacgacgaagtggctgaagtggctgagaaagagacacaagcagcgagcaaatatttccacgtccagaaagtggcacgccaggaccctagagtcgccccaatgtccaacctgcttccagctcccggtttacctcctcatggccaacaggcaaaggaggatcatactaaagacgcatcaaaggcctcacccagtgtcagtacagcgggacaacccaactggaacctagacgagcagttgaagcagaacggcggattggcctggtcagatgatgctgatgggggtagaggccgagagatttccagggattttgcaaagctgtatgagctcgacggtgatccggaaaggaaagaattcctggatgatctgttcgtttttatgcaaaaaaggggcacccccatcaaccggattcccattatggccaagcagatcctggacctctacatgttatacaagctagtaacagagaaaggaggtctggtagagattataaataaaaaaatctggcgcgaaatcacgaaggggctaaacttgcctacctcaatcacctcagcggcatttactttgcgaacccaatatatgaaatatctatatgcatacgaatgcgaaaaaaaggcactgagctcacccgctgaacttcaggcggctattgacggcaaccgccgagaaggcaggcgtcctagctactcgtcctctctgttcggttattcccctgctgctgccacagccgctgcggctgccggagctccagctctgctcagtccccctaagatacggtttcccatcttgggcttgggcagctccagtggtacaaatacctcatcacctcggatcagcccagccactacattgcgaaaaggagatggtgccccagtgactactgtgcccgtgccaaaccggttagcagtgcccgtcacgctagcttctcagcaggctggaacccgcaccgccgcattagagcagcttagagagagactggagtcaggggaacccgcagagaaaaaagcatctggaacatggtgtcagtag

SEQ ID NO: 27362 - DNA, 1413 bp, Artificial Sequence
  Description of Artificial Sequence: Synthetic coding sequence
atggaacctctccaacagcagcagcagcagcaacagcagcagcaaaaacagccccatcttgctcctttgcagatggatgctcgagagaagcaagggcagcagatgagagaagctcaattcctgtatgcacaaaagttggttacacaaccgacactactgtcagccacggcaggtcggcctagtgggagcacgcctctgggaccattagctcgagtgccgccaacagctgcagtagcacaggttttcgagcgaggcaacatgaactcggagcccgaagaagaagatggaggtctcgaggacgaagatggagatgacgaagtggccgaggtggccgaaaaagagacacaggcggcttcaaagtattttcacgtgcagaaggtcgccaggcaggatccacgggtggctcctatgtcaaatctcctgcccgctccaggcctcccaccacacggacagcaggccaaggaggaccacaccaaagacgcttccaaagctagcccctctgtgtccactgccggacaacctaactggaatctggatgagcaattgaagcagaatgggggtctcgcttggtcggatgatgctgacggcggtcggggtagggagattagccgtgacttcgcgaagctgtacgagctggatggagaccccgagaggaaggagtttctggacgatcttttcgtcttcatgcagaagaggggcaccccaatcaatcgcatcccgataatggctaaacagatcctggacctgtatatgttatacaagctggttaccgaaaagggcggactggtcgagattattaacaagaagatctggcgggagattacaaagggactgaacctgcccacatctattaccagcgccgcttttaccctcagaacacagtacatgaaatatttgtacgcttacgaatgcgagaagaaggcgttgtcctccccggcagaattacaggcggctatcgatggcaaccgtcgggagggcagaagaccctcttactcctctagcctctttggttacagccccgctgccgcaaccgcagcagcagctgccggtgcgcctgccctcctcagtcctccgaagattaggttcccaatactggggctaggatcttctagtggtacaaacacgtcttcgcccaggattagtccagccactacacttcgcaaaggtgacggggcaccggtgacaaccgtgcccgtacctaacaggctcgcagtgcccgtcaccctagcttcccagcaagctgggactagaacggctgctctcgaacagcttcgagagagactggaatctggtgaaccagccgaaaagaaagcatcccgtctgtccgaggaagagcagagacttgtgcagcaagcctttcagagaaatttcttttccatggccagacagcttagcattctttatgttttctag

SEQ ID NO: 27363 - DNA, 7934 bp, Artificial Sequence
  Description of Artificial Sequence: Synthetic coding sequence
atgggcgaacacgggttggagctagccagcatgatacccgctctgcgagagctggggagtgccactccagaagaatacaatacggtggtgcagaaaccacgccaaatactatgtcagtttatagaccggatactgaccgacgttaatgtggttgccgtggaattggtgaagaagacagattctcagccaacatctgttatgttattggattttatccagcacataatgaaatcctctccacttatgtttgtgaatgtgtccggctctcacgaagcgaaaggctcttgtatcgaattctccaactggattattacacgcctgctaagaattgcggctacacccagctgccatctactgcacaagaagatctgcgaagtgatatgctcactgcttttcttatttaaatcaaagtcacccgctatctttggagtgttaaccaaagagcttctacagctcttcgaggatctggtctacctgcaccgacgcaacgtgatgggacacgcagtggagtggcctgtcgtgatgtccagattcctcagccagctcgatgaacacatgggttatcttcagagcgcgccactacagctgatgagcatgcagaacctggagttcatcgaagtgacgctcctcatggtgctgacccggatcattgcgattgtattctttcggagacaagaactgctgctgtggcagatcgggtgtgtacttctggagtatgggagtccaaagattaaaagcctggcaatctctttccttaccgaactctttcagctaggaggtctcccggcacaaccagcgtcaactttcttttccagtttcttggagctgctgaaacatcttgtggagatggacaccgatcagctaaagttgtacgaagagcctctgagcaaactgataaaaacccttttcccctttgaggctgaagcttaccgcaacatcgagccagtctacctgaatatgctcctcgagaagctttgcgtgatgttcgaagatggggtccttatgcgcctgaagtccgacctgttgaaagccgcactgtgccacctgctccagtattttctcaagttcgtgcctgcaggctacgagtctgctctccaagttcggaaagtgtatgtacgaaacatctgcaaagcccttctggacgtgcttgggatcgaggtggacgccgaataccttttaggccctttatacgccgcattgaaaatggagtccatggaaattatcgaagaaatccaatgccagacccagcaagagaacctgagcagcaactccgatgggatctctcctaagagacggagactgtcctcatcgttaaacccaagtaagagggcaccaaaacaaactgaggaaatcaagcacgtggacatgaatcagaaaagcatactgtggtcagcactgaaacagaaagcagagtcactccagatcagcttagagtattccggcctcaagaatccagtaatcgaaatgctcgaggggattgccgtggtgctgcagctgacggccctttgcacagtgcactgtagccaccagaacatgaactgccgcacattcaaggactgtcagcacaagtccaagaaaaagccatccgtggttatcacatggatgagtcttgatttctataccaaggttcttaaatcctgccgttcgctgcttgagtcagtgcagaagctggacctggaggccacgatagacaaagtggtgaagatttatgacgcgttgatctacatgcaggttaacagctccttcgaggaccatatactcgaagacctgtgtgggatgctgtctctcccttggatttactcacactcagatgacggctgtctgaaactgacgacgtttgctgctaatctgctgacactttcttgccgtatttccgatagctactctccccaagcccaatctaggtgtgtgtttctgctaactcttttcccgcgtaggatctttctggaatggcggacagcagtatataattgggcactgcagtcatcacatgaagtgatcagagcttcttgtgtgtctggctttttcatactgcttcagcagcagaattcatgcaatagagtgccaaagatcctcatcgacaaagtaaaggacgacagcgatattgtcaagaaggagtttgcctccatcctggggcagcttgtgtgtaccctgcacggaatgttttatctcacttcgtccctcacagaacctttttcagagcatgggcacgtggacctgttttgtcgcaacttaaaggcaactagtcagcacgagtgttctagcagccaactgaaagccagtgtttgcaagcccttcttgttcctgctgaaaaagaaaatcccttcacctgtcaagctcgcttttatagacaacttgcatcatctctgtaagcatcttgacttcagggaagacgagaccgacgtgaaagctgtgctcggcacattgcttaatctgatggaagacccggacaaagatgtacgcgtggccttttcgggaaacattaaacacatcctggagagcctcgattccgaagatgggtttatcaaagaactgttcgtgctgcggatgaaggaggcttacactcacgctcaaattagccgtaataacgagctcaaagacacacttattctgacgactggtgatattggacgagcggctaagggcgatcttgttccatttgctttactgcacctcctccattgcttgctcagcaaatccgcatcagtctctggcgcagcatacaccgaaattcgcgctctggtggccgctaaatctgttaaattgcagagttttttttcccagtacaaaaagccaatctgccaatttctggtcgagtccctacattcttcccagatgaccgcactgccaaacaccccatgccagaatgccgacgtccgcaagcaagacgttgctcatcaacgcgagatggcgctgaatactttgagcgagattgccaatgtcttcgacttccccgatttgaaccgcttccttacaaggacactccaggtactgctgcctgatttagccgctaaggccagtcctgctgctagcgcgctcattagaactctaggaaagcagttgaacgtgaataggcgcgagatccttatcaacaactttaagtatattttctctcatcttgtgtgctcatgctccaaggatgagctggagagagcacttcattacctgaagaacgagacagaaatcgaactcggatccttactgagacaggacttccaagggctccacaacgaacttctgttgcgcatcggagaacactaccaacaagtttttaatggtctgtccattctcgcctcgttcgcatcatcagatgacccgtatcaaggcccaagagacataatatctccagagctgatggccgattatttgcagcctaaattgctcggaatcttagcattcttcaatatgcaacttttatccagttcagtagggatagaggacaagaagatggcgctgaacagtttgatgtccctcatgaaactaatgggaccaaaacacgtttctagcgttagggtcaagatgatgacgactctgcggaccggactaaggtttaaagacgattttccagaactgtgctgccgcgcatgggattgctttgtgcgttgcctggaccatgcatgcctgggtagtttgttatcgcacgtgattgtcgccctgctaccgctaattcatatccaacctaaggagaccgccgctatttttcactacctgattatcgaaaatcgcgacgcagtacaggattttctccacgagatttattttctacctgatcaccccgaactcaaaaagatcaaggcagtccttcaggaatatagaaaggaaacctctgagagcacagacctgcaaacaactttgcagttatcaatgaaggctattcagcatgaaaacgtggatgtgaggatccatgccctgacaagtttaaaagaaaccctgtacaaaaatcaagaaaagttaatcaaatacgctactgacagcgaaacagtggagccgatcatctcccagctcgtgacagtgttactcaaaggatgccaggatgccaactcccaggccaggctcctttgcggagagtgcttgggggaactgggggctatcgatcctgggagactagactttagcaccacggagacccagggcaaggattttaccttcgtgacgggagtcgaggatagttcattcgcgtatggcctgttaatggagctcacgagggcttacctcgcgtatgccgataattctagggcccaggactctgcagcctacgccattcaagagctcttgagtatctacgactgtagagagatggagaccaatgggccaggccaccagctctggcggaggtttcctgagcacgtgcgtgagatccttgagccacacttgaacacaagatacaagtcatcacaaaaaagcacagactggtctggagtgaagaagcctatctatctgagtaagctaggttcaaattttgcagagtggtcggcatcttgggccggttacttgatcactaaggttcgccacgacctggcgtctaaaatctttacatgctgcagcattatgatgaagcacgacttcaaagtgacgatatacctgttgccgcatattctggtgtatgtcttgctggggtgcaatcaggaagatcagcaggaggtttacgcagaaattatggcagttctgaaacatgatgatcagcacaccattaatacccaggatatagcgtcagatctctgccaattatccacgcagaccgtgttttcaatgttggaccatctgacacagtgggctcgtcacaagtttcaagccttaaaggccgaaaaatgcccccattctaaaagcaatcgaaacaaagtggacagcatggtgagcacagtggattacgaggattatcaaagcgtcacccgattcctggacctgattcctcaggacaccctggctgttgcgtctttccgctcaaaggcttacacacgggcagtgatgcattttgaatctttcataacggagaagaagcagaatatacaggaacatctcggattcctgcagaagctgtacgccgcaatgcatgaacctgacggagtggccggtgtgagtgcaattagaaaggccgaaccgtccctcaaggaacagattttggagcatgaatccctgggattgctacgggacgctacggcctgctatgatcgggctatacaactagagccggatcaaatcattcattaccacggggttgtgaagtctatgcttggcctgggacagttgagtactgtaattactcaggtcaatggagtacatgccaaccggtcggaatggacagatgagttgaacacctaccgggtggaggcagcctggaagctgagccagtgggacttggtggaaaattacctggctgccgatggcaagagcacaacatggagcgtgcggctgggtcagctcctgctttcagccaaaaagagggatatcaccgccttttacgactcattgaaactggtgcgcgctgagcagatcgttccactttccgctgcaagcttcgagcgaggctcataccagcgaggatacgaatacattgttagacttcacatgttatgtgagctggagcacagtatcaaacctttgtttcagcattcccccggtgacagttcccaggaggatagcctgaactgggtagccaggttagagatgacccagaattcatacagggcaaaagaacccatcttagcactgaggcgggctctgctgtccttaaataagaggcctgattacaacgagatggttggcgaatgctggctgcagtccgctagagtagccagaaaggcaggccaccaccaaactgcttataatgccctgctcaacgcaggtgagagtcgcctcgcagagttgtatgttgaacgggcaaaatggctctggagcaaaggtgatgtgcaccaggccttgatcgtgctgcaaaagggggtggagctgtgcttccctgagaacgaaaccccccctgaggggaagaacatgctgatccacggacgggcaatgctcctagtgggaaggttcatggaagagaccgcaaacttcgaatctaacgccattatgaaaaaatataaagacgttacggcctgcctgccggagtgggaagacggtcacttctacctggccaagtactacgataaactgatgcctatggttacagacaataagatggagaagcagggcgatctcatccgctacattgtgctccattttggtcggtcactgcaatacgggaaccagtttatctatcagtcaatgccccgaatgctcaccctctggctagattatggaaccaaggcttatgagtgggagaaagcaggaaggtccgacagggttcagatgaggaacgacctcgggaaaatcaataaggtgatcacagaacatactaactacctggccccttaccaatttttgaccgctttctcccagctgatctcacggatttgccacagccacgatgaagtttttgttgtcttgatggaaatcatcgccaaagtgtttctggcctatccacagcaggcaatgtggatgatgactgccgttagcaagtcaagctaccccatgcgggttaaccgatgcaaagaaattctgaataaagctatacatatgaaaaagtccctggaaaagttcgtcggggatgcgacgaggcttacggataagcttctagaactgtgtaacaagcctgtggacggctctagttccaccctttccatgtctacccacttcaaaatgttaaagaaattggtggaagaagcgacgtttagcgaaatccttattccgctccagtccgtgatgataccgaccctccccagtattttgggcacccacgcaaaccacgctagccatgagcctttccccggtcactgggcatatatcgcaggatttgacgatatggtcgaaattctggctagcttacaaaagcctaagaaaatcagcttaaaggggtccgatggcaaattctacatcatgatgtgcaaaccaaaggacgatctgcggaaggactgtaggctgatggaattcaatagcctgattaataagtgtctacgaaaggacgcggaaagtcgcagacgcgaactgcacatccgcacatacgccgtgatcccccttaatgatgagtgcggtatcatagagtgggtgaataacacagccggtctgagaccaattttgaccaaactgtataaagagaaaggtgtgtatatgactggcaaagagttgagacagtgcatgcttcccaagagcgccgcactctctgagaaactgaaggtgttccgcgagttcctgttgcctagacaccctcctatatttcatgagtggttcctcaggaccttcccagaccctacgtcttggtatagcagcaggtcagcctattgcaggagtaccgcagtgatgagcatggtgggttacattctcggcctcggcgacagacatggagagaatatcctgtttgacagcttgaccggcgaatgtgtgcacgttgattttaattgtctgtttaataaaggtgagacctttgaagtgcccgagatcgttccgttcaggctgactcacaacatggtcaacgggatgggtcctatgggcactgaaggccttttcaggagggcatgtgaggtcactatgcgcttaatgagggatcagagggagcccctgatgtccgttctgaaaacgttccttcacgaccccttagttgaatggagcaagccagtaaagggacatagcaaagccccacttaacgagacaggagaggtggtgaacgagaaagcaaaaacacatgttctagatatcgaacagcggctgcaaggtgttattaaaactagaaatagggtcaccggtctgcccctcagtatcgaaggtcacgtgcattacctcattcaagaggccacggacgagaacctcttgtgccagatgtacctaggatggacaccatatatgta

SEQ ID NO: 27364 - DNA, 7742 bp, Artificial Sequence
  Description of Artificial Sequence: Synthetic coding sequence
atgggagaacacggactggagttggcctctatgatccccgcactgcgggagctgggctctgcaactcccgaggaatataataccgtggttcagaagcccaggcaaattctgtgtcagttcatagaccgcatcttaaccgatgtaaacgtggtcgccgtagaattggtgaaaaagacagacagtcagcccacttccgtgatgctacttgacttcatacagcacattatgaagtcgtcccccttaatgttcgtaaacgtgtcaggcagtcatgaggcaaaggggagctgtatcgaatttagcaactggattatcactagactcttgcgaattgccgctaccccgagttgccatcttcttcataaaaaaatttgcgaggtcatttgtagtcttctcttcctctttaaatccaagtcaccagcaatttttggagtgctgactaaggagttgcttcagctgttcgaggacctggtttacctgcataggagaaacgtgatgggacacgccgtggaatggccagtggtgatgagccgattcttgtcccagctcgatgaacacatgggatatctgcagtctgcccctctacagctgatgtccatgcagaacctcgaatttatcgaagtaacgctgctgatggtgttgacacgaattattgcgatcgtttttttcagaagacaggaactgctgctgtggcagattgggtgtgtcctgcttgagtacggctcacccaagatcaagagcctggccatttcttttttgacagagctttttcagctcgggggactccctgcgcaacctgcgagtacctttttctctagttttctggagctcctcaaacatctggtcgaaatggataccgatcagctcaaattgtatgaggagcctctctcgaaactgataaagactctcttcccatttgaagctgaagcctatcggaatatagagcctgtttacctgaacatgctgctggaaaagctgtgtgttatgtttgaagacggtgttctgatgaggctgaagtctgatctgttgaaggctgcactgtgccacttgcttcaatatttcttgaaatttgtaccagctggttatgaatcagctttacaagttcgcaaggtgtacgtacgaaacatttgcaaggcactgctggatgtcctgggcatcgaggttgacgctgagtatttacttggacccctctatgccgctttgaagatggaaagcatggaaattattgaagagatccagtgtcagactcagcaggagaacctgagcagcaactccgacggtatctcccctaaacgcaggagactcagtagttctttgaacccatctaaaagggccccaaagcagactgaagatagaacatttaaggactgtcagcataagtctaagaagaagcccagtgtcgtaatcacctggatgagcctcgatttctatacgaaagtcttgaaaagctgtcgatcgttgctggaaagtgtacagaagctggatttggaggccacaatcgataaggtggtgaagatctatgacgccctaatatatatgcaggtcaactcatcgttcgaggaccatatcctagaggatctttgcggaatgctgagtctgccttggatttatagccattctgatgacggctgcctgaagctgactacctttgccgcaaacctgctgaccttgtcgtgtcgtatatctgacagttacagcccacaggctcaatcacggtgcgtgttcttattgactctttttccccgtaggatctttctagaatggcggaccgctgtctacaactgggctcttcagtcctcccacgaggtgatacgcgcttcatgcgtttcaggatttttcatcctgttgcagcagcaaaacagctgtaaccgggtgccaaaaatcctgattgacaaagtcaaggacgactcggacatagtcaagaaagagttcgcaagtattcttggacagctggtgtgtactctgcacggcatgttttacttaacttcttcacttactgagcccttttccgagcatggacacgtcgatctgttctgtcggaatttgaaggccacttcacagcatgagtgcagctctagccaactgaaggcttcagtttgcaagcctttcttgtttctgttgaaaaagaagatcccctctcctgtaaaactcgccttcattgacaatctgcaccatttgtgtaaacacctggactttcgagaggacgagaccgatgtgaaagctgttctcggtactctgttaaacctcatggaggacccagacaaggatgtgcgcgttgcattcagtgggaacatcaaacatatacttgagtccctcgattctgaggatggcttcattaaggaactgtttgtgctaaggatgaaagaagcttacacacatgcccagataagcagaaataatgagctgaaagatacactgattcttacaactggtgacattggcagagcggctaagggagaccttgtgcctttcgccctcctgcatctgctgcactgcctgctgagcaagagtgccagtgtcagtggggctgcatacactgaaattcgggctctcgtcgccgcaaaatcggtgaagctgcaaagctttttcagccagtacaaaaagcctatttgccagttcttggtggagagtctgcattcatcccaaatgactgctcttcctaataccccttgtcaaaatgcagatgttcggaagcaggacgttgcccaccaaagggaaatggccctcaatacactgtccgaaattgccaacgtgttcgactttccagatcttaacaggtttcttaccaggacgctgcaggtgttactacccgacctggcagcaaaagcgtcccctgccgctagcgcactaatccgaacccttggcaagcagttgaacgttaatcgtagagagatactaattaacaacttcaaatatattttctctcacctggtgtgtagttgtagcaaagatgaactggagcgtgcattacactatcttaaaaacgagaccgaaatcgagctgggcagtctcctgcgccaggactttcagggtctccacaatgagttactcttgcgtatcggtgaacactaccaacaagtatttaacggtctgtccattctcgcttccttcgcttcttctgacgacccatatcaaggacctagagatataatcagtcccgaactaatggccgattatctccaaccaaaattgctgggcatcttggcattcttcaacatgcagttgctgtctagctccgtgggaatcgaagacaaaaagatggcattgaatagtcttatgtctttgatgaagctgatgggtcccaagcatgtgtccagcgtcagagtgaagatgatgaccaccctgagaactggccttcgcttcaaagacgacttccctgagctgtgttgcagagcttgggattgcttcgttagatgtctggatcatgcctgcttggggtccttattgtcccacgtgatcgtggccttgttgcccctaatccatatccagcccaaggagactgcagcaatttttcattatttaatcattgagaatcgggatgcagtccaagacttcctgcatgagatttatttcctgcctgaccaccctgagttaaaaaaaattaaggccgtgctgcaagagtataggaaagaaacgtctgagtctacagacctgcagaccactctgcagttgtcgatgaaagcgattcagcatgagaatgtggatgtgagaatccacgcactgacatcgctgaaggaaacgctctataaaaatcaagaaaagttgattaaatatgccaccgattctgagaccgtggaacccatcatttcacagctggtgacagtgctcttgaaggggtgccaggatgccaactctcaggcacggctcctatgcggcgagtgcctgggagagctcggcgcaattgaccctggaagattggatttctctactacagagacacaggggaaggacttcacatttgtgaccggagtggaggattcctcctttgcatacggactgttgatggagctgactcgcgcttacctcgcctacgctgacaacagtagggcacaggacagcgctgcctacgcgatccaagagctcttgagcatttacgattgtagggagatggagactaacggcccaggtcaccagctctggcgacgcttcccagaacacgtccgagagattctggagccgcacctgaacacaagatataaatccagccagaagagcacagattggagcggggtgaagaagccaatttacctgtcaaagctcgggtcgaattttgccgaatggagcgcatcgtgggccggatatctcatcacaaaagtgcggcatgacttagcgagcaagatctttacctgctgttccatcatgatgaaacacgatttcaaagtgaccatctatttactcccccacatcttagtatacgtcctgctcgggtgcaaccaggaggaccagcaggaggtctacgccgagattatggccgtgctgaaacacgacgatcaacataccatcaatacacaagatatcgccagcgacctgtgtcaactgtcaacccagacagtgttttctatgcttgaccacttgacccagtgggcaagacacaaatttcaggccctcaaggccgaaaaatgtccccactcgaagtctaataggaacaaagtggattctatggtcagcacagtggactatgaagactaccagagtgttaccaggtttttagacctcatcccccaggacacattagctgtcgcttcttttcgttcaaaggcctatacccgggcagtcatgcattttgagtcattcataactgaaaaaaaacaaaatatccaggagcacttggggtttttgcagaaactttacgcagccatgcatgaacccgacggcgtcgcaggcgtctctgccattagaaaggcggagccttctttgaaagagcagatcctggagcacgaatcactcggcctcttacgcgacgcaaccgcttgctacgacagggctatacagctggagcctgatcagataatccattatcacggtgtagtcaaatcaatgctcggacttggccagctgtctaccgtgatcacccaagttaacggagtgcacgcaaatagaagcgaatggacagatgagttgaacacctacagagtggaagctgcctggaagctctcccagtgggacctagtcgagaactatctagccgcagacgggaaaagcaccacctggtcagtcagactggggcagctcctgctgtccgctaagaaaagagatatcaccgctttttatgattccctgaaactggtacgcgctgaacagatagtcccattgtctgcagcttcatttgagagagggtcttatcaacgtggctacgagtacatcgtgcggctgcatatgctttgtgagttggaacactctataaaaccgctctttcagcactcccctggggactcaagtcaggaagactctctcaattgggtggcacggctggaaatgacacagaactcctaccgcgctaaagaacctattctggctttacgaagagcacttctgagtctgaataagagacccgattataatgagatggtgggcgagtgttggctgcaatccgcaagagtggcccgtaaggccggacaccaccagaccgcgtacaacgcactcttaaatgccggagagtctcgtctggccgaactgtacgtagagcgcgcaaagtggctgtggtcaaagggggacgtccaccaggccctgatcgtgctgcaaaaaggggtagagctgtgtttccccgaaaacgagaccccccctgagggcaagaatatgctgatacacggcagggcaatgctgctcgtgggcaggttcatggaggaaaccgctaattttgagtcaaacgccataatgaaaaagtataaggacgttacggcctgtctgcccgagtgggaggatggtcacttttacctagccaagtattacgataagctgatgccaatggttaccgataataagatggagaagcagggggatctgatacggtatattgtactgcacttcggtagatctctgcagtacggcaatcagttcatttaccagtctatgcctcggatgctgaccttatggttggactacggtaccaaggcatatgagtgggagaaggcaggccgatcagatagggtccagatgagaaacgacctggggaagattaataaagtgatcacggagcacacgaattatctggcaccataccagttcctgacagcgttttctcaacttattagtcggatctgccatagccacgacgaagttttcgtagttctgatggaaatcattgcgaaagtattcctggcttaccctcaacaagcaatgtggatgatgactgcagtgagtaagagttcctaccccatgcgggtaaataggtgcaaagaaattctgaataaagcgatacacatgaaaaagtcattagagaagttcgtcggggacgctacgcgtctgactgacaaacttctggagctgtgtaacaagcctgtcgacgggagttctagcaccctgtccatgtcaacccacttcaaaatgctaaaaaagctggttgaggaggctactttttcggagatactgattcctcttcagtctgtgatgatcccaacgctaccgtccatcttaggtacccatgccaaccacgcctcacatgagccatttcccggacactgggcgtacattgccggttttgacgacatggtggagatccttgcaagcttgcagaaaccgaaaaaaatttccctcaaggggagcgatggaaagttctacattatgatgtgcaagcccaaggatgatctacggaaagactgtagattgatggagtttaactccctgattaacaaatgtttacggaaggacgcagagtctaggcgtagagagctccacattaggacctatgccgtcatacccctgaatgacgaatgtgggatcattgagtgggtgaataacacagccggtctgagacctatactgacgaagctctataaggagaaaggcgtatatatgacgggaaaggagctgcgacagtgtatgctcccaaagtcggcagcgctgtcagagaagctgaaagtgtttcgcgagttcctccttcctcggcatcctcctatcttccacgaatggttcttacgcacttttccagatccgacctcttggtattcaagccgaagtgcctattgccgaagtactgcggtgatgtccatggtggggtacatactgggtctgggagatcgccatggggagaatatcctgtttgactccttgacaggcgaatgtgtgcatgtagacttcaattgcttgtttaacaagggggagacctttgaagtccctgagatcgtgcccttccgcttgacacacaacatggtcaatggcatggggcctatgggaacggagggcctcttccggagggcttgcgaagtgaccatgcgcttgatgcgcgatcagcgagaacctcttatgtccgtgctgaaaacgtttctccacgatcctctggtggaatggagcaagccggtgaagggtcacagtaaggccccactgaatgaaacaggagaagtggtgaatgaaaaagccaagacacacgttttggatatcgaacagcggttacaaggagtgattaagacgaggaaccgggtaacaggccttcctctttcaattgagggccacgttcactatctcattcaagaggctactgacgagaatctgctgtgccagatgtatctcggttggaccccatacatgta

SEQ ID NO: 27365 - DNA, 9171 bp, Artificial Sequence
  Description of Artificial Sequence: Synthetic coding sequence
atgagtctggtgttaaacgacctgctaatctgctgccggcagcttgaacacgacagagctaccgaaagaaagaaagaggtggagaagtttaagaggctcatcagggacccagagactataaagcacctcgatcggcacagcgattccaaacagggaaaatatttgaactgggacgctgtgttcaggtttcttcagaaatatattcaaaaagagaccgagtgtctgcggattgcaaagcccaatgttagtgcgtcaacacaggcaagcaggcagaagaagatgcaggaaatcagttccctggtaaaatattttatcaagtgcgcaaaccggcgtgcccctagactgaagtgtcaggagctgctcaattatattatggacacagttaaggacagttccaatggagccatctacggggctgattgttccaatatcctcctgaaagacatattatcagtgcgaaaatactggtgcgagattagccagcagcagtggctagagctgttctctgtctacttccggttatacctgaagcccagccaggacgttcacagggtgctggtggccaggatcatccacgcagtgaccaagggctgctgcagccagactgacggattaaatagtaagtttcttgacttttttagcaaggccatccagtgtgcccgacaggagaaatcatcttcgggcctgaaccacatattggccgctttgacaatctttcttaaaacattggccgtgaattttagaatcagggtttgcgagcttggcgatgagatactgccaacgctgctatatatctggacgcagcataggcttaatgattctttgaaggaagtgataatagagctgtttcagttgcagatatacatccaccaccccaagggggctaagactcaagaaaagggggcatacgaatcaaccaagtggcgatctatactgtataacctctatgacctcctggtgaatgaaatctcccatatcggttcccgcggtaagtactcaagtggcttcagaaacattgcggttaaggaaaatctgattgaactgatggccgatatatgccaccaggtgtttaacgaagacactagatcactggagatctcgcagagttacactacaacccagcgggaatctagcgactattctgtgccatgtaaacgaaagaagatagaacttggctgggaggtaatcaaggatcacctacagaaaagtcagaatgatttcgatctcgtgccttggctccaaattgcaactcaactgattagcaaataccccgcatcactgcccaactgcgagctgagtcccctgctgatgatcctgagccagctgctgccgcagcaacgtcacggcgagcgaaccccatacgttctccgttgtcttaccgaggtggccttgtgtcaggataaaaggagcaaccttgagtcttcccagaaaagcgatctgctgaaactgtggaacaaaatttggtgcatcacctttcgaggtatcagcagtgaacagattcaggctgagaacttcggcttattgggcgcaatcatccaggggagtcttgtagaggtggatcgggagttttggaaactgttcactggcagtgcctgccggccttcttgccctgctgtgtgttgcctgacacttgccctcaccacgtcaatagtgccgggaaccgtgaaaatgggtatcgaacagaatatgtgcgaagtcaaccgcagcttcagccttaaagaatcaatcatgaaatggctgctgttttatcagctggagggggatctggaaaactcgacagaagtgcctcctattctgcacagcaacttcccacatctggtgttggaaaagatccttgtgtccctgaccatgaaaaactgtaaagccgctatgaattttttccaatctgtgcctgagtgtgaacaccaccagaaggacaaggaagaactgtcatttagtgaagtggaggaactatttctgcagacgacatttgataagatggactttctgaccatcgtgcgagaatgtgggattgaaaaacatcagtccagcattggattctccgtccatcaaaacctgaaggagtcacttgataggtgtctgttaggattgtccgaacaactactcaataactattcttccgagattaccaactcagaaacgttagtacgctgtagtaggctgcttgtgggcgtgctgggctgctattgttacatgggcgtgatcgccgaggaggaagcctataaatccgaactgtttcagaaagcaaagagtttaatgcagtgcgccggagagtccatcaccctatttaagaacaaaacgaacgaggagttccgcatcggttccctccggaacatgatgcagctgtgcaccaggtgcctgtcaaattgtacaaagaaatctcccaacaaaatcgcctccggattcttcttacggctccttacaagtaaactgatgaatgacattgctgatatttgcaaatcactggcttctttcatcaagaaaccttttgatcgaggggaggttgagagcatggaagacgataccaatgggaatttaatggaagtggaggaccagagttctatgaatctctttaatgattaccctgactcatctgtatccgatgctaatgaacccggagagtcccaaagtaccatcggcgctatcaatcctctggccgaggagtacctctcgaagcaggatcttctcttcctggacatgctgaaattcctgtgcctgtgcgtcacaaccgctcagacaaacaccgtctcgtttcgggcagccgatatacgcagaaaactcttaatgttgatcgattccagcacccttgagccaacaaagagcctgcacttgcatatgtaccttatgctgctcaaggaactgccaggcgaggagtaccctctacccatggaggatgtgctggagctcctcaaaccactgagcaatgtctgttcactttacagacgagaccaggacgtgtgtaagacaatcctgaaccacgtccttcacgtggtgaagaatctgggacagagcaatatggatagtgagaataccagggatgctcaaggacagtttctgactgtgatcggtgcattttggcacctaaccaaggaacggaagtacatatttagtgttagaatggcactggtgaattgcctgaaaacacttcttgaagccgacccctattcaaaatgggccatcctcaacgtgatgggcaaggattttcccgtcaatgaagtgttcactcaatttctcgctgataaccaccaccaggtcaggatgctcgccgcagaatcaatcaacagacttttccaggacaccaagggagatagttccaggctccttaaggccttgcctctgaaacttcaacagaccgcatttgagaacgcatacttgaaggcgcaggaaggaatgagggaaatgagtcactccgcggagaaccctgaaacgctcgatgaaatctacaataggaagtccgtgctcctcaccctaattgctgtagtgctctcttgcagccctatttgcgagaaacaagccttgtttgcactctgcaagtccgtgaaagaaaacggattagagccgcacctggtaaagaaagtcctggagaaggtgagcgagacatttggctatcgtagactagaagactttatggcatcccacctggactacctggtacttgaatggctgaacctgcaggatactgagtacaacctttcctctttcccgttcatcttattaaattacacgaacatagaggatttctaccggagttgttacaaagtgttaattccccaccttgttatccgtagccacttcgacgaggtaaaatctatcgccaaccaaatccaggaagattggaaatctctgctaactgattgctttccaaaaattcttgttaacatccttccctatttcgcctacgagggcacaagggactccggcatggcgcagcagcgggagaccgcaacgaaggtttacgacatgcttaaaagcgagaaccttcttggcaaacagattgaccatcttttcatcagcaacctgcccgaaatagtggtagagttgctgatgactctgcatgaacccgcaaatagctctgcctcccagagtaccgacctctgtgatttctctggtgatctggatcctgctccaaatcctccgcacttcccctctcacgtgatcaaggccacttttgcctatatctctaactgccataaaacaaagctgaagtcaattctggaaatactgtctaaaagccctgattcttatcagaagatcttgctggccatctgcgagcaggctgcagaaactaataacgtctacaaaaagcacagaattctcaagatctatcacctttttgtaagccttttactaaaagatattaagagtggactgggcggagcttgggcatttgttctccgtgacgtaatttataccttgatacactacatcaaccagcgtcccagttgtattatggacgtctcgctgcgcagttttagtttgtgctgcgacctgctgtcccaagtttgtcagaccgcggttacctactgtaaggatgcgctagagaatcaccttcatgttatcgtcggaacactaatcccgctggtctatgagcaggtggaggtgcagaagcaggtgctagatttgctcaaatacctggttatagataataaagataatgagaatttgtacataaccatcaaactgctagacccctttcccgaccatgtcgtgttcaaggatttgagaattacccagcagaagattaagtatagcaggggccctttttccctccttgaagagataaatcacttcctctctgtgagcgtatacgacgccttgcctcttaccaggctagaaggcctgaaagacctgcgtagacaactggagttgcacaaagatcagatggtcgatatcatgagagcgagccaggataatccgcaggatggaataatggtcaagctagttgtcaatctgctgcagctgtccaagatggccattaaccatactggggaaaaagaggtgttggaggcggtaggcagctgtcttggagaggtggggccaatcgacttctcaactattgccatccagcattctaaagatgcctcttataccaaagctctaaaattgtttgaggacaaggagctgcagtggacatttataatgttgacctacctcaataacactcttgttgaggactgcgttaaggtccgatctgcggctgtcacttgtttgaagaatatccttgctacaaagacaggccacagcttctgggagatctacaagatgaccaccgatccaatgctggcgtacttgcaaccatttaggacttcccgcaaaaagttcttggaggtacctcggttcgataaggagaaccccttcgaagggctagatgatattaacctctggattcctctctccgagaaccatgatatctggatcaagacgctgacctgcgctttcttggacagcgggggaacaaaatgcgagatcttacagcttctgaaacccatgtgcgaggttaaaaccgatttttgtcagacagttctaccatacctgatacacgacattctactgcaggatacaaatgaatcctggagaaatctgctgtccacacacgtccagggattcttcacttcctgcttgcggcatttctcccagacctctcgcagcacaacaccagccaatctcgattctgagtctgagcattttttccgctgttgtttagacaagaaaagtcagcggactatgctggccgtagtcgactacatgaggagacagaaacgtccatcctctggaactatctttaatgacgcattctggttagacttgaattatttggaagttgctaaggtggcccagagctgcgcggcacactttacagcattattgtatgctgagatctatgccgacaagaaaagtatggatgaccaggagaagagaagtcttgcattcgaggaaggatctcagaataccactatctcctctttgagcgaaaagtctaaggaggagacaggcatatccttgcaggaccttctgctggaaatctaccgtagcattggtgaaccagatagtctctatgggtgcgggggaggcaaaatgctgcagcctatcacccgccttcggacctacgagcatgaggccatgtggggaaaagcacttgtcacctatgacttggagaccgcgattcccagcagtactcggcaggccggtattattcaggcactacaaaacctggggctctgccatattcttagcgtctatctcaaaggtcttgactatgaaaataaggattggtgtccggagcttgaggagctccactatcaggccgcttggagaaatatgcaatgggatcactgtaccagcgtctctaaggaggtggaagggacctcttatcacgagagcctgtacaacgcgctgcagagtctgcgggatagagagtttagtaccttctatgagagtctgaagtacgccagagtgaaggaggtggaggagatgtgcaagcgctccctggaatctgtctattcactatacccaaccctttcacggctccaggccatcggtgagctggaatctatcggggaacttttctcaagatccgtcactcacaggcaactgagcgaggtgtatatcaaatggcagaagcattctcaactgttaaaagatagtgattttagtttccaggaaccaattatggcgctccgaactgtgatactggagattttgatggaaaaggagatggacaatagtcagcgtgagtgcatcaaagacatattgactaaacatctggtggaactgtctatcctggccagaactttcaaaaatacccagttacctgaacgggctatcttccagattaaacaatacaattccgtcagttgcggcgtctctgaatggcagctcgaggaagctcaggtgttctgggcgaaaaaggagcagtcattggccctcagtattttaaaacagatgatcaaaaaacttgatgcgagctgtgcagccaataacccatcgctgaagctgacctacacggagtgtcttagagtctgtggaaactggctggcggaaacctgcctggagaatcccgctgtaattatgcagacatatctggagaaggcagtggaggtagccggtaattacgacggggagtcaagtgacgagctccggaatgggaagatgaaagccttcctgtcccttgcacgctttagcgatacgcaataccagcgcatcgaaaattacatgaagagttctgaattcgaaaacaagcaagccttgctaaaaagagccaaagaggaggtgggcctgttacgggagcataagatccagactaacagatatactgtgaaagtgcagagagagttagagctggatgaactcgccttacgcgctctgaaggaggaccgcaagcggtttctgtgcaaggccgtggagaattatattaattgccttctctccggtgaggagcatgatatgtgggtcttccgcctctgttccctctggctcgaaaactctggcgtgtccgaggtcaacggaatgatgaagagggatggtatgaaaatccccacctacaaattcctgcccctcatgtaccagctggctgctcgtatgggcaccaaaatgatggggggtctaggctttcacgaagtactgaacaatctgatttctaggatctctatggatcatccgcaccacaccttgttcattattttggccctggcgaacgctaatagagacgagtttctgactaaacccgaggtggcgcgacgatctagaattaccaaaaatgtgcccaagcagtcatctcagcttgatgaagatcgaacagaagctgctaacaggatcatctgtaccattaggagccggcgaccacagatggttcgatctgttgaggcactgtgcgatgcatacatcattctggccaacctggatgccactcagtggaagacacagcgcaaggggatcaacatacctgccgaccaaccgatcaccaagctaaagaacttagaagacgtggtggtgccgacaatggaaattaaagtcgatcataccggcgaatacgggaatctggtgacaattcaaagcttcaaggcagagtttcgcctggccggtggtgtcaacctgcccaaaattatcgactgtgtcggctcagacgggaaggagcgtcggcaactggtcaaaggtcgagacgacctgcgccaggatgccgtgatgcagcaggtttttcagatgtgcaatactctactgcagcgtaacacagagaccaggaagaggaaacttacgatttgcacctacaaggtggtgcccctgtcacagcggagcggtgtcctggaatggtgtacaggaactgtgcctatcggcgaatttttggtcaacaatgaagatggcgctcataaacgttatcgacccaacgatttctccgcctttcagtgccagaagaaaatgatggaggtgcagaagaagtcctttgaggaaaagtacgaggtgtttatggatgtgtgtcagaactttcaacccgttttccggtatttttgtatggagaagtttttagaccccgcaatatggtttgagaaacgcctcgcctatactcgcagtgtcgcgacgtcttctatcgtgggatatatactaggcctgggagaccgtcatgtgcagaacattttaatcaatgaacaatctgcggagctggtccacatcgatctgggcgtggccttcgagcagggaaagatcctgccaacaccagagaccgtacccttccggctgactcgagacattgtggacggtatgggaatcaccggcgtcgagggagtgtttcgcaggtgctgcgagaagacaatggaagtaatgcgaaattcccaggagacactgcttactattgtcgaggtgctgctgtacgaccccctgttcgactggacaatgaaccccctaaaggcgctttacttacagcagcgcccagaagatgagactgagctccaccctaccttgaacgccgatgaccaggaatgtaagaggaatctcagcgatattgaccaaagctttaataaggtcgccgaaagagtcctgatgaggctgcaggaaaaactcaaaggagtggaagagggaaccgtactgagcgttggcggacaggtgaatttgctcatccaacaagctatcgatcctaaaaacctgtctcggctgtttcctggatggaaggcatgggtatac

SEQ ID NO: 27366 - DNA, 417 bp, Artificial Sequence
  Description of Artificial Sequence: Synthetic coding sequence
atgacccttcacgaacctgcaaactcaagtgcctcacagtccactgacttgtgcgatttttcaggggacctggacccagctcctaaccctccccacttcccgtcacacgtgataaaagccacattcgcttacatcagcaactgtcataagaccaaactcaaaagcatactcgagattctgtccaagagtcctgactcctaccaaaagatcctgctcgccatctgtgaacaagctgcagagaccaacaatgtttataaaaagcaccgcatcctcaaaatataccacctctttgttagtctgctccttaaggacatcaaaagtggtttaggaggcgcttgggcctttgttctccgggacgtgatttatacccttatacattacatcaatcagagaaaactaactatattcagtcaatag

SEQ ID NO: 27367 - DNA, 9170 bp, Artificial Sequence
  Description of Artificial Sequence: Synthetic coding sequence
atgtctctcgtgttgaatgacctactaatctgctgccgccagttggagcacgacagggccacggagagaaagaaggaggtggagaaattcaaaagactcattcgcgatcctgaaacaatcaagcacctggaccgccacagcgattcaaaacaaggcaaatatctgaattgggatgctgtgttccgatttttacagaagtacatccagaaagaaaccgagtgcctacgtatagccaagcccaacgtgtcagcttctacccaagcatcacgccagaaaaaaatgcaagagatttcaagtctggtcaagtatttcattaagtgcgctaacaggcgtgcccctcggctcaagtgccaggaactgttaaactacatcatggacactgtgaaggactccagcaatggcgcaatatatggtgccgattgtagcaatatcctgttgaaggatatcctcagcgtgcggaaatactggtgcgagattagtcagcagcagtggctagagctgttttctgtgtacttccgtttgtatctaaagccctcacaggatgtccaccgggtccttgtcgcacgtataatccacgccgtgaccaaaggctgctgcagccagaccgacggcttgaacagcaagttcttagacttctttagcaaggccattcagtgcgctcgccaggagaagtctagttccggacttaaccatatcctggcagcccttactatcttcttaaagacccttgccgtgaattttcggatccgggtttgtgaacttggggatgagattctgccaacccttctctacatttggacccaacaccgcctcaatgattcactgaaggaggtgatcatagaactgttccagctgcagatttacatacaccatccaaaaggggcaaagacacaggagaagggcgcttatgagagcacaaagtggcgatctatcctttacaacttatatgatttgctcgttaatgaaatcagccacatcggatcacgtggtaagtatagctctggattccgaaatattgctgtaaaggaaaacctgatcgagctgatggctgatatttgccatcaggttttcaatgaagacactagaagtctggaaatctcccaatcctataccactacccagagggagtcatcggactacagcgtgccatgtaaacgcaaaaaaattgagctgggctgggaagttattaaggatcaccttcagaaatctcagaacgatttcgacttggtaccttggttgcagatcgccactcagttgatatcgaaataccccgcatcattaccaaattgtgagctttcaccacttcttatgattctgagccagctgctgccgcagcaaaggcatggcgaaaggactccgtacgtgctacgttgtctgacagaggttgctctttgccaggacaaacggtcgaatcttgagagcagccagaaatccgacctgcttaagttgtggaacaagatctggtgcataacattcagagggatttcctctgagcagattcaagcagagaactttggcctgctaggagctatcatacagggaagtctggttgaagttgacagggagttctggaaactgtttacaggaagcgcgtgcaggccaagctgcccagccgtctgctgtctgactttggcgctgactaccagcattgttcccggaactgtgaaaatggggatcgaacagaacatgtgcgaagtgaaccgttctttttccctgaaggagagtatcatgaagtggctgttgttttatcaattggaaggggacttggagaactccactgaggtcccccctatcctgcatagcaactttcctcacttagtgctggagaaaattctcgtgtccctgacgatgaagaattgcaaggccgctatgaactttttccagtctgtgcccgaatgcgagcaccatcagaaggataaagaggaactgagcttttccgaggttgaagaactctttctgcagacaacgttcgacaagatggacttccttacaattgttagggagtgcgggatcgaaaaacaccagagcagtattgggttcagcgtacatcagaaccttaaagagtctcttgatagatgtctgttggggctcagcgaacaactgctaaacaactactcttcagaaattaccaatagcgagaccctcgtgaggtgttccaggctcctggttggagtgctgggctgctactgttacatgggagtgattgcagaggaggaggcctacaagtcagagcttttccagaaggcgaagagtctcatgcagtgcgcaggagagtctatcacactctttaaaaataaaacgaatgaagaatttagaataggatccctccgaaatatgatgcagttgtgcaccaggtgtctttccaactgtaccaaaaaaagtccaaacaagattgccagtggcttctttctaagactcctgacatcaaaactcatgaatgatattgctgacatttgtaaatctttagcgtcctttatcaagaagccctttgataggggtgaagtcgaaagcatggaggatgacacaaacgggaacctcatggaagttgaggaccagtcttccatgaacctttttaacgactacccagactcttcggtctctgacgctaacgaaccaggcgagtcccagtcaaccataggagccataaatcctttggccgaggagtatctctctaaacaggacttgctgtttttggacatgcttaaattcctgtgcctttgcgtcacaaccgcccaaaccaatacggtctcgtttagagccgctgatatcaggcgtaaactactcatgctaatagactccagtaccctggaaccaaccaagagcttgcatctgcacatgtacctgatgttattaaaggaactcccaggcgaagaatacccactgccgatggaggacgtgctggagttactgaaacccctgagtaacgtttgctccctttacaggcgagatcaagacgtttgcaagacgatcctcaaccatgtattgcacgtagtgaaaaacctgggtcagtccaacatggatagcgaaaatactagagatgctcagggacagttcctgaccgtgatcggtgctttttggcatctaaccaaggaacgaaagtacatctttagcgtacgaatggcccttgttaactgcctgaagacactcctggaggcagatccttacagtaaatgggcgatcctgaatgtgatggggaaggattttcccgttaacgaggttttcacccaattccttgcagacaatcaccaccaggtgcggatgctagcagcagagtcgattaatcgactcttccaggacaccaaaggcgactcaagcagattgctgaaggctcttcccctgaagctgcagcagaccgctttcgagaacgcttatctgaaagcccaggaaggaatgcgggagatgtcacacagcgcggaaaaccccgaaacgctagacgagatttacaaccgcaagagcgtcctgctgacactcatagctgtcgtgctgtcatgttcaccaatctgtgagaagcaggccctctttgctctctgcaagtctgtcaaggaaaatggcctggaacctcatttggtgaaaaaggtcctggagaaagtgtctgaaactttcggataccgcaggctcgaagatttcatggcatctcacctcgactatctcgtgctggaatggctcaatctgcaggataccgaatacaatttaagtagcttccctttcatcctgcttaactatactaatattgaggatttctacaggtcatgttataaggtcctgattccacacctggtcatcaggtcccacttcgatgaggtgaagtccatcgcaaatcagatccaagaagattggaaatcgctcctgacggattgctttccgaaaatccttgtcaatatattaccatatttcgcgtatgaaggcacacgggattccggcatggctcagcagagggagacagctactaaggtgtacgatatgctcaaaagcgaaaacctgctgggaaagcagatagatcacctgttcatctccaacctgcccgagattgttgtggagttactaatgacgctgcacgaacctgccaactccagcgccagccagtccaccgacctgtgcgattttagtggagacctagatccagctcctaaccccccacacttcccctcccacgtcatcaaggctacattcgcatacatcagtaactgccacaagactaaactgaagagtattctggaaatcctaagcaaatcccctgactcctaccagaagatcctattagctatttgtgaacaggcagcagaaactaataatgtgtacaagaaacatcggattctcaagatctaccatttattcgtgagcctgttgctcaaagacattaaaagcggtctgggaggcgcttgggcattcgttttgagagacgtgatatacacacttatacactacataaatcagaggccttcttgtataatggatgtgagcttgagaagcttctccctgtgctgcgatcttctgtcccaggtgtgtcagaccgccgttacctattgcaaggacgcgctggagaaccacctgcatgtgatcgttgggacgctcatccctctagtctatgaacaggttgaagttcagaaacaggtgctggatttgcttaaatatctggtcatcgataataaggacaatgaaaacctgtacattaccattaaactgcttgacccattccctgaccatgtagtctttaaagacctgagaatcacccagcagaaaatcaagtattcccgcggacctttctctctgctagaagagatcaaccatttcttgagtgtaagtgtgtacgacgcgttgcccctaacaagactggaggggctcaaggatctgaggcgtcagctcgaacttcacaaggaccagatggttgatattatgcgcgctagtcaggacaacccccaagacgggataatggtgaaactggtagtgaatctgctacagttatcaaaaatggccattaatcataccggcgaaaaagaggtgttggaagccgttggaagctgtctcggcgaagtcggccctatcgacttcagcaccatcgctatccagcactctaaagatgcctcatataccaaggcactgaaactgtttgaggacaaagagcttcagtggacgtttattatgctgacttatctgaataatactttggttgaagactgtgttaaggtaagatctgcggctgttacgtgcctgaaaaatatccttgcgacgaaaaccggacattctttctgggagatctataagatgacgactgatccaatgctcgcctacctccaaccgtttcgcacaagcagaaagaaattcttggaagtcccccgattcgacaaggaaaatccgttcgagggcttagatgatattaacctatggatccctttaagcgagaatcacgacatctggatcaaaacactgacgtgcgccttcctggattcggggggtactaagtgtgagattctccagctgctcaaacctatgtgtgaggtgaaaacagacttctgtcagactgtattaccctacctgattcatgatattctgttacaggataccaatgagagttggcggaacctcctcagtacgcatgtgcagggattctttacctcctgtttgcgccactttagtcagacctctcgttccaccacaccagcaaatctggattcagagtcagagcacttctttaggtgttgcttagacaagaagtcgcaacggactatgctcgcggtggttgactatatgcgaagacagaaacgcccatccagcggaacaattttcaatgacgccttctggctcgatctgaactacctcgaggttgctaaagtagctcaatcctgcgccgctcacttcacggccctcctatacgcagaaatatacgccgacaaaaaatcaatggacgaccaggagaagaggtcactggcgttcgaagaaggatcgcaaaacacaaccatatcatcactctcggaaaagagcaaggaagagaccggtattagccttcaggatctactgttggaaatctaccgaagtattggggaaccggacagtctgtatggctgcggtggcggtaagatgctgcagccaataacccgattgcggacttatgagcacgaggcaatgtgggggaaagcacttgtcacttatgacctcgagacagctattccatccagcactaggcaggccggaataatacaagctctgcagaatcttggtttatgccacattttgtctgtctacctgaaaggtctcgactatgaaaataaggattggtgcccagaactggaggagctgcactaccaggcggcatggcgcaacatgcagtgggaccattgtaccagtgtgtccaaggaagtcgaaggtacaagctaccacgagtctctatataacgccctgcagagcctgcgggaccgggagttcagcactttttacgaatctctcaagtacgcaagagttaaggaggtggaggagatgtgcaagagaagcttggaaagcgtgtatagcctgtacccaacacttagtcgccttcaggccataggcgagctggagtctattggcgagttgtttagtcgcagtgtgactcacagacaactctcagaagtgtacatcaaatggcagaaacatagtcaactcctaaaggattccgatttctcgtttcaggaacctatcatggctttgcggacagttatactggagattctgatggagaaggaaatggacaacagccagcgcgagtgcattaaagacattttgaccaaacacttggtggagctttccatcttagctaggacttttaagaatacccaactcccggaacgtgccatcttccaaattaagcaatacaactctgtctcttgcggcgtgagcgagtggcaattagaggaggcacaggtcttctgggccaagaaggaacagagcctggctttatctattcttaagcagatgattaaaaagctggatgccagttgtgccgctaataaccccagtttgaagttaacttacaccgaatgcttgagggtgtgcggaaactggctggctgagacttgcctcgagaatccggcagtgatcatgcagacctatttagaaaaggctgtggaggtcgcagggaactacgacggtgaatcatccgacgagctcaggaatggcaagatgaaagcatttctcagcctggcgagattttcagacacacagtaccagcgcatcgaaaattatatgaagtccagcgagttcgagaataaacaggctctcttgaaaagagctaaagaagaggtcgggctcttgcgcgagcacaagatacagaccaaccgttatacagtgaaggtccagcgtgagttggagctggacgaattagctctgcgtgctctcaaagaagatcggaagaggttcctgtgcaaggccgtggagaactatataaactgtctgctttcaggggaagaacatgatatgtgggtgtttaggttgtgtagcctgtggctggagaatagtggcgtttccgaggtaaacggtatgatgaaacgggacggtatgaaaatccccacctataaattcttgcctctgatgtaccagctggccgctaggatgggtactaagatgatgggcggtctcggtttccatgaggtgctcaacaacctgattagccgaatctccatggatcacccacaccacactctcttcatcattcttgccctggctaacgctaacagagacgaattcctcaccaaacccgaggtggccaggcgctcccggataaccaaaaacgtgcctaaacaatcctcccaattagacgaagacaggacagaagcagccaaccggattatatgtacaatacggtcaaggaggccccaaatggtgaggtccgttgaggccctctgcgacgcctacatcattctagcaaatttggacgcgactcaatggaagacacaacgaaagggtataaacattccagcggatcagccaattacaaagctaaagaatctcgaggacgttgtggttccaaccatggaaatcaaggtggaccacaccggcgagtatggcaacctggtgactatccagagttttaaggcagaattccgattggccggaggtgttaatcttccgaagatcatcgattgtgtgggctctgacggtaaagagagaaggcagctagtcaagggccgagatgatctgagacaggacgcagttatgcaacaggttttccagatgtgcaataccttattgcagcgcaataccgagaccaggaagcggaaactgactatctgtacttataaagtcgtgcccctatctcagaggagtggcgtgctcgagtggtgcaccggcacagtgcctatcggcgaattcttggtaaacaatgaggatggagctcataagcgctacagaccgaacgatttttctgcattccagtgccagaaaaaaatgatggaagtccaaaagaagtcatttgaggagaagtatgaagtgttcatggacgtgtgtcagaattttcagcctgtattccggtatttttgcatggagaaatttctggaccccgctatctggtttgagaagaggctcgcatacacccgaagcgtcgctacttcatctatcgtgggatatattctgggattaggcgatcggcacgtacagaatatcctgattaatgagcaatctgcagaactggtgcacatcgacctgggggtagcgttcgagcaaggaaaaatcctgccaacacccgagactgtgccttttcgtctcacaagggacatcgtggatgggatgggcatcaccggggtggaaggcgtgtttaggcgctgttgcgagaagaccatggaggtgatgcggaactcacaggaaaccctacttactatagttgaagttctcctgtatgaccccctattcgactggactatgaaccctttgaaggcattgtatctgcagcagcgtcccgaggatgaaaccgagcttcaccccacattaaatgctgacgatcaagagtgtaagcgtaatctgagcgacatagatcagagtttcaataaggttgccgaaagagtgctgatgaggttgcaggaaaaactgaaaggggtagaggagggcactgtcctcagcgtgggcggacaagttaacctactgatacaacaagcaatagatcccaagaatctgtctcgactgtttcctgggtggaaggcctgggtcta

SEQ ID NO: 27368 - DNA, 4110 bp, Artificial Sequence
  Description of Artificial Sequence: Synthetic coding sequence
atgtctctggtactgaatgatctcttgatttgctgccggcagctggagcacgaccgcgctacagaacgtaagaaagaggtggagaaattcaaacggctgattagagaccctgagaccattaagcacttggacagacattctgatagtaagcaaggtaagtacctgaactgggacgccgtgtttcgcttccttcagaagtatatccagaaggaaactgagtgcctccgcattgctaaacccaatgtctccgcctccactcaagctagtagacagaagaagatgcaagaaatttcaagcctggttaagtacttcatcaaatgtgcaaacaggcgggctcctagactgaaatgtcaggagttgttgaactatattatggataccgtgaaggacagttcaaacggcgctatatacggcgcagactgttccaacattctgctgaaggacattcttagcgttagaaaatattggtgcgaaatctcccagcaacagtggctggaactcttttctgtgtacttccggctctacctgaagccttctcaggacgtgcaccgcgtgctggtggcgcgaattattcatgccgtgacgaagggatgctgttctcagactgacggtctgaattcaaagttcctcgacttcttttccaaagctatacagtgcgcaaggcaggagaagagctctagcggtttaaaccacatcctggctgcattaaccattttccttaagactctcgctgtgaatttccggatacgcgtgtgtgagctgggcgacgagatcttaccgactctgttgtatatctggacccagcatcgcctgaatgacagcctcaaagaggtgattatcgagctcttccagcttcaaatctatatacatcacccaaagggcgcaaagacacaggaaaaaggcgcatacgagagtacgaagtggcgaagtatcctgtacaatctgtatgatctactcgtgaatgaaatcagtcatattggctctcgcggtaaatacagctcaggcttccgcaatatcgccgtgaaagagaatctaattgaacttatggctgacatatgtcaccaggtctttaacgaagacacaagatcactggagattagtcagagttacactacaactcagagggaaagctcggattacagcgtgccatgcaagaggaagaaaatcgagctggggtgggaagtgattaaagatcacctacaaaagagccagaatgacttcgacctggtgccatggcttcagattgcgacacaacttatttcgaagtacccagcgtcactcccaaattgcgagctgtctcccctgctaatgattctctcccaactgttaccacagcagaggcacggagagcgcactccatacgtactcaggtgtctgacggaggtggccctttgccaggacaaacgtagcaacctggagagctcccagaagtccgaccttctgaagctgtggaacaaaatatggtgcatcacttttcgaggaattagttctgagcagattcaggccgagaactttggtctgctcggcgcaataattcaggggagcctggtcgaggtggaccgtgagttttggaaactattcaccggcagcgcctgccgcccatcttgtcctgcagtgtgttgcttaaccctggcccttaccacaagcatagtgcctgggacagttaaaatggggattgagcagaacatgtgcgaagtaaacaggagcttcagcctcaaggaaagtattatgaagtggctcctattctatcagctcgaaggtgacctggaaaattccacagaggtaccgccaattctgcactcaaactttccgcatctcgtcctcgagaagatcctcgtgtccctgacaatgaaaaattgtaaggccgctatgaacttcttccagagcgtgccagagtgtgaacaccatcaaaaagacaaggaagaactgtcattctcggaagtggaggaactatttctgcagacgacattcgacaaaatggatttcctaacaatcgtgcgcgagtgcggcatcgagaaacaccagagcagcatcgggttctctgtccaccagaacctcaaagagagcctcgaccgatgtttacttggtctttccgagcagttactcaacaactatagctccgagataaccaacagcgaaacgttagtcaggtgctcacgactattggttggagtgcttggatgttactgctatatgggcgtcatcgcagaagaggaggcttacaagtctgaactctttcagaaggctaagagcctgatgcaatgtgcaggcgagtccatcacactttttaagaacaagaccaatgaagaatttcgaatcgggtctctccggaatatgatgcagctgtgtaccagatgtctcagcaactgcaccaagaagtctcctaacaaaattgcctctggctttttcctaagactgctgacttctaaactgatgaacgacattgccgacatttgcaagtccttggctagcttcatcaagaaacccttcgaccgaggggaagtggaaagcatggaggatgataccaacggcaacctcatggaagtggaagatcagagctctatgaatctctttaacgactaccctgactccagcgtttccgatgccaacgagccaggcgagagccaaagcacgatcggtgccatcaatcccctagccgaggagtatctcagcaagcaagatttgctgtttttagacatgctcaaatttctgtgtctgtgtgtgaccacagcacagaccaatactgtaagctttagggcagcggacatcaggagaaaactactgatgctgattgactcttctacactggagcccacaaagagcctccatctgcacatgtatttgatgcttcttaaggaactgccgggagaggaatacccactgcccatggaggacgtgctggagctgctgaagccgctgagtaatgtgtgctctctttatagacgcgatcaagacgtctgcaagacaattttgaatcacgtgctccacgtggtgaagaatctcggtcaatctaacatggattccgaaaacaccagggatgcccaaggccagtttcttacagtgatcggggcattctggcatttgactaaggaaaggaagtatattttttcggtccggatggcactggtcaactgcctgaagaccctgctggaggccgacccatattccaaatgggccattctgaatgttatggggaaagacttccctgtaaacgaagtcttcacccaattcctagccgataatcaccaccaggtccgcatgctagcggctgagtcaattaatcgccttttccaggatacaaaaggcgacagttcccggctcctcaaagctctccccctgaaactgcagcagaccgcttttgaaaatgcctatctgaaagcccaagaggggatgcgggaaatgtcccattcagcggagaatcctgagacgcttgacgaaatatacaataggaaatcagttctgctgactctcatcgcggtggtgctgtcttgcagtccaatttgtgagaagcaggcactcttcgccctctgtaaaagtgttaaggagaatggacttgagcctcacctagtcaagaaggttctggagaaggtgtccgagacatttggatatcgtagactggaggacttcatggccagtcacctggactatctcgtgctcgagtggctgaatttacaggacactgagtataacctcagctcctttccctttatattgctcaactatacaaatattgaagatttttacagatcctgctataaggtgctgatcccccatttggtcatccgaagccatttcgatgaggtgaagtctatagctaaccagattcaagaggactggaagtccttactgaccgattgcttccctaagattctggtcaatatattgccttattttgcgtacgaaggcacacgggactctggaatggcccagcagcgcgagacagcaactaaggtctacgacatgcttaagagcgaaaatctgcttggcaagcagattgaccatctgttcatctctaatctccccgagatagtggtcgaactccttatgacactgcacgagccagctaactccagcgccagtcagtctaccgacctgtgtgatttcagctag

SEQ ID NO: 27369 - DNA, 282 bp, Artificial Sequence
  Description of Artificial Sequence: Synthetic coding sequence
atgtccctggtgttgaatgacctgctgatttgctgtaggcaacttgagcacgatcgagcgaccgagcggaaaaaagaagtcgagaagttcaagaggctgattcgcgatcctgaaaccattaagcacttagaccggcatagcgatagcaagcagggcaagtatcttaattgggatgcagtttttagatttctccagaagtacatacagaaggaaaccgagtgcctgcgcattgccaagcctaatgtctctgcatctacacaggccagcaggcagaagaaatag

SEQ ID NO: 27370 - DNA, 921 bp, Artificial Sequence
  Description of Artificial Sequence: Synthetic coding sequence
atggagagtatctttcacgaaaaacagccttcaggcaatatggatgacagcggatttttttctatccaggtcatctccaacgcccttaaggtgtgggggctggaactcatcctcttcaatagccccgaatatcagagactccgcattgacccaatcaacgaaagatcttttatctgtaactacaaggagcactggtttactgtacgcaagctgggtaaacagtggtttaacctgaactcactgcttacaggcccagagcttatcagcgatacctacctcgccttattcttagcccagctgcagcaggaaggttattccatattcgtcgtgaaaggagacttgcccgattgtgaggccgaccagctgctccaaatgattcgagtccagcagatgcacaggcctaagttgataggcgaagagctggcacagctgaaggagcaaagagtgcataaaacagacctcgagagagtgcttgaagccaacgacggatccggtatgcttgacgaggacgaagaggacctgcagcgcgcactggccctgtcccggcaagagattgacatggaggatgaagaggccgacttgcgccgtgcgatacagcttagtatgcaaggcagctctagaaacatctcacaagacatgacacagacaagcggaacaaacctaacctccgaggagttgcggaagaggcgggaggcctacttcgagaagcagcagcagaagcagcagcagcaacagcagcagcagcaacagggggacttaagcggacagtccagccatccttgcgagcgacctgctacatcttccggcgctctgggctctgatcttggtgatgctatgtccgaagaagacatgctccaggctgcagtcactatgagcctggagacagtgaggaatgacctaaaaacggaggggaagaagtag

SEQ ID NO: 27371 - DNA, 1110 bp, Artificial Sequence
  Description of Artificial Sequence: Synthetic coding sequence
atggaaagtatcttccacgagaaacaggagggatcactctgcgcccagcactgcctgaacaatctgctccagggagagtatttcagccccgtggagttgtcctctatcgctcatcaactagacgaggaagaaaggatgcggatggcagaaggaggcgtcacaagcgaggattacaggactttcctccagcaaccctccggcaacatggacgacagtggattcttttcaatacaggtaatttctaacgcacttaaggtgtggggactcgagttgattctatttaatagcccggaataccagaggttaagaattgaccctatcaacgagcgatcattcatttgtaattataaggagcattggttcacagtgagaaagctcgggaagcagtggtttaacctgaactcactgctgactggccctgaattaatatctgatacatatctggccttgttccttgctcagctccagcaggaaggttattctattttcgttgttaagggcgacctaccagactgtgaggcagaccagttgcttcagatgattagagtccagcagatgcatcgccctaaacttattggcgaggagcttgcccagttgaaggaacagcgagttcacaaaaccgacttggaacgcgtattggaagccaacgacggctccggtatgctagatgaagatgaggaggacctccagcgtgccctcgccctgagccggcaggagatagatatggaggatgaggaggccgacctgcggcgtgccattcagttatccatgcaaggttcctctagaaacatatcccaggacatgactcagactagcggaaccaatctaacatccgaggagcttagaaagcgcagagaagcatacttcgagaaagaccagcattttcatatcttgaaacagcaacagaagcagcagcagcagcagcaacagcagcagcagggtgatttaagcggacagtcctctcatccttgtgagcgtccggcaaccagctctggagctctggggtccgatcttggtgacgccatgtccgaggaggatatgctgcaggccgcagtgactatgagtctggaaacagtgcgaaacgacctaaagaccgagggtaagaagtag

SEQ ID NO: 27372 - DNA, 1086 bp, Artificial Sequence
  Description of Artificial Sequence: Synthetic coding sequence
atggaaagcattttccatgagaagcaggagggcagtctttgtgctcagcactgtctgaacaacctcctgcagggcgagtatttttcaccggtggagctttccagcattgctcaccagctggatgaggaggaacggatgcgaatggcagagggtggagtgacatccgaggactatcggacctttctgcaacagccaagcgggaatatggatgattccggctttttcagtatacaggtgatctcaaatgccctgaaagtgtggggccttgagctcatcctgttcaattcacctgagtatcagcgactcaggattgaccctattaatgagagaagctttatttgtaactacaaagagcattggttcactgtccggaaattgggaaagcagtggtttaacctgaacagcctcctaactggcccagagctgatctccgacacgtaccttgccctgtttctcgctcagctccagcaagagggctatagtatctttgttgtgaagggcgacctgccagactgcgaggcagaccaactgctacagatgatcagagtacaacagatgcacagacctaaactgattggtgaagaactggcacagctcaaagaacagagggtgcataaaaccgaccttgaacgggtacttgaagccaacgatggatccggcatgttagatgaggacgaagaggatcttcaacgagcgttagcccttagccgacaggagatcgacatggaagacgaagaggcagatctccgcagggctatccagttgtctatgcaggggtcttctaggaacattagccaagacatgactcagacatccggtactaaccttacctccgaagaactgcggaaacgcagagaggcttactttgaaaaacaacagcagaaacaacagcagcagcagcagcagcaacagcagggcgacctatccgggcaaagcagtcacccctgcgagcgcccagctacatcttccggtgctctgggtagcgatctgggagatgcaatgagcgaagaggacatgttacaggctgcagtgactatgtcgttagagaccgtgcgcaatgacctgaagactgaaggcaagaaatag

SEQ ID NO: 27373 - DNA, 1101 bp, Artificial Sequence
  Description of Artificial Sequence: Synthetic coding sequence
atggagtctatctttcacgagaagcaggaagggtcgttgtgtgcacagcattgcctcaataacctgttacaaggcgaatacttttccccagtggaactctcttcaattgcccaccagctggatgaggaagagaggatgagaatggccgaaggaggcgtcacctcagaagactatcgtaccttcctgcagcaaccctccggtaacatggacgattccggcttcttttccatccaggtcattagcaacgctcttaaggtgtggggtctggaactgatcctgttcaactcgccagagtaccagcggctaagaatagatcccatcaacgagaggagcttcatttgcaactacaaagagcattggttcaccgtgaggaagctggggaagcagtggttcaacctgaacagccttttgactggcccagagctgatctctgacacataccttgccctattcttggcccagctccagcaggaaggttatagtattttcgtagtcaagggtgacctccccgactgcgaagccgatcagctactccagatgattcgggtgcagcagatgcaccgacccaagctgatcggagaggagcttgcacaactcaaggaacagcgagtgcataaaacagatctggagcgggtgttggaagccaatgacggctccggcatgttggacgaagatgaggaggacctgcagcgtgcccttgctctgagcaggcaggagatcgatatggaggatgaagaggcggacctgaggagggcaatccaactgagtatgcagggctcatcgcggaatatctctcaagatatgacacagacatccggcactaatctcacctccgaggaactgcggaagagaagagaagcgtactttgagaatgactacttcgacagtcagcagcagaagcagcagcagcaacagcagcagcaacagcagggagatctcagcggccagagcagccacccctgtgaacgcccagccaccagtagtggcgcactagggagcgatctcggcgacgccatgagcgaggaggatatgctccaagccgctgtgactatgtccctggagacagtaaggaacgatttgaagacagagggaaagaaatag

SEQ ID NO: 27374 - DNA, 1065 bp, Artificial Sequence
  Description of Artificial Sequence: Synthetic coding sequence
atggagtctatcttccacgaaaagcaggagggatcactttgtgcccagcactgtctgaacaatttgctacaaggagaatactttagtccagtggagctgtcttctattgcccatcagctggacgaggaagagcggatgcggatggccgagggcggtgtcacctcagaggattatcgtactttcctgcaagttattagcaacgcattgaaggtctgggggctcgagctcattcttttcaacagccccgaataccagcgtctcaggatagaccccatcaacgaacgtagctttatctgcaattacaaagaacactggtttactgtgcgtaaactgggaaagcagtggttcaatctgaatagtttactgacaggtccggaactgataagcgacacctacctcgccctgttccttgcccaactgcagcaggagggctatagcatcttcgtggtaaagggggacctgccagattgtgaggcagaccaactgttacaaatgattcgtgtgcaacagatgcataggcctaaactgattggagaggagcttgctcagttaaaagagcaaagagtgcataagaccgacttggaaagggtcctggaggctaatgacggtagcggaatgttggacgaggacgaggaagacctacaaagggcactcgccctgtcacgtcaggaaatcgatatggaggacgaggaggctgatttacgtagagctatccagctgagcatgcagggatcgagtcgaaacatcagtcaggatatgacgcagactagtgggaccaatcttacctctgaagagctgagaaagaggagagaagcttacttcgaaaaggatcagcactttcatatcctgaagcagcagcagaaacagcaacagcagcagcaacaacagcagcagggagacctctccggacagagctcacacccttgtgagcggccagcaacaagctccggagcattgggaagtgacttaggcgatgccatgagtgaagaagatatgctgcaggctgctgtgaccatgtccctcgaaaccgtcagaaatgatcttaaaactgagggaaaaaaatag

SEQ ID NO: 27375 - DNA, 1113 bp, Artificial Sequence
  Description of Artificial Sequence: Synthetic coding sequence
atggagtctatcttccacgaaaagcaagagggcagcctgtgcgcccagcattgcctcaacaatctgcttcagggagagtattttagtcctgtcgaactgtctagcatcgctcatcagttggatgaagaggagagaatgcggatggctgaaggcggtgtgacatctgaagattatcgaacctttctccagcagccttctgggaacatggacgactctggattcttctcgatccaggttattagtaatgcccttaaagtgtggggccttgagcttattttgtttaacagtccggagtatcagcgcctaaggattgatccaataaacgagcggtctttcatctgcaactacaaggaacactggttcacagtccggaagttaggcaagcagtggtttaatctgaatagccttcttacaggcccagaactgatctcagacacataccttgcactgtttcttgcccagctgcagcaggagggttacagcattttcgtggtcaaaggggacttgccagattgcgaggccgaccagctactgcagatgatacgcgtgcagcagatgcacaggcctaagctaatcggggaggaactggcccagctgaaggaacagcgagtccacaagacggacctggaaagggtgctcgaagctaacgacggttctggtatgttagatgaagatgaagaggatctgcagcgagccctcgcgctctcaaggcaggaaattgatatggaggacgaagaagctgatctgcgtcgtgctatccagctgtccatgcagggctcctcacgtaatatctctcaggacatgacccagacttcaggaacgaatttaacgtccgaggagcttcgtaaacgtcgcgaagcttacttcgagaaaaccgagtccagatcggtggctcaggcccagcaacagaagcagcagcaacagcagcagcaacagcagcagggcgatttgtcaggccaatcatcacacccgtgcgaacggccagcgactagctccggtgctctgggctcagacctaggggatgccatgtctgaagaagacatgctccaagccgctgtcactatgagtctggaaaccgtaaggaatgacctgaagactgaaggtaagaaatag

SEQ ID NO: 27376 - DNA, 1041 bp, Artificial Sequence
  Description of Artificial Sequence: Synthetic coding sequence
atggagtctatcttccacgaaaagcaggaaggatcattatgtgctcagcattgcctgaacaatctcctgcagggtgagtattttagcccagtcgaactgagctcaattgcacatcagctggacgaggaggaacgtatgagaatggcggaaggaggagtaacgtctgaggattatcggacatttttacaggtgatttccaacgcgctgaaggtgtggggcctggagttaattctgttcaacagccccgaatatcaacggctcagaatcgaccccattaatgagaggtctttcatctgcaactacaaagaacactggttcaccgtgaggaagcttggtaaacagtggttcaacctaaattcactgttgacaggtcctgagctgatttctgacacatacttggcgctgtttctagctcagctgcagcaagaaggctattcaatcttcgtggtgaaaggagacttacccgattgcgaggctgaccagctgctgcagatgattcgggtacaacaaatgcaccggcctaagctgattggggaggagcttgcccagctcaaggagcagagggtgcataagacagatctggaacgcgtcttggaagccaatgacgggagcggcatgttggatgaagatgaggaagatctccagcgtgccctggcactttcccgacaagagatcgacatggaggacgaagaagccgacttacgtagggccatccagctgagcatgcagggatcttcgcggaacataagccaggacatgactcagacttctggaacaaatctaacctcggaggaactgcgcaagcgtcgtgaggcgtatttcgagaagcagcaacagaaacaacagcagcagcaacaacagcagcagcagggggacctgtctggtcaatcaagtcacccgtgtgaacgcccagccacctctagcggggctttgggatccgatctcggcgacgcaatgtccgaagaagatatgcttcaggccgcagtcaccatgtcactcgagaccgtgcgcaacgacttaaaaaccgaaggcaagaaatag

SEQ ID NO: 27377 - DNA, 1095 bp, Artificial Sequence
  Description of Artificial Sequence: Synthetic coding sequence
atggaaagtatctttcacgagaaacaagagggttccctctgtgcccaacattgtttgaacaatctattgcagggcgaatacttctcacctgtagagctgagttccatagcccaccaactggatgaagaggaacgcatgcgtatggctgaggggggagtgacgtccgaagattatcggacgtttctgcaacagcctagtgggaatatggacgacagcggattcttttccatccaagtgatttccaatgccctgaaagtgtggggccttgaactgattctgtttaactcccccgaataccagagactccgaattgaccccataaatgagcgctccttcatttgcaattataaggagcactggtttactgtgcgcaaactgggtaagcaatggtttaacctgaacagcctgcttacagggcctgagttaattagtgatacttacctcgcactgtttctggcccaattgcaacaggagggctacagcatttttgttgtgaagggtgacctgccagactgcgaggccgaccagctcctgcagatgattcgcgtccaacaaatgcaccgaccaaagctgatcggggaagagctcgcacagctgaaggaacagagggtgcacaagaccgacctggaacgggtgctcgaggctaatgatggctccggtatgcttgatgaagatgaggaggacttgcagcgggcactcgccctttcaagacaggagatcgacatggaggatgaggaggctgacctcagaagggccattcagctctcaatgcagggctcctcccgaaatatttcccaggacatgacacagacgagtgggaccaacctgacatccgaggaattaaggaaaagacgagaagcatatttcgaaaaacagcagcaaaagcagcagcagcaacagcaacagcagcagcagggcgacctgtctggacagtcaagccacccatgcgaaagaccagccacttcatctggcgctctaggctcggacctcggaaaggcctgctcaccctttatcatgtttgcaacctttaccctttacttgacctacgaactgcacgttatttttgccctacattattcctctttccctttgtag

SEQ ID NO: 27378 - DNA, 1119 bp, Artificial Sequence
  Description of Artificial Sequence: Synthetic coding sequence
atggaaagcatttttcatgagaaacaagagggatcgttatgtgctcagcactgtctgaataaccttctgcaaggggaatacttcagcccagtcgagctttcatctatcgcgcatcagcttgatgaggaggaaaggatgcgcatggcagaagggggagtgactagtgaagactacagaacttttttacaacagccatccggtaacatggatgacagtggtttcttctccatccaggttatcagcaatgccttaaaggtgtggggcctggaattgatcctgttcaatagccctgaatatcaaaggctgcgtatcgaccccattaatgaacgaagtttcatatgcaactacaaagagcattggttcacagtgcggaagcttggaaaacagtggttcaatctgaacagcctgttgacaggcccagaattgataagcgatacttacctggccctgttccttgctcagctgcagcaggagggctacagtatattcgtggttaagggggacctcccagactgcgaggccgaccagctgctgcaaatgattagggttcagcagatgcaccgtcctaaactgattggagaagagcttgcccaactgaaggagcagcgagtgcacaaaacggacttagagagggtgctggaggcaaatgacggatccggaatgctggatgaggacgaagaggacctgcagcgggctctagcactttcccggcaggagatcgatatggaagatgaagaagccgacctaaggcgagccatccagttgagcatgcaaggatcttcaagaaacatcagccaggacatgacccaaacttctggcactaatctcacctccgaagaactacggaagagacgagaggcctattttgagaaatttggcagaccgaggagagctgattgcttgaggcagcagcaaaagcagcagcaacaacagcagcagcagcagcagggcgacttgagcggccagtcctcccatccgtgtgaaagacctgccaccagctcgggggcattgggttccgacttgggtgatgccatgagtgaagaggacatgctgcaagcagctgtgaccatgagcctggaaaccgttaggaacgaccttaagaccgagggaaagaaatag

SEQ ID NO: 27379 - DNA, 1128 bp, Artificial Sequence
  Description of Artificial Sequence: Synthetic coding sequence
gacagtgtgagcaagaaaaaacaggagggcagcctgtgtgcccagcattgtttgaataatctgctgcagggtgaatacttctcgccagtagagctgtctagcatcgcccaccagctggacgaggaggagaggatgcgaatggccgagggcggtgtgacatccgaggattaccgaactttccttcagcagcctagtggaaacatggacgactcaggatttttcagtattcaggtcatatctaacgctctgaaagtctgggggctcgaactgattctatttaacagtcctgagtatcagaggctgcggattgatcccatcaatgagaggtccttcatttgcaattataaggagcactggtttacagtccggaaactcggaaaacagtggttcaatcttaatagtcttctgactggaccagaactgatctctgacacctaccttgccctgtttctcgcccagctgcagcaggagggctacagtatcttcgtagtgaagggcgacttgcccgactgcgaagctgaccagctgctacagatgatccgggtacaacagatgcatagacctaagctaattggggaagagcttgctcagctcaaggagcagagggtgcacaaaacagatttggagcgggtattggaggccaatgacggttcaggcatgctggatgaggatgaagaagatctgcaacgagcgctcgccctgtcccggcaagaaatagatatggaggacgaagaggccgatctgaggcgggctattcagctctcaatgcaaggctcatcacggaatatcagccaggacatgacacagacatcagggaccaatctgacatccgaggaactgcgcaaacgccgagaagcatactttgagaaaaaatttaccgcgaacagaacggaccagcattttcatattctgaagcagcagcagaaacagcagcagcagcaacagcaacaacagcagggcgacctgtcggggcagtcttcacatccttgtgaaagacccgcaacctcatcaggagcccttggttctgacctcggtgatgccatgtccgaagaggatatgctccaagccgctgtgacaatgtctttggagacagttcgcaacgatctcaaaacagaagggaagaagtag

SEQ ID NO: 27380 - DNA, 1125 bp, Artificial Sequence
  Description of Artificial Sequence: Synthetic coding sequence
atggagtctatctttcacgaaaaacaagagggttccctgtgcgcccagcactgcctgaataacctcttacagggcgagtatttttcaccagttgagcttagtagcattgcccaccagctggacgaggaagaacgcatgagaatggctgagggtggtgtcacttctgaggactatcgaacgtttctccagcagccatcaggcaacatggatgatagcggtttcttttccatccaggtgatttcgaatgcacttaaggtctggggcctcgagctgatcttatttaactcgccggagtatcagcgcctgcggattgatccaattaatgagcgttcatttatttgcaactacaaagagcactggtttacagtccgcaagttgggaaaacagtggtttaatcttaactcactgctcaccggacccgagcttatctcagacacttatctcgcgctatttctggcacagctgcagcaggaaggttacagcatattcgtcgtcaaaggcgatctccctgactgcgaggctgaccagttgttgcagatgatccgtgtgcagcagatgcaccgccctaagttaatcggcgaagagttagcgcagctgaaagagcagcgcgtccacaaaactgacctggagcgagtcttggaggccaacgacggcagcggaatgttagatgaggacgaggaggacctacaacgcgcattagccctcagccgtcaggagattgatatggaagatgaagaagcagatctccgacgtgctattcagttgtccatgcagggatcttcccggaatattagccaggatatgacccaaaccagcggcactaacctgacttcagaggaattgaggaaaagaagggaggcatattttgagaaggtcttcttcaaaaacctacaacagatcggcagagccaggcaacagcagaagcagcagcaacagcagcaacagcagcagcaaggggatctgtccggccagtctagccatccgtgcgaaaggcctgctaccagctcaggggctctgggctccgacctgggggatgccatgtcagaggaagatatgctccaagccgctgtgaccatgagtttggagaccgttagaaacgacctgaaaacagaagggaaaaaatag

SEQ ID NO: 27381 - DNA, 1113 bp, Artificial Sequence
  Description of Artificial Sequence: Synthetic coding sequence
atggagagcattttccacgaaaaacaggagggttctctctgtgcacaacattgcctcaacaatctgctgcaaggcgaatacttttcaccggtggagctgtcatctatagcccaccagctcgatgaagaggaacgcatgcggatggctgagggtggtgtgacaagcgaggactacagaaccttcctccagcagccgtctgggaatatggacgactctgggttctttagtatccaggttatctcgaacgccctgaaggtttggggactcgagctaattctatttaatagtcccgaatatcagcgcctgcgaatagatcctataaacgaaaggtctttcatttgcaactacaaagaacactggtttactgtccgtaagctgggcaagcaatggtttaacctcaatagcttactgaccggcccagagctgatatctgacacctacttagctctgttcctcgcccaattgcagcaggagggctacagtatttttgtcgtgaaaggagatcttcctgactgcgaagctgatcagctgctccagatgattagagtacagcaaatgcatagaccaaagctgattggagaggagctggcccaactgaaggagcagagggtgcacaagacggacctggagcgtgtgctggaggctaatgacgggagtgggatgctggatgaggacgaggaggacttgcagcgcgctttagcattgtcaaggcaggagatcgatatggaggacgaagaggcagatctaaggcgggctattcagctgtcgatgcagggcagctcgcgtaacataagccaggacatgacccaaaccagcggaaccaatctgactagcgaagaactacgaaaacggagggaggcttactttgagaagatctactttaccttcgagtgtttccgtcagcaacaaaaacaacagcagcagcagcagcagcagcaacagggcgatcttagcggccagagtagtcatccctgtgagcgccctgccacatcgtcaggagccttaggctccgacctgggcgacgcaatgagcgaggaagacatgctccaggccgctgtgacgatgtccctggaaaccgttagaaatgatttgaaaactgaaggtaagaagtag

SEQ ID NO: 27382 - DNA, 1134 bp, Artificial Sequence
  Description of Artificial Sequence: Synthetic coding sequence
atggagtccatattccatgaaaagcaggaaggttccctgtgcgcccagcattgcctgaataacttgctccagggagagtacttttcccccgtagaactctcatccatcgcccatcagctggatgaggaggagcggatgaggatggccgagggtggagtgacatctgaggattatagaaccttcctgcagcaacccagcgggaatatggacgacagcgggttttttagcattcaggttatatccaatgctctgaaggtttggggactggagttgattctttttaacagtccagagtaccagcggctaaggatcgaccccatcaatgaacggagtttcatctgtaactacaaggaacattggttcactgtccgaaaactcggcaagcagtggttcaacctgaatagcctgttgaccgggccagagcttataagcgacacttacctagccttattcctcgcgcagctgcaacaagaagggtacagtatcttcgtcgtcaaaggagacctgcctgactgcgaagcggatcagttactccagatgattcgcgtacagcagatgcaccgacccaaactcatcggagaggagctggcccagctaaaggagcaacgcgttcataaaacagatttggagagagtcctggaggctaacgatggcagtggaatgttggacgaggacgaggaggacttgcagcgggctctggccctgtctaggcaggagattgacatggaagatgaggaggccgatcttaggcgcgcaatacagctcagcatgcagggttctagccgcaacatcagccaggacatgacacaaacatctggtactaatctcactagcgaagagctgcgcaagcgcagggaggcctattttgagaaggtgttctttaaaaacctacagcagaatcagcactttcatatcctcaagcagcagcagaagcagcagcaacagcaacagcaacagcagcagggagacctgagcggccagtcctcccatccatgcgagaggcccgctacttcctccggggctctcggttcagacctaggagatgcgatgtcagaggaggatatgttgcaagcagccgtcacaatgtctctggagactgttagaaacgatctcaagacagaggggaaaaagtag

SEQ ID NO: 27383 - DNA, 549 bp, Artificial Sequence
  Description of Artificial Sequence: Synthetic coding sequence
atgatacgagtgcaacaaatgcaccggcctaagctgattggcgaagagctggcccaattgaaggagcagagggtgcataagacagatctcgaacgcgtgctggaggccaatgacggatctggtatgctggacgaggatgaagaggacttgcagcgcgcactggccttatccagacaggaaattgacatggaagatgaagaggcagatctgagaagagcgatacagctgtccatgcaagggagcagtcgcaacattagtcaggatatgactcagacaagcggcacaaatctaacaagcgaggaattacgcaagcggagagaggcctacttcgagaagcagcaacagaagcagcagcagcaacaacagcagcagcagcagggcgacctgtcgggtcagtccagccatccatgcgagagacctgccacaagctctggcgctctcggaagcgaccttggagacgctatgtctgaagaagacatgctgcaggccgcagttacgatgagcctagagactgttaggaatgatttgaaaacagagggaaaaaaatag

SEQ ID NO: 27384 - DNA, 3306 bp, Artificial Sequence
  Description of Artificial Sequence: Synthetic coding sequence
atgtcagctaaggctatttcagagcagaccggaaaggaactcctatacaagtttatctgcacaacaagcgccatacaaaaccggtttaagtacgctcgtgtgacacctgataccgattgggctcgccttctgcaggatcacccgtggctgctcagccagaatctggtagtgaaaccagaccagctgattaaaagacgtggtaagctgggactcgtgggagtgaacctcaccctggacggggtgaaatcatggctcaaaccccgtctggggcaggaggctacagtcggtaaagctaccggctttctgaaaaacttcttaatagaacctttcgtccctcactcgcaagccgaggagttctacgtgtgcatctacgccaccagggagggagattatgtgctatttcatcatgaaggcggagtggacgtcggcgacgtggatgcaaaagcacagaaattactagtgggggtagatgagaagctgaatccagaggacataaaaaaacacttactcgtccacgcccctgaggataaaaaagagattctggcttcgtttatcagtggattatttaacttctacgaagatctgtatttcacatatttggagatcaatcctctggtggtgacaaaggatggagtttatgtgcttgatctcgccgcaaaagtggatgctacggccgattacatttgtaaggtgaagtggggcgatattgagtttccgccaccatttgggagagaagcctaccccgaagaggcgtatatcgcagatctggatgccaagagcggcgcaagcctcaagctaacactcctgaatcccaaaggacggatttggacaatggtcgctggagggggagccagcgtagtgtactcagacacaatatgcgacctcggcggagtgaacgagctggccaattacggggaatattccggagcgccaagtgagcagcaaacatacgactacgccaagacgatcctgagtctgatgactcgggagaaacacccggacggaaaaatcctgataatagggggatccatcgccaatttcacaaatgtcgccgcaacctttaagggcatagtacgagctatcagggattaccagggaccacttaaggagcatgaagtgacaatattcgtgaggcgcggagggccaaactaccaagaaggtctacgagttatgggagaggtcggaaagaccactggtatccccatccatgtgtttgggacagagacacacatgacagcaatagtgggaatggccctgggccacaggcccattcctaaccaacctcctacagcagcccataccgctaatttcctgctgaacgcttctggcagcacgtccacccccgctcccagtcgcaccgcctccttcagtgagtcacgggctgacgaagtagcccctgccaagaaggctaaaccggcaatgccccaggactctgttccctctcctaggtcgctgcagggcaagtctaccacactgttctcgcgtcatactaaagccatcgtctgggggatgcaaacacgtgctgtccagggtatgttggatttcgactacgtgtgttcacgcgatgagcccagcgtggctgcaatggtttatccttttaccggcgatcacaagcagaagttttactggggtcacaaggagattttaatacccgtctttaagaacatggcagatgctatgcggaagcacccagaggtggatgtactcattaactttgcaagcctgcgaagcgcctacgattctactatggagacaatgaattacgcacagattagaacaattgcaatcatcgccgagggtatcccagaagcccttacccgtaaattaattaagaaggctgatcagaaaggcgtgactataatcggcccagccaccgtggggggtattaaaccaggatgcttcaaaataggaaacactggaggcatgctggacaacattctagccagcaagctgtatcgtcctgggtccgtggcctatgtttccagatctggcggtatgtcaaatgagcttaacaacataattagccggacaacggatggagtttatgagggcgttgctattggcggtgacagatacccaggatctacatttatggaccatgtgctgcgctaccaggacacccccggtgtaaaaatgattgtcgttcttggagaaatagggggaactgaagagtacaagatttgtcgtggaataaaggaggggcgtctgacaaagcccattgtctgctggtgtattggaacatgtgccaccatgttcagttcggaagttcaattcggacacgcaggggcatgtgctaatcaggccagcgagacagctgtagcgaaaaaccaggccttaaaggaagccggagtctttgtccctcggtcctttgacgaactaggcgaaattatccaatcagtgtacgaggaccttgtggcgaatggcgtaatcgtgcctgcacaggaggtcccgccacccactgttccaatggactatagctgggccagagagctggggttgattaggaaaccagcaagcttcatgacctccatttgcgatgagcggggacaggagctgatatatgcgggtatgcccattaccgaagtgtttaaggaagaaatgggcataggaggcgttctcggcctactgtggtttcaaaaaagactgccaaagtattcctgtcagttcatagagatgtgtctcatggtcactgctgaccatggacccgcagtgtcaggggctcataatacgattatctgtgccagagccggtaaagatttagtaagcagtcttacctctgggctactaaccattggggaccggtttgggggagcactcgacgccgcagctaagatgttttctaaagcattcgactctggcataatcccgatggaatttgtaaataaaatgaagaaggagggcaaactgattatgggcattgggcatagggtgaagagcataaacaatcctgacatgagggtccaaatcctcaaagactacgtgcgtcaacactttcctgccacaccattactggattatgctcttgaagtcgagaagatcaccacgagcaaaaagcccaatctaattcttaatgtcgatgggctgatcggcgtggcattcgtggatatgttgagaaattgtggctcgttcacgagggaggaggcagatgagtacatcgacattggcgctttgaatggaatttttgtgctgggccgttccatggggttcattggacattacctagatcaaaagcgattgaagcaagggctgtaccgccatccctgggatgatatatcgtacgtgctgccggaacacatgtcaatgtag

SEQ ID NO: 27385 - DNA, 3276 bp, Artificial Sequence
  Description of Artificial Sequence: Synthetic coding sequence
atgtctgccaaagccatctctgagcagacggggaaagagctgctgtacaaattcatctgtaccacctccgccatccagaatcgttttaagtacgcccgtgtgacacctgacacggactgggcacgcctgctgcaggaccacccttggctgttatctcagaatttggtggtgaagccagatcagctcatcaaacgcagaggtaagctgggactggtgggagtcaaccttacgctggacggtgtcaagtcatggctgaagccccgtctcggtcaagaagccacagtgggaaaggccacaggctttctgaaaaactttctgattgaaccgtttgtgcctcactcgcaggcagaggagttctacgtttgtatatacgccacaagagagggggactatgtcttgttccaccacgagggcggtgtcgatgtcggtgacgtggatgcaaaggcccagaaattactcgtcggggtggatgaaaagctcaatccagaagacatcaaaaaacacctcctggtccatgcgcctgaggacaagaaagagatcctggcttcattcatttcaggactatttaacttttacgaggatttgtactttacatacctcgaaatcaatccacttgtagtcaccaaggatggcgtgtacgttctggacctggccgctaaagtggacgccaccgcagattacatctgtaaggtgaaatggggcgatattgagtttccgcctccgtttgggagggaagcctacccagaagaggcatacattgctgacctggacgcgaagtccggtgcttccctgaagctgaccctgctcaaccccaaggggagaatctggaccatggtcgccggtgggggtgcttccgtcgtgtatagcgataccatttgtgacctcggcggtgtcaacgaactcgcgaattacggtgagtacagtggggcaccatctgaacagcagacctacgattatgccaagactattctgagtctcatgacgcgagagaagcatcccgatgggaagattttaataattggaggcagcattgccaattttaccaacgtcgccgcaacgttcaagggtatcgtgcgcgcaatacgagattaccaggggcctttgaaggaacacgaggtcacaatctttgtgaggagggggggacctaactatcaggagggactcagggtgatgggtgaggtgggaaagaccactggcatcccgatacatgtgttcggcacagagactcacatgacagccatcgtgggcatggctctgggccatcgtcctatcccaaaccagccaccaacggccgctcataccgccaatttcctcctcaatgcatctggaagcacgtccactcccgcaccctctaggacagccagcttttcagaatcccgggcagatgaagtagcaccagcaaagaaagctaagcctgcgatgccgcagggcaaaagcacaaccctctttagccgccacaccaaggccatcgtgtggggtatgcaaactcgcgctgtgcaggggatgttggactttgactatgtgtgcagccgtgacgaacctagcgtggctgctatggtgtacccattcaccggggatcacaagcagaagttctattggggacataaggagattctgatacctgttttcaaaaacatggccgacgcaatgcgaaagcatcccgaagtggacgtgctgataaactttgcttcactaagatcagcctacgacagcacaatggagactatgaactatgctcagattagaacaattgctataatagcagaagggatccctgaggcactgactcgtaagttgatcaaaaaggcagaccagaagggagtaaccattatcgggcctgcaaccgtcggagggatcaagccgggatgctttaagataggcaacacaggtggaatgcttgataatatccttgccagcaaattgtacaggccgggatccgtcgcctatgtctccaggagcggcggaatgtccaacgaattgaacaacatcatatcacgcaccaccgatggcgtttacgagggggtggccatcggcggtgacaggtatcccggaagtactttcatggaccacgtgctgcgttaccaggatacaccgggtgtcaagatgatagtagtcctaggcgagatcggagggaccgaggaatacaaaatttgtcgcggaattaaggagggtcggttaacaaaacctatcgtctgctggtgtatcgggacctgcgccaccatgttttctagtgaagtccagttcggccacgccggtgcttgcgctaatcaggccagtgaaaccgcagtcgcaaagaaccaagccctcaaagaagctggcgtgtttgtgcccagatccttcgatgagctcggagaaattatccagtcagtttatgaggacctagtcgctaatggtgtcattgtgcctgcccaagaggtaccgcctccaacagtgcctatggattactcttgggctcgtgaactcggcttgatccggaaaccagcgtcatttatgacctcaatctgcgacgagcgcggacaggagctcatttacgcagggatgcctatcactgaggtcttcaaggaggaaatgggaatcgggggagttctcggcctcctttggttccaaaagaggttgccaaagtacagctgccagttcatcgaaatgtgcttgatggttaccgcggatcatggacctgccgtttccggtgctcacaatacgatcatctgcgctagagccggaaaagaccttgtgtctagcctgacctcagggctcctcaccatcggtgaccgtttcggcggagctctggacgcagctgccaaaatgttcagcaaggcatttgacagtggtattatacctatggagttcgtgaacaagatgaagaaagagggaaagttgatcatggggatagggcacagagttaagagtatcaataaccctgacatgcgcgtgcagatccttaaagactacgtgcggcaacactttcccgctacccctttactggattatgctctggaagtggagaagatcacgacatctaagaagcctaatctgattttgaacgtggacggattgatcggggtcgcgtttgtcgacatgctcaggaattgtggctcttttacccgcgaggaggcagatgagtatattgatattggggcacttaacggcatcttcgtcctgggtcgatccatgggattcattggtcattacttggatcagaagaggttgaagcaggggctgtatcggcacccatgggacgatatctcatacgttctacctgagcacatgtcgatgtag

SEQ ID NO: 27386 - DNA, 3276 bp, Artificial Sequence
  Description of Artificial Sequence: Synthetic coding sequence
atgtccgctaaagcaatcagcgaacagacaggaaaagagcttctgtataagtttatttgcactacctcggcgattcagaaccgctttaaatatgcccgagtaacccctgacaccgactgggcccgtctactgcaggaccacccctggctgctctctcagaatctcgtggtgaagcccgaccagctgatcaagaggcgaggtaagctgggcctggttggcgtaaatctcaccctggacggagtgaaatcctggctgaagccgagactcggccaggaagcaacggtgggaaaggctactggtttcctgaaaaatttccttatcgaaccgttcgtgcctcatagccaggcggaggagttctatgtgtgcatttatgccaccagggaaggggattacgttcttttccaccacgaaggtggagtggatgtcggcgatgttgacgccaaggcccagaaactcctggtgggcgtcgatgagaagttgaaccccgaggacattaaaaagcatctccttgtgcacgcacctgaagataaaaaggaaattctggcgtcctttatcagcggactgttcaatttttacgaggacctgtactttacttacctagaaattaacccgctggtggtgactaaggacggcgtgtacgtgctggatctcgcggctaaagtagatgccacagccgactatatctgcaaagtaaagtggggggacattgagttcccccctcctttcggacgcgaggcctaccctgaggaggcttacatagccgacctggacgccaagagcggcgcttcgctgaagctgaccctgctgaatcccaaagggagaatttggacaatggttgccggtgggggagcctcagtggtgtactccgatactatatgcgatctggggggagtaaacgagctggccaattatggggaatatagtggagcaccttccgaacagcagacatacgactatgctaagaccatcttgtctttgatgactcgtgagaaacatccagatggcaaaattctcatcattggaggaagcatcgcgaatttcaccaatgtagctgccacttttaaggggattgttcgcgctatccgggattaccagggaccattgaaggagcacgaggtgaccatctttgtgcggagaggcggaccaaattatcaggagggtctgcgggttatgggggaagtaggaaaaactactggcatcccgatacacgtgtttggaaccgaaacgcatatgacggcaattgtgggaatggccttgggacacagacccattccaaaccagccacctactgctgctcatactgcaaattttcttttgaatgcctctggttccaccagcacacccgcacccagcagaacggcaagtttctccgagtcccgcgcagatgaggtggcccctgccaagaaagccaagccagccatgcctcaggggaaatcgaccaccctcttcagtcgccacaccaaggctatcgtgtgggggatgcagacccgagccgtgcaggggatgctggattttgattacgtttgtagtagagacgagcccagtgtggccgcaatggtctatccatttacaggcgatcataagcagaaattttactggggacataaggagatactgatccccgtctttaagaatatggctgacgctatgagaaagcacccagaggttgacgtcctcattaactttgcctccctgcgaagcgcttatgactctactatggagacaatgaactacgcccagatccgtacaatcgctattatcgcagagggtatccccgaagccctgacgagaaagcttataaaaaaagcagaccagaaaggggtgaccattataggacccgctacagttggaggtatcaagcctggctgcttcaagattggcaataccgggggaatgttggacaacatcctggcatcgaagctataccgccctgggtctgttgcgtatgtttcgagatccggcggaatgtccaacgagcttaacaacataatctctcgcaccactgacggtgtgtatgagggagtggccattggaggggaccgttatcccggttcaacatttatggaccacgtcttgcgctatcaggacacccccggtgtgaaaatgattgtcgtgctcggggagatagggggaactgaggaatataagatatgtcggggaatcaaagaagggaggttaaccaagcctattgtgtgctggtgtatcggcacatgcgcgactatgtttagcagtgaggtgcagtttgggcatgcaggcgcatgtgcaaatcaggcgtcggagaccgccgtggcaaaaaaccaggccctcaaggaggcgggtgtgtttgttccgcgttccttcgacgaacttggagagatcatccagtcagtgtacgaggacttggtagccaacggagtgatcgttccagctcaggaggtccctccccctacagtgcccatggactattcttgggccagagaactggggctgatccgcaagccggctagctttatgaccagcatatgcgacgaaaggggtcaggaactgatttatgcaggtatgcctattactgaagtgtttaaagaagaaatgggcatcggcggagttctcggactactgtggttccagaaacgtctgccaaagtactcttgccagttcattgagatgtgcctgatggtgactgcagatcacggaccggctgtgtctggcgcacacaacaccatcatctgtgcacgcgctgggaaagatctcgtgtcgtctctcacctctggcctgttgaccatcggagatagatttggaggggcattagatgccgctgcaaaaatgttttccaaggccttcgactctggcattatccctatggagtttgtaaataagatgaaaaaggagggcaagctcattatgggaatcgggcacagagtgaaaagcatcaataacccggatatgcgcgtccagatcctgaaagactacgtgcgacagcactttcctgctacgccattactggattacgccctcgaagtggagaagatcaccacctcaaagaaaccgaatttgatcctcaacgtcgacgggctcatcggggtggcttttgtggacatgctccgaaattgcggttccttcacaagagaggaggccgatgaatatattgacataggcgctttaaacgggatcttcgtactgggacgttcaatgggcttcatcggccattacctcgatcaaaagcggttgaaacagggcctctacagacatccttgggatgatatctcgtatgtactacctgagcacatgtccatgtag

SEQ ID NO: 27387 - DNA, 3468 bp, Artificial Sequence
  Description of Artificial Sequence: Synthetic coding sequence
atgggggcaggtaagagccctgctggaccagggcagaagcccgatcccggtaaactgccagcagcgggtgtactgcgtatcctacgcggatcttccggtctgtggaaaaaacgacgtgctcgaacctccgccgagaccgggcgagcgggactctccgccgcaatgagcgccaaggccattagcgaacagacgggcaaggaactcctctataaatttatttgtactacctctgccatccaaaataggttcaagtacgccagggtcactccagatacagactgggccagactgcttcaggaccatccttggctgctgagtcagaatctggtggttaagccagaccagttgatcaaaaggagagggaaactcgggcttgttggcgttaacctgacactggatggggtgaagagctggctgaagccacgtctcggacaggaggcaactgtgggaaaagctacaggcttcctgaaaaacttcttgattgagccatttgttccacacagccaggctgaagagttctacgtgtgcatttacgctacacgagaaggcgattatgtgttattccaccacgagggtggagtagacgtaggcgacgtggacgctaaggcccaaaagctgttggtgggcgtggacgagaaactaaatcctgaagacatcaagaagcacctgctggtgcatgcccctgaagataaaaaggagatcctggcctcgtttatttctggtttattcaatttctacgaggacttgtatttcacctacctcgaaattaatcctctggtcgtcactaaggatggggtgtatgtgctggacttagccgcaaaagtggatgctacagctgactacatctgcaaggtgaagtggggtgacatcgagtttccaccgccttttggcagagaagcatatccagaggaggcctacatcgccgacctggacgcaaaatcaggtgcttcgcttaaactgaccttgcttaatcctaaagggcgtatctggaccatggtagccggaggcggagcatctgtggtgtattcagacacgatctgcgaccttggcggtgtaaacgaactagctaactatggcgagtactccggagccccatcagagcagcagacttacgattatgctaagaccatcttatcccttatgacacgcgaaaagcatcctgacgggaaaattttgattataggcggaagtatcgccaattttacaaatgtggcggctactttcaagggaatcgttagagcaatccgcgactaccagggccctctgaaggaacatgaagttaccattttcgtgcgtcgcggagggcctaactatcaggaaggccttcgcgtcatgggtgaggtgggaaagacaacaggtattcccattcatgtttttggcactgagacgcatatgaccgccatcgtggggatggctctgggccatagacctatccccaaccagcctcctaccgcagcccacacggccaactttttgcttaacgcttcggggtctacatccacaccggctccttctcgcacagcgtccttttctgagtcgcgggctgatgaggttgctcctgccaaaaaggcaaaacctgccatgccacaggacagcgttccaagccctcgatccctccaaggaaaaagtacaacgcttttcagtcgtcataccaaagctattgtctggggcatgcaaacccgggcagtgcaggggatgctggactttgattatgtctgcagcagagacgaaccctccgtggctgccatggtatatcccttcactggggaccataaacagaaattctactggggtcacaaggaaatcctgattcctgttttcaagaacatggcggatgcaatgcgcaaacacccagaagtggatgtgctgatcaatttcgcctcactgcgttcagcatacgattccacgatggagactatgaactatgcccagattaggacgatcgctatcattgccgaaggtatacccgaggccctgacccggaaactaatcaagaaggccgatcaaaagggtgtaaccattataggtcctgcaaccgtgggcggtatcaaacccggatgcttcaaaatcggtaacactggcggtatgctggataacatactggctagtaagctgtataggcctggttcggttgcatacgttagtcggtctggcggaatgtcaaacgagctgaacaacattatttctcgaaccactgacggagtgtacgagggagttgcaattggtggcgacagataccccggatctacttttatggaccacgtgcttcggtaccaggacacccccggagtgaaaatgatcgtggtgcttggggaaataggcggtaccgaggaatacaaaatatgtagaggcattaaggaaggaaggctcacaaagcccatcgtctgctggtgtatcggcacctgtgcaacaatgttctctagcgaggtgcagttcggtcatgccggagcctgtgccaatcaagccagcgaaaccgcagttgccaagaaccaggctcttaaagaggcgggagtgttcgtgcctaggtcatttgatgaactaggcgagattatccagagtgtatatgaggatcttgtcgctaatggcgttattgtccccgcacaggaggttccacctcctacagttcctatggattattcttgggcgagagaactgggtctgatcaggaagcctgcctcttttatgacctctatttgtgacgaacggggtcaagagttaatctacgccggaatgcccatcacagaggtgtttaaggaggaaatgggaattggtggcgttctcggcttgctgtggttccagaaacgacttccaaagtacagttgccagttcatcgagatgtgtctaatggtgactgctgatcatgggccagccgtctctggagctcataatactatcatttgcgctagggcgggtaaggacctcgtctcctccctaacgagtgggttgcttaccatcggtgataggttcggcggagccctggacgccgcagctaaaatgttctccaaggcatttgattcgggtataataccgatggagtttgtgaataaaatgaagaaggagggcaaactgatcatgggtataggccacagggtgaagtcaattaataaccccgatatgagagttcaaatcctgaaagactatgtgagacaacacttccccgcaaccccacttctagactacgctcttgaagtggaaaaaatcactacaagtaaaaaaccaaatctcattctgaacgttgacggcttaatcggagtggctttcgtagacatgctccgaaattgcggatcatttaccagggaagaggccgacgagtacatcgatattggcgcactgaacggaatatttgtgctgggtagatcaatgggattcattggtcactatctggatcagaagagattaaagcagggcctgtaccggcacccgtgggacgacatcagctacgtgttgcccgagcacatgagcatgtag

SEQ ID NO: 27388 - DNA, 2493 bp, Artificial Sequence
  Description of Artificial Sequence: Synthetic coding sequence
atgtctgccaaagcaatctccgagcagacaggcaaggaactcttgtacaagttcatctgtaccaccagcgccattcagaatagatttaagtacgcacgcgtcacacctgatacagactgggcaagacttctccaagaccacccttggttgctgtcccagaatctcgttgttaagccagaccagctaataaaacggaggggcaagctgggcctggtgggcgtgaatctaactttggatggagtgaaatcatggctcaagccccgacttggtcaggaagctacgggtatagtgcgggcaatccgcgattaccaagggcctttgaaagagcatgaagtgacaattttcgtccgacggggtggccctaactatcaggaaggcctgcgcgtcatgggcgaagtcgggaaaacaactggcatacccatccacgtatttgggaccgagactcacatgaccgctatcgtgggcatggccttaggtcataggcctatccctaaccagccaccaactgccgctcacacagccaattttcttctaaacgcgagtggctccacctcgactcccgctccttcccggacggcgagcttcagcgaaagccgagctgatgaagtggcacccgctaagaaggccaagcccgcaatgccccagggaaagagtacaactctcttctctaggcacactaaagcaattgtgtgggggatgcagacacgtgcggtacaggggatgctggacttcgactacgtttgcagccgggacgagccatctgtggctgccatggtctacccctttaccggggatcataagcaaaagttctactggggccacaaggagatcttaattcccgtgttcaagaacatggccgacgcgatgaggaaacaccccgaggtggacgtgctaatcaatttcgcaagcctccgaagcgcttacgactctaccatggagaccatgaactacgcacagattagaaccattgccattattgccgaaggtattcccgaggcactcacacggaagctgataaaaaaagccgatcagaagggggtgactattatcggtcctgctacagtgggcggtatcaaaccgggatgctttaagatcggaaacaccgggggtatgctggacaacatcttagcatctaaattgtacagaccagggtcagtggcatatgtctctcgttctggaggcatgtcaaacgagctgaataatatcatttctaggactaccgacggagtttatgaaggtgtggccatcgggggagataggtatccaggcagtacattcatggatcacgtcctcaggtaccaggacacccccggagtaaagatgattgtggtgttaggcgagattggaggaacggaggagtacaaaatctgcagaggcataaaggaggggagactcactaagccaattgtttgttggtgcataggcacctgtgctactatgtttagctcagaggttcagtttgggcatgcaggtgcctgtgcgaaccaggccagtgaaactgccgtagcaaagaaccaagccctcaaggaggctggcgtgtttgtgccacgctcatttgatgagctgggcgagatcatccaatccgtatacgaggacttagtcgcaaacggggtgattgtgccagcccaggaggtgccaccgcctaccgtgcctatggactactcatgggccagagagctgggtctgatccgaaagccggctagctttatgacttctatctgcgacgagagaggacaggagctgatttacgcaggtatgcctatcactgaggtctttaaggaggagatgggcattggaggtgtgctgggcctgctgtggttccagaagcggttgccgaagtatagctgccagttcatagaaatgtgcctcatggttactgccgaccacgggccagctgtgtcaggcgctcacaataccattatatgcgccagggcaggaaaggacctggtgtcaagtctcacatcaggtctgctgactatcggtgatcggttcggcggagcgctcgacgcagcagctaaaatgtttagcaaggcattcgactcgggcattatccccatggaattcgtaaacaagatgaaaaaggagggaaaactaatcatgggaatagggcaccgcgttaaatctatcaataaccccgacatgcgtgtgcaaattttaaaagactatgtgcggcaacacttccctgcaacacctctcttggactacgctctcgaggtagagaaaatcacaacctcaaagaaacctaacctaatactgaatgtagacgggctgattggcgtggctttcgttgatatgctgagaaattgtgggtcttttaccagggaggaggcagacgagtacatcgatattggcgctctgaatgggatctttgtcctagggaggagcatggggtttatagggcattatttggaccaaaagcgcttaaaacaaggactctaccgccacccttgggatgacatctcctacgttcttccggagcacatgtccatgtag

SEQ ID NO: 27389 - DNA, 1512 bp, Artificial Sequence
  Description of Artificial Sequence: Synthetic coding sequence
atgtcgtccatcctggaagaaagaattctgggagccgacacgagcgtggatctcgaggaaactgggagggttctgtccattggggacgggattgcacgagtgcacggcctgcgcaacgtgcaggctgaggaaatggtcgagttttcctccggactgaagggaatgtcacttaatctggagcctgacaatgttggggtggtggtgttcgggaatgataagctcatcaaggagggcgatatcgtgaagcgaaccggagcgattgtagatgtgccagtgggcgaggagctactcggcagggtcgtcgatgcactgggcaatgctatcgatggaaaaggaccaatcgggtctaaaacccgaagacgcgtgggcttgaaagctccgggtattataccccgtatctcagttcgggaacccatgcagacaggcattaaagccgtggattctctggtgcccattggcagaggacaaagggagctgattatcggcgacagacaaactggtaaaacgagcattgcaatcgacacaatcatcaaccagaaaaggtttaacgacgggagtgatgagaaaaagaaactgtattgtatctatgtggccatcggacagaagcgatccacagtggcacagctggttaaaagactgaccgacgccgatgctatgaagtacactatcgtggtctctgccactgcatcagatgcggcacccctgcaatatttagctccctatagtggatgcagtatgggtgaatatttccgagacaatggcaagcacgcactgattatctatgacgacctgagcaagcaggctgtggcctataggcagatgagcctcctcctgcgcaggccacccggaagggaggcctatcctggtgacgtcttttacctgcactctcgcctcctggaacgggctgcaaaaatgaatgatgcatttgggggaggaagcttgaccgcccttcctgtgattgagacacaggccggagacgtttctgcttatatacctacgaatgtgattagcatcacagatggccaaattttcctcgagaccgaactcttctataaaggaatccgaccggcaatcaatgtaggcttaagcgtcagcagagtcggctcggcagcacagactagagccatgaagcaggtggctggcacaatgaaactggagctggcccagtatcgcgaggtggcggcttttgcacagttcgggtccgatcttgacgccgctacccagcaactgctgagcaggggagttcggctgactgagttgcttaaacagggacaatattctcctatggctattgaagagcaggttgctgttatttacgccggagtgagaggttatttagataagctcgaaccctcaaaaatcaccaagttcgaaaatgcgttcctgagccacgtggtttctcagcaccaggctctcctcggtactattcgtgccgacgggaagatcagtgagcagtcagatgccaaactcaaagagattgttaccaattttttggcgggatttgaggcctag

SEQ ID NO: 27390 - DNA, 177 bp, Artificial Sequence
  Description of Artificial Sequence: Synthetic coding sequence
atgctgtctgtgagagtggccgcagccgtcgtgcgggctcttccccgtcgggcaggcctggtgtcaagaaatgccctgggtagttctttcattgctgctaggaacttccacgctagcaatactcatctgcagaagactgggaagctgttatttttaagcctgaggagaacatattag

SEQ ID NO: 27391 - DNA, 1596 bp, Artificial Sequence
  Description of Artificial Sequence: Synthetic coding sequence
atgctgtctgtgcgagtagctgctgcagtggtccgagcgttgcccaggcgagcgggattagtgtctcgtaacgcccttggttcttcgttcatcgctgcaaggaactttcatgcttcaaacacacacctacagaaaaccggcaccgccgagatgtcttccattttggaagagcgaattttgggcgcagatacaagtgtagatctggaggaaaccggaagggtgctttcaatcggggatggcattgccagggttcacggtctgcggaacgtccaggcagaagagatggttgagttctcctccggtttaaaaggcatgtccctgaatcttgagcctgataacgtgggtgtagttgtctttgggaacgataagttgataaaggagggcgacatcgtgaaacgcactggcgctattgtggatggacctattggtagcaagactcggcgaagagtcggcctcaaggcaccaggcatcatcccaagaatatccgtacgggagcccatgcagacagggattaaagctgtggacagcctcgtacccatcggaagaggtcagcgagagcttatcatcggagataggcaaactggcaagacaagcatcgctattgacactatcatcaatcagaaacgctttaatgacggatcggacgagaaaaagaaactctattgcatctacgtcgctattggacagaagcgatctactgtggcacagctggtcaaaagacttacggatgcggatgccatgaaatataccatcgttgtatcggcgaccgccagtgacgccgcaccactgcagtatcttgctccttacagcggatgttctatgggggagtattttagagataacgggaaacacgctttgatcatctacgatgatctgtctaaacaggctgtggcttaccgacagatgtcactgctattgagacggccacccggacgggaagcctaccccggagatgtcttttatctccatagtagactgctcgaaagagctgcgaaaatgaatgatgcgtttggaggaggaagcctcacagcactgcccgttattgagactcaagccggtgatgtttctgcctacatccctacaaacgttatcagtatcaccgatgggcagatctttctggaaactgagctcttctacaagggcattcgtcccgcaatcaacgttggcttgagcgtgtcccgtgtgggatcggctgcccagacacgcgctatgaaacaggtggcgggtactatgaagctcgagctagcccagtaccgagaggttgccgctttcgctcaattcggctcagacctggacgcggcaacacaacagttgcttagccgaggcgttcggctgactgagctgctcaaacagggccagtattctccaatggccattgaggaacaggtggcagtgatctacgctggcgttaggggctacctggacaaactggaaccaagtaagatcaccaaatttgagaatgcatttctgtcacacgttgtgagccaacatcaggcgctgctgggaaccatccgcgcagatggcaagatttctgaacagtccgacgctaagctgaaggagatcgtgaccaacttcctggcaggttttgaagcctag

SEQ ID NO: 27392 - DNA, 1662 bp, Artificial Sequence
  Description of Artificial Sequence: Synthetic coding sequence
atgctctcagtacgggtggctgcagccgtggttagagctctaccgaggcgggcaggacttgtgtctcgcaacgcccttggctccagtttcattgcagcccgtaatttccacgcttccaatacccatctgcaaaaaaccggaactgccgaaatgtcttccatactggaggaaagaattctcggagccgacacgagcgtcgacctcgaggagaccggtagggtactctcaatcggcgatggaatagccagagtgcacggactccggaatgtgcaggctgaggagatggtcgagtttagctccgggctcaaaggcatgtctttgaatctcgaacctgacaatgtcggcgtcgtagtattcgggaatgataagctgatcaaagagggcgacatcgttaagcgtaccggcgctatcgtggatgtgcctgtaggtgaggaacttctggggagggtggttgacgcactcgggaacgccatcgatggcaaagggccaataggcagcaagacgcgcagacgggtaggacttaaagccccaggcatcattcccagaattagtgttcgagagcccatgcagaccgggattaaggccgtggacagtctggtacctattggcaggggtcagagggaactgattatcggtgaccgccagaccggaaaaacaagcatagctatagatactattattaaccagaagaggttcaatgatggctctgatgagaaaaaaaaactgtactgtatttacgtggccatcggacagaagcggagtaccgtggcccagctcgtcaagcggctgaccgatgcagatgccatgaagtatactatcgttgtgtctgccactgccagtgatgcagcccctctccaatacttggccccttatagtggttgctccatgggcgaatactttcgggataacgggaaacatgcactgatcatctatgatgacttgagcaaacaggccgtggcataccgacagatgagcctgctcctgcgcaggccacctggcagggaagcttacccaggtgacgtgttctacttacactcccggctgttagaacgcgcagctaagatgaacgacgcttttgggggtggctctctgaccgctctaccagtgatagagacccaggcaggtgacgtgagtgcatatattcccaccaatgtgatcagcattacagatggacagattttccttgagaccgaactgttctataagggcatcaggccagctatcaatgtgggactgtctgtctcacgagttggaagcgcagcccaaactagagccatgaaacaagttgccggaacaatgaaattggaacttgcacagtacagagaagtggctgccttcgcacagttcggttccgatctggacgccgctacccagcaactgttaagtcggggagttagattgactgagctgctgaaacaaggtcagtattcccctatggctattgaagagcaggtggctgttatttatgcaggtgtcaggggttatctggacaagctggagccctctaagatcaccaagttcgagaatgccttcctatcacacgtcgtgtcccagcaccaggccttgttaggaactatccgggctgacggcaaaatttctgaacagagtgatgctaaactaaaggaaatcgtgaccaactttctagcgggtttcgaagcatag

SEQ ID NO: 27393 - DNA, 1662 bp, Artificial Sequence
  Description of Artificial Sequence: Synthetic coding sequence
atgctgtcagtgcgggtcgccgctgccgtggtgagggcccttccgcgaagggccggtttagtgagtcgaaatgccctggggtccagcttcattgcggctaggaattttcacgcttccaacacacacctgcagaagacgggtaccgctgagatgtccagtattcttgaggagcgcatcctcggagctgatacgtccgtggacctggaggaaaccggccgagtcttgtctattggagatggaatcgcacgcgtgcatggtctgcgaaatgtgcaagccgaagagatggtcgaatttagtagcgggctcaaaggtatgtctttgaatttggagcctgacaatgtaggtgtagtcgtattcgggaacgacaaactgataaaagaaggggatatcgttaaaaggaccggagcaattgttgatgtgccggtgggcgaagagctgctgggccgagtagtcgatgcactgggaaatgctatcgatggtaaaggccctattggttccaagacacgccgtagagttgggctcaaggctcccggaattatcccccgtatcagtgtgagagaaccaatgcaaactgggatcaaagcggttgactctctggttccaattggacggggtcaacgcgaattgattattggcgacagacagaccggaaaaacttcaattgccatcgatactatcataaatcagaaaaggttcaatgacggttccgatgagaagaagaagctatattgtatttatgtcgccatcggccagaaacgaagtactgtggcccagctcgtgaagcgcttgaccgacgcagatgcgatgaaatacaccatcgtcgtgtcggcaacagcatccgatgctgcgccacttcaataccttgcgccttactccggctgttccatgggtgagtattttcgcgacaatgggaagcatgccctgattatttatgacgatctttccaaacaagccgtggcctatcggcagatgagtttgctcttgcgccgaccccctggacgggaagcctacccaggtgacgtgttttacctgcacagcaggttgctcgagagggctgctaaaatgaacgacgctttcggcggaggttctttaaccgcgctcccggtgatcgagacgcaggctggcgacgtcagcgcttatatccctactaatgtgatctcgattaccgatgggcaaatttttctggagacggaactgttctataaaggcattcggccagccatcaatgttggcctgagcgttagtagagtaggcagcgctgcccagaccagggctatgaagcaggtggcaggtaccatgaagttggagctggcccagtatagggaggtggccgcttttgcacaatttggaagcgacttagatgccgcaacacaacagctgcttagccgtggggtgcgcctgacggaactgctgaagcaggggcagtatagccctatggccatcgaggagcaagtggctgtgatctatgccggagtcagaggctatctggataaattagaaccctccaagatcacaaaattcgaaaacgcctttctgtctcacgtcgtttctcagcaccaggccctgctgggcactatacgtgcagacggcaagatctccgagcaaagtgacgctaaactgaaggaaatcgttacaaattttctggctggattcgaggcctag

SEQ ID NO: 27394 - DNA, 1512 bp, Artificial Sequence
  Description of Artificial Sequence: Synthetic coding sequence
atgagctctatcttagaggagcggatattgggcgcagatacttctgtggatctggaggaaacaggccgagtcctttccatcggggatggtatcgcaagggtacacggcctgcgcaacgtccaagctgaagagatggtggagttctcaagcggtcttaaaggtatgagcttgaatctggagcccgataacgtgggagtggtcgtgttcggaaacgacaaacttattaaggaaggagacatcgtcaaaagaaccggggctatcgtggatgtgccagtgggtgaggagctcctaggcagggttgtggatgccttaggaaacgctatcgatgggaaaggccctatcgggagtaagacccggagaagggttggacttaaagcgcctgggatcattccgaggatttctgttcgtgaacctatgcagacgggcatcaaggctgtggattcacttgtgcctatcggaaggggacaaagggaactgattatcggggatagacaaaccgggaagacctctatcgctattgataccattatcaaccaaaaacggtttaacgatggaagcgacgaaaaaaaaaagctctattgcatatacgtggctattggacaaaaacgctcgacggtggcccagttggtcaaacgactgactgatgccgatgcaatgaagtacaccatcgtggtgagcgccaccgcctctgacgcagctcccttgcaatatttggcgccatatagcgggtgctcaatgggtgaatacttcagagataacgggaaacacgccctcataatctacgacgatctgagcaaacaggcagttgcttatcggcaaatgtcactcctgctgcggagaccccctggcagagaggcttacccaggcgacgtcttttatctccattcacgccttctggaaagggctgccaaaatgaacgatgcctttggagggggttccttgacagcgttgcctgtgatcgagacccaggcaggagatgtgtctgcgtatatcccaacaaacgtcatctctattactgacggtcagatatttcttgagaccgagctattctacaaaggcatcaggccagctattaatgtaggcctctccgtatcacgcgtaggttctgctgcccagacacgcgctatgaagcaggtcgccggaactatgaaactggaactggctcaataccgtgaggtagccgcattcgcacaattcgggagcgatttggacgcagcaacgcagcagctgctcagtcggggtgtgcgtctcactgagctgctgaaacaaggtcagtatagtccaatggctatagaggaacaagtggcggtgatctacgccggtgtgcgaggctatctggacaaattggagcccagtaaaatcacaaagttcgagaatgcttttctgtcgcatgttgtgtcccagcaccaggctctattgggcacaatccgagcggacgggaagatctccgagcagagcgatgcaaagctcaaagaaattgttactaacttccttgcaggtttcgaagcatag

SEQ ID NO: 27395 - DNA, 3843 bp, Artificial Sequence
  Description of Artificial Sequence: Synthetic coding sequence
atggacctcgagggcgatcgaaatgggggagcgaagaagaagaatttcttcaaactaaataataagtcagagaaagacaaaaaggaaaagaagcccactgtgtccgtgttctcgatgttcagatattctaactggctggacaagctgtatatggtcgtgggaaccctggcggcaattatacacggagccggactgccactgatgatgctcgtcttcggcgaaatgactgacatcttcgccaatgctgggaatttggaagacttaatgtcaaacattacaaataggtccgacatcaatgatactgggttctttatgaacttggaagaggacatgacacgttacgcctactactactctggaattggagccggtgtgctcgttgctgcctacattcaggtgagtttttggtgcctcgccgctgggcgtcagattcacaagatacgcaaacaatttttccacgcaattatgcgtcaggagattgggtggttcgacgtgcatgacgtgggtgagctgaacaccaggctgactgatgacgtttcaaaaatcaacgaagggataggcgacaagattggcatgttcttccaaagtatggccaccttttttacaggattcatagtgggatttacccgtggctggaaactgaccctggtaatcctcgccattagtccagtgctggggctgagcgccgctgtgtgggccaagatcctgagtagtttcaccgataaagaactgctagcctatgctaaagccggtgcagtcgctgaggaggtcttggctgcgattcgcacagtgatcgcattcgggggtcagaaaaaagaacttgaacgctacaacaaaaatctggaggaagccaaacggatcggaatcaagaaggccatcaccgccaacatcagcattggcgcagcatttctgctcatttatgccagttatgcccttgcattttggtatggaacaaccctggtcctcagcggtgagtattctataggccaggtgctgacagtgtttttctctgttctgattggcgcttttagcgtcggccaggcatcccctagtatagaggcattcgccaatgccagaggagctgcctacgagatattcaagataattgataacaagcccagtatcgactcgtattcaaaatctggacacaaacccgacaatatcaaggggaatcttgagttccgcaatgtccacttttcttaccccagcaggaaagaagtgaagatcctgaaagggctaaacctgaaagtccagtccggccagaccgtggctctggttggcaactccggctgtggcaagagtactacagtacaactcatgcagaggctctatgatcctacagagggaatggtctccgtcgacggacaagacatccgcacaattaacgtgaggttcctgcgcgaaattatcggtgtggtgagtcaggagccagtgctcttcgctactaccatcgccgaaaacatcagatacggaagggagaacgtcacgatggatgagattgagaaggccgtgaaggaggctaatgcttacgatttcatcatgaaattgccacataagttcgataccctcgtgggagagcgcggtgcccagctgtctgggggacagaaacagcgcatcgctattgccagagccctggtgcgaaacccaaagatcctgctgcttgacgaagctacctcagcactggacaccgaatctgaggccgtcgtccaggttgctctggataaagcgcgaaagggtagaaccaccatcgtgattgcccataggctgagcactgtcagaaacgctgatgtcattgccggtttcgacgatggggtgattgtggagaaaggaaaccacgacgagctaatgaaagagaagggaatttatttcaagctggtgacgatgcagaccgcaggtaatgaagtagagctcgagaacgcagccgatgagtccaaaagcgaaattgacgcccttgagatgtccagtaatgatagccgttcatccttaattaggaagaggagcaccaggcggtctgtccgcggaagccaggcccaggaccgcaaactgtcaaccaaggaggccctggacgagtctattccaccagtgtctttctggagaattatgaagctcaatctgactgagtggccgtactttgtagtgggagtattttgcgctatcatcaatggtgggctgcagcccgcttttgcgatcatcttttctaagataatcggcgtgttcacacggattgatgatccggagaccaagaggcaaaattccaacttgttttctctgctcttcctggccctgggaatcatcagcttcatcacatttttcctgcagggattcacgtttgggaaggccggagagattctaacgaaaagattacggtacatggtgttcaggtccatgttacgtcaggacgtatcctggttcgacgatcccaagaacacgaccggcgctctcacgactaggcttgctaatgatgcagcgcaggtgaaaggggcaataggtagtaggcttgccgtgatcacccagaacatcgctaaccttgggaccgggataatcattagcttcatttacggctggcaactgaccctcctgttattggcaatcgtgcccatcatcgctatagctggcgtagtcgaaatgaagatgctgagtggtcaggctcttaaggataaaaaagagctggagggcagcggaaaaatagcaactgaggctattgaaaatttccggacggtggtgagcttgactcaggagcagaagttcgagcatatgtacgctcagtccttacaggtgccctacaggaattccctgagaaaagcccacatttttggcatcacattttccttcacccaggccatgatgtacttcagctatgcagggtgttttaggtttggggcttacctggtcgcccacaagctcatgagtttcgaggacgtgttactcgtcttctctgcagtagtatttggcgctatggcagtcgggcaggtatcttccttcgctccagactacgctaaagccaaaatctccgcagcccacattatcatgattattgaaaaaactcccctcatcgattcttacagtaccgagggcttgatgccgaatacgcttgaaggcaacgtgacctttggcgaagttgtctttaattaccccacccgccctgatatacctgtccttcagggtctgtcccttgaagtaaagaaaggccagaccctcgccctcgttggctcgtccggctgtggtaagtcaaccgtggtgcagctattagagcgcttctatgatccactcgcaggaaaggtactcctggatggcaaggagatcaagcgcttgaacgtgcaatggttaagagcccacctggggattgtgagccaggagccaattctcttcgattgttctattgctgaaaacatcgcttatggggataacagtcgggtggtcagtcaggaagaaatcgtgcgagctgccaaggaggctaatatccatgcttttatcgaaagcttgcccaacaaatacagcacaaaggtgggcgacaaaggaacgcagctctcaggaggacagaagcagaggatagcaatagcaagggcactcgttaggcagccccacatcttgctgctggacgaagccaccagtgcccttgacactgaaagcgagaaggtagttcaggaggctctcgacaaggcgagagaaggacggacttgcattgtcattgcacacaggttatccaccatacaaaacgcggatctaatagttgtgtttcagaatggtcgcgtgaaagagcatggtactcatcagcagctgctcgcccaaaagggaatctacttctccatggtgtcagtgcaggccggaacaaagcgccagtag

SEQ ID NO: 27396 - DNA, 69 bp, Artificial Sequence
  Description of Artificial Sequence: Synthetic coding sequence
atggacctggagggcgaccgtaacgggggtgcaaaaaaaaagaacttcttcaaacttaacaataaatag

SEQ ID NO: 27397 - DNA, 147 bp, Artificial Sequence
  Description of Artificial Sequence: Synthetic coding sequence
atggacttagaaggagatcgaaacgggggagctaagaaaaaaaacttctttaagcttaacaacaaatccgagaaggataagaaggagaagaaaccaaccgtctctgtgttctctatgtttaggtactccaattggttagacaaatag

SEQ ID NO: 27398 - DNA, 3186 bp, Artificial Sequence
  Description of Artificial Sequence: Synthetic coding sequence
gccctgagcccagtgatgggcgtgtcggctggttactggcctaagatcctatccagtttcacagacaaggaactgctcgcttacgccaaggccggagctgtcgccgaagaggttctggcagcaatccgcacagttatcgcctttggcggacaaaagaaagaactggagcgatacaacaagaatcttgaagaggctaaacgaattgggataaagaaagccattactgccaatatatcaattggggcagcttttctcttaatctatgcctcctacgctctcgcgttttggtacggaactacacttgtgctttctggcgagtactcaatcggccaagtcttgaccgtgttcttttccgtgctcatcggcgctttctccgtaggacaagctagccccagtatcgaagcatttgccaatgcaagaggtgccgcttacgagatcttcaaaattatcgataataaaccatcaattgatagctattcgaagtccggacacaaaccagataacattaaaggtaacctcgaattccggaacgtccatttctcctatccctcgagaaaggaggtgaagatactgaagggtctgaatctcaaggttcagtccggccagacagtagcactcgtaggtaacagcgggtgcggcaaatcaacaaccgtgcagctcatgcagagactttacgacccgacagagggcatggtctcagtggacggacaggacattcgcaccattaatgtccgattcctgcgtgagatcatcggagtggtgtcacaagaaccggtgctttttgccactacaatagcagagaatattcgatatggcagagagaatgtaaccatggatgaaattgagaaggccgtgaaggaagccaacgcatatgatttcatcatgaaactccctcacaaattcgataccctggtaggagagcggggtgcccaactgagcggcggtcaaaagcagaggatcgccatcgcaagggctctggtgcggaatcctaagatcctcttgctcgacgaggccaccagtgcactggatacggaatcagaagcagtagttcaagttgccctcgacaaggccagaaaaggaagaacgacgatcgtgattgcccaccgccttagtacagtccgtaatgctgacgttatcgctgggtttgatgacggagtaatcgtcgaaaagggaaatcacgacgaacttatgaaagagaaggggatctattttaagctggttacaatgcagacggccggtaacgaagttgagttagaaaacgccgcagacgaatccaaaagtgaaatcgacgctctggaaatgtcatctaacgatagcagaagttcactcatcagaaagcgtagtaccaggagatccgttcgaggatcccaggcccaggaccgcaagctgtcaacaaaagaagcactggatgaaagtattcctcccgtctcattctggcgaataatgaagctcaatcttacagaatggccttactttgtagtgggtgttttctgtgcgataattaatggagggcttcagccggcattcgccataattttttctaaaattatcggggtatttactcggattgatgatccggagacaaagagacaaaattccaatttatttagccttctatttctagccctgggcattatttcttttattacttttttcctgcagggcttcactttcggtaaggcaggggagattctgactaagagactgcgctacatggtgtttcgcagcatgctgaggcaggacgtcagctggttcgacgatcctaaaaatacgactggcgctctgactacaaggctcgccaacgacgcggctcaggtcaagggggctatcggtagccgtctcgccgtaattactcagaatatcgcgaacctgggcaccggtatcatcatctcttttatttacggttggcagctgaccctgctccttctggccatcgtccccataatcgctatagctggcgttgtagagatgaagatgctgtccgggcaggccctgaaagacaaaaaggagcttgaagggtccggaaagattgccacagaagcgatcgaaaattttcgcacagtggtgtctctgacacaagagcagaaattcgaacacatgtatgcgcagtctctgcaggtgccctacagaaacagcctgcggaaagctcacatctttggcattacgttttccttcacccaagctatgatgtactttagttacgcaggttgcttccgtttcggggcttatctggtagcgcacaaactgatgtcttttgaggatgtgttgctcgtcttctctgcagttgtgttcggggctatggcagtgggacaggtttcttcattcgcacctgactatgctaaggccaagatcagtgccgcacatatcatcatgatcatcgagaagacccctctgattgattcctactctactgaaggtcttatgcctaacactttagaggggaacgttacatttggtgaagtggtcttcaattaccccacaaggcctgatattccagttctgcagggcctgtctctggaagttaaaaagggccaaaccctggccctagtcggaagctctggttgcggcaagtcgacagtggtgcagctcctcgagaggttctacgacccgttggcagggaaggtcttgttggacggcaaagaaatcaagagactgaacgtccagtggctccgagcccacctcgggattgtgtctcaagagccaattttgttcgactgcagcatcgcagaaaacatagcctacggtgacaacagtcgggtcgtctcgcaagaggaaattgtaagagcagccaaggaggctaatatccacgcattcatcgaatccctgcctaacaaatactcaaccaaagtgggcgataaagggactcaactgtccggagggcagaagcagcgaatcgctattgcaagagcgctcgtaagacagccacacatcttactgctggacgaagccactagcgccttggatacagaatccgaaaaagtggtccaggaggccctcgacaaagccagggaaggtaggacgtgcatcgtgatagcccatcgtctaagcaccatccagaatgccgacctgatagtcgtgtttcaaaacggtagagttaaggagcacggcacacaccagcagctccttgcacagaagggcatttacttctccatggtctcagtgcaagcgggtaccaagaggcagtag

SEQ ID NO: 27399 - DNA, 3651 bp, Artificial Sequence
  Description of Artificial Sequence: Synthetic coding sequence
atggatctggaaggagatcgcaatggcggtgcgaaaaagaaaaattttttcaagttaaacaataagtcggaaaaggacaaaaaggaaaaaaagcctaccgtctcagtcttcagcatgttcagatactctaattggctcgacaaattgtacatggtcgtgggtactctggccgctatcatccatggagccggtctccctcttatgatgcttgtgtttggagagatgaccgacatattcgccaatgccggaaacctcgaagacctgatgagcaacatcacaaatcgaagcgatatcaacgacacaggcttctttatgaatttggaagaagacatgacatccgatgtcagcaagataaatgagggaatcggcgataaaattggtatgttctttcagtctatggccaccttttttaccggctttatagtagggttcaccaggggctggaaactgaccctcgtgatattggccatctctcccgtgctagggctatctgctgccgtgtgggctaaaatactgtccagtttcaccgacaaggagcttctcgcttatgctaaggcaggagctgtggctgaggaagtactggccgctattcgaaccgtcatagcttttggcggacaaaagaaggagctggaacggtacaataagaatctggaagaagccaagcgtatcggaattaaaaaggccattacagccaacatctctattggtgccgctttccttcttatttacgcatcctacgccttagcattttggtatggaacaacccttgtattgagtggtgaatactctatcggccaagtcctcaccgttttcttttctgtgctgatcggcgcattctcagtcgggcaggcttccccaagtattgaggccttcgctaatgcccgaggcgctgcgtacgaaatcttcaagataattgataacaagcccagtattgactcttattctaaatccggacacaagcctgacaatatcaagggcaatctggagtttcgaaatgtgcatttcagttacccaagtaggaaagaagtgaaaattctgaaaggacttaaccttaaagtccaatcagggcagactgtggctttagtcggaaactctggttgcggcaagagcaccacagttcagcttatgcaaagattatatgaccctaccgagggaatggtctcggtcgatggtcaagacatccgcaccatcaatgtgaggttcctgagggaaatcattggcgtggtttcacaggagcccgttctgtttgccactaccatcgccgagaatatccgctacggaagggagaatgtcactatggacgagatagaaaaggcagtgaaagaggctaacgcgtatgattttatcatgaagctgccccacaaatttgacacacttgtgggggagcgaggtgcccagctctccgggggacagaaacagcggattgctattgccagggcactcgttcgcaaccctaagatactcctgctggatgaggctacctcagctttggacaccgagagtgaagctgtggttcaagtggctctggataaggctcgtaaaggcagaactacaattgtgatagctcatagactgtcaactgttaggaatgccgacgtgatcgctgggttcgatgatggggtgatagtggaaaaaggtaaccatgatgagcttatgaaagaaaagggtatttacttcaaactggtgaccatgcagacggcgggaaatgaggttgagctagaaaacgccgctgacgagtccaaaagtgagatcgacgccttggagatgagctcaaacgatagcagatcctctctgataaggaagagatctacaagaaggagcgtgaggggcagccaggcacaggatcgtaagttgtccactaaggaggccctggacgaaagtatcccaccagtgtcattctggagaattatgaaattgaatctaacagagtggccttatttcgttgttggcgtcttctgtgctattattaacggaggtctacagcccgcattcgctatcatatttagcaaaattatcggtgtgtttacccggattgatgaccctgaaaccaaaagacagaacagtaacctatttagtttgctgttcttggcactaggcataataagttttatcacgtttttcctccagggcttcacctttggaaaggctggcgagatactgactaagaggttacgctacatggtttttagaagcatgctgcggcaggatgtctcctggtttgacgatcctaaaaacacaaccggggctctcacaacgaggttggctaatgatgccgctcaggttaagggggctatcggatctaggctggccgtgatcacacaaaatattgccaatctgggtaccggcattatcatctctttcatctacgggtggcagctgaccctgctgctactggccatcgtccctataatcgccatcgctggtgtggtcgagatgaagatgctgtcaggccaggcgctcaaggacaagaaggaactcgagggaagcggcaagatagccaccgaggccatcgaaaatttccggaccgtggtttcactgactcaggagcaaaaattcgagcatatgtacgctcagtcgctgcaggtcccttatcgcaattcccttcggaaagcacacatttttggtatcacattttcattcacccaagctatgatgtatttcagctatgccggttgtttcagattcggggcatatcttgttgctcacaagctgatgagctttgaggatgtcctccttgtcttttcagctgtggtattcggagccatggccgtcgggcaggtatcgagtttcgcaccagactatgctaaagcgaaaatcagcgccgcacatattatcatgataatagagaagacccccttgattgacagttattctacagaaggccttatgcctaataccctcgaaggcaacgtaaccttcggggaagtggtattcaactaccctactagacccgatatccccgtgctgcagggattgtctctagaagttaagaaaggccagacgctcgccttggtgggctcctccgggtgtggtaaaagcaccgtggtgcagctgctggagaggttctatgatccacttgccggaaaggtgttgctcgatggaaaggagattaagaggctgaatgtgcagtggttacgggctcatctgggcattgtcagccaagagcccatactgttcgactgtagtatagccgaaaatattgcatacggcgacaactctagggtggttagccaggaagagattgtacgggcagctaaggaggctaatatacacgcctttatagagtcactgccaaacaagtactcaacgaaggtgggagataaaggaactcagctatccggtggacaaaaacagagaattgcaatagctagggcgttggtccgacaaccccacattctccttctggacgaggcaacgagcgcccttgacactgaatccgagaaagtagtccaggaagctctggacaaggccagagaagggcgtacttgcatcgttatcgcccaccgcctgagtacaatccaaaacgccgatctcatcgtcgttttccagaacggccgagtaaaagaacacgggacccaccaacagctgctggcccagaagggcatctacttttccatggtgtctgtgcaggccggaacgaagaggcaatag

SEQ ID NO: 27400 - DNA, 4401 bp, Artificial Sequence
  Description of Artificial Sequence: Synthetic coding sequence
atggctctccgcggattctgctccgccgacggaagtgatccgctgtgggactggaacgtgacttggaacaccagcaatcctgacttcaccaagtgttttcaaaacactgtgctggtctgggtgccctgcttttatctgtgggcttgtttcccgttctactttctatacctttcccgccacgacagaggctatatccagatgactcctcttaataaaaccaagaccgcattgggattcctgctgtggatcgtgtgctgggccgacctgttttacagcttttgggaaagaagccgtggcatcttcctcgctcctgtctttctggtttcgccaacgctactggggattaccatgctcctcgcaacattcttaattcaactcgagcggaggaagggggtgcagagtagcgggatcatgctaactttttggctggtggccctcgtgtgtgcacttgccatcttacgttccaagattatgaccgccctcaaggaggacgcgcaggtggatttgtttcgagacatcacattttatgtatacttctctcttctccttatccaacttgtgctgagttgcttctccgaccggtcccctctcttctctgagacgattcatgaccctaatccgtgcccggagtcaagcgcctccttcctctcacgaattaccttttggtggataaccgggcttatagtacggggttacagacagccactggagggcagtgacctttggagcctgaacaaggaggacacgtccgagcaggtcgtgccagtgcttgttaaaaactggaagaaggagtgcgcgaaaacaaggaaacagcccgtcaaagtggtgtactctagcaaggacccagcacagcctaaagaaagctcaaaagtggacgcaaatgaagaagtggaagccctaatagtcaagtctcctcagaaagagtggaatccatcactattcaaagttctttataagacttttggtccttacttccttatgtcgtttttttttaaagccattcacgacctcatgatgttttcagggcctcagattctgaagctgctgataaagttcgtcaacgataccaaagctcctgactggcaaggctacttttatacagtgctgctctttgtcaccgcatgcctgcaaacattagttctgcatcagtatttccacatatgttttgtgtcgggcatgcgaatcaagaccgccgttataggcgcagtgtaccggaaggcactcgtgatcacgaattctgctagaaaaagtagcacagtgggggaaatagtgaatctcatgtcagtggacgcccagagattcatggatctggccacttacatcaatatgatttggagcgcaccactgcaggtaatcctagccctttatctattgtggctgaacctcgggccttccgtgctcgctggtgttgccgtcatggtccttatggtgcctgtcaatgccgtgatggccatgaaaactaagacttatcaggtggcgcacatgaagtcaaaggataaccgtatcaagctgatgaacgagattcttaatgggattaaagtccttaagctgtacgcttgggagctggccttcaaggataaggtcctcgcgatcaggcaagaagaactgaaggtgctgaaaaagagcgcgtatctgagcgctgtgggcacctttacatgggtgtgtacccctttccttgtggccctttgtaccttcgcagtgtacgtcacaatagacgagaataacattctggacgcacaaactgcattcgtgtctctagccctcttcaatatcttgagattccctctaaacatcctccccatggtgattagctccatcgtgcaggcgagcgtgtccttgaagcgccttcgcattttcttgtcacacgaagagctcgagccggactcgattgaaagaagacctgtgaaagatggtggcggaacaaattcaattactgttcggaatgccacattcacatgggcacgatcagacccaccaacattgaacggcatcaccttctccattcccgaaggagccctggtggctgtcgtaggacaagtcggatgtgggaagtcttccctcctgtctgccctgctggctgagatggacaaggtcgagggccacgtcgccataaaggggtccgtggcctacgtgccccaacaggcctggattcaaaacgattcactgagggagaacattctattcggttgtcagctcgaggaaccctactaccggtccgtgatccaggcctgcgcgctactgccggatttggagatcctgccatctggagatcgaactgaaataggagaaaagggcgtaaacctcagcgggggacaaaagcagagagtgtctctagctcgggcagtctattcaaacgcagacatctatctgttcgacgaccctctgtcagccgtcgacgcccacgtgggcaaacacatattcgagaatgttatcggaccaaagggcatgttaaagaacaagactcggattctcgttacacattctatgtcatacttaccacaggtggacgttatcatcgtgatgtcgggcggaaaaattagtgaaatgggaagttatcaagagttattggctagagatggcgctttcgctgagtttctgcgaacctacgcatctacagagcaggaacaggatgcggaggagaacggcgtcactggggtgtcgggcccagggaaagaggctaagcagatggagaacgggatgctagtcacagactcagccggaaaacagctccagcggcagttgagctcttcttcctcatattccggcgacattagtcgtcaccataacagtacagccgagctgcaaaaggcggaagccaaaaaagaagaaacctggaaacttatggaagccgataaagcgcaaacaggacaagtgaagctgtccgtgtattgggactatatgaaggccattgggcttttcatcagtttcctgtccatattcctattcatgtgtaaccatgtgtcggctctggcctccaattattggttaagtctgtggaccgatgatcctatcgttaacgggacccaggagcataccaaagtgaggctgagcgtgtacggggcactgggtatctcgcagggaatcgcagtattcgggtatagcatggccgtgagcatcggtggcatcctagcaagccggtgccttcacgtagacctgctacactccattctgcggagtccaatgtcctttttcgaaagaacccccagcggcaaccttgtgaaccggtttagcaaggagttggatactgtggactcgatgatcccggaggtgatcaaaatgttcatgggtagcctgtttaacgtgatcggggcatgtatcgtaatcctgctcgccacaccaatagcggctataataattcccccattgggcctgatttatttcttcgttcagcgtttctacgtcgcctctagtcgacagctgaaacgtcttgaaagtgtctctcgctcacccgtgtatagccactttaacgaaacactcctcggtgtatctgttatacgagctttcgaggagcaagaacgcttcatccatcaaagcgatctgaaggtcgatgagaatcagaaggcctattatcccagcatcgtggctaatcgttggctggctgtgaggctcgaatgcgtcggtaattgtattgttcttttcgctgcactctttgcagtgatctcccgccattctctgtcggccggacttgttggcctcagcgtgtcttactccctacaagtgaccacatacttgaattggctcgtcaggatgtcctctgagatggagaccaacatcgtcgcggtcgaaagacttaaggaatatagcgaaaccgagaaggaggctccgtggcagatccaggagacagccccacccagttcctggcctcaggtcgggagagttgagtttcggaactattgccttagatacagggaggaccttgattttgtgctgagacatattaatgtaaccattaatggcggtgagaaagtgggtattgtaggcaggaccggtgcagggaaaagctcccttaccctgggattgttcaggattaatgagagcgcggaaggagagatcatcatcgatggcatcaacatagccaaaataggactgcacgatcttaggtttaaaattaccatcattccacaggaccccgttctgttcagcggcagcctgcgcatgaatctcgatccttttagccaatattccgatgaggaagtatggacttctctggagttagcccacctgaaggacttcgtctccgccctgcctgataaactggatcacgaatgtgccgagggtggggagaacctcagagtgattgtgctggataagggcgagatccaggagtacggagcaccttccgacctcttgcaacaaaggggattgttctacagcatggccaaagatgcaggtttggtgtag

SEQ ID NO: 27401 - DNA, 4428 bp, Artificial Sequence
  Description of Artificial Sequence: Synthetic coding sequence
atggccctgagaggtttctgctctgccgatggtagcgatcccctctgggactggaatgttacttggaacacatcgaatcctgattttaccaagtgctttcagaatactgtgctggtttgggtcccctgcttctatctgtgggcttgctttccattctattttttgtaccttagcagacatgaccgcggttacatccagatgacccccttaaataaaacaaaaacagccctgggatttctcctgtggatcgtctgttgggccgacttattctacagcttttgggagagaagccgcggaatctttctggcgcctgtcttccttgtatcgccaaccctccttggaattactatgctcctggccaccttcctgatacaactggaacgccgtaaaggcgtacagagttccggaatcatgctgactttctggcttgtggccttggtgtgcgcgctagctatactgcgctccaaaatcatgacagctctgaaagaagatgcgcaggtcgatttgtttcgagatattacgttctacgtgtacttcagtctcctgctgattcagctggtgctgtcctgtttctccgaccgatcccccttgttttccgaaaccatacacgaccctaacccttgccccgagagcagtgccagcttcctgtcaaggatcaccttttggtggatcactggactgatcgtccggggttataggcaacccctggagggctccgacctgtggtcgctgaacaaggaggatacgtcggaacaggtagttccagtgctcgttaaaaactggaagaaagaatgtgccaagacacgcaagcagcctgtgaaggtggtgtactcttcgaaggatccggctcagcctaaggagtcatctaaggttgacgcaaacgaggaagtggaagcgctcatcgtgaagtccccccagaaggagtggaatccatccttgttcaaggtcttatacaagacatttggaccatatttcctgatgtctttcttctttaaggctatacacgatctgatgatgttctctggccctcaaattcttaaactgcttattaagtttgtgaatgataccaaggccccagactggcagggctacttttacactgtcctattatttgtgactgcttgccttcagacattagtgttgcatcagtacttccacatatgctttgtgtcgggaatgcgcataaagacagcagtaatcggtgccgtgtatcgaaaggcgttagtgatcacgaacagcgccaggaaaagcagcacagtgggcgagatcgtcaacttaatgtccgtggatgcccagcgcttcatggatctagcaacctacatcaatatgatctggtccgcacccctacaggtaatccttgccctgtacctcctctggctaaatctggggccttctgtgcttgcaggtgtggctgtcatggtgttaatggtgcccgtcaacgctgtcatggccatgaaaacaaagacttaccaggtcgcgcatatgaagtcaaaagacaatagaatcaaacttatgaacgaaatacttaacggcattaaagtcctcaaactttacgcctgggaactcgccttcaaggacaaggtgttagcaatccgccaggaagagctgaaagtcctgaagaagagtgcttatctgagtgcagttggaacgttcacttgggtgtgtaccccgtttctagtggccctgtgcactttcgccgtgtacgtaacaattgacgagaataatattttggatgcacagactgccttcgtgtctttggctctctttaacatcctgcggtttcctctcaatatcctgccaatggtgatttctagcatcgtgcaggcgagcgtgtctctcaagcgcctgcggatttttctctctcatgaggaacttgagcctgacagtattgaaaggagaccagtcaaggacggaggcggtaccaacagtatcactgttcgaaatgcaacgttcacctgggctcgatcagacccccctacactgaacggcattacttttagcattccagagggcgctctggtggccgtcgttggtcaagtagggtgcggaaagtcctccctcctatccgcgcttctggcagaaatggacaaggtggaggggcatgtagccatcaagggtagtgttgcttacgtcccacagcaagcatggatacagaatgactccctgcgggaaaatattctattcgggtgccagcttgaagagccctattaccggtccgtcattcaggcatgcgctctcctgcctgatctcgaaatcctcccttcgggagatcgcacagaaattggagagaaaacccgtatccttgtgactcatagtatgagttacctgccacaggtggacgtaattattgttatgagcggtggtaagattagcgaaatgggcagctaccaagagcttctagctagagatggagcctttgccgaattccttaggacctacgccagcaccgagcaggagcaggacgcagaagagaacggagtcaccggggtgtccggtccaggcaaggaagcaaaacagatggagaatggaatgttagtgaccgactcagctggtaagcagctccagcgccagcttagcagctcctcttcgtatagcggcgatatctccagacaccataattccaccgccgagttgcaaaaagctgaggccaagaaagaggaaacctggaaattaatggaggcagacaaggctcagaccggccaggttaaattatctgtgtattgggactacatgaaagccattggactctttattagcttcctgagtatctttctgtttatgtgcaatcatgtgtccgcactcgcctccaactactggctgtctctttggactgatgatcccatcgttaacgggacacaggagcataccaaagtacgcttatctgtatacggcgcattgggcatcagccagggcatagctgtgtttggatattctatggcggtgtccattggcggtatactagcgtctagatgcttgcatgtggacctcctgcactctattttgaggagcccaatgagctttttcgaaaggacccctagtggtaaccttgtgaaccggttcagtaaagaactcgacacggtcgacagtatgatccctgaggtaattaaaatgttcatggggtccctttttaacgtcatcggggcatgcatagtgattctgctcgccacccctatcgctgccattattataccgcctctcggattaatttacttcttcgtccaacgattttatgttgcgtcaagtcgacagctgaagaggctggaatctgtgagtcgcagcccagtctatagccatttcaatgagactctcctaggggtttcggtgatcagggcttttgaagagcaggagcggttcattcatcagtctgacttgaaggtggacgagaaccagaaggcgtattacccctccatcgtggctaacagatggttagctgtccggctggaatgcgtcgggaattgcatcgtgctctttgccgcactgtttgctgtaatatcacgccattctttatctgccggtctcgtgggtctgagcgtctcttacagcctccaggtgacaacttaccttaactggcttgtccgaatgtcctcagagatggaaacaaacatcgtggcggtcgaaagactgaaggagtattctgagaccgagaaggaggcaccctggcagatacaagagacggcccctccatcttcttggccacaagtcgggcgtgtggagttcagaaactactgtttacgttaccgcgaagatcttgactttgtgctcaggcacatcaatgtcaccatcaatgggggtgagaaggtgggcatcgtgggtagaactggtgcaggcaagtcctctctgactctgggtctgttccggatcaatgagtccgcagagggtgaaatcattatcgatggaattaacatagcgaagatcggacttcatgacctcaggttcaagattaccatcattccccaagaccccgtactgttttccggttcgctgcgaatgaatttagacccatttagtcagtattccgacgaagaagtgtggacgtccctggaactagcacatcttaaggactttgtctccgctctccccgataagttggaccatgaatgtgccgaggggggtgagaacttgagcgtggggcaacgccagcttgtatgtttagctcgagctttgctgcgtaagactaaaatactggtgctcgatgaggccaccgcggcagtggacctggagactgatgaccttattcagagcacaatacgtacccagttcgaagactgcacagtgctgacaatagcccaccgattgaataccatcatggattatacacgagtcatcgtgcttgacaaaggagagatacaggaatacggcgcacccagtgacctgcttcagcagcgaggactgttctattccatggctaaggacgctggactggtctag

SEQ ID NO: 27402 - DNA, 4251 bp, Artificial Sequence
  Description of Artificial Sequence: Synthetic coding sequence
atggctcttcgcggtttttgctctgccgacggatcagacccgctgtgggactggaacgtcacttggaacacatctaatcctgactttactaagtgctttcagaatactgtcctcgtgtgggtgccctgtttctacctatgggcctgtttccctttctactttctgtacctgtcaaggcatgacagagggtatatacagatgacccctctgaataagacaaagactgccttgggattcctgctctggatcgtatgctgggcggatctgttctattccttctgggaacgttcaagaggcatctttctggccccagtgttcttggtgtcgccaaccttgctcggcattactatgctgctggccacctttctgattcagttggaaaggcggaaaggggtgcagtcaagcggaatcatgttgacattctggttggtggctctggtctgtgccctggcaatactgcgatctaagatcatgactgcattaaaggaggatgcccaggtcgatttgtttcgggatattacattttatgtctacttttcactgttactgatccagctggtgctgtcatgtttcagcgaccgttccccattgttcagtgagacaatacacgatcccaatccctgtccagagtcctccgctagttttctaagcagaattactttctggtggatcactggtctgatcgtgaggggctatcggcaacccctcgaaggaagcgacctgtggtccttaaataaagaagatacctctgaacaagtggtacctgtgctggttaagaattggaagaaagagtgcgctaaaacacgtaaacagccagtgaaagtcgtctattcgagcaaggatcccgctcaacctaaggagagcagtaaagtggatgccaatgaagaggtggaggcgctgatcgtgaagtcacctcaaaaggagtggaacccttccttatttaaggtgctctataaaactttcggaccatactttctcatgagcttctttttcaaggcaatccacgacctcatgatgttctccggtccccagatcttgaagttactgataaaatttgtcaatgatactaaggcccctgactggcaggggtacttctacacggtgcttctgtttgtgaccgcatgtttgcaaacgctggttctgcaccagtactttcatatctgctttgtgtctggtatgcgcattaagactgccgtgatcggcgcagtctaccgaaaggcactggtcataaccaattctgctcgaaagagttcaactgtgggtgagatcgtgaacctgatgtctgtcgatgctcagcggtttatggatctggccacctatatcaacatgatttggtcagctccactgcaggtgatcctggcgttatatctgctgtggctgaacctgggaccttctgtattagccggagtcgccgtgatggtgctaatggtgccggttaacgcagttatggccatgaaaactaagacctatcaggttgcacatatgaagtccaaggacaaccgtattaagcttatgaacgaaatcctgaacggaatcaaagtattgaagctgtacgcctgggagctggcattcaaggacaaagtcctggctatccggcaggaagagctgaaggttctgaagaagtccgcctacctgagtgctgtggggactttcacctgggtctgtacaccgtttctggtcgctctgtgcactttcgctgtgtacgtgaccatcgatgagaacaacatcctcgatgcacagactgcttttgtgagtctggcactgttcaacatactgcgctttcctctgaacatcctacccatggtgatctcatcaatcgtgcaggcctccgtctcactgaaacgcctcagaatctttctgtctcatgaggaactcgagccagacagcatcgaacgtagacctgtgaaagatggcggtggaacgaacagcataaccgtacgaaacgccacgtttacatgggcacgaagtgaccctccaacactaaacggcattacatttagtatcccagaaggggctttggtggcagtcgtgggacaggtgggatgtggtaagtctagcctcctttccgcgctgttggcagaaatggataaagttgagggacacgtcgccattaagactaggatacttgtgacccattcaatgtcttacttgcctcaagtggatgttattattgtgatgagcggtggcaagatctctgaaatgggctcctaccaggagctgctggccagggatggagcctttgccgaatttctccggacctacgcctctactgagcaagaacaagacgccgaagaaaacggggtgaccggcgtgagcggtccaggcaaagaagcgaaacagatggagaatggaatgctcgtcaccgatagtgcaggaaaacagctgcagcggcaactaagttcatcttcatcatattcaggggacatttcccgccaccacaattctacggcagagctgcaaaaggcagaagctaagaaggaggagacctggaagcttatggaagccgataaagctcagacaggtcaggtcaaactctctgtgtactgggattacatgaaagcaatagggttattcatcagcttcctgagtatttttctgtttatgtgtaatcatgtctccgctctggcctcgaactactggctgagtctttggacagacgatcctatcgtgaacggcacccaagaacacacgaaggtaaggctgtctgtgtatggtgccttgggtatctcacagggcatcgccgtgttcggctactctatggcagttagcattggtgggatccttgcctctcgatgtctgcacgtggatcttcttcatagcatactgaggtcgccgatgagtttcttcgagcgcacacccagtggcaacctggttaataggttttccaaagaactggataccgtggattccatgataccggaggttataaagatgttcatggggtcgctgttcaacgttatcggagcttgtatagtgattttgttggctaccccgatcgcagcgatcatcatcccccctttaggcctgatatactttttcgtgcagcgcttttacgtggcatcttcccgtcagctcaaacgcctggagtcagtgtcacgatctccagtgtactcacactttaacgaaacgctgctcggtgtttctgtgattagagctttcgaagagcaagaacgctttatacatcagtcagaccttaaggtggatgaaaatcaaaaggcctattatccgtcaattgtcgccaaccggtggcttgccgttcgccttgaatgcgtggggaattgtatagtgttgttcgccgctctgtttgctgtgatttccaggcatagcctgtccgctggcctggttggattgtcagtgagctactctctacaggtaacgacgtacctgaactggctggtgcgtatgtccagtgagatggaaacgaatattgtcgcagtcgagcgcttgaaagagtacagtgaaacagagaaggaagcgccttggcagatccaggagactgcccctccgagctcttggccccaggtgggccgagtggaattccggaattactgtctgcggtatagagaggacttggatttcgtgctgcgccacattaacgtcaccatcaacggcggagagaaggtcggaattgtcggcagaacaggagcaggaaagagtagcctgactctcggattatttcgcataaacgagtccgccgaaggggaaattatcattgacgggatcaacattgcaaagatagggcttcacgacctgcggttcaagattacaatcatcccacaggatcccgtgttgttctccggaagcctgagaatgaaccttgaccccttctcccagtacagtgacgaggaggtttggaccagtctggaactggctcacctcaaagacttcgtgagcgccttaccggataaactcgatcacgagtgcgcggagggaggcgagaacctatcagtgggacaacgacagttagtgtgcctcgctcgcgctctgctgaggaagaccaagatcctggtgctggacgaagcaaccgccgcagtggatctggagacagatgatcttatacaaagcacaataaggacccagttcgaagactgcacagtgctgaccatcgctcacagacttaacaccatcatggattatactcgagttattgtgctcgataagggcgaaatccaggaatacggcgctcctagcgacttgctgcagcagcgaggcctgttctacagcatggctaaagatgccggactggtgtag

SEQ ID NO: 27403 - DNA, 4419 bp, Artificial Sequence
  Description of Artificial Sequence: Synthetic coding sequence
atggctctgcggggattttgttccgcagacgggagtgatcctttgtgggactggaacgtgacctggaatacctcaaatcccgactttacgaaatgctttcagaacaccgtcctggtctgggtgccatgtttttacctgtgggcctgtttccccttttattttttatacctgagtcggcacgaccggggatacattcagatgaccccactgaacaagaccaagaccgctttgggtttcctgttgtggattgtttgttgggccgacctgttttacagcttttgggaacgaagccgtggcatattcctagcccctgtgttcctggtgtccccaaccttactgggtataacaatgttgctggcaactttccttatacagctcgaacggagaaagggggtgcagtcctccggaatcatgctcacgttctggttggtagctttggtgtgcgctctggcgatcctgcggtctaaaatcatgacggctttgaaggaggacgcacaggtggatctcttccgtgacataactttttacgtgtactttagccttcttctgatccagttagtactatcatgtttttcagaccggtctcccttatttagcgagacaattcatgatccaaatccctgtcctgagtcctctgcttcctttctgagcagaatcaccttttggtggataacgggcctgattgtgcgtggctatcggcagccactggaaggcagtgacctgtggagccttaacaaagaagatacgtccgagcaggttgttcctgtcctggtaaagaactggaaaaaagaatgtgcgaaaactcgaaagcaacctgttaaggttgtgtattcttcaaaggatcctgcgcagccaaaggaatccagtaaagtggatgctaatgaagaagtcgaagccctcatcgtcaagagtccccagaaggaatggaatccgtctctgtttaaagtgttgtataaaacttttggaccatatttcttaatgtccttcttctttaaggccattcacgatctaatgatgttttcaggcccacagattctgaagctgctgataaagtttgtgaacgacacaaaggctccggattggcagggatatttctacacagtcttactgttcgtcaccgcctgcctccagaccctggtacttcatcagtatttccacatctgcttcgtgtctgggatgagaattaagacagccgtgatcggggcagtgtaccgtaaggctctggtgatcacaaatagtgctcgaaagtcttctactgtcggggagatcgtcaatctgatgagtgtggatgcccagaggtttatggatctggccacttatattaatatgatttggtcagcccctctccaggttatcctggccctatacctgctgtggctgaaccttggaccttccgtgctggccggagttgccgtgatggtcttaatggtgccagttaacgccgtcatggctatgaaaaccaagacataccaagtggcccatatgaagtcaaaggataaccggatcaagctcatgaacgaaatcctgaacggtatcaaggttctgaagctgtatgcctgggaactggcatttaaggataaagtgcttgctattcggcaggaggaactcaaggtcctgaagaagtccgcatacctgagtgctgttggcactttcacttgggtgtgcacccctttcctggttgcactctgcaccttcgccgtatatgtgactatagacgaaaacaacatcctggacgctcagacagcattcgtgtccttagccctcttcaacatactccgtttccccctgaatatactgccgatggtaataagttctatcgtgcaggcttcagtgtctctaaagcgacttcggattttcctctcccacgaggagctggagcccgactctattgaacggagaccagtgaaagatggaggcggaactaatagcattacagtgagaaacgctacatttacatgggccagaagcgacccaccgacgctaaacgggatcaccttttccattcctgagggcgctttagtcgcagtggtcgggcaagtcggctgcggcaaaagcagtctcctgagtgcgctgttggccgagatggacaaagttgaaggtcacgtcgccatcaagggcgtaaatctgtccggtgggcagaagcagagagtgtcccttgccagggcagtgtacagcaatgctgacatctacctgttcgatgaccccctgtcagctgttgacgcccatgtcggtaagcacatcttcgaaaacgtcatcggtcccaaaggtatgctgaaaaacaagacccgaatcctggtgacacacagcatgtcctatctgccacaagtcgacgtgattattgtaatgtctggtggcaagattagcgaaatggggtcgtaccaagaattattagccagagacggagcgttcgcggaatttctgaggacttacgcatccacggaacaggaacaggatgcagaagaaaacggcgtgactggtgtctccggccctggcaaggaggcaaaacagatggagaatggcatgctagtgaccgacagcgccggtaagcaactgcaaaggcagttgagttctagtagcagctactctggagacatttccaggcaccataatagtacagcggaactgcagaaagcagaagcaaagaaagaagagacgtggaaactgatggaggcagacaaggcgcagaccggccaggtgaagttaagtgtttattgggactacatgaaagccattggcctgttcatctcctttctgagcattttcctcttcatgtgcaatcacgtctcggctctggcatcaaactattggctctcactgtggacagacgaccctatcgtgaacgggacacaggagcacaccaaggtgagacttagcgtgtatggcgctcttggaattagccaggggatcgctgtgtttgggtacagcatggctgtctctattggcggtatcctggcttctcgctgtctgcatgtggatctgttacacagcattcttcgctcccctatgtcattctttgaaagaacaccctccgggaatcttgtaaatcgtttcagtaaggagctcgacactgttgattccatgattcctgaagtgatcaagatgttcatgggctccttattcaatgtgatcggcgcatgcattgtcatcctactggctacacctatcgcggcaattatcattcctcctttgggactcatttattttttcgttcagcgtttctacgtggcttcttctagacagttgaaacgccttgagagtgtctcccgcagtcctgtgtactcccatttcaatgagactttactcggcgtttcggttatacgggcattcgaagaacaagaaaggttcatacatcagagcgacctcaaggtggacgagaaccaaaaagcatactatcccagcattgtggcgaaccggtggttggctgtcaggctggagtgcgtgggcaactgcatagtgctctttgccgctttgtttgctgtaatctcgcgacactcgctgagtgcaggattggttgggctgtccgtgtcttattcattgcaggtaacaacatatctaaattggcttgttcggatgagctccgaaatggaaaccaacattgtagcggtcgaacgtctcaaagagtacagcgagaccgagaaggaggccccttggcaaatccaagaaactgcgcctcccagcagttggcctcaggtcggccgagtggaattccgaaattattgtctcagatatcgagaggatctagactttgtgctgagacatatcaatgttactattaatggcggagagaaggtcggaatcgtgggtcgcacaggagccggtaagagttccctcacgcttggactgttccgtatcaatgagagtgccgagggagaaattattatcgatgggatcaacatcgcgaagattggactccacgacctgagatttaaaattaccatcatcccacaggaccccgtcctgttctctggatctctgaggatgaaccttgacccgttttctcagtacagtgacgaggaggtgtggacttctctggaactggcccacctgaaggactttgtttcagcccttcccgataagctcgaccacgagtgcgccgagggcggagaaaacctgtcagtcggccagagacagcttgtttgcctggcacgggcactgttgcgcaaaaccaagattctcgttctggacgaggctacagctgctgtggacctggaaacagacgatcttatccaaagcacgatcaggacccagtttgaggactgtacagtcttgaccattgcccatcgccttaataccattatggactatactagagtgatcgtgcttgacaagggggagatccaggaatacggcgctcccagtgatctgcttcagcaaagagggctgttctactccatggccaaggatgccggtctcgtttag

SEQ ID NO: 27404 - DNA, 4626 bp, Artificial Sequence
  Description of Artificial Sequence: Synthetic coding sequence
atggccctaagaggattctgttcagcggacgggagcgatcctctctgggattggaacgttacctggaacacttctaaccctgatttcaccaaatgttttcagaacaccgtcctggtttgggtgccgtgtttctatctctgggcctgcttcccattttatttcctttatctgtcaagacacgacagaggttacattcagatgaccccgctcaataaaacgaagactgcgctgggttttctactatggatcgtctgttgggcagatttgttctatagcttctgggagagatctcgcggaatatttctcgcaccagtatttctggtctcacccacgctgttgggcattacgatgctgttggctacctttttgatccaactggagcgacgaaagggcgtccaatcctcgggtattatgctgacattttggctagtagccttggtgtgcgcactcgccatattgaggtctaagattatgaccgccctgaaggaagacgcccaggttgacttgtttagggatattaccttctacgtttatttcagtctgctgctgatccagttggttttgtcctgttttagcgaccgctcccccttattctctgagacgatccacgacccaaatccctgtcccgaatcttcggcttccttcttgagtcgtattactttctggtggatcaccggcctgatcgtgcgtggatatcggcaaccgctggagggctcagatctatggagcctgaacaaagaggatactagcgagcaagtagtccctgtgttggtgaagaactggaaaaaggagtgcgctaagacaagaaaacagcccgtcaaggttgtgtattcgtccaaagaccccgctcaacctaaggagtccagcaaggtagacgcaaatgaagaagtggaagccctgattgtgaagagcccgcagaaggagtggaatccttcattgtttaaggtattgtacaaaactttcggtccatacttcctgatgagctttttctttaaggccattcacgacctgatgatgttttctgggccacagattctgaaactccttatcaaatttgtcaatgacacaaaagcacctgactggcaagggtacttttacacagtgctcctgtttgtgaccgcctgtctccagacactcgtgttacatcagtacttccacatttgctttgtgtctggcatgaggattaagactgcagttatcggggctgtgtatcgtaaggcacttgtgataaccaacagcgctaggaaatcgtccaccgtaggcgagatagtgaacctcatgagcgtggatgcccagagatttatggacctcgcaacctatatcaatatgatttggagtgctcccctccaagtaatactcgccctttatttgctgtggctgaacctcggcccatccgttcttgccggtgtggctgtgatggtgttaatggttcccgtgaacgccgtcatggctatgaagacgaaaacttatcaggtcgctcacatgaaaagcaaagacaacaggatcaaacttatgaatgagatcctgaatgggataaaagtactgaaactatatgcctgggagctggccttcaaagacaaggtcctcgccatccgtcaggaagagctgaaggtgcttaagaaatccgcttatctgagcgctgtggggacgttcacctgggtctgcacacctttcttagtagcactatgcaccttcgcagtctatgtgactattgatgaaaacaacattctagacgctcagaccgcttttgtaagtttggcactgttcaacattcttcgctttcctctgaatattcttccaatggtaattagcagcatcgtacaagccagcgtaagtctgaagcgattaaggattttcctaagtcatgaggaactggaacctgacagcattgagcgacgtcccgtgaaggacggcggtgggactaactctatcacagtcagaaatgcaactttcacctgggcacgttctgaccccccaacactcaatgggatcaccttctcgatccccgaaggtgccctggtcgccgtggtaggccaggtggggtgtggaaaatctagcttgctttccgcgctccttgctgaaatggacaaggtcgagggacatgtggcgattaagggctcggttgcatacgtcccccagcaagcctggatccaaaatgattccctcagggagaatatcctgttcggatgccagctagaagaaccttattatcgaagtgtcatccaggcctgtgctctgctccccgaccttgaaattctaccgagtggtgaccgcacggagatcggggaaaagggagtaaacctttccgggggtcagaagcagcgggtgagtcttgctagagcagtgtacagcaatgcagacatctatctgttcgatgatcctttgagtgctgttgatgcacacgtgggcaaacatatctttgaaaatgtgattggtcctaagggaatgctgaaaaacaagaccaggatcctggtcactcattccatgagctacctccctcaggtggatgtgataatcgtgatgtctggcggaaaaataagtgagatggggagctaccaggagttgctcgcccgagatggggcatttgcagagtttttgcggacatacgcctcaactgaacaagaacaagatgctgaggagaacggatccaccgtaatggatgaggaggaggctggtgtgacaggtgtgtccggccctggcaaagaggccaaacagatggaaaacggaatgcttgtgaccgactccgcagggaagcagctccaaaggcagctgtcatcttcctccagctattcgggagatatctccaggcatcacaacagcaccgccgagttacagaaagccgaagccaagaaggaagaaacctggaagctgatggaggccgacaaggcgcaaactggccaagtgaagctttcggtttactgggactacatgaaagccatcggtctttttatctcttttttatccatattcctttttatgtgtaaccacgttagcgctctggccagcaactactggctgagcttgtggactgacgacccaattgtcaatggtactcaggagcatacgaaggtccggctgagcgtgtatggtgccctgggaatcagccagggaatcgctgtctttggatattcaatggcagtgtctataggaggcatcctggccagtagatgccttcatgtggacctgctgcactctatactcagatcgccgatgtcgttctttgagaggacacctagtggcaacctcgtaaataggttcagcaaggaactagatacagtggatagcatgatacctgaagtgattaaaatgttcatgggaagtctgttcaacgtgatcggcgcttgcatcgtcattctgcttgctacaccaatcgcggcaattatcattccaccgcttgggctaatttactttttcgtacagcgattttatgtggcctccagccgtcaactgaagcgtttagagagtgtgtccaggtcccccgtctacagccatttcaacgaaacactgctgggagtgagcgtcattcgagcttttgaagagcaagagcgttttatccaccagtcagacttgaaagtggacgagaatcagaaagcatactacccatctatcgtggctaataggtggctggcagtcaggctggagtgtgtgggtaactgtatcgtactgttcgctgccctgtttgcagtgatcagtcggcacagcctgtccgccggattggttggcctcagcgtctcgtattctctacaggttacaacatatcttaattggctggtccgaatgagctcggagatggaaaccaatatcgtggccgtcgagagactgaaggaatacagcgaaaccgaaaaagaggccccttggcagatacaggaaactgcgccaccatcttcctggccgcaggtgggcagagtcgagttcaggaattactgcctgcgttatcgggaagacttagacttcgtgctcagacacattaatgtgacgataaatggcggagagaaggtgggtatcgttgggaggaccggtgcaggtaaaagtagccttacactgggactctttaggatcaacgaatctgctgagggagaaatcattatcgacggaatcaatatcgctaaaattggccttcatgaccttaggtttaagatcacaatcattccacaagatcctgtattattttcaggatccctaaggatgaacctcgatccctttagtcagtactcggatgaggaggtgtggacgtcactggagcttgctcacttgaaggattttgtaagtgctctgccagacaaactcgaccacgagtgcgccgaaggaggcgagaacttgagcgtgggtcagagacagctggtctgcctggccagggccctgctcaggaaaacgaagatcctcgtgttggatgaggctaccgctgcagtagatctggaaaccgacgacctcatccagtcaaccatcaggacacaattcgaggattgtactgttctgacgattgcacacagactcaacacaataatggattatacaagggtgatcgtgctggataaaggggagattcaagaatatggagccccaagcgatcttttgcagcagcgcggattattctattccatggctaaagacgcgggtcttgtctag

SEQ ID NO: 27405 - DNA, 4596 bp, Artificial Sequence
  Description of Artificial Sequence: Synthetic coding sequence
atggctctgcgcggtttctgcagcgctgatggcagcgacccactgtgggactggaatgttacctggaacactagtaatcctgattttaccaaatgcttccagaatacagtgttggtatgggtaccatgtttttacttgtgggcctgtttcccgttctacttcctctacttgtcccggcatgatcgaggctacattcagatgacccctctgaacaaaacaaagaccgccttgggcttcctactctggatagtttgctgggcagatctgttctattcgttctgggagaggtccagaggaatctttcttgccccagtctttcttgtgagccctacgctcctgggcatcaccatgctattagccaccttcctaatccaactcgaacggaggaaaggagtccagagctccggaataatgctgacgttctggctcgtggctttggtgtgcgccctggcaattctacgatccaagattatgactgcccttaaggaagatgcccaggttgacctttttcgtgatattacgttttacgtgtacttctcccttcttttgattcagctggtcctttcctgcttttccgacagatctcctttattctctgagaccatccatgatcccaatccgtgtccagaatctagcgcaagcttcttgtcccgaatcacattctggtggatcacagggctcattgtccggggatacaggcagcccctggagggcagcgatctctggtctctgaataaagaggatacctcagagcaagtcgttccagttctggtgaaaaactggaaaaaggagtgtgctaagaccagaaaacagccggtgaaagtggtttactcatccaaggatcccgctcagcctaaggagagctctaaggtggacgccaacgaagaggtggaagccttaattgttaagagtcctcagaaggagtggaatcctagcctttttaaagttctgtacaagacatttgggccttatttcttaatgtccttcttctttaaagcgatccacgacttgatgatgttttctggtccacagatactgaagctgctgattaaatttgtgaacgacacaaaggcccctgactggcaggggtacttctacaccgttctgcttttcgtaacggcctgcctgcagactctcgtgctgcatcagtactttcacatttgtttcgtatcgggtatgcgcatcaaaactgctgtcattggtgccgtgtaccgaaaggctttggtcattacgaatagcgcgaggaagtcatccaccgttggtgagatcgtcaacctcatgtctgtggacgcccagagattcatggacctggcgacctacataaacatgatctggtcagcccctttacaggtgatcctagccctgtatctgctgtggctgaacctcggaccttccgttttagcaggcgtggctgtcatggtgctgatggttcctgtgaatgcagtaatggcaatgaaaactaaaacctatcaggtggcacatatgaaatctaaagacaatcgcataaagctcatgaatgaaatccttaacgggatcaaagtgttaaaactctatgcctgggaactagcttttaaggataaggtcctcgcgataagacaggaggagctgaaagtgttgaagaagagtgcctacctgtctgctgtaggcaccttcacctgggtgtgtaccccttttttggtggccctttgcactttcgcagtgtatgttactatcgacgagaacaacatattggacgcacagaccgccttcgtttccttagcactcttcaatatcttgagatttcccctcaacatcttacccatggttatcagtagcatcgttcaggcttctgtcagcctgaaaagacttcggatcttcctttctcatgaggagctcgagccagacagcattgagcgccgacccgtcaaggatgggggtggcactaattccattacagtccgcaatgctactttcacttgggccagatccgatcccccaaccctaaacggtataacattctccatccctgaaggggctctagtcgccgtcgtgggccaggtgggctgtggcaagtcaagcttgctgtcggcgctgctggccgaaatggataaagttgaagggcacgtggcaataaagggaagtgtggcgtacgtaccccagcaagcttggatccagaacgacagcctgcgtgagaatatcctttttggctgtcagttagaggagccttactaccgttccgttatccaagcctgcgcattactgccagatctggaaatcctacccagcggggacagaaccgagattggagagaagggggtgaatctctcaggcggtcagaaacaacgggtaagtctcgcaagggccgtttacagcaacgcggacatctatctgtttgacgatcccctgtctgcagtcgacgcacatgtggggaaacatattttcgagaacgttattggccctaagggtatgctcaaaaataagacccggatcctcgttacccactctatgtcttacttaccacaagttgatgtgattatcgtgatgtccgggggtaagatctcagagatgggatcataccaggaactgctagcacgggacggggctttcgctgaattcctgcggacatatgcttccactgaacaggagcaggatgcagaggaaaatggcgtcactggggtgagcgggcctgggaaggaggctaaacagatggaaaatggcatgctcgtgacggatagcgcaggaaagcagctgcagcgccagctgtctagttctagtagttattccggggatatttccagacatcacaactcaacagccgagttgcagaaagccgaggctaaaaaagaggaaacctggaaactaatggaagctgacaaggctcaaaccggacaggtaaagttatctgtgtattgggattatatgaaggcaatagggcttttcatcagttttctatccatcttcttgttcatgtgtaaccatgtgtccgccctggcctctaactactggctgtctctgtggacagacgaccctattgtgaatggaacacaggaacatacaaaagtgaggctgtccgtgtacggtgccctcggcatctcccagggcatcgccgtgtttgggtactctatggcagtctccatcggcggaatcctagccagtcgctgcctgcacgtggacctactgcatagtattttacggtcacccatgagctttttcgaaaggacacctagcgggaaccttgttaatcggttctctaaggagctcgatacagtcgacagcatgatcccagaggttatcaagatgtttatggggagcctcttcaacgtgataggcgcttgtatcgtcattttattggccacaccaattgctgcgatcatcatcccacctctcggattgatctacttctttgtacagaggttttatgtggccagctctagacagctgaagcggctcgagagcgtctcacgctcacccgtctattcacatttcaatgagaccttgctcggggtgagtgtcattagggctttcgaggagcaggaaagatttattcaccagtccgacctcaaggtggatgaaaatcaaaaggcttactaccctagcatcgtggccaacaggtggcttgccgtgcgcctggaatgtgtcggaaattgcatcgttctcttcgccgctttatttgccgtgatatcacgtcattccctgtctgccggactggtgggactttccgtatcctactccctgcaagtgacaacctatcttaactggctggtccgaatgtcttcagagatggagacgaatatcgtcgccgtcgaaaggttaaaagagtattctgagactgagaaggaagccccatggcagattcaggaaactgcgcctccctctagctggccccaggtgggtcgggtagagtttagaaattactgcctccgttatagggaagacttggattttgttctgagacatattaatgttaccattaacggaggcgagaaggtcggcatcgttggtaggacaggggcaggaaaatcgtccctgaccctgggccttttccgtatcaatgaaagcgcggagggcgaaataattatagatggtatcaatattgcaaagatcgggttgcacgacctcaggttcaaaattaccattatcccacaggatcccgtattgttctccggatctctgcggatgaacctggacccattctctcagtacagtgacgaggaagtgtggactagcctggaactggcccacctcaaagattttgtgtcagccctgccagataaacttgaccacgagtgcgctgagggaggtgaaaatctcagcgtgggacagcggcaactggtatgtcttgccagagcgctgctgcgcaagaccaagatcctggtgctcgatgaggcaacagccgctgtggacctcgaaacagacgatctcatccaaagcaccatacggacacagttcgaggactgtaccgttctgacaattgcacataggttgaatactattatggattatacccgggtcatcgtgctcgataaaggcgagatacaggaatatggagccccatctgacctgcttcagcagcggggtctgttctacagcatggcaaaagacgctgggctggtgtag

SEQ ID NO: 27406 - DNA, 3648 bp, Artificial Sequence
  Description of Artificial Sequence: Synthetic coding sequence
atgagctttttctttaaggccattcacgacctgatgatgttttctgggcctcagatcctcaaacttctgatcaaatttgtgaatgacactaaagcccctgattggcaggggtacttttatacagttttgctgttcgtgacagcttgcttgcaaaccctggttcttcatcagtacttccacatctgctttgtttctggaatgcgaatcaagactgcggtgattggggcagtataccgaaaagccctggtgatcacaaattcagcaagaaaaagctccaccgtgggggaaatagtgaacttaatgagcgtggacgcccagcgttttatggatctggccacgtacatcaatatgatttggagcgccccactgcaggtgatactcgccctatatttgctttggctaaatcttgggccaagcgtacttgcaggcgtcgctgtcatggtgctcatggttccagtgaatgccgtgatggcaatgaagacaaaaacctaccaggtcgctcatatgaagtctaaggataacagaattaaattaatgaacgaaatcctcaacggcattaaggttctcaagctgtatgcctgggagttggcatttaaagataaggtactcgccattcggcaagaggaactgaaagtgctgaagaaatctgcctatctatcagcagtgggaacctttacatgggtctgcacgccttttctcgtcgccctgtgcactttcgcagtctatgtcaccatcgacgagaacaatatcctcgacgctcagaccgcttttgtgagtctagctctcttcaatattttgaggtttcccctcaacatacttcccatggtgatttctagcattgtccaggcttcggtttcactgaagagactgagaattttcctgagccatgaggaattggagcccgacagcatcgaaaggcgtcccgtaaaggacggtggtggaactaatagtattacagttcgcaatgccacgtttacctgggctcgtagcgatccacccacccttaacgggataaccttctccatccctgagggggctctggtcgccgtcgtcggccaggttggctgtggaaagtccagtctgctctctgcacttttggccgagatggataaagtcgagggtcatgtggctatcaaaggttctgtggcctacgtgcctcagcaagcctggatacagaacgacagcctgcgagagaacatactttttggctgtcagttggaagaaccgtactatcgaagcgttatccaggcctgcgccctgttacctgatctggaaattctgccaagcggcgaccgaacagagatcggcgagaagggcgttaatctcagtggcggtcagaagcagagggttagcctcgcccgagccgtgtatagcaatgcggatatctatcttttcgatgaccccctaagcgccgtagacgcccacgtgggaaaacatatcttcgagaatgtgatcggacctaaaggtatgttgaaaaataagacccgcattctggtgacacactcaatgagctaccttcctcaagtagacgtgattattgtaatgtctggcggaaagatctctgagatgggaagctaccaggaacttttggctcgcgacggcgcattcgcggaatttttgaggacatacgcctctactgagcaggaacaggacgctgaggagaatggcagcactgtgatggatgaggaggaggctggagtgaccggtgtcagtggcccaggcaaagaggccaaacagatggaaaatggaatgctggtgactgactccgccggaaagcagctgcagcgccagctaagctcttctagttcatacagcggcgatataagccgccaccacaatagtacggccgagctacagaaggcagaggccaaaaaagaggaaacatggaagcttatggaagcagataaagctcagactggtcaagtcaagttgagtgtctactgggactacatgaaggcaattggtctgttcattagttttctgagcatctttctctttatgtgcaaccacgtctcagcgttagcaagcaactactggctgagtctctggaccgacgaccccatcgttaacggaactcaagaacacactaaggtgcgcttgtccgtgtacggcgcattgggcatcagtcagggtatcgctgtcttcggttacagtatggcggtctctatcggtgggatccttgccagccggtgtctgcacgtggatctgctgcattcaatactgaggtcacctatgtccttctttgaacgcaccccgagcggtaacctcgtgaacaggttctcaaaggaactcgacaccgtggacagtatgattcccgaggttatcaaaatgtttatgggctctctattcaacgttattggcgcatgtatcgtgatactgctggctacgccaatagccgctatcatcattcccccactcggcctcatttacttctttgttcaacgcttttacgtagcttcttccagacagctcaaaagactggaaagtgtttcacgatcccctgtgtatagccatttcaatgaaaccctgctgggggtgagtgtgattagggcattcgaggagcaggagaggtttattcaccagtcggacctaaaagtggacgagaatcaaaaggcgtattatccttctatcgtggccaataggtggctggccgtgaggcttgaatgtgtgggaaattgtatagtgctctttgcggcactgtttgcggtgatcagcagacatagcctttccgccggactggtcggtctgtccgtctcctactcgctgcaggtgaccacgtatctcaattggctggttagaatgtcttcagaaatggaaaccaacattgtcgccgtggaacggctgaaagagtacagcgagactgagaaggaggctccatggcagatccaggaaaccgctccgccatcgtcttggccccaagtggggcgagtggagttccgaaactactgtctgcgctaccgagaggatcttgactttgtacttaggcacataaacgtcacaataaatggtggtgagaaagtgggtatcgtggggaggacaggcgctggaaagagtagtttaacactcggcctttttagaatcaatgagtctgctgagggggaaatcatcatcgatggaatcaatatagccaagattggactgcatgacctacgattcaagatcactataatacctcaggaccccgtcctgtttagtggatcgctgcggatgaatctggatccatttagccagtattcggatgaagaggtgtggacctccctggagttggcccatctcaaagattttgtgtctgcactccctgacaaacttgaccatgagtgtgccgaggggggagaaaacctgagcgtcggtcagcggcaattggtatgtcttgcaagggctttactgcgcaaaactaaaatcctcgtattggatgaagccaccgctgctgtggacctcgaaacagacgatctgatccaatcaaccatccggacgcagtttgaggattgcaccgtgttgacgatagctcatcgtctgaacaccatcatggactacactcgggtcattgtgttagacaaaggggaaatccaggagtatggcgctccgtctgacctcctccaacagcgagggctgttctattccatggccaaggacgctggactggtttag

SEQ ID NO: 27407 - DNA, 1968 bp, Artificial Sequence
  Description of Artificial Sequence: Synthetic coding sequence
atgagtagttcaaatgtagaagttttcataccagtgagccagggaaacacaaacggttttccggctacagccagtaacgacctgaaggcatttacagaaggggcagtattatccttccataatatctgctatagggtcaagttaaaatccggctttctaccctgtcggaagccagtcgagaaggagattcttagcaatatcaacggaatcatgaagcccggtctgaatgctatactggggcctacaggcggagggaaatcctcactgttggacgtactggccgctcgaaaggatcctagcggtttgtcgggggacgtgctgataaacggggctccaagaccagctaatttcaaatgcaattctggttatgtcgtccaggacgacgtggttatgggcactctgacagtccgcgaaaatcttcagttctcggccgctctgcgcctggccaccaccatgacaaaccacgagaaaaacgaacgcatcaaccgagtcattcaggaactgggtctggataaggtagccgattcaaaggtgggtacccaattcattcgaggcgtatcgggcggagagagaaaaaggacctcaatcggaatggagctgattaccgatccctccatcctgtttctggatgaacccactacggggttagattcatctacagccaatgctgtcctgctacttctgaaacggatgagcaagcagggacggaccataatctttagcattcaccagccgcgatattctatttttaaattgtttgacagcctcaccctcctggccagcggcaggcttatgttccacggccctgcgcaggaagcacttggttacttcgaatcagctgggtaccattgcgaggcctacaacaacccggcagatttctttctggacatcattaacggagactcaaccgctgtggccttgaaccgggaagaggactttaaagccacagagataatcgaaccgtctaaacaggacaagcctcttatcgaaaagctggcggagatttacgtcaacagctccttttataaggagaccaaggcagagctgcatcagctaagcgggggagagaagaagaaaaagattactgtcttcaaggagatttcatatacaacttcattctgtcaccaactcaggtgggtatccaagcgatcgtttaagaacctcttgggaaatccgcaggcatctattgcgcagattattgttaccgtggtgctgggtcttgtgattggggctatctattttgggctcaagaatgactcgactggcattcagaatcgggctggggtcttgttttttttgactacaaatcagtgctttagctccgtgtccgcagtggagctgttcgtggtggagaagaagttgtttatacacgagtacatctccggctactatcgggtgtccagctattttctaggcaagctgttgtctgatctactccccatgagaatgctgccctcgatcatattcacatgtattgtgtatttcatgctgggcctgaagcctaaagccgacgcctttttcgtcatgatgttcactcttatgatggtagcttatagcgcttcaagcatggccctggcaattgccgctggccaatcggtggttagcgtggccacattactgatgaccatatgtttcgtgtttatgatgattttctcaggcttgctggtgaacctcactactatcgcctcgtggcttagctggctgcaatacttcagtattccacgctacggttttaccgcactccagcacaatgagttcctgggacagaacttctgccctggcctcaacgctacagggaacaacccgtgcaactacgccacatgcaccggagaggagtacctggtgaagcaggggatcgacctgtctccttggggcctgtggaagaaccacgtggcactcgcttgcatgattgtcatcttcttgacgatcgcctacctcaaactgctgttcctaaagaagtactcctag

SEQ ID NO: 27408 - DNA, 1836 bp, Artificial Sequence
  Description of Artificial Sequence: Synthetic coding sequence
atgtcttcctctaatgtggaggtttttattcccgttagtcaaggaaatacaaatggattcccggctaccgctagcaacgacctcaaggctttcaccgaaggagccgttctgagttttcataacatctgctacagggtcaagctgaaatcgggttttttaccttgccgcaagccggtggaaaaggagattctgtccaacattaatgggataatgaagcctggtctaaatgccatactcgggcctacaggcggtggaaaatccagtctgctggacgtcctcgcagctagaaaggatccctccggattgtctggcgatgtgctcatcaatggggctccccgtcctgcaaacttcaagtgcaattccgggtacgttgtgcaggatgacgtggttatggggacattaacagtgagagaaaatctccagttcagtgctgctctgaggctggctaccaccatgactaatcatgagaaaaatgaacggataaatcgcgttattcaggaattggggctggataaggtggccgacagtaaagtagggacacaatttatccgcggtgtgtccgggggagagaggaagcgcacctccatcggaatggagctcattaccgatccgtcgattcttttcctggatgagcctaccacagggctcgactcctccaccgctaacgctgtgctcctcttgctgaagcgcatgtcgaagcagggacggaccatcattttttccatacaccaacctagatattctatttttaaactgttcgattctttaacattgttggctagcggaagactgatgtttcacgggcctgcacaagaggctttggggtattttgaaagtgccggataccactgtgaagcctacaacaatccggctgattttttcctcgacattattaacggggatagcacagctgtggctctcaaccgggaggaggactttaaggctaccgaaatcatagaaccttctaagcaggataaacccctcattgagaagcttgccgagatctacgttaacagcagcttctacaaggaaaccaaggctgagctccaccagctctccggcggtgaaaagaaaaaaaaaatcacggtttttaaagagattagctacacaaccagcttttgccatcagctgagatgggtgtctaaacgcagttttaaaaacctgctaggtaaccctcaggcgagcatcgctcagatcatcgtcaccgtcgtattaggcttggttatcggagctatctatttcgggctgaagaatgacagcacaggaattcaaaacagagccggtgtgttattttttctcacaaccaatcagtgtttctcttctgtttcagcagtagagctgtttgtagtggaaaaaaagctgtttatccatgagtatattagcggatactatagggtgtcttcctattttctcggaaagctcctgagcgacctgctccccatgagaatgctcccctccattatctttacatgtatcgtctacttcatgctggggctcaagccaaaagcagacgcctttttcgtgatgatgtttacgctgatgatggtagcctacagtgcatccagcatggcactcgctattgctgctggacaaagcgtagtttcagtggccaccttgctcatgacaatttgcttcgtattcatgatggtctgctggtcgatttcgcaaccactgcacttaggctgtcacgggttctctacttctgcctttcacgacatggatttgaggttgtgctctatcatgaatttctgggacaagacttccgcccaagactctatgcagcaagaaactatccttgtgacaatgcaacacgttctggccaaaaacatctggtag

SEQ ID NO: 27409 - DNA, 1212 bp, Artificial Sequence
  Description of Artificial Sequence: Synthetic coding sequence
atggatcggagcaaagagaactgtatttccgggcctgtaaaggccactgccccagtcggtggcccaaagagagtgctggtgactcagcagtttccctgtcagaacccacttccagtgaattcgggccaagctcagcgagtgctatgtcccagcaatagctctcagaggatccctctccaggcccagaaactggtttcatcgcataagccagtgcaaaaccagaagcaaaaacaattgcaggcaacctccgttccacatcccgtatccaggcctctgaataacactcagaagtccaaacagccacttccgtctgccccagagaacaatcccgaagaagagctggcatccaaacagaagaacgaggagagtaagaaaaggcagtgggcgctggaagacttcgagattggacgaccactgggcaaaggcaagttcgggaatgtgtacttagcgagagaaaaacagagtaaattcatattggcccttaaagtgctattcaaggctcagttggagaaggcgggagtggagcaccagttgaggcgagaggtcgagatccaaagccacctccgccaccctaacattctgcggctctatggatactttcacgacgctacaagggtatatctcattcttgaatacgcccctctagggacagtgtatagggaactccagaagctgagcaaatttgatgaacagcggactgccacctacatcacagagttggctaatgcgctctcctactgtcattctaagcgcgtcatacaccgcgatatcaagcccgaaaatctgttgttgggctcagctggcgagctcaaaattgctgacttcgggtggtccgtgcacgctcctagctctcgcaggactacgctgtgtggaacccttgattatctccctccagagatgatagaaggtcggatgcacgacgaaaaagttgatttatggtcactgggcgtgctttgctatgagtttttggtgggtaagcctcccttcgaggcaaacacttaccaagagacatataagaggatcagccgagtggagtttacttttccagattttgtcacggagggagcccgagatctcattagccggcttctgaagcacaatccaagtcaaagacccatgctgagagaggttctggaacacccctggattacagcaaatagcagcaagccatctaactgtcagaacaaagaatccgcaagcaaacagtcctag

SEQ ID NO: 27410 - DNA, 1212 bp, Artificial Sequence
  Description of Artificial Sequence: Synthetic coding sequence
atggataggtctaaagagaactgcataagtggccctgtgaaagctaccgcccctgtcggcggaccaaaacgcgtgctggttactcagcagttcccatgccagaatccgctacccgtgaattccggccaggctcaaagggtgttgtgtcccagcaactccagtcagcgtattccactccaggctcagaagctcgtcagttcccacaaaccagttcaaaatcagaaacagaagcagcttcaggccactagcgtgcctcacccggtgtcacgcccactaaacaatacgcagaaatctaagcagcctctcccatccgcccctgaaaacaaccccgaggaggagttggcctctaagcagaaaaacgaagaatctaagaagcggcagtgggcgcttgaagacttcgagatcggtcgcccactgggcaaggggaagttcgggaacgtatacctggccagagagaaacagtccaagttcattctcgcactgaaggtgctgtttaaagcccagttggaaaaagcaggtgtagaacaccaactccggcgagaggtcgagattcaatcccacttacgccacccaaatattttacgactctacggttatttccatgacgcgacacgagtttacctgatcctggagtatgctccactggggacggtctacagagaactccagaagctgagcaagtttgacgagcaaagaaccgccacgtacatcacggaactggccaacgccctgagttattgccattccaagcgggtcatccaccgagacatcaagccagaaaatttacttctggggagtgctggggagctcaagattgccgatttcgggtggagtgtgcatgccccttcgtctcgtcggactaccttgtgcggaacgttagattatcttccgcctgaaatgattgaggggaggatgcacgatgagaaggtggatctctggagcctgggtgttctatgttatgagtttttggtgggcaaaccccctttcgaagccaatacataccaggaaacttataaaaggatctccagggttgagtttaccttccctgacttcgtgaccgagggggctcgggacctcatcagccgcctgctgaagcacaatccctcacaacgcccaatgctccgcgaggtgctagagcatccttggataaccgctaactcaagcaagcctagcaattgtcaaaataaggaatccgctagtaaacagtcttag

SEQ ID NO: 27411 - DNA, 1212 bp, Artificial Sequence
  Description of Artificial Sequence: Synthetic coding sequence
atggacagatccaaggaaaattgcatcagcggccctgtgaaggccactgcccctgtgggtggtccaaaacgtgtgctggttacacaacagtttccgtgccagaatcccctccctgttaactcgggccaagcacagagagtcctttgcccctctaactcctcgcagagaatacctttacaagctcagaaactggtttcttcgcacaaaccagtgcagaatcagaagcagaagcagctccaggccacctctgtccctcatcctgtgtcccgccctctcaataacacacaaaagtccaaacagcctctcccatcagcccctgagaataaccccgaggaggaactcgccagtaagcagaaaaacgaggaatcgaagaagagacagtgggctttagaggactttgagattggacggccactggggaagggcaaatttgggaatgtttacttagctagagagaagcagtcaaaatttatactcgccctcaaggttctattcaaggctcagctggaaaaggccggagtcgagcatcagcttcgacgagaggtcgagattcagagccatctgcggcatccaaatatactgaggctgtatggatacttccacgacgccacgagggtctacttaatattggagtatgctccactcggaaccgtgtaccgcgagctccagaaactttctaagttcgatgagcagaggactgccacctatattaccgagttggccaatgctctgtcttattgccattccaaacgagtcatacacagggacattaaacccgaaaacctcctgcttggttccgccggagaactgaagatcgcggattttggatggtccgtgcacgcgccatcgtcccgcaggaccaccctgtgcggtaccttagactacctgccccctgagatgatcgagggcaggatgcacgacgagaaggtggacctgtggagcttaggcgtgctctgttacgagttcttggtgggcaaaccacctttcgaggccaatacgtatcaagagacatacaagcgcatctcccgtgtggagttcactttccccgatttcgttaccgagggtgcacgggatctgataagtaggctgctaaagcacaatccctctcagcgcccaatgctgcgtgaagtcttggaacacccgtggattacagctaacagcagcaagcccagcaattgtcagaataaagagagtgccagcaagcagagctag

SEQ ID NO: 27412 - DNA, 1044 bp, Artificial Sequence
  Description of Artificial Sequence: Synthetic coding sequence
atggaccggtctaaggaaaactgcattagcggcccagtaaaggcgactgctcccgtcggtggtcccaagcgggtgctagtgacacagcagtttccctgtcaaaacccactcccagtgaactcgggacaggcccagagggtgttgtgtccctctaattcttcccagagaatccctctgcaggcccagaagctggtttcatctcacaaacccgtgcagaaccagaagcagaaacagctgcaggccactagcgtgccacacccagtgagccgacccctgaataatactcagaagtccaagcagcctctgcccagcgccccagagaataaccctgaagaagagctggcttctaagcaaaagaacgaggagagcaaaaagaggcaatgggcactcgaagacttcgagattggacggcctttgggaaagggcaaattcgggaacgtgtacctggccagggaaaagcagtccaagtttatacttgccttgaaagtgctgtttaaggcgcagctagagaaagccggtgttgaacaccagctccgacgcgaagtcgagatccagtctcaccttcggcatccgaatatcttgcgattatacgggtactttcacgacgccacacgggtctatctcattctggaatatgcacctttgggtaccgtgtatagagagctgcagaagttgtccaagtttgacgaacagcggactgccacgtacatcactgagctggccaacgcgttgagttattgccactcaaaaagggtaatacatagagatattaaaccagagaacctcctcctcggcagcgcgggtgaactaaaaattgctgatttcggctggagtgtgcacgcccctagttcacgcaggacgacactctgcggcaccctggattacctgcccccagaaatgatcgaggggaggatgcatgacgagaaagtggatctctggtctctcggcgtgctgtgttacgaattcctcgttggcaagccaccctttgaagccaatacctaccaggaaacatacaaacggataagtagagtgcgcagaaattag

SEQ ID NO: 27413 - DNA, 1212 bp, Artificial Sequence
  Description of Artificial Sequence: Synthetic coding sequence
atggatcgcagcaaggagaactgcatctccggccctgtgaaggctacagctccagtggggggaccgaagcgggtgctcgtaacccaacagtttccctgtcagaatccattgcccgtaaattcagggcaggcacagagagtcctgtgcccatcaaattctagtcaacgcattcctctgcaggcccagaaactggtgtctagccataaacctgtccaaaaccaaaagcagaaacagctgcaggccaccagcgtgcctcatcctgtgtcacgtccattaaacaacactcagaagtcgaagcagccactaccatcagcccctgagaataaccctgaggaggaattggcatctaaacagaaaaatgaggaatccaagaagcggcagtgggctctcgaagattttgagatcggtcgtccgctcgggaaggggaaatttgggaacgtgtacctggccagggagaagcagtccaagtttatcttagcccttaaggtcctcttcaaggcccagctcgagaaggccggagtggagcatcagctaagacgtgaagtggagatccagtctcacctcagacaccctaacattcttagactgtacggctacttccatgacgccaccagggtgtacctgatcttagagtacgcacctctcggaacagtatatagggaactgcagaagctaagtaaattcgacgaacagcgcactgcaacctatatcactgaactcgccaatgccctgtcttactgccattccaaacgggtcatccaccgagacatcaagcccgaaaatctgttactgggatcagcaggcgaacttaagatcgctgatttcggctggagcgtccacgccccttcatctcggagaaccactctctgcggtactctggactacctgcccccagaaatgatcgagggtcgcatgcatgacgagaaagtagatctgtggagcctgggggtcctatgctatgagtttctcgtcggcaaacctccctttgaagcgaatacttaccaggagacatacaaaagaatcagccgcgtcgagttcacattccccgactttgtgacagagggagccagggatttaatctcccgcctgctgaagcacaatccaagtcagaggcccatgctgcgggaggtgctcgagcatccatggataacagctaattcatccaagccttccaattgtcagaacaaggagtccgcatccaagcagagttag

SEQ ID NO: 27414 - DNA, 1212 bp, Artificial Sequence
  Description of Artificial Sequence: Synthetic coding sequence
atggacaggtctaaggaaaattgcatctcagggcctgtgaaggctacggcaccggtgggcggtcccaaaagagtgctggtgacacagcagtttccatgtcagaatcccctgccagtcaacagtggtcaagcacagagggtactgtgcccgtctaattcctcacagcgcatacctctgcaggctcaaaagctggtatcctcacacaagccagtgcaaaatcagaagcagaagcagcttcaggctacttccgtgccccacccagtcagtcggcctctgaacaacacgcagaaatcaaagcagccgctgccttcagctccagagaataaccctgaagaggagctggctagcaagcagaaaaacgaagaaagcaaaaagcgccaatgggctctcgaggatttcgaaattggtcgtccgcttggaaaaggcaaattcgggaatgtctacctagccagggagaaacaatccaagttcatcctcgcccttaaagtcctattcaaagcccagctagaaaaggccggtgttgaacatcagctgcggagggaggtcgagatccagtcgcatcttagacaccccaatatcctccggctctatggctattttcacgatgccaccagggtgtacctgatacttgagtacgcgcctttgggaactgtgtatagggaactacagaaattgtctaaattcgacgaacaaaggacagccacttacatcacagagctggccaacgccctgtcctactgtcactccaagcgagtgatccatcgcgacattaagccggagaacctcctgctgggtagcgcgggagagctaaagatagccgacttcggatggagtgtgcacgccccatcctctcgcaggacgacattatgtggtaccttagactatcttcctcccgaaatgattgaaggcagaatgcatgacgaaaaggtcgatctctggtcgctcggtgtcctctgttacgaatttcttgtcggcaagccacccttcgaagccaatacttaccaagagacttataagcggatttcacgagtggaatttacctttcccgacttcgtgactgagggcgcacgggacctgatttccagactgctgaagcataatccatctcagcggccaatgctgagggaggtcctggagcacccgtggatcactgccaactcgtcaaagccctccaattgccagaataaggagtccgccagtaaacaatcgtag

SEQ ID NO: 27415 - DNA, 1212 bp, Artificial Sequence
  Description of Artificial Sequence: Synthetic coding sequence
atggataggtcaaaggaaaactgtattagtggtcccgttaaagccacagcacctgttggcggaccaaagagagtgctcgtaactcagcagtttccttgtcagaacccacttccagtaaactctggacaagcccaaagggtgctgtgtcccagcaacagctcccagagaatccccctgcaggcgcagaagcttgtgtcaagtcacaagcctgtgcaaaaccagaagcagaaacaattacaagctacaagcgttcctcatcccgttagtcgtccacttaacaatactcagaaatcgaagcagcccttacctagtgcccctgagaataacccggaggaggaactcgcaagtaagcaaaaaaatgaggaaagcaagaagcggcaatgggctctcgaggatttcgagatcggtcggcctctcgggaaagggaaattcggcaacgtgtacctggccagggagaagcagtccaaattcattctagctttgaaagtactttttaaggctcaactggagaaagcaggagtggagcaccaactccgccgagaagtggagattcagtcccacttacggcatcctaacatcctgcgactttacggctacttccatgacgccaccagagtgtatttgattctcgagtatgccccactcgggaccgtctatcgtgagctccagaaactgtcaaagttcgacgagcagcgtacggccacctacatcaccgagctggccaatgcattatcttactgccactcgaagagggtgattcaccgggatatcaaaccagaaaacttgttattgggaagcgccggagagctgaaaatcgcagatttcgggtggtccgtccatgcaccctcatccaggcgcaccactctgtgtgggaccctggactaccttccacctgaaatgattgaagggagaatgcatgacgagaaggttgacctatggtctttgggagtgctgtgctatgaattcttggttgggaaaccacccttcgaggccaacacataccaggagacatacaagcggattagtcgcgtggagtttactttcccggattttgttaccgaaggtgcccgtgatctgatctcccgattactgaaacacaacccctcccagagaccaatgttgagagaagtcctcgagcatccctggatcacagccaatagtagcaaacctagtaattgtcagaacaaggaaagtgcctctaagcaatcttag

SEQ ID NO: 27416 - DNA, 1212 bp, Artificial Sequence
  Description of Artificial Sequence: Synthetic coding sequence
atggatcgcagcaaggagaactgtataagcggtccggtaaaagccactgctccagtgggcggtccaaaacgagtgcttgtgacacagcagttcccttgtcagaatcccttgccagtgaattccggtcaagcccagcgggtcttgtgtcccagcaactccagccagcgcatccctttgcaggcacaaaagctggtgtctagccataagccagtgcagaatcagaaacagaagcagctccaagccacttctgtgccacacccggtgagtaggccactcaataacactcagaaatcaaagcaacctctgccgtctgcccctgagaataaccctgaagaggaactggcaagcaaacaaaaaaatgaagaatctaagaagagacaatgggctctggaggatttcgaaatcggtaggccccttggaaagggcaaatttggcaatgtctacctggcgagggagaaacagtccaaatttattctagcccttaaagtgctgtttaaggcacagcttgagaaagccggagttgagcaccaactacgacgagaggtggagatccaaagccacttaagacatcccaacattctgaggctctacgggtactttcacgatgctaccagggtttacttaatcctcgagtacgccccactgggcacagtataccgggaactccagaagttgagtaaatttgacgagcagcgcaccgcaacatatataaccgaattagccaatgctctgagttattgtcattccaaacgcgtaattcacagggatattaagccagagaatttactccttgggtctgccggagaactgaagatcgccgacttcgggtggtctgtgcatgcaccctcttccagacgtactacactttgtgggacgttggactacctcccgccagagatgatcgagggcaggatgcacgacgagaaagtcgatctgtggagtctgggcgtgctgtgttacgaattcttagtgggaaagcccccttttgaagccaatacctaccaggagacttataagcggatctctcgggttgagttcactttccccgactttgtgacagagggtgctcgcgacttaatctcccgactccttaagcacaacccttcccagaggcccatgctgcgagaagtactggagcacccctggatcacagccaattcttccaaaccatccaattgtcagaataaggaatctgcctcaaagcagtcatag

SEQ ID NO: 27417 - DNA, 1212 bp, Artificial Sequence
  Description of Artificial Sequence: Synthetic coding sequence
atggatcgttccaaagagaattgtatttcaggccctgtgaaagccaccgcgcctgtgggtggccctaagcgcgtgctcgtaacccagcagttcccctgccagaatccgttaccagtgaactccgggcaagcacagcgggttctctgcccttccaactcttcacaaagaattcctctgcaagcccagaaactggtgagcagtcataaacctgtgcagaaccaaaaacagaaacagctccaggccacatcggtgcctcacccggtgtctagacccctgaataacacacagaagtctaaacagcccttaccgagtgccccagagaataaccccgaggaagaattagcctccaagcaaaaaaatgaggagtctaaaaagagacagtgggcacttgaggacttcgaaataggcagaccactgggaaagggcaagttcggcaacgtgtacctggcacgggaaaagcagtccaaattcatcctcgctctgaaggtgctcttcaaggcccagcttgaaaaggcgggtgtcgagcatcagttgcgtcgggaggtggaaatccagtcccacctgcgccatcctaacatactgagactgtatggttatttccatgatgcaactcgtgtgtatctcattttggagtacgctccgctggggacagtctatcgggagctgcaaaagctaagtaagttcgacgaacaaaggacggccacttacatcacagagttagccaatgccctgtcttactgccacagcaagagagtcatccaccgcgacatcaagccggagaacttgctactgggctctgccggagagctgaagattgctgatttcgggtggtctgtacatgctccatcctccagacggaccactctgtgcggcaccctagattacctgccgcctgagatgattgaaggccgaatgcacgacgagaaagtggacctctggagcttgggagtgctctgctatgagttcttggtcgggaaacctccctttgaagctaacacataccaggaaacatacaagagaattagtagggtcgagttcacattcccagacttcgttacggagggcgctcgcgatctgataagcaggcttctcaagcacaacccgagccagcggccaatgctgcgggaagtgctagagcacccatggatcacagctaactcctccaagccctctaattgccagaataaagagtcagcctctaagcagtcatag

SEQ ID NO: 27418 - DNA, 570 bp, Artificial Sequence
  Description of Artificial Sequence: Synthetic coding sequence
atggacaggtccaaggagaattgcatctcaggaccagtcaaagccacagcccctgtcggcggacccaaacgagtactggtgacacagcagtttccttgccagaatcctctgccagttaactccggccaggctcagcgagtgctatgtccctccaactccagtcagcgtatacctctgcaggctcagaaactggtctcaagccacaagcccgtgcaaaatcagaaacaaaagcagttgcaggccactagtgtgccacaccccgtgagcaggcctctgaataatacccagaagagcaagcagcctttgcctagtgcccctgaaaacaaccctgaggaggagcttgcttcgaaacagaaaaatgaagagtcgaagaagcgacaatgggctctggaggatttcgagatcggcaggcccctaggcaaagggaagttcgggaacgtgtacctggccagagagaagcagtccaaattcatcttggctttaaaggttctctttaaagcgcagctggaaaaggcaggcgttgaacatcagctgaggcgggaagtcgagatccagtctcatctgagatag

SEQ ID NO: 27419 - DNA, 444 bp, Artificial Sequence
  Description of Artificial Sequence: Synthetic coding sequence
atggaccggtcgaaggaaaactgcatctccggcccagtgaaagccaccgcaccagtgggcggtccaaaacgggtcttggtgacacagcagttcccgtgtcagaatccgttacccgtcaattccggccaggcccaaagggtcctgtgcccgtccaactcgtcgcaacggattcctctccaggctcagaagctggtctcctcacataaacccgtccagaatcagaagcagaagcagttgcaggccacttccgtaccccaccctgtgtcaaggccccttaacaacacccagaagtctaagcagcctttgccatccgcaccggagaataatccagaagaggaattagcatcaaagcagaaaaatgaggagtctaaaaaacggcagtgggccctcgaagactttgagattggccgtcctttgggaaaggggaagtttggaaacgtgtag

SEQ ID NO: 27420 - DNA, 816 bp, Artificial Sequence
  Description of Artificial Sequence: Synthetic coding sequence
atggacagaagcaaggaaaattgcataagtgggcctgtgaaggccaccgcaccagtgggaggccctaagcgagtcctggttactcagcagttcccctgtcaaaacccccttcccgtcaattccggccaagcgcaaagagtcttgtgccccagcaactcatcccaacgcattcctcttcaagctcagaaactggtctctagtcacaaaccagtgcagaatcagaagcaaaaacagctgcaagccacatcagtgccccatcccgttagtaggcctctaaataatacacagaagagcaaacaacctttgcccagtgcaccagagaacaatccagaagaggagctcgcatctaagcaaaagaatgaagagagtaagaagcggcaatgggctctcgaagattttgagataggcagacccctagggaagggaaagttcgggaatgtctatctcgctcgcgagaagcagagcaaattcattctcgcgctgaaagttcttttcaaggcccagctggagaaggcaggcgtggagcaccaacttcggagagaggtcgagattcagtctcatctgcgacatccaaacatccttcgtctgtatgggtacttccacgacgcgactcgcgtatacctaattcttgaatacgctcctctgggcaccgtttatcgtgaacttcagaagctgtcaaaattcgacgaacaacgcaccgccacatacatcaccgagttagctaatgctctgtcttactgccattccaaaagggtaattcaccgtgacataaaaccagagaacctgctgctgggctcagccggagagctcaagtag

SEQ ID NO: 27421 - DNA, 240 bp, Artificial Sequence
  Description of Artificial Sequence: Synthetic coding sequence
atggatcgaagtaaagagaattgcatttccggtcccgtgaaggccacagcacccgtaggaggaccaaaaagagtgctggttactcagcaatttccatgtcagaaccctcttcccgtgaacagcggtcaggcgcagagggtgctttgtcccagcaatagtagtcagcggatccctttacaggcccagaaactcgtcagcagccataagcccgtgcagaaccagaaacagaagcagttgtag

SEQ ID NO: 27422 - DNA, 321 bp, Artificial Sequence
  Description of Artificial Sequence: Synthetic coding sequence
atggataggtctaaggagaactgcatttctggacccgtcaaagccacggccccagtcggaggtcctaaaagggttctcgttactcagcaattcccatgccagaaccctctgcccgtgaactcgggtcaggctcagcgcgtgttgtgcccaagcaactccagccaacgtatccctctgcaggcccagaaattagtatcatcacacaagccagtccagaatcaaaagcagaagcagttgcaggccacaagcgtgcctcatcctgtgtccaggcctctgaataacactcaaaagtcaaagcaaccactcccctctgcaccttag

SEQ ID NO: 27423 - DNA, 1035 bp, Artificial Sequence
  Description of Artificial Sequence: Synthetic coding sequence
atggcacagaaggaaaacagctatccctggccctacggaaggcaaacagctccgtctgggctttcgacactcccacaaagagtcctgcggaaggaacctgtgaccccctccgcccttgttctcatgagcaggtctaacgtgcagcccacggcagctcccggtcagaaggttatggaaaacagcagcggtacacccgatatcctgaccagacatttcactatcgatgatttcgagattggacgccctctggggaaagggaaattcggtaacgtgtacctggcccgtgaaaaaaagtctcactttattgtggccctgaaggtactcttcaagtctcagatcgagaaggagggcgtggagcaccaactgcgccgagagatagaaatacaagcccacctgcaccaccctaatatcttgcggctttataactatttttacgatagaaggcgcatttatctgatcctggaatacgcccctcgcggtgagttatataaggagcttcaaaaatcctgcacgttcgatgaacagcgcacagctactattatggaggaattggccgacgcactgatgtactgtcacgggaagaaggttatccacagggacatcaaacctgagaatctgctgcttggactgaagggcgaactgaagatcgccgacttcgggtggtctgtgcatgcccctagtttgcggagaaaaactatgtgtggcaccctggactatctgccaccagagatgatcgagggtaggatgcataatgagaaggttgatctatggtgcataggtgtgctctgttacgagttactggtcggcaaccccccattcgaatctgctagccataacgaaacttacagacggatcgtgaaggttgacctcaagttcccagcttccgttcccatgggcgctcaagacctgatctcgaaactgcttcgtcacaaccctagcgagcggttgccactagctcaggtctcagcccatccatgggtgagagcaaatagccgccgtgttctgccaccaagcgctctgcagtccgtggcttag

SEQ ID NO: 27424 - DNA, 912 bp, Artificial Sequence
  Description of Artificial Sequence: Synthetic coding sequence
atgtcgcggagcaacgtacaacccactgctgcaccagggcagaaagttatggagaacagtagtggtactcctgatatcttaacccggcattttacaatagatgattttgagatcgggcgaccactgggcaagggtaagtttggcaacgtgtacctcgcccgagaaaaaaagagccattttatcgtggctctcaaagttttgtttaagtcgcagatagagaaggagggagttgagcaccagctaagacgtgagatcgaaattcaggctcacttacaccaccccaatatactgagactgtacaactacttttatgatcgcaggcgaatctacctaatcttggagtacgcgccaaggggagagctctacaaggagctgcagaagagctgtaccttcgatgagcagcgaaccgctacaatcatggaggaactggctgatgctcttatgtactgtcacgggaaaaaggttatccatcgcgacatcaagcctgaaaatctcctcctggggttaaaaggagagctgaaaatcgccgactttggttggtccgtccacgccccttcgctgagaaggaaaactatgtgcggtaccctcgattacctcccaccagagatgatcgaggggcgaatgcacaatgagaaagttgatctgtggtgcattggcgtcctatgctatgaactcctagtgggcaatccgccattcgaatcggccagccacaacgaaacctacaggcgaattgttaaagtagatttaaagtttcccgcatctgtgccaatgggggctcaggatctcatcagcaaacttttacgccacaatcccagcgaaagactgcccctggctcaggtttccgcgcacccctgggtccgggctaattccaggagggtgctgccgccttcagcgctgcagagtgtggcctag

SEQ ID NO: 27425 - DNA, 1035 bp, Artificial Sequence
  Description of Artificial Sequence: Synthetic coding sequence
atggctcagaaagaaaactcctatccatggccttacggtcgccagacggccccttccggcctttccacattaccacagcgtgtactacggaaggagccagtgacccctagcgccctggttctcatgtcccggtccaatgtgcagcccaccgccgctcccggacagaaagtgatggaaaatagctctggtacccccgatattctcaccaggcattttacgatagacgatttcgagattgggcgacctctcgggaaagggaaattcggtaacgtgtacttggctagggaaaagaagtcccactttattgtcgcgctaaaggtcctatttaagtcccagattgaaaaggagggggtggaacaccaattgcggagggaaatcgaaatacaagcacacctgcaccatcccaatatcctgcgactatacaactacttctacgatcgaagaaggatttatctgatattggagtacgcaccccgtggcgaactctacaaagagcttcagaagtcttgcactttcgacgaacagcgtaccgccacaatcatggaggagttggcggatgccctgatgtactgccatggaaagaaagtcatccacagggacatcaaaccggaaaacttattgctgggcctcaagggcgagctgaaaattgccgatttcggctggtcagttcacgctccttcgctgcggagaaagactatgtgcgggaccctagactacctgccaccagagatgatcgagggcagaatgcacaatgaaaaagttgacttgtggtgcatcggtgtgctctgctatgagctcctagtcggtaaccccccattcgaaagtgcgagccacaacgagacatacaggcggatcgttaaagtggatctgaagttccccgcatccgttcccatgggtgcgcaggacctgatttccaagctgctccgacataatccttctgagaggctccctttagcacaggtgagcgcccatccgtgggtccgagccaacagtagacgcgttcttccccctagcgccttacagtccgtcgcctag

SEQ ID NO: 27426 - DNA, 930 bp, Artificial Sequence
  Description of Artificial Sequence: Synthetic coding sequence
atgtcatcccccagggcggtggtacagttgggaaaggcccagccagccggagaagaacttgctacagccaatcagaccgctcagcagccaagctcacctgcaatgcgtaggttgaccgtcgatgacttcgaaataggcaggcccttggggaaagggaaatttggcaacgtgtatttggcccgtttaaaggagagccatttcattgttgcgctgaaggtgctctttaaatcccagatcgagaaggaggggttggaacaccagcttcggagggaaatcgaaatccaggcacacttacagcatccgaatatcttgcgcctttacaactatttccatgacgcgcgacgcgtctatctcattcttgaatacgctcctaggggagagttgtataaggagctgcagaagtctgagaagcttgatgagcagagaacagcaaccatcatcgaggaacttgcagatgctctcacttactgtcatgacaagaaagtcatccaccgcgatatcaaaccggaaaacctgctgctgggatttcggggtgaggtgaagatagccgacttcggatggtctgttcacactccatctctgcggcgaaagacaatgtgcgggaccctggattatctaccccctgagatgatcgaaggtcgcacttatgacgagaaggtggacctttggtgtataggagtcctgtgttatgaactcctcgttggctacccaccgttcgagtcggcttcccactctgaaacctacagacgcattttaaaagtggatgtgaggttcccattatccatgccccttggcgcaagggatcttatttcccgtctcctgcgatatcagccccttgagcggttgccccttgcacagatcttgaaacatccatgggtccaggcacattctaggagagtcctgcctccatgtgcccagatggccagctag

SEQ ID NO: 27427 - DNA, 873 bp, Artificial Sequence
  Description of Artificial Sequence: Synthetic coding sequence
atggccacagcgaaccaaaccgcccagcagccatcaagccctgccatgcggaggctgacagtcgacgactttgagatagggagacctctcggcaaaggcaaattcgggaacgtgtatctcgctagactgaaggagagtcactttatcgtggccctgaaagtgctgttcaaatcgcaaatcgagaaagaaggcctggagcaccaactgcggcgagaaatcgagatccaggcgcatctgcagcacccaaatattctgcgcctgtacaactacttccatgatgctcgccgagtctatttgattctggaatacgcgccacgtggagagttatataaggaactgcagaagagcgaaaagctggatgagcagaggacagccacgatcatagaggagctggcagatgccctgacttactgtcacgacaaaaaagtgatccaccgtgatattaaacctgagaacttgctgctgggcttcagaggggaagtgaagatcgccgatttcggctggtccgtgcacacaccctcgctgcgcagaaagactatgtgcggcaccctcgactatctccctccagaaatgattgaggggcgtacttatgatgagaaagtagacttatggtgcattggcgtgttatgctatgagctgctggttggctaccctccttttgaatcagcaagtcattctgaaacgtaccgacgcatattgaaggtggatgtgcgctttcctttgtcaatgccactcggagcgagagacctgatcagccgcttgttaaggtatcaaccactggaacggctgcccttagcacagattctgaagcatccctgggtgcaggcacacagtagacgggtcctgcctccatgtgcccaaatggcctcatag

SEQ ID NO: 27428 - DNA, 828 bp, Artificial Sequence
  Description of Artificial Sequence: Synthetic coding sequence
atgagacgacttacagttgatgatttcgagatcggcagacccctcgggaagggcaaatttggcaacgtgtatcttgcccgattgaaagagtcccacttcatcgtagccctgaaggtgcttttcaaatcccaaatcgaaaaagaaggattggaacaccaattgcgcagagagatagaaatacaggcacacctacagcatcccaatatcctgagactgtacaactacttccacgatgctcgcagggtatacctgattctggagtacgctcctaggggggaactctacaaggaactccagaagtccgagaagttagatgagcaacgtacagcgacaattattgaagaactggcagatgctttaacctactgccacgacaagaaagtcattcaccgcgatattaagccagagaatttgctcctcggcttcaggggagaggtgaaaattgctgacttcggttggtcggttcacacccccagtctgcggcgaaaaacaatgtgtggcacattggattacttgcctccagagatgatcgaggggcgtacttacgacgaaaaagtcgacctctggtgtattggggttctctgctatgagctgctggtgggctatcccccttttgagagcgcttctcactcggaaacttataggcgcatactgaaagtggatgttaggtttccattatcaatgcctctgggcgctcgggatcttatcagcaggttacttaggtaccagccattagaaagactccctctggctcagatccttaaacacccatgggtccaggctcacagccggagagtcctgcctccctgtgcgcaaatggccagttag

SEQ ID NO: 27429 - DNA, 2589 bp, Artificial Sequence
  Description of Artificial Sequence: Synthetic coding sequence
atgaacattcaagagcagggctttcccctcgacctgggggctagttttacagaggacgctcctcgtccaccagtgcccggtgaggaaggagagctggttagcaccgacccgcgtcctgcaagctattcattctgcagcggaaagggggtgggcatcaaaggcgagacatccaccgccactccgaggcgatcagacctggacttgggatacgagccagaaggttccgcatctcccacaccgccttatctgaaatgggcagagtcgcttcacagcttgttagatgaccaggacggaattagcctttttcgaacctttctgaaacaggaaggttgcgccgatctcctcgatttctggttcgcctgtacgggcttccgcaagctggagccttgcgatagcaacgaagagaagcgcctgaagctggctcgagctatttacagaaaatacatccttgataacaacgggattgtgagcagacaaaccaagcccgctacaaagtcctttatcaaggggtgtatcatgaagcagctgatcgatcccgcaatgttcgatcaagcacagacggaaatacaggcaactatggaagaaaacacttacccctccttcctcaaatcagacatctacttggaatatacccgcactgggagtgaaagtccaaaggtgtgttcagatcagtcctcaggttctggaactggtaaaggcataagcgggtacttgccgacactgaacgaggatgaagagtggaaatgcgatcaggacatggacgaagacgacggcagagacgccgcaccacccggacggctgccccagaagctgttgttggagacggccgctcctcgagtcagtagttcacggaggtactctgaaggtagagaattcaggtatggctcatggagggaaccagtaaatccatactacgtcaatgctggctacgcactggccccagctacgtcagccaatgattccgagcagcagagcttaagcagtgatgctgatacactaagtctcaccgatagtagcgtggacgggattccaccatatcggatacgcaaacagcatcgcagggagatgcaggagtccgtgcaggtgaatggcagagtcccgctgccacacatcccaagaacgtacagagtgcctaaagaagtgagggttgagcctcagaagtttgctgaggagctgatacaccggctggaggccgtccagcggacacgggaggcggaagagaagctggaagagcgtctcaaaagggtgaggatggaagaagagggggaagatggggaccccagcagcggcccacccggtccctgccacaagctcccacccgcacccgcttggcaccatttcccaccacgatgcgtcgatatgggttgcgcaggcttgagggacgcacatgaggaaaatccggaatccatcttagatgaacacgtgcagagggtgcttaggacccctggccgacagtcacctgggccaggtcaccgcagtcctgacagcgggcatgttgctaaaatgcctgtggcgctaggcggtgccgcaagcgggcacggaaaacacgtcccaaagagtggtgcaaagctggacgcagccggactgcaccaccaccgtcatgttcaccatcacgtccaccactccacggccagaccgaaggaacaggtagaagccgaagcaactagacgagcgcagtcgagcttcgcttgggggctggaacctcacagtcacggcgcacgctcccggggatactctgaatcagtcggagcagcaccaaatgccagtgatggtctggcacacagtggcaaggtgggtgtggcctgcaaacgcaatgcgaagaaggccgaatccggtaaatccgcgagcaccgaggtgcccggagcatctgaggatgctgagaagaaccaaaagatcatgcaatggatcatcgagggggaaaaggaaatcagtagacacagacgcaccggtcatgggtcttccggtactcgaaagcctcagccacacgagaattcaagacccctctcactggaacacccctgggccggaccgcagctaagaacgtcggtgcagcccagtcatctgtttatccaggatccaacaatgccaccgcaccccgcacccaatccacttacccaactcgaggaggcaagacggcgtctggaagaagaggagaagagggcatcgcgtgcgccatccaagcagcgatacgtacaggaagtgatgcggagaggacgcgcttgtgttcggcctgcctgtgctcccgtcctccatgtggtaccagccgtgtcagacatggagctatccgagaccgagaccagaagccagcggaaagtcggcggaggctccgcccagccttgcgacagcatcgttgtggcctactatttctgtggagagcctattccgtataggactttggtgcgaggcagggctgtgacactggggcagtttaaagaacttctcactaaaaaaggatcctaccgatactacttcaagaaagtctctgatgaatttgactgtggggtggtctttgaggaagtgagagaagacgaagctgttctgcctgttttcgaggaaaaaatcattggcaaagtggagaaagttgattag

SEQ ID NO: 27430 - DNA, 2481 bp, Artificial Sequence
  Description of Artificial Sequence: Synthetic coding sequence
atgaatattcaggaacagggatttcctctggacctgggagcatcattcaccgaagacgcgccacgacctcccgtgccgggagaagagggagagctggtaagtactgaccccagaccagccagctattccttctgtagcggcaagggcgttggcatcaaaggggaaacttcaaccgcaacccccagacgctctgatctggatttgggctacgagccggaaggcagcgcatcgcccacacctccatatctcaaatgggctgaatccctccattcactgctcgacgatcaggatggaatctccctcttccggacgtttctcaagcaggagggctgtgctgacctgctcgacttctggttcgcctgtactggttttaggaagttagagccctgcgacagtaatgaggaaaagaggctcaagctggcccgagctatctatcgaaaatatatactggataataacggcattgtgtctaggcaaacaaagccagcgaccaagtctttcatcaaaggctgcattatgaagcagttaattgatcctgccatgtttgaccaagcccaaactgagatccaggccacaatggaggagaatacctaccccagctttctgaaatccgacatatacctggagtacacaaggactggcagcgagagtccgaaggtgtgcagtgaccagtcgtccggctctggaacaggaaaaggtatctcaggatatctgcctacattgaatgaggatgaagaatggaaatgcgaccaggacatggacgaggatgacgggagggatgcagcccctcccggacggctaccccagaaactactgctggagaccgcagctcctagagtttccagctcgcgacggtattctgaggggcgagagtttaggtatggaagttggcgggaaccagtgaatccctactacgtaaacgccggttatgctctggctcctgctaccagcgctaatgatagtgagcaacagagcctttccagtgacgcagacacactgagtctcacagatagttccgtggacggcatccctccctatcggatcagaaaacagcaccgacgggaaatgcaggagagcgtgcaggtgaatggcagagttcctctgccccatatacctcgtacctaccgggtccctaaggaggtgagagtggagccccagaagttcgccgaggagctgattcaccgactggaggccgtgcagcgaacacgcgaggccgaggaaaagttggaagagcgtctgaaacgtgtacggatggaggaagagggcgaagacggggatccttcgagtggacctcccggtccgtgccacaaactccctcctgctcccgcttggcaccacttcccaccacgctgtgtggatatgggatgtgcgggattgcgcgacgcccatgaggaaaaccccgagtccattctggacgagcatgtgcaaagagttctgcgaactccgggtcgccagtctcctggtccaggccataggtcccccgattcagggcacgttgccaagatgccagtcgcactgggtggcgcagctagcggccacgggaaacacgtccctaaatcgggggctaaactggacgccgcaggattgcaccaccaccgccacgttcatcatcacgttcaccatagtaccgcccgtcccaaagagcaggtagaagcagaagccacccgtcgagcacagagcagtttcgcttggggattggagccccatagccatggagcccgaagccggggatacagtgagtcagttggagccgcaccaaatgcgtccgacgggttggcccattccggtaaagtgggcgtcgcctgtaaacgcaatgctaaaaaggccgaatccgggaaatcagcttccaccgaagttccaggcgcatctgaggatgccgagaaaaaccagaagattatgcagtggatcatcgaaggcgaaaaagaaattagccgccatcggcgaaccgggcatggatcctctggaaccagaaagccccagccccatgagaactccagacccctgtcgctggaacatccttgggcaggccctcaactcaggacaagtgtgcaaccatcccacctgttcatccaggatcctactatgccgccacatccggctcccaaccccctgacacagttagaagaggcccgtagaagactcgaggaggaggaaaaacgtgcatcacgcgctcccagcaagcagcggactagaagccagcggaaagtcgggggaggttctgcccagccctgcgacagtatcgtcgttgcctactacttttgcggcgaaccaatcccgtaccgcaccctggtccgtggcagagccgttaccctggggcagttcaaggagctgctaacgaagaaggggtcttatagatactactttaagaaggtctcagacgaatttgattgcggagtcgtctttgaagaagtaagggaagacgaagcagtactcccagtgtttgaggagaagataattgggaaagtagagaaagtggactag

SEQ ID NO: 27431 - DNA, 309 bp, Artificial Sequence
  Description of Artificial Sequence: Synthetic coding sequence
tagttggaggaggaggaaaaaagggcctctcgcgcaccctcaaagcaacgaaccaggagccagaggaaggtgggcggaggatccgcacagccttgcgattccatcgtcgtcgcctactacttctgcggcgagcctataccctatagaactttggtcaggggcagagcggtgacactgggccagttcaaggaactcctgacaaagaagggtagctatagacctcctagtcacctaaggtgttgtctgctaactgcgcttctgacatccgtccttcaaattcttctgcaggaaagcgagcgaagggtttag

SEQ ID NO: 27432 - DNA, 1824 bp, Artificial Sequence
  Description of Artificial Sequence: Synthetic coding sequence
atggtgtgcacccgcaaaactaaaacactcgtgagcacttgtgtcatcttgagcggtatgacaaacattatttgtctcctgtatgtcggatgggttaccaactatattgcatccgtctatgttcggggacaagaaccagcgcctgataagaagctcgaagaagataagggagacactctgaagataattgagaggctcgatcatctcgagaatgttatcaaacaacatatacaagaagcaccggctaagcccgaggaggccgaagctgagcccttcactgacagctccctgttcgctcactggggccaggaactcagcccagaggggagacgggtggccctcaaacagtttcagtactatggttacaatgcatatttgagtgacagacttcccctggacagacccctgccagatctacgacccagtggctgtcggaaccttagtttccctgatagcctgcccgaagtgtctatagtttttatattcgtgaacgaagccctttcagtgctcctcaggagcattcattcagcaatggagcgtaccccccctcacctgttaaaggagatcatactggtggacgacaacagctcaaatgaggagctgaaggagaagctcactgagtacgtcgataaagtaaattcccagaagccaggatttattaaggtggtccggcactcaaagcaggaaggattgataagaagtagagtaagcggatggcgggctgccaccgcaccagtagtcgccctctttgatgcccacgtcgagttcaacgtcgggtgggccgagcctgttctgacccgaatcaaggaaaaccgtaagcgcataatctcaccaagctttgacaacataaaatacgacaatttcgagattgaggagtacccgctggccgctcaaggttttgactgggagctgtggtgccggtacctcaacccaccaaaggcatggtggaagcttgaaaattccacagcccctattagaagccccgcactgataggatgttttatcgtcgaccggcagtattttcaggagatcggtctcctggatgagggaatggaagtgtatggcggtgagaatgtggagctgggcatacgggtgtggcaatgtggtggatcggtggaggtgctgccctgctccaggatcgctcacattgaaagagcgcacaagccatacaccgaggatctgaccgcacacgtaaggagaaacgctctgagggtggccgaggtctggatggacgaatttaaatcccacgtgtacatggcgtggaatatacctcaagaggatagcggtattgatattggggacattactgctcgtaaggctctccggaagcagctccagtgcaaaacattcaggtggtatcttgtgtctgtctaccccgagatgcgtatgtattccgatataatcgcctatggcgtgctccagaacagcttgaaaacagatttgtgcctagatcagggaccagacacagagaacgtgcctattatgtatatctgtcacggtatgactccccagaacgtatattacacgtctagccagcaaatccatgtcggaattctgagtcctaccgtggatgatgacgataaccggtgcttggtggacgtcaactcacgccctcggttaattgagtgcagctatgcaaaagcaaagcgcatgaaactccactggcaattctcccaggggggacccatacagaacaggaagtccaaacgttgtctagagctgcaagaaaattcagaccttgaattcggattccagctggtgttacagaagtgcagcggacagcattggtctatcactaacgtgttgcgctctctggctagttag

SEQ ID NO: 27433 - DNA, 1710 bp, Artificial Sequence
  Description of Artificial Sequence: Synthetic coding sequence
atgagtacctattccacattccctgccggagtgcctgtgtccgagcggtccttagcccgagcagggttctactacactggtgtcaacgataaggtcaaatgtttttgctgcggcctgatgctggacaactggaaactgggagactccccaatacagaagcataaacagctttacccctcttgctcattcattcagaatctcgtctctgctagtcttgggtcaacctccaagaacactagtcctatgcggaactcattcgctcattcattgtcacccacgctggagcactccagtttatttagcgggagctactcgagtctcagccctaatcccttaaactctagagccgtagaggatatctcttcaagcagaacaaacccatattcttatgccatgagtaccgaggaagcgagattcctgacctaccacatgtggcccttgacgtttctctctccatccgaactggcccgtgctggtttctactacataggcccaggcgatagggtggcttgctttgcctgcgggggtaagctgagcaattgggagccaaaagacgatgctatgagtgaacacagacgccatttcccaaactgccctttcctggagaacagccttgagacactgcgcttctctatatcaaatctctccatgcagacgcatgccgctcgaatgcgcacattcatgtattggcccagctccgtgccagtgcagcccgaacaactcgctagcgccggtttttactacgttggcagaaacgacgacgtaaaatgcttctgttgtgatgggggactcaggtgctgggaatccggggacgacccctgggtggagcatgccaaatggtttccgagatgcgagtttctgatccgcatgaaagggcaggaatttgtggatgagatccagggaaggtatccccatttactggagcagctgctgagcacatctgatacaactggagaagagaacgccgaccccccaattatacacttcgggcctggggagagctccagcgaagacgctgtgatgatgaataccccagtcgtgaagtcagctctggaaatgggttttaaccgggatctcgttaaacaaactgtgcagagcaaaatcttgaccactggcgagaattataaaacagtcaatgatattgtgtccgccctgctgaatgctgaggacgagaagcgggaggaggaaaaggaaaaacaggctgaagagatggcatccgatgatctgtcactgatccggaaaaatcgaatggcacttttccaacagcttacatgtgttctccctatactggacaatctgctgaaagccaatgtgataaacaaacaggaacacgatattatcaagcagaaaacgcagatccccctgcaagcccgagaactcatcgacacgatactcgtaaaggggaatgccgcagccaacatctttaagaattgcctaaaagagatcgactccacactgtataaaaacctgtttgtagataagaatatgaagtacattcccacagaagacgtctccggcctcagccttgaggagcagttgaggcggctgcaggaggagaggacctgtaaagtctgtatggataaggaagtctccgtggtttttatcccttgtgggcacctggtggtgtgtcaagagtgtgccccatccctcagaaagtgtccaatctgccggggaataattaaaggcacggtgagaacctttctttcttag

SEQ ID NO: 27434 - DNA, 1794 bp, Artificial Sequence
  Description of Artificial Sequence: Synthetic coding sequence
atggaagacagtacaattctaagtgactggacaaatagcaacaaacaaaaaatgaagtacgatttctcgtgtgaactgtaccggatgtcgacctattccacttttcccgctggtgtgccagtgtctgaaagatctctggcacgcgcagggttttactatacaggggtgaatgataaagttaagtgcttttgctgtggtctgatgctggacaactggaaactgggggacagccctatccagaaacacaagcagctgtatcccagctgctctttcatacagaatttggtgtctgcgtccctagggtccacatctaagaatacctccccaatgagaaacagttttgcccattctctgtccccaactctcgaacactctagcctgttcagtggtagctatagtagcctgtctcccaatcctctcaattcgagggccgtggaggatatatcaagctcacggacaaatccatatagttacgccatgagcacagaagaggctcgcttcctaacttatcatatgtggccactgaccttcctctcccctagcgaactggccagagccggtttttattacatcggcccaggcgatcgagtggcttgttttgcctgtgggggaaaactttcaaattgggaacccaaagatgatgccatgagtgagcataggagacacttcccgaactgccccttcttggagaactccctggagaccctcagattcagcatatcaaacttatcaatgcagacacatgcggcaaggatgcgcacattcatgtactggccgtcaagtgtacctgttcaaccagaacagcttgcctctgcagggttttattatgtgggtaggaacgatgacgtgaaatgcttttgttgtgatgggggtttgaggtgctgggagtccggtgatgacccctgggttgagcacgcaaaatggtttcccaggtgtgagttcctgatcaggatgaaaggtcaggaatttgtggatgagatacagggccgttatccccacctactagagcagttattgagcacgagcgacacgacaggagaggagaatgctgatcctcccattatacacttcggcccaggagagagctcttcggaggacgctgtcatgatgaacacaccagtggtgaagagcgccctggaaatggggttcaatcgggatctagtcaaacagacagtgcaatcgaagattctgaccactggtgagaattacaaaacagtaaatgacatagtctccgctcttcttaacgccgaagatgaaaaacgcgaagaggaaaaagaaaagcaggccgaggagatggcctccgatgacctatccctgatccggaaaaatcgcatggcactgttccaacagctcacgtgcgtcttacccatactcgataacctgctgaaggccaacgtcattaataagcaagagcatgacatcatcaaacaaaagacccagattcctctccaggctcgggaactcattgatactatcctcgtgaaaggcaatgcagcagcaaacattttcaaaaattgccttaaagagattgatagtaccctctacaaaaatctcttcgtcgacaaaaatatgaagtatatccccaccgaagatgtatcaggcctgtcccttgaagaacagctgagacgcttgcaagaggagagaacatgtaaagtttgcatggacaaggaagtgtctgtcgtcttcattccatgtggtcatcttgtcgtgtgtcaggagtgcgctccaagcctgcggaagtgcccaatatgtagggggattatcaagggcaccgtgcgaacctttctgtcttag

SEQ ID NO: 27435 - DNA, 1605 bp, Artificial Sequence
  Description of Artificial Sequence: Synthetic coding sequence
atgcacaaaacagccagtcaacggctgtttcccggtccgtcctatcaaaatattaagagcatcatggaggatagtacaattctcagcgattggactaacagcaataagcagaagatgaaatatgatttttcttgtgaactctaccgcatgtccacatactcaaccttccccgctggagtgcccgtctctgagaggtccctagcaagggctggtttctattatactggggtgaatgacaaagtaaaatgcttttgctgtggattaatgttggacaattggaaactaggcgattcccctattcaaaagcataagcagctgtatcctagttgtagcttcattcagaatctcgtctccgcatctctcggatccacttcaaagaacacttctccgatgaggaactcattcgcacactcccttagccccacactggaacattcctctctgttctcaggttcctattcatccctgtctccgaatcctctaaatagtagagcggtagaagatattagttctagccggaccaacccgtatagctacgccatgagcacagaagaagccagatttcttacttatcatatgtggccattgacattcctttctccttccgaactcgccagggctggcttctattacattggccctggtgaccgggtagcctgttttgcatgcgggggtaagctctctaactgggaaccaaaggatgacgctatgtctgaacatcggcgacatttccccaactgcccttttcttgaaaacagcctggagacgttgcggttctctatttcgaatctgtccatgcagacccacgccgctcgaatgcggacattcatgtactggccatctagcgtgcctgtgcagcctgaacaactggcttccgcaggcttctattatgtcggtcggaatgacgatgtgaagtgtttttgctgcgatggaggcctgagatgctgggagagtggggatgacccgtgggtggagcacgcaaagtggtttccacgctgcgaattcctcattaggatgaagggccaggagtttgtggatgaaatccagggccgatacccacatttgttagagcagctgctctccactagcgacactaccggggaggagaatgccgacccccctattattcacttcggccctggcgagtcttcgtctgaggacgctgttatgatgaatacaccagttgtaaagtccgctctggaaatgggctttaatcgggatctggtcaagcaaacagtgcagtccaagatcctaactaccggcgagaactataagacagtgaacgacatcgtgtcagctcttcttaatgcagaggatgagaaacgggaagaggaaaaggagaagcaggccgaggagatggcaagtgatgacctgtctctgatccggaaaaaccgtatggccctgtttcagcagcttacctgtgtgctgcccatcctggacaatttgctgaaggctaatgtgattaacaaacaggaacacgacattatcaagcaaaaaacgcagatccctctgcaggctcgggaacttattgatactatcctggtcaagggcaacgctgctgccaacattttcaagaactgtcttaaggttaagcagcggttctag

SEQ ID NO: 27436 - DNA, 1815 bp, Artificial Sequence
  Description of Artificial Sequence: Synthetic coding sequence
atgaacatcgtcgagaatagcattttcctgtccaatctgatgaaatcagccaacacctttgagttgaaatacgacctgtcttgcgaactctacaggatgagcacatactctaccttcccagccggtgtgcctgtgagtgagcgaagtctggcacgagcaggattttattacactggggtcaatgataaagtgaaatgcttttgctgcggactgatgctcgacaactggaagagaggggattcacccacagagaagcacaaaaaattataccccagttgccggtttgtgcaaagcctgaatagcgtgaacaatcttgaagctacaagccagcccacatttccctccagcgtgacgaactccacccactcactccttccgggaacagagaacagcggatatttcagaggctcttacagtaacagcccctcgaatcccgttaatagtcgcgctaatcaggatttcagcgccctgatgcgtagcagttatcactgcgccatgaataacgagaacgctagactgctgaccttccagacatggccactgacttttctttctccaaccgatctcgccaaagcgggtttctactatataggaccaggcgaccgcgtggcctgttttgcctgcggtggcaagctttcaaactgggaacctaaggataatgcgatgtcggagcatcttcgacatttcccaaaatgtccatttattgagaaccagttgcaagacacctcacggtacactgtctcaaacctcagcatgcagactcacgccgcacggttcaagacgttcttcaattggccctccagcgtcttagtgaatccagaacagctggcttcagccggattctactacgtaggaaactcagatgatgttaaatgcttctgttgtgatggcggacttcggtgctgggagtccggcgacgacccgtgggtgcagcacgctaagtggtttccgagatgtgaatacttaatcagaataaagggacaggaatttatccggcaggtgcaggcctcttaccctcatttgctggaacagctgctgtccacttctgacagtccgggtgacgagaacgctgagtctagcattatccatttcgaacccggtgaggaccactctgaggatgctattatgatgaacacacctgtgattaatgctgcagtcgagatgggcttcagccggtctctagtcaaacagacagtacaaagaaagatcctggccacgggtgaaaactatagactggtcaacgacctggtgcttgacctgctgaatgctgaagacgagatcagagaagaagaaagggagagagccactgaagaaaaagaatcgaatgatctcctgctgatacggaaaaatcgaatggccttgttccaacaccttacttgtgtgatcccaatcctggactcccttctcaccgctggtatcattaatgagcaagagcatgacgtgattaagcagaaaacccagacatctcttcaagctagagaactgatagacacaatcctggttaaaggtaacatcgctgccactgtgtttaggaactccctgcaagaagcagaggcggtgctgtacgaacacctgtttgtgcaacaggacatcaagtacatacccacagaggatgtcagtgacttacccgtggaggagcagctgcggagactccaggaggaacgcacctgtaaagtttgtatggacaaagaggtgagcatagtttttattccctgtggccacctcgtcgtttgtaaagactgtgcaccgagcctccggaagtgtccaatctgtaggtcaacaataaagggaactgtcaggacatttctgagttag

SEQ ID NO: 27437 - DNA, 1815 bp, Artificial Sequence
  Description of Artificial Sequence: Synthetic coding sequence
atgaacatcgtagagaactctatatttctaagcaatttgatgaaatccgcgaataccttcgaactaaagtacgatctgagttgcgagctctaccggatgtcaacctattcaaccttccccgcaggtgtacccgtttctgagaggtccttggcgcgtgccggattctattacacaggggtcaacgacaaggttaagtgtttttgctgcggtttgatgcttgacaattggaaaagaggtgattccccaacagagaagcataagaagctgtacccgtcctgccgattcgtccagtcccttaattctgttaacaacttagaagccacgagccagccaacttttccttcctcggtcaccaattctacgcactctctgctgccagggaccgaaaactctgggtatttccgtgggtcttattccaactctccttccaatcctgttaactcccgagctaatcaagatttcagcgccctgatgcgcagctcctaccactgcgctatgaacaacgaaaatgcacggctgctaactttccagacctggccccttacctttctttcaccgaccgacttggctaaagctggcttctattatatcggcccaggtgatcgggtcgcctgtttcgcatgcggcggaaaactctcgaattgggaacccaaggacaatgccatgtcagagcacttgcgccacttccccaaatgcccgtttattgaaaatcaacttcaggacacgagtaggtataccgtttccaacctttctatgcaaacccacgctgcccgtttcaagacttttttcaattggccttccagtgttctggttaaccctgagcaactggccagcgccggtttctattacgtcggcaactctgatgacgtgaaatgtttttgctgcgacggcggactacgttgctgggagagcggcgacgacccctgggttcagcatgccaagtggtttccccgatgtgagtacctgattcggattaagggtcaagaattcattcgccaggtgcaggcaagctacccgcacctgttggagcagctcttgtccacatccgattcgcctggcgacgagaatgccgaatcctctatcatccactttgaaccaggcgaggaccacagcgaggatgctatcatgatgaatacaccagtcattaatgccgctgtggagatgggatttagccgcagccttgtgaagcaaaccgtgcagcggaagatacttgcaacaggggaaaattacaggctggtgaacgacctggtactggatttgctaaacgctgaagatgagatccgtgaggaggagcgagagcgggcaacagaggagaaggaatccaacgacttgttgcttatcagaaagaacagaatggccttgttccagcacctcacatgtgtgattccaatcctcgactcactgctcaccgcaggtattataaacgagcaggaacacgacgtgatcaaacagaaaactcagacatccttgcaggccagagagcttatcgataccatacttgtgaaagggaatatcgccgctaccgtgttccgcaactcgttgcaggaggcagaggctgtgctgtatgagcatctattcgtgcagcaggatattaaatacatcccaaccgaggacgtgtcagacctcccagtcgaggagcagttgagaaggctgcaggaagagcggacctgcaaggtgtgcatggacaaggaggtgagcattgtgtttattccgtgcggacatctcgtagtctgtaaggattgcgcaccctcgctcaggaagtgccccatctgtaggtcaactattaaaggtaccgtccgaaccttcctctcttag

SEQ ID NO: 27438 - DNA, 498 bp, Artificial Sequence
  Description of Artificial Sequence: Synthetic coding sequence
atgggcgctcccaccctccctcccgcatggcaaccatttttgaaggatcacagaattagtacattcaagaactggccattcttagaaggatgtgcatgtaccccagagaggatggccgaagctggcttcattcactgcccgaccgagaacgagccagacctggcacagtgtttcttttgcttcaaagaactagagggttgggagcccgatgacgaccccattggccctggaacagtcgcatacgcttgcaacaccagtaccctcggcggacggggtggcaggatcacacgagaagaacacaagaagcactcatctggctgtgcattcctctcagtgaagaagcaattcgaggagttaaccctgggcgaattccttaaactagacagagagagggctaagaacaagattgctaaggaaaccaacaataagaaaaaagagttcgaagagacagcagagaaggtgcgcagggcaatcgaacagctggctgccatggactag

SEQ ID NO: 27439 - DNA, 429 bp, Artificial Sequence
  Description of Artificial Sequence: Synthetic coding sequence
atgggagccccaacactgccacccgcatggcagcctttcctgaaggaccacagaatatctacctttaagaactggccatttctggagggctgtgcctgtacccctgagagaatggccgaggcgggattcattcattgtccgacagagaacgaacctgatctggcacagtgcttcttctgcttcaaagaactggaaggttgggagcccgacgatgatccgatcgaggagcacaagaagcactcttccggttgcgcgttcctgtctgttaaaaaacaattcgaggaattaacgctgggggaatttctaaaattggaccgggagcgagctaagaacaagatcgctaaggagaccaataataagaagaaggagtttgaggaaacagctgagaaagtccgtagggcaatcgagcagttagccgctatggattag

SEQ ID NO: 27440 - DNA, 414 bp, Artificial Sequence
  Description of Artificial Sequence: Synthetic coding sequence
atgggggctccaaccttgcccccagcatggcagcccttcctgaaagaccacaggatttcaactttcaaaaactggccgttcctcgaaggctgtgcatgtacccccgaacggatggctgaagccggattcattcattgtcccactgagaatgaacccgatcttgcacagtgtttcttctgttttaaggagctagaagggtgggaaccagatgatgatcctatgcaacgaaaacccacgatccggagaaaaaacctcaggaagcttagacgtaagtgcgctgttccttctagcagctggctaccctggattgaggcttctgggaggagctgtttggtgccagagtggttgcaccatttccaggggctctttcccggagctacatcactccctgtagggcctctggctatgtcctag

SEQ ID NO: 27441 - DNA, 432 bp, Artificial Sequence
  Description of Artificial Sequence: Synthetic coding sequence
atgggcgctccaaccctccccccagcttggcaaccatttttgaaggaccatcgcattagcacattcaagaattggccattccttgaaggatgcgcctgtacacctgaacgcatggctgaagccggttttattcactgtcctacagaaaatgagcccgacttagcacagtgttttttttgcttcaaagagctcgagggctgggagcctgatgatgatcctattgggcctggtacggtggcctatgcgtgtaatacctccactctcgggggtcgtggaggacgtatcactcgggaagagcacaagaaacacagctccggatgcgcattcctcagcgttaagaaacaattcgaggagctgaccctcggagagtttctcaagctggaccgtgaaagggccaagaataagatcgagcgggcactgttggccgagtag

SEQ ID NO: 27442 - DNA, 14574 bp, Artificial Sequence
  Description of Artificial Sequence: Synthetic coding sequence
atggtgactggcggaggtgcggcaccccctggtacagtcactgagcccctcccctcagtcatcgtcctgagcgctgggagaaaaatggctgcggcagccgctgccgctagcggcccaggatgcagttctgcagcaggagccggtgcggctggagtaagcgagtggctggtccttcgagatgggtgtatgcattgtgacgcggacggcctccacagcctaagctaccacccagcgttaaacgccattctggctgtaacatcccgaggcactatcaaagtgatcgatggcaccagtggagcgaccctgcaggctagtgcgcttagtgctaaacctgggggtcaggttaaatgtcaatatattagtgcagtcgacaaagtcattttcgttgacgattacgctgttggttgccgcaaggatttaaacggcatcttgctgttggataccgctctccagacccctgtatccaagcaggacgacgttgtccagctagaacttcccgttacagaggcccagcagctattgtccgcttgtctagagaaggtggatatctcttcaacagaaggctatgacctgttcattacacaacttaaggatggcctgaaaaacacttcacacgaaaccgccgcaaaccataaggtggccaaatgggcgactgtcacttttcacctgccccaccacgtcctaaagtccatcgccagtgctatagttaacgaactaaaaaaaattaatcagaatgtggcagcactgcccgttgcctcttccgtcatggaccgcctaagctacttgcttccttccgctaggccggagctaggcgtggggccaggtcgttcagtcgaccgttcgctgatgtactccgaggccaatcggagagagacatttacttcttggcctcacgtcgggtacaggtgggcacagccggaccccatggcccaggcaggattttaccatcaacccgcaagctcaggcgacgatcgcgctatgtgctttacttgttctgtttgtctcgtctgctgggaacccacagatgaaccatggtccgagcatgaacggcactcccctaactgtccgttcgtgaagggcgagcacacccaaaacgtgcctctgtccgtgactcttgccactagccctgcccagttcccctgcacagatggcacagacaggatcagttgttttggcagtggctcctgtccccacttcttagctgccgctactaagcgtgggaaaatctgcatctgggacgtttctaagctgatgaaagtgcaccttaagtttgaaattaacgcttatgaccctgcaatagtgcaacagctgattttgtctggagatccctccagcggcgtcgactctcgcaggcctaccctagcttggctggaggattctagctcctgctcagacatccctaaactggagggagacagtgatgatttgctcgaggatagcgacagcgaagagcattccagaagcgattcagtgacagggcacacctcccagaaagaagccatggaggtaagtcttgatataaccgccctgtctatcctacagcagcctgaaaaactccagtgggaaatcgtggcaaacgtgctggaggacacggtgaaggacctggaagaactgggcgctaacccttgcctcacgaatagcaagagtgagaagactaaagagaagcatcaagaacagcataacatcccatttccctgtcttttggccggaggtctgctgacatacaagtcaccagcaacctcaccaatttcttcaaacagccaccgcagtctggacgggctcagccgaacacagggcgagagcatttccgaacaaggatctacagacaacgaaagttgtaccaatagcgagctgaatagcccattagtacggcgaacccttccagttctactcttatattccattaaggagtctgacgagaaagccggaaaaattttcagtcaaatgaacaacatcatgagcaaatctctgcacgacgacggattcacggtgccccagataattgaaatggagctggattctcaggaacagctgttgctgcaggatccacctgtaacatatattcaacagttcgctgacgctgccgctaaccttacctctccagattctgagaaatggaactctgtgttcccaaaaccaggcacccttgtccagtgcctccgactgcccaaattcgcagaagaggagaacttgtgcattgactccatcaccccctgcgccgatggcatccacttactcgtggggctgaggacttgtcctgtggagtccctgtcagcgatcaatcaagtggaggcactgaacaacctgaacaagctgaactccgctctttgtaaccggcgtaagggtgagctggagtctaatcttgctgtagttaatggtgcaaatatctctgtgatccagcacgagagtcccgctgatgttcagacacccctcatcatccagccagagcaaaggaatgtctccggaggctatcttgtcctgtacaagatgaactacgcaaccagaatagtcactttggaagaggagcctattaaaatccagcacatcaaagacccacaggatactattactagtctgattctccttccgccagacatcctggacaaccgcgaggacgactgtgaggagcccattgaagatatgcagcttacctccaaaaatggcttcgaacgggaaaagacaagcgacatttctactctcggtcaccttgttatcactacccagggcggatatgtcaaaattctggaccttagtaattttgagattcttgccaaggtcgagccccctaaaaaagaggggaccgaggaacaggatacgtttgtgtctgtgatctactgttccggtacagacagactgtgcgcttgcacaaagggcggagagcttcattttcttcagataggaggcacttgtgatgacatcgacgaggccgacattctagtggacggaagccttagtaaaggtatcgaaccatcctctgaaggttctaagccattaagcaaccctagtagccccggtataagcggggtggacctgctggttgaccagccctttacgttagagatcctgactagtctcgtggaacttacccggtttgagaccctgacccctagattttctgccaccgtacccccttgttgggttgaggtccagcaggaacagcagcagcgtaggcatccccagcacctgcaccaacagcaccacggagatgccgcacagcacacccggacctggaagctgcagaccgactctaactcctgggatgagcatgtgttcgagttagtcctgccaaaggcttgcatggtgggacacgtggacttcaaatttgtattgaactctaacattacgaacattccccagatacaggtgacactacttaagaacaaagcaccgggtctgggcaaggtgaatgctttaaatatagaggtagagcagaatggcaaaccatctctcgtggatctcaatgaggagatgcagcatatggacgtggaagaaagtcagtgtttgaggttatgtccctttctggaggatcataaggaggatatactttgcggccctgtctggctggcgtcaggtctcgatctgagcgggcatgcaggcatgctgactctgacgtcccctaagctggtgaaaggtatggccggtggaaaatataggtctttcctgatacacgtgaaggccgtaaatgagaggggtacagaagagatctgcaatggtggtatgcggccagtcgtcaggctgccatcactgaagcaccagagtaataagggctacagcctcgccagccttctggccaaagtagccgcaggcaaggagaagtcttccaatgtgaagaacgaaaatacctccggaacccgcaagtccgagaacctccggggatgcgatctgcttcaggaggtctcagtgaccatccgccgatttaagaaaacttcaatctctaaagagcgggttcaaagatgcgctatgctgcagttttctgagttccacgagaagcttgtcaatacactgtgtcggaaaacagacgacggccagattacggagcacgctcagtcccttgtgttagacacactgtgctggttagctggcgtgcattcgaacggaccgggtagctcaaaagagggcaacgagaacctgctgtctaagacccgaaagtttttatctgatattgttcgcgtgtgcttttttgaagcaggtcggtcaattgcccataagtgtgcacgcttcttggctctctgtatcagcaacggtaaatgtgatccttgtcagcctgcttttggcccagtgctgttaaaggccctgcttgataacatgtctttcctgcccgcagctactaccggcggatccgtgtattggtacttcgttcttcttaactatgtaaaagacgaggacctcgctggatgctctacagcatgcgcctccctgttaaccgccgtgtctaggcagctacaagaccgcttgactcctatggaggcactgttacagactcggtatgggctctactccagcccattcgatcctgtcctttttgatctggagatgagtggctcttcttgtaaaaacgtgtacaacagttctatcggcgtgcagagtgacgagattgatttgagtgatgtcctctccggtaatggaaaggtatcctcctgtactgctgcagagggctctttcacctcgctgaccggtcttctcgaagtggaaccccttcatttcacatgcgtgagcacctccgatggcacccgcattgagagagacgatgcgatgtcctcttttggggtgacaccagcagttgggggtttatcttctgggacagtcggtgaagcctcaacagctctgagttctgccgcacaggttgcattacaatcactgtctcatgcaatggccagtgccgagcagcagctccaagtgttgcaggagaaacagcagcaactcctgaaattacagcagcagaaggctaagctcgaggccaagcttcaccagacaacagccgctgcagccgcagccgcaagtgccgtaggccctgtgcataatagcgtcccatctaacccagtggcggcacccggtttcttcatccatccttccgacgtgatccctcctacaccaaagaccactcccttgttcatgactccacccctgacaccaccgaatgaggctgtctccgtcgtgatcaacgccgaattagctcagctgtttccgggttctgtcatcgatccaccagccgtgaacttagctgcacataacaagaattctaacaaatcaaggatgaacccattgggatccggcctcgccctcgccatctcccatgccagccactttttgcaaccaccccctcaccagagtatcatcatagagaggatgcattctggcgcaagaagatttgtgactctggacttcggacggccaatcctgttaaccgacgtgttgatcccgacatgtggagatctggctagtctgtcgattgatatctggacactgggagaagaagtggacggtagaaggctcgtggtagcaaccgacatatccacccactccttgatcctccacgaccttattccaccccctgtttgcagatttatgaagatcacagtgataggacggtatggctccaccaatgcccgagctaagatccctctcggattctattatggtcacacctacattctaccatgggagagtgaactgaaattaatgcacgaccccctcaaaggggagggagagagcgccaaccagcccgagatagaccagcatctggcaatgatggtggccctgcaggaggacatccaatgtaggtacaacctggcgtgccatcgccttgaaaccctgctccaaagcatcgatctcccaccccttaactccgcaaacaacgcccagtattttctgcgcaaaccagacaaggccgttgaagaggatagccgggtgttcagcgcataccaggactgtattcagctccagctgcagctgaacctggctcacaacgccgtccagcgtttgaaggtagccctcggggcaagtcgcaagatgctctctgaaacgagcaaccctgaggatctgattcagacctcttctacagaacagctgaggaccataatccggtatttactggacaccctgctgagccttcttcacgcaagcaacggccattccgtccccgcagttctgcagtctacgttccacgcacaagcctgcgaggagctgttcaagcacctgtgtatcagtggtacgcccaaaattcgacttcataccggcctgctgctcgtacagctgtgcggcggagaaagatggtgggggcagtttctgagcaacgtgttgcaggaactctataatagtgagcagctccttatatttccccaagatcgggtattcatgttactgtcctgcatcgggcagaggtccctgagcaattctggtgtgctcgagtcattgttgaatctcctggacaatttgctcagcccgttgcagccacagctccctatgcataggcgcacagagggggtccttgacatccctatgatcagctgggttgtgatgttagtaagcaggttgcttgattacgtcgctactgtggaggatgaagctgcagcagcgaagaaaccgctcaatggcaatcagtggagtttcatcaacaacaaccttcacactcagtctctgaacagatcaagcaagggttcttctagcctggaccggctgtacagccggaaaattcgcaaacagctggtgcaccacaaacaacagttgaatctgcttaaggcaaaacagaaggccttggtggagcaaatggagaaggaaaaaatacaaagcaacaagggcagcagctacaagttacttgttgagcaagccaaactgaagcaagctactagcaaacactttaaggatctgatacgtttacggagaaccgctgagtggagtagatccaaccttgacactgaagtgaccacggccaaagagagccccgagatagagccccttccctttaccctagcacatgaacgctgtatctccgtggtgcagaagcttgtactgttccttctttcaatggattttacatgtcatgcagaccttttgctcttcgtgtgtaaagtactggcccgaattgcaaatgctacccgacccactatacatctttgcgaaatcgtcaacgagccgcaattggagagattgctacttctgctggtcgggacggacttcaaccgcggagatatcagctggggaggagcctgggcacagtatagtctgacatgtatgctgcaagatatcttggccggtgagctgcttgcacctgttgccgctgaggctatggaggaagggaccgtcggcgacgatgttggtgccaccgccggagactctgatgactctcttcagcagagttcagtgcagctgctcgagaccattgacgagccacttacacacgatattactggtgcaccgcctctcagctctttggagaaagataaagagatcgatctggagctcttgcaggatctgatggaggtcgatattgatcccttggacatcgatctggagaaggacccattggctgccaaggtatttaagcccatctcttccacttggtatgattattggggggctgactatgggacgtacaactacaacccctatattggaggactcggaatccccgtcgcgaagcccccagcgaacacagaaaaaaatggaagtcagacagtgtcagtctcggtttcccaagctctcgacgctcggttggaagtggggctggagcagcaggccgaactgatgctgaaaatgatgagtacactggaggcagactcaattttacaggccctgacaaataccagtccgactctctctcagagccccacaggaaccgacgatagcctgctgggcggactccaggcagccaaccagacatcacaactcatcatccaattgagtagtgtgccgatgctgaatgtctgcttcaataaattatttagcatgctgcaagtgcaccacgttcaacttgaaagccttctgcaactgtggctgacattaagcctcaattccagcagcacagggaacaaagagaatggagcagatatattcctgtacaatgccaatcggataccagtgatctccctgaatcaggcctccatcacatcattccttacggtgctggcatggtaccctaatactcttcttaggacctggtgcctcgtactgcattccctgaccctcatgacgaacatgcagctgaactcgggcagttcatccgctattggtacccaggagtcgacggcacacctgttagtctccgatccaaatttaatacacgttctcgttaaattcctcagtggcacaagtccccacggtacaaaccagcatagcccgcaggtcggacccacagccacgcaggccatgcaggaatttctgaccagattgcaggtacatctgagctccacttgcccacaaatatttagcgagtttctgctgaagctgattcatattctcagtactgaaagaggggcattccaaacaggccaaggccctctggatgcccaagtgaagctcctggagtttacccttgagcagaattttgaggtggtgagcgtgagcacgatcagcgcagtgattgagagcgtgacctttctagtgcaccattatataacctgctctgacaaggtgatgagccgttcagggtcagattcgtcggttggggctcgcgcatgcttcggcggtctgttcgcaaacctgataagaccaggcgacgctaaagctgtatgcggcgagatgacccgcgaccagctcatgtttgatctgttaaaactggtgaatatcctggtacagctacccttgtctgggaaccgcgagtatagcgcacgagtgtcggttactaccaacactacggatagtgtgagtgacgaggagaaagtgtccggcggaaaggacggtaatggcagctccacgtcagttcagggcagcccggcatatgtggcagatcttgtcctggccaatcagcagatcatgtcccaaatcctctctgccttgggcctgtgcaatagctccgccatggccatgattattggggcttccggtctgcatctgaccaagcatgagaacttccacggtggcctggatgccattagcgtcggagatggcttgttcaccatactcacaacactgagcaagaaagccagcacagttcacatgatgctccagccgattctgacctatatggcctgtgggtacatgggacgccagggttccctggctacatgtcagctctccgaacctctcctctggtttattcttcgggtgctcgacacatcagacgctctaaaagctttccacgatatgggaggggtgcagctgatttgcaacaacatggtgacttccactagggcaattgtgaacacggcccgaagtatggtgtcaacaatcatgaagtttctggatagcgggcctaataaagcagtggactccaccctgaagacgcggattctggcttcagagccagacaatgcggagggaattcataacttcgcgcctctggggacgatcacatcgagtagcccaaccgcccagccagccgaagtattattgcaagccacccccccacatcggagagctagatctgcagcatggagttacattttcctaccagaggaggcctggtgcgacctgacaattcatctgccagcggctgtccttctcaaagagatccacatccagccacatttggccagcctggctacctgcccatcctcagtatcggtggaggtgagcgccgatggggtgaatatgttaccactttctacacctgtcgttacgtccggcctcacatatataaagattcagctcgtgaaggccgaagttgctagcgctgtttgtttgcggctgcaccggcctagagacgcaagcacactgggtttatcacagatcaaactcctcggcctgacagccttcgggacgacatcatccgcaactgtgaataacccatttctgccttccgaagatcaggtgtccaagactagtatcggctggctccgcttacttcaccattgtctcacccacattagtgatctcgaaggcatgatggctagcgcggctgcccctactgctaatttgctccagacttgtgccgctctcttgatgagtccctactgtggcatgcacagcccaaacatcgaggttgtgttggtcaagatcggtctccagtccacacggatcggactgaagcttatcgacatcttgttgcgaaattgtgctgcaagtgggagtgaccccacagatttgaacagccctctcctttttgggcgtctgaatgggctttcatccgacagtacaatcgacattctgtatcagctggggactacccaggaccccggaaccaaggataggatacaggccttactgaagtgggtcagcgatagtgcgagagttgccgcaatgaagcgctctgggaggatgaactacatgtgccctaactcgtccacggtagagtacgggttgctcatgccatcaccatctcacctgcactgtgttgccgcaatactatggcattcttacgagctgttagtagagtacgatcttcctgcgctactcgaccaggaactgttcgaactgctgttcaactggtccatgagcctgccctgtaatatggtgctcaagaaggcggtggattcactgctctgttctatgtgccacgtccaccccaactatttctctctgttaatgggctggatggggatcacccctcctccagtccagtgtcaccacaggctatcaatgacggacgattccaagaagcaggatttgtcgagctctctcactgatgacagcaagaacgctcaggctccgttagccctgacagagtcacatctcgcaactcttgcgtcttcgagccagagtcccgaggcaataaagcagctcctggactccgggctcccaagcctgctggtcagaagccttgcatcattctgtttctcccacatatctagttccgaatcaatcgctcagtcaattgacatttcccaggataagctgaggaggcaccatgtgcctcaacagtgtaataagatgcccatcacagcagacctcgtggctcccatcctccgcttcctgaccgaggtgggcaactcccatataatgaaagactggctgggcggaagcgaggtgaatccattatggaccgcactcctgttcctcctctgtcacagcggttccactagtggcagccacaatttgggcgctcaacaaactagtgctagatccgccagcctcagcagcgccgctacgaccgggctgaccacccaacagcgaaccgccatcgagaatgccactgtggcatttttcctccagtgcattagttgccaccctaataatcagaaactcatggcacaggttctgtgtgaattgtttcagacttcccctcaaaggggaaaccttcccacatcaggcaacatatctggatttattcgtcgcctgtttctgcagctgatgcttgaagatgagaaagttaccatgtttctccagagtccttgtccgctctataaaggcaggattaacgccaccagccatgtgattcagcaccctatgtatggggctgggcataagtttaggacactccatcttcctgtgtcaaccacattgagcgacgtgctcgacagggtatctgacaccccgagcattactgccaagctcatcagcgaacagaaggacgataaggagaagaagaaccacgaggagaaagagaaagtgaaggctgagaatgggtttcaggataactactctgtggtggtggcctcgggcctgaagtcccaatcaaaacgggctgtatccgctactcccccacggcctccgtcccgacgtgggcgtactatcccggataaaatcggatccacgtccggtgccgaggcggcaaacaaaattataacagtgcccgtgttccacctatttcataagctcttagccggacagcctttacccgcagaaatgaccctggctcagctgctgacattgctctacgatcgtaagctgcctcaggggtacaggtcgatcgacctgacagttaagctcggcagtagggtcattacagacccgagcttgtctaaaaccgactcttacaaaagactgcacccagagaaggaccacggcgatcttctggcatcctgcccggaagatgaggcccttacccccggtgacgagtgcatggacggaatactggatgagtcgctgctggagacttgcccaatccagagtcccctccaggtttttgctggcatgggcggtctggcattaatcgctgagcgcctgcccatgctgtatcctgaagtgattcagcaggtttctgcgcctgtggttacctctacaacacaggaaaaaccaaaagattcagaccagttcgagtgggttacaattgaacagtcaggcgagttagtgtatgaagctcccgagactgtcgccgctgagccgcctcccatcaagtcagcagtgcagactatgtcaccaattccagctcactctctggccgctttcggtctgttcctgcggttacctgggtatgcggaagtactgcttaaagaaaggaagcacgcccaatgcctgcttcgtttggtgttaggtgtgactgacgatggtgaaggttcacacattttgcagagcccctcagccaacgtgctgcctactttaccgtttcatgtactgcgcagtctgttctccacaacgccgctgactacagatgatggcgtgctcctgcgaaggatggctttggaaatcggggcattgcacctgatcctggtctgtctctccgcactgagccaccacagtcctcgagtaccaaattccagtgtgaatcagacagaaccccaagtgtcttcatctcataatccaacgtcgaccgaggaacaacagctgtactgggccaagggtaccggatttggcactggctctaccgcgagtggctgggatgttgagcaggccctcaccaagcagaggctggaggaagagcacgttacctgcttgctccaagtgttggcctcatacattaatcccgtgtcttccgcagtgaacggcgaagcccagtcaagtcatgaaacccgaggccagaacagtaatgcattacccagcgtactcttggaactgctctctcagagttgtttaatcccagccatgtcctcatacctcagaaatgacagcgttcttgacatggccaggcatgtccctctgtatcgagcactgctggaactgttacgtgcgattgcatcatgcgccgctatggttccactgttgcttccactgtccactgagaacggcgaagaggaggaagaacagagtgaatgccaaaccagcgtggggacgctgctggcaaaaatgaagacctgtgtggatacctataccaacagattgaggtccaaaagggaaaacgtgaaaaccggggttaaacctgatgcatccgaccaggagcccgaggggctgacgctactggtgcccgacatacaaaagacagcggagatcgtatacgccgctaccacatctttacggcaagccaaccaggagaaaaagctgggcgaatactccaaaaaagccgcaatgaagcctaaacccttgagtgtgctgaagtcactcgaggaaaaatatgtggctgtaatgaagaagttgcagtttgacacatttgaaatggtgtcggaggacgaggacggaaaactgggctttaaggtcaactaccactatatgagccaggtgaaaaacgcaaatgacgctaatagcgccgctcgagccaggcggctggcccaggaggcagttacactcagtacaagcctccctctctcctcatcgagttcagtgttcgtgagatgcgatgaagagaggttggatattatgaaggttctgatcactggcccagccgacacaccctacgcgaatggctgtttcgagtttgacgtctacttcccccaagactacccctcctcaccgccactggttaaccttgagactaccggcggacattcagtgcgtttcaaccccaacctgtataatgacggcaaagtgtgtctgagtatcctcaacacctggcacgggcgtccagaagaaaaatggaatccacagaccagttctttcttgcaggtactggtcagcgtgcagtcccttattcttgtcgcagagccctatttcaacgaacccggttacgagcggtcccggggaactcctagcggtacccaatcatcacgcgagtatgatggcaacataagacaggcaacggtcaaatgggcaatgcttgagcagatccgcaaccctagcccgtgcttcaaagaggtgattcacaaacacttttacctcaagcgagtggaaattatggctcagtgcgaagaatggatcgccgacatccagcagtatagttctgacaagagagtgggccgaaccatgagtcatcacgcagccgcattgaagcggcacactgcacagctgcgggaggagctattaaaactgccttgtcctgaaggactcgaccccgatacagatgatgcacctgaggtgtgtcgggcaaccaccggtgcggaggagacactgatgcacgaccaagtcaaaccgtctagcagcaaggaactgccttcagattttcagctttag

SEQ ID NO: 27443 - DNA, 1566 bp, Artificial Sequence
  Description of Artificial Sequence: Synthetic coding sequence
atgagcttaagcagatctgaggaaatgcaccgcttgacagaaaatgtgtacaagacgatcatggagcagttcaatccatccctccgcaattttattgcgatgggaaaaaattacgagaaggccctcgcaggcgttacctatgcggcaaaaggttacttcgacgccctcgtcaaaatgggtgaactcgcctcagaaagccaggggtccaaggagctgggtgacgtgttgttccagatggctgaggtgcatagacagatccagaaccagcttgaggaaatgctcaagtctttccataacgaattactgacacaattggaacaaaaagttgagctggactccagatacctcagcgccgcactgaagaagtaccagaccgagcagcgctctaaaggagacgcactggacaaatgtcaggctgaattaaaaaaacttcgcaaaaaatcacagggctccaaaaatcctcagaaatactctgacaaagaactgcagtacatcgacgccatatctaataagcagggagagcttgagaattatgtaagcgacggctataaaaccgccctaacagaagagcgtaggagattttgttttctggtggaaaaacagtgcgctgtggccaagaacagcgctgcctatcattccaagggtaaagagcttctcgcccagaagctgcccctgtggcagcaagcctgtgccgatcccagcaagatccccgaacgggctgtgcagttgatgcagcaggttgcatccaacggagctaccctaccatccgcactgagtgcctctaagtccaacctggtcatctctgatcctatcccgggagcaaaaccactgcccgtccccccagaactcgcaccgtttgtgggacgcatgtcagctcaagagagtacaccgatcatgaatggcgtgaccgggcctgacggggaagattatagcccatgggctgacaggaaagccgctcagcccaagagcctaagcccgcctcagagccaaagtaaattgtccgatagctactctaacacactgccagttcgaaaaagcgttacacccaagaatagttatgctaccactgaaaacaaaacccttcccagaagttccagcatggcggctgggctagagagaaatggcaggatgcgagtgaaagccatcttctcacacgccgcaggcgataacagcacactgctgagctttaaggagggggatctgattactctgctggtccccgaggcaagggatgggtggcactatggcgagtctgaaaagactaaaatgcgcggatggtttccattttcatatacgagggtgctcgattcagatggcagcgacagattacatatgtcactccagcagggaaaatcctccagcacaggtaatctgttggataaagacgacctggcaataccacctccggattacggagccgcatcaagggcctttcctgcccagactgctagtggcttcaaacaacgcccatacagcgtagcggtccccgctttctctcaaggcctggacgactacggggctcgctcaatgtcatcaggaagcgggactctggtatccactgtctag

SEQ ID NO: 27444 - DNA, 1659 bp, Artificial Sequence
  Description of Artificial Sequence: Synthetic coding sequence
atgagcttgagtcggagcgaagagatgcatcgtctcactgaaaacgtgtacaagaccatcatggagcagtttaacccatctctgagaaactttattgctatgggtaagaactacgagaaagcgttggccggagtgacctacgccgcaaaaggctacttcgatgccctggtaaaaatgggagaactggcctcagaatctcagggtagcaaagaattgggggatgtgctgttccagatggcggaggtacaccggcaaatccagaatcagttggaggagatgctgaagagctttcacaatgagctgctgacccagctcgaacaaaaggtggagctggattcgcggtacctttcggctgctctgaaaaagtatcagaccgaacagcgttctaaaggggatgcgttggacaagtgccaggctgagctgaaaaagttaagaaagaagtctcaaggctccaagaacccccagaaatattcagataaggaactccagtatatagacgcgatctccaacaagcaaggcgaactcgagaattacgtttccgatggttacaaaaccgcgctgaccgaggaacgcagaaggttttgctttcttgttgagaagcagtgtgctgtggctaagaactcagctgcctaccattcaaaaggcaaagagctcctcgcacaaaagctgcctctgtggcaacaggcttgtgccgacccgtccaagatccccgagcgcgcagtccaactgatgcagcaggtggctagcaatggcgctacactcccctcagctctcagtgcctcaaagtccaacctcgtgatctcagaccctatacccggagcaaaaccactccctgttccacctgagctcgcccctttcgttggcagaatgtccgcacaggaaagcaccccaattatgaatggagtgaccggacccgacggggaggattatagcccttgggccgaccgcaaagccgctcagcctaagagcttgtctcctcctcaaagtcagagtaagctgtcagactcttatagtaacacactaccagtgcggaagtctgttaccccaaaaaactcctacgctacaacggaaaacaagactttgccccgttcgtcttctatggctgcaggactagaacgaaacggtcgaatgcgagtcaaagctatcttttcgcatgccgctggtgacaactcaaccttgttaagctttaaagagggcgaccttattacactcctggtccccgaggccagagacgggtggcactacggcgagagcgagaagacaaaaatgcggggatggtttcccttttcatacacgagagtgcttgattcagatggcagtgataggcttcacatgagcctccagcaaggtaagtcaagctccacgggcaatctgcttgataaagacgacctcgccatccctcccccagattacggcgcagccagccgtgcgtttccagctcagaccgcttccggattcaagcagaggccatacagtgttgccgtccccgcattcagccaaggcctggacgactacggtgcacggtccatgagtcggaacccattcgcccatgtgcagttaaagcccacggtgactaatgacagatgcgatctttcagcccaaggtcctgagggcagagaacatggggatggtagcgctagaaccctggccggaagatag

SEQ ID NO: 27445 - DNA, 1371 bp, Artificial Sequence
  Description of Artificial Sequence: Synthetic coding sequence
atggccgaagtgcaccggcaaatccaaaatcagctggaggaaatgctgaagagctttcataatgaactcctgactcaattggaacaaaaggtggaattggattcacgttacctgtccgccgcactgaagaagtaccagacagagcagagaagtaagggagatgctctcgataaatgccaggccgaactgaaaaagctccgaaagaagtcacagggatcaaagaacccgcaaaagtactcagataaagagctccaatacattgatgccatatcaaacaagcagggagaactggaaaactacgtgagtgatggctataagaccgccctgacagaagaaaggcgccgtttctgctttttggtggaaaagcagtgtgcagtggcaaaaaatagtgccgcataccactcgaaaggcaaggagctgctggcccagaaactgcccctgtggcagcaggcttgcgctgatcctagcaaaattcccgagcgcgcagtgcagctcatgcaacaggtggcctccaatggggcaacactgccaagtgccctgtctgctagcaagagcaatctagtgatcagcgatcctatacccggagcaaagccattacctgtcccacctgagctggcgccatttgttggcaggatgtccgcccaagagagtacccccatcatgaatggcgtgaccggcccagacggcgaggattacagtccttgggcagacaggaaggcggcacaaccaaaaagtctgtccccccctcagagtcagtctaaactcagcgacagctatagcaacacactccccgtccgaaaaagcgtgaccccaaagaactcatacgctacaactgagaacaaaaccttaccgagatcgtctagtatggctgccggtttagagcgcaacgggcgaatgagggtcaaagccattttcagccacgccgcaggtgataacagtaccctgttgtccttcaaagagggtgaccttattaccctgctggttcctgaggcacgagacggttggcactacggcgagtctgaaaaaaccaaaatgcgcggatggtttcctttcagctatacccgcgttctcgactcagatgggtcagatcgcctccatatgtctcttcagcaggggaaaagttcatctaccgggaacctgctcgacaaagacgatctagccatccctccccctgattacggggctgcatcccgggcattccctgcccagacagcctcaggcttcaaacagcgcccatactctgttgctgtacccgctttttctcagggtctcgacgactacggagcgcgatctatgtcgagaaatccctttgctcatgtacagctgaagccaaccgtcacaaatgacaggtcagccccattgctgtcctag

SEQ ID NO: 27446 - DNA, 1128 bp, Artificial Sequence
  Description of Artificial Sequence: Synthetic coding sequence
atgttacttcctgagggacagcggcagagggccctgggttttgggaccgtgacatcgacttattctcccgtggggcagtatattgacgccatctcgaacaagcagggcgagctggaaaactacgtgagtgacgggtacaagactgcccttaccgaggagcgtaggcggttttgcttcctggtggagaagcagtgcgcagtcgcaaagaattccgccgcttatcactcaaagggaaaagaattactcgcccagaaattgccactctggcagcaggcctgcgcagaccccagtaagattcctgagcgtgcagtgcagttgatgcaacaggtggcctccaatggcgctaccctaccttccgcgctcagtgccagcaaatccaaccttgtcatcagtgatccaattccaggcgctaagccgctgcccgttccacccgaacttgcacctttcgtgggaagaatgagtgcacaggaaagcacacctatcatgaatggagtcacaggccctgacggcgaggattactcaccgtgggcggatagaaaggcagcccagcctaagtcgctgtcaccgcctcaaagtcagtccaagctgtcagacagctattccaacactctgcctgtccgcaagtcagtgacgcccaagaactcttatgccactaccgaaaataaaacgctcccaaggtcttcctctatggcagctggtcttgagaggaacggacgcatgcgggtcaaagcaattttttctcatgctgctggcgataatagcaccctgttaagttttaaggaaggggacttgatcacccttcttgtccccgaggccagggacgggtggcactacggggagagcgaaaaaacaaagatgagaggctggtttcccttcagctacactagagtgcttgacagcgatggaagcgatcgcttgcatatgagcctgcagcaaggtaaatccagttcaactggcaacctcctcgacaaagacgacttggccatccctcctcccgactacggggcagcttcgcgcgcatttcctgcccagaccgcctccggctttaagcaacgaccatactccgtggccgttcctgcattttcccagggcctggacgactacggcgctcgatcaatgagtcggtag

SEQ ID NO: 27447 - DNA, 1605 bp, Artificial Sequence
  Description of Artificial Sequence: Synthetic coding sequence
atgtccctctccaggagcgaagaaatgcacagactgacagagaatgtatataaaaccataatggaacagtttaatccttcactgagaaattttatcgccatgggaaaaaactatgaaaaggcactggctggagttacatacgccgctaagggatatttcgatgcgctcgtcaagatgggagagctggcctccgagagtcaggggagcaaggaactcggtgatgtgctgtttcagatggctgaggtgcacagacagattcagaaccagctggaagagatgcttaaatccttccacaatgagcttctgactcagctcgagcagaaggtagagcttgattctaggtatctgtccgcagcgcttaagaaatatcagacagaacagagatccaaaggtgacgcactcgataagtgtcaagctgagcttaaaaaactacgcaagaagagtcaaggcagtaaaaacccacagaagtattctgataaagagctgcagtatatcgacgccatcagcaacaagcagggagagctggaaaattatgtatcagatggttacaagaccgccctgacagaggaaagaagacgattctgttttctcgtcgaaaagcagtgcgccgtcgccaagaattcagccgcataccactctaagggtaaggagctgctggcccagaagctcccactgtggcagcaggcttgtgccgaccctagcaagatacccgagcgggctgttcaactgatgcagcaagtggcaagcaatggggctacattaccaagcgcgctctccgcctctaagagcaacctcgttatttcagaccccatccccggagctaagccactcccagtgccgcctgagctcgcccctttcgtcggtcgcatgtctgctcaggagagtacacctatcatgaatggtgttaccggcccagacggcgaggactactctccgtgggccgatcgcaaggccgctcagccaaagtcactgagcccaccccagtcccagtccaaactgtcagattcctattccaatacactgcctgtgcgaaaatcagtgacccctaagaacagctatgctactacagagaacaagacactgcctaggtcatctagcatggctgccggtttggaacggaacggtcgcatgcgcgtcaaagccatcttctctcacgcggctggtgataacagcacactccttagtttcaaggagggagatcttatcacgttgcttgttccagaagcacgagacggatggcattacggggagtctgaaaagaccaaaatgagagggtggtttccattctcatatacacgtgtcttggacagcgacggcagtgaccggctacatatgtccttacaacagggaaaatccagttccaccggcaatcttctggacaaggatgatcttgcaatccctccgcctgattatggcgcagcttcgcgggctttcccagctcagactgcatccggatttaagcagcgtccctattcagtggctgtcccggcattttcccagggtctggacgattacggcgcaaggtctatgtcccgtaatccctttgcccacgtgcaacttaaaccgactgtcacaaatgataggtctgctcccctcctctcttag

SEQ ID NO: 27448 - DNA, 1563 bp, Artificial Sequence
  Description of Artificial Sequence: Synthetic coding sequence
atgagtttgagtcggtctgaggagatgcatcgcttaacagaaaacgtgtataaaactatcatggaacagtttaatccctcattgcggaactttattgccatgggcaagaactacgaaaaggcgttggcaggagtgacttatgccgctaagggctattttgacgcccttgtgaaaatgggagagttagcaagtgaaagccaggggagcaaggagcttggcgatgtgctgttccagatggcagaagtccatcgtcagatccagaatcagctggaggagatgctgaaatcattccataacgagctgctgacacaattggagcagaaagtggaattggacagccggtatctgtcggccgctctcaaaaagtatcagactgaacagagatcgaaaggggatgcacttgataagtgtcaggctgaactcaaaaagctccgcaaaaagtctcagggttctaaaaacccacagaagtatagcgacaaggaactgcaatacattgacgctatcagcaataagcaaggcgagctcgagaattacgtgagcgatgggtacaaaacagctttgaccgaggaaaggaggaggttttgctttctggtcgaaaagcaatgtgctgtggccaagaacagcgccgcatatcattctaaaggaaaggaactcttggcccaaaagttgccactgtggcaacaggcttgtgctgatccttccaagatccccgagcgcgctgtacagctgatgcaacaggttgctagtaatggggcaacgctccctagtgcactgagcgcctcaaagtcaaacctcgtcatttcagatcctatccccggagcaaaaccactcccagtgccacctgagctcgcaccattcgtgggtcgtatgagcgcacaggagtcaactcctattatgaatggcgtaacgggtcctgatggcgaggattacagcccttgggctgacagaaaggctgcacagccaaagtctctttctccaccgcagtcacagagcaagctgagtgatagctactccaacactttgcctgtgcgaaagagcgtgaccccaaagaactcctatgctaccactgaaaacaaaactctgcctcgtagctcctctatggccgctggcctggagcgtaacggacggatgcgggtgaaggccattttttcccacgctgccggagataactccacgctgctgtctttcaaggaaggcgacctgatcacgctactggttccggaggccagggacggctggcattatggagagtccgaaaagactaagatgaggggctggtttcccttcagttacacccgggtgctcgattcagacggcagcgatcggctccatatgtccctccagcaagggaaatctagcagcacaggcaacctgcttgataaagacgacttagcaatacccccaccggactatggcgctgcctcaagggcctttcctgctcagacggcttctggattcaagcaaagaccctatagtgttgccgtgccagccttttcacaaggcttggatgattatggagccagaagcatgtcttctgcagacgtggaggttgcaagattttag

SEQ ID NO: 27449 - DNA, 720 bp, Artificial Sequence
  Description of Artificial Sequence: Synthetic coding sequence
atggcccacgcaggacggactggctacgataaccgtgagattgtgatgaaatatatccactacaagctgagccagagaggatatgagtgggatgccggtgacgtgggagccgcacctccaggggctgcacctgcccctggcatcttctcttctcagccaggacataccccccaccccgcagcgtcacgtgaccccgtcgctcgtacatcgccactgcagacgccagctgctccaggcgcagccgcaggacccgctctgagcccggttccgcctgtggtgcatctgacgctgaggcaggccggagacgacttctcaaggagatataggagggactttgctgagatgagctcccagttgcacctcactccattcaccgctcggggtagatttgccacagtagtggaggagttgtttcgcgatggtgtgaactggggcagaattgtggcgtttttcgaatttgggggagtgatgtgcgtggagagcgtaaatcgcgagatgtccccactcgtcgacaatatcgctctgtggatgaccgagtacctgaacagacacctccacacgtggattcaagacaatggcggttgggacgcattcgtggagctatatggtcccagtatgaggccactattcgatttttcatggctgagcctgaagaccttattatccctggccctggtgggcgcatgcatcacccttggagcttaccttggccataagtag

SEQ ID NO: 27450 - DNA, 720 bp, Artificial Sequence
  Description of Artificial Sequence: Synthetic coding sequence
atggcccacgccggacggacaggatatgataatcgagagattgtgatgaaatatatccactataagctttcccagaggggatacgaatgggatgccggagatgtgggtgccgctcccccaggagcagcgccagctccgggtatctttagttctcagcccggacataccccacatccggcagcaagtcgcgacccggtcgcccgaactagcccacttcagacacccgcagcgccaggagccgctgctggacctgcgctctccccggtcccacccgtcgtgcatttaacactaaggcaagctggcgacgatttctcgcgacgctaccgaagagatttcgccgaaatgtcctctcaactccacctcacaccctttacagctagaggcagatttgctaccgtggtcgaagaactgttccgggacggagtgaattggggacggatcgtcgcctttttcgaatttggcggtgtaatgtgcgtggagtcggtgaaccgcgagatgtcgccactggtggacaacatcgcactctggatgaccgagtacctcaacaggcacctccacacctggattcaggataacgggggttgggatgctttcgtggagctgtacggtccttctatgagaccgctctttgatttttcatggcttagtttgaagacacttctgtccttggctctcgttggagcctgtataaccctcggcgcttatttaggccacaagtag

SEQ ID NO: 27451 - DNA, 618 bp, Artificial Sequence
  Description of Artificial Sequence: Synthetic coding sequence
atggcacacgccggacggactggctatgataatcgagagattgtcatgaagtatatccactacaagctgagtcagaggggatacgaatgggatgctggtgacgtcggggctgctccccctggcgctgccccagccccaggtatcttctctagccaacctgggcatacgcctcacccagcagcttctcgcgaccctgtggccaggaccagccctctgcaaacccctgccgcaccaggagctgccgcaggccctgctttatctcctgtgccacccgtcgtgcatcttacactgcgccaggccggagatgacttctctcggaggtatcggcgagactttgcagaaatgtctagtcaattgcacctgacaccattcacggctagaggcagatttgcaacagtcgtagaagagctgtttcgggatggcgtgaactggggcaggattgtcgccttcttcgaatttgggggagtgatgtgtgtggagagcgtgaacagagaaatgagcccgctcgtcgacaatattgctctttggatgacagaatatctgaaccgacacctgcacacatggatccaggacaacggcggatgggtgggagccctgggcgatgtctccctgggctag

SEQ ID NO: 27452 - DNA, 1578 bp, Artificial Sequence
  Description of Artificial Sequence: Synthetic coding sequence
atgaaggcccttattgctgccctgctgcttataactttgcaatacagctgcgctgtttcacctaccgactgcagcgctgtggaacccgaagccgaaaaagcattggatctcatcaacaagcggagacgtgacggctatctttttcagcttcttcggatagctgacgcacacttagaccgggtggagaataccacagtctactatttggtgctggatgtgcaggagtcagactgctccgtgttaagccgcaaatattggaatgactgtgagccccctgatagcagaaggccgagtgaaatcgtgattggtcagtgcaaggttatcgccacacgacattcacatgagtcacaggacctgcgcgtcatcgacttcaactgtacaacgagctccgtatcctcagcgctggcaaatacaaaggactcgccagtgctgattgacttctttgaggacaccgagaggtaccggaagcaggctaacaaagccctcgagaagtacaaagaagagaatgacgatttcgcaagctttcgggtcgacaggattgagagagtggcccgtgtaaggggcggagaaggcacaggctactttgtcgatttttccgtccggaactgtcctaggcatcacttcccgagacatccaaatgtcttcgggttctgtcgggctgatctgttctatgacgtggaggcacttgacctagagtcgccaaaaaatctggtgattaattgcgaagtcttcgatcctcaggaacatgagaacattaacggcgtgccaccccacctgggacatccttttcattggggagggcatgagcgtagctccactaccaagccaccatttaaaccccatggcagcagggatcaccaccatccccataagccccacgaacatgggccacctccaccgccagatgagcgggatcactcccacggaccccctctgcctcaaggccctccccctctgctgcccatgtcttgctcatcatgccagcatgccactttcggtaccaatggtgcccagaggcacagtcacaacaataatagctccgacttacatccccataaacatcacagtcacgagcagcatccccatggtcaccaccctcacgcccaccacccacatgaacatgacacgcatagacagcatcctcatggacatcacccacacggtcaccacccccacgggcaccaccctcacggtcatcatccgcacggacaccacccccattgccatgacttccaggactacggcccatgtgaccctccccctcacaaccagggacactgttgccatggacatgggcctcctccaggccatcttcgaaggcgaggccctggcaaagggcctcgccctttccattgtcggcagatcggatccgtctatcgcctgcctccattgcggaagggtgaggttctgcccttgccagaagcaaattttccctcattccccttaccgcaccacaagcatccattaaagccagacaatcagccctttccgcaatccgtgtcagagagttgtcccggtaaatttaaaagtgggtttccacaggtgagcatgttcttcacgcatacgttcccaaagtag

SEQ ID NO: 27453 - DNA, 2121 bp, Artificial Sequence
  Description of Artificial Sequence: Synthetic coding sequence
atggcctctccagcagattcttgcattcagttcacgcggcatgccagcgacgtactgttgaatctcaatcggctccgctccagagacatactaactgacgttgtcattgtagtgtctcgggagcaattcagagcacataaaaccgtcctaatggcctgctcgggtctgttctactcaatttttaccgaccagttaaaatgtaacctgagcgtgattaacctggacccggaaatcaacccagagggtttctgcatcctgcttgatttcatgtacacttcccgacttaatcttcgggagggaaatattatggcggttatggccaccgcgatgtacctgcaaatggaacatgtggtggatacatgtcggaaattcataaaggcaagtgaggccgagatggtgtccgctatcaaacctcccagggaagaatttctaaactctcggatgctgatgcctcaggacattatggcatatcggggtagagaggtggtcgagaataacctgcccctccgctccgccccaggatgcgagagcagagcctttgctcccagtctgtactcgggcctgtccactccccctgcttcttattcaatgtactcccatcttcccgtaagttctctactctttagcgacgaagagttccgcgacgttagaatgcctgtggcaaaccctttcccaaaagaacgagccctgccctgcgactcggctagaccagtgccaggtgagtactcccggcctaccctggaagttagtcccaacgtttgccactctaatatctacagccctaaagaaaccattccagaggaagctcggagcgacatgcactattcagttgctgagggcctcaagcccgcagcgccttcagcgcgtaatgctccttactttccctgcgacaaagcttccaaggaggaggagcgaccctctagtgaagacgaaattgcccttcactttgaacctcccaacgcgcctctgaacaggaaaggattggtatctcctcaatctccccagaaatccgattgccagccaaattcgcccactgaaagttgttcttcaaaaaatgcttgcatactccaggcctcagggtcaccccctgctaagagccccacagatcctaaggcatgtaactggaaaaaatataaattcatcgtactcaactcactgaatcaaaacgcaaaacctgaaggacccgaacaagccgagctgggtcgcctctctcctagagcatacacagcccctcccgcatgtcaacccccaatggaacccgagaacctagacctacagtcccccaccaaactgagtgcctccggggaggactctaccattcctcaggctagtcgtcttaataacattgtaaatcgctcaatgactgggagtcccagaagttcctctgagagtcactcacccctgtacatgcatccacccaaatgcacatcttgtggctcacagtctcctcagcacgccgagatgtgtttacataccgctggaccaaccttccccgaagagatgggagagactcagagcgaatatagtgacagttcctgcgagaacggagctttcttctgcaatgagtgcgattgccggttctctgaggaggcttctttaaagcgacacacattgcagactcactccgataaaccttacaagtgtgaccgctgccaggcatcattccgttataagggaaatcttgcatctcataaaaccgtccatacgggtgaaaagccataccggtgtaacatatgcggggctcagttcaaccgccctgctaatctgaaaacacacacacggatccactcaggggaaaaaccctataagtgcgaaacgtgtggcgcaagattcgtacaagtggctcatctgcgcgctcatgtgcttatccacaccggggaaaagccatatccctgcgagatttgcggcacccggttcagacatcttcaaaccctcaaatcccacttgcggattcacactggggagaagccttaccactgtgagaaatgcaatttgcattttcggcacaaatctcagctccggctacaccttcgacagaagcatggggcaatcactaatacaaaggttcagtacagggttagcgcgactgatctgccccctgagctgcccaaagcctgttag

SEQ ID NO: 27454 - DNA, 369 bp, Artificial Sequence
  Description of Artificial Sequence: Synthetic coding sequence
atggctagtcctgcggacagttgcatccagtttacacggcatgctagtgacgtgctcctgaaccttaatcgcctgagatcaagagatattcttactgatgttgtgattgtggttagcagggagcagttcagggcccataagaccgtgcttatggcttgttctgggctgttttatagcatcttcactgaccagttgaagtgcaatctgtctgtgatcaatttggatcccgaaatcaatccagaaggcttctgcatcttgctggactttatgtatacaagccggcttaacctgagagaaggcaacatcatggcggtaatggctacagcaatgtacctgcagatggaacatgtggtcgacacctgccggtag

SEQ ID NO: 27455 - DNA, 315 bp, Artificial Sequence
  Description of Artificial Sequence: Synthetic coding sequence
atggccagccctgcagactcttgtatccagtttaccagacacgcgtccgatgttctccttaatctcaaccgcttacgcagccgcgatatattgacagatgtggtgatcgtggtctctcgagagcagttccgggcacacaagacagtgctgatggcatgtagtggactcttctacagtatattcaccgaccagctcaaatgcaatttatccgtcatcaacctcgaccccgagatcaacccggagggattttgcattttgctggactttatgtacaccagtcgactgaatctgcgcgaggggaatataatggcgtag

SEQ ID NO: 27456 - DNA, 1953 bp, Artificial Sequence
  Description of Artificial Sequence: Synthetic coding sequence
atggctagccctgccgattcctgcatccaattcacgcgtcacgcgagtgatgtcctacttaaccttaaccgcctgcgtagcagagacatcctgactgatgtcgttatcgtggtgtcccgcgaacagttccgggctcataagacggtcctcatggcctgttctgggctcttttactcgatattcacggatcagctgaaatgtaacctatctgtaataaacctcgatccagaaataaatcccgagggcttttgcatccttttggacttcatgtataccagcaggctgaatctaagagaaggtaatattatggcagtaatggctactgctatgtaccttcagatggagcatgtagtggacacgtgcagaaaattcataaaagcaagtgaagctgagatggtgagcgccataaagcctcctcgcgaggagtttctgaatagcagaatgctgatgcctcaggatatcatggcttatcgagggagagaagtggtggagaacaacctcccgctgcggtcggcccctggatgcgaatctagggcctttgcccctagtctctacagcggcttgtcaactccgcctgcatcttactccatgtactctcatttgcccgtcagctctctcctgttcagtgatgaggagtttagagatgtccgcatgcccgtggctaatccctttcccaaggaaagggccctgccatgcgattccgccaggcctgtgcccggagagtatagccgtccaactttagaagtaagcccaaatgtgtgccacagcaatatctactctcctaaggagactatccctgaggaggcccgatccgacatgcattatagcgtggcggaaggcctgaaaccggctgccccttcagccaggaatgctccctacttcccttgtgacaaagcttctaaggaggaggagcgcccatcgagcgaggacgaaatagcgctccactttgaaccgcctaatgcccctctcaatcgtaagggcctagtgtcacctcagtcaccgcagaaatcggactgccagccaaactcccctaccgagtcttgctcttctaagaatgcatgtattcttcaagctagtggatctccccctgctaagagtcctacggaccctaaggcctgtaactggaagaaatacaaatttatcgtgctcaattcccttaatcagaacgctaaacccgaaggacccgagcaagccgagctaggacgcctgagtcctcgggcatacaccgctcccccagcgtgccagccccctatggagcctgagaatctggacctgcagtctccaaccaagctttccgctagcggcgaagactccacgatcccccaggcctctcggttgaacaatatcgtgaataggtctatgactgggtcgccccgatctagtagcgagtctcacagccctctgtacatgcaccctcccaaatgtacctcatgtggcagccaaagtccccagcacgcagagatgtgtctgcatacagccggtccaacctttccagaggaaatgggcgagacacagtccgagtattccgatagttcttgcggtgaaaagccctatagatgcaacatttgtggcgctcagtttaatcgcccagccaacctcaaaacacatactaggatccattcaggtgagaagccatacaaatgtgaaacctgtggagccagattcgtgcaggtggcacatttgagggcacatgtgttgatacatacaggggagaaaccgtatccatgcgaaatctgcgggaccagattccggcatctccagacactcaagtcccacctgcgaatacacaccggtgaaaaaccataccattgtgaaaagtgtaacctccactttcgccataagtcgcagctgcgactgcacttgcgtcagaagcacggagccataacgaacactaaggtccagtaccgggtttccgctaccgatctgccccctgagctgcccaaggcatgttag

SEQ ID NO: 27457 - DNA, 306 bp, Artificial Sequence
  Description of Artificial Sequence: Synthetic coding sequence
atgaagtttgggatgggctccgctcaggcgtgcccttgccaggttcctagggccgcttccaccacatgggtgccgtgccaaatttgcgagacaaggggcgctgcagctgccccacctttgacccttgaaggtcctgtgcagtcgcatcatgggacccctgccctgacacagggaccacaatcccctcgggatggggcacagctgggggcttgcacccgccctgtcgatgtcagggacagcggcggaagaccactacctcctcccgacaccctcgcgagcgctggagacttcctctgtaccatgtag

SEQ ID NO: 27458 - DNA, 396 bp, Artificial Sequence
  Description of Artificial Sequence: Synthetic coding sequence
atgaaattcggcatggggtcggcgcaggcttgtccctgccaggtaccccgagccgcatctactacatgggtcccatgccagatctgtgggcctcaaccaagcctttcccttgctgagcagcatctagagtcccctgtcccatctgctccaggggctttggcgggtggacccacccaagccgctcctggggtccgaggcgaagaggagcaatgggccagggagatcggagctcagctcagacgaatggcagatgaccttaatgctcagtatgaacgcagaaggcaggaagagcagcagaggcacaggccatctccctggagagtgctgtacaacctcatcatgggactgcttcctcttccaaggggccaccgggctcccgaaatggagccgaattag

SEQ ID NO: 27459 - DNA, 582 bp, Artificial Sequence
  Description of Artificial Sequence: Synthetic coding sequence
atggcaagggcacgacaagagggctcctcccccgaaccagtcgagggcttggcgcgagacgggcctcgtccttttcccctaggaaggctagtcccttccgccgtctcgtgtggtctatgtgaaccgggactggccgcagcccctgcagctcctaccctgctacccgcagcctatctgtgtgccccaacagcgccacctgctgtgacggccgctcttggcggatccaggtggcccggtggcccaagatcgcgccctagagggccaagaccggacggccctcagccttcactgagcttagccgagcagcacctagagagtccagtgccttctgcacccggagccctcgctgggggacccacacaggctgcaccaggggtgcgaggcgaggaagagcagtgggcacgggagatcggtgctcaacttcggcgaatggccgacgacttgaatgcccagtatgagcgacggcgtcaggaagagcagcagcggcatagaccaagcccctggagagttctgtataatctaattatgggcttactgcctctcccccgtggccacagggctccggaaatggaaccgaattag

SEQ ID NO: 27460 - DNA, 786 bp, Artificial Sequence
  Description of Artificial Sequence: Synthetic coding sequence
atgaaattcggaatgggctcagcccaggcctgtccgtgtcaggtgcctcgtgccgctagtaccacctgggtgccgtgtcaaatttgcggcccaagggagcggcacggccctcgtactcctggcggtcagttacccggtgcacgcagagggcctggacctagacgccctgccccactgcctgccagacctccaggggctctggggtccgtgctgcgacccctacgagcgaggcccggatgtcgccctagacggcctcatcccgcagctagatgcctgcccctgagacctcatcgcccaacaaggcggcatagacgccctggaggatttcccctggcttggggaagtccgcagcccgcaccacggccagctcctggcaggagttccgcgctcgcactggcgggtggggcagcccctggagttgcccgtgcacagcggcctgggggtagtggaggtcgatctcacccaggcggtccaggctccccaaggggaggtggcaccgtggggccaggggatcgcggacccgctgccgcagacgggggacggcctcagcggaccgtgagggccgcagaaacgcgcggagccgcagccgctccccctctgacactggaaggccctgtgcagtcacaccatgggacccccgctctgacacaaggaccgcagagtccacgtgacggcgcacaattaggggcatgcacaagacccgtggatgtccgcgactccgggggtcgccctctgccgcctcctgacactctcgctagcgccggtgactttctgtgcacaatgtag

SEQ ID NO: 27461 - DNA, 1308 bp, Artificial Sequence
  Description of Artificial Sequence: Synthetic coding sequence
atgctctgcggcttccaggaggatgccacgcctcctcctcctccgaggcctcgacgattacaccggagattgccgagacccgaagaggtcggtatgctgagtctgcctcccggattgctcactgtgtccggctcggcagccgcagccgatgcagtgccactgagacctggcgactgggcaggcgtgtctactgcagacaggggagaacgggctccactcgggcctgccttctgtgacctcgcggtctcacctaccagtcccgcttggcgcggagaagaggacgaaggcgctaaagcatcttctggggacattgggagcctcgattatcaggagttcgtcgtggacattgagtctcggctgcgtatggaaggagtggagcttaaagaggaatggcaggacgaagattttccaatccctctccccgaggatgacagcattgaggccgacattctcgcaataaccgggccagaagatcaacctgggtccctggaagtgaacggcaataaagtgcgcaagaaactcatggctccggacatcagcctgacattggacccttctgacgggagtgtgctgtctgatgatctggatgagtccggagaaatcgatctagacgggctcgatactccttcagaaaattctaatgagttcgagtgggaagacgacctgccgaaaccaaagaccacagaggtcatcaggaaagggtccattactgagtacactgctgctgaagagaaggaggacggaaggagatggcgtatgtttcgtatcggtgagcaagaccatagggtagacatgaaagcaattgagccatataagaaggttatttctcatggcggatactatggggatggactgaacgccatcgtggtttttgccgtgtgtttcatgccagagagttcgcagcccaactacaggtacctgatggacaacctattcaagtatgtgatcggcactctcgaattactggtcgcagagaactatatgattgtgtatttaaacggagccaccacgcggagaaaaatgccctcactgggctggctgcgcaagtgctaccagcaaatcgatcgacgtctgcggaaaaatttgaagtctctgattattgtgcatccatcgtggtttatcaggaccctcctggcggtcactaggcccttcatcagctctaagttctctcagaaaattcgctacgtgttcaacctcgcggaacttgcagagctcgtccccatggagtacgtgggaattccagaatgcattaagcaggtcgaccaggaactgaacggcaagcaggacgagcccaagaacgagcagtag

SEQ ID NO: 27462 - DNA, 1131 bp, Artificial Sequence
  Description of Artificial Sequence: Synthetic coding sequence
atggagccctgccccagcagtgctcccccacctttttaccctggagtgggcgaagtagcaggccttcgttggttctccatctacgaccagcgcccaagttggtatcggacgaagaaactcggcctccttgacatcggcagcctggattaccaggagttcgtagttgacatagaaagtcggctccgcatggagggagtggagctcaaagaagaatggcaggatgaagacttcccaatccctctgcccgaagatgatagcattgaagcagatatcctggccatcactggccctgaggaccagccaggctcattggaggtaaacggcaataaagtgagaaagaaactgatggctcctgacatcagcctcacacttgacccatctgacggctctgttctctccgatgacctcgacgagtcaggtgagatcgacctggacggtttagacactccctctgaaaattcaaatgaattcgaatgggaagacgatctgcctaaaccgaagacgacggaggtgattcggaaaggcagcatcactgaatatacggctgcggaagagaaggaggatgggagaaggtggcggatgttcaggataggtgagcaagaccatagagtggacatgaaggcaatcgagccttacaagaaggttatatcccatggaggatactatggcgatggacttaacgccatcgttgttttcgcagtgtgttttatgcctgagtcaagccaacccaactaccggtatcttatggacaacctgtttaaatacgtgatcggaaccctggaattgctggtggcagagaactatatgatcgtctatctaaacggtgctactactcggagaaaaatgccttcactggggtggcttcgaaaatgctatcagcaaattgaccggaggctgcggaagaacctaaaaagtttgataatcgttcatccttcatggttcattcgtactctgctggccgtgacccgcccttttatttcaagtaagttttctcagaagatacgatacgtttttaacctggccgaactggccgagctggttcctatggaatatgtgggcattcctgagtgcataaaacaagtcgatcaagagctaaacggcaagcaggacgaacccaagaatgagcagtag

SEQ ID NO: 27463 - DNA, 939 bp, Artificial Sequence
  Description of Artificial Sequence: Synthetic coding sequence
atggccaaagtcttctcattcatccttgtaaccaccgcattaaccatgggacgagaaatatccgctttggaggactgtgctcaggaacagatgcgcttaagagcgcaggtcaggctgctcgaaacacgggtgaagcagcagcaagtgaaaatcaagcagctgttgcaggagaacgaagtccagttcctcgacaagggagacgagaacactgttattgacttgggcagcaagcgccagtatgctgattgcagcgaaattttcaacgatggctacaagttgtccgggttctataagataaaacctcttcagtcgcccgcagaattctctgtgtactgtgatatgagtgatggagggggttggaccgtcattcagcggaggtcggatgggtcagaaaacttcaataggggctggaaagactacgagaatggcttcggcaactttgtgcaaaagcatggggagtattggctggggaacaagaatttacactttcttactactcaggaggattacacacttaagatcgacttagccgacttcgagaagaacagcaggtacgcccaatacaagaacttcaaagtgggcgacgagaagaatttctatgaactaaacatcggcgaatacagtggtactgcgggagatagcttggctggaaacttccatcccgaagtgcagtggtgggcctcccaccagcgaatgaaattcagtacttgggacagggatcacgataactacgagggcaactgcgccgaggaagaccaatccggttggtggttcaaccgttgtcacagtgccaatttgaacggcgtttactacagcggcccatacacagcgaagacggataacggaatcgtttggtacacttggcatggctggtggtatagcctcaagtcagtggtgatgaagatcaggcccaacgattttatcccaaacgtaatatag

SEQ ID NO: 27464 - DNA, 660 bp, Artificial Sequence
  Description of Artificial Sequence: Synthetic coding sequence
atgagctctcaccttgtggagccacctccacctcttcataacaataataataattgtgaagagaatgagcagtcactgccccctccagccggactcaatagcagctgggttgagctccccatgaattcgtccaacggaaacgataatggcaacggtaagaacggcggtctggaacacgtccctagcagctcgagcatacacaatggggacatggagaaaatcctccttgatgcacagcacgaaagtgggcaatcgtcctcacggggatcatctcattgcgactcaccatccccacaggaggacggtcagattatgttcgacgttgaaatgcacacatcaagggaccactctagccagtctgaggaggaggttgttgaaggggaaaaggaggtagaggccctgaagaagtctgctgattgggtctccgactggtcaagtcggccagagaacattcccccaaaggagttccactttcgccatcccaagcgcagcgtgtccctgtccatgcgaaagtcaggggcaatgaagaaagggggtatcttttccgcagagtttttgaaagtgttcattccatctctttttctcagccatgtgttggcgctagggctaggcatctacattggcaagcgactgtccaccccaagtgccagcacatactag

SEQ ID NO: 27465 - DNA, 540 bp, Artificial Sequence
  Description of Artificial Sequence: Synthetic coding sequence
atgaacagttcaaatggaaatgataatgggaatgggaagaatggcggtctcgagcatgtgccatcttcatcctctatccacaatggagacatggaaaaaatcttgctggacgcgcagcacgagagcggacagagttcctcccgaggctcaagccattgcgactctccaagcccccaggaggatggccagattatgttcgatgtggagatgcacacctctcgggaccactcttctcagtccgaggaggaggttgtggaaggcgagaaggaagtagaggctttaaaaaaatccgccgactgggtatccgattggagctctaggccagaaaatataccaccgaaagaatttcactttaggcatcccaagcggtctgtctcactgtccatgcgtaagtcgggggcaatgaaaaagggtggcattttcagtgcggagtttctcaaggtctttattccttccctctttctctcacacgtcttggccttgggtttggggatatacatcggtaagagattaagcacacctagcgctagcacctactag

SEQ ID NO: 27466 - DNA, 540 bp, Artificial Sequence
  Description of Artificial Sequence: Synthetic coding sequence
atgaactcgtcgaatggaaatgacaacggaaacggcaaaaacggcggtttggagcacgtgccttcatccagctctatccacaacggcgatatggagaaaatactgctggatgcccaacacgaatcaggccagagctcctccagggggtcatctcactgtgactcacccagtcctcaagaggacgggcaaattatgttcgacgtcgagatgcacacgtcacgcgatcacagtagtcagtccgaagaagaggtggtggagggcgagaaggaggtcgaggccctgaagaagtccgctgattgggtttcagactggagtagcagaccagagaatatccctccaaaggagttccactttcggcatcccaaaaggagcgtgagtctcagcatgaggaagtctggcgctatgaaaaaggggggaatcttctctgctgagttcctcaaggtattcattccatccttgttcttatctcacgtgctggccctgggactgggaatttacatcggaaagaggttatcgacccctagcgcctctacctattag

SEQ ID NO: 27467 - DNA, 540 bp, Artificial Sequence
  Description of Artificial Sequence: Synthetic coding sequence
atgaacagctccaatggcaatgacaacggaaacgggaagaatggcggtctcgagcatgtgcccagcagctcgtctatccacaacggagacatggaaaagatcctcttggacgcccagcatgagagtggacagtcttcttctagaggcagcagccactgtgacagcccgagcccccaggaggatggccagatcatgtttgatgtcgagatgcacactagccgagatcattccagtcagtctgaggaagaggttgtagagggggaaaaagaagtggaggcgctgaaaaaaagtgcggactgggtctcagactggagttcaagacccgaaaacatccctcccaaagagttccatttccgccaccctaagagatctgtaagcctatccatgcgtaagtctggggctatgaagaaagggggtatcttctctgcggaattccttaaggtttttatcccttccctcttcttgtcccacgtattagccctgggtctgggaatctacatcggtaagagactgtcaaccccctctgcttcaacgtactag

SEQ ID NO: 27468 - DNA, 636 bp, Artificial Sequence
  Description of Artificial Sequence: Synthetic coding sequence
atggcttcagggcagggacctggtccgcctaggcaggagtgcggcgagcctgctctcccttcggcttccgaagaacaagtcgcacaagatacagaagaagtttttcgctcttatgtgttttacagacaccagcaggaacaggaagcggagggagtggctgctccagctgaccccgaaatggtcaccttgcctctgcagccaagctccacaatgggccaggtcggcagacagctggcgattattggcgacgatataaatcggcgttacgacagtgaattccaaacaatgctgcagcacctgcagcctacagctgagaatgcatacgagtactttaccaaaatcgcaacatcattgtttgaatctgggatcaattggggaagggtggttgccctcctgggcttcggctacagactagccctgcacgtgtaccagcacggattaaccgggttcctggggcaggtcactcggtttgtggttgacttcatgcttcaccattgcatcgcacgttggatcgctcagagaggaggctgggttgccgcattaaacctcggaaacggcccaatcctaaacgtattggtagtgcttggggtggttcttctgggtcagttcgtagtgcggagattttttaaatcttag

SEQ ID NO: 27469 - DNA, 576 bp, Artificial Sequence
  Description of Artificial Sequence: Synthetic coding sequence
atggccagcggacagggacccggtcctcccagacaggaatgcggtgaacctgctctgccgtcggcttctgaggaacaagtggcccaagacacagaagaggtcttccggagctatgttttttatagacaccagcagcagcccagttctacgatgggccaggttggccgacagttggctataattggcgacgatatcaatcggagatatgactcagaatttcagacaatgctgcaacatttacaacccacagccgagaatgcttacgagtatttcacgaaaatcgccacgtctttattcgagagcggtattaactggggcagagtcgtcgctctccttggattcggctaccggctcgctctgcatgtctatcagcacggactgacaggatttctgggtcaggttactaggttcgttgttgactttatgcttcaccactgcatcgccagatggatcgctcagaggggaggttgggtcgccgcattgaatttaggcaatggaccaatcctgaacgtcctggtagtcttaggagtggtgcttctgggtcagtttgtagtaagacgtttctttaaatcctag

SEQ ID NO: 27470 - DNA, 636 bp, Artificial Sequence
  Description of Artificial Sequence: Synthetic coding sequence
atggccagtggacagggacccggtccgccaagacaggagtgtggagagccggcactgccatctgctagtgaggaacaggtggcccaggacaccgaggaagtttttagatcctacgtgttttataggcatcagcaggaacaggaggccgaaggggtcgcagctcccgcagaccccgaaatggttaccctacccctgcagccctcatcaacaatggggcaggtgggacggcagctcgctatcataggtgacgacatcaataggcggtacgactccgagtttcagactatgcttcagcacctccaacccacagcagagaacgcatatgagtactttactaaaattgcgaccagcctgtttgagagcgggattaattggggcagagtcgtggctcttctcggcttcggttaccgcttggcactgcacgtttatcagcatggtctgactggatttctggggcaagttacaaggtttgtcgtcgactttatgctgcaccactgtatagcccgttggatcgcacagcggggaggttgggttgccgctctgaacctgggcaacggcccaatcttgaatgtgctggttgtgctcggggtggtactcctgggccagttcgtcgtgcgcaggttttttaagtcctag

SEQ ID NO: 27471 - DNA, 462 bp, Artificial Sequence
  Description of Artificial Sequence: Synthetic coding sequence
atggcaagtgggcagggccctggtccacccagacaggagtgtggcgaacctgccttgccatctgcatctgaagagcaggtagcccaggataccgaagaggtgtttcggtcttatgtgttctatcgccaccaacaggagcaggaggccgaaggggtcgctgcacccgcagatccggagatggtgaccctgccactacagccatcctccaccatgggccaggttggcagacagctcgcaattatcggggatgatattaatcggcgatacgacagtgaattccaaaccatgttgcagcacctgcagccaactgctgagaatgcttacgagtacttcacgaaaattgcaacccgcccagccgcaactccaacagcgtgcctcagggtggcttctattggtgccgtttggtggttgttttgggcttccgccacggtttggccttacaccagcacctcaatggcttag

SEQ ID NO: 27472 - DNA, 507 bp, Artificial Sequence
  Description of Artificial Sequence: Synthetic coding sequence
atgttccagatcccagagttcgaaccctcggagcaggaggactcgtcttccgcagagaggggtctaggtccgtcccctgcgggagacgggccatcaggtagtgggaaacatcatcgccaggccccagggctgctgtgggacgcctcacatcaacaagaacagcctacttcctctagtcaccatggaggcgctggagccgtggaaatacgatcccgccattcaagttacccagccggaacggaggacgacgaaggcatgggggaagagccctcacctttccgtgggaggtcccgcagtgcgcctccaaatctgtgggctgcccagcggtacggaagggagctgcgccgaatgtcagacgagtttgtagactccttcaagaaaggactgccgaggcccaagagcgccggaacagctacacagatgcgccagagttcatcctggaccagagtgtttcagtcttggtgggatcggaaccttggcaggggaagcagtgctcctagccagtag

SEQ ID NO: 27473 - DNA, 507 bp, Artificial Sequence
  Description of Artificial Sequence: Synthetic coding sequence
atgttccagattcccgagttcgaacctagtgagcaggaggactcatcctcagccgagcgaggcctcggtcctagccctgccggtgatggtccctctggctcagggaagcaccaccgccaagccccaggcctcctgtgggacgccagccatcagcaggagcagcccacaagctcctcccatcacggcggtgcaggagcagtagagattagatctcgtcactcctcttatcctgctggaaccgaagacgacgagggtatgggcgaggagccttccccattccggggacgctccaggtctgcccctccaaatctatgggccgctcaaagatatgggagggagctcagacggatgtctgatgagtttgtggattcattcaagaaaggcctaccgcgaccgaagtccgccggaaccgcgactcaaatgcggcagtccagcagctggacccgagtctttcaaagctggtgggatcgcaatcttggcaggggatcaagcgcaccatcacaatag

SEQ ID NO: 27474 - DNA, 450 bp, Artificial Sequence
  Description of Artificial Sequence: Synthetic coding sequence
atgttccagatcccggagtttgagccttctgaacaggaggatagttcctccgctgagcgaggactagggccttcaccggctggtgacgggccttctgggtccggtaagcaccacaggcaggcaccaggcttgttgtgggatgcttcgcatcagcaggagcaacccacgtcgagttcgcatcatggtggagccggtgcagttgagataaggtccagacattctagttacccggctggcaccgaggatgacgaaggtatgggagaggaaccatcaccattcaggggacggtcccggtcggccccacccaacctctgggcagcccagcgctacgggcgtgagctcaggcggatgtcagacgaatttgtggactctttcaaaaaaggactcccacgacctaagagcgcgggaactgcaactcagatgaggcaatcatcacgaaggttacgctag

SEQ ID NO: 27475 - DNA, 591 bp, Artificial Sequence
  Description of Artificial Sequence: Synthetic coding sequence
atgaacaggtcgcaagaggtgacacgcgacgaagagtccactcggtcagaggaagtgacgcgggaagaaatggcagctgcgggtctgaccgtaaccgttacccattcgaacgaaaagcatgacctgcacgtcacctctcagcagggatccagtgaacctgtggtgcaggacctggcccaagttgtcgaggaggtcatcggggtccctcagagtttccaaaaactcatattcaagggtaaatctctgaaggagatggagaccccactgtcagcacttggaatacaggacggctgtagagtcatgctaattggcaaaaagaatagcccacaggaggaggtagaattgaagaagctgaagcacctggaaaagtctgtggaaaagatagctgaccagcttgaggagcttaacaaggagctgacaggaatccagcaaggctttctgccgaaagatcttcaggcagaggcattatgtaagctcgacagacgggtgaaggctacaatcgaacagtttatgaaaatcttagaagagatagatactctcattttgccagagaacttccctaccctcacgctggtgctgaacgaaaagtag

SEQ ID NO: 27476 - DNA, 693 bp, Artificial Sequence
  Description of Artificial Sequence: Synthetic coding sequence
atgaatagatcccaagaggtgacgcgggacgaagaaagtacacgcagcgaagaagtcactcgagaggagatggctgccgctggcctaaccgtgactgtcactcacagtaacgagaaacatgatctccacgtgactagccagcaggggagttccgagccagtcgtgcaggatttggcacaggttgtcgaggaggtgattggtgtcccacagagctttcaaaaattgattttcaaaggcaaatccctgaaggaaatggaaaccccactctctgccctggggatccaggatggatgtcgcgttatgcttataggcaagaagaacagtccccaggaagaggtggaactcaagaagctgaagcacttggaaaagagcgtcgaaaaaattgctgatcagttggaggaattgaacaaggaactcaccgggatccagcaggggttcctgcctaaggatctgcaagcagaggcactctgcaagcttgacagaagagtcaaagccacaatcgaacagtttatgaaaatcctcgaggagatcgacactctgatcctgcccgagaacttcaaagactcaagactgaagcgcaagggactggttaaaaaggttcaggctttccttgcggagtgtgacaccgtcgaacaaaacatctgccaggagacggaaagactgcagtccactaatttcgccctggccgagtag

SEQ ID NO: 27477 - DNA, 1038 bp, Artificial Sequence
  Description of Artificial Sequence: Synthetic coding sequence
ctagcacagcggggaggagccaggaggcccagaggcgacagggagcgactggggtctaggctccgggcactgaggcctggcagagaacctagacaaagcgagccccctgctcagagaggcccaccgccatcaggtcggcctcccgctaggtcaaccgctagcggtcacgatcgtccaaccaggggtgctgctgcaggtgctaggcggccaagaatgaaaaaaaagaccagaaggcgctccacacgctctgaggaacttacccggagcgaagaactcaccctctctgaagaagccacctggtctgaggaagccactcaatccgaagaagctacccagggcgaggagatgaataggtcacaggaggtgacccgggacgaagagtctacacgctccgaggaagtgacacgggaagagatggctgccgctggattaaccgtgacggtcacgcactcaaatgagaaacacgacctgcatgtgacctcccagcaaggaagttccgagcccgtggttcaggatttggcccaggtagtggaggaagtgatcggagtgcctcagtcttttcagaaactgatctttaaaggaaaatctttaaaggagatggaaacacctctctcagcactgggtatccaggacggctgtcgagtcatgctgattgggaaaaaaaactccccccaagaagaagtggagctgaaaaaactcaaacatttggagaagtccgtggaaaaaatagccgatcagttggaggagcttaacaaggaacttacaggaatacagcagggtttccttccaaaagacttacaagctgaggctctctgtaagctcgatcgacgcgtgaaggctactatcgaacagttcatgaaaattctggaggagattgacaccctgatccttcccgagaattttaaggatagtaggctgaagcgaaagggactcgtgaagaaagttcaggctttcctggccgaatgtgacactgtggaacaaaacatctgccaagagaccgaaagactccagagcactaattttgccctagccgagtag

SEQ ID NO: 27478 - DNA, 1728 bp, Artificial Sequence
  Description of Artificial Sequence: Synthetic coding sequence
atgtcggccgcaacacattccccaatgatgcaggttgctagcggaaatggtgaccgtgatcccctccctccaggctgggagattaagatagatcctcagacggggtggcccttctttgtggatcacaattcaaggaccacaacctggaatgatcctagagttccttcagaaggacctaaagagaccccttcatccgctaatggcccatcaagagaaggctccaggctgccccctgcaagagaaggacatccagtgtaccctcagctgaggcccggttatattccaattccagtactccacgagggagccgagaaccgtcaggtccatccctttcatgtgtacccccaaccgggtatgcagagattccgaacagaggccgcagccgcagctccgcagcgatcccagtcccctctgagggggatgccagaaaccacccagcccgacaagcagtgcgggcaggtggccgcagcagcggcagcacagccgccagcgagtcacggtccagagcggagtcaaagccccgctgccagcgattgtagcagctcctcttcttctgcctcgcttccttcatcaggccgaagttcattaggaagccaccagctccctagaggctacataagcatcccagttatacatgagcaaaacgttacaagacccgctgcacagccctcgttccaccaagcacagaagactcactatccagcacagcagggtgaatatcagactcatcaaccagtgtaccataagattcagggcgacgactgggagcctcgcccactccgcgcagcttctcctttccgctcatccgtacagggggcaagcagtcgggagggatcgccggcaagaagcagtaccccactacatagtccttcgcccattagagtgcataccgtggtggatagacctcagcagcctatgactcacagagagaccgcacctgtttcccagccggaaaacaaaccggagtctaagcccggacccgtcggaccagagctgccacctggtcatatcccaatacaagtgattagaaaggaggtggactcaaagcccgttagccaaaagccacctccaccgagcgagaaggtcgaggtgaaggtaccacctgcaccggtgccgtgccccccacccagccccggtccctccgctgtgccttccagcccaaaatctgtagccacggaagagcgcgcagcaccgtcaaccgcgcctgccgaagcaacccctccaaagcccggagaggccgaggctccccctaaacatccgggtgtactcaaagtagaagccatactggagaaagtgcaagggctggagcaggcggtcgacaacttcgaaggaaagaagactgacaaaaagtacctcatgatcgaggagtacctcaccaaggagctgcttgcactcgacagtgtcgacccggaagggagagccgacgttcgccaggccaggcgggacggcgttcggaaggttcagacaatattggagaagctggaacagaaggccattgatgtgcctggacaggtgcaggtctacgagctccaaccgagcaaccttgaggcagatcaaccgctccaggccatcatggagatgggcgctgttgccgctgacaaaggcaagaagaacgccggaaatgccgaggacccccatacagaaacccagcaacccgaggccaccgccgcagcaacatccaacccaagctctatgacagatactccgggtaaccccgcagcaccttag

SEQ ID NO: 27479 - DNA, 978 bp, Artificial Sequence
  Description of Artificial Sequence: Synthetic coding sequence
atgcaggaaacgccctcgtcagctaatggaccgtcccgcgaagggtcaagactgcccccagcccgtgaaggccaccctgtgtaccctcagctgagaccaggctatatcccaatcccagtgctacacgagggggcagaaaataggcaggtgcacccatttcacgtctaccctcagcccggaatgcagcggtttaggaccgaggccgcagctgctgcccctcagcgatcacagtcgcctttacggggtatgccagagaccacccagccggataaacagtgtgggcaggtggccgctgcggctgccgctcaaccacctgcctcccacggaccagagcgcagccagagtcccgctgcatccgactgtagctctagtagctcttccgccagcctgccatcgtccggacgcagttccctgggctctcaccaattgcctagggggtatatcagcatccctgtgatccacgaacagaacgttactcgcccagcggcacaaccatcgttccaccaggcacagaaaactcactatcctgctcaacagggggaataccagactcatcagcctgtttatcacaaaatccaaggggacgactgggagcccaggcccctccgcgcagcttcaccctttagaagcagcgtccaaggggcttcctctcgagagggttctcctgcaagatccagcactccgttgcattccccctctcccattcgggttcatacagtagttgatagaccacagccaatgacacaccgcgagacagcacccgtcagtcaaccagaaaataagccggagtccaagcccggtcctgtaggccctgaactcccaccgggtcacatccccattcaagtgatcaggaaggaggtcgatagcaagccagtatctcagaagcccccacctcccagcgagaaggtggaagtgaaggtgcctcccgctccggtaccttgccccccaccttctccaggtcctagcgctgttccatag

SEQ ID NO: 27480 - DNA, 657 bp, Artificial Sequence
  Description of Artificial Sequence: Synthetic coding sequence
atggacggttctggcgaacagcccaggggcggagggcctacttcatcggagcagatcatgaagaccggcgctctcctgctgcaggggttcattcaggatagagctggcagaatgggcggagaggcgccagaattggctttggaccctgtacctcaggatgccagcactaagaagctgtccgagtgtctgaaacggataggtgatgaactggactccaacatggaactccagaggatgatagccgcagtcgacactgattctcctcgcgaagtattttttagagtggccgctgacatgttctctgatggtaactttaattggggccgtgtggtcgctctgttttactttgcatctaaactggtgctcaaagccctgtgtaccaaagtgcctgagttgatccgaacgataatgggctggaccctggattttctgcgggaaaggctgctaggctggatacaggaccagggaggctgggtgaggctgctaaagcctccccaccctcatcatcgcgcattgactaccgctcctgcaccccctagcctgccacctgccacaccactgggcccatgggcattttggtctaggagccaatggtgtcccttgccgatatttcggtcttctgacgtcgtttacaatgcgttctccttgcgggtttag

SEQ ID NO: 27481 - DNA, 579 bp, Artificial Sequence
  Description of Artificial Sequence: Synthetic coding sequence
atggacggaagcggggaacagccacgcggagggggacccaccagcagtgagcaaattatgaagactggcgcactgctgctgcaaggcttcattcaggatagggctggcagaatgggaggcgaggccccagaattagccctggacccagtgccccaagatgctagcacaaaaaagctttcggaatgccttaaacgcatcggcgacgagttggattccaatatggaattgcaaaggatgatcgcagcagtggatacagattcccctagggaagtgttttttagggtggccgcagacatgttctccgacggcaatttcaactgggggagggtggttgccctgttctacttcgcatccaagctcgtcctgaaggcattgtgcacaaaagtccccgagcttattcggacaataatggggtggaccctcgattttctccgggagagactactgggctggattcaggaccaagggggatgggacgggttgctgagttacttcggcacccctacgtggcagaccgtcacaattttcgtagcaggcgtgctgacggctagtctgactatttggaaaaagatgggttag

SEQ ID NO: 27482 - DNA, 432 bp, Artificial Sequence
  Description of Artificial Sequence: Synthetic coding sequence
atggatggctccggcgagcagccaagggggggagggccaaccagttctgagcagataatgaaaacaggcgctcttctgctgcagggcatgattgccgctgttgacacagactctcccagagaggtgtttttccgagtggccgctgacatgttttcagacgggaattttaattggggacgcgtagtggctctattttactttgccagcaagctggtcttgaaagctctgtgcacaaaggttcctgaactcattcggaccatcatggggtggacgttggacttcttaagggaacggctgctcggctggattcaggaccagggcggatgggatggcctcctgtcttattttgggacaccgacctggcagacagttacgatattcgtggccggagtcctgacagcatccctgaccatctggaagaagatgggatag

SEQ ID NO: 27483 - DNA, 126 bp, Artificial Sequence
  Description of Artificial Sequence: Synthetic coding sequence
atggatgggagcggagagcagccacgcggtggtgtgtcctctcgcattgagcagggcgaatggggaggcagacatccatcttggccctggacacggtgcttacggatgcggcctccaagatcctag

SEQ ID NO: 27484 - DNA, 540 bp, Artificial Sequence
  Description of Artificial Sequence: Synthetic coding sequence
atggatggctctggtgagcagcccagaggcggaggcccaacatcatcagagcagatcatgaagactggagcactgctactgcagggcttcattcaggatcgcgctgggcgaatgggcggagaggcccctgagctggcgctggacccggtgccgcaggatgcgagcacaaagaaactctcagagtgcctgaagagaattggagacgaactggactcaaatatggagctgcaacgcatgattgccgcagtggatacggattccccacgggaggtttttttccgggtggccgcagatatgttctccgatggaaacttcaattggggccgagtggttgccctcttctattttgcgagcaaactcgtcttgaaggctttatgcaccaaggtgcccgagctgatccgcaccataatgggctggactctggattttctccgggaaagactgttagggtggatccaggatcaggggggttggaccgtgacgatcttcgtggccggagtgttgactgctagtctcaccatttggaagaagatgggctag

SEQ ID NO: 27485 - DNA, 495 bp, Artificial Sequence
  Description of Artificial Sequence: Synthetic coding sequence
atggacggcagcggcgaacagcccagagggggaggtcccacctcgagtgaacagattatgaagacaggcgctctgctcctccaggggtttatccaggatagagccggaagaatgggtggtgaagcacccgagcttgccctcgaccccgttcctcaagatgctagcaccaagaagctctcggaatgcctgaagcgtattggcgatgaactcgatagcaatatggaactccaaaggatgatcgctgccgtcgataccgattcgccgagggaagtgttctttcgggtcgccgcagatatgttcagtgacggcaattttaattggggcagggtggtggctctcttctactttgcctccaagcttgtactaaaagccggtgtgaaatggcgggacctgggatctttgcagcctttacctccaggctttaaaaggttcacttgtttatcaatccccagatcatgggattaccggccatgcgctcctcggtgtaggaactag

SEQ ID NO: 27486 - DNA, 1806 bp, Artificial Sequence
  Description of Artificial Sequence: Synthetic coding sequence
atggcttacgatgatagtgtgaagaaagaggattgcttcgacggggaccacactttcgaagatattgggctggccgctggcaggagccaaagggaaaagaaaaggtcttacaaggacttcctgcgggaggaggaagaaattgctgctcaagtgcgtaattcttcaaaaaaaaaactaaaggattccgaactgtacttcctcgggactgatacacacaagaagaaacgcaagcatagcagtgacgactactactatggagatatctcctccctggagtcaagccagaagaagaagaagaagtctagccctcagtccaccgataccgccatggatctgcttaaggctatcacttccccgcttgccgcagggagcaagccaagtaaaaagactggtgagaagtcctccggttcaagctctcattcagagtcgaagaaggaacaccaccgtaaaaaagtaagtgggagttcaggcgagctcccattggaggatggcggaagccacaagtccaaaaagatgaagccattatatgtgaacacagagaccctgacactgcgcgaaccagatggcctcaaaatgaagctgattctcagtccaaaggagaaaggcagcagcagtgtagacgaggaatcattccagtatccgagccagcaggcgaccgtgaaaaagtcatcaaaaaaatctgcaagggatgaacagggcgctctcctgcttggtcacgagctccagagctttctgaaaaccgctagaaaaaagcataagtcttcctcggacgcacactcctctcccggacccgagggttgcgggagtgacgcatcccaatttgctgagtcacacagtgccaaccttgacctgagcgggctcgagccaatcctggtggagtccgattctagtagcggcggagaactagaggcaggtgaattggtgatcgacgattcttatagggaaataaaaaaaaagaagaaatccaagaagagcaagaagaagaaagacaaggagaagcataaagagaaacgacatagtaaaagtaaaagaagcttgggcctgtcggctgtgcccgtaggcgaagtgacggtgacctccggaccacccccttctataccgtatgccggagcagctgcccctcccttgcccctgccaggactccatactgacggtcactcggaaaagaaaaagaaaaaggaggagaaggacaaagagcgtgaacggggtgaaaagcccaagaaaaagaatatgtctgcttaccaggtattctgtaaagaatatcgcgtgactatcgtggctgaccaccctgggattgactttggcgaacttagcaagaagctcgcggaggtatggaaacaactgccagagaaggacaagctcatttggaagcagaaagcgcagtacctccaacacaaacagaataaggccgaggcaacaaccgtgaagcgcaaggcttcctcatcggaaggttcgatgaaagtcaaagcatcctccgtgggagtgctgtcaccacaaaagaaatctccccctaccacgatgcttctgcctgcttcacccgcaaaagccccagagactgagcctatagacgtcgccgcacacctgcaattgctgggtgagtcgctgtccctgatcggccaccggctacaggaaaccgaaggaatggtggccgtatccgggagtctcagcgtgctcttagactccataatttgtgcactcggaccattggcgtgccttactacccagctccctgaactgaatgggtgtccaaagcaggtcctctccaatacactagacaacatagcttacatcatgccaggtctctag

SEQ ID NO: 27487 - DNA, 702 bp, Artificial Sequence
  Description of Artificial Sequence: Synthetic coding sequence
atgagccagtccaatagggagctggtggtcgatttcctgtcctacaagctgtctcagaaggggtacagttggtcccagttctccgacgttgaggagaacagaacggaagcacctgagggtaccgaatccgaaatggagacgccttctgctattaatgggaacccatcttggcacctagctgatagccctgctgtcaatggagctacagggcattctagttctttagacgcgcgagaagtgatcccgatggctgcggttaagcaggccctgagggaagcaggcgacgagtttgagctgaggtataggcgagcgtttagtgatctgaccagtcagctccatatcacaccaggtacagcgtaccagagcttcgaacaagtggtcaacgagttgttccgggacggagtgaattgggggcgtattgtggccttcttctctttcggtggagctttgtgtgtcgagtctgtggacaaggagatgcaggtactcgttagcaggattgcggcatggatggcaacgtacctgaacgaccatttagagccatggattcaagaaaacgggggatgggacacctttgtggaactctacgggaacaatgcagcagcagagtcacgcaaggggcaggagcgctttaatcggtggttcttgacaggaatgactgtcgctggagttgtgcttctggggtcgctcttttctcgcaaatag

SEQ ID NO: 27488 - DNA, 513 bp, Artificial Sequence
  Description of Artificial Sequence: Synthetic coding sequence
atgagccagtccaaccgtgaattagtagtggacttcctgagctacaaattgtcacagaaagggtattcctggtcccagttttccgacgtagaagaaaaccggaccgaggccccagagggaaccgaatccgagatggaaaccccctcggcaatcaatggcaatccttcatggcacctggcagacagcccggctgtgaacggagcgaccggccattcgtcttcgctcgatgctcgagaggtcattcccatggcagccgtgaaacaagcccttagggaagcgggagacgaatttgagctccggtataggagagctttctcagatttgacctcccagctgcacataacccccggaacagcctatcagagtttcgaacaggacaccttcgtggaactctacggaaacaacgccgcagccgagagtcggaaaggtcaggagcggttcaatcgctggtttctgaccgggatgacagttgctggagtggtcctgctgggcagtctattctccagaaaatag

SEQ ID NO: 27489 - DNA, 702 bp, Artificial Sequence
  Description of Artificial Sequence: Synthetic coding sequence
atgagccaatccaaccgtgaactggtcgtcgactttttgtcctacaagttgagtcagaagggatattcatggtcccagttttccgacgtggaggagaatcggactgaggcacccgagggcacggagtccgaaatggagacgcccagtgctataaatgggaacccgtcttggcatctcgccgattcgcctgccgtcaatggtgccaccggtcattcctcgagcctggatgccagggaagttataccaatggccgctgtgaaacaggcactcagggaagctggtgatgagtttgagctgaggtaccggagggcatttagtgatttgacaagccagttacatatcacgccaggcaccgcatatcaatctttcgagcaagtcgtcaatgaactttttagagacggggtgaactggggtcgcattgtggcattcttctcattcggcggagcattatgtgtggaatcggtggacaaagagatgcaggtacttgtcagtcgtatcgccgcttggatggccacctatctcaatgatcacctggagccctggattcaggagaacggcggatgggatactttcgtcgagttgtacggtaacaatgcagcagccgagtcccggaagggtcaggagcggtttaatcgatggtttctcaccggaatgaccgtggcaggagtagtactcctagggtctctgttttcccgaaagtag

SEQ ID NO: 27490 - DNA, 567 bp, Artificial Sequence
  Description of Artificial Sequence: Synthetic coding sequence
atgagccagagcaaccgggagctcgtggtagactttctctcttacaagctgagccaaaagggctactcctggtcacagttttctgacgttgaggaaaatcgtaccgaggccccagagggtaccgagagcgagatggagaccccgtcagcgataaatggaaatccctcctggcatctggctgactctcccgcagtcaacggcgctaccggccactcgtcctccctagatgccagagaggtaatcccaatggcagctgtgaagcaggcgctgcgtgaggccggagatgaatttgagctgcggtacaggcgcgcattctccgatctcacctctcaactacatatcactcctggaacggcgtatcagtctttcgagcaggttgtgaatgaactcttcagagacggtgttaattgggggcgaattgtggcattcttttcatttgggggtgcactgtgcgtggaaagcgtggacaaggaaatgcaagtcttggttagcaggattgcagcatggatggccacatatttgaacgaccatctggaaccttggattcaggaaaacgggggatggtag

SEQ ID NO: 27491 - DNA, 702 bp, Artificial Sequence
  Description of Artificial Sequence: Synthetic coding sequence
atgagccaatccaaccgagagttagtggtagatttcctttcctacaaactgagccaaaaagggtacagttggagtcagtttagcgatgttgaagagaatcgcaccgaagctccagagggcaccgaaagtgaaatggagaccccgtctgctatcaacggcaacccttcgtggcacctggcggacagtcccgctgtgaatggcgcaactgggcactctagcagcttagacgcccgagaggtgatacctatggccgctgtcaaacaggctctgagagaagctggcgatgaatttgagttgcgatatcgaagagcattcagtgatctgaccagccagcttcatatcacacccggaaccgcataccaaagctttgaacaggttgtcaatgaattgtttcgcgatggtgtgaactggggcaggattgttgctttcttctctttcggtggggcattgtgcgtggaatctgttgacaaagagatgcaagtgctggtcagccgtattgctgcgtggatggccacatacttaaacgaccacctcgaaccatggatacaagaaaatggtgggtgggatacatttgtggagctgtatggcaacaatgcggcagcagaaagtcgaaaaggacaggagcgcttcaaccggtggtttcttactgggatgacagtcgcaggggtggtactcctcgggagcttgttctcccgtaagtag

SEQ ID NO: 27492 - DNA, 567 bp, Artificial Sequence
  Description of Artificial Sequence: Synthetic coding sequence
atgagtcagtccaaccgcgaactcgttgtggactttctgtcttacaagctgagtcagaagggatattcatggtctcagtttagtgatgtggaagagaacagaacagaggcccctgagggcacggagagtgaaatggagacccccagcgcaatcaatgggaaccccagctggcacctggctgactctccggcagtgaatggagccacaggtcattcttcaagcttggacgctagagaggtgatccctatggccgcagtaaagcaggcactgcgggaagccggtgacgaatttgaactccgctaccgtagagccttttcagaccttacgtcacagcttcatataactcctggaaccgcataccaatccttcgaacaggtggtgaatgaactcttccgcgacggcgtaaactggggcagaatagtggcttttttttcctttggcggagccctgtgcgtggaatccgtagacaaggagatgcaagttctggtcagtaggattgctgcctggatggctacctatctcaacgatcatcttgagccgtggatccaggagaatggaggctggtag

SEQ ID NO: 27493 - DNA, 147 bp, Artificial Sequence
  Description of Artificial Sequence: Synthetic coding sequence
atgtctcagagtaatagggagctggtcgttgatttcttgtcttacaagttgtcgcagaagggatacagctggtctcagttttctgatgtggaggagaatcgcactgaggctcccgaaggcacggagagcgagatggaaactccttag

SEQ ID NO: 27494 - DNA, 546 bp, Artificial Sequence
  Description of Artificial Sequence: Synthetic coding sequence
atgtcacaaagtaaccgggagctagtagtcgattttctgagctacaaactgtcacaaaagggttatagctggtcccagttcagcgacgtggaggagaatagaacagaggcacctgagggcacagagtccgaaatggagacaccatccgctatcaacgggaacccatcgtggcaccttgccgatagccctgcagtgaatggggctacaggccacagtagcagtctggacgcccgtgaagttatacccatggcggctgtgaagcaggccctcagggaagctggggatgagttcgagctgcggtatagaagagcctttagcgatctcactagccagctccacatcaccccaggcactgcttaccaatcatttgagcaggttgtgaacgaattgttccgggatggtgtgaattgggggcgaattgtggccttctttagttttggtggcgcactgtgtgtagaatcagtggataaggagatgcaagtcctggtctcgcgaatagcagcctggatggcaacatatttgaatgaccatctggaaccctggtag

SEQ ID NO: 27495 - DNA, 618 bp, Artificial Sequence
  Description of Artificial Sequence: Synthetic coding sequence
atgtcccagagcaatagagagctcgttgtggacttccttagttataagctctcacagaagggctattcttggagccaattcagtgatgttgaagaaaacagaaccgaggcacctgaaggtacagaatccgaaatggagacaccttcggcgattaacggaaatcctagttggcatctggcagactcccccgctgtaaacggggcaacaggacactcatcatctctggacgctcgcgaagtgatcccgatggccgcagtgaaacaagccctgagggaggctggcgatgagtttgagctgagatacagaagggccttttcagatttgaccagtcaactgcacatcactcctgggacggcctatcaaagctttgagcaggtagttaatgagctgttccgcgatggagtgaactggggcagaattgtggcattcttcagtttcgggggtgcgctgtgcgttgagtccgtcgataaagagatgcaggtcttggtgagtcgaatcgccgcatggatggcgacttatctaaacgatcaccttgagccatggatacaggagaacgggggatgggatacttttgttgaactctacggtaataacgcagcggctgagtctaggaagtag

SEQ ID NO: 27496 - DNA, 567 bp, Artificial Sequence
  Description of Artificial Sequence: Synthetic coding sequence
atgtcccagtctaatcgtgagctggtggtggattttctttcctacaagttgagccaaaagggctattcctggtctcagttttctgacgtcgaggagaatcgcaccgaggccccagagggaaccgagagtgaaatggagactccatctgccatcaacgggaaccctagctggcatcttgccgacagccctgccgtaaacggagccacagggcactcctcctctctggatgctcgagaagtaatcccgatggccgctgtcaagcaggccctgcgagaggccggagacgaatttgagttgcgttatcgacgcgcattttcggatctgacctcacaattacatatcacccctggtactgcttaccagtctttcgagcaggtcgtgaacgagctgttcagagacggtgtgaactggggcagaatcgtggccttctttagcttcggcggtgcactgtgtgtcgaaagtgtggacaaggagatgcaagtcctggtcagtagaatcgccgcttggatggcaacttacctcaacgaccacttggagccatggattcaggaaaatggtggatggtag

SEQ ID NO: 27497 - DNA, 615 bp, Artificial Sequence
  Description of Artificial Sequence: Synthetic coding sequence
atggtcgaccaactgagggagcggaccactatggccgatccactccgcgagcggaccgagttactgttggccgattatctcggctattgcgccagggaacctggcacccctgagcccgctccttctacccctgaagccgcagtgctgcggtctgcagctgctaggttacggcagatacatcgatcattcttttccgcttatctcggctatcctggaaataggttcgaactggtcgccctgatggccgacagcgtgctttccgacagccccggacctacatgggggagagtggtgactctcgtgacgttcgccggaacactgttggagcggggtcctctcgtaacagcccgatggaagaagtggggcttccagcccaggttgaaggagcaggagggagacgttgcccgagactgccaaagattagtggctctactgagtagtcgcctgatgggccaacatcgcgcatggctccaggcccaaggtggatgggacggcttctgccacttcttccgaacccctttccctctggcattttggcgcaaacagctagtgcaggcctttctgtcgtgcctcctgacaactgctttcatatatctgtggacaaggctgctttag

SEQ ID NO: 27498 - DNA, 417 bp, Artificial Sequence
  Description of Artificial Sequence: Synthetic coding sequence
atggccaaacaaccttcagacgtatcctcagaatgcgatagagagggtcggcaattgcagccagctgagaggccccctcagttgcgtcccggtgctccgacatccctacaaaccgagccgcaagaccggagtcccgcacccatgtcctgtgacaaatcgactcaaacacctagtcctccatgtcaggcctttaatcattatttatcggctatggcaagcatgcggcaggctgaaccagccgatatgcggccagagatttggattgcccaagagctcagaagaatcggtgacgaatttaatgcctattatgctcgacgggtgttcctgaataattaccaggcggcagaggaccaccccaggatggtgattctccgtctgcttcgatatatcgtgaggctggtgtggcggatgcattag

SEQ ID NO: 27499 - DNA, 339 bp, Artificial Sequence
  Description of Artificial Sequence: Synthetic coding sequence
atggcgaagcagccctctgatgtgagctctgagtgtgatcgcgagggccgtcagctgcagccggctgagaggccccctcagcttagacccggagccccaacctctctgcagactgagccccaggatcgcagccctgcaccaatgagctgtgacaagagcacacaaaccccctctccaccttgccaagcttttaatcactatctgagcgctatggtggtcatactggaagatatcggcgaccttagcctctgttttgggttcatcttcacgggcctggatctttacggacatcaccactcccaggataccgagcaactcaaccacaaagacttcagctag

SEQ ID NO: 27500 - DNA, 519 bp, Artificial Sequence
  Description of Artificial Sequence: Synthetic coding sequence
atggctaagcagcctagcgacgtgagtagcgagtgtgacagggagggcagacagcttcagcctgctgagaggcctcctcaattgaggccaggggcaccaaccagccttcagacagagccacaaggcaatccagagggcaaccatggcggtgaaggggacagctgcccacatggatccccccagggacctcttgcaccccctgcaagccctgggccattcgcaacccgcagcccgctcttcatattcatgcgccgtagctcactgctgtcgcggagctcatcaggctatttctccttcgatactgataggtcacctgcccctatgagctgtgataaatcgacgcagacccccagccccccttgccaggccttcaatcactacctgagcgctatggcctcaatgaggcaagctgaacccgcagacatgcgaccggaaatctggattgctcaggagctgcggagaattggcgatgaatttaatgcgtactacgcacgacgcatgccactgccaccagactag

SEQ ID NO: 27501 - DNA, 219 bp, Artificial Sequence
  Description of Artificial Sequence: Synthetic coding sequence
atggccaagcagccatccgatgtcagctcagagtgcgatcgcgagggcagacagctgcaacccgcagagcggccaccccagctccgccctggcgctcctacttctctgcagactgagcctcaggggaatcccgagggaaaccacggaggggaaggggatagctgccctcacggatcaccccaagggccactggctcccccagcaagcccaggaccctag

SEQ ID NO: 27502 - DNA, 258 bp, Artificial Sequence
  Description of Artificial Sequence: Synthetic coding sequence
atggcaaagcaaccctccgacgtgtcgagcgagtgtgaccgcgaaggcaggcaattgcagcctgcagagcgccctccacagctcaggccaggggcaccaacgtcactgcagaccgagccccaagcctccatgagacaagctgagcctgctgatatgcggccagaaatctggatcgctcaagagttgagaaggatcggggacgagtttaacgcctactacgctcgaagacttgctaagctgttggccagctcaacatag

SEQ ID NO: 27503 - DNA, 597 bp, Artificial Sequence
  Description of Artificial Sequence: Synthetic coding sequence
atggccaaacagccctctgatgtgagctcggagtgtgatagggagggcagacagctgcagccggcagaaagacccccacagctacgtccaggggctcctacatccctccagaccgaaccacagggtaacccagaagggaatcacggcggtgagggggacagttgtccgcatgggagccctcaaggaccattggctccacctgcatccccagggccatttgccacccgatcccctctgttcatcttcatgcgtcgctccagcctgctgagcaggagttcaagtggatacttttcattcgacacggacaggtctccagctccgatgtcttgtgacaagtccacacagaccccatcccccccatgtcaggccttcaatcattacttgtccgctatggcctccatgagacaagctgaacctgccgacatgaggccagagatctggattgcacaggaactgcgcaggatcggggacgagtttaatgcctattacgccaggagggtcttcctaaataattaccaagcagccgaagaccacccaaggatggtgattctcagactgctgcgatacatagtgcggctggtgtggcgcatgcactag

SEQ ID NO: 27504 - DNA, 369 bp, Artificial Sequence
  Description of Artificial Sequence: Synthetic coding sequence
atggccaaacagccatccgatgtaagcagcgagtgcgaccgagaggggaggcagctccagcctgccgagcggccaccgcagcttcgcccaggcgcaccaacatcattacagaccgaaccacagggcaatcccgagggtaaccacggtggagagggtgacagctgccctcatgggtcaccccaaggccctctcgcaccgcctgcaagtcctggtccttttgcaactcgttctcctctgttcattttcatgcggagaagcagcctactgtcccgctctagtagcggatactttagtttcgatacggataggtcacctgctcccatgtcatgcgacaaaagcacccagacaccgagccctccttgccaatag

SEQ ID NO: 27505 - DNA, 222 bp, Artificial Sequence
  Description of Artificial Sequence: Synthetic coding sequence
atgaggcaggcagaaccagccgatatgcgaccggagatttggattgcccaagaactgcggcgtatcggagacgaattcaatgcctattatgcccgaagagtaatgatgttttccctgccagctttccttctcaccccctctccatctaccctgtacttctttaagaaaacagtcacgtcttgtaactatatgctgatcctggagatgatcacagtggcctag

SEQ ID NO: 27506 - DNA, 243 bp, Artificial Sequence
  Description of Artificial Sequence: Synthetic coding sequence
atggccaaacagccttctgacgtctcttctgaatgcgatcgtgaaggccgacagctccagcccgcagaaaggcctccccaactgagacccggagcacctacatcccttcagactgagccccaggatagatccccggcacctatgtcctgcgataagagcacccagacaccaagcccaccttgccaggcctttaatcactacctgtccgccatggtgagggaaatcgaagaggtagtggtgtag

SEQ ID NO: 27507 - DNA, 408 bp, Artificial Sequence
  Description of Artificial Sequence: Synthetic coding sequence
atggcgaagcaaccatccgatgtcagctcagaatgtgaccgggaaggtcggcagttgcagccggcagagaggcccccacagctgcgccctggagctccaacctcactgcaaaccgaaccacagggcaatcctgaaggcaatcacggcggagaaggggatagttgccctcacggttcaccccagggtccactcgcacctccagcctctcccggacccttcgctacaagatctcctctgttcatattcatgcgaaggagctctctgttatctcgatcctcatctggctatttttctttcgacacagacaggagcccagccccaatgagctgtgataagtcaactcaaactccgagccctccctgccaggcgtttaatcattaccttagcgctatggcaaattgggattag

SEQ ID NO: 27508 - DNA, 423 bp, Artificial Sequence
  Description of Artificial Sequence: Synthetic coding sequence
atggccaaacaaccttcagacgtgtcgagtgagtgcgatcgcgaggggcgtcagctgcaacctgccgagcgtccaccacagctccgacccggagcgccaactagcctgcagacagaaccacaaggtaatccggagggcaatcatggtggcgagggagactcttgtccccatggaagtcctcaaggtcctctggcccctccagcatcccctggtccctttgccactagatctcctctgtttattttcatgagacggtcctccttactgtctcgctccagtagcggctatttctccttcgatacagacaggtctccagcacccatgtcatgtgacaagagtacacagactccttcccccccttgccaagcctttaaccactacctctcagcaatggtccgcgaaatagaggaggtcgttgtgtag

SEQ ID NO: 27509 - DNA, 291 bp, Artificial Sequence
  Description of Artificial Sequence: Synthetic coding sequence
aaacagccgagcgatgtgtctagcgagtgtgatagagaaggcaggcaactgcagccagcagaacggccacctcagttgcgacccggagcaccgacatctctgcagacagaaccacaagacagatcccctgcccctatgtcgtgtgataagagcacgcagacccctagcccaccgtgccaggcgttcaaccactacttgtccgccatggatgactcggctggcagctcccttcgaatagccctgcaccgggaagtccagtggcctctgaaatggctcgctaagagtagctag

SEQ ID NO: 27510 - DNA, 249 bp, Artificial Sequence
  Description of Artificial Sequence: Synthetic coding sequence
atggccaagcagccctcagacgtcagctccgagtgcgaccgcgaaggaagacaactgcagcccgcagagagacctccccagctaagaccaggggctcctacctccctacagaccgagccgcaggcttccatgaggcaagcagagcctgctgacatgaggcctgaaatctggattgcacaggagcttaggagaattggtgatgaatttaacgcctattacgctagaaggatgccactaccgcctgactag

SEQ ID NO: 27511 - DNA, 582 bp, Artificial Sequence
  Description of Artificial Sequence: Synthetic coding sequence
atggcaactccagcgtccgcccctgatacccgcgctctggtcgccgattttgtgggatacaagctacgtcagaaaggatacgtttgtggcgctgggccaggtgagggcccagctgccgacccactgcaccaggcaatgcgggctgccggagacgagtttgagacccgattccgtagaacattcagtgacctggccgcacaactgcatgtgacacccggtagcgcccagcagagattcacccaggtaagcgacgaactttttcaaggaggacccaactgggggcgactggtagcgttcttcgtctttggcgctgccctgtgtgcggaatcggttaataaggagatggaacctctggtcgggcaggttcaggagtggatggtggcataccttgagactcagctggcggattggatccactcctccgggggttgggccgagtttaccgccttatacggggacggagccttggaagaagcgcgaagactgagagaggggaactgggcatcagtaaggacggtcctgacaggcgctgtcgccttaggcgcattggttactgtgggggcatttttcgcctcaaaatag

SEQ ID NO: 27512 - DNA, 156 bp, Artificial Sequence
  Description of Artificial Sequence: Synthetic coding sequence
atggcaacacctgcgtcggcccctgatacgagagcactggtcgcagattttgttgggtataaactgcgtcagaagggatatgtctgcggtgcaggaccaggggagggtccggctgctgacccactgcaccaggccatgagggctgctggcgattag

SEQ ID NO: 27513 - DNA, 219 bp, Artificial Sequence
  Description of Artificial Sequence: Synthetic coding sequence
atggccacacctgcctcggccccagatacgagggcactcgttgcggatttcgtgggatataagctgcgccagaagggctacgtctgcggcgcaggacctggggaagggcctgcagccgatccactgcaccaggccatgcgggcagcaggggacgaatttgagacgagattccgccgtactttttctgatctggccgctcagctgcacgtaacaccatag

SEQ ID NO: 27514 - DNA, 450 bp, Artificial Sequence
  Description of Artificial Sequence: Synthetic coding sequence
atggctactcccgcatcagcccctgacaccagagctctcgtcgccgacttcgtcggatataagctccgacagaaaggctatgtctgtggcgctgggccaggtgaggggcctgctgcagatcctcttcaccaggcaatgagggcagcgggagacgagtttgagacacggtttagacggactttttccgatttagcagcccagctacatgtcacccccggttccgcccagcagagattcacccaggtttctgatgagctatttcaggggggaccaaattggggcaggctcgtggcgttctttgtctttggcgcagccctctgtgcagagagcgtgaacaaagaaatggagccactcgtagggcaggtacaggaatggatggtggcatacttggagacccagctggcggactggattcattcttcaggcggatgggcagaatttacagcctag

SEQ ID NO: 27515 - DNA, 435 bp, Artificial Sequence
  Description of Artificial Sequence: Synthetic coding sequence
atggctacacctgcttccgcccctgacactcgcgctctagtcgccgactttgtaggatacaaactgcgccagaagggctacgtgtgtggagccggaccgggtgaaggcccagccgctgatccactccaccaggccatgcgcgctgccggagacgagtttgaaacaaggttccgccgtacattttctgatctcgcggctcagctccacgtgacccctggaagcgctcagcagagattcacccaggtaagcgacgaattgttccagggcggaccaaattgggggaggctcgtggctttctttgtgttcggcgctgctctgtgtgccgaaagcgtgaataaagaaatggaaccccttgtgggacaggtccaagaatggatggtcgcctatttggagactcagttggctgactggatacattcctcagggggttggtag

SEQ ID NO: 27516 - DNA, 528 bp, Artificial Sequence
  Description of Artificial Sequence: Synthetic coding sequence
atgaccgactgcgagtttggctatatctatcgattggcccaggactacctccagtgcgtcctgcagatcccacagcctgggtccggccctagtaaaacctccagagtgttgcagaacgtggccttttcagtacagaaagaggtggagaaaaacctgaaatcctgcctggataacgtgaacgtggtgtctgtagacactgcacgcaccctctttaatcaggtaatggaaaaggaattcgaagacggtattatcaactggggacggatcgtcaccatttttgcctttgagggaatactcatcaaaaaactactgcgacagcagattgccccagacgtcgacacgtacaaagagataagctattttgttgccgagttcataatgaataacacaggagagtggatcaggcaaaatggtgggtgggaaaacggctttgtgaagaagtttgaaccaaagtcaggctggatgacatttctggaggttactggtaagatttgtgaaatgctgtcgctgttgaagcagtactgctag

SEQ ID NO: 27517 - DNA, 492 bp, Artificial Sequence
  Description of Artificial Sequence: Synthetic coding sequence
atgaccgactgcgagtttgggtatatttatcgactggcccaggactaccttcagtgcgtcctccagattccccaaccagggtcagggcctagtaagacaagtcgcgtgctacagaacgtggccttctccgtccagaaagaagtcgagaagaatctgaagtcatgtttagataatgtgaatgttgtctctgtagacactgcccgaacactcttcaaccaggtgatggagaaggagttcgaggatgggattatcaactggggcaggattgttacgatcttcgcgtttgaaggcattctgatcaaaaagttgcttaggcagcagattgcccctgatgttgacacctacaaagagatcagctatttcgtagcggagtttattatgaacaatacgggggaatggattcgacagaacggcggttggggcaagtggcacaatcacacgcctatgctggtggagagcgtggcccacaagaaacgtaaaatggccctatag

SEQ ID NO: 27518 - DNA, 726 bp, Artificial Sequence
  Description of Artificial Sequence: Synthetic coding sequence
atgtgctcaggcgctggggtaatgatggcaagatgggccgcacggggacgggcaggttggcgttcgactgtcaggatcctcagtccactcggccactgcgaaccaggcgttagtaggtcttgtcgagccgctcaggccatggattgcgaggtgaacaacgggtcaagcctcagagatgagtgcattaccaaccttctcgtgttcggctttctccagagttgcagtgataatagtttccggagagaactggatgctctgggtcacgaattgcccgtgttggctccccaatgggaagggtatgatgagctgcagaccgatggcaaccgatcctcccattcgaggctaggaaggatcgaagctgacagcgagtcccaggaagatattattagaaacattgccaggcacctagcccaggtgggtgacagtatggacagatccattcctccaggattggtaaacggactggcccttcagctccggaacacctctaggtctgaagaagatcggaaccgggatttggcaaccgctctcgaacaactgctgcaggcgtacccgagagatatggaaaaggagaagaccatgctggtgctggcccttctgctggccaaaaaggtggcaagccacaccccgtctttgctacgtgacgtgttccacaccacagtgaattttattaaccagaacctgcgaacatatgtcagatcccttgcccgtaacggcatggactag

SEQ ID NO: 27519 - DNA, 414 bp, Artificial Sequence
  Description of Artificial Sequence: Synthetic coding sequence
atggattgtgaggtcaacaacggaagtagcttacgcgacgagtgcataacaaacctgcttgttttcggcttcctgcagtcttgcagtgacaattcttttaggcgtgagttggatgctctgggacacgaactgccagttctcgcgccacaatgggaggggtacgatgaattgcagaccgatggcaaccggagctctcacagccggctcggacggatcgaggctggtgcgtctgacaacaacacagcaagtgccgaggaggaaactgaggccgcagggtccgtcgcagtggagcgcggtctgcacggggctgccactgtgattttgaaggtcaaaaaaactagtagcgggatcctccccggaacatcccctcggtcagggacagcatggaccgtcgcgtctctgcgcgcttggtag

SEQ ID NO: 27520 - DNA, 300 bp, Artificial Sequence
  Description of Artificial Sequence: Synthetic coding sequence
atggacaggtccattcctccaggactggtgaatggcctagcgctgcagttgagaaatacaagtagatccgaggaggacaggaatagagatctggccaccgccctcgagcagctgctgcaagcatatcctagagacatggagaaggagaagacaatgctcgttcttgccctgttgctcgccaaaaaagtggcgtcccacactcctagcttgctcagggatgtgttccataccaccgtgaacttcatcaatcagaatttgcgcacctacgtgcgcagcctggcaagaaatggtatggactag

SEQ ID NO: 27521 - DNA, 300 bp, Artificial Sequence
  Description of Artificial Sequence: Synthetic coding sequence
atggatagatcgatacctccaggcctcgtgaacgggttagccctacagctgcgaaacacctctcgtagtgaggaagaccggaacagagacttggctaccgcgctggaacagctcctccaggcctatcctagggacatggaaaaagaaaagacaatgctcgtgttggcccttctcctggccaagaaagtagcatcacacaccccctcactcctgcgggatgtatttcacacgactgttaacttcatcaaccagaatttgcggacctacgtccgttccctggctaggaatggaatggactag

SEQ ID NO: 27522 - DNA, 588 bp, Artificial Sequence
  Description of Artificial Sequence: Synthetic coding sequence
atggattgtgaagtcaataatggaagcagcttgcgagacgaatgtatcactaatcttttagtgttcggctttctccagtcctgcagcgataatagctttaggcgtgaacttgatgctcttgggcacgagttgcccgttcttgcccctcagtgggaaggctatgatgaattgcagacagacggaaatagaagctcccactctcgcctcgggaggatcgaagcagactctgaaagccaagaggacatcattagaaatattgccaggcaccttgctcaagtgggcgatagtatggataggtccatcccacctggcttggtgaatggactggctctgcagcttcgaaataccagcaggtccgaggaggatcgcaacagagacctggccaccgcactcgaacagctccttcaggcctacccgagggatatggagaaggaaaaaacaatgctggtgctggctctcctgctcgctaaaaaagtggctagtcacactccgtcacttctgagagatgtgtttcacacgacggtcaactttatcaatcagaacctccggacatatgtgcggagcttggctcggaatggaatggattag

SEQ ID NO: 27523 - DNA, 588 bp, Artificial Sequence
  Description of Artificial Sequence: Synthetic coding sequence
atggactgcgaagtaaacaacggatccagcttacgtgatgagtgcattaccaacctcctcgtctttggcttccttcagtcttgctccgataacagtttccggcgagagcttgacgctcttggacacgaattacctgtgctagcccctcagtgggagggatacgatgagttacagactgacgggaataggtcatctcactctcgtcttggaagaatcgaggctgacagcgaatctcaggaagacataattcgtaatatcgcccgacatctggctcaggtgggagattcaatggatagaagtatccccccaggcttggtcaatggtctcgctctgcagctgcggaacacttcaagatccgaagaagataggaatagagacctggcaaccgcactggaacaactcctgcaggcctacccacgtgacatggagaaggagaaaaccatgctcgtcctggccttgctcctcgccaaaaaagtggcttcacacacaccctcactgttacgcgacgtgttccatacaaccgtgaacttcatcaaccagaacctgcggacctatgtgaggtcacttgccaggaacggaatggactag

SEQ ID NO: 27524 - DNA, 1353 bp, Artificial Sequence
  Description of Artificial Sequence: Synthetic coding sequence
atggaagagccacagaaatcttatgttaacacgatggatctggagagagatgagcctttgaaaagtaccggcccacagatttcggtgtccgagttttcctgtcattgctgttacgacattctggtgaaccccaccacactgaactgcggccattctttctgtagacattgtctggcattgtggtgggccagttcaaagaagactgaatgtcccgaatgcagagagaaatgggaaggttttcctaaggtctccattctccttcgcgacgctattgagaagttgtttcccgacgccatccggctgagatttgaggacatccagcaaaataatgacatcgtgcagtcgttggcagcgttccaaaagtacggcaatgatcaaatcccactggcccctaacaccggcagagccaaccagcaaatggggggaggtttcttcagtggtgtcttgacagctttgacaggcgtggccgtggtacttttggtctaccactggagttcgcgcgagagcgagcacgaccttttggtgcacaaggctgtggccaaatggaccgcagaggaggtcgtgctatggctcgaacagctggggccttgggctagcctctaccgcgagcggttcctaagcgagcgtgtgaatggccgtcttcttctcaccctaaccgaggaggagtttagtaaaactccgtacaccatcgaaaactctagccaccggcgagccattctgatggagctggaacgcgtcaaggcgctgggagtgaaacctcctcaaaacctttgggaatataaggccgttaaccctggccgatcactttttctcctgtatgcgttaaaatcatccccacggctctcccttctctatctctatctgttcgattacacagacacttttctgcccttcatccacacaatatgtccattacaggaggacagtagcggcgaggacatcgtcacgaagttgttggatctcaaggagcctacgtggaaacagtggcgggagttcctggtgaagtattcatttctgccgtaccagctgatagccgaatttgcctgggattggctggaagtccactactggacatcacgtttcctgataattaacgccatgttactttcagtactggaacttttctccttttggaggatatggagccgcagcgagctgaagaccgtcccacagaggatgtggagtcacttttggaaagttagcacccagggtctatttgtcgctatgttttggcccctcataccgcagttcgtatgcaattgcctgttttattgggccctctactttaatccaatcattaatatagatctcgtcgtgaaagagctgaggcgccttgagacccaggtattatag

SEQ ID NO: 27525 - DNA, 969 bp, Artificial Sequence
  Description of Artificial Sequence: Synthetic coding sequence
atggtgggaattttcaaggaaaacaggatgtctaggatgcagcggaaaatgggcagattcccccaatcccagtacagtccacaggtcgttctgcttgtttatcattggtctagtagagaatctgagcacgatctattggtgcacaaagctgtggccaaatggacggccgaggaagtcgtgctctggctagagcagttgggaccctgggccagcctgtatagggaaaggttccttagcgaaagggttaacggacgactgctgctcaccctcaccgaggaggagttcagcaagactccatacaccatcgaaaactctagtcacaggcgtgctatcttgatggagctcgagcgagtcaaagcccttggagtgaagccccctcagaatctgtgggagtacaaggccgtcaatcctgggcgttccctgttcctgctctacgccctgaagagttctcccaggttgtccctgctgtatctgtacctttttgattacaccgacacgtttctccccttcatccatactatatgcccactgcaggaggatagttcaggcgaggatattgtgactaaactgcttgaccttaaggagcccacatggaagcagtggagagagttcctcgtgaaatattcgttcctgccttatcagctcatcgccgaatttgcctgggattggctcgaggttcactattggaccagcaggttcctgatcattaatgcgatgctgctgtccgttctggagctattcagtttttggaggatctggtctaggagtgagctgaaaactgtgccccagagaatgtggagccatttctggaaggttagcacacaaggccttttcgttgctatgttctggcctctgattccacagtttgtctgcaactgcctcttctactgggcgctgtatttcaacccgatcattaatatcgaccttgtagttaaggagctacgcaggcttgaaactcaggtgttatag

SEQ ID NO: 27526 - DNA, 4254 bp, Artificial Sequence
  Description of Artificial Sequence: Synthetic coding sequence
atggctgccgtacctcagaacaatctgcaggaacagttggagaggcacagcgccaggacactgaacaataagctcagtctctctaagcctaaattcagcggatttacattcaagaagaaaacttcgtccgacaacaatgtgagcgtaacgaatgtaagcgtggcgaagactccagtgctgcggaacaaagatgtcaacgtgacggaggatttttctttcagcgagcctctcccgaatactactaaccaacagcgggtgaaagacttctttaaaaacgccccagccggtcaggaaacacaacgagggggaagcaaatctttgttaccggattttctgcagacacctaaagaggtggtttgcacgacccagaatacccccacagtcaagaaaagccgcgacacagcccttaagaagctcgagttttctagcagcccagactcactcagcacgataaatgactgggacgatatggatgatttcgacactagcgaaacatctaagagtttcgtgacaccaccccagagccatttcgttcgtgtgagcaccgcccagaagagtaaaaagggtaaaaggaatttctttaaagcccaactgtataccacaaacaccgtcaagacggacctgcctccgccatccagcgagtccgagcagatcgacttaaccgaagaacagaaggacgactcagaatggctgtctagtgacgtgatttgcatcgatgacggccctattgcagaggtgcacattaatgaggacgctcaagagagtgattctctgaaaacacatctcgaggatgaacgggataattcagagaaaaagaagaatctggaagaagcagagttacacagcaccgaaaaggttccttgcatcgaatttgatgatgacgattatgataccgatttcgttccaccttcccctgaggagattatatcggcctcaagctcctcatctaagtgccttagcaccttgaaagatctggacacctccgaccgcaaagaagatgtgctgtctacttccaaggatctgctgagcaagcccgaaaaaatgtctatgcaagaactaaaccccgagacctcaacggattgcgatgctaggcagatctctctgcagcagcaactcatccacgtgatggagcatatttgcaaactcatcgataccattcccgacgataaactgaaactgttggactgtggcaatgagttgttgcaacaacgtaatataagaaggaaacttctaactgaagtggacttcaataagagtgatgcttcactgctgggctcgttgtggcgctacaggcccgacagtctggacggccctatggagggcgactcttgtccgactgggaatagcatgaaggagctgaatttttcccacttgccatccaattcagtaagcccaggcgactgcctgctgactaccacgttagggaaaacaggattttccgcaacccggaagaatctatttgagcggccactgttcaatactcatcttcagaaatctttcgtctccagtaattgggcggagacccccagactagggaagaagaacgagtctagctactttccagggaatgtgctgacctccaccgccgtcaaggatcaaaacaagcacaccgcctctatcaatgaccttgaaagggaaactcagccctcttatgatattgataacttcgacatcgatgatttcgatgatgacgacgattgggaggacattatgcacaatttggctgcttcaaagagctcgaccgcggcataccagcccatcaaggagggcaggcccatcaagtccgtgtcagagcgactgagcagcgcaaagacagattgtctgcctgtctcgtcaacagcccagaatattaacttcagtgagtccatccagaattacacagacaaatccgcccaaaatctcgcttcccggaatctgaaacacgagaggtttcagtctctttcattcccccacactaaagaaatgatgaaaatatttcacaagaaatttggcctgcataatttccggaccaatcaactggaggcgatcaacgcggcactcctcggagaggattgctttatcctgatgcctaccggtggcggtaaatctttgtgctatcagctgcccgcttgcgtttcacccggagtcaccgtggttataagccctctccgcagcttgatcgtggaccaagtgcagaagttaacatctctagatattcctgcaacctacctgacaggagacaagacagattctgaagctacgaacatctacctgcagctctccaaaaaggatccaattatcaaactgctctatgtgacaccggaaaaaatctgtgcaagcaacaggctgatcagcactctcgagaacctgtatgagagaaaattgctggcaaggtttgtaattgatgaggcccactgtgtttctcagtggggacacgatttccgccaggattataaaaggatgaatatgcttcgacagaaattcccttctgttcctgtcatggcccttacggccaccgcaaatccaagagtgcagaaagatattcttactcagctcaaaattctgagaccgcaagtctttagcatgagctttaacaggcacaatttgaaatactacgtattgccaaaaaagccaaagaaggtggcctttgattgcttggagtggataaggaagcaccacccatatgattctgggatcatttactgcctgtctcgcagggagtgcgatacaatggccgataccctgcaaagagatggattggccgctctggcgtatcacgccggattgtcagacagcgctcgcgatgaagtccagcagaagtggatcaatcaggacgggtgtcaggtgatctgcgccactatagccttcggcatggggattgacaagcccgacgtgaggtttgtgatccacgcctctcttcccaagagcgtcgaggggtactatcaggaatcaggtagagccggacgggatggggaaattagtcactgtctgctgttctatacctatcacgacgtgaccagacttaagcggctgatcatgatggagaaggatggcaaccaccacacacgagagacccattttaacaatctgtatagtatggtgcattattgtgaaaacataaccgaatgccgcaggattcagctcctcgcatattttggggaaaacgggttcaatcctgacttttgcaaaaagcatccggacgtcagttgtgataactgttgtaagaccaaggactataagacacgcgacgtgaccgacgatgtgaagtcaatagttaggttcgtgcaggagcattcctctagccaggggatgcgtaacattaaacacgtcggaccaagcggcagatttactatgaatatgttggtcgacatcttcctaggttccaagtccgctaaaattcaatcaggaatattcgggaaaggatccgcgtattctcgtcacaacgccgagcgactgttcaagaagttaatactagacaaaattctggatgaagacctttacatcaatgctaatgaccaggcgatcgcttacgtcatgctgggcaataaagcacaaacagtccttaacgggaatctgaaggtcgatttcatggagaccgagaacagcagctctgtaaagaaacagaaagccctggtggccaaagtcagccaacgcgaggagatggtcaaaaaatgcctgggagagctgaccgaagtgtgcaaatccctgggcaaggtgttcggtgtgcactatttcaacatatttaacactgtaacgcttaaaaagctcgctgagagcttgagtagcgacccagaagtcttgctccaaatcgacggggtgactgaggacaagctagagaagtatggggcagaggttattagcgtgttgcagaagtacagcgaatggacatcgcctgctgaggacagctctcctgggatctcactgtctagctctaggggtcctggaagatccgccgcagaggagctcgatgaggaaattccagtttctagtcactatttcgcatctaagacaagaaatgagcgcaagagaaagaaaatgccagcaagtcagagatctaaaaggaggaagacggccagctctgggtctaaggctaaggggggttccgctacctgccgaaaaatctcttcaaagaccaaatcgagcagcatcattggctcttcatcagcgtcccacacttcccaggccacctccggagctaattcaaagttagggattatggcaccccctaaacctatcaaccggcctttcctgaagccttcgtacgctttttcctag

SEQ ID NO: 27527 - DNA, 3144 bp, Artificial Sequence
  Description of Artificial Sequence: Synthetic coding sequence
atgtccatgcaggaactcaatccagagaccagcaccgactgtgatgcaaggcagatcagcctccagcaacaactgattcacgtgatggagcatatttgtaaactcatcgataccatacccgatgacaagctgaagttgttggattgtggcaacgaactgctacagcagcggaatatacgtcgtaaactcttgactgaagttgacttcaacaagtctgatgccagtctgttgggaagtctgtggaggtaccgaccggactctcttgatggaccaatggaaggagacagctgtccgaccggaaacagcatgaaagagctgaatttctctcatctgcctagcaattctgtcagtccgggtgactgcctgctgaccaccacactgggcaagaccggcttctcagctacgaggaaaaatttgttcgaacggcctctgtttaatacccatctgcaaaagagttttgtttcatctaattgggctgaaacacctcgcctcggcaagaaaaatgagagctcttattttccagggaatgttctcacctcgactgccgtgaaagaccagaacaagcacaccgcaagcatcaacgatctggagcgggaaacacaaccaagctacgatatcgataattttgacatagacgactttgacgatgatgatgactgggaagacataatgcacaacctcgctgctagcaagtcctccacagccgcatatcagccaattaaagaagggagacctataaagtccgtgtccgagcgccttagttcagccaagactgactgcctcccagtgagctccacagcgcagaacatcaatttttcagagtccatacagaattacacagacaagagcgcccaaaacctggcttcccggaaccttaagcacgagaggtttcaatccttgtctttcccgcacactaaggaaatgatgaaaatcttccataaaaaattcggcctgcacaacttccgaacgaatcaacttgaggccattaacgcagcactgctcggggaagattgtttcatcctaatgcctacagggggtggaaaaagcctgtgctaccaattgcctgcatgtgtcagcccaggggtgacggttgtgatttctccgctcaggtccctcatcgtcgaccaggtgcagaagcttacaagtctcgacattccagccacttaccttactggagacaagactgactctgaagctaccaacatctatcttcagctgagtaaaaaggatcctattattaagctgctttatgtaacacctgaaaagatttgcgcatccaataggcttatatcaactctggagaacctgtatgagcggaaacttttagcgaggtttgttattgacgaggcccactgtgtatcacagtggggacatgatttccggcaggactataaaagaatgaatatgctcagacaaaagtttcccagtgtgcccgtgatggcgctgaccgccactgccaatcctcgggtgcaaaaggacattctcactcaattgaagattctgcggccacaggtgttctctatgagcttcaatcgccataacttaaagtactatgtgctccctaaaaaaccgaagaaggttgcttttgactgcttggagtggatcaggaagcaccatccctacgactccgggattatatattgtttaagcaggagagaatgtgacacaatggctgatactttacaaaagtggattaaccaggacggctgccaggttatatgtgccactatcgctttcggtatgggcatcgataaaccagacgtcagattcgtgattcacgcctctctgcccaagtctgttgaaggctactaccaagaatctggccgagcaggcagagacggcgaaatctcacactgcctgctgttctatacttatcacgacgtcaccaggttgaagaggctaatcatgatggagaaagatggcaatcaccacacgagggagacacactttaacaacctatatagtatggtccactattgtgagaatataacagagtgcagaaggattcagctactagcctactttggtgaaaacggattcaaccctgacttctgcaaaaagcatccagacgtgtcctgcgacaattgttgcaaaaccaaggattataagactcgggacgtgaccgatgacgtgaaatccatagtcaggtttgtgcaggaacactcgagctctcagggtatgcgcaatatcaaacacgtagggccatcaggccgtttcacaatgaacatgctcgttgacattttcttaggctcaaagtctgcaaagattcagtcaggcattttcggaaagggcagcgcctacagcagacacaacgccgagcggctattcaagaaacttatcctcgacaaaatccttgacgaggacttgtatatcaatgccaacgatcaggcaattgcttatgtgatgcttggcaacaaagctcaaacggtgctgaacgggaatctaaaggtggactttatggaaacggaaaacagcagctcagtgaagaagcagaaggcgctcgtcgccaaagtttcccaacgggaagagatggtgaagaaatgcctgggggagcttaccgaggtgtgcaaaagcttgggcaaggttttcggggtacactattttaacattttcaataccgtgactctgaagaaactggccgaatccctatcaagcgatcctgaagttctcttacagattgacggcgtcactgaggataagcttgaaaagtacggcgctgaagtcatctctgtattgcagaagtactcggagtggacctctcctgccgaggacagtagccccggtataagcctgtcaagtagccgcggacctggccgatcagccgctgaggagttggacgaagaaatccccgtgagcagtcactatttcgcatctaaaaccagaaatgagcggaagaggaagaagatgcccgcatcacagagatccaaaagaagaaagaccgcctcgtccggttctaaagccaagggtgggtccgcgacctgcagaaaaatctccagtaagaccaaatccagttcgattatcggatcatcaagcgccagtcacacttcccaggctacttctggggcaaatagcaagctcggaattatggcaccccctaagcctattaataggcccttcttaaaaccaagttatgccttctcatag

SEQ ID NO: 27528 - DNA, 1560 bp, Artificial Sequence
  Description of Artificial Sequence: Synthetic coding sequence
atgaatatgctccgccagaaattcccatcagttccggttatggcactgactgccaccgcaaaccctagggttcaaaaggacatccttacccagctgaagatccttcgtccgcaggtcttttccatgtcctttaaccgacataatcttaaatattatgtgctaccgaaaaagcccaagaaggttgcatttgactgccttgaatggattagaaagcaccatccatacgattcaggtattatctattgtttgagccgccgtgagtgtgataccatggccgacacactgcagcgcgatgggctcgctgctctggcctatcacgctgggttaagcgacagcgcaagggacgaagtgcaacagaaatggatcaaccaggatggctgtcaggtgatctgcgctacaatcgcatttgggatgggcatcgacaaacccgacgtgcgtttcgtaatacatgcgtctctcccaaagtctgtagaagggtattatcaggagagcggaagagctggacgtgacggtgagatcagtcactgccttctgttttatacataccatgatgtgacccgcttgaagcgcctgattatgatggagaaagatggcaaccaccacacacgggagacccacttcaataatctatatagtatggtgcactattgtgagaatataacggagtgccggaggatccagctgcttgcatatttcggggaaaacgggtttaatcccgacttctgcaagaaacaccctgatgtcagttgtgacaactgttgcaagaccaaggattataagactagggatgtaaccgacgatgtaaaatcaattgtgaggtttgtccaggagcattcttcctcgcaggggatgcgaaacatcaagcacgtaggaccaagcggcagatttacgatgaacatgctcgtggatatctttctcggatccaagtcagccaagattcaaagtgggattttcggcaagggttcagcatattcccggcacaatgccgagaggctgttcaagaaactgatcctcgacaaaatcttggacgaggatctatatattaacgctaatgaccaggccattgcttacgttatgctcgggaacaaagcccagactgtcctgaacggcaatctcaaggtagacttcatggaaaccgagaattcaagcagcgtgaaaaagcagaaagcccttgtcgcaaaggtttcgcagagagaagagatggttaaaaagtgcctgggggagctcaccgaggtgtgcaagagtctcggtaaggtgttcggcgtgcactatttcaacattttcaacacagttacactaaagaagttggctgaatctttgtcatctgacccagaggttctgcttcagatcgacggggtgacggaagacaaattagagaagtacggcgcagaggttattagtgtgctgcagaaatactcggagtggacatctcctgccgaggatagttctcccggaatcagcttgagcagtagccgtgggccaggccgttctgcggcagaggaactggacgaggagatcccggtcagctcccactatttcgctagcaagactcgtaattag

SEQ ID NO: 27529 - DNA, 981 bp, Artificial Sequence
  Description of Artificial Sequence: Synthetic coding sequence
atgcaccggaccacccgcattaaaatcaccgaattaaacccacacctgatgtgtgtgctttgcggaggctatttcattgacgcgactacgattatcgagtgtctgcactccttttgcaaaacttgtattgtacggtatcttgaaaccagcaagtactgccctatttgcgacgtgcaggtgcacaagactcgtcccttattgaatatccgctcagacaagacgctccaagatatagtgtacaaattagtgcctggcctcttcaagaatgaaatgaaacggcgacgcgacttctatgccgcacatccttccgcggatgctgcaaatggctccaacgaggacagaggagaggtggccgatgaggataaaaggatcatcaccgatgacgaaattatttccctcagcatcgaattctttgatcagaacagactggatcggaaggtgaacaaggataaagaaaagtctaaagaagaggtcaacgacaagagatacctgagatgtccggcagccatgaccgtcatgcatctgaggaagttcctccggagcaaaatggacatcccgaacacattccagatcgatgtcatgtatgaggaggagccattgaaggattactatacactgatggacatcgcatatatatacacatggagaagaaatggaccattaccactcaaatatagggtgcgccctacttgcaagcgaatgaagatctcacaccagcgggatggtctaactaacgccggtgagcttgaaagcgattctggaagcgataaggcaaacagtccagcaggcggtatccccagtacctctagttgcctgccaagcccatcaactcctgtacaatcccctcacccacagttcccccatattagctctacaatgaatggcacatccaactctccttctgggaaccatcagtcttctttcgccaacagaccgaggaagtcatctgtgaacgggtcaagcgcaacatcgagtggctag

SEQ ID NO: 27530 - DNA, 717 bp, Artificial Sequence
  Description of Artificial Sequence: Synthetic coding sequence
atgtgtgtgctctgtgggggatattttattgacgctactaccatcatcgaatgtcttcacagtttttgtaaaacctgtatagttcgatacctagagacttccaagtattgtccgatctgcgatgttcaggtgcacaaaactagacccttacttaacatccgtctagacaggaaagtgaacaaagacaaagagaagtcgaaagaagaggtgaatgataaacggtatctaaggtgcccagccgctatgaccgtcatgcacttgcgcaagtttctgaggagtaagatggatatacccaacacatttcagattgatgttatgtatgaggaggagcctctgaaggattactacacactcatggacattgcgtatatctatacctggcgtaggaacgggcctctcccattaaagtaccgtgtcagacctacatgcaagcggatgaagatttctcaccagcgggatggcctgactaacgctggggaactcgagtcagattcaggctctgacaaggcgaactcccctgctgggggtatcccatctacctcatcatgtctcccgtcaccctcaacacctgtgcagtcaccacacccacagttcccccatatatcctcgactatgaatggaactagtaacagtccttcgggcaaccaccaatcatcctttgccaaccgtccacggaaaagctcagtgaacggctctagcgctactagcagtggttag

SEQ ID NO: 27531 - DNA, 318 bp, Artificial Sequence
  Description of Artificial Sequence: Synthetic coding sequence
atgcatcgtaccacacggatcaagatcactgaattgaaccctcacctcatgtgcgtgctctgcgggggttatttcattgatgccactactatcattgaatgtttgcactccttctgcaaaacgtgcatcgtgagatatctggaaactagcaaatattgccccatttgcgacgtgcaggtgcacaagacgagaccccttttaaacatacgaagtgataagacacttcaggatatagtgtataagctggtcccagggctgttcaagaacgagatgaagcgacgcagagacttttacgccgcacacccgtccgcagactag

SEQ ID NO: 27532 - DNA, 624 bp, Artificial Sequence
  Description of Artificial Sequence: Synthetic coding sequence
atgcacagaaccacacggattaaaatcaccgagcttaatccgcacctgatgtgtgttctgtgcggcggttattttattgatgccacgacgattatcgagtgtttgcatagtttttgcaaaacatgtattgtcagatatcttgagaccagcaagtactgcccgatctgtgatgtccaggtgcacaagacacgcccactgctcaacattaggagcgataagactctgcaagacatcgtgtataagctggtgccgggactttttaaaaatgagatgaagaggcgtagagatttttacgctgcccacccttcggccgacgctgctaatggatctaacgaggataggggggaagtggccgatgaggacaaaaggatcatcaccgatgatgaaatcatcagcctgtcgatagagtttttcgatcagaataggctggatcgtaaggtgaacaaagataaggaaaagtcgaaggaggaagttaatgacaagagatatctcagatgccctgcagccatgacggtgatgcacctgcgtaaattcctgaggagcaagatggacattcccaatacttttcagattgatgttatgtatgaggaggagccacttaaggattattacaccttgatgtag

SEQ ID NO: 27533 - DNA, 453 bp, Artificial Sequence
  Description of Artificial Sequence: Synthetic coding sequence
atgcaccgcaccactcggatcaaaatcacggagctaaaccctcacctaatgtgcgtgctctgtggagggtattttatcgacgccacaacaattattgagtgtcttcattcgttttgcaaaacctgcatagtgaggtacctggagacgtccaaatattgccctatctgcgacgttcaggtgcacaagaccagacccctgttgaacattcgcagcgataaaacgttacaagacatcgtttacaagctcgtgcccggactattcaagaatgagatgaagcgcaggagagacttttatgccgctcacccaagcgcggacgccgctaatggatccaacgaagaccggggagaagtcgcggacgaagataagaggattatcaccgatgacgagattataagcctttccattgagttttttgaccaaaaccgccttgaccggaaagtgaataaggactag

SEQ ID NO: 27534 - DNA, 555 bp, Artificial Sequence
  Description of Artificial Sequence: Synthetic coding sequence
tacttcattgatgccacaaccataatcgagtgcctgcacagcttctgtaaaacatgtatcgtgcggtatctagagacaagtaaatactgtccaatctgcgatgttcaggttcataaaaccagaccgttgctgaatatacgcctggaccgcaaggtgaataaagacaaggagaagtcaaaggaagaggtgaacgataagagatatttacgctgtcctgctgctatgaccgtgatgcacctgcgaaagtttctgcgcagtaaaatggatattcccaatacatttcagatcgatgtcatgtacgaagaagaacctctgaaggactactacacattaatggatatcgcctatatctatacatggaggaggaacggcccactgccccttaagtaccgtgtaagacccacgtgcaaacgcatgaagatctcgcaccagagggatggattgactaacgccggagaactcgaaagtgattctggaagcgacaaggccaatagccccgcaggaggcatacctagtaccagctcatgcctaccctcccccagcacgccagtttag

SEQ ID NO: 27535 - DNA, 279 bp, Artificial Sequence
  Description of Artificial Sequence: Synthetic coding sequence
atgcatagaacaacaagaataaagatcaccgaacttaatccgcatcttatgtgcgtgttgtgtgggggatactttatcgacgctaccaccattatcgaatgtctgcatagcttttgcaagacatgtatcgtcagatatctggaaaccagcaagtattgtcccatttgtgacgtccaagttcacaaaacccgacccttgctgaatatcagatcagacaagaccctccaggatatcgtgtataagctggttcccggactgtttaccgctaacggatcttag

SEQ ID NO: 27536 - DNA, 2193 bp, Artificial Sequence
  Description of Artificial Sequence: Synthetic coding sequence
atgcccggtgttgcaagactcccactcctcttaggcttattgcttcttccaagaccgggaaggccgctggatctcgcggattatacctatgaccttgctgaggaagacgattctgaacctctcaattataaagatccctgtaaggccgctgccttcttgggggacatcgccctcgatgaagaggacctgcgcgcatttcaggtacagcaggccgtggatctgcgccgtcatacagccaggaaatcctctatcaaggccgcagtgccaggcaacacaagcactcccagttgtcagtccactaacgggcagccccaaagaggtgcatgtggtcgctggcgagggaggtctcgcagcaggcgagctgctacctcccggccagagagggtttggcccgatggagtgattcctttcgtcatcggcggaaattttaccggatcccaaagggcggtcttcagacaagcaatgcggcattgggagaagcacacctgcgttactttcctcgaacgcacagatgaggactcctacatcgtatttacctaccgaccctgtggttgctgtagctatgtgggacggcgtggcggtgggccacaggctatttccatcgggaaaaactgtgacaagttcggcatagtggtgcacgagctcggccatgttgtgggtttttggcacgaacacacccgaccagatcgggatcgccacgttagcatcgtcagagagaacattcagccagggcaggaatacaacttccttaagatggaacctcaggaggtcgagagcctgggagaaacatacgactttgatagcatcatgcattacgcgagaaatacattcagccgcggaatattcctggataccatcgtccccaagtacgaagtgaatggtgtgaagccgcctattggccagaggaccaggctgagcaaaggcgatattgcacaggcacgaaagctgtacaaatgtccagcttgcggcgaaaccttgcaggattctactggtaacttttcgtcaccagagtaccctaacggttattccgctcatatgcactgcgtgtggcgcatcagcgtgacccccggtgaaaaaattattctcaacttcacatcccttgacttgtatagaagcagactgtgctggtacgactacgttgaagtccgtgacggtttttggcgaaaggctccacttagaggcaggttttgtgggtcaaagctgcctgaacccatcgttagcaccgactccagactgtgggtggagttccgctcgtcatctaactgggtgggcaaagggttctttgcggtttatgaggccatctgcgggggagacgtcaaaaaggactatgggcacatccaatcccccaactaccccgacgactatcggcctagcaaggtttgcatttggaggatacaggtgagtgaggggtttcatgtgggtttgacattccagtctttcgaaatagagcgacacgattcctgtgcatatgattatcttgaggtgagggacggtcattcagagagttccactctgattggccgttactgcggatacgaaaagcctgatgacataaaatccacatcctctcggctttggctgaagttcgtttcggacggttcgataaacaaggccggtttcgccgttaacttctttaaagaggttgacgagtgtagtaggccaaacagggggggatgtgaacagcgctgcctaaataccttgggcagttacaaatgtagttgtgatccagggtacgagctagcaccagataagcgcagatgtgaggcagcatgtggaggcttcctgaccaagcttaatggttcaatcacctcccccggatggccgaaggagtatcctcctaacaaaaattgcatttggcaactcgttgcacccacccaatataggatctcacttcaatttgacttttttgagacagaggggaacgacgtctgtaagtatgactttgtggaggtgaggtctgggcttacggctgactctaagttgcatgggaagttctgtggttctgaaaagcctgaagtgatcacatctcagtacaacaacatgcgcgtagagttcaagtctgataatactgtctcgaaaaaaggattcaaggcccattttttttcagagaaacgtcctgccctgcagccccctagaggcagaccgcaccagttgaaattccgcgtacagaagcgaaataggacgcctcaatag

SEQ ID NO: 27537 - DNA, 2961 bp, Artificial Sequence
  Description of Artificial Sequence: Synthetic coding sequence
atgccgggtgtggccaggctccccctattactcggcctgctgctgcttcctagacctggtcgccctttagatctggccgattatacttatgatctcgccgaagaggacgacagcgagccactgaattataaggatccctgcaaggccgcagctttcctcggagacatcgcactcgatgaagaagacctgagagcctttcaggtgcaacaagccgtcgatctccggaggcataccgccagaaagtcaagcatcaaagcagccgtccctggcaatacgtcaacccccagttgtcagagcacgaacggtcagccgcagcggggagcatgcggtcgatggcgcggacggtcccgatctcggagggctgctaccagcagaccagagagggtctggccagatggggtcatacctttcgttatcggcggtaacttcaccggttcgcagagagccgtgttccggcaagcaatgcggcactgggaaaagcacacgtgcgtgacatttctcgaacggactgacgaggactcctatattgtgttcacttaccgcccttgtggttgttgcagctacgtcggacgccgaggcggaggccctcaggctataagtatcggaaaaaactgcgataaatttggcatagttgtgcatgaactgggacacgtggttgggttttggcacgaacacacccgcccagacagagatcgccatgtgtctatcgtccgtgaaaatattcagccagggcaagagtataatttccttaagatggagcctcaggaggtggagagtctgggcgagacatacgatttcgatagcattatgcattatgctcggaatacctttagtcgaggtatattccttgacactattgtacctaagtatgaagttaacggagtgaagccaccaatcggacagagaacgcggttaagtaagggggacatcgcacaggcccgaaaactatacaagtgccccgcttgcggagagactctgcaggattctaccggcaatttctccagtccagagtacccgaacggttattcagcccatatgcattgtgtttggcgtatctcagtcacacccggtgagaagatcatcctgaacttcaccagcctggacctgtaccgctccagactgtgctggtatgactatgttgaggttcgagacggattctggcgcaaggcaccactgcggggtaggttttgcggttccaagctcccagagcccattgtgtctaccgacagcaggttgtgggtcgaatttcgttcaagctccaactgggtcgggaaaggctttttcgcggtgtacgaagcgatctgcggcggagatgttaaaaaggactacgggcacattcaatcccccaactatcccgatgattacagaccgtctaaagtctgcatctggagaatccaggtgtccgaagggtttcacgtcggcctgacattccagagcttcgagatcgagcgacacgatagttgcgcgtatgactaccttgaagtgcgggacggccactcagaatcaagcaccttgatcggtcgctactgcggatatgagaaacctgatgatattaagtctacatcaagccggctgtggctcaagtttgtaagtgatggttctatcaataaagccggatttgccgtcaatttcttcaaggaagtcgacgaatgtagcaggccaaaccggggtggctgtgagcagcggtgccttaatacattaggtagctacaagtgctcgtgcgatccagggtatgagctcgcccctgacaagcgtagatgtgaagccgcttgcggtgggttccttacgaaactgaacgggagcatcacgtccccaggttggccaaaagagtatcctcccaataaaaattgcatttggcagctcgttgctccaacccagtatagaatcagtctgcagttcgattttttcgagacagaaggaaacgacgtatgcaaatatgatttcgtagaagtgcggtccggactcacggccgacagtaagctgcacgggaaattctgcgggagtgagaaaccagaagttatcacctcccagtacaacaatatgcgggtcgaatttaaaagcgataataccgtctcaaagaagggattcaaggcgcattttttctccgacaaagacgaatgcagtaaggataacggaggctgtcagcaagattgcgtgaacacatttgggtcatacgagtgccagtgtcgctccggcttcgttctgcacgataacaagcacgactgtaaagaggctggttgcgatcacaaggtgactagtacatctggaaccatcacaagtcccaattggcccgataagtatccttctaagaaggaatgtacttgggctatatctagtacaccaggacacagggtaaagcttaccttcatggaaatggacatcgaatcacagcctgagtgtgcatacgatcacctggaggtgttcgacggtagggacgctaaggccccagttcttggcagattctgtggatccaagaagccggagcccgtgctcgcaaccgggtcccgcatgtttttgaggttttattccgacaactccgtccagcgcaagggttttcaggctagccacgcaacagagtgcggaggccaggtgcgggctgatgtaaagaccaaggacctgtattctcatgcacaattcggtgacaacaactatccaggcggagtggactgcgagtgggtgatcgtggccgaagagggctacggggtggaactggtgtttcagacattcgaggtggaagaagagacagattgcggctacgattacatggaactgttcgatgggtacgattccacagctcctcgcttgggacgatattgcggatccgggccacctgaagaggtgtacagcgcaggcgactccgttttggtgaagttccatagtgatgatacaatcacaaagaagggattccatctaaggtacacatcgactaaattccaggataccctgcactcgcgcaaatag

SEQ ID NO: 27538 - DNA, 909 bp, Artificial Sequence
  Description of Artificial Sequence: Synthetic coding sequence
atgcccggtgtcgcaagacttccactgctcctgggattattactattacctcggcctggcagacccctggaccttgccgactatacatacgacctcgcagaggaagatgactcagaacctctaaattacaaagacccatgcaaagccgctgctttcctgggggacattgcgctagacgaagaggacctaagggcttttcaggtgcaacaggccgtagacttgagacggcacaccgctcgaaaaagttcaatcaaggcggcagtgcccggaaacacctcgaccccatcttgccagtccactaacggccagccccaaagaggtgcctgcgggcgttggagagggcgaagccgctcccgacgcgcagcaaccagcaggccagagcgggtgtggcccgatggagtaattccgttcgtcataggaggcaattttactggtagccagcgggctgtatttagacaggcgatgcggcattgggagaagcacacttgcgttacttttctggagagaaccgatgaggactcgtacattgtgtttacatatcgaccttgcggttgttgttcgtacgtcgggagacgaggaggaggtccacaggctatctccattgggaaaaactgcgataagtttggcattgttgtccatgaacttggtcacgtggttggattttggcacgagcacacacgccctgacagagatagacacgtcagcatagtgcgcgagaacatccagcccggtgtgcttcactcgagtctgctgctgctatcatgcgggtctagaaatggagcctcatttccatgttcactagagagtagcatacaccaggccttatgttggacgggactctttctgcggccatctccctttcctcggctccctctggcagcgcctagaacgttaagagctggagtgtag

SEQ ID NO: 27539 - DNA, 1869 bp, Artificial Sequence
  Description of Artificial Sequence: Synthetic coding sequence
atgccgggtgtggccaggctcccactcctgctgggcctgcttctcctgccgagacccggaagaccgttggatctcgccgactatacttatgatctggcagaagaggatgacagcgagcctctgaattataaggacccttgcaaggccgcagcgttcctcggggatattgctcttgatgaagaggacttaagggcttttcaggtgcaacaggccgtggaccttagacgccacactgcccgtaaaagcagtataaaagccgcagtgccgggaaacaccagtacccctagttgccagtccacaaatggacagccccagcgaggcgcttgtggccgatggcgcggaaggagtagatccaggagagcggctacatccaggccagaacgcgtgtggccggatggagtgatcccattcgtgattggcggaaacttcaccggaagccagagagctgttttcaggcaggccatgcgtcactgggaaaaacatacatgtgttaccttcctggaaaggactgatgaggacagttatatagtgtttacctatagaccatgcgggtgctgctcttatgtgggcagaaggggcggtggccctcaggcaatttcgatcgggaagaactgtgataagttcggtatcgttgttcatgagctcggtcatgtcgtcgggttttggcatgagcacaccagacccgatcgggatcggcatgtgtctatcgtgagagagaacatccagcccggacaggagtacaactttcttaagatggagccacaggaggttgaatctctgggcgaaacctatgatttcgattccattatgcactacgctagaaataccttctccagagggatttttttagacaccatcgtacctaagtatgaagtgaatggcgtgaaacctcccattgggcaaaggaccaggttgagcaagggtgatatagcacaggcgcgtaagttatacaaatgtcccgcatgcggtgagaccctgcaggatagtacgggcaacttttcctcgcctgaataccctaacggttattcggcccacatgcattgcgtttggcgcatctctgtcacgcccggagagaagataattcttaattttacatcgctggacttgtacaggagcagactgtgctggtacgactatgtggaggtgcgtgatggcttctggcgcaaagctccactaaggggtagattctgcggttcaaaactgcccgagccaatcgtgtctactgacagtcgcctgtgggtcgagttccgaagttcgtctaactgggttggcaaaggcttctttgccgtttatgaggccatttgtggcggagacgtgaagaaggactatggacacatccagtcaccgaactaccctgacgactatcgcccatcaaaagtgtgtatctggcggatacaggtgagcgagggattccacgtggggttgaccttccaaagcttcgaaatagagcgccacgactcctgcgcgtacgactatctggaggtacgagatggccactctgagagcagtactttgataggtagatactgcggatatgagaaacctgacgacatcaagtcgacctcttcccgcctgtggctgaagtttgtgtcggacgggtctattaataaggcgggattcgctgttaatttttttaaggaagtagatgagtgctcacgacccaatcggggaggatgcgaacagaggtgcctaaatactttggggtcttacaaatgtagctgtgacccagggtacgaattggcccctgacaagcgaaggtgtgaggggtgctacgacctgcaggtgggtaagcctctcctgtgggatcgccattgctttcgtctgtctacccacggcccagaaatgctgggcacagcattgcgaggttag

SEQ ID NO: 27540 - DNA, 2472 bp, Artificial Sequence
  Description of Artificial Sequence: Synthetic coding sequence
atgccgggtgtggcgcgactccccctgctcctcggcctgctcctcctcccccgaccaggtcggcctcttgacctggccgactatacctacgacctggccgaagaagacgactcggagccattaaactataaggacccctgtaaagccgcagcttttctgggggatatcgctcttgatgaggaagatctccgggcatttcaagtccaacaggccgtggatctccggaggcacaccgctcggaaaagctccattaaggccgctgttccagggaatacttcaacccccagttgccagtccacaaatggacagcctcagagaggcgcttgtggaagatggagagggagaagcagaagtaggagagcagccacgtctcgacccgaaagagtttggccagacggggtgatcccctttgtgattggcggtaacttcaccggtagtcagcgggcagtgttcagacaggctatgaggcattgggaaaagcatacctgtgtgacattcctggagcgcactgatgaggattcttacatagtgtttacatatagaccctgtggctgttgctcatatgtcgggaggagagggggaggcccacaggcgatatcgattggaaaaaattgcgacaagtttgggatagtggtacacgagttgggtcatgtggtaggattctggcatgagcacacgcgtccggatcgtgatcgccacgtttccattgtgcgtgaaaacatccagcccggtcaggaatataattttctgaagatggagccgcaagaggtggagagcctgggagaaacctatgactttgattcaatcatgcactacgcacgtaatacatttagccgaggaatctttctcgacacaatcgtgcctaagtatgaggttaatggggtcaaacccccaatagggcagcgaacaaggttgtctaagggggacatagcacaggcaaggaagctttacaagtgccccgcttgtggagagaccctgcaggactcaaccgggaatttcagctctccagagtatcccaatgggtacagcgcccatatgcattgtgtatggagaattagtgtgacgcctggggagaagatcatcttgaacttcaccagtttggatttatataggagccgcctctgttggtacgattatgttgaggtacgcgatggcttttggcggaaggctcccttacgcggacgcttctgcgggagcaaacttccagagcctattgtaagcacagactcccgcctgtgggtggagttcagatcaagctctaactgggtaggcaaggggttctttgctgtgtacgaagccatttgtgggggtgatgtgaagaaggattacggacacattcagagccccaattacccggatgattaccgcccttccaaggtgtgcatctggcggatacaggtctcagaggggttccatgttggcctgacattccaatcatttgaaatcgagaggcatgatagctgcgcttacgactatctggaggtgcgggacggacactcagagagtagcaccctgatcggacgctactgcggctatgagaaacccgatgatatcaagtccacgtcttctagactctggctcaaatttgtatctgacggctcaataaacaaagctggcttcgctgtgaatttctttaaggaggtcgacgagtgtagccgaccaaatcgtggcggatgtgagcaacgctgcctgaataccctgggttcatacaagtgttcgtgtgaccctggttacgagctggcacctgataagagaagatgtgaggctgcctgtgggggtttcctgacaaaactcaacggatccattacttctcccggttggccgaaggagtacccccctaataagaattgcatttggcaactggtcgccccaacccagtaccgtatttccttgcaatttgacttcttcgaaacggaaggtaacgacgtatgcaagtacgactttgtggaggtgcggtctgggctcaccgctgatagcaaactgcatggcaagttctgcggaagtgagaaaccggaggttataacctctcaatacaataacatgcgggtggagtttaagtctgataacacggtgagtaagaagggctttaaggcccattttttttccgttcttgaaggcgctggggacaggcactctcacctatccgggctcgagctattgctctgtccgcatgccttggttgataccgtacctgccccaccaagcgctctgcacggagatacacacgcacacactcatacccatgtgcacacgcactgccctatagcacaggaaacctgcaggggacctccgctgggggcatctcgactgagcccgcagggcccaggccatctgaccctggctccccaggaaggatcctacctggacttctgggacactcaccggggagaccctaagccacgtcgtcggcgaaaatcgttgaaaacattctctctaacgcctgctacttttcggggaatttgggcactctag

SEQ ID NO: 27541 - DNA, 2193 bp, Artificial Sequence
  Description of Artificial Sequence: Synthetic coding sequence
atgccaggcgtcgcaaggctccccctcctacttggccttctgttactgcctcggcctggacgccctttggatctggctgactacacttacgacctcgccgaggaagacgatagtgaacccctgaactataaggacccatgtaaagctgctgcctttcttggggatatcgcgctagacgaggaagacctgcgcgcattccaggttcagcaggctgtggacctacgaagacacactgctagaaaatcctccataaaggcggcagtccctggcaataccagcacccccagttgtcagagcaccaatggccagcctcagaggggagcctgtggtcggtggaggggtaggtcaaggtctaggcgggctgctacctcacggcctgaaagggtgtggcctgatggagttataccttttgttataggcggaaactttacaggttcccaaagggcggtcttcaggcaggccatgagacactgggaaaaacatacatgcgttacgtttcttgaacgcacagatgaagatagctacatagtctttacttatagaccttgcggctgctgctcatacgtcgggagaagaggcggtgggcctcaggctatatccatcggcaaaaattgcgataaatttggtattgtagtgcacgaactaggccacgtcgtgggattttggcacgaacacactaggcccgatcgcgatcggcacgtctctattgtgagggaaaacatacagccaggtcaggagtacaatttcctgaaaatggaaccccaggaggtcgagtctttgggtgaaacctacgattttgacagcattatgcattatgccagaaatacattctctcggggaattttcctggacactattgtccccaagtacgaagtcaacggtgtcaagcctcccatcggacagcggactcggctcagtaaaggcgacattgctcaggcacggaagctgtacaaatgccccgcatgcggagagaccctccaggatagcaccggtaacttcagcagtccagaatatccaaacggctactcagctcatatgcattgtgtttggcgcatttccgtcaccccaggcgaaaaaatcattttgaacttcacaagcctcgacctgtacagatcaaggctgtgctggtacgactacgtggaagtgcgcgacggcttctggaggaaagcccctctgcggggaaggttctgtggctccaaactccctgagcccatcgtgtccaccgacagtagactgtgggtcgagtttcgcagttcctccaactgggtgggaaaggggttctttgccgtgtatgaagcaatttgtgggggtgacgtgaaaaaggactacggccatattcaatcacccaattatcccgacgactataggccctcaaaggtgtgcatctggcgcattcaagtgtccgaaggattccacgtcggtctgacctttcagtcatttgagatcgagcgacatgacagttgtgcgtacgactacctggaggtcagggacggacatagcgaaagcagcactctcattgggaggtactgtggctacgaaaagccagatgatattaaaagcacctctagtcgactgtggttgaaatttgtttcggacggctctatcaacaaggctggattcgccgtcaactttttcaaggaggtcgatgagtgctctagaccaaacagggggggatgtgagcaacggtgtctgaacacgcttggatcgtataagtgtagttgtgaccctgggtatgagcttgcacctgacaagagacgctgcgaggcggcatgcggaggattcttgaccaagttgaatggctctattacgtctcctggctggccgaaggagtacccaccaaataaaaattgtatctggcagctcgtcgctccaacccagtataggatatccctccagttcgatttctttgagacagaggggaacgatgtgtgcaagtacgactttgtggaagttaggagcggacttactgccgattcgaagttacacggcaaattctgcgggagcgaaaagcccgaggtcatcacgagccagtacaacaacatgagggtggagtttaagagcgataacacagtcagcaagaagggtttcaaggcccactttttcagcgaaaaacgcccagccttgcagccgccaaggggtaggccccatcagttaaaattcagggttcaaaagaggaaccgaacccctcagtag

SEQ ID NO: 27542 - DNA, 1509 bp, Artificial Sequence
  Description of Artificial Sequence: Synthetic coding sequence
atgctgctaagatccgcgggaaagctcaatgtagggaccaagaaagaagacggagagtcgacagccccaacaccacgtcctaaggtgctgcgttgtaaatgtcaccaccattgccccgaagacagcgtgaacaacatctgcagcaccgacggctactgcttcaccatgatcgaggaggatgactctggtttgcctgttgtgacttccggatgcctggggttagagggcagcgacttccagtgtcgggacacaccaattccccaccagcgccgaagcattgagtgttgcacggagagaaacgagtgcaataaagatctgcacccaactcttccccctctgaaaaatcgcgacttcgtggatggtcctatccaccatcgcgctctgctgatctctgtcaccgtgtgttcccttctgctggtcctcatcattctgttttgttactttcggtacaagagacaagaaacacggccacggtactccattggcctcgaacaggacgagacatacatccctccaggcgagtccttgagagacttgattgagcagagccagtcttcaggcagcggctccgggctgcctcttctggttcaacggacaattgcaaagcagattcaaatggtcaagcagatcggcaagggtcggtacggcgaggtgtggatgggtaagtggaggggagaaaaagtggctgtcaaagtgtttttcaccacggaagaagcatcatggttcagagagacagaaatatatcagaccgtactcatgcggcatgagaacatacttggattcatcgctgctgacatcaaaggaaccgggtcctggacacaactgtatctgatcaccgactaccacgaaaacggaagcctgtacgattatctgaaatccactacactcgatgccaagtctatgcttaaacttgcttatagtagcgtctccgggctctgccacttgcacactgagatctttagcactcagggaaaacccgctattgcccacagagatctgaaatcaaagaacattctggtgaagaagaacggaacttgctgcatagcggaccttggccttgccgtgaaatttatctcagacacaaacgaagtggacattccgccaaacaccagagtgggcaccaagcggtacatgccccctgaagtgctggatgaatcgctcaatcgcaatcattttcagtcttacattatggctgacatgtacagttttggcctgatcttatgggaagtagcccgtcggtgcgtcagcggtgggatcgtggaggaatatcagctcccctaccatgacctcgttccttcagaccctagctacgaggacatgcgggagatcgtgtgcatcaagaagcttcgaccctcatttcccaacaggtggtcatccgacgaatgccttaggcagatgggaaagttgatgaccgagtgttgggcacataacccggcaagccgccttaccgcccttagagtcaagaaaacacttgctaaaatgtccgagtcacaggacatcaagttatag

SEQ ID NO: 27543 - DNA, 1509 bp, Artificial Sequence
  Description of Artificial Sequence: Synthetic coding sequence
atgctccttcgctccgccggaaagctcaatgtgggaacgaagaaggaggacggcgagtccaccgcaccaacacctcggcctaaggtattgaggtgtaaatgccatcaccattgtccagaagacagtgtgaacaatatatgctctacagatgggtactgtttcacaatgatcgaggaagatgactctggattacccgtcgtcacatccggatgcctgggcctcgagggcagtgacttccagtgcagggataccccaatccctcatcaacggagatctattgagtgctgcacagagcgtaacgaatgcaacaaggatctgcacccgactctgccaccactcaagaatcgagatttcgtggacgggcctatccaccaccgcgctctgctcatttccgtgactgtgtgctctctcctgttggtccttatcatattgttctgttatttccgatataaacggcaggaaactagacctcggtactccatagggctcgagcaggatgagacctatattcctcccggtgaatccctccgcgatcttatcgagcagtctcaatccagcggctccgggtcaggtctgccactcctcgtccagaggacgatcgcaaaacagatacaaatggtgaaacagatcggaaaaggaaggtatggggaggtatggatgggaaagtggcgaggtgaaaaggtcgcagtaaaggtgttctttactaccgaagaggccagttggttccgagagaccgaaatttaccaaacggtcctaatgaggcacgagaatatcctgggattcatagccgctgatatcaagggcactggtagttggactcaattatatctgataactgattaccacgagaatggatcactatacgattacctgaaaagtaccactttagacgctaagtctatgcttaaactagcatattctagcgtgagcggcctctgtcacctgcacacggaaatcttcagtactcagggcaaaccagcaattgcccatcgagacctgaagagcaagaacatcttagtcaagaagaacggaacatgttgcattgctgacttggggctcgctgtcaagttcatctcagacacaaatgaggtcgatatcccgcctaacacgcgagtgggaactaagagatacatgcccccagaggtgctggacgagagtcttaatcggaaccacttccagtcttatatcatggctgacatgtactcctttggcttgatactgtgggaggttgcgaggcgatgtgtctctggcggaattgtggaggagtatcaactgccgtaccacgatttggtgccttcagaccctagctacgaggacatgcgggagatcgtgtgcatcaaaaaactccgcccttccttcccaaaccggtggtcttctgacgaatgcttgcgtcagatgggtaaacttatgaccgagtgctgggctcacaatcccgcatctagactgactgcactcagagtcaaaaaaacccttgcaaaaatgtccgaatcccaagacatcaagctctag

SEQ ID NO: 27544 - DNA, 1599 bp, Artificial Sequence
  Description of Artificial Sequence: Synthetic coding sequence
atgggctggctcgaggagctgaactggcaactgcacattttcctgcttattctactctctatgcataccagggcaaatttcctggataacatgttacttaggtccgcgggaaagctcaacgtggggacaaagaaagaggatggcgagtccaccgcccctactcctcgcccaaaagtactgagatgtaagtgtcaccaccattgccccgaggattctgttaataatatttgttctacagatgggtactgttttacaatgattgaagaggacgacagcggattgcccgtggtcacctccggttgtctgggcttagaggggagcgacttccagtgtcgagacactcctatcccgcaccagcgccgtagcattgagtgttgtaccgagaggaacgagtgcaacaaggacttgcatcctactctccctccactaaagaacagggattttgtagacggacctattcaccatcgagctctgctcatatccgtaacggtatgtagtttacttttagtgctcattatcctgttctgctatttccgttacaagagacaggaaacccgccctagatactccattggtctcgaacaggacgagacctatataccgccaggggaatccctgcgggacttgattgaacagtcccagtcctctggatcaggaagcggtctgcctctcctggtgcagcgtactatcgcgaagcagattcagatggtgaagcagatcggcaaagggcgatacggcgaagtgtggatgggaaagtggcgcggagagaaagttgccgtaaaagtcttcttcactactgaggaggccagctggttccgggagactgaaatttaccagactgtgctgatgcgccatgagaacatcctcggcttcatcgctgcagatatcaaaggtacaggctcatggacgcagctctacctgatcaccgactaccatgagaatggcagcctgtacgactacctcaagagcacaaccctggacgcaaagtcaatgctgaaactggcctattcctcagtgtcaggactctgccacctccatacggagatttttagcacccagggaaagcccgcaattgcccacagagacctgaaatccaagaatattctcgtgaagaaaaatgggacttgctgcattgctgatctggggctagcagtgaagtttatatctgatacgaacgaggttgacatcccgcctaatactcgagtaggcaccaaacgctatatgccccctgaggtgctggatgaaagcctgaaccgcaaccactttcagagctacatcatggctgatatgtacagctttgggttgatactgtgggaggtggccaggagatgcgtctcaggtggcattgtggaggaataccagctgccttatcacgatctcgttccttcagatccctcatatgaagatatgagggaaattgtctgtatcaaaaagcttcgacctagctttcccaacaggtggagctccgacgagtgtcttaggcaaatgggaaagctgatgaccgagtgctgggcgcacaacccagcatcacgcctcacagctctgcgggtgaaaaagaccctggcaaagatgagtgaatctcaggatatcaagctgtag

SEQ ID NO: 27545 - DNA, 345 bp, Artificial Sequence
  Description of Artificial Sequence: Synthetic coding sequence
atgctcctgagaagcgctggtaagctgaacgtcggaactaaaaaggaagatggcgaatctaccgcacctactccacgaccaaaagtgctgagatgcaagtgccatcaccattgcccggaggactcagtaaataatatttgttctacagacgggtattgcttcactatgatagaagaggatgacagcggactgcctgtagtgacctcaggctgtttaggactggaaggttctgacttccagtgccgcgtcagaacactaccttttctcataaaagaggaccagctgaacgccgcacagaaaggaacaaacgtaatcaagacctacacactccactgtctccactag

SEQ ID NO: 27546 - DNA, 378 bp, Artificial Sequence
  Description of Artificial Sequence: Synthetic coding sequence
atgctcctgcgttctgccggtaagctgaatgtcgggacgaaaaaggaggacggcgagagcacagctccgacaccccgacctaaagtgctgcggtgtaagtgccaccaccactgtcctgaagacagtgttaacaacatttgctcaaccgacgggtactgcttcacaatgattgaagaagacgatagcggtctgcctgtggtcacatcagggtgtctcggattggaaggttctgactttcagtgccgggacactccaatcccccatcagcgacgcagtattgagtgttgcactgagcgaaacgagtgcaataaggatctgcaccctaccttgccccctttgaagaaccgagacttcgtggatggaccaattcaccattag

SEQ ID NO: 27547 - DNA, 1509 bp, Artificial Sequence
  Description of Artificial Sequence: Synthetic coding sequence
atgctcttgcgctccgccggtaaactcaacgtgggaacaaaaaaggaggacggggagtctaccgccccaaccccccgtccaaaagtgctgaggtgtaaatgtcatcaccattgtccagaagatagcgtcaataacatttgcagtaccgacgggtattgctttactatgattgaagaggatgattccggcttgcccgtggttaccagtgggtgcctcgggctggaagggtctgattttcaatgcagagacacccccattccacatcaacggaggtctattgaatgctgcaccgagcggaatgagtgtaataaagatctccacccaaccctgccccctctgaaaaaccgggactttgtggatggacccattcatcaccgcgcattgctgataagcgtgactgtatgcagccttctgctggtcctgataattctcttctgttattttagatacaaaaggcaggaaactaggcctcgttactcaataggtcttgagcaggacgaaacctacatccctccaggggagagcctccgcgacttaattgaacagtcgcagtcttccggatcggggtccggcttgcccctgcttgttcagaggaccatcgccaagcagatccagatggtcaagcaaataggcaagggaagatacggggaggtgtggatgggcaagtggagaggcgagaaagtagccgtgaaagtctttttcacaacggaggaggcatcctggttccgggagactgagatctaccagacagtcctgatgaggcacgagaacatactgggatttatcgccgctgacatcaaaggcaccgggagctggacccaactgtacctgatcactgattaccacgagaatgggtctctatatgattacctcaagagcactaccctcgacgctaagtccatgctcaaactcgcatattcatcggtgagcgggctttgccatctccacaccgagatattttctacccaagggaaaccagcaatcgcacatcgggatctgaaatcaaaaaatatactggtgaagaaaaacggcacgtgctgtattgcagacctcggactggccgttaaattcatctcggatactaatgaagttgatattccgcctaatacccgggtgggaactaagcgctacatgccgcctgaagtcctcgacgaaagcctgaatagaaaccacttccagagttacatcatggccgatatgtattccttcggcctgatcctgtgggaggtagcccgaagatgtgtctccgggggtatcgtggaagagtaccagcttccttatcacgatctcgtgccatctgatccatcgtacgaggatatgagggagatagtctgcatcaagaaattacgcccttcattccctaaccggtggagtagtgatgagtgtttacggcagatggggaaacttatgaccgagtgctgggcacataatcccgcttctagacttaccgcactgagggtcaaaaagacactggctaagatgagtgagtcccaagatatcaagctgtag

SEQ ID NO: 27548 - DNA, 1509 bp, Artificial Sequence
  Description of Artificial Sequence: Synthetic coding sequence
atgctcctgcgcagcgccggtaaattgaacgtgggcaccaagaaggaagatggtgaaagcaccgccccaactccccgtcccaaagttctcagatgcaagtgccaccaccattgcccagaggacagcgttaacaatatctgctcaactgatgggtattgcttcactatgatcgaggaagatgatagcggcctgcccgttgtaacctcaggctgcttgggtctagaagggtccgacttccagtgccgcgacactccgatcccacatcagaggagaagtattgagtgctgtactgagaggaacgaatgtaataaagatctccacccaactttacctcctctgaaaaatcgcgatttcgtagatgggccaatccaccaccgggctcttctcataagcgtgactgtgtgctcacttctgctcgtgctgatcatcctcttctgctacttcagatataagcgccaggagacccggcctaggtacagtattgggttggagcaggatgagacttacatcccgccaggtgagagcctgagggacctgatagagcagtcacagtccagcgggtctggttccggtcttcccctactggttcagaggaccatagcgaaacagatccagatggtcaaacagattggcaaggggagatacggagaagtgtggatggggaaatggaggggtgaaaaggttgccgtaaaagtattttttactaccgaggaagctagctggtttagagagacagagatctatcagactgtcttgatgcgtcatgaaaacattttgggtttcatagccgctgacattaaaggcacgggatcctggactcaactctacctgataaccgactaccatgagaatgggtccctatatgattacctaaagtccactacattagatgccaaaagtatgctgaaattagcttattccagcgtgtcagggctttgtcacttgcataccgagatcttcagcactcagggaaaaccggcaatcgcacaccgagaccttaaatccaagaacattctggtcaaaaagaatggtacttgttgtattgccgatttaggactggccgtgaaattcattagcgatacaaacgaggttgacatcccacctaacacgagggtaggcaccaaaagatatatgcccccagaggtactggacgaaagtctgaaccgtaaccattttcaatcatacatcatggctgacatgtattctttcggactgatattgtgggaagtcgcaaggaggtgcgtttcgggaggtatagtagaggaataccagttaccatatcatgatcttgtgccatcagacccttcctacgaggacatgagggagatcgtctgtattaaaaagctgcgcccaagctttccaaaccgatggtcctctgacgagtgtcttcggcaaatgggtaagttgatgacagaatgctgggcccacaaccccgctagtagactaaccgccctgcgggtcaagaagaccctggccaaaatgtccgaatctcaggatataaagctttag

SEQ ID NO: 27549 - DNA, 1509 bp, Artificial Sequence
  Description of Artificial Sequence: Synthetic coding sequence
atgctcctccggagtgcaggaaagctgaacgttggaactaagaaagaggacggtgagagtacggctccaacaccacggccaaaagttttacgttgtaaatgccatcaccactgtcctgaggacagcgtgaataatatctgctcaacggatgggtactgtttcacaatgattgaggaggacgattctggtctgccggtcgttacgagcgggtgtctaggccttgaaggaagtgattttcaatgccgcgatacaccaattcctcaccagcggagaagtatagaatgctgcaccgaaaggaatgagtgcaataaagacctgcatcccaccctgccacccctgaagaatcgcgattttgtcgatggaccgatacatcatcgcgcattgttgatcagcgtgacagtttgcagcctgctgctcgtgcttatcatcctattttgttatttcaggtataaaagacaggaaactagaccccgttactccatcggactggaacaagatgagacctatatccctcctggggagagcctccgcgatctgatcgagcagtcccagtcttctggttctggatctggcttacctctgttagttcagcgcactattgctaaacagatccagatggtgaagcaaatagggaaaggtaggtacggagaagtgtggatgggaaaatggcgcggtgaaaaagtggccgtcaaggtgttctttaccacagaagaggcctcctggttccgggagacggagatctaccagaccgtcctgatgagacacgagaatattttagggtttatcgccgctgatattaagggcactggctcttggacacaattgtatctaatcactgactaccatgaaaatggatcgctctatgactacctaaaatcaactacactcgatgcaaagtctatgctgaagctggcttatagttccgtcagcggcctctgccatctacacacagaaatcttctcaacccagggcaagcccgctatagcacatcgcgatctgaagtctaagaatatactggtgaaaaagaacgggacctgttgtattgctgacttggggctggccgtgaaattcattagtgatacaaacgaagtggacatcccaccgaataccagggtagggacgaaaaggtatatgccgccagaggtcctggacgagtccttgaataggaatcacttccaatcctacatcatggctgatatgtactcttttgggctgattctctgggaagtcgccagaagatgtgtgagcggcggtatcgtcgaggagtatcagctcccttatcacgatctcgtgccatccgatccctcctacgaagatatgcgggagattgtctgtattaaaaagctccggccttcttttccaaatcgctggagctctgacgaatgcctgcgacaaatgggcaaactgatgaccgaatgctgggctcacaacccggcaagcagacttaccgccctgcgcgtgaaaaaaacccttgctaagatgtcagaatctcaggatatcaagctctag

SEQ ID NO: 27550 - DNA, 4755 bp, Artificial Sequence
  Description of Artificial Sequence: Synthetic coding sequence
atgagggggcaggcagctgcacctggacccgtgtggatcctggcacccttgctattactcttattattgctggggagacgcgctagggccgctgcaggcgcagatgccggtccgggacccgagccttgcgccactctggtacaagggaagttctttggttacttcagcgccgcagctgtttttcccgcaaatgcatctagatgttcatggactctcagaaatcccgacccaaggagatatactctgtacatgaaagtcgctaaggcccctgtgccatgcagcgggcctgggagagtgaggacatatcagtttgactcttttctggagtcgactcgcacttacctgggagtggagtctttcgacgaagtcttgcggttgtgtgacccatcagcgccattggcgttcttgcaagcgagtaagcaattccttcaaatgagaagacagcagcccccacagcatgatggcctgagaccaagggccggtccccctggaccgaccgatgactttagcgttgagtatctcgtcgtgggaaaccgcaacccgtcgcgggcagcctgccagatgttatgtcgttggctggatgcctgcctcgcaggttcgcggtcatctcacccgtgtggcatcatgcagaccccatgcgcctgtctgggaggcgaggctgggggtcctgccgctggtcccctggcacctcgaggcgacgtgtgtctgcgcgatgccgtggccggaggccctgagaattgcctcacatctctcacacaggatagaggcggtcacggggcaactggaggctggaaactctggtcgctttggggtgagtgtacccgcgattgcggaggcggactccagactaggacgcgaacctgtttacccgcacctggcgtggagggcggaggctgcgaaggagtactggaagagggcaggcaatgcaaccgggaggcatgtgggccagctgggcgtacgtctagccggagtcaatccctgaggtcaactgatgcgaggcgacgtgaggagctcggagatgagctccaacagttcggctttccggcaccacagacaggtgaccctgctgctgaggagtggtcaccctggagtgtttgctctagcacatgcggagagggttggcagacaagaacccggttttgcgtgagtagttcctactctacccagtgcagcggcccacttcgggagcagcggctctgcaataactcagccgtgtgtcccgtccacggtgcttgggatgagtggagtccttggtcactttgctcttctacatgtggtaggggcttccgggaccgcacccggacatgtagacctccacagttcggaggaaacccctgcgagggacctgagaagcagaccaagttttgcaacatcgccctgtgcccagggagagctgtcgacgggaactggaacgaatggagttcttggtccgcctgctccgcgagttgctcccagggcagacaacagaggacgagagagtgtaacggcccttcatacgggggagctgaatgtcaggggcattgggtggagactcgggactgctttttgcagcagtgtccagtcgacggcaagtggcaagcttgggcttcttgggggagctgctcagtgacctgcggggcaggctcccaacggcgagaaagagtatgctcaggcccttttttcggcggtgcagcgtgccagggtccacaagacgaatacaggcagtgcggaactcagagatgccccgaacctcacgagatctgcgacgaagataatttcggcgcagtaatttggaaggaaacccccgctggggaagtggccgctgtgagatgtcccagaaacgcgacaggtctcattttgcgcagatgtgagctggatgaagagggcatagcctattgggaaccacctacttacataaggtgtgtcagtatcgactacaggaatattcagatgatgactcgagaacatttggctaaggctcaacgtggcttgcctggcgagggggtgagtgaagtgatccagaccctggtggagatttcccaagacggcacatcatactctggcgatctcctctctacaattgacgtgttacgaaatatgaccgaaatattcaggcgggcttattatagccccacaccgggtgacgttcagaattttgtccaaatcctctccaatctgctagccgaagaaaaccgagacaaatgggaggaagcccaactggcaggcccaaatgccaaggagctatttcggttggtggaagattttgttgatgtgatcggttttcgcatgaaggacttacgcgacgcttatcaagtgaccgacaacctggtgctgagtattcacaaactgccggcttcgggagcgacagatataagctttccgatgaaagggtggagagcaaccggcgattgggctaaagttcccgaagatagggttaccgtgagcaagagcgtgtttagcacaggcctgaccgaagccgatgaggcctccgtgtttgtggttggcaccgtgctgtatcgaaatttggggtcatttttggccttgcagcgcaataccacagttctcaattcgaaagttatctctgtgactgtgaagccccctccacggtctcttcgcacccctttagaaatcgagttcgcccatatgtacaacggaactacaaaccaaacttgcatcctctgggacgagacggatgtgccctccagcagcgctcctccacagctgggcccatggtcttggcgagggtgccgaactgtgccgcttgacgccctccggaccaggtgcttgtgcgatcgtctcagcactttcgctatactggctcagctgtcagccgacgccaacatggagaaggccacactgccttccgtgacactcatcgtgggctgtggcgtgtcctctttgacgctgttaatgctagtgattatatatgtttccgtgtggcggtatattcgctctgagcgatcagtgatccttatcaatttttgcctgagtatcatctcatcaaatgctctgattctgattggacaaacacagacacgaaacaaagtggtgtgcacactggtggcagcatttttacacttcttctttttatcaagcttttgctgggtgctgacagaggcatggcaaagttatatggcggtgaccggccacttaagaaacaggctaatccgcaaacggttcctctgtctcggctggggacttcctgccctcgttgtcgcaatttccgtgggcttcaccaaagcaaaggggtattcaaccatgaactattgttggctgagtcttgaagggggtctgctctatgctttcgttgggccagccgctgccgtcgttctggtgaatatggtgatcggtatcctagtgtttaacaaattggtttctaaagatggtataactgacaagaagctgaaggaacgcgcaggtgcctcactgtggtcttcctgcgtcgtgctgcccctcctcgccctgacatggatgagcgccgtgttggccgtgaccgataggagatcagcactcttccagatcctgtttgctgtattcgatagccttgaagggtttgtgatcgtaatggtgcactgtattctgcggagagaggttcaggatgcggtaaaatgccgtgtggtggatcgccaggaggagggcaatggtgactctggcggaagctttcagaatggccatgcccaattgatgactgattttgaaaaggacgtggatctcgcttgcagaagtgttttgaacaaagacattgctgcttgtagaaccgctactattacgggcacattaaagaggccttcccttccggaggaggaaaagctcaaactcgcccatgctaagggtcccccaaccaatttcaatagtctccccgcaaacgttagcaaacttcatctccatggcagccctcggtatcctggcggacctctgcctgacttccctaatcatagcctcactcttaaaagggacaaggctcctaagtcatccttcgtcggggatggcgacatcttcaaaaaactcgactcggaactcagtagggctcaagagaaggcattagatacatcgtatgttattctgcctaccgccaccgccactctgcgacctaagccaaaagaagagcctaaatacagcatccacattgaccagatgccccagacccgtctgattcatttgtcgactgctccagaggccagtctcccagcccgatcacctcctagccggcaacctccaagtggaggtccaccagaggctcccccagctcagcccccacccccacctccaccaccgccacccccaccccagcaaccactgccccctcctcctaacctggagcccgcacccccttctctgggcgaccccggagagcctgcagctcacccaggcccatctactggaccctcgactaaaaacgaaaatgtggcaactcttagcgtctcctcgttggaacgccgtaagtcaagatacgccgaactcgactttgaaaaaataatgcacaccagaaaaaggcaccaggacatgttccaggaccttaaccgcaagttgcagcacgcagctgagaaagacaaggaggtgctgggccctgactcaaaacctgagaagcagcagaccccaaataagcggccatgggagtccctgaggaaggcacatgggaccccgacttgggtcaaaaaggaactcgagcccttgcaacctagccccctggaattgcggtctgtggaatgggagcgatctggcgctaccattcctctggtgggtcaggatattatagatctgcagaccgaagtttag

SEQ ID NO: 27551 - DNA, 4755 bp, Artificial Sequence
  Description of Artificial Sequence: Synthetic coding sequence
atgcgagggcaggctgcggctcctggtcccgtgtggattttggcccctcttctgctgctcttgctcctgctgggcaggcgagcgagagccgctgccggtgcagacgcaggacccggaccagagccatgcgccaccctggtgcagggaaagttcttcggctacttttcagccgcagctgtgtttcccgcaaacgccagcaggtgcagctggaccctgcgtaatcccgatccacgacgttatacactttatatgaaggttgcaaaggctccggtgccctgctcaggaccgggaagagtcaggacttatcagtttgattctttcctggaaagtacacggacttatctgggcgttgagagctttgacgaagtgctcaggctttgcgaccccagtgctccgctggcttttctgcaggctagcaaacaatttcttcagatgcgcaggcagcagccccctcagcacgacggcctgcgccctcgcgctgggccacccggtccgacagacgacttttctgtggagtacctggtagttggaaaccgcaacccctcccgcgcagcctgccagatgttgtgtcgctggttggatgcctgcctcgcgggtagccgttcttcccatccctgcggtataatgcagaccccctgtgcgtgtctcgggggagaagctggcggtcccgcagcaggacccctggcacctcggggagatgtgtgcctgcgtgatgctgtcgccggagggcctgagaactgtctgaccagcctgacccaagatcgcggaggccatggcgctaccggaggctggaaactgtggtcgctttggggggaatgcacgcgggactgcggcggtggcctccagaccagaaccaggacctgtctgcccgctcccggagtggaagggggtgggtgcgagggagtgctagaagagggcaggcagtgtaacagagaggcctgcgggcctgctggtcgaacaagctcccgctcacagagcttgagaagcaccgacgcacggcgacgggaagagctgggggacgaactccaacaattcgggtttcccgcacctcagacaggggatccagccgctgaggaatggtccccctggtctgtttgtagttcaacttgcggggaaggatggcagacgagaacccggttctgcgtttccagctcttactctactcaatgctccggcccacttcgcgaacagaggctttgtaacaattctgcagtgtgccctgtccacggcgcttgggacgagtggtctccgtggagcctttgctctagcacatgcggacgcggattccgcgaccgaactcgcacatgccggcctccgcagttcggcggaaatccttgtgaggggccagaaaaacagactaagttctgtaatatcgcactatgtccagggagagccgttgatggcaattggaatgagtggagctcctggtctgcctgtagtgccagctgcagccagggccgtcagcagcgcacacgtgaatgcaacggaccatcttatggtggcgctgagtgtcagggtcactgggtcgagacccgggactgctttctccaacagtgccccgtggacgggaagtggcaggcatgggccagttggggctcttgctccgtgacctgtggcgctggtagtcaaaggagggagcgagtgtgctcaggacccttttttggaggcgcagcatgccaggggccacaggacgagtataggcagtgcggcacacaaagatgcccggagccccacgagatttgcgacgaagataactttggcgcagtgatttggaaggaaacaccagccggtgaagtggctgccgtgcgctgtccacggaacgccaccggcctcattctgagacgttgtgagctcgatgaggagggcatcgcatactgggaaccccctacttacattcgctgcgtctctatcgactacagaaatattcagatgatgacccgcgagcacctcgcgaaggcccagaggggcctgcccggagaaggggtgtctgaggttatccaaacactagtggaaatcagccaggacggcactagctattctggggacctccttagtaccattgacgtcctgcgtaacatgacagagatatttaggcgggcttactacagtccgactcctggagacgttcagaatttcgtccagatcctgtcaaatcttcttgctgaagagaatagggataagtgggaagaggcccagctggctggcccaaatgccaaggagttattccgacttgttgaggattttgtggacgtaatagggttccggatgaaggacctgagagatgcctatcaagtaaccgataatctggtgctttcaatacataagctgccagcgtccggggctactgatatttcttttcctatgaaaggatggagagccacaggcgactgggcaaaggtgccggaggaccgtgtgactgtcagcaagagcgttttctcgacggggctgacagaggctgatgaagcaagtgtgtttgtagtgggcacagtgctctaccgcaacctcggttcatttctggcactacaacggaatacaacagtgctcaacagtaaggtaatctccgtgactgtcaaacctcctcctcgctccctgcgcacaccactggagatagaattcgcacatatgtataacggcacgactaatcagacatgcatcctgtgggacgagacggacgtgccaagtagctcggctccccctcaactcggaccctggtcatggcgcggttgtcggaccgtgccattggatgctctcaggacacggtgcctgtgcgaccggcttagtacattcgctattctggctcagttgtcggccgacgccaatatggagaaggcaactttacccagcgtgacgttaatcgtcgggtgcggcgtctcttccctaaccctgctgatgctcgtgattatctatgtgtcggtgtggcgctacatcaggtccgagagaagtgtgatcctcattaatttttgcctgagcattatttctagtaacgcccttatcctcatcgggcaaacccagaccaggaacaaggtggtgtgtacgctcgtggcagcttttctgcattttttcttcctatcgagcttctgctgggttcttaccgaggcctggcagagctacatggccgtgaccgggcacctccgcaaccggctgattaggaagcgcttcctatgcctcgggtggggactgccagccctcgttgtggctatttcagtgggattcacaaaggcgaagggctactcaaccatgaattattgttggctgtctctggaagggggtcttctgtacgctttcgtgggaccagcagctgcagtggtattggtcaatatggtcatcgggatcctggtgttcaacaagcttgtgagtaaagacggtataacggacaagaagctcaaggagagagctggcgcatctttgtggtcaagctgtgtggtcttacctcttttggccttaacctggatgagtgccgttctggcagtgaccgacaggcgatcagctctattccagatcctcttcgcagtgtttgacagcttggagggttttgtgattgtgatggtgcactgtatcttacgtcgcgaagtccaggatgcagtgaagtgccgtgtggtagatagacaggaggagggtaatggtgactcgggaggatccttccaaaatggacatgctcaacttatgactgactttgaaaaggacgtggatctcgcttgtcggagtgttctgaataaggatatcgccgcttgcaggactgcgaccataaccgggactcttaaaaggccttcattaccagaggaagaaaagcttaaattggcacatgcgaagggaccgccaacaaatttcaattcgctgcctgctaacgtaagtaagctgcatctccacggatccccccgttatccaggaggtcctctcccggacttccccaatcatagcctcacactgaagagagacaaagctcccaaatcatctttcgtgggagatggtgatatctttaagaaacttgatagcgagctttctcgagctcaggaaaaagctcttgatacaagctacgtgatcctccccactgctaccgcaacactgcggcctaagccaaaggaggagcctaaatactccatacacattgaccaaatgccacagacgcgactgatccacttgtctaccgcacccgaggctagcttgcccgctcgtagtccaccctcacgacagcccccaagcggcggtccacccgaagccccaccagcacaacctccaccccctcccccaccgcctccgcctccgcctcagcagcctctcccccctcctcctaacttagagcctgcaccaccctccctcggcgatcctggggaaccagctgcccatcccggaccaagtacgggccctagtactaaaaatgaaaacgttgcaaccctctctgtaagttccctggagaggcgaaaatccaggtatgctgagctcgacttcgaaaagatcatgcacacccgaaaaaggcatcaggacatgttccaggacctcaatcggaaactccagcacgcggcagagaaggataaagaagtcctgggaccagattcaaagccagagaaacagcagacaccaaataaacgtccatgggagagtcttcggaaagcccatggcacacccacttgggtgaagaaggaactggagcctcttcagccgagtcccctggaactccggtccgtcgagtgggagcgcagtggcgctacaattccccttgtggggcaggacataatcgatctgcaaacagaagtatag

SEQ ID NO: 27552 - DNA, 2334 bp, Artificial Sequence
  Description of Artificial Sequence: Synthetic coding sequence
atgcccgataatcgtcagcctaggaacaggcagcctcggattcgaagcgggaacgaaccaagaagtgctcctgctatggagcccgacggaagaggcgcatgggcccattctagagccgctctggacaggttggagaagctgctccgctgctctcggtgtactaatattttgagagagcccgtgtgtcttggaggttgcgagcatatcttttgctctaattgcgtgtctgattgtattggcaccggctgccctgtgtgttatacaccagcctggatccaggacctgaagattaaccggcagctcgacagcatgatccagctgtgctccaaactgcgcaacctgctacacgacaatgagctgtccgaccttaaagaagacaaacccaggaagtccctgttcaatgacgcaggaaataaaaaaaattctatcaaaatgtggttctcccctcgctccaaaaaagtaagatacgtggttagcaaggcctctgtccaaacccagccagccattaaaaaggatgccagtgcccagcaagacagttacgaattcgtgtccccaagcccaccagctgacgtgagcgaacgcgctaaaaaggcctctgcacgcagcggtaagaagcagaaaaagaaaaccctcgccgagatcaatcagaaatggaatcttgaagccgaaaaggaggatggtgaatttgacagcaaggaggaatcgaagcagaagctcgtgagtttctgctcccaaccctcagtgatctcgtctccccaaattaatggggaaattgacttactggccagcggctccctgactgagtctgaatgcttcggtagtttaactgaagtctcattaccattggcggagcagatcgaaagcccggatacaaagagccggaatgaggtagtgacacctgagaaggtgtgcaaaaattacctgacctccaaaaaaagcctgcctctggagaacaacggtaagcggggacaccacaacaggctgtcttcaccgatctctaagcggtgtagaacctcgattttgagtacctccggagattttgtgaaacaaacagtcccgagtgaaaatattccgctacccgaatgcagttcacccccaagctgcaaacgtaaggtgggcggaacaagtgggcgaaagaactcaaatatgagtgacgaatttatctcgttgtcccctggtacgcccccttccactctgagctcgagcagctaccgccgtgttatgagcagtccgagcgcaatgaagcttttaccaaacatggccgtgaaacggaaccaccgaggagagaccctcttgcacatcgcttcaatcaagggggatatcccttccgttgagtacttactccagaacggaagtgacccgaatgtcaaagatcatgccggatggactccacttcacgaggcatgtaatcacggtcatctcaaggttgtggagctgttgctgcagcacaaagcgctggtaaacacaaccggctaccaaaacgactcacccctgcacgacgcagccaagaatgggcatgtggacattgtcaagctgctgttgagctacggcgcaagtcgtaatgccgtgaatatcttcggcctgcgtccagtagattacaccgacgatgaatccatgaagtcccttctgttgctccccgaaaagaacgaatccagctccgcatctcactgctccgtaatgaataccggccaaaggagggacggcccactcgttctgataggcagcggactgagctcagaacagcagaaaatgctgagtgaacttgcagtgatactcaaagccaagaagtatacagagtttgactctacggtgacacatgtggtggtaccaggcgatgccgtgcagagtacccttaagtgcatgttaggtattctcaacggctgctggatcctcaagttcgaatgggtaaaggcttgcctgcggcgaaaagtatgcgagcaagaggagaagtacgagattcccgagggtccaagaagaagcagattgaatcgggagcagctgcttcctaagctatttgacggttgctacttctacctgtggggcacattcaaacaccacccaaaagacaacctgatcaaactggtgactgccggaggaggccaaatactctctcgtaaacctaagccagactcagacgtaacacagaccatcaacacggtagcttaccacgctagacctgattctgaccagcgcttctgcacacagtacataatctatgaagatctgtgcaattatcatcctgaaagagtgagacaaggaaaggtctggaaggctccttcatcatggtttattgattgtgttatgagctttgaattactaccgttagactcctag

SEQ ID NO: 27553 - DNA, 1704 bp, Artificial Sequence
  Description of Artificial Sequence: Synthetic coding sequence
atgtggttttcacctcggagcaagaaggtacgttacgtcgtctcaaaagcgagcgttcagactcaacccgctattaaaaaggacgcgagtgctcagcaggatagctacgagtttgtgagtccctctccgccagcagatgttagcgaacgggctaagaaggcatccgccaggtctgggaaaaagcagaaaaagaagacactcgctgaaatcaaccagaaatggaacctagaggccgaaaaggaggacggcgagttcgactctaaagaggaaagcaaacagaagctcgtttcgttttgttcgcagccttcagtcatctctagtcctcagatcaacggagagattgacctcttagcctccggaagcctcaccgaatccgagtgttttggcagccttacagaggtgtccctccccttggctgagcagattgaatctcctgacacaaaatcgcggaacgaagtggtaacccctgaaaaagtgtgtaagaattatctaacttcgaaaaaaagtcttcctctcgagaacaatggtaaaagaggacaccacaaccgcctcagcagtcctatatctaagcggtgtcgaacctccatcctatcgacatccggtgatttcgtgaaacaaaccgttccaagtgagaatataccattaccggaatgtagctccccaccgagctgtaaacggaaggtcggtggcacctcaggcaggaaaaactccaatatgtcagacgagttcatctcactgtctccaggaacaccccctagtaccctgagctcctcgtcataccgcagggtgatgagctctccctctgctatgaagctactgcccaatatggctgtgaaaaggaatcataggggagaaactctcttgcatattgcttctattaagggtgacatcccgagcgtagaatacctcttgcagaacgggtccgatcccaatgtgaaggatcatgccggatggacacccttgcacgaagcttgcaaccacggtcacttaaaggtggttgaactgctcctgcagcacaaagcattggtcaacactacaggctaccaaaacgacagccctctgcatgatgctgcaaagaacggccatgtggatatcgtgaaattgctgctcagttacggcgcttccaggaacgccgtgaacatatttggattaagacctgtggattacaccgatgatgagtccatgaaaagtctactgctgctccctgaaaagaatgagtccagctctgccagtcattgctccgtgatgaatacaggtcagcggagagatggaccgttggtgctgataggaagtggactctcgagtgagcaacagaaaatgctcagtgagctggcagtaatactcaaggcaaagaagtacaccgaattcgatagcacagtgactcatgtagtcgtgccgggtgacgcagtgcagagtactctgaaatgtatgcttggaatacttaacggctgttggatcctgaagttcgagtgggtgaaagcctgcctgagaaggaaggtctgcgaacaagaagaaaagtatgaaattccagagggcccacgcagatcccgtcttaatcgcgagcattgtcagagctgcctcatggacgcgacgtccatctgcggagaaccgagcaacacaattcaaagaacgacactgctgtcctcctctctgcaggtgggagcgagaagttcagtggagagcccttcacagaccgttacctag

SEQ ID NO: 27554 - DNA, 3750 bp, Artificial Sequence
  Description of Artificial Sequence: Synthetic coding sequence
atgtcatctatgtggtcagaatacactatcggcggtgtgaagatctacttcccttataaggcttatccctcccagctggcaatgatgaactctatccttagaggcctcaacagtaagcagcattgcttgctagaatccccgacaggcagcggcaagtctctcgcactcttatgctccgctttagcatggcagcagagccttagtggcaagccagctgacgagggagtcagcgaaaaagcagaagtccagctgagttgctgttgcgcgtgccacagtaaggacttcactaacaacgatatgaaccaagggacatcacgacatttcaattatccctcaactcctccttccgaacgaaatggtaccagtagcacttgtcaggactcacctgaaaagactaccctggccgcaaagctctccgccaaaaaacaagcgtcaatataccgcgatgaaaacgacgacttccaggtcgagaaaaaacggatccgacctctcgagactacccagcaaatcagaaagagacattgttttggaactgaggttcataatctggacgccaaggtcgattctggcaagactgtgaaacttaactcgccgttagaaaaaataaattctttttctcctcagaagcctcctggacattgcagcaggtgctgctgctcaactaagcagggcaacagtcaggagagttcgaacactataaagaaggatcataccggtaaaagcaagatccccaagatctatttcggcacgcggacccataagcagatcgcacagatcactcgggagctgcgtagaactgcctactcgggagtcccaatgactatactcagctctagggatcacacctgcgtccatccagaggtagttggaaacttcaataggaacgaaaaatgcatggaactcctggacggtaagaacggcaagtcctgctacttttaccacggcgtccacaagatcagcgatcagcacactctccagacattccagggtatgtgtaaggcatgggacattgaagaactggtcagcctcggcaagaagttgaaggcttgtccttattatacagctcgcgaattaatccaggatgccgatatcatcttttgtccctataactacctgctggacgcgcagattagggaatcaatggacttgaacctgaaagaacaagtggtcattctcgacgaggcacataatatcgaagactgcgcccgagagtcggcctcctacagtgtgaccgaggtgcaacttcgatttgctcgcgatgagctggacagcatggtaaataacaacataaggaagaaagaccacgagcccctgagagccgtttgctgctcgctgattaactggttggaggcgaatgcagagtacctcgtggaacgggattacgaatctgcctgcaagatctggagtggaaacgagatgctgctcactttgcacaagatgggtattactaccgccacgttcccaatacttcagggtcacttcagtgcagttctccagaaagaggagaagatctcaccaatctacggtaaggaggaggcaagggaggtccccgtaatatccgcgtcaacacagattatgttgaagggcctgtttatggtccttgactacttgttcaggcagaattctagatttgccgacgactacaaaattgccatccagcagacgtactcatggactaaccagatcgacatttcggacaagaatggtttactggtgctccccaagaacaagaaacgctcacgacaaaagaccgcggtgcacgtgctgaacttctggtgtctcaaccctgccgttgctttttctgacatcaacggtaaggtgcaaacgatcgtgctgacctccgggacactttctccaatgaaatcgttcagtagtgagctaggggtgactttcactattcaactagaggccaaccatattatcaaaaactctcaagtgtgggtgggcacaatcggaagcgggccaaaaggtagaaacttgtgcgccacattccagaatactgaaacattcgaatttcaggatgaggttggcgcactattgcttagtgtgtgccagacagtgtcccaggggattttgtgttttctgccctcttataaactccttgaaaagttaaaggagaggtggctgagtaccgggctctggcacaacctggagctggttaagacagttatcgttgagccccaaggtggggagaaaacaaatttcgacgaactgcttcaggtctactacgacgccatcaaatataaaggagaaaaggatggagcgctcctggtggctgtatgtcgagggaaggtgagcgaaggactcgatttcagcgatgacaatgccagagccgttattactatcggtatccccttcccaaacgtgaaggacttgcaggtggaattgaagaggcaatacaatgatcatcatagcaaactgcggggtctgctgcctgggcgacagtggtatgagattcaagcataccgtgctctgaaccaggccctgggtcggtgtattcggcatcgcaatgactggggtgccttgatcctggtcgatgaccggtttcgcaataatccatcaaggtacatatctggacttagcaaatgggttcgtcaacaaatccagcaccattccaccttcgagtcggccttggagagtttggccgagttcagcaaaaagcatcaaaaagttctgaatgtgtcaattaaggacagaaccaatattcaggacaacgagtcaacccttgaggtgacgtcacttaaatacagcacttcaccctacttgctggaagcagctagtcatctgtctcctgaaaatttcgtcgaagatgaagccaagatctgcgtccaggagttgcagtgccctaaaataattaccaagaatagccctttaccaagcagcattattagtcgtaaagagaaaaacgaccccgtgttcctcgaagaggcaggcaaggcagagaagattgtcatctctcgctccacctcacccacgtttaacaagcaaactaaaagggtctcttggtcgagttttaacagtttgggacagtatttcacaggaaagatacccaaagccacccctgaactgggaagttccgagaatagtgcatcttcacccccaagattcaaaactgaaaagatggagtcaaaaacggtgctcccgtttactgataagtgcgagagtagtaatctcactgtcaacacctccttcggaagctgtcctcagtccgagactatcatctctagtctcaaaatcgacgctactcttaccagaaagaatcactcagagcatcccctgtgctctgaggaagccctggacccagacattgaacttagcctcgtgagcgaagaggacaagcagtccactagtaatcgtgatttcgagaccgaggcagaggacgagtcaatctatttcactcctgaattatatgatccagaagatacggatgaggagaagaacgacctggcagagactgacaggggcaaccggctggccaacaactcggactgcattctggctaaggatttattcgagatccgtactatcaaggaggtggacagcgccagagaggtcaaagctgaggattgcatcgataccaagctcaacggaatcctgcacattgaggagagtaaaattgatgatatcgatgggaacgtcaagacaacatggatcaatgaactcgaactgggcaaaacccatgagatagagatcaaaaacttcaagccctcccccagcaagaacaaggggatgtttccaggcttcaaatag

SEQ ID NO: 27555 - DNA, 945 bp, Artificial Sequence
  Description of Artificial Sequence: Synthetic coding sequence
atggcatccagaagtaagagaagggccgtggagagtggagtaccccagccccctgatccccctgtccagagagatgaggaagaggagaaggaagttgagaacgaagacgaagatgacgacgattccgataaggagaaggatgaggaagatgaggtgatcgacgaggaggtaaacattgaattcgaagcttacagtctatcagataacgactatgatggaattaaaaagctactacagcagctgttcctgaaagctccagtcaacactgcagagctgaccgatctgctaatccagcagaatcacattggctccgtcattaaacagaccgacgtgagcgaggatagtaacgatgacatggacgaagacgaggttttcggatttatctccctgctgaatcttacagagaggaaggggacccagtgcgtcgagcagatccaggagctggtacttcggttctgtgaaaagaattgtgagaagagcatggtggagcagttagacaagttcttaaatgatacaactaagccggtcggcctgttgctcagtgaacgattcatcaacgttcccccacaaattgcactccctatgtaccagcagctgcaaaaggagcttgcgggagcccatcgaacaaacaagccttgtgggaaatgttatttttaccttctgatttcaaaaacttttgtggaagccggtaagaataatagtaaaaagaaaccaagtaacaagaagaaggccgcactgatgttcgctaatgccgaagaggagtttttctacgagaaagccattctcaaattcaattactccgtgcaagaggaatctgacacttgtctgggtggcaaatggtcctttgatgatgtacctatgactccactacgcacagtaatgctgatccctggcgataaaatgaacgagatcatggataaactgaaagagtacttgtctgtctag

SEQ ID NO: 27556 - DNA, 879 bp, Artificial Sequence
  Description of Artificial Sequence: Synthetic coding sequence
atggcatcgcggtcaaagcgcagggccgtcgagtcaggcgtgccgcagccaccagatccccctgtgcaaagggatgaagaggaggaaaaggaagtggagaatgaggacgaggacgatgatgattccgataaggaaaaagacgaagaggatgaagtgatagatgaggaggttaacatcgagtttgaggcttacagcctctcggacaacgactatgatggaatcaaaaagctcctgcaacagctgttcctaaaggcccctgtgaacacagccgagttaaccgacctgcttattcagcagaatcacattgggagcgtgatcaaacagacagacgtgagtgaagacagcaatgacgacatggatgaagatgaagtgtttgggtttattagtcttttgaacctcacagaacgcaagggcacacaatgcgttgaacaaattcaagaactggtcctccggttttgtgaaaaaaactgtgaaaagagtatggtcgagcagttggacaagtttttgaatgatacgacaaaacctgtgggactcttgctatctgagagattcattaatgtaccgccacagattgccctccccatgtaccagcagctacaaaaagagttggcgggagcccaccgaacgaacaagccctgcgggaagtgctacttctaccttctaatctctaaaaccttcgtggaagccggaaaaaacaatagtaagaagaagccttccaataaaaaaaaggcggcattgatgttcgcgaacgcagaggaagaatttttttacgaggaacaaggtaagccggaagtgctcggcggaccggacacccggcgagggctagaaccagtcccaatacagcataacggttggagcgtgcctcccgtgctcgaatag

SEQ ID NO: 27557 - DNA, 969 bp, Artificial Sequence
  Description of Artificial Sequence: Synthetic coding sequence
atggcatctcgaagcaaaaggagggccgtggaaagcggcgtgccccaaccccctgatccaccagtccagagagatgaggaggaggaaaaagaagtggagaacgaggacgaggatgatgatgattctgacaaggaaaaagatgaagaggatgaggttatcgatgaagaggtgaacatcgaattcgaagcctattcacttagcgacaacgactatgacggcattaagaagctgctccaacagctatttttgaaggctcccgtgaacacagccgaacttactgatctgctgatccaacagaatcatattggctccgtgatcaagcagaccgacgtgagcgaggacagtaatgacgatatggacgaggacgaggtttttgggtttatctctctgctaaatctaaccgaacgcaaaggaacacaatgtgtggagcagattcaggaactcgtgctgcgcttctgtgagaagaattgtgaaaagagtatggtcgaacaacttgacaagtttctcaacgataccacaaagccagtaggtctattactgtctgagcgatttatcaacgtacctcctcagatcgctctccctatgtaccagcagcttcagaaggagctggctggggctcacaggactaacaaaccatgcgggaaatgttacttttacttgctcattagcaagactttcgttgaagcaggtaaaaataatagtaaaaagaaaccttctaacaagaagaaagccgctctgatgtttgctaacgcagaagaagagtttttttacgaagagcaagggaagccagaggttctcgggggtcctgataccagacgtggcctggaaccagtgccaatccaacataatggaggctcacgtggccaagtcacggccctggtgagcttgaaggccggactaattcagtcacgtagcactctttccgactttcaaggaactttcatgaccgttggcattgctctctcatag

SEQ ID NO: 27558 - DNA, 879 bp, Artificial Sequence
  Description of Artificial Sequence: Synthetic coding sequence
atggccagcagaagcaaacgcagagctgtagagagtggcgtgccacagcctcccgatcctcccgttcagagggacgaagaagaagagaaagaggttgagaacgaagatgaagacgacgatgacagcgataaggagaaggacgaggaggacgaggtgatcgacgaggaagttaatatcgaatttgaagcatactctctctccgataacgattacgatggcattaagaagcttctccagcagctgtttttaaaagcccctgtgaatactgcggagctgacagacctgctaattcagcaaaaccacatcggaagcgtaatcaagcagacagacgtgtccgaggactccaacgatgacatggacgaagatgaggtattcgggtttatttccctcctaaacctaacggaacgtaagggtacacagtgcgtggagcagatccaggagcttgtattaagattttgcgagaaaaattgcgaaaagtcaatggtggagcagctcgacaagtttttgaatgatactaccaaaccagtgggtctgttgctgtcggagaggtttatcaacgtgccccctcagatcgccctgcccatgtaccagcagctgcaaaaagaattagcaggcgctcaccgaactaacaagccatgcgggaagtgctatttctacctacttatatccaagacattcgtagaagctgggaagaataatagcaagaagaaacccagtaataagaaaaaggcagcactaatgtttgccaatgcagaggaagagtttttctacgagaaggccatactgaaatttaattattctgtgcaggaggagtctgatacatgtctgggtgggaagtggagcttcgatgattggtcggtacctccagtcctggaatag

SEQ ID NO: 27559 - DNA, 789 bp, Artificial Sequence
  Description of Artificial Sequence: Synthetic coding sequence
atggcctcccgatcgaagaggagagcagtggagtcaggggttccccagcctcccgatccccctgttcaacgggatgaagaggaagagaaggaagttgaaaacgaagatgaagatgacgacgactctgacaaggaaaaagatgaggaagacgaagtgatcgatgaagaggttaatatcgaattcgaggcttattcattgagcgacaacgattacgatggtattaaaaagctgctccaacagctgtttttgaaagccccagtcaacaccgccgaactgactgacctgttgatccaacagaatcacattggaagtgttattaaggggacgcagtgcgtggaacagatccaggagttagttctgagattttgtgagaagaactgtgaaaaaagcatggtggagcaactcgacaagttcctcaatgataccaccaagcccgttggactgcttctgtccgagagattcattaacgttccaccccaaatcgcactccccatgtaccagcaactccagaaagagctcgccggtgcccaccgcaccaataagccttgtggtaagtgttacttctatctgctgatcagtaagacatttgtggaagcaggcaaaaacaactcaaaaaagaagcccagcaataagaaaaaagccgctttaatgtttgctaacgcagaggaagagttcttttatgaggagcaggggaagccggaggtgctgggtggacccgacacccgacgtggtctcgagcctgttcccatacaacacaacggctggtctgtcccacccgtgctggaatag

SEQ ID NO: 27560 - DNA, 1398 bp, Artificial Sequence
  Description of Artificial Sequence: Synthetic coding sequence
atggtggaccccgtaggattcgcagaggcctggaaagctcaattcccggattcagagcctcctcgcatggaattgcgctccgtgggcgacatcgagcaagaattagaacggtgtaaagcttcgatcagaaggctcgagcaggaggtcaaccaagagcgatttcggatgatctacctgcagacattactcgctaaggagaaaaaaagttacgaccggcagcggtggggcttccggagggcagctcaggccccagacggggcaagcgaaccacgcgcttcagcgagccgccctcagccggctcctgccgatggggcagatccaccacctgcagaagaacccgaggctcgcccagatggcgaagggtcccccggaaaggccagaccaggcaccgccaggcgacccggagctgccgcatccggcgagcgcgacgacaggggaccaccggcatccgtggctgctttacgcagcaatttcgagcggataaggaagggccacggacaacctggggcagacgccgagaaaccattctatgtgaatgtcgaatttcaccatgagcgaggtctcgtaaaagtcaacgataaagaggtaagtgatcgcatttcatcgctggggagccaagccatgcagatggagcggaagaagagtcaacacggagcgggaagctcggtcggagatgccagccgcccaccataccgtggacgtagctccgagagcagctgcggggtggatggcgattacgaggatgccgagctgaaccctagattcctgaaggataacctgattgacgctaatggtggtagtcgcccaccctggccgcctctggaataccagccttatcagagtatttacgtcgggggaatgatggaaggggaagggaagggacctttgcttagatcacagagcacatccgagcaggaaaagaggctcacatggccacggaggtcttattcgcctcgctcctttgaagactgtggcggtgggtatacccccgactgtagtagtaatgaaaacctcacttcctccgaggaagacttttcctctgggcagtcttctcgcgtatcgccttcacccaccacttaccgtatgtttcgcgataagtccagaagcccaagccagaattctcaacaatcttttgattcatctagccctccaacccctcagtgtcacaaaagacaccgacactgccccgtcgtcgtgtctgaggcaaccatcgtcggtgtaagaaagactggacaaatttggcctaatgacggagaaggagccttccatggcgagcatccaggagccgctgaggaagtgttccagaagttgctcccggatatccgcggagcagcggacgcggatcagctggtttgcgagacacccgattgtccacagcacagtgcagatcaccaatag

SEQ ID NO: 27561 - DNA, 1377 bp, Artificial Sequence
  Description of Artificial Sequence: Synthetic coding sequence
atggtggaccctgtcggtttcgctgaggcttggaaagctcagtttcccgacagcgaaccccctcgtatggagctgcgaagcgtcggcgacatagagcaggaactcgaaagatgtaaagcttccattcgcagactggagcaggaagtgaaccaggagcgctttcgtatgatttatctccaaaccctactcgcaaaggagaagaagtcctatgatcggcaaaggtggggtttccggcgagccgctcaggcaccagacggggcttcagaacccagagccagcgcttcccgtccgcagcctgctccagccgatggcgctgatcccccacctgccgaggaacccgaagccaggcctgacggggaggggagtcctgggaaggcccgtccaggtactgccaggaggccaggagccgctgccagtggggaaagggacgaccggggtccacccgctagcgtcgctgccctccggtcaaatttcgaaaggatcaggaaaggtcacggacagcccggagccgatgctgaaaaaccattctacgtgaatgtcgagttccaccatgagagaggcctggtgaaagttaacgacaaagaagttagcgaccgaattagttcactcggcagccaggccatgcagatggaacgtaaaaaaagccagcatggggctggatcgagtgtgggggatgcatctcgaccaccataccgtgggagaagtagcgaaagcagttgtggggtcgacggcgattacgaggacgcagagctcaaccccagattcctgaaagacaatcttattgacgccaacggcggaagcagacccccatggcctccactggagtatcagccgtatcaatctatttacgtggggggtatgatggagggagaaggcaaagggcctctcctgaggtcccagagcacatcagagcaggagaagcgactgacgtggccacgtcgctcttactctccacgcagcttcgaagactgcggcggaggctacactccggactgttctagtaacgagaatctgaccagttccgaggaagatttcagctccgggcagtcctcccgggtgtcaccgagtcccacaacctatagaatgtttcgtgacaagtcaaggagtccttcgcaaaattctcaacagtcatttgactcaagtagcccacctacccctcagtgccacaagcgccataggcattgtcctgtcgtggtttctgaggccaccattgttggagttagaaaaacaggccagatctggccaaacgacggcgagggggcttttcatggggatgccgatggctcctttgggaccccacctggctacggatgcctgtgcctcccggcatggccaagcggatgtacagccgcaactgccagagtgacccgatcatag

SEQ ID NO: 27562 - DNA, 3816 bp, Artificial Sequence
  Description of Artificial Sequence: Synthetic coding sequence
atggtcgatcccgtggggtttgccgaagcatggaaagcacagtttccggacagcgagcccccacggatggagctgagatccgtcggggatatcgagcaagagcttgagcgctgcaaagcctccatcagacgactggaacaggaggtgaatcaagagcgattccggatgatctacttgcaaactttattggcaaaagagaaaaagtcctatgacaggcagcggtggggcttcagacgcgctgctcaagcacccgatggagcttctgagcccagagcctcagcttcgcgcccacagccagctccagccgatggagcagatccccctcctgccgaggagccggaggcccgtccagacggcgagggcagccccggtaaggccaggccgggaacagctcggcgacccggtgctgccgctagcggagaacgcgatgatagagggcctcccgcttcagttgccgctctaaggagtaattttgaaagaatcaggaaagggcacgggcagcctggggctgacgcagaaaagcccttctacgtgaacgtggagttccatcatgagcgcggactcgtcaaggtcaatgacaaggaggtctcggatcggatctcctctctcggctctcaggccatgcaaatggagcggaaaaaaagccaacatggcgctggatccagcgtcggcgacgcctcccgccctccatacagagggaggagctccgagtcttcatgtggggtggatggagactacgaagatgccgagctgaacccacgctttctgaaggacaatctgattgatgccaacgggggatctcggcctccttggcctcctcttgagtaccaaccctatcagagcatctatgttggcggaatgatggaaggggagggcaaggggcctctactacgctcccagagtaccagtgagcaggaaaaacgtctgacctggcctaggcgctcctatagccccaggtctttcgaggattgtggcggaggctacacgcccgactgcagttctaatgagaacctgaccagcagtgaagaggactttagttctggccagtctagtagagtgagtcccagccctacaacctaccgtatgttccgggataaaagccgtagtcccagccagaattcacagcagagcttcgactcatcctccccacctactccccagtgccacaaacgccacagacactgtcctgtggtagtctctgaggctacgattgtcggggtcaggaagacaggtcagatatggccaaacgacggtgaaggagcattccacggcgatgcagatgggtctttcgggacacctcccggttatggctgtgccgctgaccgagccgaagagcagaggcgccatcaggatggtttaccctatatcgatgactccccctccagctccccacacctctctagcaagggacggggatccagagatgcactcgtgagcggtgcccttgagtccaccaaggcctccgaactggatctggaaaaaggacttgaaatgcggaaatgggtattatcaggcatcctggcctccgaagagacctacctgagtcatcttgaggctcttctgttgcccatgaagcccctgaaagcggcagccacaacaagtcagccggtgctgacttcccaacagatcgagaccattttctttaaggtgcctgaactgtacgaaatccacaaggaattttacgatgggcttttcccaagggtccagcagtggagccaccaacagcgcgtgggagatctgttccagaagcttgccagtcagctcggagtataccgagccttcgtggataattacggcgtcgctatggagatggcagaaaagtgttgtcaagccaacgcgcagtttgcggagatttcggaaaatctgagggcacgcagcaataaggacgccaaagaccctacaacgaagaactctcttgagaccttgctgtacaagccggttgatagagtgacaagatctacactcgtccttcacgatcttctgaagcacacgcccgcatcccatcctgatcatccacttcttcaggacgccctgaggatcagccagaatttcctctcttccatcaacgaagaaataacacctagacggcagtctatgacagtaaaaaaaggtgaacaccggcagttactgaaggatagtttcatggttgaactggtagaaggtgccagaaaactgaggcacgtattcttatttaccgacttgttgttgtgtacaaaactgaaaaagcagtccgggggtaaaacacagcagtacgattgtaagtggtacatcccactaacggacctgagctttcagatggtagacgagctggaggccgtacctaatatccccctagtccccgacgaggaactcgatgctctgaaaatcaaaatatctcaaattaagaatgacatacagcgggagaaacgagccaacaaagggtccaaggcgacggaaagactgaagaagaagctgagtgagcaagagagtctactcctgctgatgtctccgtcgatggcgtttcgagtgcactcacgcaacggaaaaagttatacctttctgatctcctccgattacgagagggccgagtggagggagaatatcagagagcagcagaaaaagtgtttccggtcctttagtctgaccagcgtggagttgcaaatgttaaccaattcttgcgtgaagctccaaaccgtccattcaattccactgaccatcaataaggaagatgatgagagtcctggcttgtatggatttctgaacgtgatcgtgcatagcgcgacaggctttaagcagagctccaacttatactgtaccctggaggttgattcatttggatatttcgttaataaggcaaagacaagggtgtaccgggacacagctgagcctaattggaatgaagaatttgagatcgaactggagggcagccagaccctccgaattctctgttatgagaagtgctacaacaaaaccaaaatacccaaggaggacggtgagagcacggatcgtctgatgggcaagggccaggtgcagctggacccccaggcactccaggatcgcgactggcagagaaccgtgatcgcaatgaatggaattgaagtcaagctgagcgtgaagtttaactcccgggaattctcactcaaaaggatgccgtctagaaagcagaccggcgtgttcggggtaaagatagccgttgtcaccaagagggaaagatccaaggtgccatatatcgtcagacagtgcgtggaggagatcgaaaggcggggtatggaggaagttggaatctatagagtgtcgggcgtggccacagatatccaggccctgaaagccgcttttgacgtgaacaacaaggacgtaagcgttatgatgagtgagatggacgttaacgcaatcgccggaaccttaaagctgtacttcagagagttgccagagcctcttttcacagacgagttctacccaaattttgcagagggcatagcacttagcgaccctgtggctaaggaaagttgtatgcttaacctcttattgagcctaccagaggctaatcttctgacattcttgttccttctcgatcatttaaaaagagtggccgagaaagaggctgtgaacaaaatgtccctgcacaacttagcgactgtgttcggccctacactcctgaggcccagtgaaaaggagagcaagttgcccgctaatccttctcagccaatcaccatgaccgactcgtggagtctggaagttatgtcccaggtgcaagtgctgctgtacttcctacagctggaggccatcccagctccagacagcaagagacagagtattctgttttccaccgaggtctag

SEQ ID NO: 27563 - DNA, 2811 bp, Artificial Sequence
  Description of Artificial Sequence: Synthetic coding sequence
ccatctgcccctagagtgtccacagtgggcctgctgtgttctggagccggacctcacttatgcccttgcgctgaagagggaactggaggactggaatcccagggtgagatcattccctctcgcggaagccgcaagccagacggcgtctccggctcccgcagactgttctctagtttgtgcaagtctcaggagggaagccgaaaagaatgtctacggaaacatcggcgattaggacccgctatgccagtgtcctcccctggtttccccggtcctctggcaaggtcagaacatcacttggacaccgctgcactacagacaggacagcggtctagcgctggaactaagatgggttgtcccacactgatgactaggccgcctcacaggcccacaagcgcagcacgcgctggggctgcagggatgcgctggtcaagagagccctggtcccctctgaagagatctgaactggatctcgaaaagggcctcgaaatgcggaagtgggtcctgtcaggaattctggcaagtgaggagacatatctttctcaccttgaggccctcctgttgcccatgaagccactgaaagccgcagctacaacgagtcagccagtcctcacaagtcagcagatcgaaacaatattctttaaagtaccagaattgtatgagattcataaggagttttatgacgggttatttcccagagtacagcagtggtcacatcagcagagggtgggtgatctatttcagaagctcgcctcccagctgggggtctacagggcatttgtcgataattatggtgtggcgatggaaatggccgaaaaatgctgccaggccaacgcacagttcgccgagatctccgagaacctgagagccaggtccaataaggatgccaaggatcctacgaccaagaacagtcttgagacactgctgtacaagccggtggatcgcgtgacccggtccacacttgtgctgcacgaccttctcaaacatactcccgcttctcaccccgatcaccccctactgcaggacgcattgcggatatcccagaactttctcagctctataaatgaggagatcacccctcgacggcagagcatgaccgtgaagaaaggcgaacataggcagctactaaaagacagtttcatggtggaactcgtggaaggggcaagaaagttgaggcatgtttttttattcaccgacctcctactctgtacgaaactgaagaagcagagtggaggcaaaacccagcagtacgactgcaaatggtacatccctctgacagacttgtcatttcagatggtggacgagctggaggccgttcccaacatccctctggtcccagacgaggaactcgacgccctcaagatcaaaattagtcagatcaaaaacgatattcaaagagagaagcgcgctaataaggggtctaaggccacagagagactgaaaaaaaagctgtcagaacaagaatctttgctactgttaatgagcccgagtatggcgtttagagttcactcacggaacggcaaatcctatacatttctcatctccagtgattatgaaagggccgagtggcgcgaaaatattcgcgagcagcagaagaaatgtttcaggtcctttagcctcacctcggtagaactccagatgttgactaatagctgtgtgaaactgcaaacagtgcattccatccccctaacgatcaataaggaggacgacgagtccccgggtctttacggatttctgaatgttattgttcatagcgctaccggctttaaacagtcatcaaacctgtattgtaccctcgaagtggactcttttggttacttcgtgaataaagcaaagacccgggtgtatcgcgatacagctgagccaaattggaatgaagaatttgagatagaactcgaaggttcccaaacgctccgcattttatgctatgaaaaatgctataataaaacaaagattcccaaagaagacggagagtccacagatcgactcatgggcaaaggccaggtgcagctggatccccaagcgctgcaggaccgagactggcaacgtacagtgattgccatgaatggcatcgaggtaaaattgtccgtcaaatttaattctagggagttcagcttgaagagaatgcccagcagaaaacagaccggcgtgtttggcgtgaaaatcgctgtggtcactaaacgagagagatctaaagtgccatatatcgtgcgccagtgcgtggaggaaattgagcgaagaggcatggaagaagttggcatatatagggtgagtggagtggctacagacattcaggcgctgaaggctgcattcgatgtgaacaataaggacgtctctgtgatgatgtcagaaatggatgtgaacgcaatcgctggaactttgaaactatattttcgagagcttcctgagccactcttcaccgacgagttttaccccaacttcgccgagggaattgcgttgagcgatccagtggctaaagaaagctgtatgttgaatctgctcctaagcctcccagaagcgaacctgcttacgtttctgttccttctggaccacctgaaaagggtcgccgagaaggaagctgtaaataaaatgtctctccataacttagcgacagtctttggaccgacactgctgaggccttctgaaaaggagtcaaagttgccagctaacccaagccagcccatcacaatgaccgactcctggtccctcgaagtcatgtcacaagtgcaggtgttactctacttccttcagctggaggctattcccgcacctgactccaagcgccagagcatcctcttctctacagaggtctag

SEQ ID NO: 27564 - DNA, 3684 bp, Artificial Sequence
  Description of Artificial Sequence: Synthetic coding sequence
atggtggatcccgtgggattcgctgaggcctggaaagcccaatttccggattctgagcctcccaggatggaactgcggtccgtgggagatattgagcaggaactcgaacgttgtaaggccagtattaggcggctcgagcaagaggtgaaccaagaacgctttagaatgatttatttacagaccctgttggcaaaggaaaagaaatcatatgataggcaacgttggggattccggagagccgcacaggctccagatggtgcgtctgagcccagggccagcgcgagtagaccgcagccagcgccagctgatggtgctgaccctccaccagctgaggaacctgaggcccgacccgacggagaagggtcccctggaaaggcaaggcctggcaccgccaggcgaccgggagccgcagcatcaggcgagcgagacgatcggggtccacctgcatctgtcgcggcattgaggtcgaactttgagcggatccggaagggacacggacagccgggagctgacgctgagaaaccattttacgtcaatgttgagtttcatcatgaaagaggtctggtgaaggtcaatgataaggaagtcagcgacagaattagctcactgggaagccaggccatgcagatggagcggaaaaagtctcagcatggtgccggatcttctgtaggagacgcaagtcgacccccttacaggggccgttctagcgaatcatcttgcggtgtggatggtgattacgaggacgctgaactcaatccaagatttctgaaggataatctgatcgacgctaatgggggatcacgccctccttggccaccattagaataccagccctatcagagcatttacgtgggcggtatgatggagggagagggcaagggacctctcctacggagccagagcacatcagaacaggagaagagattaacatggcccaggaggtcgtactctccacgtagtttcgaagactgcggcggaggttatacaccggattgttcaagcaacgaaaatctcacatcttccgaagaagatttctcctcagggcagtcctcccgggtttccccgtcgcctaccacgtatagaatgtttcgagacaaatcacggtcgccctcgcagaactcgcagcaaagtttcgacagcagttctcctcccacgccccagtgccataagcgccacagacattgtcctgtggtggtctctgaggccacaatcgttggagtacgcaaaacaggacaaatttggcccaatgacggggagggcgcattccacggtgatgcggatggctctttcggaacccccccaggttacggctgcgcggcagaccgagcagaagaacagcgaaggcaccaggatggcctgccctatattgatgatagtcctagtagttccccgcatctgtcttccaaggggaggggttctcgtgatgccttggtgtccggggctttggagtcgactaaggcttccgaactggacttggagaaaggtttggagatgaggaagtgggtgttgagcgggatcctggcaagcgaggaaacatatctctcccacctagaggccttactgcttccaatgaaacctctgaaggctgccgcaacaaccagccagccagtgctcacatcccagcagattgagaccattttctttaaagtacccgaactgtatgaaatccataaggagttttatgatggactcttcccgagggttcaacagtggtcccaccaacagagagtcggggatctgtttcaaaagctcgcttcccagctgggcgtctacagggccttcgtggacaactatggcgtagccatggagatggcagagaaatgctgtcaggcaaatgcccagttcgctgaaatatctgaaaaccttcgcgcacgcagcaacaaagacgctaaggacccaactactaaaaacagcctcgagaccctgttatacaagcctgtagatcgggtgacccgcagcaccttggtgctgcacgatctactgaaacatacccccgcttcacacccagatcatcctctacttcaggacgcccttagaatttcccagaacttcctgtcttccatcaatgaggagattacccccagacgtcagtccatgacagtaaaaaaaggcgaacatagacagctgctgaaggattcttttatggttgagctcgtggagggagcacgtaagctaaggcacgtgtttctgttcaccgacctgctcttgtgtaccaagttgaaaaaacagagcggcggaaagacacagcaatatgattgcaaatggtacatacccctgaccgacctgagctttcagatggtggacgagctggaggctgtgcccaacatccccctggttccagatgaagagctggatgccctgaaaatcaagatctctcagatcaagaacgatatacagcgggaaaaaagagcaaataagggcagcaaggcgaccgagcggctgaagaaaaagctgtccgagcaggaaagtcttcttcttctgatgtcaccatccatggcatttcgtgtgcattcgcggaacgggaaaagctatacgtttcttatctcatcagattacgagagggccgaatggagggaaaatattagagagcagcagaagaaatgtttccgatcattcagtctcacatcagtggaactgcagatgctgactaactcttgcgtgaaactacaaactgtgcacagcataccacttactattaacaaggaagatgacgagagcccgggactatacggatttcttaacgtcatagttcacagcgccacaggcttcaaacagtcctccaatctctattgtaccctagaggtggatagtttcggttactttgtaaataaggctaagaccagagtttatagagatacagcagaaccgaactggaacgaactcgatccacaggctctgcaagacagggactggcagagaactgtgatcgctatgaacggcatagaagttaagctgtccgtgaagttcaattcccgcgagttcagtctcaaacgaatgccctctcggaagcagactggcgtgtttggcgttaaaatcgccgtcgtgactaagcgcgaacggtctaaagtcccctacatagtgcgacagtgcgtggaagagatcgaacgaagggggatggaagaggtaggcatctacagagtgtctggcgtggccaccgatatccaggctttgaaggccgcatttgatgtgaataataaagatgtgtcggtgatgatgtctgagatggacgtaaacgcaattgccggtactctcaagctgtattttcgcgaactcccagagccactgttcaccgacgagttctaccctaattttgcggaggggattgccctgtctgatcccgtcgccaaggaatcctgcatgttaaacctgctgctctctttgccggaggcaaacctcctgacgtttctgtttttactcgaccacttgaagagagtggcagagaaagaggcggtgaacaagatgagccttcataacttagcgacagtatttggcccaactctgttgcggccaagcgagaaagaatctaagctgcctgctaacccttcccaacctataacaatgaccgactcttggagccttgaggtcatgtctcaggtgcaggtactgctatacttcctgcagctggaagccatccccgcaccagactcgaagcggcagtctatacttttttctacagaggtgtag

SEQ ID NO: 27565 - DNA, 1404 bp, Artificial Sequence
  Description of Artificial Sequence: Synthetic coding sequence
atggtggaccctgtagggtttgccgaggcctggaaggcccagtttcctgatagtgagcctcccaggatggagttaaggtcagtaggcgacattgaacaggagctcgagcggtgtaaggcttctattcgacgtttagaacaggaagtcaaccaagaacgcttcagaatgatatatttgcagacactcctggcgaaagagaaaaagtcctacgaccggcagagatgggggttcagaagggccgctcaggcacctgatggcgcttcagagccaagggcaagcgcttctaggccacagcctgccccagcagacggagccgatccaccacctgccgaggaaccagaggctaggcccgacggcgagggctcccccggaaaggcgagacctggaaccgcacggaggcccggagcggctgcttctggcgagcgtgacgatagagggcctcccgcaagcgtggccgctctacgttctaactttgagaggatacggaaaggacacggacagccaggagcagatgccgaaaagcctttctatgtgaacgtggagttccatcacgagcggggattggtcaaggtcaacgacaaagaagttagtgacagaatctcctcattagggagccaggccatgcaaatggagagaaaaaaaagccaacacggcgcaggatctagcgtgggagatgcaagtcgtccaccataccggggacggtccagtgagtcgagctgcggcgtcgacggagattacgaggatgcagagttgaacccaaggttcctgaaggataatctaattgatgccaacgggggttcccgccctccatggccacctctggagtatcagccataccagagtatctatgtgggtggaatgatggagggcgagggaaaaggaccccttctccggagtcagtctacatccgagcaggagaagcgtctgacatggccgagaaggagttattctccgaggagcttcgaagattgtgggggaggttacacaccagattgctcatctaatgaaaatctgacaagttctgaggaggatttttcatccgggcagagcagtagagtgtccccctccccgaccacgtacagaatgttccgggacaagtcccggagcccatcacagaactcccagcagtctttcgactctagcagcccgccaacacctcaatgtcacaaaagacatcgccattgtccagtagtggttagcgaagcaaccatcgttggcgttagaaagactggccaaatttggccaaatgacggtgagggcgctttccatggggacgccgttcttaaaacagaggtgcctcatcagggtgttagaagagctcggctgtctttagaggccttgggggaagatccgagctttttgtttcccgcttccgatggcccacgccatagttctacctggtag

SEQ ID NO: 27566 - DNA, 1365 bp, Artificial Sequence
  Description of Artificial Sequence: Synthetic coding sequence
atggtggatcccgttggcttcgcagaggcatggaaggcccaattccccgattctgaaccacctcggatggagctgcggtcagtcggagatatcgagcaggaactggaacgatgtaaggcctcaatcaggcgcctcgagcaggaggtgaaccaggagcggttccgtatgatatacttgcaaactcttctggcgaaagagaaaaaaagctacgatcgccagcgatggggctttaggagagctgcacaggctccagacggcgctagcgaacctcgtgcaagcgcctcccggccacaaccagccccagcagacggggcagatccacctcctgctgaagagccagaagcacgaccagacggggaaggatcccctggtaaggcacgccctgggactgctcgcagaccgggagcagccgcttcaggcgaacgggatgataggggccctcctgcctccgtagctgccctcaggagtaattttgagcgcatcaggaaggggcacggacagcccggagcagatgctgagaagcctttctatgtgaacgtggagtttcatcacgagcgtggattggtgaaggtgaacgataaggaagtatctgaccggatctcttcactgggcagtcaggccatgcaaatggagcggaagaagagccagcatggggctggctcgtccgtaggggatgcatcaaggcccccttataggggccgatcttctgaaagcagttgtggtgttgatggcgattatgaggacgccgagctgaacccgagatttctgaaggacaatttaatagatgccaacggtggctcaaggccgccttggcctccgctcgaataccagccatatcagagtatctacgttggtgggatgatggaaggggagggcaaaggtcctctgctgagatcacagtccacaagcgagcaggaaaaaaggctgacttggccgagaaggtcttattctcctagatcctttgaggactgcggagggggatataccccagactgcagttctaacgaaaacctgacctcctccgaggaggatttctccagcggccagagctcccgcgtctcaccttcccctactacctatagaatgtttcgcgacaaatctaggtccccaagccagaactcccagcagtcattcgattcctccagccctccgacccctcagtgtcataagcgtcatagacactgcccggtcgtagtgtcagaggctactattgttggagtgaggaaaacagggcagatctggcccaatgacggggagggggctttccatggagacgccgacggttccttcggaactccccctgggtacgggtgtgcagctggccgaccccctcatcttactgagctcccagtccaacaccagtag

SEQ ID NO: 27567 - DNA, 4704 bp, Artificial Sequence
  Description of Artificial Sequence: Synthetic coding sequence
atgaatgtggagaaagccgagttctgcaacaagtctaagcagccgggtttggccaggtctcagcataaccggtgggcgggttcgaaggagacatgcaatgaccggcgaacacctagcacagagaagaaagtggatctcaatgccgatcctttatgtgagcgaaaggagtggaacaagcaaaaattgccctgctcagaaaacccaagagacaccgaggacgttccctggatcaccctgaatagttcaatccaaaaggtgaatgagtggttttcgaggtccgatgaactcctgggctcagacgattcacatgacggcgagagtgagagcaatgcaaaggtcgctgacgtcctggacgtgctgaatgaagtcgacgaatattccgggtccagcgaaaagattgatctactggcaagtgatccacacgaggcactgatttgcaaatccgaacgtgtgcatagtaaaagcgtggaaagtaatattgaagacaagatcttcggtaagacttacaggaaaaaagcctcattgcctaacctgtcccacgtgacagagaaccttatcataggcgctttcgtgaccgagccacagattatacaggagcgaccactgactaacaagctcaagagaaaacgcaggcctacctcggggctccatccagaagactttattaagaaagccgatctggccgtccaaaaaaccccggagatgatcaatcaaggcaccaaccaaacagaacaaaacggacaggtgatgaatatcaccaattccggccatgaaaacaagactaagggggacagcattcagaatgagaaaaaccccaaccctattgagagtctggaaaaagagagtgccttcaaaaccaaggccgaaccgataagctctagcatatccaatatggagcttgagctgaatatccataactccaaggcccctaagaagaacagattgagacggaaatcatctacaaggcacattcatgcactcgaattggtggttagtagaaacctgtcaccacctaactgcacagagctccaaattgactcctgctcaagttccgaagaaattaagaagaagaaatataaccagatgcccgtcaggcatagccgcaatctgcagctcatggagggaaaggagccagccaccggtgcgaagaaaagcaataaacccaacgaacagaccagcaagcggcatgattcagatacattccccgagctgaagctcactaatgcgcctgggtcctttaccaagtgttcaaacacgtctgaacttaaagagttcgtaaatccaagcctacctagagaagagaaggaagagaagctggagaccgttaaggtatcaaacaacgctgaggatcccaaagatctgatgctgtcaggagagcgggtcctccagacggagcgaagcgtggagtcatccagcatttcactggtgccaggaaccgattacggaacacaggagagtataagcctcctggaggtgagtaccctcggtaaggccaaaacggagcctaataagtgtgtgtcgcagtgtgctgcatttgagaaccctaagggacttatccacggatgctctaaggacaataggaatgacactgagggtttcaaataccccctgggacacgaggtgaaccattcacgcgagacttcaatcgagatggaggaaagcgagctggacgcccagtacctccagaatacctttaaagtgtccaagagacagagtttcgcccctttctctaatccaggaaatgccgaagaggagtgtgccaccttctccgcgcatagcgggtccctgaagaagcagagcccaaaagtgactttcgagtgtgaacagaaggaagaaaaccagggaaagaatgaaagtaacataaaacccgtccaaacagtgaatatcacggctggctttcccgtagtgggacagaaagacaagccagtcgacaatgccaagtgtagcattaaagggggatcccgcttttgcctttcatctcagttcagaggcaatgaaactgggctgatcacccccaataagcacggcctgttgcaaaacccctaccggataccacccctgttccctattaagtcgttcgtgaagacaaaatgcaaaaaaaacttgttggaggagaactttgaggaacattccatgagcccagaaagagagatgggaaacgaaaatattccgtcgacagtaagcaccattagcaggaataacattcgcgaaaatgtctttaaggaggctagttcttctaacattaacgaggtgggcagttcaacaaatgaggtgggctcctccattaatgagatcggtagcagcgatgagaacattcaagcagagctgggacgtaatagagggccaaaactgaatgcaatgctcagactgggggtgctgcaacctgaagtctacaagcagtcactgcctgggtccaactgcaagcaccctgaaattaagaaacaggaatacgaagaggtcgtgcagactgtaaataccgattttagtccctatctgatctccgacaacctggaacaaccgatgggatctagccacgcgagtcaggtttgcagcgagaccccggatgacctcctggacgacggcgagattaaagaggatacttctttcgcagaaaatgacatcaaggaatcttccgctgtcttcagcaaatcggtccaaaagggagaattatcacgcagcccctccccatttactcatacccacttagctcagggctatcgtcggggagctaagaaactggagtccagtgaagaaaacttgtccagtgaagatgaagagttgccttgtttccagcatctgcttttcggcaaagttaataacatcccgagtcagtctactagacactccactgtggccacagaatgcctgagcaaaaatactgaagagaatttgctgtctctcaaaaatagcttgaatgactgctcgaaccaagtgatcctggcaaaggcatcccaagagcaccatctttccgaggagaccaaatgctctgcatcactgttcagttcccaatgtagcgagctagaggatctcacagctaacacaaatacccaggaccccttcctgattggcagctctaaacagatgaggcaccaatcagagagccagggcgtgggccttagcgacaaggaactggtttctgacgacgaagaacggggaaccggccttgaagagaataaccaagaagaacagagcatggattccaatttgggtgaagcggcatctggttgtgagtctgagacaagcgtttctgaggattgcagcggtctgagctcccagtcggacattttgaccacccaacagagagacaccatgcagcacaacctgataaaactccagcaggagatggctgagctcgaagccgtccttgagcagcacggctcccagccttcaaattcctacccctccattataagcgattcttccgcacttgaggacctcaggaacccagagcaaagtacttccgagaaggcagtcctgacaagtcagaagtcaagcgagtatcctatcagccagaacccagagggcctgtctgcggataagttcgaagtgtctgcggactcttctacctccaagaacaaggaacctggagtagagagatcaagccccagtaaatgtccgagtcttgacgacagatggtatatgcatagctgttcaggttccctgcagaatcggaattatccatcccaggaagaactcattaaggtagttgatgtggaggaacaacagcttgaagagtccggacctcacgacctgaccgaaacttcatacctgccacgccaagacctagaaggcactccctaccttgagtccggcatatcactgtttagcgacgaccctgagagtgatccatctgaagacagggctcccgaaagtgctcgcgttggtaacatcccgtctagcaccagtgctctcaaagttcctcagttgaaagtcgctgaatctgcacagtccccagccgcagcacatactacagacacagccggttataatgcaatggaggaaagcgtcagcagagagaagcccgaactcaccgcaagcacagagcgtgtgaacaagagaatgagtatggtggtgtcaggtctgacacccgaggagtttatgctggtgtataaattcgcccgtaaacatcacataaccctgactaatttaattacagaagaaacgacacacgtagtcatgaagactgatgccgagtttgtctgtgagcggaccctgaagtattttctgggcatcgcaggtggtaaatgggtggtatcctacttttgggttactcagagtatcaaagagcgcaagatgttgaacgaacacgattttgaagtgagaggtgatgtagttaacgggagaaaccaccaggggccaaagcgggcacgagagtcccaggaccgtaagatcttccgcggacttgaaatctgctgttatgggcctttcacaaacatgccaaccgaccagttggagtggatggtgcaactgtgcggagccagcgtggtgaaggaactcagtagctttacactgggcaccggagtccaccccatcgtcgtcgtgcagcctgatgcatggactgaagacaacggtttccatgctattggacagatgtgtgaagcgccagtagtgacacgcgagtgggtgctggattccgtagccctttaccagtgtcaggagctggacacatatctcatcccacagatcccgcacagccattactag

SEQ ID NO: 27568 - DNA, 4875 bp, Artificial Sequence
  Description of Artificial Sequence: Synthetic coding sequence
atggatctgagcgccttgcgcgtggaggaggtgcagaacgtaattaatgccatgcagaaaatactggaatgcccgatttgcctggaactgataaaggaacctgtctccacgaaatgcgaccatattttctgtaagttctgtatgttgaaattgctgaatcagaagaagggcccatcacagtgccccctttgcaagaacgacataactaagcgctctctccaggagagtacccgctttagtcagctcgtagaggagctcctgaagatcatctgtgcctttcaactcgacactggcctggagtacgctaattcatacaattttgccaagaaagagaataactcacccgagcatctgaaagacgaggtctctatcattcagtccatgggctatcggaatagggccaaacggttgcttcagagcgaaccagagaatccttctttgcaggagacatctttgagcgtgcagctgtcaaacctcgggacagtacgcaccttgcgcaccaagcagcggattcagcctcagaaaactagtgtttacattgaattaggcagtgactcgtcagaagacaccgtaaataaggcgacatactgctctgtcggagatcaagaactgttgcagatcacccctcaagggactagagatgaaatcagtctcgactcagctaagaaagctgcgtgcgagtttagtgagaccgatgtcacaaacactgagcaccaccagccctcgaacaacgacctcaatacaaccgagaaacgggctgctgagaggcacccagaaaaataccagggctcttctgtgagcaacctgcatgtcgagccctgcggtaccaacacacacgcttcctctctgcagcacgagaactcttctctgcttttaaccaaagatcgtatgaacgtggagaaggccgaattttgtaacaaatctaaacagcctggtctggctaggtctcagcacaacaggtgggctggaagcaaagagacatgcaacgaccggagaactcccagtactgagaaaaaagtcgatcttaacgccgaccccctctgtgaaagaaaagagtggaacaaacagaagttaccatgttcagagaatccaagagacacggaggacgttccttggataaccttgaactcttccattcagaaggtcaatgagtggttcagtcgctctgatgaattactggggagtgatgacagccacgacggggagagcgagagtaatgcaaaagtagccgatgtgcttgatgtgctaaatgaagtggacgagtattccgggtctagtgaaaagattgatcttctggccagcgaccctcacgaagctctaatctgcaagagcgaaagagtgcatagcaaaagcgttgagtccaacattgaagataagatttttggtaaaacgtacaggaaaaaagcttcattgccaaacctttcccacgtgacagaaaatttaattatcggggctttcgtgactgaaccccagatcatccaggagcgacccctaaccaacaagctgaaacggaaaaggaggccaactagtggcctgcatcccgaggacttcataaaaaaagccgatttggccgttcaaaagactcccgaaatgattaaccagggcacaaaccagacagagcaaaatggccaggtgatgaacatcaccaattcaggccacgaaaacaagaccaagggtgatagtattcaaaacgaaaaaaaccctaatccaatcgaaagtctcgaaaaagagtctgcatttaagacaaaggcggagcctatatcgtcttctatttcaaacatggaactggagctgaatattcacaatagtaaagcccctaagaagaacagactaagaaggaagtcaagtacccgccacatccacgcccttgaactggtagtgagtaggaatttaagccctcctaactgcacagaattgcagatcgacagctgctctagcagcgaagagatcaaaaaaaaaaaatacaaccagatgccagtgagacatagtcggaacctacaactaatggagggcaaggagcccgcaaccggcgctaaaaagtcaaacaagccaaatgaacagacctccaagaggcacgatagcgatacctttcccgagctcaaactgacgaatgcacccggatcatttactaagtgttccaatacttccgagctgaaagagttcgtgaatccctctctgcccagggaggagaaggaggaaaaactcgaaaccgtgaaagtgtccaataacgccgaagaccccaaggacctgatgttatctggcgaaagagtactgcagacagagaggagtgttgaaagctccagcatcagtttggtgcctgggacggactatggcacccaggagagcatatcattgctggaggtctcgacactgggaaaggcaaagacagagccaaataagtgcgtctcccagtgtgccgcatttgagaaccccaagggtttaatccatggctgttcgaaggataacagaaatgatacagagggatttaagtatcccctggggcatgaggtgaaccacagtagagagaccagcatcgagatggaggagtcggagctggatgcccagtaccttcagaataccttcaaggtttcaaaaaggcaatccttcgctcccttcagcaaccccggaaacgcagaggaggagtgtgccaccttttcagctcacagcgggagcctgaaaaagcaaagcccaaaggtgacttttgagtgtgaacagaaggaagagaatcagggaaaaaacgaatccaacatcaagcctgtccagactgttaacatcaccgcgggtttcccagtggttgggcagaaagataaaccggtggacaatgctaagtgctccatcaagggtggtagtcgtttctgcctgtcctcgcagttcagaggcaacgaaaccggcctgattactccaaacaaacacgggctgctgcagaacccataccggatcccccctctgttccccatcaaatccttcgttaaaaccaaatgtaagaaaaacttgttggaggaaaatttcgaagaacatagtatgagtcccgagagagagatgggcaatgagaacattccctccaccgtcagtaccatcagccgaaacaacattcgggagaacgtcttcaaggaggcttcaagttctaacatcaacgaggtcggttcctcaactaacgaggtagggtcaagcatcaacgagattggttcttcagatgagaatatccaggccgagctgggccgtaacagaggcccaaaattgaatgcaatgctcagactcggcgtgctgcaacctgaggtgtataagcagtccctgcccggtagtaattgcaaacacccggagataaagaagcaggaatacgaagaagtggttcaaacagtgaacacagacttttcaccttacctcattagcgacaacctggagcagccaatgggctcatcacacgcttcccaggtgtgctctgaaacgcctgacgacttgctagacgatggggaaatcaaagaagatacctcatttgccgagaacgacattaaggaaagctctgctgtgtttagtaagagtgtgcagaagggtgaactcagcaggagccctagtccttttactcatacccacctcgctcaggggtatcgcaggggggctaaaaaactggaaagttccgaagagaatctgagttccgaagatgaggagctcccatgcttccagcaccttctatttggcaaggttaataacatcccatcccagagcaccaggcactcgaccgtggccaccgagtgtttatcaaagaacaccgaggaaaatctgttgagcctcaagaacagtttgaacgattgctcgaatcaggtgatcctggccaaagcttcccaggaacaccacttatccgaagagaccaaatgctctgcgagcttgttcagcagccagtgtagcgaactggaggacctcacagccaatactaacactcaggatcctttcctgattggttcctcaaaacagatgagacaccagtctgaatcccaaggggtgggtttaagcgacaaagaattggttagtgatgatgaggagcgtggcactggcttggaggagaataaccaggaggagcagtcaatggatagcaacctcggggaagccgcaagtgggtgtgaatccgagacttccgtatccgaagactgttcggggctcagctcacaatccgacattctgacaacccaacagagggacacgatgcaacacaacctgatcaagttacagcaggagatggccgaactcgaggcggttctcgaacaacacgggagtcagcccagcaattcgtacccgtccataatcagcgattctagcgccctggaggacttgcggaaccctgagcagtcgaccagcgagaaggacgccgaattcgtgtgcgaaaggacgcttaaatattttctgggtattgcgggtggcaaatgggtagttagctatttttgggtgactcagtccattaaagagcgtaagatgctcaatgagcacgactttgaagtgaggggagacgtggttaatgggcgaaaccaccagggacctaagcgagctcgcgagtcccaggaccgcaagatttttcgcggtttggagatctgctgctacggcccattcacaaacatgcctactgatcagctggaatggatggtgcaattgtgtggagcatctgtggtcaaggagctaagttcattcacactcgggaccggcgtgcacccaatcgtcgtcgtgcaacccgatgcctggaccgaggacaatggattccacgccattggccagatgtgcgaggctccagtcgttactagggagtgggtgctggattccgtagccctttaccagtgccaggaactggatacctacctgatccctcaaattccccactcccactactag

SEQ ID NO: 27569 - DNA, 2043 bp, Artificial Sequence
  Description of Artificial Sequence: Synthetic coding sequence
atggacctctctgccctgcgggtggaagaagtgcaaaacgttattaacgctatgcaaaaaattctggagtgtcctatttgcctggagctgatcaaggagcccgtttcaacaaaatgcgatcatatcttttgcaaattctgtatgctcaagcttttgaaccagaagaaaggaccgtcccaatgccccctctgtaaaaacgatatcaccaaacggagcctgcaggaaagcacgcggttctctcagttagtggaggagttgctgaaaataatttgcgcattccagctggacaccggacttgagtacgctaatagctacaatttcgcgaagaaagaaaacaatagccccgagcacctgaaggatgaagtttctatcatccagtcaatggggtataggaatcgggcaaaacggcttctgcagtccgagccagaaaacccctctctgcaagagacatccctgtctgtgcagcttagcaatctgggcaccgttcgcaccctgagaacaaagcagaggatccagccccagaaaacatcagtgtacatcgaactgggtgaggctgctagcggttgcgaatccgagactagtgtctctgaagattgctctggcttaagcagtcagtctgatatacttacaactcaacagcgggacaccatgcaacataacttgattaagttacaacaggagatggcagagctggaggctgtgttggagcagcacggctcccagccttcaaattcatatccctccattatctccgactccagcgccctagaggacttaaggaacccagaacagtcaacctcagaaaaggctgtcctgacatcccagaaatcttctgaataccccattagtcagaatcccgaagggcttagcgcggacaaattcgaggtgtccgccgatagctccacatccaagaataaagagcccggagtggagcgatcctccccctccaagtgcccttcgttagacgaccggtggtacatgcattcgtgctctggcagtctgcagaatcggaactaccccagtcaagaggagttaatcaaagtggtagacgtggaggagcagcagctggaagaatcgggtccacatgatctgacagagacaagctatctgccaagacaggacctagagggcacgccatatctggagtctggcatcagcttgttctctgatgatcctgagagtgatccttctgaagatcgggcaccagaatctgccagagtgggcaacattcctagctctacttccgctcttaaggtgcctcaactcaaagttgcggagagcgcacaatcacccgcagccgcacacacaacagacacggctggctataacgctatggaagagtctgtcagcagggagaaacccgaactcacagccagcactgagcgggtgaataagcgcatgagcatggtggtgtccggtctgacaccagaagaatttatgttggtgtataagtttgcacggaagcaccatatcactctcaccaatctgattactgaggagactacgcatgtcgttatgaaaactgatgccgaattcgtgtgtgagagaactctgaagtactttctcggaatcgctggtggcaagtgggtggtgtcttatttctgggtgacccagtcaattaaggagaggaaaatgctgaatgaacacgacttcgaagtgcgtggggatgtggtgaacggtcgcaatcaccaaggacccaaaagagctcgggaatctcaggatcggaagatctttagaggactggagatctgttgttatggcccatttacaaacatgcctactgatcagctggagtggatggtgcagctgtgcggcgcttccgttgtgaaagagctgtctagttttacgctggggaccggtgtgcaccctattgtggtcgtccaaccggacgcttggaccgaagataatgggttccacgctatcggccaaatgtgtgaggccccagtggtgactcgtgagtgggtgctggactccgttgcattataccagtgtcaggaactggacacctaccttattccccaaataccccattctcattattag

SEQ ID NO: 27570 - DNA, 2166 bp, Artificial Sequence
  Description of Artificial Sequence: Synthetic coding sequence
atggatttgtctgccttacgggtagaagaggtgcagaatgtgatcaacgccatgcagaagattttagaatgtcccatatgcctggagctcattaaggaacccgtctccacaaaatgcgatcacatcttctgcaaattctgtatgctgaagctgctgaaccaaaagaagggacccagccagtgtccactctgtaagaatgatattacaaagcgatccctgcaggaaagcacgaggttctcccaactggtcgaagagctgcttaagatcatctgtgctttccagctcgatactggacttgaatatgcgaacagctacaatttcgctaagaaagaaaacaattcccccgagcatttaaaggacgaggtatctataatacagagcatgggctatcggaaccgggcaaagcggctgctccagtcagaaccggagaacccaagcttgcaagagaccagcttgtccgtgcaattgtcaaatctggggacagtgagaacgttgcgtacaaaacagcggatacagccccaaaaaacttcagtctacattgaactcggctccgactcttctgaggacacggtgaacaaggcaacatattgttctgtgggcgaccaggagctgctacaaataacaccccagggcaccagagatgaaatctccctggatagtgccaaaaaaggggaagccgcatccggatgtgaatctgaaacctccgtctctgaggattgtagcggcctttcatcccagtccgacatactcacaactcagcagagggacactatgcagcacaacctcatcaaactccagcaggagatggccgagttagaggctgtgcttgaacagcacggaagccagccctctaactcatatcctagtataatcagtgactctagtgctttggaggacttgaggaacccagagcagagcacatcggagaaggccgttctgaccagtcagaagtcttctgagtatcccattagccagaatcctgaagggttaagcgccgataaattcgaagtgagcgccgacagctctactagtaagaataaggagcccggagtggagcgcagtagcccttcgaaatgcccaagtctcgacgaccggtggtatatgcacagttgtagcggttcactgcagaatcgaaattatccatcccaggaggagcttattaaggttgtggatgtggaggagcagcagcttgaggagagcggaccacatgacctgaccgaaaccagttacctccctaggcaggacttggaaggcaccccctacttagaatctggcatctcactgttttccgatgatccagagtccgacccatcagaggatagggccccagagagtgctagggtaggcaacatcccctccagcacctccgccctcaaggttcctcagctaaaggtggccgagagcgcgcaatccccagctgcagcccatacaaccgacacagccggttataatgctatggaagagtcagtgtccagggagaaacctgagctcaccgcatcgaccgagagggtgaataagcggatgagcatggttgtctcgggccttacgccagaggaatttatgttggtctataaattcgctagaaagcatcacattaccctgacaaacctcataaccgaagaaactacccatgtggttatgaagacagatgcagaatttgtgtgcgagcgtaccctgaagtatttcctcgggattgcaggcggtaaatgggtggtctcttacttctgggtcacccagtccatcaaggagagaaaaatgctgaacgaacacgacttcgaagtacggggtgacgtggtgaacggacgcaatcaccagggcccaaaacgcgctcgcgagagtcaagacagaaagatcttcaggggcctggagatttgctgttacgggcctttcacaaatatgccaacggaccagctcgaatggatggtccagttatgcggtgcttccgtcgtaaaggagctgagttccttcactctaggaacgggagtccatccaatcgtggtggtccagcctgacgcttggactgaggacaacgggtttcacgctattgggcaaatgtgcgaagcacccgtggttacacgggaatgggtcctcgacagtgtagccttataccagtgtcaggagctggacacgtacctgatcccacagatcccccatagtcattactag

SEQ ID NO: 27571 - DNA, 4797 bp, Artificial Sequence
  Description of Artificial Sequence: Synthetic coding sequence
atggacttgtccgcacttagggtagaagaagtgcagaatgtcataaacgccatgcaaaagattttggagtgtccaatctgcttagaactcattaaagagcccgtgtcgacaaaatgcgatcacatcttttgcaagttttgtatgctgaagcttctgaatcagaagaaggggcctagtcagtgcccactgtgcaaaaacgacatcacaaaaagaagtctccaagagagcacccgcttttctcagttggtagaagagctcctgaagattatctgcgccttccagctggacacaggacttgaatacgctaacagttataatttcgcgaagaaggagaataactctcccgaacacctgaaagatgaagttagtattattcagtcaatgggctaccgtaaccgcgctaaacgtctcctccagagcgagcctgagaaccctagcctgcaggagacgagtctcagtgtgcagctgtctaatcttgggactgtgcggactcttcgcaccaaacagaggatccagccccagaagacctccgtgtacatcgagctgggatctgactcctccgaggacaccgtcaacaaggccacctactgtagcgtgggagatcaagagctcttgcagataactccacagggcacacgcgacgaaatttcactggactcagccaagaaggccgcttgtgagttttctgaaaccgatgtgaccaacaccgaacaccaccagccgtccaataatgatctcaacactacagagaaacgcgctgcagagcgacaccctgagaagtatcaggggtcttccgtttctaacctccacgtagagccttgtgggacaaacacgcatgccagctccctgcagcacgagaacagctcactgttgcttactaaagataggatgaacgtcgagaaagccgagttttgcaacaagagtaaacagcctggactggccagatcccagcacaatcgatgggccggaagcaaggagacctgcaatgatcggagaaccccttccactgaaaagaaagtggacctgaacgccgatcctctgtgtgagcgaaaagagtggaataagcagaaactcccctgcagcgaaaaccccagagacactgaggatgtgccttggataaccctgaacagttcaatccagaaagtaaacgagtggtttagcagatcagacgaacttctgggaagtgacgattctcacgatggggaatcagagagtaatgctaaagtggcagacgtgctggacgtcttgaatgaggttgacgagtacagcggctcatcagagaaaattgacctgcttgcatcagaccctcatgaagcactgatctgcaaatccgagagagttcatagcaaatctgtggaaagcaacatcgaggataaaatctttggaaaaacgtaccgcaagaaagccagccttccaaatctgagtcatgtgaccgagaacctaatcatcggggcatttgttactgaaccgcaaataatccaggaacggcctctgaccaataaactgaaacggaagcggagacctacaagcggcctgcaccctgaggattttattaagaaggctgatctggctgtgcagaaaacccccgagatgattaatcagggaactaatcagaccgagcaaaatggccaggtgatgaacataacaaacagcgggcatgagaataagacaaagggcgacagcattcaaaacgagaagaatcccaatccgattgagagtctagaaaaagagtccgccttcaaaaccaaagccgagcctatttcaagtagtatctccaatatggagctcgagctcaacatacacaactctaaggccccaaaaaaaaacagactgaggcgaaaatctagtactcggcacatccacgctctggaactggtcgtttcgcgcaatctatcaccccctaattgcaccgagctccaaattgatagctgcagttcttccgaagaaatcaagaagaagaagtataaccagatgccagtccggcactcacggaatctccagctgatggagggtaaggagcctgctactggcgctaagaagagcaataagcccaacgagcagacctccaagcgtcatgactctgataccttcccagaactgaaactaaccaatgcacctggttcttttacaaaatgttctaatacgtccgaactgaaagagtttgtcaatccttctctgccgagagaagaaaaggaagaaaaattggaaaccgtcaaagtgtcgaacaacgccgaggatcctaaggatctgatgctctccggagagcgggtactacagaccgaaaggtccgtggaatccagctctatctcactagtgccagggacagactatggaacacaagagtcaataagcctgctggaggtctctacactggggaaagccaagactgagccaaataagtgcgttagccagtgcgccgcattcgaaaacccaaagggactcatacacgggtgtagcaaagacaacagaaatgacacggagggatttaagtacccgcttggacacgaagtaaaccatagtcgagaaacgtctatagaaatggaagaaagcgagttggatgctcagtatcttcagaatacatttaaggtcagcaaaagacaatcttttgcacccttctcaaacccgggtaacgccgaggaagagtgtgcgactttttctgcccattctgggagcctaaagaaacagtcaccaaaggttaccttcgagtgcgagcagaaagaagagaaccaagggaaaaatgaaagcaatataaaacctgtgcagactgtgaatattaccgccggattccctgtggtggggcagaaggataagccagtcgacaatgcaaagtgctccatcaagggcggaagcaggttttgcctgtctagtcaatttcgagggaacgaaaccggactaatcacccccaacaaacatggactgttgcaaaatccctaccggatcccgccactttttcccatcaaatccttcgttaaaaccaagtgcaagaagaaccttctcgaagaaaatttcgaggagcatagcatgtcacccgaacgcgaaatgggaaatgaaaacatccctagtaccgtcagcactataagtagaaacaacattcgggaaaatgtcttcaaggaagcatccagcagcaacatcaacgaagtaggaagtagtactaatgaagtcggcagttctatcaatgaaataggctcatcagacgaaaacattcaggccgaattggggagaaacaggggtccaaagctgaatgcaatgctgagattgggcgttttacaacctgaggtctataagcagagcctgccagggtctaactgcaagcacccagagattaaaaaacaggagtacgaagaggtcgtgcaaactgtaaatactgacttctccccttatctgattagtgataacttagaacagcccatggggtcgtctcacgcttcccaggtctgttccgaaacacccgacgacctgttagatgatggagaaatcaaagaagacacttcctttgcagagaacgatataaaagagtcttctgccgtgttcagtaagtccgtccagaaaggggagctgagtaggagtccatctccattcacccacacgcatctggcacagggatatcggaggggggcaaaaaaacttgagagttctgaagaaaacctgtccagtgaagacgaggagctgccttgcttccagcacctgctgttcggcaaggtcaacaatattccctcacagtccactcgacattctacagttgccacagagtgtctatcaaagaataccgaagagaacctcctgtcactgaagaactcccttaatgattgttccaatcaagtcatcctcgctaaggccagtcaagagcaccatctgtcggaggaaacaaagtgttccgcctctctgttctcatcacaatgcagcgagctggaggacctgacagccaacactaatacccaggacccttttctgatcgggtccagcaagcagatgcgtcaccaatccgaatcccaaggggtcgggcttagcgacaaggagttggtgtccgatgatgaagagaggggaaccggcttggaagagaacaatcaagaagagcaatccatggatagcaatcttggtgaagctgctagtggatgtgagtcagaaaccagcgtatctgaggactgcagtgggttatcttcacagagtgacatcctcacgactcagcagagagataccatgcagcataatctgatcaagctgcagcaggaaatggcggagcttgaagcagtgctcgaacaacacggcagtcaacctagcaattcttacccatccatcataagcgactccagcgcgctagaggatctgagaaacccagagcagtccacttcagagaaaggcgtaacccagagtatcaaggagcggaaaatgctgaatgaacacgactttgaagtcagaggcgacgtcgtaaacgggaggaaccaccagggccctaaaagagctcgcgagagtcaagatcggaagatcttcagggggctggagatctgctgctacggtcccttcactaatatgcctactgaccagctggagtggatggtgcagctatgcggagccagcgtggttaaagagctctcaagctttacattgggtacgggagtccacccgatcgtggtcgtacaacccgatgcttggaccgaggacaatggattccatgccatcggccaaatgtgcgaggctcccgtcgtgactagggaatgggttctggactcagtggccttataccagtgccaggagctagatacttacttgattccacaaatcccacacagtcattactag

SEQ ID NO: 27572 - DNA, 5591 bp, Artificial Sequence
  Description of Artificial Sequence: Synthetic coding sequence
atggacctctccgcgctccgagtggaggaggtccagaacgttattaatgcaatgcagaagatcctggaatgtcccatatgcctggaactcattaaagagccagtgtctaccaaatgtgatcacatattctgcaagttctgcatgctgaagctgcttaaccagaagaagggaccctctcagtgcccactatgcaagaatgatattacaaaaaggtcattacaggaatccacacggttctcccagcttgttgaagagctgcttaagattatctgtgcgtttcaactagataccgggctggagtacgctaattcttataacttcgccaaaaaggagaataactccccagaacacctgaaagacgaggtgtccataatccaatcgatggggtacagaaaccgggcaaagcggctattgcagagtgagcctgaaaatccatccttgcaagagacatccctgtcggtgcaactcagtaatctggggaccgtaagaaccctgaggactaaacaacgcatccagccccagaagaccagtgtatatatagaactaggcagcgattctagtgaggacacggtgaacaaggccacatattgcagtgtcggtgatcaagagctcctgcaaatcacgccccagggcacgcgcgacgaaatttcattggattcagccaaaaaagctgcttgtgaattttctgaaacggacgtgacaaacaccgaacaccatcaaccctccaacaatgatctgaacactaccgaaaagagggccgctgagagacaccccgagaaatatcaaggatcctccgtgtctaaccttcacgtagagccgtgtgggactaacacccacgccagctcgctgcaacatgaaaacagctccctgcttctcaccaaggaccgaatgaacgtagaaaaagcagagttttgcaataagtccaaacagccgggactggccagatcacagcataatcgctgggccggaagtaaagagacgtgtaacgatagaaggacaccaagcaccgagaagaaggtggatttgaatgccgatcctctatgtgagcgcaaggagtggaacaagcagaagttgccttgtagcgaaaaccctcgagacaccgaggacgtcccttggattaccctgaacagctctatccagaaggtgaacgagtggttctcccgatcagatgagctgctggggtcggacgattcacatgacggggagtctgagtccaacgccaaagtcgcggatgtgctcgatgtgcttaacgaagtcgacgagtattccggctcttcagaaaaaattgacctcctggccagcgatccccacgaggcactgatatgcaaaagtgagcgggtgcacagtaaatcagtagagtccaatattgaggacaaaatttttggtaagacctacagaaaaaaggcgtcacttccaaacctgagtcacgtgacggaaaaccttatcattggggcattcgtaaccgaaccccagatcatccaggagaggcccttgactaataagttgaagagaaaacgaaggcccacctctggactgcacccagaggacttcatcaagaaagcggacctggcagttcagaagaccccagaaatgataaatcagggaactaaccagacggaacaaaacgggcaggttatgaatatcactaacagtggtcatgagaacaagaccaagggagactccattcagaacgagaaaaatcccaaccccatcgagtcacttgagaaggagagtgcctttaaaaccaaggccgagcccataagctcatcaattagtaatatggaactcgaactcaacattcacaattctaaagcgccaaagaaaaaccggctccgccgaaagtcttctacccgtcatatacatgcgttagagctcgttgtcagcagaaacctttccccgcctaattgcacagaactccaaatcgacagctgcagcagcagcgaggagatcaagaagaaaaagtataatcaaatgccagttcgccactccagaaatctgcaactcatggagggcaaagaacctgccaccggggctaaaaaaagcaataagcctaatgagcagactagcaagcgccacgattcagacactttccctgaactgaagctgaccaatgctcctgggagtttcactaagtgctctaacacctccgagctgaaagagttcgtgaatccttccctcccaagggaggagaaggaggaaaaattggagactgttaaagtgagcaataacgccgaggacccaaaggatctgatgctttcaggagagcgggtgcttcagacagagaggagtgtggaaagctccagcattagcttggtacccggtacagactatggcacccaggagtctattagcctgcttgaagtctccactttgggaaaagccaagaccgagccgaacaagtgcgtgagccagtgcgcagcatttgagaatcccaagggcctcatccacgggtgttcaaaggacaaccgaaatgacaccgaggggttcaagtatcctctgggacacgaggtgaaccactccagggagacaagcatcgaaatggaggagtctgaactggatgcccagtacctgcaaaacaccttcaaagttagcaagcgacaaagctttgcacccttcagcaatcctggaaacgccgaagaggagtgcgctaccttttcagcccattctggctctttgaaaaaacaatctccaaaggtgacatttgagtgcgaacagaaggaagagaaccaggggaagaacgaatccaacatcaagcccgtccagacggtaaacataactgcgggattccctgtggtggggcagaaggacaaacccgttgacaacgccaaatgtagtataaaaggagggagtagattttgcctctccagtcagttccggggaaacgaaactggactcatcactccaaataaacatgggctcttgcagaacccataccgtatccctccgctctttccaatcaagagtttcgtgaagaccaaatgcaaaaaaaaccttctagaagaaaacttcgaagagcactccatgtcaccagagcgcgaaatggggaacgagaacataccttccactgtgagtaccataagtagaaataatattagagagaacgtttttaaggaagcctcttcttctaacattaatgaggtggggagttctactaatgaggtggggagttccattaacgagattggttcctccgacgagaacattcaggcggaactgggtagaaacagaggccctaaacttaacgccatgctgaggttgggggtccttcaacccgaagtgtataaacagtctctgccaggatcaaactgtaagcatcctgagatcaaaaaacaagaatatgaggaagtagttcaaacagtcaacacggacttttccccctacctgatttccgacaacctggagcaaccaatgggtagttctcatgccagtcaggtctgttcagagacacctgacgacctcctcgacgacggggaaatcaaggaagacacttcttttgctgagaacgatatcaaggaatcatccgcggtattttccaaaagtgtacaaaagggggaactgagccgttctccatctcctttcactcacactcacctggcccaggggtatagacgaggggcaaaaaagctggagtcgtcagaggaaaacctctcctcggaagacgaggaactgccatgtttccaacacttactcttcggcaaagtgaacaatataccaagtcaaagtaccaggcacagcacggtggccactgaatgtctgagcaaaaatactgaggagaatctgctctctctgaagaacagtttaaacgattgttccaatcaggtcatcctagccaaggcttcgcaggagcaccacttgtcagaggagaccaaatgctccgcgtctctgttttctagccagtgctccgaactggaggatctgaccgctaataccaacacccaggaccctttcctcatcggtagctccaagcagatgagacaccaaagtgagagccaaggggttggactgtctgataaagagttggtgtccgatgacgaggaaaggggtacagggctggaggagaacaatcaggaagagcaatccatggacagcaatttaggggaggctgcgagcgggtgtgaaagcgagaccagcgtctctgaggattgtagcgggttgtcatcacaaagtgacattctgactactcagcagcgcgatacgatgcagcacaatctgatcaaactgcaacaggaaatggccgagctcgaagccgtgcttgagcaacacggaagccagccatctaatagctatcctagcattatctccgatagtagcgcactcgaagacctgcgaaatcctgaacagtcaacaagtgagaaggccgtccttacatcccagaagtcgagcgagtatcccatttcccagaaccctgaaggtctgtctgcagacaagttcgaggtctccgctgactcttcaactagcaagaacaaagaacccggagtcgagaggagttccccgagtaagtgcccctctctggacgaccgctggtacatgcacagttgttcgggaagcttgcagaaccgcaactacccttcccaggaggagctgatcaaagtcgtcgacgtggaagagcagcaactggaggagagcggtccacacgatctcactgaaacgagttatctacccagacaggatttagaaggaactccttatcttgaatcaggcataagcctcttctccgacgatccggaatccgatcccagtgaagatcgtgcacctgaatctgcacgggtaggaaacatccccagcagcacctcggcgctcaaggtgccccagcttaaggtcgcggagtctgctcagtctcccgctgcagcccacaccacggataccgccggatacaacgccatggaggaatctgtgtcaagggagaaaccagagctaaccgcttctaccgagagggtgaataaacgcatgtctatggtcgtaagcggactgacacccgaggagttcatgctcgtgtataaatttgcacggaaacaccacattaccctgactaatcttatcacggaggaaacaacccacgtggttatgaaaaccgatgccgaatttgtgtgcgaacggaccctaaagtatttcttggggattgctggagggaaatgggtcgtgagctatttttgggtcacacagtctatcaaggagcgcaaaatgctgaacgagcacgactttgaagtccgcggtgatgtggtcaatggcagaaatcaccagggcccaaaaagggcccgtgagtctcaggaccgcaagatcttcagaggcctcgaaatctgctgttacggaccttttacgaacatgcccaccgatcagctcgaatggatggtgcagctgtgcggcgctagcgtggtcaaggagctgtcctcctttacactcggcaccggtgtacatccaatcgtggtggtgcagcctgatgcctggacagaagacaatggtttccacgcaatcggccaaatgtgtgaggctccagtggtgaccagggaatgggtcttggatagtgttgctctctaccagtgtcaggagctagatacctacctgattccacagatccctcatagccactacta

SEQ ID NO: 27573 - DNA, 2139 bp, Artificial Sequence
  Description of Artificial Sequence: Synthetic coding sequence
atgttaaaacttctgaaccagaaaaagggcccttcacagtgtccactgtgcaagaacgatataacaaagagatcattgcaggaatctactaggttttctcaactcgttgaagagctcctcaagatcatctgcgcgttccaattggatacgggcctggaatacgccaactcatacaatttcgcaaagaaggagaataacagtcccgagcatctcaaagatgaggtgtcaataatccagtccatgggatacaggaacagagccaagcgcctgctgcagagcgagccagagaatccgtcactgcaagagacgagcctgagcgttcagctttccaacttgggcactgtgcggaccctgaggacaaaacagagaatccaaccccaaaagaccagcgtgtacattgagcttggcagcgattcctctgaagatactgttaataaggctacgtattgctctgtaggcgaccaggaactcctgcagatcacaccacagggcacacgtgacgagatatccctggactcggctaagaaagccgcatgcgagttttcggagacggatgtcactaatacagagcatcatcagccatctaataatgatctgaataccacagaaaaaagagctgccgagcgccacccagagaaatatcaaggggaggctgccagtggatgcgagagcgagactagtgtctctgaggactgctccggtctcagctcacagtcagatatcctaacgactcagcagcgggatactatgcagcataatttaatcaagctccagcaagagatggctgagttggaggcggtattagagcagcatggatcccaacccagtaatagctatccatcaatcatttcagatagcagtgctttggaggatctcagaaaccccgaacagtccaccagtgaaaaagtcctgacctcacagaaatccagcgagtaccccatcagtcagaacccagaaggattgtccgcagataagttcgaggtttcagccgatagcagtactagtaagaataaagagccgggtgtcgaacggtcatctccgtctaaatgcccatcattggatgaccggtggtacatgcactcgtgctcaggcagcctgcagaacagaaattacccgtcccaggaggaattgatcaaagtggtcgatgtggaagagcagcagctggaggagagtgggcctcacgatttaacggagacaagttatttacccaggcaagacctagaaggcacaccatatctggaaagcgggatctcgctgttcagcgacgacccagaaagcgacccaagtgaggaccgggctcccgaatccgctagagtgggaaacataccaagctccaccagcgctctgaaagtgccccaactgaaagtcgccgaatccgcgcagtcccctgctgccgctcacactaccgatacggccggatacaacgctatggaggagtctgtgagcagagagaagccagagctgaccgctagtacagaaagagtgaataaacgcatgtcaatggtggtatcaggcctcacccccgaggaatttatgttagtttacaaatttgctagaaaacatcacattacactcactaacctaataaccgaggagacaacccacgtggtcatgaaaacagacgccgaattcgtctgcgagcgcaccttgaagtactttctgggcatcgcgggaggcaaatgggtcgtgtcttacttttgggtgacacagtctattaaggaaagaaagatgctgaatgagcatgattttgaggtgaggggggacgtcgtaaatggcaggaaccaccagggacccaagagagcacgcgaaagccaggatcgaaagatattcaggggcctcgagatatgttgctatggccctttcacaaacatgcctaccgaccagctggagtggatggtgcaactgtgtggcgcttctgttgtcaaggagctgtcctcctttacgctgggcaccggcgtgcacccaatagtggtcgtgcagcccgacgcatggaccgaagacaacggcttccacgcgatcggtcaaatgtgcgaggcaccagtcgtaacacgagaatgggtgttagacagtgtggctctctatcaatgtcaggagttggatacatacttaataccacagattccacatagtcactactag

SEQ ID NO: 27574 - DNA, 5654 bp, Artificial Sequence
  Description of Artificial Sequence: Synthetic coding sequence
atggacctttctgcactgagggtggaggaggtgcaaaacgtgattaatgcaatgcagaaaattttggagtgcccgatttgtttagagttgatcaaggagccagttagtacaaaatgcgatcacattttctgcaagttctgcatgttgaaacttctcaaccagaagaaaggacctagccagtgtccattgtgcaagaacgacatcaccaaacgctcattgcaagaaagcaccaggttttcacaattggtggaagagctgctgaagattatctgcgccttccagctcgatacgggtttagaatacgcaaattcctataatttcgccaagaaggagaataacagtcctgagcatttgaaggatgaggtgtccatcatccagagcatgggctaccggaatcgtgctaaaagattattacaaagtgagccagagaacccttctctgcaggagactagtttaagcgtacagcttagcaatttgggcacagtgcgcacactgaggactaaacagagaatccagccccagaaaacttcggtttatatcgaactgggctctgactcgtccgaggacacagtgaataaagcaacttattgtagcgtgggtgaccaggaactcctgcaaatcaccccacagggaacccgagatgagattagcctggactcagcaaaaaaagcggcatgcgaatttagcgaaacggatgttacaaacactgagcaccatcagccatccaataacgacttgaacaccaccgaaaagagggcggctgaacgccatcccgagaaataccaaggctcttcagtgagcaacttacatgtcgagccctgtgggactaacactcatgcctctagtctgcagcatgagaactcgagcctgctgcttaccaaagaccgcatgaatgtggaaaaagccgagttttgcaacaaaagcaagcagcccggtctggcccgatctcagcacaatagatgggcgggatctaaggagacatgcaatgataggagaactccatctactgagaaaaaggtggatctgaacgccgatcccttgtgtgagcgaaaagaatggaacaaacagaagctcccatgttctgagaatccccgtgatacggaggacgttccatggattaccctaaattcgtcaatccagaaggtgaacgagtggttcagtcgatctgatgaactgctggggtccgacgatagccacgatggcgaaagcgaaagcaatgctaaagtcgccgatgtgctggatgtgctgaacgaggtggacgagtactctggctcctctgagaagatcgacctactggcctctgaccctcacgaggctctgatctgtaagtcggagcgggtgcattccaagtctgtcgaatcgaacatcgaggacaaaattttcggcaaaacttaccggaagaaggctagtctgcccaacctcagtcacgttacagagaatctcatcattggtgcctttgtgacagagccccagattatccaggaacgcccattgacaaataagcttaagcgaaaacggaggccaacttctggactgcatccggaagacttcatcaagaaagccgatctggccgtccagaagacacctgagatgatcaaccagggaactaaccagacagaacagaacggccaggtaatgaacatcaccaacagtgggcatgagaacaagacgaaaggggactccatacagaatgaaaaaaaccccaatccaattgagagccttgaaaaggaatctgcgtttaagaccaaagcagagcctatcagctccagtatcagcaacatggaattggaactgaacattcacaattctaaagctccgaaaaaaaacaggctccggaggaagtcgagcactagacacatccacgcactcgaactggttgtgtctcggaacttgagcccccctaactgtactgagctgcagatcgactcttgttccagctccgaagagatcaaaaaaaagaagtacaatcagatgccagtgcggcattcaaggaacctgcaactcatggaaggcaaggaaccagccactggggcaaagaagagcaacaagcccaatgagcaaacgtccaagcggcatgacagcgatacgtttcctgaacttaagctcactaacgcaccgggttcctttaccaagtgctccaacacatccgagctgaaagagtttgtgaatccttcgctgccgagggaagagaaagaagaaaagttagagaccgttaaggtgtcgaataatgccgaagacccgaaagacctgatgctgtcaggtgagagagtcttacagactgagaggtccgtggagtcttcttcaatttcactggtacctggcacagattatggaacacaggaatcaataagcctcctcgaggtctctaccttgggcaaggcgaaaacagagcccaacaaatgtgtctcccagtgtgcagccttcgagaatcctaagggtctcatccatggctgcagcaaggataatagaaacgatacggagggcttcaagtaccctcttggacacgaagtgaatcattctagggaaacgtctatcgagatggaggaatccgaactagatgcccaatatctgcagaacaccttcaaagttagtaaacgccagagctttgccccttttagtaaccccggaaacgccgaggaggagtgcgccacattcagcgctcattccggatcactgaagaagcagtcacctaaagtgactttcgagtgtgagcagaaggaagaaaaccaaggcaagaatgagagtaacatcaagccagtgcagactgtgaacattaccgccggattccctgtggtgggacaaaaggacaaacctgtcgataatgcaaagtgttcgatcaaggggggatccaggttttgtctgtcctcgcagttccgcggaaacgaaactgggctgattactcccaacaaacacggtctgttacaaaatccttacaggattccaccactctttcctatcaaaagtttcgtgaagaccaaatgcaaaaagaatcttcttgaggagaatttcgaggaacattcaatgtcaccagaacgcgaaatggggaatgaaaacatcccttcaacagtatctaccatcagcaggaacaacatccgtgagaatgtctttaaggaggctagctccagtaacatcaacgaagtaggttcatcaacaaatgaggtcggaagcagtatcaatgaaattggatcctcagacgaaaatattcaggccgagctcgggagaaatcggggaccaaaactaaacgctatgctgcgactgggtgtgctgcagcccgaagtatataaacagtcacttcccggttccaattgcaagcatcctgaaatcaagaaacaagagtatgaagaagtggttcaaacggttaatacagatttttcaccatacttgatcagtgacaacctcgaacagcccatgggcagctcacacgctagccaggtgtgttccgagaccccagacgatctgctcgacgatggggagattaaggaggacacatcctttgcggagaatgacatcaaagagagctcagccgtttttagcaaatccgtacaaaaaggtgagctaagtaggtccccgtctccctttacccacacccatctcgcgcagggctaccggaggggggctaaaaagctggagagtagcgaggagaacttaagctccgaggatgaagagcttccgtgcttccagcacctcctgttcggcaaggtgaacaacattcccagtcagagcactaggcactccacagtggccactgaatgtctgtctaagaatactgaggaaaatcttttaagcctcaaaaactccctgaacgactgtagcaatcaagttattctagcaaaagcatcgcaggagcaccatctcagtgaagaaaccaagtgctccgcgtccctattttcttcgcagtgttcagaactggaagatctaacagccaatactaacacacaggacccatttctgattggttcctcgaagcagatgcggcaccagtcagaaagccagggagtaggactgagcgataaggagctggtttccgacgatgaagagagagggaccggtctcgaagagaataaccaggaggagcagtcaatggattcaaatctcggagaggctgcttccggctgtgagagtgagacgtcggtctccgaggattgttccggcctgagtagtcaatctgacatcctcacaactcagcagcgcgatactatgcagcacaaccttattaagctccagcaagagatggccgagctggaagccgttctcgagcagcatggctcccaaccctctaactcatacccttccatcatctctgactcttcagccctcgaggatctgagaaacccggagcagagtacttctgagaaagacagccacatccatggccaacgaaacaattcaatgttttccaaaaggcctagggagcacatttctgtgctgacttcacagaagtcctcggaatatccgatcagccagaatcccgaagggctgtccgccgataaattcgaggtgtctgccgactcatccactagcaaaaacaaggagccaggggtggagcggtcatctccaagcaaatgcccgtccttagatgataggtggtacatgcattcctgctcaggcagcttgcaaaatcgcaactacccctcccaggaggagctgattaaggtcgttgatgttgaagagcaacaactagaagagagcgggcctcatgacctcactgagacctcctacctgcccagacaggatctcgaaggcacaccatacttggagtccggaatcagcctgttcagcgatgatcccgagtctgaccccagcgaggatcgcgcacccgaatctgccagggtcggtaatatcccaagtagcactagtgctcttaaagtgccacaattgaaggttgccgagtcagctcagtctccggctgccgctcatactactgacactgctggctacaacgccatggaagaatcagtgagcagggagaaaccagagctgaccgctagtacggagagggtgaacaaacgaatgtccatggtcgtttcaggcctcactcctgaggagtttatgctggtgtacaagttcgctagaaagcaccacattacgcttaccaacctcattacagaggagacaacacacgtggtgatgaagaccgatgccgagtttgtgtgcgaaaggacactgaagtatttcctgggaatcgcaggcggtaaatgggttgtgagctacttctgggtgactcagtccatcaaagagaggaaaatgctgaatgagcatgacttcgaagtgaggggggatgtggtcaatggaagaaaccatcaagggccaaagcgagctcgagagagtcaggaccgaaagatattcagaggattggagatctgctgttacggcccttttacaaacatgcctaccgatcagttagaatggatggtgcagctgtgcggggctagtgtcgtaaaggaattatcttcctttactcttggaaccggagtccacccgatagtggtcgtgcagcccgatgcctggactgaggacaacggatttcacgccataggtcagatgtgtgaagctcccgtagtcaccagggagtgggtcctggactctgtagcattgtaccaatgtcaagagctggatacctacctgatccctcaaattccacactcccactacta

SEQ ID NO: 27575 - DNA, 192 bp, Artificial Sequence
  Description of Artificial Sequence: Synthetic coding sequence
atggacctctccgccctgcgggtggaggaggttcagaatgtgatcaatgccatgcagaagattctcgaatgtcccatctgcctcgagctcattaaggagccggtgagcacaaaatgcgatcatatcttctgtaagttttgcatgctgaagctcctcaaccagaagaaggggcctagtcagtgccccctgtag

SEQ ID NO: 27576 - DNA, 192 bp, Artificial Sequence
  Description of Artificial Sequence: Synthetic coding sequence
atggacttatccgcattacgggtcgaagaagtgcagaacgtgataaacgctatgcaaaagatcctcgaatgtccgatctgtctggaattgatcaaagaaccggtgtcgacgaaatgcgaccacattttctgcaaattttgcatgcttaaactattgaaccagaagaagggccctagtcagtgtccgctctag

SEQ ID NO: 27577 - DNA, 2100 bp, Artificial Sequence
  Description of Artificial Sequence: Synthetic coding sequence
atggacctatcagccttacgggttgaggaggtgcagaacgttatcaacgccatgcagaagatactggagtgcccaatctgcctcgagctgatcaaagagccagtttccaccaaatgcgaccacattttctgcaagttctgcatgcttaaactgttgaaccagaagaagggtccctcccaatgtcccttatgtaagaatgatataacaaagcgctcactccaggaatccacgcgttttagccagctcgtcgaggaactccttaagatcatttgcgcctttcagttggacacaggccttgaatacgccaattcctataacttcgcaaaaaaggaaaataacagccctgagcatttgaaagatgaggtctccatcatccagtcgatgggctatagaaatagggctaagaggttactgcagtctgagccagagaacccgtctctgcaagagacgtccctgagcgttcagttatcaaacctgggcacagtgagaaccctgcgcaccaagcagagaatacagcctcagaaaacttcagtgtatatcgaacttggttctgacagctcggaggacacagtgaacaaggcaacctactgctcagtgggggaccaggagctgctgcagatcacccctcaggggacaagagatgagatttccttggattccgctaagaaagcagcctgcgaatttagcgagaccgatgttaccaacaccgagcaccaccagccctccaataacgatctcaatacaactgagaagcgggcagccgaaaggcatcccgagaaataccagggggaagcagcttccggctgtgagagtgaaacgagcgttagtgaagattgtagcggcttgtcctcacaatctgatatactcaccacacagcagcgtgacacaatgcaacataaccttattaaactgcagcaagagatggccgaactggaagcggttttagagcagcacggtagccagccatcaaattcttacccttccatcatctcggacagtagcgcgcttgaagatctacgcaaccctgagcagtcgaccagcgagaaggtcctcacgtcccaaaagtcctcagagtatcccatttcccaaaaccccgaaggactgagcgcggacaagtttgaggtgtccgccgacagctcaaccagcaagaacaaagagccaggagtggagcgctcctcaccctctaaatgtccatccctagatgatcgatggtatatgcactcatgttccggcagcttacaaaaccggaattaccctagtcaggaggaacttataaaagtggtagacgtagaggaacaacagcttgaagaatccgggcctcacgacctaactgagacatcctacctgccaaggcaagacctggaaggcacaccatacttagagtctggcatctcactattcagcgatgatcccgagagcgacccgtctgaggaccgggctccagagtccgccagagtgggcaacatcccttcctccacgagtgcgctgaaggtcccacaattgaaagtagcagaaagcgcacagagccccgcagctgctcacactaccgatacagcgggttataatgccatggaagagtctgtgagcagagaaaagcctgagcttactgccagtactgagagggtgaataagcggatgtctatggtggtttctggtctgacaccagaagaattcatgttggtgtataaattcgcgagaaaacatcacatcaccctcaccaacctgattacagaagagactacccacgtggtgatgaaaacagacgcggaatttgtttgtgaacggactcttaagtactttctcggcattgcagggggtaaatgggtggtttcctatttttgggtgacccagagtattaaagaaaggaagatgctgaacgagcacgactttgaggtgcgcggagacgtagtgaatggtcggaaccaccaggggcctaaaagagcccgagagtcccaggatagaaagatctttcgaggcctcgagatctgttgctacggcccattcactaacatgcctaccggctgtccaccaaattgtggctgtgccgcacgatgtctggatcgaggccaatggctgccgtgcaactgggcggacgtctag

SEQ ID NO: 27578 - DNA, 1950 bp, Artificial Sequence
  Description of Artificial Sequence: Synthetic coding sequence
atggatctcagcgccctgcgtgtggaggaggttcagaacgtcataaatgcgatgcagaaaatccttgaatgccccatttgtctggaactaattaaagaaccagtgagcacaaagtgcgatcacatcttttgtaaattttgcatgctgaagctgcttaatcagaaaaaaggcccatcacagtgcccgctctgcaaaaacgatattaccaagaggtcgctccaggagtcaacacgcttctctcagttggtggaggaactactgaagattatctgtgcatttcagcttgataccgggctggagtacgcaaactcttataactttgctaagaaggagaataactccccagagcatctgaaagacgaagtgagtatcattcagtccatgggataccgcaatagagcaaaacggctgctgcagtctgagcctgaaaacccaagtttacaggagacatccctcagtgtgcaactgagtaacttggggacagtacgcactcttcggactaagcagcgcatccaaccccagaaaaccagcgtctatatagagctcggatccgatagctcggaggataccgtgaacaaggccacatattgcagtgtaggcgatcaggaactcttgcagattacaccccagggtactagggacgaaatctctttggattctgctaaaaaggccgcttgcgagtttagcgagaccgatgtgaccaacacggaacaccatcagcctagcaataatgatttaaacaccacggagaagagagcggctgaacggcacccggaaaaataccaagggagctcagtatccaatttgcatgtcgagccttgtggaactaacacgcatgcgagttcactgcagcatgaaaacagtagtttgctgctgactaaagacagaatgaatgtagaaaaggccgagttttgtaacaagagcaaacagcctggtctggccagaagtcaacacaataggtgggctggatcaaaagagacgtgcaacgatagaaggacccccagtactgagaaaaaggtcgacctgaacgccgacccactttgcgagagaaaggaatggaacaagcaaaaactcccctgtagcgaaaacccgcgtgacactgaagatgtcccctggattaccctgaactcttcgatacagaaggtcaacgagtggttttccaggtccgacgaacttctcgggtccgatgattcccacgacggagagtcagaatccaatgcaaaggtggccgatgtcctggatgtacttaacgaagtggatgagtactcaggtagtagtgagaaaatcgatctattggccagtgacccccacgaagccctgatttgtaaatcagagcgggtacactccaagagcgtggaatcaaatatagaagacaagatttttgggaagacctatcggaagaaagcctctctacccaacctttcgcatgtaacagaaaatctgatcattggcgcattcgtgactgaaccccagattattcaggaacgacccttgactaacaagctaaagcggaaaaggcgacccacatccgggctgcacccagaagatttcataaagaaggccgacctcgcagtgcagaaaacgcccgagatgattaatcagggtaccaaccagacagaacagaacggccaagttatgaatatcactaactcaggtcacgaaaataagactaaaggcgatagcatccaaaatgaaaagaatccaaatcccattgagagcctggagaaggagagtgctttcaagactaaagcagagcctatctcatcatctattagtaacatggagctcgagctgaacatccacaattcaaaggctcctaagaagaaccgactgcggagaaaatcttctacgcgccacatccacgcccttgagcttgtggtaagcagaaacttgtccccaccaaattgtaccgaattgcagatcgactcctgttcttccagcgaagaatag

SEQ ID NO: 27579 - DNA, 5657 bp, Artificial Sequence
  Description of Artificial Sequence: Synthetic coding sequence
atggacctgtccgcgctaagggtggaagaagtccaaaatgtaatcaacgcaatgcaaaagattcttgaatgtcccatctgtttggaacttattaaggaacccgtatcaaccaagtgcgaccacatcttctgtaagttctgcatgctcaagctcctcaatcagaagaaaggcccatctcaatgtccactgtgtaagaacgatatcactaaaagaagtctgcaagagagcacccgcttctcccaactcgtcgaggagctgctcaaaattatttgcgcgtttcaattagatacaggcttggagtacgctaactcatacaatttcgccaaaaaagaaaataacagtcccgaacacttgaaagacgaagtttctattattcagagtatggggtaccggaatcgggcaaagcgcctgttacagtctgagcccgaaaacccttctctgcaggagacgagcctgtcagtccagctatcgaatcttggtacagtcaggaccctgcggacaaagcagcgtatccagccacagaagacctctgtctacattgaactcggttctgactccagtgaggacaccgttaacaaggcgacatattgtagtgtgggcgatcaggagctcctgcagatcaccccacagggaacaagggatgagataagtcttgatagtgcaaagaaggcggcatgcgaattttccgagacagacgtcactaatactgagcaccaccagccgagcaataacgatctgaatacgactgagaagagggccgcagagagacaccccgagaaatatcaggggtcttctgtaagcaacctgcacgtcgaaccctgcggtaccaacacgcacgcaagcagtctgcaacacgagaattcttccctcctattgacaaaagataggatgaatgtagagaaggccgagttctgcaataaaagtaagcagccagggttagcacgatcacagcataataggtgggcagggagtaaagagacttgcaatgacagacgaactccatctaccgaaaagaaggtggacctgaatgccgatccattgtgcgagcgcaaggagtggaacaaacagaagttgccctgcagcgaaaaccctagggacacagaagatgtaccctggattacactcaatagctctattcagaaagtgaacgagtggttctctagaagcgacgagctgctgggctcagacgacagtcatgatggtgagtctgaatcgaacgccaaagttgccgacgtattggatgttctgaatgaagttgacgagtattccggttcttctgagaaaatcgatctgctggcaagcgatccgcacgaggccctgatttgtaagtccgaacgagtccactcaaaaagcgtggagtcgaatatagaggacaaaatctttgggaagacatatagaaaaaaagccagcctgcctaatctgtcacacgtaacagaaaacctgatcatcggtgcttttgttacggaaccccagattatacaggaacggccactgactaacaagctgaaacggaaaagaaggcctacttcgggtttgcaccccgaggacttcattaagaaagccgatctggctgtgcaaaagacgccagagatgattaaccagggaaccaaccagacagagcagaatggccaggtgatgaatatcactaattcgggacatgaaaacaaaacaaaaggcgattctatccaaaatgaaaaaaaccccaaccctatcgaatcattggagaaggagagcgcattcaagaccaaggctgaaccaattagttcatctatctccaatatggagttggagctcaacattcataatagcaaggcacctaagaaaaacaggctcaggagaaaaagtagtacccgccatattcacgcactagagttggtcgtgagccgaaacctatctcccccaaactgtaccgaactgcaaatcgattcctgctcctcctcagaagagatcaaaaagaagaaatataatcaaatgccagtccgacacagtcgcaacctccagctgatggaaggcaaggagcctgctacaggcgcaaaaaagtctaacaagcccaacgagcagacgtcaaaaagacacgactctgatacatttcctgagctcaagctgaccaatgcacccggaagtttcactaaatgttccaatacatctgagctgaaagagttcgtgaacccgtcccttcccagagaagagaaagaagagaaacttgaaactgttaaagtttccaataacgctgaggacccaaaggatctcatgctatccggggaaagggtgctgcaaaccgaaagaagtgtggaaagttcatccatctctctcgtcccagggactgactatggcacacaggaaagcattagcctgttagaggtgtccacacttggcaaggccaagaccgaacctaacaagtgcgttagccagtgcgctgcattcgaaaatcccaaaggactcattcatggatgtagtaaggataatagaaatgacaccgagggtttcaagtacccactgggacacgaagtgaatcattccagagaaaccagcatagaaatggaggagtccgagctcgacgcccaatacttgcaaaacacgtttaaagtttctaaaagacagagctttgccccttttagcaatccgggtaatgcagaagaagaatgcgcaacatttagtgctcacagtggcagtctaaaaaaacagtctcccaaagtaacatttgagtgtgagcagaaggaagagaaccaggggaagaacgagagcaacattaagcccgtacaaacagtgaatattactgctggcttcccggtggtgggacaaaaagacaaaccagtcgataatgcgaagtgtagtatcaagggtgggtctcgtttttgcctgtccagtcaattccgaggtaatgaaaccggactgatcactcccaacaaacatgggttactgcagaatccctaccggatccctcctctgttccctatcaagagtttcgtgaaaacaaaatgcaagaaaaacctgctggaggagaacttcgaggaacactctatgtcacccgaacgggaaatgggcaacgaaaacatccctagtactgtatctaccatttctaggaacaatattagagagaatgtgttcaaggaggcgtcctcttccaatatcaatgaagtcggttcgtcaaccaatgaggtgggaagcagtattaatgagatcggctcctccgatgaaaacattcaggcagaactgggccgaaatagagggccaaaattgaacgccatgctccgattaggcgttctgcagcctgaggtttacaaacagagtctgccgggtagcaactgcaagcacccggagattaaaaaacaagaatacgaggaagtggtacagaccgtaaatacggatttctctccttatctcatctcagacaacctggagcagccaatgggttcatcccacgcctctcaggtgtgctctgaaacccccgatgacctgctggacgatggagagatcaaagaggacacaagcttcgcagagaacgatatcaaagagtcatccgcagtcttctcaaaatctgttcagaagggggaactgagtcgtagtccatcaccgtttacccacacccaccttgctcagggttacagaagaggagctaagaaattagaatccagtgaggagaacttatcttcagaggacgaggagctcccctgctttcagcatttgcttttcggcaaggtcaataacattccaagtcagagcacgcgtcacagtactgtagccaccgagtgcttatcaaaaaatacagaagagaacctgctgagtctgaaaaatagcctgaatgactgtagtaatcaggtgattctggcaaaagctagtcaggagcatcatttgagcgaagagaccaaatgttcagctagcttatttagtagccagtgtagcgaactggaagacctcaccgcgaatactaacacccaggatcctttccttatcgggtcttcaaagcagatgcgccaccaatccgaatctcagggggtaggacttagtgataaagaactagtgagtgatgatgaagagagaggaactggtctggaggagaacaatcaggaggagcaaagcatggactctaacctgggtgaggccgctagcggctgtgaatcggagaccagcgtgtcggaggactgctcagggctgagcagccagtcagacatacttacaacccaacaacgcgacactatgcaacataacttgataaaactgcagcaggaaatggcggagcttgaggccgtattggagcagcacgggtcacagccatctaacagctacccctctattatctcagatagttccgcactcgaggatttaaggaatcccgagcagtccacatcggaaaaggactcccatatccatggccagagaaacaattccatgttcagtaagcgcccacgtgaacatatctcggccgttctcaccagccagaaaagttccgaataccccatttcccagaatccggaaggtctgtcggctgataaatttgaggtctccgccgacagcagtacctcgaagaataaggaaccgggagtcgagcgctctagccctagtaaatgcccttcactggatgatcggtggtacatgcactcatgcagtggctccttgcagaacagaaactatcccagccaagaggagttaataaaagttgtagatgtcgaagaacagcagctggaggaaagtggtccacacgacctcaccgagaccagctacctaccacgtcaggacctcgagggaactccctaccttgaatcaggaatcagcctttttagcgacgatcctgagtccgacccttccgaagacagggcaccagagtcagctagggttggcaacattccatcatccacctctgcccttaaagtgccccaactgaaggtggccgagagcgcccagtcgcccgcagctgcccatacgaccgatacggcaggctacaatgccatggaagaatcggtaagcagagagaagcccgaattgaccgcctcgactgaacgcgtgaacaagcgtatgtccatggtggtttcaggtctgacaccagaggagtttatgctcgtgtacaaattcgcccgaaaacaccacattactttgacaaatctcattacagaggagaccacacacgtggtgatgaagaccgacgctgagtttgtctgtgaacgcactttgaaatatttcctgggaattgctggcggaaagtgggtggtaagctatttttgggttacccagtctataaaggaaagaaagatgctgaatgaacacgatttcgaagtcagaggagatgtggtcaacggaaggaatcaccagggacctaaacgagcccgagaaagtcaggacaggaaaatcttccgtggcctggagatatgttgctatggaccatttaccaatatgcccaccgaccaattggagtggatggtgcagctgtgtggcgcttcagttgtgaaggaactgtcttcattcaccctcggaacgggcgtgcatcctatagtcgtggttcagcctgacgcctggacggaggataacggctttcatgctattggtcaaatgtgcgaagccccagttgtgaccagagagtgggttctcgacagtgtggcgttgtaccagtgtcaggagttagacacctacctgatcccccagatccctcattctcattacta

SEQ ID NO: 27580 - DNA, 669 bp, Artificial Sequence
  Description of Artificial Sequence: Synthetic coding sequence
atggacctgtccgctctacgcgtggaggaagtgcagaatgtgattaacgccatgcagaagatcctcgagtgtcctatttgcctggaactcattaaggagccagttagtacaaaatgtgatcacatattctgtaaattttgcatgctcaaactgctgaatcagaagaagggaccatcccagtgtcctctgtgcaaaaacgatatcacaaaacggtccttacaggagtccacaagatttagccagcttgtcgaggaactattaaagatcatttgtgcatttcagctggacacagggctggagtacgccaatagttacaactttgccaagaaagaaaataactccccagaacacctgaaggacgaggtttccattatccagtcaatggggtaccggaatagagccaagagactattgcagtcagaacccgaaaacccatcactggaaacttcactgagcgtgcagttgagcaacctcggtacggtgcgcacactccggacaaagcagcgcattcagcctcagaaaaccagcgtgtatattgaattaggatctgactcttccgaggacacggtcaataaggcgacctattgcagtgtgggggaccaggagctgctacagatcaccccccaggggaccagggacgaaatctccctggatagcgcgaagaagtag

SEQ ID NO: 27581 - DNA, 1869 bp, Artificial Sequence
  Description of Artificial Sequence: Synthetic coding sequence
atggacctttccgctcttagagtcgaagaggtgcagaacgtaattaatgctatgcagaagattctcgaatgccctatatgccttgagctgatcaaggaaccggtttccaccaagtgtgatcacatcttttgtaaaagtttacaggaatccaccagattctcccagctggtggaggagctgctgaagatcatttgcgcatttcagctggatacggggctggagtacgctaattcctacaactttgccaaaaaagagaataattcacccgagcatctgaaagatgaggtgtccattattcagtcgatggggtacaggaaccgcgctaaacggttattacagagcgaacctgaaaaccccagtctgcaggagacctctctgagcgttcaactgagcaacctgggcaccgtccggacgctcagaactaaacagagaattcaaccccagaaaacatctgtgtacatcgaacttggaagtgatagctctgaggataccgtaaataaggctacttactgcagcgtgggcgaccaggagctgctgcagatcacccctcaggggacaagggatgagatatctctggactctgccaagaaggctgcatgcgagttttcagaaaccgacgtgacaaatactgaacatcatcagccctcaaacaacgacctgaatacgacagagaaacgcgcagcagaacgtcatcccgaaaaatatcaagggtctagcgtgtctaacctgcacgtggaaccctgcggcactaacacccacgcctccagtcttcagcacgaaaacagttcactgctgctcacaaaagatcgtatgaacgtggaaaaggcagaattctgcaacaagtccaaacagcccggtttggccaggagccagcataacaggtgggcgggtagcaaagagacttgtaatgacagaaggaccccatcaacggaaaaaaaggtggatctgaatgccgatcccctgtgcgagcgtaaagaatggaataaacagaagttgccttgctccgagaatccacgtgataccgaagatgtcccctggataacactgaatagcagcattcaaaaagtgaatgaatggttctctagaagcgacgagctgctcggctcagacgactcccacgatggagagtccgagtcaaacgctaaggtggcggacgttctagacgtgcttaacgaggtcgatgaatattcaggtagcagtgagaaaatcgacctcctggcatccgatcctcatgaagccctgatctgcaaaagtgagagggtccattcgaaatccgtggagtccaacatcgaggataagatttttggcaagacgtatcgtaaaaaagcatcccttccaaacctttcgcatgtcaccgagaatctgatcataggcgcattcgtgactgaacctcagatcattcaggaacggcctctcaccaacaagttgaagcggaagcgcaggccgacatctggattgcacccagaagatttcattaaaaaggccgatttggcggtgcagaagacccccgagatgatcaaccaaggtacaaaccagacagagcagaacggccaggtgatgaacatcactaacagcggccatgaaaataagacgaagggagatagtatccagaacgagaagaatccgaatcccatagagtccctcgaaaaggagtccgcctttaagacgaaggcagaaccaatctcgtcttctatcagtaatatggaactggagctgaacattcacaactctaaggccccaaagaagaaccggcttcgacgcaagtcctctacccggcatatacacgcgctggaactggtggtctcaaggaatcttagcccacccaactgcacggagctgcagattgacagttgttcatcctcagagtag

SEQ ID NO: 27582 - DNA, 1872 bp, Artificial Sequence
  Description of Artificial Sequence: Synthetic coding sequence
atggatttgagtgccctccgagtcgaagaagttcaaaatgtcattaacgcgatgcagaagattctcgaatgtcccatttgtcttgaactgatcaaggagccagtgtctacgaagtgcgatcacatcttctgtaaattttgcatgctcaaactgcttaatcagaagaagggaccctcccagtgccctctttgcaagaacgacattaccaagcggtcactgcaggaaagtacaagatttagccagctcgttgaagaactcctgaagatcatatgcgctttccagttagatacagggctggagtacgccaactcctacaacttcgctaaaaaggaaaataatagccctgagcacctgaaagatgaggtgtcaatcatccaaagcatgggctatcggaatcgggctaagcgcctactccaatcagaaccagagaatccctctctagaaacctctctgtctgtccagttgtctaacttaggaacagtccggacgcttaggaccaagcagaggatacagcctcagaaaacatctgtgtatatcgaactgggaagcgatagcagtgaggacacagttaataaagctacatattgctcagtcggcgaccaggaactgctgcaaataaccccacaagggactcgcgacgagattagtctggatagtgcgaagaaagctgcgtgtgagtttagtgagacagacgtgaccaacactgaacaccatcagccatcgaacaatgacctaaacactacagagaaaagagccgcagaacggcaccccgaaaaataccagggcgaagctgcaagcgggtgtgagtcagaaacatctgtctctgaagactgtagcggactatcttcccagtcagatatcttgaccacacagcagcgagataccatgcagcacaatctgatcaaactgcagcaagagatggccgaattggaggcggtgctagagcagcacggtagtcagccatcaaactcgtacccatccataataagcgatagtagcgcactagaggacttacgtaatcctgaacagtccaccagcgaaaaggctgttcttacatcacaaaaatctagtgagtatcccattagtcagaatccagagggactcagcgcagacaagtttgaggtctcagccgactcctccacatcaaaaaacaaggagcctggcgtcgaacggagctccccttccaaatgtcccagtctggacgatagatggtacatgcacagttgttccggttcgctacagaatcggaattacccaagccaggaagagctcattaaggtcgtggatgtggaagagcaacagttagaggagtcaggaccccacgatctgaccgagacctcatacctacccaggcaggatttggaggggacaccataccttgaatctggcatcagcctgtttagcgacgaccccgagtccgatccctccgaagatagagccccagagtctgctcgcgttggaaatatcccgagtagtaccagcgcactgaaagtgccccagcttaaggtagccgagtcagcccaaagcccagctgccgcacacactacagatactgcaggatacaacgccatggaggaatctgtctctcgtgagaaaccagagcttacggcgagcaccgaacgagtgaacaaaagaatgtctatggtggtcagcggactcacgcccgaagagttcatgctggtctacaagtttgcacggaagcaccatatcacactgacaaacctaatcaccgaagagaccacccatgtcgtgatgaaaacggacgccgagtttgtgtgcgagcgcacactgaaatactttctgggaatcgccggagggaagtgggttgtttcttatttctgggtcacgcagagcattaaagagcggaaatag

SEQ ID NO: 27583 - DNA, 1497 bp, Artificial Sequence
  Description of Artificial Sequence: Synthetic coding sequence
gagttacttaaaattatatgtgccttccagctggatacagggctggaatatgcaaattcatataacttcgcaaaaaaggaaaacaatagtccagaacacctgaaagatgaggtgtccatcattcagagtatgggataccgcaacagagccaaaaggttgctccagagcgaaccagagaatcccagtctggagacttcactttccgtgcagctatccaacttagggaccgttcggactttgagaactaagcaaaggattcagccacaaaaaacaagtgtctatattgaactggccgcatgtgagttcagtgaaactgacgtgacaaacacggaacatcatcaaccgtctaataacgatctgaatactactgaaaagagggctgcagagcggcacccggaaaaatatcagggggaagcggcatctggttgtgaatctgagacgagcgtgagtgaggattgctctggcttgagctcacagtcagacattctgactacgcagcagagggatactatgcaacacaatttaataaagcttcagcaagaaatggccgagcttgaagccgtgctggagcaacacggctcacagccctcaaattcatacccttctataattagtgatagcagtgcattggaggacctgcggaaccccgaacaaagcacgtctgaaaaagccgtgctcacgagccagaaaagcagcgagtaccctatatcccagaatccagaagggctctccgcagacaaatttgaagtgtcagcggatagcagcacaagcaaaaataaggaacccggagtagaaagaagctccccgtccaagtgcccgagtctcgacgaccggtggtacatgcacagctgctctggctcactccagaataggaactacccgagtcaagaggaactgattaaggttgtagacgttgaggagcagcagctggaggagtcggggccacacgaccttacggagacctcttatctccctagacaggacctggaggggacaccctacctggaatccgggatttccctgttcagtgacgatccagagtccgatccttccgaagatcgggctcccgagtcagcgcgagtcggaaacataccctctagtacgtcagcgctcaaagtgccccagttgaaagtggcggaatcggcccagtcacctgctgctgcgcatacaaccgacactgccggatacaacgcgatggaggagagtgtctcacgtgaaaagcctgaactcacggcctcaaccgaaagagtgaacaagcggatgtctatggtggtttccggactcacacctgaagagttcatgttggtgtacaagtttgctagaaagcaccacatcacacttaccaacctgattacagaggagactacccacgtcgtgatgaagacagacgcggagttcgtgtgcgaaaggactctgaagtactttctgggaattgccggagggaaatgggtggtgtcctacttttgggtcacccagagcatcaaggagcggaagtag

SEQ ID NO: 27584 - DNA, 297 bp, Artificial Sequence
  Description of Artificial Sequence: Synthetic coding sequence
atggatctgtccgcactccgggtggaagaggtccaaaacgtgataaatgcaatgcagaagatattggaatgccccatctgcttggagttgatcaaagaacccgtgagtaccaagtgtgaccatattttttgcaaatcactgcaggagtcgaccaggttcagccagctggtggaagagttgcttaagatcatctgcgcctttcagctcgataccgggctagagtatgctaacagctataatttcgccaagaaagagaataactccccggaacatctgaaggatgaggtgagtatatag

SEQ ID NO: 27585 - DNA, 2280 bp, Artificial Sequence
  Description of Artificial Sequence: Synthetic coding sequence
atggacctcagtgccctgagggtggaggaggtacaaaatgttataaatgcaatgcagaagatcctggaatgtccaatctgtctggaattgatcaaagagcccgtttcgactaaatgcgaccatattttttgcaagttttgcatgcttaaactactgaaccagaaaaaagggccatctcagtgccccctgtgtaagaatgatatcaccaaacgttctctacaggaatccacccgcttcagtcagttagtggaggagttgttaaaaataatctgcgcatttcagctggatacaggccttgagtatgccaatagttataacttcgccaagaaggaaaacaactctccggaacatctgaaagacgaagtgtcaattatacaatctatgggctatagaaatcgggctaaacgtttgctgcaatcggagcctgagaatccctccctccaggagacttccctgagcgtgcagctgagcaatctaggcactgtcagaaccctgcggacaaaacagcgaattcaacctcaaaaaacctcagtgtatattgaactggggagtgatagctctgaagataccgtcaataaggctacctactgttcggtaggtgatcaagaactgttacagattactcctcagggaacccgtgacgagatcagccttgactcagccaaaaaggccgcatgtgaattctccgaaaccgacgtgaccaacaccgaacatcatcagccgtcgaacaacgacctgaacacgactgaaaagagagccgcagagcgccaccctgagaagtaccagggcgaggccgcttccggctgtgagtctgaaacttctgttagtgaagattgctccgggctgtcctctcaatccgatatcctgaccacccaacaacgggacaccatgcagcataatctgattaaactgcaacaagaaatggcagaactggaagccgtgctagagcagcacggctcccagcccagcaactcttacccgtctatcatatctgattccagcgcactggaggatctaaggaaccccgagcaatccacctctgagaaggtgctaacgtcccagaagagctccgagtacccaatctcccagaaccctgagggtctgagtgcagataagtttgaggtcagcgcagactccagcacatctaagaataaagaacctggcgtggagcggagctcccccagtaagtgcccctctctggatgacagatggtatatgcattcgtgtagcgggtctttacagaaccgtaattacccatcacaggaggaactcataaaggttgttgacgtagaagaacagcagctggaagaatcaggaccccacgacctgaccgaaacatcatacctcccgcgacaagatttggagggcacaccctacctggagagcggcattagccttttcagcgacgaccctgagtctgacccttccgaagaccgggcacccgaatccgccagagtgggtaacataccatcttctacttctgccctgaaagtcccccagctgaaggtggccgaaagcgcccagtcccctgccgcagcacatacaaccgatactgctggatacaacgctatggaagaatctgtgagccgggagaaacccgaactgactgccagcaccgaacgagtcaacaaaaggatgagtatggtagtgagtggcctgacacctgaagagtttatgttggtgtacaaatttgccagaaaacaccacatcacgctgaccaatctaatcacagaggaaacgacacacgtagtcatgaaaacagatgcagaattcgtgtgtgaaaggaccttgaagtatttcctgggcatagcaggaggcaagtgggtggtgagttacttctgggttacccagtcaatcaaggaacgcaagatgttaaatgaacacgatttcgaggtgagaggagacgtagtcaacggacgtaatcatcagggcccaaagagagcccgagaaagccaggacaggaaaatcttccggggactggagatctgctgctatggcccatttaccaatatgcccacagaccagctcgagtggatggtgcagctctgtggagcgtcagtggttaaagagctttcctctttcactctgggcaccggcgtgcatcccattgtggtcgtacaacctgatgcatggacagaagataacggctttcacgcaataggacagatgtgcgaagcacccgtggtaactagagagtgggtcctggactcagtggccctataccagtgccaggagctggacacgtatctaattcctcagataccacattcacactactag

SEQ ID NO: 27586 - DNA, 180 bp, Artificial Sequence
  Description of Artificial Sequence: Synthetic coding sequence
atggatctgtcagctctgcgagtcgaagaggttcaaaatgttataaacgcgatgcaaaaaattttagaatgccccatctgcctcgaactgatcaaagagccagtttcaacgaaatgcgatcatattttttgtaaagtgttactctgctgcccatcttggtccacagtggtcaggtcttag

SEQ ID NO: 27587 - DNA, 5450 bp, Artificial Sequence
  Description of Artificial Sequence: Synthetic coding sequence
atgctgaagctgctgaaccagaagaagggaccatcacaatgcccgctctgtaaaaacgacatcaccaaacgttccctacaggaaagtacccggttctcgcaattggtcgaggagctgttgaagataatttgtgcatttcagctagacactggcctggaatatgcgaactcttacaatttcgcaaagaaggagaacaatagccccgaacacctgaaggacgaagtcagcatcatccagtccatggggtaccggaatagggcgaagcgcttgctccagtccgagcccgagaatccttcactgcaggagacaagcctgagtgtccagctgtcgaatcttggcacggtcagaacgctgcgtacaaaacagcgaatacagccccagaagacatctgtgtacattgaactgggctcagattcttctgaggatactgtgaacaaggctacgtactgttccgtgggagaccaggagttgctccagatcacgccacagggtacacgggacgaaatcagcctggattcagccaagaaggcggcatgtgagtttagtgagaccgatgtcacaaacactgagcatcatcagccctcaaataacgacctgaataccaccgagaaaagggctgccgaaaggcaccccgagaagtaccagggctctagcgtcagtaacctccacgtggagccatgtggcaccaatacccatgctagctctctccagcatgaaaacagcagcctgcttttaaccaaagatcgcatgaacgtggagaaggccgagttttgtaacaagagcaagcaaccgggacttgctcggtcccagcacaaccgttgggcgggatctaaggagacctgcaatgatcgcagaacccccagcacggaaaaaaaggtggacctcaatgctgatccactgtgcgagcgcaaagagtggaataagcaaaagctgccctgttcggagaatcccagggatacagaagatgtgccttggatcacgctgaattccagtatccaaaaggtcaatgagtggttttcccgctcagacgagctgctcgggagcgatgacagtcacgatggcgaaagcgagagcaacgccaaggtcgccgatgtactggacgttctgaatgaagtggacgagtatagcggaagctccgagaaaattgacctgttagcaagtgaccctcacgaagctctaatatgtaagagtgaacgcgtgcactctaaatctgtggagtccaatatcgaggataagatttttggaaaaacctaccgtaaaaaggccagtctgccaaatctctcccatgttactgagaatttgatcatcggtgccttcgtgacagagcctcagatcattcaggaacgaccccttaccaacaagcttaaacgcaagagaagaccgacaagtggactccaccctgaggatttcatcaagaaggccgatttagcagtgcagaagactcccgaaatgattaatcagggcacaaaccagactgagcagaacggacaggtgatgaacattaccaatagcggccacgagaataagaccaagggcgatagcatccaaaacgagaagaatccaaaccccattgagagtctagagaaagagagtgccttcaagaccaaggctgagccgataagttcatctatttctaatatggagcttgagctgaatatacataatagcaaagcaccaaaaaagaaccgcctcagacgcaaaagctctaccaggcacatccatgccctggagctggtcgtatcgcgcaacctgtcgccccctaattgtacggagctccaaattgatagctgtagcagctcagaggaaatcaaaaaaaaaaaatacaaccagatgccagtgaggcacagccgcaacttacagctgatggaggggaaggagcccgcaacaggcgctaagaagagcaacaagcctaatgaacagaccagcaagcggcacgatagtgacactttccctgagttgaagttgaccaacgccccaggcagctttaccaaatgttccaacacctcggagctgaaggagttcgtaaatccttccctgccaagagaagaaaaggaagaaaagcttgagaccgtgaaggtgtcgaacaacgctgaggaccccaaagatctgatgctgagcggcgaacgcgtgctccagaccgagcgctcagtggagagcagtagcatctctctcgtaccagggacagactatggaacccaggagtcaatttccctgctggaagtatctacattggggaaagcaaagacagagcccaataaatgcgtttcccagtgcgctgcatttgaaaatcccaagggccttatccatggctgttcaaaggataatcgtaatgacacagagggcttcaagtatcctctcggacacgaagtgaatcattcacgggagacgtcaatagaaatggaggagagcgagctcgatgcccagtatcttcaaaacactttcaaggtgtctaagaggcagtccttcgcgccattctctaatcctggtaacgcagaggaggagtgcgcaaccttttcagctcatagtggcagcctgaaaaagcagagtccaaaggtaacttttgaatgcgagcagaaagaggagaaccaaggcaagaacgagagtaatatcaagcccgttcagactgtgaatatcactgctggttttccagtggttgggcagaaagacaaaccagtggataacgcaaaatgtagcattaagggtgggtcccggttctgtttgtccagtcaatttcgcggaaatgagacgggcttgattacccctaataaacatggactgctgcagaatccgtatcgaatcccacccctttttcctattaagtcttttgtaaagacgaagtgcaagaaaaatcttctggaagaaaacttcgaggagcactctatgtcgcccgaacgcgaaatgggtaatgagaacattccgagcaccgttagcactatcagccgtaacaacattagagaaaacgtttttaaggaggcctcctcctccaacattaacgaagtagggtcaagcaccaacgaggtgggcagcagtatcaatgagattggctctagcgatgagaacatccaggccgagctggggagaaatcggggtcccaagctgaacgcgatgctgcggctcggggtgttacagccagaagtatataaacagtccttgccagggagtaattgtaaacatccggaaatcaaaaagcaggaatatgaagaggtggtgcagaccgtgaataccgactttagtccgtatctcataagcgataaccttgagcagcccatgggcagttctcacgcctcccaagtgtgctccgagacgcccgacgacctgctcgatgacggcgagattaaggaagatacttcttttgcagagaacgacattaaagaatctagcgctgttttctctaagtccgtgcaaaagggggagctctcccggtcaccttccccgttcactcatacccatctggcgcagggatacaggcggggtgccaagaagctggaaagtagtgaagaaaacctcagcagtgaagacgaagagctgccctgtttccagcacctgctcttcgggaaggttaataacattcccagtcagtccacaagacactccacggttgcaaccgagtgcttgtctaagaatacagaggagaacttgctgtcactgaagaattcgctaaatgattgtagtaaccaagtaatcttggcgaaggccagccaggaacaccatctttctgaagaaacaaagtgctctgctagcctgttttcgtcgcaatgttccgaactggaggacctgacagctaatacaaacacgcaggaccccttcctgattgggagcagtaagcaaatgcggcatcaaagcgagtcgcagggcgtggggctgtccgataaagagctcgtgtccgacgatgaggaacgcggaaccggcctggaggagaataaccaggaagaacagtctatggattcgaacttaggagaggccgcttctgggtgtgaatccgagacatctgtatccgaagactgtagcgggttgagctcccagagtgacattctcacaacccagcaacgcgacacaatgcagcacaatttgattaagctccaacaggagatggcagaactggaagctgtgttggaacaacacggatctcagccgtctaattcctacccttcgattatctccgattcaagtgctttggaagacctccggaatccagaacagagcacgagcgaaaaggcggtcctgacaagccagaagtcttcagagtatccaatttcgcagaatccagaagggctgtcggccgacaagtttgaggtgagcgccgattccagcacatccaagaacaaagagccaggggtggaacggtcgtcgccaagtaaatgtccaagtttggatgatcgatggtatatgcactcatgctctggaagtttgcagaataggaactatccatcacaagaggaacttattaaggttgtggacgtcgaagaacagcagctagaagagagcgggcctcacgacctgactgaaacttcctaccttcccaggcaggatctggaagggacaccgtatctagagtccgggatctccctgtttagcgacgacccagagtcagatccttccgaggaccgagccccagagagcgcacgtgtagggaacatcccaagcagcacctccgctctaaaggtacctcagctgaaggtagctgaatccgctcaatcccccgctgctgcgcataccactgataccgcaggttataacgctatggaggagagtgtgagtagagagaagcccgaactgaccgcgagcaccgagagggttaataaacgtatgtcaatggtggtaagtggtctgacgcctgaggaatttatgctggtgtacaagtttgcgagaaagcaccatatcaccctgaccaacctgattaccgaagaaaccacccatgtcgtcatgaagaccgacgctgagtttgtatgtgaaaggacccttaaatattttttgggtatagctggcggtaaatgggttgtgagctatttctgggtgacacagtctataaaggagcggaaaatgctgaacgaacacgatttcgaagtgaggggagatgtggtcaacggcaggaatcatcaaggccctaaacgggctagggaatcccaggatcggaagattttccgcggactggaaatttgttgctacggtcctttcacaaatatgcctacagatcaactggaatggatggttcagctgtgtggcgcttcagtcgtcaaggagctctcatctttcaccttggggactggcgttcatccaattgtggttgtccagcctgatgcatggaccgaggataatgggtttcacgccatcggtcaaatgtgtgaagcgccagtagtgacacgcgaatgggtgcttgactccgttgcactgtatcaatgtcaggagttggacacataccttattcctcagatcccccactcccactacta

SEQ ID NO: 27588 - DNA, 1719 bp, Artificial Sequence
  Description of Artificial Sequence: Synthetic coding sequence
atgctcaagctcctgaatcagaagaagggtcctagtcagtgccccctttgcaagaatgacatcaccaaacgctccctccaggaatcgactcgatttagccagctggtggaggagcttctcaagatcatctgtgcatttcagcttgacacaggcttggaatatgccaattcctacaatttcgctaagaaagaaaacaacagtcctgagcatttaaaagacgaggtgtctatcatccaaagcatgggatatagaaaccgggcaaaacgcctgctgcagtctgagcctgaaaatccatctctgcaggaaacatcacttagcgtgcagctgtccaacctcgggactgtgcgcacccttcgcaccaaacaacgcatacagcctcagaagacgtctgtttatatcgaactgggaagcgattcatccgaggacaccgttaacaaggccacttactgctctgtcggagatcaggaactgcttcagataacccctcaaggcacgcgggatgaaatatcactagattcagcgaagaaagctgcatgcgaattcagcgagaccgatgtaaccaatactgaacaccatcagccgagtaacaacgatctgaatactacagagaagagggctgcagagcgccatccagagaaatatcagggggaagcagcgtccggttgtgagtccgagacttccgtatcagaagattgttccggcctttccagtcagagcgatatactgacgacacagcaacgcgataccatgcagcataaccttatcaaactccagcaggaaatggctgagctggaagctgttctggagcagcatgggagccagccctcaaacagctatccgagtattatctctgatagtagtgccctggaagacctacgaaacccggagcagtccacctctgaaaaagctgtgcttacctcccaaaagagtagtgagtatccgatttcccagaatccagaaggtctgagcgccgacaaattcgaggtcagcgcagatagcagcacttcaaagaataaggaaccaggggtcgagaggtccagcccaagcaagtgtccttcgctcgacgaccgatggtacatgcatagttgctcagggagtttgcagaatcggaattatcccagtcaggaggaactgattaaagtggtagatgttgaggagcaacagctggaggagtcaggccctcatgatctgacagaaacatcctacctccctagacaggatctagagggtactccatacctggagtccggtatcagtttgttttccgacgatcctgagagcgacccttccgaggatcgggctccagagagcgcccgtgttgggaatatcccaagctccactagcgcattgaaagtgccccaattgaaagtggctgaaagtgcccaaagccccgcagccgctcatactacggataccgccggatacaacgccatggaagaatcggttagtcgagagaagccagagctgaccgcttcaacggagcgggtcaataagcggatgagcatggtcgtctccggtctcacgcctgaagagtttatgctggtttataaattcgctagaaaacaccacatcacactgacaaaccttatcactgaagaaacaacccacgttgtcatgaagaccgatgcagagttcgtgtgtgagcggactttgaagtatttcctgggcattgctggaggtaagtgggttgtatcttacttctgggtgacccagagttag

SEQ ID NO: 27589 - DNA, 1422 bp, Artificial Sequence
  Description of Artificial Sequence: Synthetic coding sequence
atggacctgtctgccctgcgagtagaggaggtgcagaatgtgattaatgccatgcagaagatccttgagtgccccatttgcttagaactgataaaagaacccgtgagtactaaatgcgaccacatcttttgcaaattttgtatgctgaagctcctgaatcagaaaaagggaccatctcaatgccccctttgcaagaacgacatcactaaacgttccctgcaggagagtaccagattttcacagctggtagaggagctgctgaagataatatgtgcttttcagctcgatacaggtctggaatacgctaacagctataatttcgctaagaaagagaacaattctcccgagcacctgaaagatgaggtaagcattatccagagtatgggttatagaaatagagcaaagaggctactgcagagtgaaccggaaaaccctagcctgcaagagactagcttgtccgtccagctgtccaatctggggactgtgagaactctgcggacaaaacagcgaatccagcctcagaaaacgagtgtctatatcgagctgggtagcgatagtagcgaggatacagttaataaagctacatattgttccgtgggcgatcaggagctgcttcagataaccccccagggtacacgtgatgagatttccttggatagcgccaaaaaagctgcctgcgaattcagcgagactgatgtgacaaatacggaacaccaccaaccgagcaacaatgatctgaacactacagagaaacgggctgcggaaagacatccagagaagtaccagggcagttccgtgtccaacctccatgttgaaccttgcgggacgaatacccacgccagcagcctgcagcatgagaacagctccctactcctcactaaagatcggatgaacgttgagaaggccgagttctgtaataaaagcaagcaacccggattagcccgaagtcagcacaacaggtgggcgggaagcaaggaaacttgcaacgatcggaggacaccttcaactgagaaaaaagtcgatctgaatgccgaccccttgtgcgagcgcaaggagtggaacaagcagaaactgccttgctcagagaacccccgtgacacggaagatgtgccttggattaccctgaatagctcaatccagaaggtgaacgaatggttcagccgctctgacgaactgctggggagcgatgactcacacgatggggaaagtgaaagcaatgcaaaagtggctgatgtactggatgtattgaatgaagttgacgagtatagcgggagttctgaaaagattgaccttctggcatcagatcctcacgaagctctaatctgcaaatccgagcgagtacattccaaatccgttgagtctaacatcgaggacaagattttcgggaagacctaccgcaaaaaggcttcccttcccaattag

SEQ ID NO: 27590 - DNA, 534 bp, Artificial Sequence
  Description of Artificial Sequence: Synthetic coding sequence
atgaacgtggagaaagcagagttttgcaataaatcaaaacagccgggactggctagatctcaacacaatcgctgggccggaagtaaggagacttgcaacgaccgtcggaccccatcgactgagaaaaaagttgacctgaatgccgaccctctctgtgaacggaaagagtggaacaaacagaagttaccatgcagcgagaatccgcgagatacagaagatgtaccctggatcacgttaaacagctctatccagaaggtgaatgaatggttttcccgaagcgacgagctgctgggttcagacgattcacatgacggagagtccgagagtaatgccaaagtcgcagacgtcctcgatgtgctaaacgaggtagacgagtattctgggagcagcgagaaaatcgacttgctcgcttcggacccccacgaggcacttatctgtaagtctgagagggtacatagcaaaagtgttgaatcgaatattgaagataaaatcttcgggaagacttacagaaagaaggcctccctgcccaattag

SEQ ID NO: 27591 - DNA, 10257 bp, Artificial Sequence
  Description of Artificial Sequence: Synthetic coding sequence
atgccaattggatccaaagagcggccaacattctttgagatcttcaaaacacgttgtaacaaggccgaccttggccctattagcctgaactggttcgaagagctttccagcgaggcaccaccctacaatagtgagccggctgaagagagcgagcataaaaataacaactacgagccaaacctattcaaaacaccacagaggaaaccatcctacaatcaactcgcctctacccctataatctttaaggagcagggcctcactctacctctctaccaaagtcctgttaaggagcttgacaaatttaagctcgaccttggacggaatgtgcccaattcacgccataaatcattgcggaccgtgaaaacaaagatggaccaggctgatgacgtgtcctgccccctcttaaactcctgtctatccgaaagtcccgtggtcttacagtgtacccacgtgactccgcaaagagataaatcggtcgtttgcgggtcactgttccacacccctaagtttgtgaaggggaggcagactcccaaacacatttccgagtccctaggagctgaagtggaccccgacatgtcttggtcctctagtctagctacacctccaactctgtcgtccacagtactgattgtgaggaatgaggaggcttcagaaactgtgtttcctcatgacacaactgcgaacgtcaaatcctatttttctaaccatgatgagagcctgaagaaaaacgaccgatttattgcttctgtgaccgattccgagaatacaaaccagcgagaggcagccagccacggttttggtaaaacttcagggaactcatttaaagtcaattcctgtaaagaccacattggtaaaagcatgcccaacgtcctggaggatgaggtttacgagacagtggttgacacttctgaagaggacagcttctcgctatgcttcagtaagtgccggactaaaaacctccagaaagtgcgcacctccaagacccggaaaaagatctttcatgaagccaacgccgacgagtgtgagaagtcaaagaatcaggttaaagagaagtactcgttcgtgtctgaggtggaacctaacgacactgatccactcgactccaacgtggccaaccagaagcccttcgaatctggttcagataagatctcaaaggaagtggtccctagcctcgcttgcgagtggtcccaacttacactttctggtctgaacggggcacaaatggaaaaaattccactgctacatatttccagctgcgaccagaacatttcggaaaaggatctgttagataccgagaacaaaaggaagaaggattttttaacttctgaaaacagcttgccacggataagctccctgcctaaaagcgagaagccgttgaacgaagagactgttgttaataaaagggacgaggaacaacatctagagtcccacacggattgtattctggccgtgaaacaggcaatctcgggaacatctcccgtggcaagcagctttcagggtattaagaagtccatattccggattagggagagcccaaaggaaacgtttaacgctagctttagtggccacatgacagatcctaattttaaaaaagagacagaggccagtgaaagtggtttggagattcatactgtgtgcagccagaaagaagatagtctatgtccaaacttgatcgacaacggcagttggcccgcaaccacaactcaaaatagtgtggctctgaaaaatgcaggactgattagcaccctcaagaaaaagacgaataagttcatttatgcaatccacgacgaaacctcatataaaggaaagaagattccaaaggaccagaagtccgagttgatcaattgtagtgctcagttcgaagctaacgccttcgaagcgcctctgacatttgctaacgctgattctggcttgcttcactccagcgtaaaacgttcgtgttcccagaacgattccgaagagcctactctctccctgaccagcagttttggaactattctccggaagtgcagtaggaatgaaacttgtagtaacaatacggtaatatctcaggacctggactacaaagaagctaagtgcaacaaggagaaactccagttattcatcactcctgaggcagacagtctgtcctgcctccaggaagggcaatgtgagaatgacccgaagagcaaaaaggtctcagatatcaaggaggaggtgctagctgccgcatgccatccagtgcagcactcaaaggttgagtattcagataccgacttccaatctcagaaatctctcctctacgaccacgagaacgccagcaccctaatcctgacccccactagtaaagacgtgctttccaacctggtcatgatcagcagggggaaagagtcttacaagatgagcgataaacttaaggggaataactacgagtctgatgtggagctgactaaaaacattcctatggagaaaaaccaggatgtgtgtgccctgaacgaaaactacaagaatgtggaattacttccccctgagaagtacatgcgggtcgccagcccaagcagaaaggtgcagttcaaccaaaacactaaccttagagtcattcagaagaaccaggaggaaactacgtcaatctctaagatcacggtgaatcctgatagtgaggagttgttctcagacaatgagaacaattttgtgttccaggtggcgaatgaaaggaataatctcgctctggggaataccaaagagttgcatgagaccgatctgacctgtgtcaacgaacccatctttaagaactctaccatggttctgtatggagacaccggggataaacaggctacacaggtttcaatcaagaaggacttggtttacgtcctcgcagaggaaaataaaaactcagtcaagcagcatatcaagatgaccctcggccaagacttgaagtctgacatctctctcaacatagacaagattcccgaaaagaataatgactacatgaataagtgggcaggactgctggggcctattagtaaccatagttttggcggttccttccggaccgcttctaataaagaaatcaagctttccgaacataatatcaagaagagtaaaatgttcttcaaagatattgaagaacagtaccctacgagtctggcctgcgtagagatcgtcaatactttagcgctggataaccagaaaaaattgagtaagccccaatccatcaacactgtcagtgcccacctccagagctctgttgtggtcagcgattgtaagaatagccacatcacacctcagatgttgttcagcaaacaggacttcaatagcaatcacaacctcacgccctcacaaaaggctgaaataaccgagctgtcaacaatcctcgaagagtccggcagccaatttgaattcacccagttcaggaaaccatcctacatcctccagaagagcacgttcgaggtgcctgaaaaccagatgacaatcctcaaaacaacttccgaagagtgcagggacgcggatctgcacgtgatcatgaatgccccatcaatcgggcaggtggactcaagtaagcagttcgaggggactgtggagataaaaaggaaattcgccggactgctgaaaaatgactgcaacaagtcagcaagtggctacctcactgatgagaatgaagttggctttcgcggattctatagcgcgcatggcacgaaactcaacgtttccacagaggccctccaaaaggctgtaaaactattttccgatatagagaatatctccgaggaaacatccgcggaggtccatcccatcagcctcagctcttctaaatgccatgatagcgtggtttccatgttcaagattgaaaatcataacgacaaaacagtgtccgaaaagaacaacaagtgccaattgatcttacaaaataatattgagatgacaaccgggactttcgtggaagagattaccgagaactataagaggaatacggagaacgaggataacaagtacacagctgcatcgcgcaatagtcataacttggagttcgatggaagtgattcctcaaagaatgataccgtttgcatccacaaagacgaaactgaccttctctttaccgaccaacacaacatatgcctgaaactctccggacagtttatgaaagagggaaatacacagattaaggaggacctgtctgatctcacttttctggaagtggccaaggcccaagaggcatgccatggtaatacctcaaataaagaacagttgactgcaaccaagactgaacaaaatatcaaggatttcgagacatccgatactttctttcaaacggcctctggaaaaaacatttccgtggctaaggagtccttcaacaagatcgtaaactttttcgatcagaaaccagaggaactgcataacttcagcctaaattctgagctgcattctgatatacggaagaataaaatggatattctgtcttacgaagagactgacattgttaaacataaaatattaaaggaaagcgttcctgtgggtacagggaatcaactggtcacgtttcagggccagccagaaagagacgaaaagataaaagaacccactttgctgggctttcacacagcaagcggtaaaaaagtgaagatcgctaaggagagtcttgataaggtcaagaatctgtttgacgagaaggagcagggtacttccgaaataaccagctttagtcatcagtgggcaaagactcttaagtacagggaagcatgtaaagatctcgaacttgcctgcgagaccattgagattaccgctgccccaaagtgcaaagaaatgcaaaattccctgaataatgataagaacctggtgagcatcgaaactgtcgtcccccctaaactactgagtgataacctgtgcaggcagactgagaatctgaagactagtaagagtatttttctgaaggtgaaggtgcacgaaaatgtggaaaaggagacagccaagagtcctgctacttgctacaccaatcaaagtccttactctgttatcgagaattctgcactggccttttacacttcatgctctcgaaagaccagtgtgtctcagacaagcttgcttgaggccaaaaagtggcttcgcgagggcatctttgacggacagcccgaacgtattaatactgctgactatgtgggtaattatctgtatgagaacaactctaactccaccattgcagaaaacgacaaaaaccatttatcggaaaagcaggatacatatcttagcaacagttccatgagcaactcgtacagttatcatagtgacgaggtctacaacgatagcgggtatctgagtaaaaataagttagatagtggtatcgaacccgtgctcaaaaacgttgaagatcagaagaatacctcctttagcaaggtcattagcaatgtgaaggatgctaatgcataccctcaaacagtgaacgaagatatctgcgtcgaagagttggtgacttcatcctcaccctgcaaaaacaagaacgccgctattaaactgtcaatttcgaattcaaacaactttgaggtagggccacccgctttccgcatcgcctccggcaagatcgtttgcgtctctcacgaaaccatcaaaaaagtcaaggatatctttaccgacagttttagcaaagtgatcaaggagaataatgagaataaatcaaagatttgccagaccaagatcatggcgggttgctatgaggcgctggacgattccgaggatatcctgcataatagtcttgacaacgacgagtgcagtacacatagccacaaagtttttgccgatatacagagcgaggaaattttacaacacaaccagaatatgtcaggcctggaaaaagtatccaaaatctctccatgtgacgtttcactagaaaccagtgatatatgtaagtgttccatcggtaaactgcacaagtccgtctccagcgcgaatacctgcggcatcttctccaccgcctcagggaagagtgttcaagtgagtgatgctagcttgcagaacgctagacaggtcttttctgaaatcgaggattccactaagcaagtgtttagcaaagtcctttttaagagtaacgaacactctgaccagctaaccagggaagagaatacggcaatacgcacgccagaacacctgatcagtcagaaggggtttagttacaacgtggtgaactcctctgccttctccgggttttcaaccgcctccgggaaacaagtctccatcttggagagctccctgcacaaggtgaagggggtactcgaggagttcgacctcatcagaacagagcacagtctgcattattctcccacgtcgagacagaacgtttcgaaaatcttaccaagagtagataaacggaatcctgaacactgtgtgaattccgaaatggagaaaacatgcagcaaagagtttaagctgtctaataatttgaacgtcgagggcggtagctcggagaataaccacagtatcaaagtgtctccttatttgagccagttccaacaagacaaacagcagcttgttctcggtacgaaggttagcctggtggaaaacatccatgtgctgggcaaagagcaggcctcaccaaaaaatgttaaaatggaaattggaaaaacagagacattttccgatgtacccgtaaagacaaacatcgaggtatgttccacatactctaaagattcagagaattacttcgaaaccgaggctgttgagattgccaaagcgtttatggaggacgatgaattgacggacagcaaactgccctcacatgctactcactcccttttcacctgccctgagaatgaggagatggtgctatctaacagccggattggcaaacgcagaggggagccactgatactcgttggcgagcctagcattaagaggaacctgctgaacgaattcgacaggatcatcgagaatcaggagaaatcgttgaaggcctccaagtctacaccagacggaaccataaaagaccggaggctctttatgcatcacgtcagcctcgagcccatcacttgcgtcccattccgcacgacaaaggaacggcaagaaatacagaaccctaatttcacagccccaggacaggagtttctttctaagagccacctgtatgagcatctaactttggaaaagtcctcatccaacctggccgtcagtggtcatccattttatcaggtctccgcaacaagaaatgagaaaatgcggcatctcattacaacaggtagacctactaaagtattcgttccgccttttaaaacaaaatctcatttccacagagtggaacaatgcgttcgaaacatcaacttggaagaaaaccgacagaaacagaacattgatgggcacggaagcgacgacagcaaaaataagattaatgacaacgagatccatcagtttaataaaaataacagtaaccaggcagtcgcagtcacattcactaaatgcgaagaggaaccactggacttaatcacatcgctccagaacgcgagagacatccaggatatgcgaataaaaaagaagcaacggcagagagttttcccacagcctggcagtttgtaccttgcaaaaaccagtactctccctcgaatctctctcaaggccgcagtggggggtcaggttccctcagcttgctctcacaagcagttatacacctatggcgtctcaaagcattgtatcaaaatcaatagcaaaaatgcagagagtttccagttccacaccgaggattatttcggcaaggagagtctttggaccggaaagggcatccaactggccgatggcggatggctgatcccctccaacgatggcaaggcaggaaaagaggagttttatcgcgcactgtgcgacacccccggagtggacccgaaattaatcagcaggatctgggtgtataaccattaccgttggattatctggaaactggccgctatggagtgcgccttccctaaggaatttgccaatcggtgcctgtcccctgagagggtacttctgcaactgaagtatcgatacgatactgagatcgaccgtagcaggcggagtgccattaagaaaatcatggaacgcgacgacaccgcggctaagactctcgtgctatgcgtttccgatatcatctcccttagtgcaaatattagtgagacctccagcaacaaaaccagcagcgccgacactcaaaaggtggctatcattgaactgacagacgggtggtacgccgtaaaagcccagcttgatcctcctcttttggccgtgctaaagaatggcagactaactgtgggccagaagattattctgcacggagctgaactggttggcagtccggacgcttgtacaccgctagaagccccagagagcctgatgctgaagatatctgctaactccactagacccgctcggtggtataccaaactggggttctttcctgatccgcgtccatttcctctgcctctgagtagcctcttctccgatggcggtaatgttgggtgcgtggacgttattattcagagggcctaccccatccagtggatggaaaagacatcctctgggctgtatatcttccggaatgagcgggaagaagagaaagaggccgcaaaatatgtggaggcccagcaaaaacgactggaggctctcttcactaaaatccaggaagagtttgaggagcatgaagaaaacaccacgaagccttacttgccgtcacgagccttaacccggcagcaggtcagagccttgcaggatggagccgagctgtacgaagctgtcaagaacgctgccgacccggcttacctcgaagggtatttttcagaagagcagctccgtgctctgaacaaccacaggcaaatgctcaacgataagaagcaggctcagatacagctggagataagaaaggctatggaaagtgctgagcaaaaggagcaggggttgagccgggatgttaccaccgtgtggaaactcaggatcgtgtcctatagtaaaaaagagaaagactcagttatcctgtccatctggcggccttctagtgatttgtactctttactcacagaaggaaaacgatatcgcatctaccatctggccactagcaaatccaaaagcaaatctgaaagggccaacatccagttggcagctacgaagaagacccagtatcagcagctgccagtttcagacgagattctgtttcagatctatcagccgagagagcctctgcacttttccaaattcctggatcccgattttcagccctcctgcagcgaggtggatttaatcgggtttgtcgtgtcagtggtcaagaaaaccggcctggcccctttcgtgtacctgagtgacgaatgttacaatctactggcaatcaaattttggattgacctgaacgaagatataatcaaaccacatatgctgatcgccgctagcaaccttcagtggcgaccagaaagcaaatccggcttgctgacattgttcgccggtgatttttccgtgttcagtgcctccccgaaggagggtcacttccaagagacctttaacaaaatgaagaatactgtggagaatatcgatatactctgtaacgaagccgagaacaaacttatgcatatcctgcatgcgaatgatcccaagtggagcaccccaacaaaggattgtactagcggaccttacacagcccagattatcccaggcacaggaaataaactgctcatgagtagccccaactgcgagatctattatcaatcacctttgtcactttgtatggccaagcggaagagtgtctccaccccagtgagcgcccagatgacgtctaagagctgcaaaggggaaaaggagatcgatgaccagaaaaattgtaagaagcggcgagctctcgactttctcagtcgcctacctctgccacctcctgtttctcccatctgcactttcgtttcgccagccgctcagaaggcctttcagccacctcgctcttgcggtactaagtatgagacaccgatcaagaagaaggagctgaacagtcctcagatgacgccgttcaagaaatttaatgaaatctctttgctggaaagcaattcaatagccgatgaagaactggctctgatcaatactcaagccctgctgtcaggcagtactggcgaaaaacagttcattagcgtttccgagtcgacaaggaccgcccctacgtcaagcgaagactaccttagactaaaaaggagatgtactacctctttaatcaaagaacaggaatcctctcaggcaagtaccgaagagtgcgaaaaaaacaagcaggatacaattactaccaaaaagtacatctac

SEQ ID NO: 27592 - DNA, 1809 bp, Artificial Sequence
  Description of Artificial Sequence: Synthetic coding sequence
atgcctatcgggagtaaggaacggccaacgttcttcgaaatttttaagactagatgcaataaagcaggcccaattagccttaattggtttgaagaactttccagtgaggcaccaccctacaactcagaaccggcagaggagtcggaacacaagaacaacaattatgaacctaacctgttcaaaacaccacagcgaaaaccttcgtacaatcaactggccagtacgccaattatttttaaggagcagggtctgactcttcccctgtaccagtcccccgtgaaggaactcgataagttcaaactggaccttggcagaaatgtccctaactctaggcataagagccttagaacagtgaaaaccaagatggatcaggccgacgacgtgagttgccctcttttgaacagttgcctctcagaaagccccgttgtgttacaatgtactcacgtcacgccacagcgcgacaagagtgtggtgtgtggttcactgtttcacacacctaaattcgttaaggggaggcaaacaccaaagcacatatctgaatccttaggcgcagaggtggacccagatatgtcatggtcctcaagcctggccaccccaccaacactttcttcaaccgtccttattgtgaggaatgaggaggcttcggagacagttttcccgcatgatactacagccaatgtaaaatcttacttcagtaaccatgacgagagccttaagaagaatgaccgctttatcgcgtccgtgactgacagcgagaacaccaaccaaagggaagccgctagccacgggtttgggaagacatctggaaacagtttcaaggtgaactcctgtaaagatcatatcggaaagtcaatgcccaacgtcctagaagacgaggtgtatgaaacggtcgtagacacttcagaagaggactctttttctctgtgcttctcgaagtgtcgcactaaaaacctgcagaaagttaggacatccaagacaaggaagaagatcttccatgaggcaaatgctgacgagtgtgaaaaatctaaaaaccaggttaaagagaagtactccttcgttagtgaggtagagcctaatgacacagatcccttggactcaaacgtggcgaaccaaaaacccttcgagtcaggctcggataaaattagcaaggaagtggtgccctccctggcctgcgagtggagtcagctgaccctctctggactgaacggggcacagatggagaagataccactgttacacatcagctcctgtgaccaaaacatcagtgagaaggatttactcgatacggaaaataagcggaaaaaagactttttaaccagcgaaaactcactgccccgtatttcttccctgcccaagtctgaaaaaccactgaacgaggaaacagtagtaaacaagcgcgatgaggagcaacacttagagagccatacagactgcatactagctgtcaaacaagccatctcgggcacctcacctgttgcctctagttttcagggtattaagaaatctatctttaggatacgggaaagtccaaaggaaacctttaacgcctcattttccgggcacatgaccgacccgaacttcaaaaaagaaaccgaagcaagcgaatccggcctggagatccacaccgtgtgcagccagaaggaggacagcctgtgtcctaatcttatagacaacgggagctggcccgctacaacaactcaaaattcggtcgctctcaagaacgcaggcctaataagcaccctcaagaagaagacgaataaatttatctacgccattcacgatgaaaccagctataagggcaagaagtag

SEQ ID NO: 27593 - DNA, 10257 bp, Artificial Sequence
  Description of Artificial Sequence: Synthetic coding sequence
atgcctatcggatccaaagagcgcccaaccttttttgagattttcaagacgaggtgtaataaagcagatctgggacctattagtctgaattggttcgaagagctttcctctgaagcgcctccgtacaattctgaacctgcggaagaaagcgaacacaagaataacaactatgagcccaatctgttcaagaccccccaacggaagcccagctataaccagcttgcctctaccccgattatcttcaaagaacagggactgacgctccccctgtaccagtctcccgtgaaggaactggataagttcaagctggacttaggacggaatgtgcctaactcacggcataaaagtctccgaactgtgaagacaaaaatggaccaggctgatgatgtgagctgtccattacttaattcctgcttatcagagtcaccggttgttctgcagtgcacccacgtcacccctcagagagacaaaagtgtagtgtgcggaagcctttttcacacgcctaaatttgtcaaggggaggcagactcccaagcatatttccgagtccctgggcgctgaggttgatccggacatgagctggtcctccagcctagctacacctccaaccttaagttccaccgttttaattgttagaaatgaggaggcgtctgaaaccgtgtttccacatgacaccaccgccaacgtaaagtcctacttctcaaatcatgacgaatccctcaaaaaaaacgacagattcatcgccagtgttaccgattcagagaatacaaatcagagagaagctgcctctcacggattcggtaagacttcaggtaacagcttcaaggtgaattcttgcaaagaccatatcgggaagagtatgccaaacgtcttggaggacgaagtttacgagactgtggtggatacctctgaggaggattccttttctctttgctttagtaagtgcaggaccaagaatcttcaaaaggttcgcacatctaaaacacgcaagaaaatctttcacgaggccaatgcagatgagtgcgagaaatccaagaaccaggtgaaagagaaatattccttcgtctctgaggttgagcctaatgatactgaccctctcgacagcaatgtagctaatcaaaagcccttcgagagcgggtcagataaaatcagtaaggaggtggtgcccagtcttgcctgcgaatggagccagttgacacttagtggtttaaacggcgctcaaatggagaaaatccccttattgcacatctcatcttgcgaccagaacatatcagagaaagacctcctggatacggagaacaagcgaaagaaggactttctgacttccgagaacagtctgccccgaatttcctcccttcctaaatcggagaaacctctcaatgaggaaactgtggtcaacaaaagagacgaggaacagcaccttgagagtcacacagattgcatcttggctgtgaagcaggcaatcagtggcacctccccagttgcaagcagttttcagggcattaagaaaagcatattccgtataagagaatctccaaaggaaacattcaacgctagcttttctggacatatgaccgatccgaatttcaagaaggagacggaggccagcgaatccggcctggagatccacacggtgtgctcacagaaggaggattcactctgtcccaacctcattgacaatggaagctggccggctaccacaacccagaattccgtggctttgaagaacgccggtctgatttccacactgaaaaagaaaaccaacaagttcatctatgctatccacgacgagacaagctataaagggaaaaaaatccctaaggaccaaaaatcagagttaatcaattgttctgcacaatttgaggctaatgcctttgaagccccacttacttttgcaaatgccgattccggactgctgcactctagcgtcaaaagatcctgctctcagaacgatagcgaagaacctacattgtctctgacgtcgtcttttggtactatcctcaggaaatgctcacgaaatgagacttgcagtaataacacagtgatatcccaagacttggattacaaagaggcaaaatgcaacaaggagaagttgcagctgtttattaccccagaggccgatagtttaagctgcctgcaggagggacagtgcgagaacgaccccaaatctaaaaaggtgtctgatattaaagaagaagtgctggctgcagcttgccatcccgtccagcactctaaagtggaatactccgatacggacttccaaagtcagaaaagtctgctgtatgaccacgaaaatgccagtaccttaattttgactcccacctccaaggacgtgctgagcaatttagttatgattagccggggtaaagagtcatataagatgtcagacaagttgaaaggaaataactatgagagtgacgtagagttgactaagaacatccctatggaaaagaaccaagacgtgtgcgccctgaatgaaaactacaaaaacgtcgagttgttacccccagagaagtacatgcgagtggcatcaccatccagaaaagtacagtttaaccagaacaccaatttacgcgtcatccaaaaaaaccaggaagaaactacgtcaatcagcaagattactgtaaatcctgatagtgaggagttgtttagcgacaatgaaaacaactttgtgttccaggtcgccaatgagaggaataacctggccctgggaaacactaaggagctgcatgaaaccgacttaacttgtgtgaacgaacccattttcaagaacagtacaatggtgctttacggggacactggagataagcaagccacacaggtctcaattaagaaggaccttgtgtacgtcctggcggaagagaacaagaacagcgtaaagcaacacattaaaatgaccctgggccaggacttgaaaagcgatatcagtttaaatatcgacaaaattcctgagaagaataatgattacatgaataaatgggccggactgctgggccctatctctaaccactcgttcggcggttcatttaggacagcatccaataaagaaattaagctgtctgaacataatattaaaaaaagtaaaatgttttttaaggacatcgaagaacagtacccaacctccttagcatgcgtcgaaattgtgaatacactcgcgttagacaaccagaagaagctgagcaaacctcagagtattaacacggtgtccgcccacctgcagtctagtgtggtggtgagcgactgcaagaacagccatatcaccccacagatgctgttttctaagcaggattttaactccaatcacaacctgacaccatcccaaaaagccgaaatcactgagttgtccacaattctggaggaatcaggcagtcaattcgaattcacccagtttcgaaaaccatcttatattcttcagaaatccacctttgaagtgcccgaaaatcagatgactatactgaagacaacttcggaggagtgtagggacgccgatctgcatgttattatgaacgctcctagcattggacaggtggattcttccaagcaattcgaaggcacggtggagatcaagcgcaaattcgcaggattattgaaaaatgactgcaacaagagcgcaagcggctatctaaccgacgagaatgaggtgggattcagaggcttttactctgcacacggaaccaagctgaacgtttccactgaggcacttcagaaggccgtaaaactttttagtgacatcgagaacatcagcgaagagacgagtgcagaggtacacccaatttctctgtcctcatctaaatgccacgactctgtcgtatctatgtttaagattgagaatcacaacgataagaccgtgtccgaaaagaataacaagtgtcagttgatcctgcagaataacatcgagatgactactggcacatttgtggaagagatcacagagaactataaacgcaacaccgagaacgaagacaataagtacacagccgctagccgcaacagccataatttggagtttgacggcagtgattcctctaaaaatgataccgtgtgtattcataaggacgaaaccgacctactcttcaccgaccaacacaatatttgtcttaagctgtctggacagttcatgaaggagggcaatacacagatcaaggaagatctctcagacctgacttttctggaggtcgcgaaggcgcaagaagcatgccatggcaacactagtaacaaggagcaactgaccgcgactaaaacagaacagaacatcaaagacttcgaaacttcagatacgtttttccagactgcttccgggaaaaacatcagcgtggctaaggaaagcttcaataagatcgtcaacttcttcgaccagaagccggaagaattacataacttttctctgaattccgagcttcacagtgatatccgtaagaataaaatggacatactgagctatgaggaaaccgacattgtaaagcacaagattctgaaggagtcagtgcccgtggggacaggcaaccaactggtgacttttcaaggacaacccgagcgtgatgagaagattaaagaacctacgcttctgggcttccatactgcctccggcaagaaggttaagattgccaaagaaagtcttgataaagttaagaatctttttgacgagaaggaacagggcaccagtgagataaccagtttttctcaccagtgggcaaagacattgaagtaccgagaagcctgtaaagacctggaactcgcatgtgagaccatcgaaatcaccgctgccccaaaatgtaaagagatgcagaactcactcaataatgacaagaatttggtgtcgatcgagacggtagtgcctccaaagctcctctctgataatctgtgcagacaaactgagaatcttaagaccagcaaatccattttcctaaaagttaaggttcacgagaatgttgagaaggaaaccgcaaagagccccgctacttgttacactaaccagagtccgtactctgtgattgaaaattccgcgctggccttctacacatcctgtagtaggaagacatcagttagtcagacatcattactggaggctaagaaatggctacgggaaggtatatttgatggccaacccgagcgcatcaataccgcagactacgttgggaactacctgtatgaaaacaatagcaactccactattgccgagaatgacaagaatcatctatccgaaaaacaggatacgtaccttagcaactccagtatgtccaactcatattcttatcatagcgatgaagtatacaatgatagtggctatctctccaagaacaagctggatagcgggatcgagcctgtgttaaaaaacgtggaagaccaaaagaacacgtcttttagtaaagtgatctctaatgtgaaggacgccaacgcgtacccacagacagtcaatgaagacatatgcgttgaagagctggtaacttccagctcaccctgtaagaacaagaacgctgccattaaattatctataagtaatagcaacaacttcgaagttgggccacctgctttccgcatcgcttcgggcaagattgtgtgtgtgagtcacgagaccatcaagaaagtgaaagacattttcaccgacagcttctctaaggtgatcaaggaaaacaacgagaataagtccaaaatttgtcaaactaagattatggctgggtgctatgaggcccttgatgacagtgaggacattctacacaattccttagacaacgacgaatgctctactcatagccacaaggttttcgctgatatacaatctgaagaaatattgcagcacaaccagaacatgtctgggcttgaaaaggtgtcaaaaataagtccttgcgatgtgtcactggaaacaagtgatatttgcaagtgctccatcggaaagctccataagagcgtgtctagcgcgaatacatgcggaatcttttctacggccagcgggaaaagcgttcaggtgtctgatgctagcctgcagaatgctagacaggtattctctgaaatcgaagacagcacaaaacaagtttttagcaaagtgctgtttaagtctaatgaacactctgatcagttgactcgagaagaaaacaccgccatcagaactcctgagcatttgataagccagaaaggcttcagttacaatgttgttaatagttccgccttcagtggtttttctacggcctctgggaaacaggtgtccatcctcgaaagcagccttcataaagtcaagggcgtcctggaagagttcgatctcatccgcacagaacatagtctccattactcacccacttccagacagaacgtgtctaagattctgcctcgcgtcgataagaggaacccggagcattgtgtcaattcagagatggagaagacctgtagcaaggaattcaaattgtctaacaacctcaacgttgaaggaggaagttcagaaaacaaccactccatcaaggttagcccctatctgtctcaatttcagcaggataaacagcagctcgttttgggcactaaagttagtttggttgaaaacatccatgttttaggcaaagagcaagcttcacccaaaaacgtcaaaatggaaataggcaagacagagaccttttccgatgtccctgtgaagacgaacatagaggtttgttctacatactctaaggattctgaaaactattttgagacagaagccgtggaaatagcgaaggcgtttatggaagatgatgagctgactgactcgaagctgccctcgcacgctacacattcccttttcacctgtccagaaaacgaagaaatggtgctctccaacagtagaatcgggaaacggagaggagaacccctcatactggtgggcgagccgtctatcaagagaaaccttctgaacgaattcgatcggatcatcgaaaaccaggaaaagtcactaaaggctagcaagagcacccctgacggaactatcaaggatagacggttgtttatgcaccacgtctctttagaaccgattacatgtgtgccctttcgcaccacaaaggagaggcaggagatccagaatcctaatttcacagcgcctgggcaggagtttttatcaaaaagtcacctttacgagcacttgaccctggaaaaatcgtcctccaacctggcggtgagtgggcatcccttttaccaggtctcagcaaccaggaatgagaaaatgcggcatctcatcacgacaggcaggcctaccaaggtcttcgtccctccatttaagacaaagtcacactttcaccgcgtcgagcaatgcgtgcgcaatattaatcttgaggagaatagacagaagcagaatatcgacggacacggctccgacgacagcaagaataaaataaatgacaacgagatacaccaatttaacaaaaacaattccaaccaggccgtggccgttacgtttaccaagtgtgaggaggagccgctggacctcataacctcccttcagaacgccagggatatccaggatatgcggataaagaaaaagcaacgccagagggtatttccacaaccgggaagcctctacctcgcaaaaactagcaccctgccacgcataagtctgaaagccgctgtggggggacaggtcccttccgcctgtagccacaagcagctgtacacctacggggtgtcaaagcattgtataaaaattaacagcaaaaacgccgaaagcttccagtttcacaccgaggattacttcggcaaggaatcactgtggaccggtaaggggatccagctggcagacggcggttggctcattccaagcaatgatggcaaagccggtaaggaagaattttaccgggctctgtgcgatactcccggagttgatcccaaattgatcagcaggatatgggtttataaccactatcgatggattatctggaaattggccgcaatggagtgcgcctttcccaaggaattcgctaataggtgcctgagcccggagagagtgctcctgcagctgaagtaccggtacgacacagaaattgataggagtagaaggtccgccattaagaaaatcatggagcgggatgacacagctgccaaaacactggtcctgtgcgtgtcagacattatttcactgagtgctaatatttctgaaacgtcaagcaacaaaacctctagcgctgatacccaaaaggtggccatcatagagttgactgatggctggtacgcagtgaaggcacagctggacccaccactcctggctgtgcttaaaaacggcagacttactgttggtcagaagattattcttcacggcgcagaactcgtggggagcccagatgcctgcaccccattggaggcaccggagagtctcatgctgaaaatcagtgcgaattccactcgcccagccagatggtataccaaactgggcttcttccccgatcctcggcctttccccctccctctgtcttctctctttagtgatgggggtaatgtgggctgcgtggacgtaatcattcaacgcgcttaccccatacagtggatggagaaaacaagctccgggctttatatattccgtaatgaacgcgaggaagagaaagaagcagccaagtatgtcgaggcacagcagaagagactagaagcactattcaccaagattcaggaagagtttgaagaacatgaagagaacaccacaaaaccatacctaccttctcgcgcactcacacggcagcaagttcgcgcactgcaggacggagccgaactttacgaagcagtcaaaaacgccgctgatcctgcctacttggagggctatttctcagaagaacagcttagagctctgaacaaccacagacagatgctcaatgacaagaagcaggcccagatacaactggaaatccgtaaggccatggagtcagccgagcagaaggagcagggtctgtcacgcgacgtcactacagtttggaaactacgaatcgtgtcatattctaaaaaggagaaagacagcgtgatcctgtctatctggaggccttctagtgatctctatagcctgctcacggaaggcaaacgatacaggatctaccatctagcgacctctaagtcaaaaagcaagtccgagagggccaacatccagcttgcggcaaccaagaagacacagtatcagcagctgcctgtctccgatgagattttatttcagatataccagccaagagaaccacttcacttttccaaattccttgaccctgactttcaaccatcgtgttccgaggtcgatcttatcgggttcgtggtgtccgtagttaagaaaacaggtttggccccttttgtatacttaagtgatgaatgttataacttgctggcaattaagttctggatagatctgaatgaagatatcatcaagccacatatgcttatcgccgctagcaatcttcaatggcggccagagtctaagagcggcttgcttacgctcttcgccggtgattttagtgtgttcagtgccagcccgaaagagggccattttcaggagaccttcaataagatgaaaaacacagtcgaaaacatagatattctgtgtaatgaggctgagaataagctgatgcacatcctgcatgccaatgatccaaagtggtcaactccaactaaggattgcacctccggcccatatactgcccagatcatacctgggacaggcaataaactgctgatgtcatcccctaattgcgagatatattatcagtcacctctgtcattgtgtatggcaaagcggaagtctgtctccacccctgtgtccgcacagatgacgagtaagtcatgcaagggggagaaggagatagacgaccaaaaaaattgtaagaagagacgcgcactggattttctgtcacggctgccactgcccccacccgtgtcccctatctgtacttttgtaagtcctgcagcacaaaaggcatttcagccccctaggtcctgcgggactaaatatgagacaccaattaagaagaaagagctgaatagccctcagatgacccccttcaagaagttcaacgaaatatcccttctggagtctaattcaattgcagatgaggagttagccctcatcaacactcaggccttactatcaggatccaccggggagaaacagtttatctcagtatccgaatcaacccgtacggcaccaacttccagtgaagactacctacgcctgaagcgacgatgcaccacaagccttattaaggaacaggaatcatctcaggcgtccacggaggaatgcgaaaagaataagcaggacacaattacaacgaagaaatacatatag

SEQ ID NO: 27594 - DNA, 2667 bp, Artificial Sequence
  Description of Artificial Sequence: Synthetic coding sequence
atgcactgccctggagaggcgccactggctgcacccagacctaccccgaaggacccctgtctaaggaacgtactggccaaagcgctgtacgacaacgtggccgagagtccggacgagttgagtttcagaaagggggacatcatgacagtgctggagcaggacacgcagggccttgacgggtggtggctttgttcccttcacggcagacaagggattgtacctggtaatcggctgaagattctggtgggtatgtatgataagaaaccagccggacccggaccgggacctcccgctaccccagcacaaccccagccgggattacatgcacctgcgcctccggcatcccagtacacacccatgttacctaatacataccaaccgcagcccgacagtgtgtacttagtgccaactccaagcaaggcacagcagggcctgtatcaggtgccagggccatcaccacagttccagagtccaccagccaagcagacctcgacattcagcaagcagacaccccaccatcccttcccctccccagcgactgacttgtaccaggtgccacccggtccaggtggcccagcccaggatatttaccaggttcctccttctgccggtatggggcacgatatttaccaagtgccacctagtatggacactcgctcttgggagggcactaagccacctgccaaggtagtagtgcctacacgggtgggtcaagggtatgtctacgaggccgctcaacctgaacaagacgaatatgacatcccacgtcacctgttagcaccaggtccacaagatatttatgacgtcccgccagtgcggggtctgctacctagccagtacggccaagaggtctatgatacaccacctatggcagtgaaaggaccgaacgggagggatcctcttcttgaagtctatgacgtgcctccctccgtggagaaaggcctccctccctccaaccatcacgctgtctacgatgtgccaccttcagtttctaaggatgtcccggacgggccattgctccgggaggagacctatgatgtgccacctgctttcgcgaaggccaaaccctttgacccagcacggacgccccttgtgctcgccgcaccccctcccgattccccccctgcggaagacgtgtatgatgtccctccaccggcacccgatctctacgatgtaccacccggactacgtcgtcccggtcctgggacactgtacgacgtgcctagggaacgggtgctccccccagaagtagctgatggaggcgtggtggattcaggcgtttatgccgttcctccgccagctgaaagggaggccccagctgagggtaagcggttgtccgcctcttccactggttctacacggtcctcgcaatctgcaagtagtctggaagtggccggacccggtcgtgaacccctggagctggaggtggccgtggaagccctcgccagattacagcaaggtgttagcgctacagtcgcccatttgcttgaccttgcgggttccgccggtgccaccggctcctggcgatcacctagcgagcctcaagaaccgcttgtgcaggacttgcaggctgccgtagctgccgttcaaagcgccgtgcacgagctgctggaatttgcccgttcagcggtgggcaacgctgctcatacatctgatcgggcactgcacgcgaagttgtcccggcagctccagaagatggaagatgtccatcaaacacttgttgcccacggacaagcacttgatgcgggaagaggtggcagcggggcaacactcgaggacctcgaccgactggtggcctgctctagagcagtcccagaagacgctaaacagttagcctcctttctgcatgggaacgcctcactactctttcgaagaaccaaggcaactgcccctggccctgaaggcggaggcaccctccacccaaacccaaccgacaagacctcttccatacagtccagacctttacccagtcctccgaaattcacatcacaagattcgcctgatggacagtacgaaaattctgaaggcggatggatggaggattacgattacgtacatcttcagggcaaggaagaatttgaaaagacgcagaaggagctgcttgagaagggctcaattacccgacagggcaagtctcaacttgaactacaacaactgaagcaattcgagagacttgaacaggaggttagtcggccaatagaccacgatctagctaactggaccccagcacaacctctggcaccgggtcgaacaggaggcctgggaccctccgataggcagttacttctgttttatctggagcagtgtgaggctaatctgacaacactgacaaacgccgtggacgccttcttcacagcggtggccacaaaccagccccctaagatctttgtggcccactcgaaatttgtcatcctgagcgcccacaagttagtgttcattggagataccctttcgcgccaggctaaagctgctgatgtgcgatcccaggtcacacactacagcaatctcctgtgtgacctcttgcggggtatagtggctaccaccaaagctgccgcattgcagtacccctccccatctgctgcccaggatatggtggaacgagtgaaggaactggggcacagtacccagcaatttaggcgagtcctcggacagctcgctgccgcatag

SEQ ID NO: 27595 - DNA, 2613 bp, Artificial Sequence
  Description of Artificial Sequence: Synthetic coding sequence
atgaatcacctgaatgtattagcaaaggcactttatgataacgtcgctgaaagtcccgacgagctaagtttccgaaagggcgacatcatgacagtgctggaacaagacacccaaggcctggatggctggtggctctgtagcctgcatggtaggcagggcatcgttcccggaaatcggctcaaaatccttgtgggcatgtacgataagaaaccagcaggtccaggccctgggccacccgctacccccgcacagccccagcccggtctgcatgctccagcaccgcctgcaagccagtatacccctatgctgcccaatacctatcaacctcaaccagacagtgtgtacttggtgcctaccccatctaaagcccagcagggattgtatcaagtgccaggacctagcccccaattccagtcacccccagctaaacagactagcacatttagcaaacagacgccccaccatccgtttcccagtcctgctacggatctgtatcaggtgccccctggaccaggcggtcctgcacaagatatttatcaggttccccctagtgccggaatgggacatgatatttaccaagtacctccatcaatggacacacgctcttgggaaggcactaaacctcctgccaaggtggtcgttccgactcgagtgggacaaggatatgtttatgaagccgctcaacccgagcaggacgaatacgacatccccaggcatcttctcgctcccggaccccaggacatatacgatgtgccaccagtcaggggacttctgccttcgcaatatggccaagaagtatacgacactccaccaatggccgttaaagggccaaacggaagggatccgctgctggaggtatacgacgttccaccatctgtggagaagggcctgcctccgagcaaccatcatgctgtctacgatgtcccaccaagcgtgtctaaggatgtacccgacggcccactcctgagggaggaaacttatgatgtgccgccagcattcgctaaagctaagcctttcgaccccgctcggacgcccctggtcctcgctgctccccctcccgacagtccccctgctgaggacgtctatgatgtgccacctcccgctccagatttgtatgacgtacctccaggtctgcgccgacccggacccggaaccctttacgacgtgccaagagagcgagtcctgccccctgaagtggcagacgggggagtcgtggactcaggcgtgtatgctgtgccgccacccgcagagcgagaagctcctgctgagggaaagcgtttgtctgcttccagcaccgggtccacaaggtccagccagtccgcgtcaagcctggaggtggccggaccgggacgggagccgttggaactggaagtggccgtggaagctttggccaggctccagcagggagtgagtgccacggtcgctcacctgctcgacctcgccggatcggctggcgctactggttcatggcgctcccctagcgaaccccaggagccgctggtgcaggacctgcaggctgccgtggccgctgtgcagtctgctgttcacgagctcctggaatttgccaggtccgccgtggggaatgccgctcacacttcagatagggccctgcacgccaagctgagccgtcaactgcagaaaatggaggacgtccatcaaaccttggtcgcccatggccaggccctggacgcagggcgtggtggcagcggagcgacgctggaagatctggatcgtctggtcgcttgctcccgggctgtaccagaggacgctaagcagcttgcttcttttttacacggcaatgccagtttgctctttcgaagaacaaaggcgactgcacctggtccggaaggagggggtaccctgcatccaaaccccacggacaaaacatcatctattcagagcagacctctgccgagcccgcctaagttcacctctcaggattcacccgacggccagtacgaaaactcagaaggcggttggatggaggactatgactacgttcatctccaaggcaaggaagaatttgagaagacccagaaggaactcctggagaagggctctattacccggcaggggaaatctcagctggaactgcaacagttaaagcaatttgaacggctggaacaagaggttagccgccctatcgaccacgacctcgccaattggacacctgcacagccactggcccctgggagaacagggggactgggccctagtgataggcagttgttgctgttctacttggagcagtgtgaagctaacttaacgactctaaccaacgccgttgacgcgtttttcactgccgtggctacaaaccagccgcctaagatctttgtggcccactctaaattcgttatcctgagtgcgcacaaactagtgtttataggcgatactttatctcggcaggctaaggccgctgacgtacgaagtcaggtaactcactactccaacctgctgtgcgacctgttgcgcggaatcgttgcaaccaccaaggcagcagccctacagtaccccagtccctcagctgcccaagacatggtcgaaagggtgaaagaactagggcattctacccaacagttcagaagagttctcggacagctcgccgcagcttag

SEQ ID NO: 27596 - DNA, 2667 bp, Artificial Sequence
  Description of Artificial Sequence: Synthetic coding sequence
atgaaccacctcaacgtgctcgccaaggcactgtacgacaacgtggccgaatcacccgacgagctgagctttcggaaaggcgacatcatgacggtgctggagcaggacactcagggtctggacggctggtggttgtgctctttacacgggcgacagggcatcgtcccgggaaatagactgaagatactggtgggcatgtacgacaagaaaccggctgggccaggacccggaccacccgctacgccagcacagcctcagcccggtctgcacgcgccagccccaccagccagccagtacacaccaatgttgccaaatacctatcagcctcagccagatagcgtgtacctggttcctaccccctccaaggcacagcagggtctctaccaggttccaggccctagcccgcagttccagtcaccccctgctaagcaaacatccactttttccaagcagactccccatcatcccttccctagtcctgccacggacctgtaccaggtgcctccaggacccggaggccctgctcaggatatataccaagtgccgcctagtgccggaatgggccatgatatatatcaggtgcctcccagtatggatacaaggagctgggagggaaccaagcctccggctaaagtggtggttcctactcgtgtgggtcaggggtacgtttatgaggctgctcagccagagcaagatgaatatgacatcccaagacacctgcttgctccaggaccgcaggatatctatgatgtgccccctgtaaggggactgctgccaagccaatacggtcaggaagtgtatgatacaccaccgatggccgtgaaaggccctaatggcagggatcctctgctcgaggtctatgatgtccccccatcagtggagaaaggcttaccccctagtaatcaccacgccgtgtctaaatgccagggcaacgctagggcacggctgcggctgtggggggtgtgggtatacgatgtgcccccaagcgtgagtaaagacgttcccgatgggccattgctgcgtgaggagacctacgatgttccccctgcctttgcgaaggccaagccattcgacccggctagaacccccctagtgctcgccgctcctccccctgatagcccgccagcagaggatgtttatgatgtaccaccccctgccccagacctgtacgacgtaccacccggtctcagaagaccagggccaggcacactgtacgacgttcctcgtgagcgcgtgctgcctcccgaggtggccgatggtggggtggtcgatagtggggtttacgccgtgccacccccagctgaaagagaggcacccgcagaaggcaaacgcctgagcgcctcttcaaccggcagcactcgcagctcccagtctgctagcagcctggaagtcgctgggcctgggcgtgagcctctggaactggaggttgccgtggaggctctcgcacgtctacagcaaggcgtctctgcaaccgttgcgcacttactagatctggcaggatccgcaggcgctaccggatcttggcgatccccctctgagcctcaagaaccgttagtacaagacttacaggcggcagtcgcagcagtacagagtgctgtccacgagcttcttgaattcgcacgatcagctgtgggcaatgcggcacatacttcagatcgcgcactacatgcaaaactgtcaaggcagctgcagaagatggaagacgtgcaccaaacactggtcgcccacgggcaagctcttgatgccggtcggggaggatctggggctacattggaggatctcgatcggctggtcgcctgttctagagctgtacccgaggacgctaaacagctggcttcttttctgcacggtaatgcctccctcctgtttcgccgtacgaaagccaccgctcccggacccgagggtggcggtactctccacccaaaccccacagacaagacatcaagcatacaatctcgccctctcccctctccccctaaattcaccagccaagatagtccagatggacagtatgaaaacagcgaggggggatggatggaggattacgactacgtgcacctgcagggaaaagaagagttcgagaaaacccaaaaggagctactggaaaaaggcagcataacccgccaggggaagtcacagctggagctgcagcaactgaaacagttcgaacgactcgaacaggaggtctcccgacctatcgaccatgacctggccaattggactccagcacagccattggcccctggaaggactgggggactgggtccttccgacaggcagttactactgttctacctagaacagtgtgaggccaacctgaccactttgacaaacgccgtggatgcattcttcaccgctgtcgcaacaaaccagcctccaaaaatttttgtcgctcatagcaagtttgtgattctaagtgctcataagctggtttttatcggggataccctgagccgccaggcgaaggcggctgacgttcggtcacaggttacacattacagcaacctgttgtgcgaccttctgcggggtattgtggcgaccaccaaggctgctgcgctccaatatccttccccctcagctgcgcaagacatggtggaaagggtcaaggagttgggccattcaacccaacagttccgcagagtgttgggacagctcgccgctgcatag

SEQ ID NO: 27597 - DNA, 2751 bp, Artificial Sequence
  Description of Artificial Sequence: Synthetic coding sequence
atgcccgcaaagccattcctctccagtgtgctcctgtcttggaaggtgctggatttcagcggacccggtccccaggggaccgggcagccttgttcatgtggccactgggcggaaggtcagggtgggcctccagagcccgctggcggacccaacgtactggctaaggctctgtacgataacgtggctgagtccccagatgagttatccttcagaaagggcgatatcatgacggtgctcgagcaggatactcagggcttagatgggtggtggttatgttctctgcacggtaggcaggggattgtgccaggtaacaggttaaaaattttagtgggtatgtatgacaaaaagccggcaggtcccggtccgggaccacctgcaaccccagcccaaccacaaccaggtttacacgcccctgctccaccagcctctcagtacactcccatgctccccaatacctaccagccacagcccgacagtgtctaccttgtccccacaccatccaaagctcagcaggggctgtaccaggtgccgggaccaagcccgcagttccagtcccccccagccaagcagacatccacattctcaaagcaaacaccccaccacccgtttccttcgcccgctacagacctgtaccaggttcctcccggtcccggaggacctgctcaggatatttatcaggtcccaccttcagcaggcatgggccatgatatctaccaagtgcctccttccatggacacacgtagttgggaagggactaaacctcctgctaaagtagtcgtgcctacacgcgttggccaggggtacgtgtacgaggctgctcagccagagcaggacgagtatgacataccacgccatctgctggctcctggtcctcaggacatctacgacgtgccaccggtgcgcggtcttctgccttcacaatatgggcaggaggtgtatgacacccctcctatggcagtgaaagggcctaatggaagagatccactgttagaagtgtacgacgtgccgccttcagtggagaagggtctcccgccttcaaaccaccacgcagtctatgacgtgcccccaagcgtgagtaaggatgttcctgacggacctctcctccgagaggaaacctacgatgttccgccagcttttgcaaaggcaaaaccgttcgacccagccaggaccccactggtactcgccgctcctccacccgattctcctcctgctgaggatgtgtatgacgtccccccaccagcacccgacttgtatgatgtgccccctggcttacgcaggcctggacccggtactctctacgacgtccccagagagcgggttctgcctccagaagtcgccgacggcggagtcgtcgatagtggggtctatgccgtacccccaccagctgaacgcgaggcaccagccgaaggaaagcggttgagcgccagcagcacagggagtacacgatcatcacaaagcgcaagtagcctcgaggtagccggaccaggcagggagcccctggaacttgaggtggcggtcgaagccctcgcacggctccagcaaggtgtgagtgctacagtggcccacttgttggacttagctggatctgctggtgcaacggggtcttggcggtcccccagcgaaccacaagaaccattggttcaggatctccaggccgcagtcgcggctgttcagagcgcagtccacgagctgctcgagtttgcaagatccgctgtaggcaacgcggcacacacctctgacagagcgctccacgcgaagctgtcgcgacagttgcaaaaaatggaagacgtgcaccagaccctggtggcccacggacaggctcttgacgcgggtcggggtggttccggggcaactctggaagaccttgaccgactggtagcctgtagccgggcagttcctgaggacgcaaagcagctcgcaagctttctccatggcaacgctagtcttctctttcggaggaccaaagccacggcaccgggtcccgaggggggagggacactgcaccctaaccccaccgataagacttcgtccattcagagtagacccttgccaagcccgcctaagttcacctcacaggactctcctgacggacagtatgaaaacagtgagggcggttggatggaagactacgactacgtgcacctgcagggaaaagaggagtttgaaaagacgcagaaagagctcctggaaaaaggaagtatcacaagacagggcaaatcccagcttgagctgcagcagctgaagcagttcgagcgactagaacaggaggtctcgcggcctattgatcacgatctcgccaactggaccccagcccaacccctggctccaggacgcaccgggggtctcggacccagtgatcgccagctgctgcttttctatctcgagcagtgcgaggcaaacctcaccactctgacaaatgcggtggatgcattctttaccgccgtggcgaccaaccagccacctaaaatatttgttgcacatagtaagttcgtgattttaagtgcgcacaagctggtgttcataggggatacactgtcacggcaggctaaggctgcagacgtaagatctcaggtcacacattattcaaatcttctttgcgacttgctgaggggtatcgtcgcaacgaccaaagccgcagccctgcagtatccatctccctctgccgcacaagacatggtagagagggtaaaagaacttggtcactctacacagcagttccggagggtcctggggcagctggcagcggcttag

SEQ ID NO: 27598 - DNA, 2667 bp, Artificial Sequence
  Description of Artificial Sequence: Synthetic coding sequence
atgctgacccatcgcccacaggaagctgagcagagggggaggacgcccggaccatcattcgagtggaacgtcttggccaaagccttgtacgacaacgtggccgaaagccctgacgagctgtcatttcgtaagggagacatcatgactgtcttagagcaggacacacaaggccttgacggctggtggctctgtagcctacacggcagacaagggatagtgccaggcaatcgtctgaaaatactcgtgggaatgtatgacaagaagcctgccggacccggacctggcccaccggctactcccgctcagccacaacctggcctgcatgctcccgcacccccagccagtcagtatactcccatgttacctaatacgtaccagccacagcccgacagcgtgtatctggtcccaactccatctaaagcccaacagggcctgtaccaagtgcctggtccctctcctcaatttcagagcccgcctgcaaagcagacgagtactttcagcaaacaaaccccacaccacccgtttccttctcctgctaccgacctgtatcaggtgccccctggaccagggggtcctgcccaggatatttaccaggtacccccaagcgctgggatgggccatgatatttaccaggttcctcctagtatggacacccgctcttgggagggaaccaaacctcccgcaaaagtcgtagtgccgacacgagtagggcagggctacgtgtacgaggcagcccaacctgagcaagatgaatacgatattcccaggcatctgctcgcccctggtcctcaggacatctacgatgtgcccccagtgagagggctcctgccatcacaatatgggcaagaggtgtatgacaccccaccaatggccgtgaaggggcctaacggaagagaccccttgctcgaggtttacgacgttcccccatcagttgaaaagggcctgccacctagcaaccatcacgctgtgtatgacgttcctcctagtgtttctaaagacgtacctgacggtcccctgctcagggaagagacatacgacgtgcctccagcttttgccaaagctaaaccgtttgatccagctaggacccccctcgtgctggctgcacccccaccggattctcctcccgctgaagatgtgtacgatgtcccacctcctgcaccagatctgtatgacgtcccacccggactccgtcgacctggccctggaacgctgtatgatgtaccccgtgaaagagtgctcccccctgaggtggccgatgggggagtggtggattccggagtctatgccgtgccccctccagcagagagagaagcaccagcagaggggaaacggttgagtgcctccagtacaggaagcaccagaagcagccagtctgcgtcgtcactggaggtggcaggacctgggcgtgagcccctagagttggaagtggccgttgaggccttggcaagacttcaacagggcgtgtcggctaccgtggcgcatttgctggacttggctgggtccgccggagcaacaggcagttggaggagtccctctgagcctcaagaaccattggtacaggacttgcaagctgcagtagctgccgtgcagtccgcagttcacgagctcctcgagtttgcccgatctgctgtcggcaacgcagcccacacttcagaccgagctctccatgccaagctgagtagacagttgcagaaaatggaggatgtacaccaaacacttgttgcacatgggcaggctctggatgccggtcgaggcggatctggcgcaacattagaggacttggacaggctggtggcctgctcaagagcggtccccgaagacgctaagcaattggcatctttcctccacggcaatgcttccctgctgttcagaaggacaaaggctacagcccctggcccagagggtggcggaacgttacaccccaacccgaccgacaaaacttccagcattcagagccgccctctaccaagcccaccaaaattcaccagtcaggatagtcccgacggacagtatgagaactccgagggaggatggatggaggactacgactacgtgcacctgcagggcaaggaggagtttgagaagactcaaaaggaactactggagaagggcagcatcacgaggcaagggaagtctcaactcgagctgcagcagctgaagcagttcgagcggctcgagcaagaggtctccaggcccatcgatcatgacctggcaaactggacacccgctcagcctctggcgccaggcagaacaggcggattggggccaagtgaccgacagttactgcttttctacctggagcagtgcgaggccaatctcacaaccctaactaatgcagtcgatgctttctttacagcagtggccacgaatcagcctcctaagatcttcgtggcacatagcaagtttgtgattctcagtgctcacaaattggtattcatcggagacaccctgtcacgccaggccaaagcggcagatgttcgctctcaggtcacacactacagtaatctgctatgtgatttattgcggggtattgtcgccactacaaaggcagcggcactgcagtacccatctccctccgccgctcaggacatggtggaacgggtaaaagagcttgggcacagtactcagcaattccgcagagtccttggtcagctcgccgctgcctag

SEQ ID NO: 27599 - DNA, 2169 bp, Artificial Sequence
  Description of Artificial Sequence: Synthetic coding sequence
atgcagggtaaaaatgtcttggccaaggctctgtacgacaatgtcgctgaatcaccagatgagctgagttttaggaaaggggacattatgaccgttctcgaacaagatactcaagggctagacgggtggtggttgtgcagtcttcacggcagacagggtatcgtgcccggaaatcggctgaagatactggtggttgtgcctacccgggtcggacagggctatgtatatgaagctgctcagcctgaacaggatgaatacgacattcctcggcacttactcgcgccaggtccccaggatatttatgacgtacctcctgtgcgaggcctgctcccctcacagtacggccaggaggtctatgacacccctcccatggccgtaaaaggccctaatggcagagatccgctcttagaggtgtatgatgtacccccaagtgttgagaaaggactccccccttcaaatcaccacgccgtgtatgacgtgcctccaagcgtgagcaaagatgtgccagacggccctctcctcagggaagagacctacgatgtgccccctgcctttgcgaaagctaaaccattcgacccggctaggactcctttggtgctggcagctccacccccagattctccaccggctgaagacgtctacgacgtgcctcctcctgctcctgatctgtatgatgtaccaccagggttacgaaggccaggacccggaacactttacgatgtgccacgagagcgtgttttaccacccgaagtggcggatgggggtgttgtcgacagcggcgtatatgcagtcccccctccagcagaaagagaagcaccagccgaaggaaagcgcttgagtgcgagctcaacaggatccacccgctctagccagtctgcatcctccttggaggtcgctggacccggtcgggagcctttggaattggaggtggccgtcgaggcgctggccagactccagcagggtgtgtcagctacggtggctcacttgctggatctggccggatctgccggagccacaggatcatggcgatccccaagcgaaccccaggagccattggtgcaagacctgcaggcggctgttgcggctgtgcagtctgcagtccacgagttgctggagttcgcacgctctgctgtcggcaatgccgcacacacaagtgacagagcgctgcatgccaagctctctaggcagctgcagaaaatggaggacgttcaccaaacgctggttgcgcacggacaggccttggatgctgggagaggagggtcaggtgcaacgctcgaagacttagatcgacttgttgcttgcagccgtgcagtgcctgaagatgcaaaacagttagcctccttcctgcacggcaatgcatccctgctctttcgcaggaccaaagcgaccgctcctggcccagagggagggggtacacttcacccaaatccgacggacaagacttcttccatacagtcccgccctttaccctctccccctaagtttaccagccaggatagccctgatggtcaatatgagaactccgaagggggttggatggaggactacgactatgtgcatttgcaaggaaaggaagaattcgagaaaactcagaaggagttgcttgagaaaggcagtatcaccaggcagggcaagtcacaactggagctgcaacaactcaaacagtttgagcgactggaacaggaagtgagccggccaatcgatcacgatctggcaaattggacccccgctcagcctctggctccaggcagaacaggaggccttggcccatcggataggcagttactgctattttacctggagcaatgtgaggccaacctcacaaccctgacaaatgccgtcgacgctttcttcacagcagtggcaaccaatcagccccctaagatttttgtagctcatagcaaattcgtaatcctgtctgcccataaattggtctttattggggacactctgagcagacaggccaaggcggctgatgtgcgaagccaggtgacgcactactctaatctgctgtgtgatctactcaggggcattgttgccactacaaaggcagccgctttacagtatcccagccccagtgccgctcaggacatggtggagcgagtgaaggagctgggccattccacccagcagttccggcgagtgcttggccagcttgcagccgcatag

SEQ ID NO: 27600 - DNA, 2613 bp, Artificial Sequence
  Description of Artificial Sequence: Synthetic coding sequence
atgagcgtgcctaatgtccttgcgaaagccctctatgataacgttgcagagtctcctgacgagctgagcttccgcaagggtgacatcatgactgtcctggagcaggatacacagggtcttgatggttggtggctttgttcccttcacgggaggcaggggatcgtgcccggaaaccggctgaagattctggtcggcatgtacgataaaaagcccgctgggccaggtccagggcctcctgcaactcccgctcaaccacagccgggtctgcatgctcccgctccaccagcgagtcagtacacccccatgctgcccaatacatatcagccccagcccgactccgtgtatctagttcccacgccaagcaaggcccagcagggactgtatcaagtgcctggtccgagcccacaatttcagagcccccctgcaaagcagacctccaccttctcaaagcagaccccacaccatccttttccatcaccggctaccgacctctaccaggtgcctcccggaccagggggacccgctcaggacatttaccaggtcccaccaagcgctggcatgggtcatgacatctaccaggtgccgccttctatggacactaggtcctgggaaggaaccaagcctccagctaaagtagttgtacccaccagggtaggccagggttatgtgtatgaggccgctcagcccgagcaggacgaatatgacatcccccgacacctactcgccccaggcccacaagacatttacgatgtgccgcctgtacggggactgctacccagtcaatatggacaggaagtgtacgatacccccccaatggctgtgaagggtcctaatggcagagacccactcctggaggtttacgacgttccgccaagtgtggagaaaggtttgccaccctccaaccatcatgccgtttacgacgtgccgccatcggtatccaaggatgttccagacggtccactgctgagggaagagacatatgacgtgccaccagcatttgccaaggcaaaaccatttgaccccgcaaggactcctctggtcttggctgcaccgcctcccgatagcccacctgcggaggacgtgtatgacgtccccccacccgcaccagacctctatgacgtgccgcctggcttgcgacggcctggccctggtaccctctacgacgtgccacgtgagagggttctgccacctgaagtagccgatggaggagtcgttgactctggagtttatgccgtgcctccaccagctgagagggaggcacccgctgaagggaagcgcttgagcgccagttcaactgggtcaacacgttcctcacagtcagcctctagtctggaagtggccggaccgggtcgggagcctcttgagcttgaggtagctgtagaagcccttgcccgactgcagcagggcgttagcgctaccgtggcccatctgctggacctggccggaagcgcaggggctaccggtagctggcgaagcccgagcgagccacaggaacccctggtccaagacctgcaggctgcagtggcagcagtgcagtccgcagtccatgagttactggagtttgcacggtcagccgtcggcaacgccgctcacacatctgaccgtgcattgcatgcaaagctgagtcgtcagctgcaaaaaatggaggacgtgcaccaaaccctggtcgcccacgggcaagcactggatgcaggtcgtggtggctcgggtgcaaccctcgaggatctggatcgtctcgtcgcatgtagcagggctgtacccgaagacgccaaacagctggcgtccttcctgcacgggaatgcaagcctgctgtttaggaggactaaggccacagcgccaggccctgagggtgggggaactttgcatccaaaccctaccgacaagactagcagtattcaatccaggccactgcccagccctccaaagttcacgtcccaggactcaccagacggccagtacgagaatagtgagggagggtggatggaagactacgactatgtacatttacaggggaaggaggagtttgagaaaacgcaaaaggagctgcttgaaaagggttctattactcgacagggcaaatcccaactggagctccagcaacttaagcagttcgagagacttgagcaagaggtcagcaggccaatcgaccacgatctagccaactggaccccagcgcagccgctggcacctggaaggaccggcggactgggacctagtgacaggcaactactgctattttatctggagcagtgtgaggcgaacctgacgacgttgaccaatgccgttgacgcctttttcaccgccgtcgccaccaaccagccaccaaaaatattcgtggcacattccaaatttgtgatcctgagtgcacacaaattggtatttattggagatactctcagccgtcaggcaaaggccgctgatgtgcgctcacaggtgacccactacagtaacctattgtgcgaccttctgaggggcatagtggcgactactaaggccgctgccctacagtatccttcaccgtccgcggcacaggatatggtggaacgtgtgaaagagcttggtcattcaacgcagcaattcagaagggtcctgggccaactagcagctgcatag

SEQ ID NO: 27601 - DNA, 2607 bp, Artificial Sequence
  Description of Artificial Sequence: Synthetic coding sequence
atggagaacgttcttgccaaggccctctacgacaacgtggcagagtcaccagatgagctctcttttagaaaaggggacatcatgaccgtactcgaacaggatacgcaagggctggatggatggtggctatgcagtttgcacgggagacaggggatcgtaccaggcaaccgcctgaaaattctggtgggaatgtacgataaaaaaccagccggtccaggtccgggacctccggctactcctgcgcagccacagccaggcctgcacgctcctgcacctcccgcaagtcagtataccccgatgcttccaaacacttaccagccccagcctgactctgtctatcttgtgccaactccatcaaaagcccagcaggggctgtaccaggtgcccggtccctctcctcaattccaatccccgcctgcaaaacaaacaagcacatttagcaagcagactccccatcacccatttccatcaccagccactgatctgtaccaggttccgcctggtccaggtggcccagctcaggacatttaccaggtgccaccatctgctggtatggggcacgacatctatcaggtgcctccaagcatggacacgaggagctgggaggggactaagccacccgcaaaagtagtggtacctacgcgagtggggcaaggctacgtgtatgaggccgctcagcctgagcaagacgagtacgacatacctaggcacctgttagcacctggtccccaggatatctacgacgtccctcccgtaaggggcctgttacccagccagtatggtcaagaggtgtacgacacaccacctatggccgtcaagggcccaaacggcagggatccactgctggaggtgtacgatgtcccgccttccgtggagaagggattgccgccatcaaaccatcatgcagtttatgacgtgcctccatcagtgtccaaggacgtacccgacggaccacttttgcgagaggagacatatgatgttccacccgcatttgccaaagccaagcctttcgaccccgctcgtacgcctctcgtgctagctgctcctccccctgatagcccacccgctgaggatgtgtatgatgtccctccacccgctccagacctttatgatgtccctccaggcctgaggaggccaggacccggaactttatatgatgtcccgagggagcgggtgctgccaccagaggtagccgacggcggagtcgtcgatagcggcgtttatgccgttccgcctcccgctgagcgcgaagccccagctgagggaaaacggctgagtgcctcctctactgggtctactcggagtagtcagtctgcaagcagtctggaagttgccggtccagggagggaaccgttggagctggaagtcgctgtcgaagccctcgcacgcctgcagcagggagtcagtgcaaccgttgcccacctcctggaccttgccggttccgcaggagcaacgggatcatggcgaagcccctccgagccacaggagcctttagttcaagatctccaagccgcagtcgccgcagtgcagtctgctgtgcatgagctcctggagttcgcacgctcggctgtcggaaacgcagcccacacatctgacagagccctgcacgctaagctctctagacagctgcagaaaatggaagatgtccaccagacactcgttgcccacgggcaagctcttgacgccggacggggaggatctggagctaccctcgaggatctggataggttagtggcctgttcgcgagccgtccccgaagatgcaaagcagctggcttcattcctacatggcaatgcctccctgctgttccgaaggactaaagcaaccgccccagggcctgagggtggcggtactctccacccaaaccctaccgacaagacgtccagcatccagtccaggcccctgccctcgccgcctaagttcaccagccaggactccccagatggtcagtacgagaactctgagggcggttggatggaggactacgattacgttcacctgcaggggaaagaagagttcgagaagactcagaaagaacttcttgagaagggctcaatcacaagacaggggaagtcccagttggagctgcagcagctgaagcagtttgagcggcttgaacaggaggtgtcgagacctattgatcatgacctggcaaattggacccccgcacagccgttggctccgggaagaactggaggactcggcccaagtgacaggcaactactgctgttctacctggagcagtgcgaagcgaaccttacgactttaacgaacgctgtagacgcattcttcactgccgtcgctacaaaccagccaccaaaaattttcgttgctcatagcaaatttgtgatcctgagcgcccataagctcgtgttcattggagacacgctcagtagacaagcgaaggctgccgatgtgcgcagtcaggttacccactatagcaatctcctgtgtgatctgttacgcggaatcgttgctaccactaaagcagctgccctccagtatccatctccttcagccgcacaggacatggtcgaaagagtgaaggaattgggtcattccacccagcagtttaggagagtgcttggacagctggccgctgcatag

SEQ ID NO: 27602 - DNA, 2526 bp, Artificial Sequence
  Description of Artificial Sequence: Synthetic coding sequence
atgaccgtcctggaacaggacactcagggtttggatggctggtggttatgctcgcttcatggtcgccaaggaattgtcccgggtaacaggttaaagatcctcgttgggatgtatgataagaaaccggcaggcccaggccctggtccaccagccacccctgcacagcctcagcccggattacatgcccctgcaccacctgcgtctcagtatacgcctatgctacccaacacctatcaaccgcagcccgattccgtgtatctggtccccactccgtccaaggcccagcaaggactctatcaggttccaggacccagtccccagttccagtcacccccagctaagcagactagtacattctccaaacagactccgcaccatccatttcccagccccgctaccgacctgtatcaggtgcctccaggtcctggcggacccgcacaggacatataccaggtgcctccctccgctggcatggggcacgatatctatcaggtgccacccagcatggatacccgcagctgggagggcaccaagcctcctgccaaagtggtggttccaaccagagtggggcagggttacgtttacgaagccgctcagccggagcaagacgagtatgatattcctagacatttgcttgcaccgggacctcaggatatctatgatgtgcccccagttcggggactgttgccaagccagtatggacaggaagtttatgacactccaccgatggcagtgaaagggccaaatgggagggaccccctgctcgaggtgtacgacgtgcctccatcagtcgagaaggggctccccccttcaaaccaccacgctgtctacgatgtgcctccgtccgtcagtaaggacgtgccagacggacctttgctgcgcgaagaaacgtacgatgtccccccagcttttgcaaaggcaaagcctttcgaccccgcacgtacccctctggtcctagcggctccgcctcctgattctccaccagcagaggacgtgtatgatgtgccacctccagcccctgacctgtacgacgtgccgccagggttgcgtcggccaggccctgggactctgtacgacgttcccagggaaagagttctgcctccggaagtggcagacggcggagtcgtggactcaggtgtgtacgctgtgccaccaccagcagaacgagaagctcctgccgaagggaaaaggttgtccgcgtcttccacggggtccacacgcagctctcagagcgccagtagcctcgaggttgccggtcctgggcgtgagcctctcgagctcgaagtggccgtggaagcactagctcgcctgcaacagggcgtctccgctacggtggcccacttgctggacttagccggaagcgccggagccacaggcagttggcgtagcccctccgagccccaagaacccttggtccaagatttgcaagcagcagtcgcggctgtgcagtctgctgtccatgagctcctcgagtttgcaaggagcgctgtggggaatgccgctcacacaagtgatcgagcccttcacgccaagctgtcaagacaactgcaaaagatggaggacgtacaccagactctcgtggctcacgggcaggcactggacgccggtcgcggaggaagtggggctactctggaggacctggatcgcctggtcgcttgcagccgggctgtcccggaggatgccaaacagctggcttctttcctgcatgggaacgcgtctttactgttcaggagaactaaggcaacagcaccaggccctgagggcggagggaccctgcaccctaatccgacggataagactagctctatccagagtagacctctgcctagcccacctaagttcacctcccaggattcacccgacgggcaatatgaaaattcagagggcggatggatggaggattatgactacgtccatctacaggggaaggaggagttcgaaaaaacacagaaggagctgctagagaaagggagcataaccagacaaggcaagagccaacttgaactgcaacagctcaagcagttcgagagactagaacaggaagtctcaaggccaattgatcacgatctggcaaattggacgcccgcacagcccctggcccctggcagaaccggcggtctgggcccttccgacagacagttattattgttttacctggagcaatgtgaggctaatctgacaaccctcaccaacgccgtggacgcctttttcactgccgtggctacaaaccagccccctaaaatcttcgtggcccattctaagttcgtgatcctctctgctcacaagctagtgtttatcggtgacacactgagtcggcaggcaaaagctgctgatgtacgctctcaggtcactcactactcaaatctgctgtgtgatttactaagaggtatcgtggcaacgactaaggcggctgccctccagtacccaagtccctcggctgctcaagacatggtagagcgggtaaaagaactggggcatagcacccagcagttccggagagtgctaggacagctcgctgccgcttag

SEQ ID NO: 27603 - DNA, 741 bp, Artificial Sequence
  Description of Artificial Sequence: Synthetic coding sequence
atgccagtgcaacccccatccaaggataccgaggaaatggaggctgagggcgatagcgcagctgaaatgaacggggaggaagaagagtccgaggaggagcgaagtgggagccagacagagtccgaagaagaaagttctgagatggacgatgaagactacgaacggagacggtccgagtgtgtgtctgaaatgctggatctggagaaacagttctctgaattaaaggaaaagcttttccgtgagcgcttaagccagcttcgcttaaggttggaggaagtgggcgcagagagagcgccagagtataccgaaccactgggaggccttcagagaagcctgaaaatccgaatacaggtcgcagggatctacaagggattctgcctggacgtgatccggaataagtacgagtgcgagttgcaaggcgcaaagcagcatcttgagagcgagaagttgctgctatacgacactctacagggagagctacaggagagaatccagaggctcgaggaagatcgacagtcactggacctatcctctgagtggtgggacgacaaacttcacgcacggggatcctcacgcagctgggatagcctgcctccgtctaagaggaaaaaagccccactggtttctgggccttacatagtttatatgctgcaggagattgatatactggaggactggacagctattaaaaaggctcgcgctgccgttagtccccagaagcgaaagtctgacggaccatag

SEQ ID NO: 27604 - DNA, 873 bp, Artificial Sequence
  Description of Artificial Sequence: Synthetic coding sequence
atgcctgttcaaccgccaagcaaggacactgaggaaatggaggctgagggtgactcagccgcagaaatgaatggtgaggaggaggaatcagaagaagaacgctccggaagccaaacagaatcggaagaggagtcctctgagatggacgatgaagattatgaacggcgtcgctccgagtgcgtctcggaaatgctcgacctggaaaagcagttttcagagctcaaggaaaaattatttcgcgagcggttgagccaactcaggctgcgcctcgaagaagtgggcgcagaacgcgctcctgagtacacagagccactcggcggtctgcaaagaagcctgaagattagaatccaggtggccggaatctacaaaggcttttgccttgatgttattaggaataagtatgaatgtgaactccagggcgctaagcagcatttagaatccgagaagctgctgctttatgacaccctgcaaggcgaactgcaggagcgcattcaacgcctggaagaggaccggcagtccctagatcttagcagcgagtggtgggatgataagctccatgcacgcggaagctctcgttcatgggattccctgccacccagcaagcggaaaaaagctccactcgtgagtggaccctacattgtttatatgctgcaggagatagatattttggaagattggacagctatcaagaaggcccgagccgctgtgtctcctcaaaagcgcaagtcggatgacaggcgaacacaccgcccactgagggtgtgcccagctagactcctctggtgctgctgggcgctcccactgcatcttgccctggcctggactccccctctgccatcaagtaggccagctcagctttggccctggtcatag

SEQ ID NO: 27605 - DNA, 735 bp, Artificial Sequence
  Description of Artificial Sequence: Synthetic coding sequence
atgccagtgcagcctccatccaaggataccgaggagatggaggccgaaggggactctgccgctgagatgaacggcgaggaggaagaaagcgaagaggagaggagcggatcccagaccgaatccgaggaggagtcgagtgagatggatgacgaggattatgaaaggaggcgatcagaatgtgtgtcagaaatgttagatttagaaaagcagttttccgagctaaaggagaaactttttcgagagcgcttgagccagctcaggctcaggctggaagaggttggagcggagagagcgccagagtataccgagccacttggtggattgcagcggtcgttaaaaatccgaatacaagtcgcaggcatctacaaagggttttgtttggatgttattagaaacaagtatgaatgtgagctgcagggtgctaaacagcatctggagagtgagaaactgctcctgtacgatacccttcagggagaactccaggaacgaattcagagactcgaagaggaccgccaatcattggacctgagctcagagtggtgggatgacaagttgcacgctcgcggatcctcgaggagttgggatagtctgccgccaagtaagcgtaaaaaggcgcctctagtttctggcccatatatcgtatacatgctgcaggaaatcgatatcttggaagactggactgccataaaaaaagcgagggcggcagtgtccccacagaaacggaagagcgactag

SEQ ID NO: 27606 - DNA, 1494 bp, Artificial Sequence
  Description of Artificial Sequence: Synthetic coding sequence
atggccgagatgggctcgaagggcgttaccgcaggaaaaatcgcgtcaaacgttcagaagaaactgactagagcacaagagaaagtcctacagaagcttggcaaagccgacgaaacaaaggacgagcagtttgaacaatgtgttcagaacttcaacaaacagctcaccgaaggaaccaggctacaaaaggacctcaggacatatttagccagcgttaaagcaatgcacgaggccagcaaaaaattgaacgagtgcctgcaggaagtgtatgaacccgactggcctggccgtgatgaagccaataagatcgcggaaaataatgatttgctgtggatggattatcatcagaaattggtggaccaggccctactgacgatggacacttacttgggacagtttcccgacattaagtctcgcatcgcaaaacgaggaagaaaactagtggattacgattccgctcggcatcactacgaaagcctgcagaccgccaagaagaaggatgaggccaaaatagcgaaagcggaagaagaactcatcaaggctcagaaggtatttgaggagatgaacgtggacctccaggaagagcttcccagcctgtggaattcacgcgtgggcttctacgtcaacacttttcagtcgatcgctggactggaggagaactttcataaagaaatgtctaaactgaaccagaatctcaatgatgtgctggttgggctcgagaaacagcatggctcaaatacattcaccgtaaaggcgcagcccaggaagaaaagcaagctgttctcccgcctgcgtagaaagaagaattcagataacgctcccgcaaaagggaataagtctcccagccctcccgatgggtccccagcagctaccccagagatccgcgtgaatcatgagcctgagcctgccggtggcgctacacctggcgcaaccctccccaagtcaccgagtcagctccggaagggacccccagtgccccctcccccaaaacacacaccaagcaaggaggtgaaacaggagcaaatcttaagcctgtttgaggacactttcgtccccgagatcagtgtgactacaccctcacagcccgctgaagccagtgaggtggccggtggtactcagcctgccgctggagcacaggagcctggtgagacggccgcatcggaagctgccagcagcagcctgcctgccgtggttgtcgaaaccttccccgctactgttaacgggaccgtggagggcggtagtggggctgggaggctggatcttccccctggcttcatgtttaaagtacaggctcagcacgactataccgcaactgacacggatgagttacagctgaaagcaggagacgtggtgctagttatcccctttcaaaaccccgaggagcaagacgagggttggctcatgggcgtgaaggagtccgactggaaccagcataaagaactagaaaagtgcaggggggtatttcccgagaatttcactgagcgggtgccctag

SEQ ID NO: 27607 - DNA, 1782 bp, Artificial Sequence
  Description of Artificial Sequence: Synthetic coding sequence
atggcagaaatgggctccaagggagtgactgctggcaagatcgcaagtaatgtgcagaagaaacttacccgcgcacaggaaaaggtcctacagaaactgggaaaagctgatgagaccaaagacgaacagtttgagcagtgcgtccagaacttcaataagcagctgactgaaggaactaggttgcagaaagaccttaggacctacctggcgagcgtgaaggctatgcatgaggcaagtaaaaaactcaacgagtgccttcaggaagtttacgagcctgactggcccggacgtgatgaggcgaataaaatcgccgaaaataatgatcttctgtggatggattatcatcagaaacttgtggaccaggccctcctgacaatggacacttatctcggccagttccccgacatcaaatcccggattgccaagcgcggtaggaagctcgtggattatgactccgctaggcatcattacgagtccctccagacagcaaaaaaaaaggatgaagccaagattgcgaagcctgtgagtctgcttgagaaagcggcaccccagtggtgtcagggaaaactacaggcacacttggtcgctcagactaatctgttgcggaaccaggcggaagaggagctgatcaaagcccagaaagtttttgaggagatgaacgtagatctacaggaagaacttcctagtttatggaacagtagagttggcttctacgtcaatacatttcagtcgatcgctgggctggaggaaaattttcacaaagagatgtccaagttgaatcaaaacttgaacgatgtgctggtgggactcgaaaaacagcatgggagtaatacctttaccgtgaaagcacagccgtccgacaatgctccagcgaaagggaataaaagcccctctccccctgacggaagccccgctgcgaccccagaaatcagagtgaatcacgaacccgaaccggcaggtggagccactcctggagcgaccctgcctaaatcaccttctcagctaaggaagggaccccctgttcctccaccacctaaacacacccccagcaaggaagtcaagcaagaacaaatcttatctctgtttgaggatacattcgtaccggaaattagtgtgactactccctctcagttcgaggcacccggaccgttttccgagcaggccagtctgctggatctggacttcgaccccctcccaccagtgaccagtcccgtgaaggctccgaccccctcaggccagagcattccctgggatctgtgggaacctacagagtcccccgctggatccctaccttccggtgagccaagcgctgccgaaggaaccttcgcagtctcctggcctagccagacggctgagcccggtccagcccagccggctgaggcttctgaggtggctggcggaacacaacccgctgccggtgctcaagagcctggggaaacagccgcttccgaggcagctagttcctccttgcctgccgtcgtggtcgagacctttcctgccactgttaacggcactgtcgagggcggatccggggctggcagattggatcttccccctggctttatgtttaaggtgcaggcccagcatgactatacggccacagacacggatgaacttcaattaaaagccggagatgtcgtcctggtgattccattccagaatccagaggagcaggatgagggttggttaatgggagtcaaggaaagcgactggaatcagcacaaggagctggagaagtgtcgcggagtttttccagagaattttaccgaacgggtgccatag

SEQ ID NO: 27608 - DNA, 1557 bp, Artificial Sequence
  Description of Artificial Sequence: Synthetic coding sequence
atggccgaaatggggtccaaaggcgtgacagcaggcaagattgccagtaatgtgcaaaaaaagctgactagggcacaggagaaagtactgcaaaagctgggcaaagccgatgaaaccaaagacgagcagttcgagcagtgcgttcaaaacttcaacaagcagctgaccgagggaaccaggctccagaaggatcttcgtacataccttgcctccgtgaaggccatgcacgaggctagcaaaaaactcaatgaatgtctgcaggaggtctacgagcctgactggcctgggcgtgatgaagccaataagattgctgagaataacgaccttctgtggatggactaccaccagaaattggtcgatcaggccttacttacaatggacacttatctcggacagtttcccgatatcaaaagtcgcatcgccaagagaggcagaaagctggtcgattatgattctgctaggcaccattatgaaagtctgcagacagcgaagaagaaggatgaagctaaaattgctaaagcagaggaagaacttatcaaagcccagaaagtcttcgaggaaatgaatgtggatctgcaggaggagttgccctctttatggaattccagggttggattctacgtcaacaccttccagtctatcgctggactggaggagaactttcataaagagatgagcaaactgaatcagaacctcaacgatgtgctggtcggccttgaaaaacagcacggaagcaacacctttaccgttaaagcccagccatccgacaatgctcccgctaagggtaacaagtccccctccccccctgacggaagtcctgctgcaacaccagagatccgcgtgaatcatgaaccagagcctgcagggggagccacacctggagcaaccttaccaaaaagcccctctcagctgcggaaggggcctcctgttcctccaccacctaagcatacccctagcaaggaggttaagcaggagcaaattttgagcctgtttgaggatacgtttgtgcctgagatatctgttaccaccccatcacagcccacggaatcaccagcagggtctctcccctcaggggaaccttcggcagcagagggaacctttgccgtatcctggccctctcagacagctgaacctgggccagcccagcccgcagaggccagcgaggtcgccggtggaactcagcctgctgcaggggctcaggagcccggagagactgccgcatctgaagctgcctcatccagtcttcccgcagtcgtagtggagaccttccctgctacagtcaacggaaccgtggaaggcggatccggcgctggtagactggaccttccccctggctttatgtttaaggtccaggcacaacatgactacacagccactgacaccgacgaactccagctgaaggcaggcgatgtggtgttagtgattcctttccaaaacccagaggaacaagacgaaggctggctgatgggcgtcaaggagagtgactggaaccagcacaaggagctggaaaagtgcagaggagtcttccccgagaacttcaccgagcgggtgccttag

SEQ ID NO: 27609 - DNA, 1230 bp, Artificial Sequence
  Description of Artificial Sequence: Synthetic coding sequence
atggcggagatgggcagcaagggggtgaccgcaggcaaaatcgccagtaatgtgcagaaaaagctgacgcgcgctcaggaaaaggttctacagaaattaggtaaagctgatgaaacaaaggacgagcagtttgagcaatgtgttcaaaacttcaacaagcagttgaccgaaggcacccgactgcagaaggatttgcgtacttatctggctagcgtaaaggcgatgcatgaagcctcaaaaaagttgaacgagtgcctgcaggaggtgtacgaacctgattggcccggaagggacgaggcaaacaaaatagctgaaaacaatgatctgttatggatggactaccatcagaagctggtggaccaggcactactaacaatggacacttacttaggtcagttccctgacatcaagtcgcgcattgccaaacgaggcaggaagctggttgattatgattctgcccgacatcactacgaaagtctgcagacagctaaaaaaaaggacgaggccaaaatcgctaaagccgaggaagagcttattaaggcccagaaagtttttgaggaaatgaatgtggaccttcaggaagaactcccttccctgtggaatagccgggtcgggttctacgtgaacactttccaatccatcgccggtctcgaggagaattttcacaaggaaatgtcaaagctgaaccagaaccttaatgatgtgttagtcggattagagaaacagcacggatctaatacctttaccgtcaaggcacagccatccgataatgctcccgctaaaggaaataagtcacctagcccaccagacggcagccccgctgccaccccagaaatccgagtcaaccatgaacccgaaccagcaggtggagctactcctggcgcaacgctgccaaagtcgccctctcagagctccctacccgcagtcgtagtggagacattcccagccactgtgaatggtaccgtggagggcggaagcggtgcaggcaggctcgacctgccccctggttttatgtttaaggttcaggcgcagcatgattacacagctacagatacagacgaattgcagttaaaagccggagatgtggtcctagtgatcccctttcagaatcctgaagagcaggacgagggatggctgatgggcgtcaaggagagtgactggaatcagcacaaagagttggaaaagtgtagaggcgtattccctgagaactttactgagagagtgccatag

SEQ ID NO: 27610 - DNA, 1521 bp, Artificial Sequence
  Description of Artificial Sequence: Synthetic coding sequence
atggccgaaatgggatccaagggtgtcaccgccggaaagatcgccagtaacgtgcagaaaaaactgaccagggcgcaggagaaagttctgcagaagttgggaaaggctgacgagaccaaggatgaacaattcgagcaatgcgtgcagaattttaacaagcaacttactgaagggactcgcctacagaaagatctccgtacttatctggcctccgtgaaagctatgcatgaagcttctaagaagttgaatgaatgcctgcaggaagtctatgagccagactggcctgggagggacgaagcgaacaagattgcggagaataatgatcttttgtggatggattaccaccaaaaactggtggatcaggctctcttgaccatggacacctacttgggccagttcccagacatcaaatccagaattgccaagaggggtcgcaagcttgtggactatgacagcgcacgtcaccattatgagtctctgcaaacggcgaagaagaaagacgaggctaagattgccaagccagtgtccctccttgagaaagccgctccacagtggtgccagggaaaactccaggcccatcttgtcgcccagaccaacttactcaggaaccaggctgaggaggaactgatcaaagcacagaaggtcttcgaagagatgaatgtcgatcttcaggaagaactcccctcactgtggaacagtcgggtgggcttttatgtgaatacctttcagagcattgctggcctggaagagaactttcacaaagaaatgtctaaactgaaccaaaatctcaacgacgttctggtaggactggagaaacagcacgggtccaatacgtttaccgttaaggctcaaccatctgacaatgcccctgctaaggggaacaagtcaccctccccgcctgacggcagcccagcagccacccctgaaatccgagtgaaccatgagccagaacccgctggcggagccaccccaggtgcaaccctgcccaaatcaccaagccaacccacggaatcaccagctgggagtttgcccagtggcgagccttcagctgcagaggggacattcgcagtgtcatggccaagccagacagctgagcccggtccagctcagccagctgaggcatctgaggtggccggaggtacacagccagccgctggggctcaagaacccggagagactgccgcaagcgaagctgcatcaagctctctcccagcggtcgttgttgaaactttcccggcaacggtgaacgggaccgtggagggcggatccggagccggacgactggatcttccgcctggattcatgttcaaagttcaggcccagcatgactatactgccaccgatacagacgagttgcagctgaaagctggggacgtggtcctggtgataccttttcagaatcccgaagaacaagacgaaggatggctcatgggagttaaagagagcgactggaaccagcataaggagctcgagaagtgtcgcggtgtttttccagaaaattttaccgaacgggtgccttag

SEQ ID NO: 27611 - DNA, 1365 bp, Artificial Sequence
  Description of Artificial Sequence: Synthetic coding sequence
atggcagaaatggggtcgaagggcgtcactgctggaaagatagccagcaatgtccagaagaaactaacacgggctcaggagaaggttctgcagaaactcgggaaggctgacgaaactaaagacgagcaattcgagcagtgcgttcagaactttaataagcagctgacagaaggtactcgcctccagaaggacctgagaacttacctggcctccgtcaaagctatgcacgaggcgtcaaaaaagcttaacgagtgtctgcaggaagtgtatgagcctgactggccaggaagggacgaggcaaataagattgcagaaaataatgaccttctttggatggattaccaccagaaactggtggatcaggccctgctcacaatggacacatatctgggtcaattccctgacattaagagcagaatcgctaagcgtggccgtaagctcgtggattacgatagcgcaaggcaccactacgagtctctgcagacagccaagaagaaggatgaggccaagatagctaaagccgaggaggagcttattaaggcgcaaaaagtgttcgaagaaatgaacgtcgatttgcaggaagagctgccgtccctatggaacagtcgcgtaggtttttacgttaacacatttcagagtatcgcagggttggaggagaacttccacaaggagatgtctaagctcaaccagaatttaaacgatgtgctggtaggcttagagaaacagcacggcagcaatacattcacggtgaaggcccagccacggaagaaatctaagctgttttccagactgcggagaaaaaaaaacagtgataacgctcctgcaaaagggaacaagtcgccctcccctcctgacggctcgccagccgcaacccccgagatccgcgttaatcatgagcccgagccagcgggaggagccacccctggggcaaccctccccaaatcaccatcccagccagctgaggcatctgaagtggcgggaggaacacagcccgctgccggtgcccaggaacctggagaaacagcagcttccgaagccgcatccagctctctcccggcagtagttgttgaaacctttccagcaactgtgaatgggacagtggagggtggctccggggcaggtcgcctagacctgcctcccggattcatgttcaaagtccaggctcaacatgattacactgctacggacaccgatgagctgcagcttaaggcgggagacgtggttctggttatcccatttcagaaccctgaagagcaagacgaaggatggctgatgggagtcaaggagtccgactggaatcagcataaagagttagaaaaatgccgcggtgtcttccctgagaattttaccgaaagagtcccttag

SEQ ID NO: 27612 - DNA, 1653 bp, Artificial Sequence
  Description of Artificial Sequence: Synthetic coding sequence
atggcagagatgggctctaagggtgtgaccgctggcaagattgcaagcaacgtgcaaaagaaactgacacgtgctcaggagaaggtattacaaaaattgggtaaagctgacgaaactaaggacgagcagtttgagcagtgtgtgcaaaacttcaataagcagctgactgagggcactcggttacagaaggacctgaggacttacctggcctccgtgaaagcgatgcatgaggcaagcaagaagctgaacgagtgtctgcaggaagtctacgagccagattggcccggtagggacgaggcaaataaaatcgccgaaaataatgatctgttatggatggattaccaccagaagttggtggaccaggccctgctgactatggacacgtacctgggccaatttcctgatattaaaagtaggattgctaagagaggcaggaagcttgtcgattatgactcagctcggcaccactacgagtcattacagaccgcaaagaagaaagacgaggcgaaaatcgcaaagcccgtaagtctgttggaaaaagctgcccctcagtggtgccagggaaaattgcaggctcacctcgtagcccagacaaatctgttgagaaatcaggctgaggaagagctgatcaaggcacaaaaggtgttcgaagagatgaacgtggatcttcaggaggaactgccatccctctggaattctcgggtaggattttacgttaatacctttcagtctatcgcgggactggaggaaaatttccacaaggaaatgagtaaattaaaccagaatcttaacgatgttctcgtgggccttgagaaacaacacggttctaacaccttcacagtgaaggctcaaccgagcgacaatgcacctgcaaaggggaataaaagtccctcaccgccagatggttctccagccgcaacgccagagatccgtgttaatcatgagcctgagcccgcagggggtgctactccaggggcaacactacctaagtcccctagccagttcgaagcgccaggacccttctctgagcaggcaagcctgctagacttagactttgatccactgccccctgtgacgtcaccggtgaaagcccctacaccttccggacagtcgatcccctgggacctctgggaacctaccgagtcaccagccggaagcttgccgagtggggagccttccgctgctgaggggacctttgcggtatcctggcctagtcagaccgccgaaccgggtcccgcacaaccggctgaagctagtgaagttgctggcggtactcagccagcagccggagcacaggaaccaggagagaccgccgctagtgaggccgcatcatcttccttgcccgctgtcgtagtcgagactttcccagctaccgtcaatggaacggtggagggagggtcaggtgccggaagacttgacctgccccctgggttcatgtttaaagtccaggctcagcacgactacaccgccacagacacggacgaattgcagctgaaggcgggtgacgtagtcctggtgatacctttccagaatccggaggagcaggatgaggggtggttgatgggcgtcaaagaaagcgattggaatcagcacaaggagctcgagaaatgccgtggcgtgtttccagagaactttactgaaagagtcccctag

SEQ ID NO: 27613 - DNA, 1449 bp, Artificial Sequence
  Description of Artificial Sequence: Synthetic coding sequence
atggctgagatgggatcaaaaggcgtaacagctgggaagatcgcctcaaatgtacagaagaagctgactcgggctcaggaaaaggtgctgcaaaaactgggaaaggccgatgaaactaaagacgaacagttcgagcagtgcgtccaaaacttcaacaaacagctgactgaaggcacccgccttcaaaaggacctgaggacctaccttgctagtgtgaaggccatgcatgaagcatccaagaagctgaatgaatgtctgcaggaagtctacgaaccagattggccgggaagagacgaagcaaataagatagccgaaaataacgatttgctgtggatggactatcaccagaagttagtagatcaggctttgcttacaatggatacttacctgggccagtttcccgatatcaagtccagaatcgccaagaggggtaggaaactggtggactatgacagcgcaagacaccattatgaatctctgcagactgctaaaaaaaaggatgaagcaaaaatcgctaaggctgaggaggagctcattaaggcccaaaaggtgtttgaagagatgaatgtggacctgcaagaagaactacccagtctgtggaattcccgcgtggggttttatgtgaataccttccagtcaatcgccggtctcgaagagaacttccacaaagagatgtctaaactgaatcagaacttgaatgatgtgctcgtgggcctggaaaaacagcatggatcaaatacctttacggttaaagcgcagcctagcgataacgcccctgccaagggaaataaatctccgagtccgcctgacggctcacccgcagctacgcctgaaatacgcgtgaatcatgagccagagcccgctggcggtgcaaccccaggtgccacattacccaagtctccgagccagttacgtaaaggtccgccagttcctccaccgccaaagcacaccccttccaaagaagtgaagcaggaacagattctgtctctttttgaggatacatttgtccccgaaattagtgtcacaaccccttcccaaccggcagaagcctcagaggtggcgggaggcacccaacctgccgcaggggcacaggagcctggggaaacagctgcgagtgaggccgcatcatctagccttcccgcagtcgtggtcgaaacttttcccgcaacagtcaatgggactgtcgaggggggaagcggcgctgggcgactggacttgccgcctggcttcatgttcaaggtacaggctcaacacgattataccgccactgacaccgatgagctgcaactcaaggccggagacgtagtccttgtgattccattccagaaccctgaggaacaggacgagggatggctgatgggagtgaaggaatctgactggaatcagcataaagagttggaaaaatgtcggggtgtgttcccggagaatttcaccgaacgcgttccatag

SEQ ID NO: 27614 - DNA, 1428 bp, Artificial Sequence
  Description of Artificial Sequence: Synthetic coding sequence
atggccgagatgggctctaagggggtcacagccggaaaaattgctagcaatgtgcaaaagaaactgacccgcgctcaggagaaggttttgcaaaaactgggtaaagcggacgagactaaggatgagcagtttgagcaatgcgtacaaaacttcaataaacagctcaccgaaggcacccggcttcaaaaggatctgcggacctatctcgctagtgtcaaggcgatgcatgaggctagcaaaaagctgaacgaatgtctgcaggaggtgtatgagcccgactggcctggtagagacgaggccaacaagatcgccgaaaataacgatttactctggatggattaccaccagaagcttgtggaccaggccctcctgacaatggatacatatctgggccagttcccagatattaaatcacgcatcgcgaaaaggggtcggaagctcgttgactacgacagtgccagacatcactatgaatcattgcagaccgcgaaaaaaaaggacgaggctaaaatcgctaaagcagaagaggaactcatcaaagcgcaaaaggtgtttgaggaaatgaacgtggatctacaagaggaattgccttccttgtggaatagcagggtggggttctatgtaaataccttccagtccatcgcgggtcttgaggaaaattttcacaaggaaatgtcaaaacttaatcagaatcttaacgatgtcttagtggggctcgagaagcaacacggtagcaacaccttcacagttaaggctcaaccgtctgataacgcaccagctaagggcaataagagtccctcgccgcctgatggatcgccggcagccacacccgaaattcgggttaatcacgagcctgaacctgccggaggtgcaacccctggagccactcttcccaagtccccctcacagccaaccgagtcgccagccggtagcctaccaagtggcgaaccttccgctgccgaggggacatttgcagtgagctggcccagccagacagcagaacctggccctgcccaacctgctgaggctagtgaggtggccggagggactcagcctgctgccggagcgcaggagcctggggagacagcagcttccgaggctgcgagcagctctctgccagcagtagtggtcgagacgttccctgccaccgtgaatggaacagttgaaggtggtagcggggctggcagactggacctcccaccaggtttcatgttcaaggttcaggcccagcacgactatacggccaccgacacagatgaattacagttgaaggcgggtgacgtggtgctcgtgataccatttcaaaatccagaagagcaggatgagggatggctcatgggagtgaaggaaagtgactggaatcagcataaggaattggaaaagtgccggggagtctttccagagaactttacagagcgcgtgccctag

SEQ ID NO: 27615 - DNA, 1320 bp, Artificial Sequence
  Description of Artificial Sequence: Synthetic coding sequence
atggccgagatggggagcaaaggcgtaacagctgggaagattgcttctaacgttcagaaaaagcttaccagggcccaagaaaaagtactacagaaactaggaaaggccgatgagacaaaagacgaacaattcgaacagtgcgtacaaaatttcaacaaacagctgacagagggtacacggctccagaaggatctgcggacatatctcgccagtgtgaaggcaatgcacgaagcctcaaagaagttgaacgagtgcctgcaggaggtgtacgagcctgactggcccggtcgtgatgaagcaaataaaatagcagaaaataatgacctgctgtggatggattatcaccagaagctggtagaccaagcgctactgacaatggacacatacttggggcagtttcctgatattaagtcccgcattgcgaagcggggacgaaagctggtagattatgatagtgcgagacaccattacgagtcccttcagactgcaaagaaaaaagacgaagccaaaattgctaaggcggaagaagagcttattaaggcccaaaaggtatttgaagagatgaacgtcgatctgcaggaggagctcccatcactttggaatagccgcgttgggttttacgtaaacacgttccagtctatcgctgggcttgaagagaattttcacaaagagatgtctaaactgaaccagaacctgaatgacgtcctagtcggactggagaaacagcacggatccaacacattcaccgtgaaggcgcagccatccgacaacgccccagccaaggggaataagagcccttcccctccagatggctctcctgccgcaacacctgaaataagagtgaaccacgagccagagccagccggtggcgcaacaccgggtgccacactgccaaagtctccaagccagccagcagaagcatccgaggtagctggtggcacacaacccgcagcaggagctcaggaacctggcgagactgctgcctctgaggctgcctcatcctcactacccgctgtggtagtcgaaacgttccctgctaccgtgaatggaaccgtagagggtggcagcggcgcaggccgattagacctccctccgggttttatgttcaaggtgcaagcacagcacgattacacagctacagatacagacgagcttcagttgaaggccggagatgtggttctcgtgatccctttccagaaccctgaggagcaggacgaagggtggctgatgggtgtcaaggagtcggactggaaccagcacaaagaactggagaaatgcaggggtgttttcccagaaaactttactgagagggtgccttag

SEQ ID NO: 27616 - DNA, 1956 bp, Artificial Sequence
  Description of Artificial Sequence: Synthetic coding sequence
atggggaaaaagcacaaaaaacacaagagtgacaagcacctgtacgaagagtacgtggagaagccactgaaactggtccttaaagttggtggtaacgaggttacagaactgagcacaggaagttctgggcatgatagcagccttttcgaagataagaacgaccatgataagcacaaagatagaaagcgcaagaagcggaagaaaggagagaagcaaatccccggagaagaaaagggtcggaaacgaaggagagttaaagaggacaaaaagaagagggaccgtgatagagtggagaatgaggctgagaaagatctgcagtgtcatgcgcctgtccgactggatctgccacccgagaagcccctgactagctctctagcgaagcaggaagaggttgaacagacacccctccaggaagccctgaaccaactgatgcgacagctacagcggaaagatccgagcgcctttttttcatttcctgtaactgattttatcgcgcctggttatagtatgatcataaaacatcctatggatttctcaacaatgaaggagaagattaaaaataacgactaccagagcatagaggagcttaaagataactttaaactcatgtgtaccaatgcaatgatttacaacaagccggaaacgatctactacaaagcagcaaagaaacttttgcactcagggatgaaaattcttagccaggagcgaatccaaagcttgaaacagtctatcgattttatggcggacctgcagaaaaccagaaaacaaaaggacggaacagacaccagccagagcggcgaggatggtgggtgctggcaaagggaaagagaagactccggagatgccgaagcgcacgcctttaagtcacccagcaaggagaacaagaagaaggacaaggacatgctcgaggacaagtttaagagtaacaatctggagagagagcaggaacagctggatcgcatcgttaaagaatcgggcggaaagttgaccagaaggctagtgaattcccagtgtgaatttgaaaggcgtaagcccgatgggaccaccacactggggctgctgcaccccgtggatcccatcgtaggggagcccggatactgcccagtacggctagggatgaccaccggacgcttgcagtccggagtgaatacactacaggggttcaaagaggacaaacggaacaaggtaacacctgtcctctacttgaactatgggccatactctagctacgcccctcactacgactctacattcgcgaatatctccaaggacgactccgacttaatctattcaacctatggggaggactctgacctgccgtccgactttagcattcacgaattcctcgccacttgtcaggactacccatacgtcatggccgatagtttgttagatgtactgactaagggtggccacagccgcaccctccaggaaatggagatgagcttgcccgaagatgaaggccatacaagaactctggacaccgcgaaggagatggaaatcactgaggttgaaccgccagggaggctggatagcagcacacaggatagactcattgccctgaaagcagtcaccaatttcggggtgccggtcgaagtcttcgatagcgaagaggcggaaatcttccagaaaaagctggacgaaaccacacggctgctgcgagagctgcaggaagcccagaacgagagacttagcactcgaccacctccaaacatgatctgtcttctgggcccatcctaccgcgaaatgcatctggcagaacaagtaacaaacaacctcaaagaacttgcccaacaggtgacacctggcgacatcgtatccacttatggcgtgcggaaggctatgggtatatcaatcccatctcccgtgatggaaaacaactttgtcgacctgactgaggacaccgaggagcctaagaaaacagacgtggctgagtgcgggccaggcggatcctag

SEQ ID NO: 27617 - DNA, 1959 bp, Artificial Sequence
  Description of Artificial Sequence: Synthetic coding sequence
atggggaaaaagcataaaaaacacaaatcagacaaacacctatatgaagagtatgttgaaaaacctctgaagttggtgctcaaagtgggaggaaatgaagtgaccgagctttctactgggtcttcgggccatgatagttccctttttgaggacaagaacgatcacgataaacataaggataggaaacgtaaaaaacgtaaaaaaggcgagaaacagattccaggggaggagaaggggagaaaacggcgtagagtgaaggaggataaaaagaagcgggatcgggacagagtcgaaaatgaagctgagaaggaccttcagtgccatgcaccagtgaggctggatctgccgcctgaaaagcctctaacaagttctctcgccaaacaggaggaagtggagcagactcctctccaggaagcgcttaatcagttaatgaggcaactccagcgtaaagacccttcggccttctttagctttcctgtgactgattttatcgctccaggttattcgatgataataaagcaccctatggacttctcaacaatgaaagagaaaatcaagaacaacgactatcaatcaattgaggaattgaaagataacttcaaactgatgtgcacaaatgccatgatttacaataagccagagaccatctattataaagcagctaaaaagttgcttcacagcggaatgaagattctcagccaggaaagaatccagagtctgaaacaatcaattgatttcatggccgacctgcagaagactcgtaaacagaaggatggaaccgatacgtcccagagcggcgaagatgggggatgttggcagagggaacgggaggatagcggcgacgcagaagcgcacgctttcaagtcaccttccaaggagaacaagaagaaggataaagacatgctagaggataagtttaaatcaaataacctcgaaagggagcaggaacaattggacagaattgtcaaggagagcggagggaagctcacccgccgactggtcaatagccagtgtgaatttgaacgacgtaaacctgacggaacgaccaccctagggctgttgcacccagtggaccccatcgttggggagcccggatattgcccagtgcggctcgggatgaccaccggccgactccaatcaggggttaacacattacagggctttaaagaagataagaggaacaaagttacacccgtcctttacctgaattatggcccatactcttcttatgcaccccactatgatagcacattcgccaacatttctaaggacgactccgatcttatatacagcacctacggcgaagatagcgacctcccctccgacttttcaatccatgagtttctcgctacttgtcaggattacccgtatgtcatggcggattctttactggatgtattgactaagggaggacattctaggaccttacaggaaatggaaatgagcttaccagaggatgagggacatacaaggactctggacacggccaaggagatggagcagatcactgaggtggaacctcccggacgcctagatagctccacccaagatcgcctcatagctttgaaggccgtcactaatttcggcgtccccgtggaggtgttcgattcagaagaggccgagattttccagaagaagctagacgagacaacaaggctcctcagggagctccaggaagcccagaatgagcgcctgtctactcgccctcctcctaatatgatatgtctgctgggcccttcctacagagagatgcacctcgcagagcaagttacgaataacttgaaagaactcgcacagcaggtgactccgggagatatagtgtcgacatatggtgttagaaaggccatggggatcagcattccctcacctgtgatggagaataacttcgtggacctcaccgaggacaccgaagagcctaaaaagaccgatgtcgccgaatgcggtcccggagggtcatag

SEQ ID NO: 27618 - DNA, 1959 bp, Artificial Sequence
  Description of Artificial Sequence: Synthetic coding sequence
atgggaaaaaaacataagaaacacaaatcggacaaacacctctacgaagaatacgtggagaaacccctgaaactggtgctgaaggttgggggtaacgaggtcactgaactgtccacaggctcttctggccacgactcctctctgttcgaggataagaacgatcatgacaaacataaggaccgcaaaagaaaaaaaaggaagaagggcgaaaagcagattcctggcgaggaaaagggacgcaagcgaaggcgcgtgaaagaagacaaaaagaaacgcgatagagatagagtcgagaacgaagccgagaaggaccttcaatgtcacgccccagtcagactcgaccttccacccgagaaacctttaacctcttctctggcgaagcaggaagaagttgagcaaacccctctgcaggaagcgctgaaccagcttatgagacagctacagcgtaaggatccatcagcattcttcagtttcccagtgacagatttcatcgccccaggatatagcatgatcatcaagcatcctatggatttcagtaccatgaaagaaaaaatcaagaataatgattatcagtcgatcgaagagctcaaagacaactttaagctgatgtgtaccaacgctatgatctataacaagcccgaaacaatctactataaggccgcaaagaaactcctgcactccggcatgaagatcctgagtcaggaacgcattcagtcactcaaacagagcatcgactttatggcggatttacagaagactcggaagcaaaaggatggaactgacacaagtcaatccggcgaagatggcggttgttggcagcgagagagagaagatagtggagatgccgaagcacacgctttcaagtccccatccaaggagaacaagaagaaagataaggacatgttggaggacaaattcaagtcaaacaatctggaaagggagcaagaacagctcgatcgtatcgtgaaagagtctgggggtaagctgacacgccgattggtgaacagccagtgcgagttcgaaaggcggaaaccagatgggacgaccactttgggcttactacatcctgtcgatccaatcgtaggggagcctggctactgtccggtgcgacttggaatgacgaccggaaggcttcagtctggggttaatacactgcagggatttaaagaagacaagcgtaacaaagtaacacctgtattgtacctgaactatgggccttattcttcctacgcccctcactacgactccacgtttgccaacatatctaaggacgatagtgacctaatttactccacctacggcgaagattcagacttgccaagtgattttagcattcatgaattccttgcaacatgccaggattatccatacgtgatggccgattctttgctggacgtgctgaccaagggtggacacagcagaactctacaagagatggagatgagcctgccggaggatgagggccacacacgcactctggatacagctaaggaaatggaacagattacagaggttgaaccacctggccgacttgatagttccacccaggaccggttaattgcactgaaggccgtcactaatttcggcgtccctgttgaggtgtttgattccgaggaagctgaaatctttcagaagaagctagacgagactacaagactgcttcgtgaactccaggaagcccagaatgagcgcttgtctaccagacctcctcccaatatgatttgcctcttggggccatcgtatagagaaatgcatctcgctgagcaagtcacgaataacctgaaagagctagcgcaacaagtgactccaggggacattgtgtccacctatggagtcagaaaggcaatgggtatctctatcccaagcccggtcatggagaacaacttcgtcgacttgacggaggacacagaggaacctaaaaagacagacgtggccgagtgtggccctggcggtagctag

SEQ ID NO: 27619 - DNA, 1980 bp, Artificial Sequence
  Description of Artificial Sequence: Synthetic coding sequence
atggccgctgttattttggaaagcatatttctgaagcgcagtcagcagaagaagaaaaccagtcccctaaactttaagaagcgcctgttcctcctcaccgtacataagctctcttattacgaatatgattttgagagagggaggagaggctcaaaaaaaggaagcatcgatgtggagaaaataacttgcgtcgaaactgttgtgcctgaaaagaacccccctccagagcggcagattccacgcaggggcgaggaatctagtgagatggaacagatctccatcatcgaacgcttcccataccctttccaggtagtatacgacgagggtcccttgtacgtgttcagcccaacagaggaactgcggaagcgctggatacaccagctgaagaatgtgatacggtataactctgacctcgtccagaagtaccatccttgtttctggatcgatggtcagtacttgtgttgcagccaaaccgctaaaaatgccatggggtgtcagatcctcgagaaccggaacgggagtctcaagccagggagttctcacaggaaaaccaaaaaaccccttcccccaacacccgaggaagatcaaattttgaaaaagcccttaccaccagagcccgctgccgctcctgtgtccaccagtgaactgaaaaaagtggtcgcactgtacgattacatgccgatgaatgcaaacgacttacaactgcgtaaaggcgatgaatactttatcctggaagagtccaacctaccctggtggagagcgagggacaagaatggccaggaagggtatattccctccaactatgtgaccgaagccgaagattccattgagatgtacgagtggtactccaaacatatgactaggtcccaggcggagcagctgctgaagcaagaaggtaaggagggaggatttattgttagagattcatccaaggccggaaaatacaccgtttcggtcttcgccaaatccacaggcgacccacagggagttatccgccattacgtagtgtgctccactcctcaatctcagtattatttggcggaaaagcacctgttttctaccatccccgaactcataaactatcaccagcataactccgccggattgataagccggttgaaatatcccgtatcacagcaaaacaagaatgcacccagtaccgctggactgggctacggctcatgggagattgatcccaaggatttgaccttcttgaaagaactcggaacaggacagttcggggtggttaaatatggaaagtggagaggtcagtacgatgtggcaatcaaaatgatcaaggaaggttctatgtcggaagacgagttcatcgaagaggcaaaggttatgatgaatttgtcacatgaaaaacttgtccaactgtacggcgtttgcaccaagcagaggccaattttcatcatcaccgagtacatggccaacggctgtcttctgaactatctacgtgaaatgcgccataggtttcaaactcagcagttgctggaaatgtgcaaggacgtgtgtgaggctatggaatatcttgagagcaaacagttcctgcatcgcgaccttgccgcacgcaattgtctagtgaatgaccagggcgtggtgaaggtgtccgactttggattgtctcgatacgtgcttgacgacgaatatacctcctcagtaggatccaagttccccgtacgttggagtccaccggaggtcctgatgtacagcaagttctcaagcaaaagcgacatctgggccttcggtgttctgatgtgggagatctactctctgggcaagatgccatacgagagattcacaaactccgaaactgccgaacacatagctcagggtctgcgtctttaccgccctcatctggcctccgagaaggtgtatacaattatgtacagctgttggcacgaaaaagcagacgaacgaccaactttcaagatcctattgagcaacatcttggacgtgatggacgaagagtcttag

SEQ ID NO: 27620 - DNA, 627 bp, Artificial Sequence
  Description of Artificial Sequence: Synthetic coding sequence
gtaattagacactatgtcgtgtgcagcactccacaaagccagtactaccttgcagagaaacacctcttcagcactattcctgagctgattaattaccatcagcacaactccgccggtctgatcagtaggacccagcagctcttggaaatgtgcaaagacgtatgcgaggccatggagtatctggagagcaagcagtttctgcatagagatctagctgcacgaaactgtctggtcaatgaccagggcgtggtgaaagtgagcgatttcggtctaagcaggtacgtcttagacgacgaatacactagctccgtagggtccaagtttcctgtgagatggtcaccccctgaggtcctcatgtactccaaattcagcagcaagtccgatatctgggcctttggggtcttgatgtgggaaatctattcactgggcaagatgccgtatgaacgcttcactaacagcgaaacggcagagcacattgcccagggactgcgcctatacagacctcatctggcctctgaaaaggtctacactattatgtactcatgctggcatgagaaggccgatgaacggccaacttttaagatcctgctctcaaacatcctagacgtaatggatgaagagtcttag

SEQ ID NO: 27621 - DNA, 420 bp, Artificial Sequence
  Description of Artificial Sequence: Synthetic coding sequence
gttattcgacactacgtggtctgttccaccccacaatcccagtactacctagcagagaaacacctgttttcaacgataccggaattaattaattaccaccagcacaactcagcgggattaatctcacgactcaagtaccctgtgtcgcaacagaacaaaaatgcgcctagcactgctggcctaggctatggagtcctgatgtgggaaatttacagcctgggcaagatgccatacgaaagatttaccaatagtgaaactgccgagcacatcgcgcagggcctacggttgtaccggcctcacctcgcctctgaaaaggtctacactattatgtactcttgttggcacgaaaaagcggacgagcgccctacctttaaaattttgctcagcaacatactcgacgtgatggacgaggaatcttag

SEQ ID NO: 27622 - DNA, 705 bp, Artificial Sequence
  Description of Artificial Sequence: Synthetic coding sequence
cgccattacgtagtgtgtagcacaccccagtctcagtactatcttgctgagaaacacctgttttcaaccataccagaactaatcaactaccatcagcataacagcgccggtctgatcagtaggctgaaatatcccgtgagccagcagaacaaaaatgcaccttccaccgcgggtttggggtacggctcttgggagatcgaccccaaagacttaaccttcctgaaggaacttgggaccggccagttcggagtcgtgaagtacgggaagtggcgaggccagtatgatgtggccataaaaatgatcaaagagggaagtatgtccgaggatgagtttatcgaggaagctaaagtgatgatgtatgttctcgacgacgaatacacctcatccgtaggatctaaatttcccgtgcgatggagccccccagaggtcttgatgtactccaagttttcatccaaatcggacatttgggccttcggagtcttaatgtgggaaatctactccctcggaaaaatgccttatgagcggttcacaaacagcgagacagcagagcacatcgcgcaaggactgcgtctttaccggcctcaccttgctagcgaaaaggtgtacactatcatgtacagctgctggcacgagaaagccgacgaacggcctacatttaagatcttgctgagtaatattctggacgtcatggacgaagagtcttag

SEQ ID NO: 27623 - DNA, 225 bp, Artificial Sequence
  Description of Artificial Sequence: Synthetic coding sequence
gtgatcaggcactatgtcgtttgttccactccacagagccagtattatctggctgagaagcacctcttcagtaccatccctgaactgatcaactatcaccaacataactcagctggactcatttccaggctgaaatatccagtttcgcagcaaaacaagaacgctccctccaccgctgggttgggctatgggatgtcctggatgatgaatacacaggcccagtag

SEQ ID NO: 27624 - DNA, 1452 bp, Artificial Sequence
  Description of Artificial Sequence: Synthetic coding sequence
atggccgcagtaatcttggaatctatcttccttaaacggagtcagcagaagaaaaaaacatcccctctcaacttcaagaaaaggctgtttctcctaaccgtgcacaaactttcctactacgaatatgactttgagcggggaagacgcggaagtaagaagggctctatcgatgtagagaagataacctgcgtggaaaccgtggtgcctgagaaaaatccaccccctgagagacagattcccagaagaggggaggagagctctgaaatggaacagatctcaataatagaacggttcccctaccccttccaggtcgtgtacgacgagggacctctctatgtgttctctccaaccgaggagctgcggaagagatggatccatcagctgaagaacgtcatcagatataatagcgatctggttcaaaaatatcacccttgtttttggatcgacggccagtatctgtgctgtagccagacggctaaaaatgccatgggctgccagattctggagaatcgaaacggaagcctgaaaccgggatcaagtcatcgtaaaaccaagaagcctttgccacctacgcctgaagaggatcaaatcctgaaaaagcctctgcctccagaacctgcagccgctcccgtttccactagcgagttaaagaaagtggtcgcactgtacgattacatgcccatgaatgccaacgacttacagctccgcaaaggcgacgaatactttatactagaagaatccaatcttccttggtggcgggctagggataaaaacggacaggaaggctacattccatcaaactacgtgacggaggctgaggactcaatcgaaatgtatgaatggtactcaaaacatatgacaagatcacaggccgagcagttgttgaaacaggaggggaaggaaggtggatttatcgtgagggactcaagtaaggctgggaaatacacggtgtcagttttcgccaagtctactggcgaccctcaaggggttatcagacactacgtagtgtgctctactccacagagtcagtattacttagccgctcggaactgccttgtgaacgaccagggcgtcgtgaaggtatcagacttcggactgtcacgctacgttttagatgacgaatatacatcgtcggtggggtctaaatttcccgtgaggtggtctccacctgaggttctgatgtattctaaattctcttctaagtccgatatctgggcattcggtgtcttgatgtgggaaatttattctctgggcaagatgccctatgagcgatttaccaatagtgaaactgcggagcacattgctcaggggcttcgcctgtatcggccacaccttgcaagcgaaaaggtgtacacaatcatgtattcgtgttggcatgagaaagctgacgaaaggcctaccttcaagatcttgctgagtaatatcctcgacgttatggatgaagagagctag

SEQ ID NO: 27625 - DNA, 519 bp, Artificial Sequence
  Description of Artificial Sequence: Synthetic coding sequence
gtgatccggcattatgttgtgtgtagtaccccacagtcacagtactaccttgccgaaaagcacttgtttagcactattccagagctcatcaattaccaccagcacaattcagcgggtctgatctctcggcttaagtatcccgtttctcagcagaacaaaaatgctccctctactgccggactgggctacggctcgtgggaaatagatcccaaagacctgacatttctcaaggaactcggcaccggccagttcggtgtggttaaatatggcaagtggaggggccaatatgacgtagccatcaagatgataaaggagggatccatgagcgaggatgagtttatcgaagaggcaaaagtcatgatgaatctgagtcacgaaaagcttgttcagctctacggggtttgtaccaaacagcggccaatctttatcatcaccgagtacatggccaacggttgccttccatgtacagtggcaggaatgcgcaagcaaatgtcagtccccctaagtaagtttttctag

SEQ ID NO: 27626 - DNA, 594 bp, Artificial Sequence
  Description of Artificial Sequence: Synthetic coding sequence
gtgatcagacactacgtggtgtgctccacaccacagagccagtactatctagcagagaaacatttattctcaactattcctgaactgatcaattaccaccaacacaacagcgccggtctcatttcgaggttgaagtatcccgtgagccagcagaataagaatgcacccagcaccgcaggactgggctatggctcatgggagattgaccccaaagatttgacctttcttaaggaactcggaaccggtcaattcggagtggtcaagtacggtaaatggcgcggacaatatgacgttgccatcaaaatgatcaaagaagggtcgatgtccgaagatgaatttatagaggaagcaaaagtcatgatgaacctgtcccacgaaaagcttgtccagctttacggagtctgtacgaagcagcggccaatcttcatcatcacagaatatatggcaaatggctgtctcctcaattacctgcgggagatgaggcaccgcttccagacccagcaactgttggaaatgtgcaaagatgtatgcgaagctatggaatatcttgagagcaaacagttcctgcacagggatctagtgtgccccggatag

SEQ ID NO: 27627 - DNA, 156 bp, Artificial Sequence
  Description of Artificial Sequence: Synthetic coding sequence
attcggcactacgttgtttgttccactccgcaatcccagtattacctcgcagaaaagcatctttttagtaccataccagaactgatcaactaccaccagcacaacagtgcaggggaagacagcgccgctgcacgagatgtgcaggggtgtctgtag

SEQ ID NO: 27628 - DNA, 891 bp, Artificial Sequence
  Description of Artificial Sequence: Synthetic coding sequence
atgaagaatgagattgccgcagtcgtcttctttttcacaagattagtgcggaaacatgacaaactaaagaaggaagcagtggaaagatttgccgagaagctgacactgattttgcaggaaaaatataagaatcattggtatccagaaaaacctagcaaaggtcaggcttaccggtgtattagggtgaacaagttccagagggtggatcccgacgtgctgaaggcatgtgaaaattcttgcattctttattcagacttgggcctccctaaggagctgaccttatgggtggacccttgcgaggtgtgttgtagacgcgatggcgtgagtccatgctggcctgattgctctcagactccagacctggtcatccgtcccccttggcccccaaaggccctggactatcgcagggagcccctccggccagcatcctcttttctgataatgtatggcgagaagaataacgcttttatcgtggctagcttcgaaaataaagatgagaataaagatgagataagtcgcaaagttactagagcccttgacaaagttacgtcagattatcactctggttcctccagttcagacgaagagacttcaaaagaaatggaggtgaaaccctcaagtgtgacagccgcagcatccccagtttatcagattagcgagttgattttccctcctctaccaatgtggcatcccttgcccaggaagaagcccggaatgtaccgcggtaacgggcaccagaaccattacccccctcccgtgccttttggatacccaaaccagggcagaaaaaacaagccttacaggccaattccggtgacctgggtgcctccgccaggaatgcactgtgaccgaaaccactggatcaatccacatatgttggcaccccattag

SEQ ID NO: 27629 - DNA, 759 bp, Artificial Sequence
  Description of Artificial Sequence: Synthetic coding sequence
atgaaaaatgagatcgcagctgtagttttcttctttacaaggctggtgcggaagcatgacaaactcaaaaaggaagcagtggagagattcgcagaaaagctcaccctcattctccaagagaagtacaagaaccattggtatccagagaagccaagcaagggtcaggcatacaggtgcatccgggtcaataagttccagcgggtagatcccgatgtcctcaaagcatgtgaaaattcttgtatactctacagcgatctgggactgccgaaggagctcacactgtgggtggatccttgcgaagtgtgctgtagatacggggagaaaaacaatgcctttattgtggccagctttgagaataaggacgagaataaagacgagatctcacggaaagttacccgggcattggacaaagttacatctgactatcactctggctccagctcatcagatgaagagacaagcaaggagatggaggtcaaacctagctctgttacagccgctgctagcccagtctaccagatctctgagcttatctttccacctttgcctatgtggcaccccctgcccaggaagaagccaggaatgtaccgagggaacgggcaccagaaccattatccgcctccggtaccatttggatatccaaaccaaggcaggaagaacaagccttataggcctataccagtcacatgggtccctcctcctggcatgcattgcgaccgaaaccactggataaatccacatatgttggctccacattag

SEQ ID NO: 27630 - DNA, 141 bp, Artificial Sequence
  Description of Artificial Sequence: Synthetic coding sequence
atgaagaatgagattgctgccgtggtgtttttctttactcgcttggttaggaagcatgacaaactgaaaaaggaagctgtcgaacggtttgctgagaagttaacgctcattctccaggagaagtacaagaatcactggtag

SEQ ID NO: 27631 - DNA, 1560 bp, Artificial Sequence
  Description of Artificial Sequence: Synthetic coding sequence
atgatgtcagagcacgacctcgcggatgtggtgcagatagcagtggaggatttaagcccggaccacccagtcgtgcttgaaaatcatgtcgtgactgacgaagacgagcctgctcttaaaagacaacgactcgagatcaactgccaggatcctagcattaagacaatttgtctgcgcctcgactcaatcgaagctaagctacaggctttggaagccacctgtaagagtttggaagagaaactcgatctggtaactaataagcagcatagcccaattcaggtgcccatggtggctggctcacccctcggagctactcagacatgcaataaggtgcgctgcgtggttccgcagactacggtgattcttaacaacgataggcaaaacgcgattgtcgctaaaatggaggatccattgtctaaccgcgctcccgattccctggaaaatgtcatctccaacgcggttccgggtcggaggcagaacactatcgttgtgaaggtgccaggtcaggaagattcgcatcacgaagacggtgagtcgggcagtgaagcatccgacagcgtctcttcctgtggacaggccggaagccagagcattggatccaacgttaccctcattacactgaattctgaggaggactacccaaacggcacctggctcggcgacgagaataatcccgagatgagagtccggtgtgccattatccccagcgatatgttgcacatttctacaaattgtcgcacagctgaaaaaatggcattgaccctgctggattacctctttcacagggaggttcaggccgtgtcgaatctctcgggccagggaaagcatggcaagaagcagcttgacccgttgactatctacgggatcaggtgccacttgttttacaagtttggtatcactgagagtgactggtatagaatcaagcagtccattgattccaaatgccggaccgcttggaggagaaagcagagaggacagtcacttgctgtgaaatccttttccaggcgcacaccgaactccagctcatattgcccttcagaacctatgatgtctacaccccctcctgccagcgagcttccccagccccagcctcagccccaggccctgcactacgcactcgccaacgcgcaacaggtgcagatacatcagattggggaagacgggcaagttcaagttggacacttgcacatcgcacaggtgccccagggggaacaggtccagatcacgcaggactccgaagggaatctgcagatccaccatgtgggacaggatggtcagctgctggaggcaacaagaatcccttgtctgctggccccatccgtctttaaggcctcgtcggggcaggtgctgcagggcgcacaattgatcgccgtcgccagctcagaccctgcagccgctggcgtcgatggaagtcccctacagggcagtgacatccaggtacaatacgttcagctggccccagtttctgatcacactgcaggtgcccagacagccgaggccttacaaccgactctgcagccagagatgcagcttgagcacggagccattcagattcagtag

SEQ ID NO: 27632 - DNA, 1398 bp, Artificial Sequence
  Description of Artificial Sequence: Synthetic coding sequence
atgatgagcgagcatgatctggctgacgtggtgcagattgccgtggaggatctgagccctgaccaccctgtcgtactggaaaaccatgtcgtcaccgatgaggatgaacccgctctgaagcggcagaggctagaaattaattgccaggaccctagtatcaaaagttttctctactccatcaatcaaactatctgcctgagactggacagcatagaggcaaaactgcaagccctggaagccacctgcaaatccctcgaagagaagctggacttggtgacaaacaagcaacattctcccatccaagttccgatggttgctgggagcccccttggggcaacccaaacctgcaacgctgtgcctggaaggaggcagaacactatcgtggtaaaggtgccaggacaggaagattctcaccacgaagatggagagagtgggtccgaagcatccgatagcgtcagtagttgtgggcaggcaggctcacaaagcattggcagcaacgttacactgataactctgaactccgaggaggattatccgaatggcacttggctgggggatgaaaacaaccctgaaatgagagtgaggtgcgccataattccctcagatatgttgcacatctccacaaactgtaggacagccgaaaagatggcactgacgcttctggactatctcttccaccgggaggtacaggccgtatctaatctgtccggtcaaggcaagcatgggaaaaagcagcttgatccactgacaatctacgggatccgttgccacctattctacaagttcggtatcactgaaagcgattggtaccgaatcaagcagagcatcgatagcaagtgccggactgcatggaggcgtaaacagcgcggacagagcctggcagtgaaaagcttctctcgcaggacacctaattcatcttcgtattgccctagcgaaccgatgatgagcaccccaccccctgcttctgaattgccacagccgcagccccagccacaggcactgcactatgcccttgcaaacgcacagcaggtgcagattcaccaaatcggagaagatggacaggtgcaggtgatccctcaaggccacctccacattgctcaagtaccccagggcgagcaggtccagataacacaagacagcgagggtaacctccagatccatcatgtgggtcaggatggccaagtattgcagggagcccagcttatagcagtggcctcgtcagaccctgctgccgcaggagttgacggctctcccttgcagggttctgatattcaggtgcagtatgtccagctagccccagtctcagatcacaccgccggtgctcagacagcggaggctctgcagccaacccttcagcctgagatgcagctggagcacggagccatccaaattcagtag

SEQ ID NO: 27633 - DNA, 1410 bp, Artificial Sequence
  Description of Artificial Sequence: Synthetic coding sequence
atgatgtccgagcatgatctcgcggatgtggtgcagatcgcagtggaggatctgagccccgaccatcctgttgtgctggaaaatcatgtggtgaccgacgaggacgagcccgctctgaaacggcagagacttgagatcaattgtcaggacccatccatcaaatcttttctttattccataaatcagaccatctgtttgagactggattccattgaggcaaaactgcaggcactggaagccacctgcaagtccctagaagaaaaactggaccttgtgactaataaacaacacagccccatccaagtgcctatggttgccggatcgcctctcggggcaacccagacgtgtaacaaagtcagatgcgccgtccccggtcggcgtcaaaataccattgtggttaaggtgcccggacaggaagacagccaccacgaggacggagaaagcgggagtgaggcctcagactccgtgtccagctgcggccaagctggaagccaatccattggcagtaacgtgaccttgatcacactgaactcggaagaagattaccccaacggcacctggctcggagacgagaataaccctgagatgcgagtgcggtgtgcaatcattccctcagatatgttacacattagcactaactgtcggaccgctgagaagatggccttgaccctgctagactacctgttccaccgagaagttcaggcagtatccaacttatccggccagggtaagcacggcaaaaagcagctggaccccttgaccatctatggtattcggtgccaccttttctataaattcgggatcactgaaagtgactggtaccgaattaagcagagcattgatagcaagtgccgtaccgcgtggcgcaggaagcagagaggccagtctctggctgttaagtcattcagtcgcagaaccccaaatagtagcagctactgcccctcagaaccaatgatgtcaacaccaccacctgcatcagaattgccccagcctcagccccaaccccaggccctgcattatgctctggccaacgcacaacaggtccagattcaccagattggcgaggatggccaggttcaggttatcccccagggacacctacacatagcacaggtcccacagggtgaacaggtacagattacacaggatagcgaaggtaatttgcagatccatcatgtgggccaagacggtcaggtgcttcagggtgcccagctaatagctgttgcctcaagcgaccccgctgctgccggagtggacggatccccactccagggctcagacattcaggtgcagtacgtgcagttggctcctgtgtctgaccatactgccggagctcagaccgccgaggctcttcagcccactcttcaacctgagatgcagctggagcatggggctatccagatccagtag

SEQ ID NO: 27634 - DNA, 1494 bp, Artificial Sequence
  Description of Artificial Sequence: Synthetic coding sequence
atgatgagcgagcatgatctggctgacgtggttcaaatcgccgttgaggacttaagccccgatcatcctggcaccgagctttgggatattgttctggaaaatcacgtcgtgaccgatgaggacgaaccagccctgaaaaggcagaggctcgaaataaattgccaggatccttccatcaagagtttcctgtactcaattaaccagactatttgtctgcgcctcgacagcattgaggctaagctgcaagcactggaggcaacctgcaagtccttggaggagaagttggacttagtaactaataaacagcactccccaattcaagtgcctatggtggctggttctccactgggagcaacccagacatgcaacaaagtccgctgtgcggtgcccggtagaagacagaacactattgtggtcaaggtaccgggtcaagaggattctcatcacgaagacggcgaatcaggaagcgaggccagtgattctgtctcctcctgcggccaggctggtagccagtccatcggaagtaatgttacattaattacactgaattccgaggaggactacccgaatggcacttggcttggagacgaaaacaacccagagatgagagtgaggtgcgctatcattcccagtgatatgctgcacatctccaccaattgccgcacagcagagaaaatggccctgaccctgttggactatctgttccaccgggaggtgcaggcggtgtcgaacctgagcggccaggggaaacatggtaagaagcaattagaccccctgacaatttatggcatacggtgtcacttgttttacaaatttggcatcactgagtcagactggtaccgcatcaaacagtcaattgatagcaaatgccggacagcctggaggcgtaagcagcggggtcagtctcttgctgtgaaaagtttttcccgcaggacccctaacagctcctcatattgccctagcgaaccaatgatgtctacgcctccgcctgcctcagagttaccacagcctcagcctcaaccacaggctttacactacgctttggctaatgcacagcaagtgcagattcatcagatcggtgaagacggacaagtgcaggtgattccccagggtcacctccacattgcccaggttccccagggcgaacaggtgcagatcacccaggacagcgaaggcaacctgcagattcaccacgtgggacaagacggccagcttctcgaagcaacacggattccctgcctcctagctccctcagtgttcaaagctagttccggtcaggtattacagggtgctcagctcatcgccgtagcctcttctgatcctgcagcagccggtgtcgatggttcgcccctacagggcagcgacatccaggtccagtatgttcagctggcccctgtaagcgatcacactgcaggcgctcagactgccgaggctctgcagcctactctgcagcctgagatgcagcttgagcatggtgccatccagatccaatag

SEQ ID NO: 27635 - DNA, 1560 bp, Artificial Sequence
  Description of Artificial Sequence: Synthetic coding sequence
atgatgagcgaacatgatcttgctgacgtggtgcagatcgctgtggaggatctgtcaccagaccatcctgtggtcttggagaaccacgtggtgaccgatgaagacgagccggctttgaaacgccaaaggttggaaatcaattgccaggatccttctatcaagacgatttgtttgagactcgacagtattgaggctaagctacaagcactcgaagcaacctgtaagagccttgaagaaaaactggatttggtgaccaacaagcagcacagccccattcaggtgccaatggttgctggcagtcccctgggagctacccagacctgtaataaagtccggtgtgtggtgccgcagaccactgttatactcaacaatgatcgccagaatgccattgtggccaaaatggaagaccccctctcaaatcgagcccctgattcactcgagaatgtaatttccaacgcggtcccgggtaggcggcagaacaccatcgtagttaaagtgccagggcaagaggactcccatcacgaggacggggaaagcggctccgaggcttcggattctgtgagcagctgcggacaggcgggatcacaaagcatcggttccaatgtgacgctgattactctgaattccgaagaggattatcccaatggtacctggttgggagacgaaaataaccctgaaatgagagtacgatgtgccataatcccctccgatatgttgcacatttccaccaactgccgcaccgctgagaaaatggctctcactctcctcgactatctcttccatcgcgaggtgcaagcagtgtctaatctgtctggtcagggcaaacacggaaagaagcagctggatccacttactatttatggcattagatgtcacctgttttacaagtttggaatcacagagagcgactggtacagaattaaacaaagcatcgatagcaagtgcagaactgcctggagaagaaaacagagagggcagtccctggcggtgaagtcattcagtcggagaacacccaattcatcatcctattgtccctcggaacctatgatgagcacccctccaccagcttctgaattgccacagccacagccccaaccccaagctctgcattacgccttggcaaacgcccaacaggtccagattcaccagatcggagaggacggtcaagtgcaggtgggccacttacacattgcccaagtgccgcagggcgagcaggtacagattacacaggactccgagggtaacctacaaattcaccatgtgggccaggatgggcagctgttggaagccactcgaattccatgtctgcttgctccgtctgtgtttaaggcctccagcgggcaggtcttgcagggcgctcagctgatcgctgtggccagcagtgacccagctgctgcaggagttgacggctcaccccttcagggatcagatattcaggttcagtacgtgcagctagccccagtgtcagaccacaccgcaggagcccaaactgctgaggccctccagccaacgttgcagcctgagatgcagttggagcacggggcaatacaaatacaatag

SEQ ID NO: 27636 - DNA, 1476 bp, Artificial Sequence
  Description of Artificial Sequence: Synthetic coding sequence
atgatgagcgagcacgacctggctgatgtagttcaaattgcagtggaagacctgagccccgatcatccagtcgttctggagaaccatgttgtcaccgacgaagacgagccagcacttaagagacagcggctggaaataaattgtcaggatccatctataaaaagctttctatattccatcaaccagactatttgcctgagattagatagcattgaggccaagcttcaggcattggaagcgacgtgtaaatcgctcgaagaaaaattagacctagtgaccaacaaacagcattcacccatccaggtgccaatggtggctggcagtcctctgggggcaacgcagacctgtaataaggtgcgatgtgctgtccctggcaggcggcagaataccatagtggtaaaagtgcctggtcaggaagattcccaccacgaagacggggaatctggcagtgaagctagcgattcggtctcttcctgtggacaggcagggagtcaatcaattgggtccaacgtgacactgatcactctgaactcagaagaagactatcctaatggaacatggctgggggacgaaaacaatcctgagatgagagtgcggtgtgcaataattccctcagatatgctgcacatcagcacaaattgtaggaccgctgagaaaatggctctcactctcttggactacctctttcatcgagaagtgcaagccgtctccaacctctctggccagggcaaacacgggaagaagcagctggatcccctgacaatttatggtattcggtgtcatctgttctataagtttgggataaccgagagcgattggtacagaatcaagcaaagcatcgattccaagtgtcgcacagcctggcgccgaaagcagagaggccagtcactggccgttaaatccttttctaggaggacccctaactcttctagctactgcccatcggagccaatgatgtccacaccacctccagcgtctgagttgcctcagccgcagccgcagcctcaggcgctccattacgcactggcgaacgcgcagcaggtgcagatccaccagataggtgaggatgggcaagtgcaagtcataccacagggacacctgcatatcgctcaggtgcctcaaggagaacaagtgcagatcacacaggactctgagggcaacctgcagatccaccatgtgggtcaggatggtcaactactcgaagcaacacgcattccatgcctccttgcacccagcgtgtttaaggctagcagtggacaggtactgcaaggtgctcagctgatcgccgtggcaagctcagacccggctgccgctggtgtggatggcagccccctccagggctccgatatccaagtgcagtatgttcaactcgcacccgtgtctgaccacacagccggagcacagactgccgaggcgctgcagcccacccttcaacctgaaatgcagctggaacacggggctatccaaatccaatag

SEQ ID NO: 27637 - DNA, 357 bp, Artificial Sequence
  Description of Artificial Sequence: Synthetic coding sequence
atgatgagtgaacacgatctcgctgatgtagttcagattgccgtggaggacctatctcctgatcatccagtggttcttgagaatcacgtggtcaccgacgaggatgaacccgcattgaagcggcagagattagaaattaattgtcaggatcccagtataaagtcttttctgtacagtattaaccaaactatctgccttcggctggactccattgaggccaaactccaggctcttgaagccacttgcaaatccctggaggagaaattggatctggtcaccaacaagcaacattcccctattcaggtgcctatggtggcgggtagccctctaggcgcaacgcagacctgtaataagtag

SEQ ID NO: 27638 - DNA, 87 bp, Artificial Sequence
  Description of Artificial Sequence: Synthetic coding sequence
atgatgagtgaacacgatctcgcagatgtggtgcaaatcgctgtggaggacctgagtcctgatcatcccgtggtactggagaactag

SEQ ID NO: 27639 - DNA, 288 bp, Artificial Sequence
  Description of Artificial Sequence: Synthetic coding sequence
atgatgagtgagcatgacctagcagatgtggtgcagatcgccgtcgaggacctgtcacccgaccaccctgtggtgttagaaaaccatgttgttactgatgaggatgaacccgctctgaaacgccagcgtctcgagataaactgtcaggacccatccataaaaagctttctctactcaatcaatcaaacgatctgtcttcgccttgactctatagaggctaaactccaggctttggaggccacgtgtaaatccttggaagaaaagctggacttagtaacaaataagtag

SEQ ID NO: 27640 - DNA, 372 bp, Artificial Sequence
  Description of Artificial Sequence: Synthetic coding sequence
atgatgtctgagcacgatctcgccgacgtcgtccaaatcgccgtggaggacttgtccccagaccaccccgtggtgctggagaaccacgtcgtaactgacgaggatgaacccgcattaaagagacagagattggagataaattgccaggatccctctatcaaatcatttttatacagcataaaccagactatttgcttacgtttagacagcattgaggcaaagctgcaagccctggaggcaacatgcaaatcgctggaagagaagctggaccttgtgacaaataagcagcacagtccaattcaagtgccgatggtggccggaagccccctcggagcaacccagacctgcaataaagttcgctgcgtggtctag

SEQ ID NO: 27641 - DNA, 588 bp, Artificial Sequence
  Description of Artificial Sequence: Synthetic coding sequence
atgatgagcgagcatgatcttgccgacgtggtccaaatagcagtggaagatctgtcgcccgaccacccgggaactgaactttgggatatcgttttggagaaccacgtggtaactgatgaggacgagcccgctctaaaacgccagcggctcgagattaactgtcaggatcccagcataaaatcatttctgtacagcatcaatcagacaatctgtctcaggttggattccatcgaagccaagctgcaggcactcgaagccacctgtaagtccctggaagaaaaattggaccttgtgaccaacaaacagcacagcccaatacaggtgccaatggtggctggcagcccccttggagccactcagacatgtaataaagtgcgatgcgctgttccgggtcgaaggcagaacactattgtggtaaaggtccctggacaggaagacagccatcatgaggatggagagtccggatctgaggcctctgactctgtttcttcttgcgggcaggcagggtcacagtctatcggtagcaacgtcacgttgatcacccttaacagtgaagaggactaccccaacggtacttggttaggatag

SEQ ID NO: 27642 - DNA, 360 bp, Artificial Sequence
  Description of Artificial Sequence: Synthetic coding sequence
atgatgtccgagcatgatctggcggatgttgtacagatcgctgtggaagacctcagccccgatcatcccgtggtcctggaaaaccacgttgtgaccgacgaggacgagcccgcactgaagcgacaacgccttgagatcaactgtcaggaccccagtattaagtccttcttatacagcataaaccaaacgatttgcctgaggctcgattccattgaggctaagctccaggctctcgaggcaacatgtaagagtctggaggaaaaactggatcttgttactaacaagcagcactcgcccatacaggtgcctatggtagcagggagcccccttggggctacacagacatgtaataaagtctag

SEQ ID NO: 27643 - DNA, 1401 bp, Artificial Sequence
  Description of Artificial Sequence: Synthetic coding sequence
atgatgtctgaacacgaccttgcagacgtagtccagatcgctgtcgaggacctcagccccgaccatcctgtggtgctggaaaatcacgtggtgaccgacgaggatgagcccgctctaaaaaggcagcgactagaaataaattgtcaggatccaagcatcaaaagctttctgtactccatcaaccagaccatctgcctccggttggattcaatagaggctaaactgcaagccttggaagcaacttgtaagtccctggaggaaaaactagatcttgttactaacaaacagcactcgcccatacaggtgccaatggttgctggttctcctctgggggcaactcagacctgcaataaggtcaggtgtgccgtgcccggacggaggcagaacactattgtggtcaaagttcccggtcaggaggacagtcaccacgaggacggcgaatctgggagcgaggcatccgattcagtgtcatcctgcggtcaggccggtagtcagtcgattgggtccaatgttactttgatcacattgaacagcgaggaagactatcccaatggcacttggctgggtgatgagaataaccctgaaatgcgggtacgatgcgcaattatacccagtgacatgctgcatatatctacgaactgccgtactgctgagaagatggcgctgacactgctggactacttattccacagggaggtacaggcagtgagtaatttgagcggtcagggcaaacacgggaaaaaacagctcgaccccctgaccatttacggcatccgatgccacctgttttataagtttgggattaccgagtccgattggtatcgcattaagcagtcgatagacagcaaatgccgcactgcgtggcggaggaagcagcgtggacagagcctggccgtcaagtcattctctcggcgaacgccgaatagttcttcctactgtccctcagagccgatgatgagcacgccaccacctgcctcggagctgccacagccccagccgcagccacaggccctgcattacgctttggctaacgcgcagcaagttcaaattcatcagatcggcgaagatgggcaggtgcaggttggacacctgcatattgcacaagtgccacagggagagcaggtgcagattactcaggattcggagggaaacctgcagatccaccacgttgggcaggacggtcaggtccttcagggcgcacagctcatcgcagtggcatccagcgacccggcagctgccggagtggacggatccccattgcagggatccgacattcaggtccaatacgtgcagctcgccccagtatccgaccatactgccggtgcccaaacagccgaagcactgcaacctaccttacagccagaaatgcagttagaacacggtgctattcaaatccagtag

SEQ ID NO: 27644 - DNA, 753 bp, Artificial Sequence
  Description of Artificial Sequence: Synthetic coding sequence
atgggctcccctgaacccacgcagggccctcgtctgtctcctatcctgatcccttattccgggagaagatacaaagtgggcagagcaagcggcgctctgtgccaccaggacagtctgccgccaatccttgaattgggtcttactttcctgagagcctctgcagggttcagcgtcccaacctcttcatcgttcgcactgcccgaaccgctgaggagcctctgcctggggaacggcgagggactagggctcagtttaacactgaccgttctcgcctggatattaggactaagtggtaccttaggcgctcttgttctatttatggtcgccacaggaatttttcaggaagctctgtggcacctacttctgctttcctttagcgttgaggccctgccctgtttcttttttttcccatttttcctcctatgtcgttgtctgcgcgcagagctacagatacagcagcgactggatggcaccctgtcattggacctaatgagactggagtcggacggcgaaaccggttgcgccgcagagagctctgtgttgcagggtgcccagctcattgccgtcgcatcttccgatccagccgcagccggagtggacggaagccctctgcaggggtcagacatacaggttcaatatgtgcaacttgcgcctgttagcgaccatacggcaggagcacaaaccgccgaagccttgcagccgacacttcagccagaaatgcagttggaacatggagcgatccaaatacaatag

SEQ ID NO: 27645 - DNA, 1527 bp, Artificial Sequence
  Description of Artificial Sequence: Synthetic coding sequence
atgatgtccgaacatgatctggcagacgtggtccagatcgcagtggaggacctatctccagaccacccagtggtgttagaaaaccatgttgtgactgacgaagacgagcccgctctgaagcgacagcggctagagataaactgtcaggatccaagtattaaaagtttcctgtatagcatcaatcagactatctgcttaaggctggatagcatcgaggctaagctccaggctctggaggccacctgcaagtccctggaggagaaactcgacctcgtcacgaacaaacagcacagccccatccaggttccgatggtcgcgggatccccactgggcgctacccagacttgtaataaagtgcgctgtgtcgtccctcagaccaccgtcatcctgaacaatgaccgtcagaatgctatcgttgcgaagatggaggacccgctgtcaaatagggctccggattctctcgagaacgtcatttctaacgccgttccgggaagacggcagaacaccatagtcgtgaaagtgcccggtcaggaggactctcatcacgaagacggtgagtcagggtcagaagcaagcgacagcgtgtcgtcttgtggtcaagcaggatcccagagcatcggatccaatgttactcttatcactctcaatagcgaggaggactatccaaatggcacgtggttaggcgacgagaacaaccctgaaatgagagtccggtgcgcaatcattcctagcgacatgcttcacatttcaacgaactgccggaccgcagagaaaatggccctcacgttgttggactatctgttccacagggaggtgcaagctgtaagcaacctgtcagggcaggggaagcatggaaaaaagcagttggatccgctgaccatatatgggatcaggtgtcatctgttttataagttcggtatcacagagagcgactggtaccgcatcaagcagtctattgactcaaaatgcaggacagcctggcgcagaaaacagaggggtcagtcgctggcagtcaagagcttcagccggaggacccccaattccagtagttactgcccgtctgagcccatgatgagcacacccccaccagcctccgagctgccacagcctcagcctcaaccccaggcactacattatgccctcgctaatgctcagcaggtgcagattcaccagattggagaggatgggcaagttcaagttatcccccaggggcacctccatatcgctcaggtgccacagggggaacaggtccagattacccaggacagtgaaggtaatctccaaatacatcatgtcgggcaggacggccaagtgctccagggagctcagctgattgcagtggcgtccagcgatcccgcagccgcaggagtcgatggctcacctttgcagggcagcgacattcaagttcagtacgtgcaactggccccagtgtctgatcatacagccggagcccagactgccgaagccctgcagccaaccctgcagcctgagatgcaactcgaacacggggcaatccagattcagtag

SEQ ID NO: 27646 - DNA, 1476 bp, Artificial Sequence
  Description of Artificial Sequence: Synthetic coding sequence
atgatgtcggagcatgacctggcagacgttgttcaaatcgcggtggaggatctgtcaccagatcacccagtggttctcgagaatcacgtagtcacagatgaggacgagccagcgctaaagcggcaacgcttggaaattaattgccaagacccctccataaagagctttctatactctatcaatcagaccatctgcctccgccttgactctattgaagccaagcttcaggctctagaggccacgtgtaaaagtctggaagagaaactggacttagtgaccaacaagcagcatagtcccattcaggtccccatggtggcaggaagcccactcggagccacgcagacctgcaataaggtaaggtgtgctgttccaggtcgacgtcagaacacgatagtggtcaaagttcccggtcaggaggactctcatcatgaggacggcgagagtggatctgaggcttccgactcagtctccagctgcggacaggcaggttcccagagtatcggaagtaatgtgacactcattacgctgaactcagaggaggactatccaaatggcacctggctgggagatgagaacaaccctgaaatgcgcgtcagatgcgctattattccttcagacatgctccatattagcacaaactgtcgcacagccgagaagatggctttgactctgctggattaccttttccaccgtgaagtgcaggctgttagtaatctgtcaggccagggcaagcacggcaagaagcagcttgatcccctgaccatctatggcatcaggtgtcacctcttctacaaattcggcatcaccgaatccgattggtataggatcaagcaatcaatcgactccaagtgcaggactgcgtggcggagaaagcaacggggacagagcctggctgttaaaagcttttcaagacgcactcctaacagtagcagttactgcccatcagagcctatgatgtctacacctccccctgcctccgaattgccccaaccccagcctcagcctcaagcccttcattatgcactggccaacgcccagcaggtgcagatccatcaaattggcgaggacggccaggtccaagtgatcccccagggccacttgcatattgcgcaggtgccccagggcgaacaggttcagatcacccaggactctgaaggtaacttacaaatacatcacgtggggcaagacggtcagctgttggaggcgacgcgcattccgtgcctattggctcccagtgtttttaaggcttctagtggacaggtgttacaaggcgctcagctcatcgccgtggcgtcatccgacccagccgctgctggcgtggatgggtcacccctccagggctcagatatccaggtccaatacgtccagctcgcccctgtgagtgaccacactgcaggggctcagacggcagaggctctacagccaaccctgcagcctgaaatgcagcttgagcatggagccatacaaatacaatag

SEQ ID NO: 27647 - DNA, 3153 bp, Artificial Sequence
  Description of Artificial Sequence: Synthetic coding sequence
atggctgccgtcaagaaggaggggggagccttatctgaggcaatgtcgcttgagggtgacgagtgggagctttccaaagagaacgtgcagccccttcgccagggtagaatcatgtccactctgcagggggcactggctcaggaatctgcttgcaataacaccctgcaacagcagaagcgcgcttttgaatatgagatccggttttacacaggcaatgaccctttggatgtatgggacagatatatttcttggactgagcagaactacccccaaggtggtaaagagagcaacatgtcaacacttctggaacgagctgttgaggctctgcagggggagaaacggtattactccgaccctcgttttcttaacctgtggcttaagctcggacgtctgtgtaatgagccccttgatatgtatagctacctgcacaaccaggggattggcgtttccctcgcccagttctacatttcatgggctgaagagtacgaggctcgtgagaacttccgtaaagcagatgccatatttcaggagggtatccagcagaaggctgaaccgctggagcgcttgcaaagccagcatagacagttccaggccagggtcagtcggcagactttgctggccctcgaaaaggaggaagaggaagaagtatttgaatccagcgttccacaacgctccacactagccgagttgaagtctaaaggtaagaagaccgccagagccccaatcatccgtgtcggaggcgctctcaaggcccctagccagaacagaggcctgcagaacccctttccccaacagatgcaaaacaattccaggattacggtgtttgacgagaatgccgacgaagctagcaccgccgagttatctaaaccaacggttcagccatggatcgcccctccaatgccccgagcgaaagagaatgaactgcaagccggaccatggaacacaggtcggtctctagaacaccgaccgcgagggaataccgcatctctcattgctgtcccagcagtgttaccatctttcacgccctacgtcgaagaaaccgcacggcaacctgtgatgactccttgtaagatagaaccaagtatcaatcacatcctctctacacgtaagccagggaaggaggaaggtgatcccctgcagcgggtgcagagccatcaacaggccagcgaggagaaaaaggaaaagatgatgtactgtaaagagaagatctatgcgggagtcggcgagttctcttttgaagaaatccgggctgaggtgttccgtaagaagctgaaggagcaacgagaggccgagctgcttacatcagctgagaagcgggctgagatgcagaagcagattgaagagatggagaagaagttgaaggagattcagaccactcagcaggagcggacaggcgaccaacaagaggagacaatgccaactaaagagacaactaaactccagattgcgagcgagagccaaaaaattcccggaatgactctgtcaagctctgtgtgccaggtaaactgttgtgcccgagagacatccctggccgaaaacatctggcaggaacagcctcactctaagggccctagcgtgccatttagcatcttcgacgaattcctcctgagcgaaaagaaaaataagagcccacctgcagatccaccgagggtgttggcccagaggaggcccctggctgtgctgaaaacatcggagtccatcacctccaacgaggatgtgtcccctgacgtgtgcgacgaatttacagggatcgaacccctctccgaagatgctataattactggcttccgtaatgtgactatatgtcccaatccagaggacacatgtgattttgctagagcggctaggttcgttagcacaccctttcacgaaatcatgtccctcaaagacctgccttcagaccctgagcgcctcctgccagaggaagatttagacgtgaaaacatccgaagatcagcaaaccgcatgcgggactatctactcccagacccttagtatcaaaaagctgtccccaattattgaggactccagggaagccactcatagcagtggcttctccggatcctctgccagcgtcgccagtacaagctctataaagtgtctgcaaatccccgaaaagctcgaactgactaacgaaaccagcgaaaatcccacccaatccccatggtgcagccagtacaggaggcagctgctgaagagcttaccagagctatcagctagtgcagaactgtgcatagaagacaggccaatgcctaagctggaaattgaaaaagaaattgagctcggcaacgaggactattgcatcaagcgtgagtacttaatttgcgaagactacaaactgttttgggtagcccctagaaacagcgcggagttaaccgtgatcaaggtgtcgtctcagcctgttccctgggacttctatatcaacctcaaacttaaggaacgtcttaatgaagattttgatcacttctgttcatgttaccaataccaggacggttgcatcgtctggcatcagtatatcaactgttttaccctccaggatctgctgcagcatagtgagtacatcactcacgaaatcacagtgctcatcatttacaacctcctcacaattgtcgagatgttacacaaagcggagatcgtccacggggacctgagtcccaggtgcctgattcttcggaatcgtatacatgatccttatgattgtaacaaaaataaccaagccttgaaaattgttgacttttcatactccgttgatctgagagtccagcttgacgtgttcactctttcggggtttaggaccgttcagatcctcgagggacaaaagattctcgcgaactgtagctcaccttatcaggtagatctttttggaatagccgatctggcacacttgctgctctttaaagagcacctgcaggtgttttgggacggctcattctggaagctgagtcagaatatttcagaactaaaggacggagagctttggaataaattcttcgtcaggatcctgaatgccaacgacgaagccacggtttccgtgctgggggagttagctgctgagatgaatggcgtgttcgatactaccttccagagccatcttaataaggctctttggaaagtgggaaagctaacctcccctggagccctgctctttcagtag

SEQ ID NO: 27648 - DNA, 3195 bp, Artificial Sequence
  Description of Artificial Sequence: Synthetic coding sequence
atggccgcagtcaagaaagagggcggagctctctcagaggctatgagccttgagggagacgagtgggaactgtctaaggagaacgtacagccactgaggcaggggcgaatcatgagtacattgcagggcgcactcgcccaggagagtgcctgtaacaataccctgcagcagcagaagcgcgcatttgaatatgagatccggttctacaccggaaatgatcccctcgatgtctgggacaggtgggtcttcctgtttcataaagataaccgtaacatcaatcgatatatcagctggaccgaacaaaattaccctcagggtgggaaagagagtaatatgtctacactgttagagcgggcagtcgaagccctacaaggggagaagagatactattcagatccgaggttcctaaatctgtggctgaaacttggccgtttgtgcaacgagccactagatatgtactcctacctgcacaaccaaggaataggggtgtcactcgcacagttctacatttcttgggcagaagaatacgaagccagggagaatttcagaaaggccgacgccatattccaggaaggaatacagcagaaagctgaaccgctggagcgcttgcagtcccagcaccgtcagttccaagccagggtgtctagacagacgctgttagccctggagaaagaggaggaagaggaagtgttcgagagtagtgtgcctcaaaggagcactctggctgagcttaaaagcaagggaaagaagacagctcgtgcacccatcattcgggtggggggagctttaaaggcgccatcccagaaccgcggacttcaaaatccttttccccaacaaatgcagaataacagtcgtattacggttttcgatgagaacgccgacgaagctagcacggctgagctgtcaaagccaacggttcagccatggatcgcaccacctatgcctagagctaaggaaaatgagctgcaagcaggcccttggaacacaggtaggtccctagaacatagaccacggggaaacactgctagcttgattgcggtgccagccgtgctgccaagctttacaccatatgtggaagaaactgcaagacaacctgtgatgacaccgtgtaaaatcgagccctcgattaatcacatattaagcacccgaaaacccggaaaggaggaaggggaccccctgcagagagtgcagagtcaccaacaggcctctgaggagaagaaagaaaaaatgatgtactgcaaagagaagatttacgcaggcgtcggggaattctcgtttgaggagatacgggcagaagtgtttcggaagaagcttaaagagcagcgggaagctgagcttcttacctctgccgagaagagggcggagatgcaaaagcagatcgaggagatggagaagaaactaaaagagattcagaccacccagcaagagcgtactggcgaccagcaagaggaaacaatgccaactaaggaaaccacaaaattacagatcgcttctgaaagccaaaagattccaggcatgactctgagcagctcagtttgtcaggttaactgctgtgccagagagactagcctggccgaaaatatctggcaggagcagccccattccaaaggaccttcagttcccttttcaatttttgatgaattcttgttatcagagaaaaaaaacaaaagccctcccgcagaccctccgagagttttggcacaacgacgccctctagcggttctgaagaccagcgagagcattactagtaatgaggacgtgagtcctgatgtttgtgacgaattcaccggtatagagcctttgagtgaagatgctattattaccgggttcaggaatgtgacaatttgcccgaaccctgaggacacgtgtgacttcgctagggccgcaaggtttgtgtctacaccattccacgagatcatgtccctcaaggaccttcctagcgatcctgagcggctgttacccgaggaagatcttgacgtcaaaacgagtgaggatcagcagacggcctgcggcacaatttattcacaaacgttgagcattaaaaagctctccccaattatcgaggacagccgggaggccacccactccagtggcttctccgggagttcggccagcgtagcaagtacctcctccataaagtgtttgcagattcccgagaaattagagttaacaaacgaaacctccgagaatcccacccagtcaccatggtgctcccaatacaggcggcaattgttgaagtctcttccagagctgtccgcaagtgccgagctgtgcattgaagaccgtcccatgcctaaactggagatcgaaaaggagatagaactgggtaatgaggactactgtattaaacgggagtacctgatctgcgaggattacaaactcttttgggtggctccaagaaatagcgccgaactgacagtgatcaaagtgagttcacagcctgtcccctgggacttttacatcaatctgaagctcaaggaacgattgaatgaagattttgaccacttttgtagttgctaccaataccaagacgggtgtatcgtgtggcatcagtatattaactgtttcactcttcaggacctcctccagcactccgagtatattactcatgagattacagtgctcattatctacaacttgctgaccattgttgaaatgttacataaggcggaaattgtgcatggcgacctgtcgccgagatgcctaatactacggaataggatacacgacccttatgattgtaacaagaacaaccaggcactcaaaattgttgattttagttattctgtggatctgcgtgtgcagctggatgtgttcacgctgtccgggttccggacagtccagatcctggaaggtcaaaaaattttggctaactgttcgagtccctaccaggttgacttattcggcattgcagacctcgctcacttactgctgtttaaggaacatcttcaggtgttctgggatggcagcttttggaagctgtctcaaaacatcagtgaactcaaggacggggaactgtggaacaagttcttcgtgaggatcctgaatgctaatgatgaagctacagtgtcagttctcggggagttagccgctgagatgaacggagtgttcgacaccaccttccagtcacatctaaataaagccctctggaaggtgggcaagctcacgtctcccggtgcgttgctgtttcaatag

SEQ ID NO: 27649 - DNA, 2802 bp, Artificial Sequence
  Description of Artificial Sequence: Synthetic coding sequence
atggctgcggtcaaaaaggagggtggggcattatctgaagctatgtcattagagggggatgagtgggagctgtccaaagagaacgtgcaaccattacggcaggggagaatcatgtctactctccagggggctctggcccaggaatctgcatgcaataatacgcttcagcagcagaagcgagcattcgaatacgagataagattctatacaggcaacgatcctctggacgtctgggaccgctatatatcatggaccgagcagaactacccacagggcggtaaagagagtaacatgtcaacgcttctagagagagctgtcgaagcccttcaaggggaaaatttttggaaggcggatgcaatcttccaggaaggcatccagcagaaggccgaacctttggagagactgcagagccagcatagacagtttcaggcgcgagtgagtagacaaaccctcctggctttggaaaaagaggaagaggaggaagtttttgagtctagcgtgccccagagaagcactttggccgaactgaaatcgaaaggtaaaaagaccgcacgcgctcccatcatcagggttggcggtgcgttgaaggccccttcccagaaccggggtctgcagaacccatttccccaacagatgcagaataattcaaggatcaccgtcttcgacgaaaacgctgacgaggcctccaccgccgagctgtctaaacccaccgtgcagccttggatagcgcctcccatgccacgagctaaagagaacgaactgcaggctgggccatggaataccgggaggtcattggagcacagacctagaggaaataccgcctcactgattgccgtacctgccgtgttgccctcatttactccttatgtcgaagaaacggctaggcagccggtcatgaccccctgtaagattgagccctcgataaaccacatcctctcaactaggaagcctggaaaggaggagggcgacccactgcagcgggtccaatcccaccagcaagcgagcgaggagaagaaagaaaagatgatgtactgcaaagagaaaatctatgctggagtcggagagttctcattcgaggaaatccgtgctgaggtttttagaaagaaactgaaagagcaacgggaggcagagcttctgaccagcgcggaaaagcgtgctgagatgcagaagcagatcgaagaaatggagaagaagctgaaagaaatacagaccacacagcaggaaaggactggagatcaacaagaagaaacaatgcctaccaaagagacaaccaagttgcagatcgcttccgagtcgcagaaaatcccaggcatgaccttgtccagctcagtgtgccaggtcaattgctgtgccagagaaacgagcctggcagaaaacatctggcaggagcagcctcattctaaggtgtccctctctctcggcccaagtgtgcctttctctattttcgacgaatttctcttatctgagaaaaagaataaatcaccacccgcagaccccccaagggtcctggcccagaggaggcctcttgctgtactgaaaacctccgagtcaatcacttccaacgaggacgtatccccagatgtctgtgatgaattcaccggtatagagccgctgagcgaggacgctattattactggctttagaaatgtgacaatatgccctaatcctgaggacacacgggaagcaactcactcaagtgggttttccggttcttcagcctctgttgcctccacctcctcgattaagtgtctccagatcccagaaaaattggaactgacaaacgagaccagcgagaatcccacacaatctccctggtgcagccaataccgccgacagttactcaagagtttgccagaactgtcagcatctgctgaactgtgcattgaggacaggccaatgccgaagctcgagattgaaaaagagatcgaactgggcaatgaagactactgtattaagcgagaataccttatctgcgaggactacaagctgttctgggtcgcgccacgtaacagcgccgaactgacggtcattaaagtgagcagccaacctgtgccttgggacttttatatcaacctaaagttaaaggaaaggcttaacgaggactttgatcatttctgctcgtgttaccagtaccaggacggctgtatagtgtggcatcaatatataaattgtttcacgctccaggatctactgcagcattctgaatacataacgcatgagatcacagttcttattatctataacctgctgacaattgttgaaatgctacacaaggctgagatcgtgcacggagacctctctccaaggtgtttgatccttcgaaataggattcatgacccgtatgattgcaacaagaataatcaggcccttaaaatcgtggatttcagctattcggttgatctgagggttcagttagacgtatttactctcagcggctttaggacagtacagatactcgagggccaaaaaattttagccaattgttcctccccctatcaggtggatctgttcggcatcgccgacctggcccacttgttgctgttcaaagagcatctccaggtcttctgggatggaagcttctggaagctctcccagaacatttcagaactcaaggacggagagttatggaataagttctttgttcggatcttgaatgcgaatgacgaagccaccgtcagcgtgctgggggaactcgcggctgagatgaatggtgtctttgacacgacgttccaatcacacttgaacaaggccttgtggaaggtcggaaaattgacaagcccgggagcccttctgtttcagtag

SEQ ID NO: 27650 - DNA, 3393 bp, Artificial Sequence
  Description of Artificial Sequence: Synthetic coding sequence
atgctggaaatttgtctgaaactggttggatgcaagtcgaaaaaaggtctgagctcttcgagtagctgctacctggaggaagccctacaaagaccagtggcgagcgactttgagccacagggccttagtgaagctgcgaggtggaacagtaaagagaatctgctggccggtccgagcgagaacgatcctaacctttttgtggctctgtacgactttgtagcatctggagacaacacactgtccattacaaaaggcgaaaagttgagggtccttggatacaatcacaatggagagtggtgcgaggcacagaccaagaatggtcaagggtgggtcccctcaaattacattacgccagtgaacagcttggagaagcactcatggtatcatggacctgtctcgagaaatgctgctgaataccttctgtccagtggtattaacggtagttttctggtacgggagtcagaaagtagcccagggcagaggtccatctctctgaggtatgaaggacgtgtttatcattaccggatcaacacagcttccgacggcaagctgtacgtctcttctgagtcccgctttaacaccctggctgagctggtgcaccatcactctactgtggcggatggcctcatcactactttacattatcccgctcccaagcggaataagcccactgtgtacggagtgtccccgaactacgacaaatgggagatggagaggacagatattacgatgaaacacaaactcggagggggacaatacggggaggtatatgagggggtgtggaagaaatatagtcttactgtcgccgtcaagaccctgaaggaggacacaatggaggtcgaggagttcttgaaagaggcagcggttatgaaagaaattaagcatcccaacttggttcagctactgggcgtgtgtacacgagagcccccattttacatcatcaccgaatttatgacatacggaaacctcctggactatttgcgagaatgtaatcggcaagaggttaacgctgtcgtgcttctgtacatggctacacaaatctcaagcgctatggagtatctcgagaaaaagaacttcatacacagggacctggccgctcgtaattgcctcgttggcgaaaaccatttagtgaaagttgctgactttggactgagtagactgatgacaggcgatacgtacactgcacacgccggtgctaagttccctataaaatggaccgccccagaatctctggcatacaacaaattttccataaaatccgacgtgtgggcttttggagtgcttctatgggagatcgccacctatggcatgagcccatatccaggcatagatctgagtcaggtatatgagttgctagagaaggactaccgcatggaacgtcctgagggatgccccgaaaaagtctacgagcttatgcgcgcatgctggcaatggaacccttctgataggccctctttcgctgaaattcaccaggcattcgagactatgtttcaggagtccagcatcagtgatgaagtcgagaaagagttaggaaaacagggggtcagaggagctgtgtccactctgctgcaggctcccgagctccctacgaaaacccggactagccggcgagctgctgagcaccgcgatacgactgatgttccagaaatgccgcattctaaggggcagggtgaaagcgatccacttgaccatgaaccggctgttagccctctgctccctagaaaggagaggggccctccggagggcggactgaatgaggatgagcgactactgcccaaggacaagaaaacaaacttgtttagcgcactcattaagaaaaagaagaaaacagcacccactcctcccaagcgtagctcaagctttcgggagatggatggccaaccagagaggagaggcgctggagaagaggaagggagggacataagtaacggcgctctcgctttcacccctcttgatacggctgaccctgccaagagtcccaaaccctctaacggtgccggagtgcccaacggtgcgttaagggagtcaggaggttctggctttcggtctccccacctctggaagaaatcgagcactttgacgtccagccgcctcgctaccggcgaagaggaaggaggcggttcctcttccaagcggttcttgcgcagctgttcagctagctgcgtgccccatggcgctaaagataccgagtggcgtagtgtcaccctgcctcgggaccttcagtcaacaggcagacagttcgactccagcacatttggaggacataagtcggagaagccagctctccccaggaagagggcaggtgaaaatcggtccgaccaagtgactaggggaacagtcacacccccacccagattggtcaaaaagaacgaggaagctgctgacgaagttttcaaggacataatggaatcctcccccggatcctcaccccctaatctgacaccaaagccattgcgaagacaggtcacagtggcccctgcatccggccttcctcataaggaggaggcagggaagggctctgctcttggcactccggcagcagcagagcctgtgactcccacctctaaggccggaagtggcgctccaggcggtacctctaaaggtcctgcagaggaatctagggtccgcaggcataaacattcttctgaatctccaggcagggacaagggtaaactcagccgactgaagcccgcacccccaccccctcccgctgcttctgctgggaaagccggtggcaaaccctcacagagtccatcccaggaggcggcaggggaggccgtgctcggtgccaaaacaaaggccacatccctcgttgatgcagtcaactcggacgccgcaaagccatcccaacctggcgaaggactgaaaaagcctgtgctacctgctacacctaagccacagagcgctaaaccctcagggacccctatcagcccagcacctgtgcctagtacactgccttccgcttcgtccgccctggcaggagaccaacccagcagcactgcctttattccgcttatcagtactagagtcagtcttagaaaaaccaggcaaccgcctgaaagaattgcctccggggcaatcacaaagggcgttgtcctagactctactgaggccttgtgtttagcaataagccgtaacagcgagcagatggcctcccatagcgcagtactcgaggccggaaaaaatctgtacaccttctgcgtctcctacgtggattctatccagcagatgcgcaacaaatttgctttcagagaggcgatcaataagttagaaaataatcttcgtgaactgcagatctgtcctgccaccgcgggatcaggccctgccgctacgcaggacttcagcaaattgttaagctccgtcaaggaaatcagcgatatagtgcagcgctag

SEQ ID NO: 27651 - DNA, 3450 bp, Artificial Sequence
  Description of Artificial Sequence: Synthetic coding sequence
atgggtcagcaaccgggtaaggtgttaggcgaccagcggcgtccatcgctgccagctctccatttcattaagggagctggtaagaaagaatcctccaggcatggaggacctcactgcaatgtctttgtggagcacgaggccctgcagaggcccgtggcaagcgatttcgagccgcagggactttctgaagccgcacgttggaactccaaggaaaacttactggcaggtccttcagagaatgatccaaatctgtttgtagcactctatgattttgttgcctcaggcgacaacaccctgtccatcacaaagggtgagaaactcagagtcttgggctacaaccacaatggtgagtggtgcgaagctcagacaaagaacggtcagggctgggtgccgagcaattatattaccccggtcaattccttagagaagcactcgtggtatcatggccctgtctcccggaatgcagcggagtatctcctgtcctccggtatcaacggcagtttcctggtgagggagagcgaaagctctccagggcagcggagcatatctttgaggtacgagggtagagtataccactacaggataaataccgcaagcgacggcaagctatatgtgtctagtgagtcccggttcaatactctggcggagctagtacaccaccacagcacggtggctgatgggctgataacgacgctccattatcctgcccctaagaggaataagccgacagtgtacggagtatctccgaactatgacaaatgggagatggaacgcaccgacatcacgatgaagcacaagcttggcggaggtcagtatggtgaggtgtatgagggggtctggaaaaagtacagcctgaccgttgctgtgaagactctaaaagaggataccatggaggtcgaggaattcctgaaggaggctgccgtgatgaaggaaatcaagcaccccaacctcgtgcaactgctgggcgtgtgcacaagggaaccgccattctacataatcacagagttcatgacctatgggaatcttctggactatcttagggagtgtaatcgccaggaagtgaacgctgtggtgctgttgtatatggccacccaaatcagtagtgcaatggagtatctcgagaagaagaattttatacacagggatttggctgctcggaactgtctagtaggcgaaaatcatctcgtgaaggtggcagatttcggtctgtctaggttaatgaccggagacacatatactgcgcatgccggagctaaattccctatcaagtggaccgctcccgagtctctggcatataataagttcagcattaagtcagacgtgtgggccttcggcgtcctcctgtgggagatcgccacttacggcatgagcccttatcccggtatcgatcttagccaagtatatgagctccttgagaaggattatagaatggagcgaccagagggttgccctgaaaaagtttatgaactcatgagggcatgctggcagtggaacccctccgatcgacctagttttgccgagattcaccaggcgttcgaaacaatgtttcaggagagttctattagcgacgaagttgaaaaggagctcggcaaacaaggtgtgcgcggagcagtgagtactttgctccaggcccctgaacttccaactaagactaggactagccggagggcagccgagcacagagacacaaccgatgttcccgagatgccccactccaaaggacagggtgagtccgacccactggaccatgagccagccgtctccccactgttgccacgaaaggaaagaggcccacccgaggggggtctgaacgaagacgagcggctcctgcccaaagataagaaaacaaacttgttcagcgcgctgatcaaaaaaaaaaaaaagaccgccccaacacctcccaagagatctagttcgttcagggaaatggatggtcagccagagaggcgcggagctggcgaagaggagggccgtgacatcagcaatggcgctctggcatttaccccgctggacacagccgatccagcaaagtcccctaaaccctcgaatggggcaggagtgcctaatggcgctctgcgtgaatctgggggatctggattcaggtctccccacctgtggaagaagagctccactcttacatcctcaagactcgccactggggaagaagaaggaggtgggtccagctccaaaaggtttctccgatcctgttctgccagctgcgtgccacacggagccaaggatactgaatggaggtctgttactctaccccgtgaccttcaatcaaccggcaggcagttcgattcaagcacatttggcggacacaaatctgagaaaccagccctgcctcgcaaacgggctggtgaaaatagatccgatcaggtcactagggggacggtgacccccccaccacgcctggtgaaaaaaaatgaggaggcagctgacgaggttttcaaagacattatggagtcctccccagggagttccccgcctaatctgacaccaaagcccctgcggcgacaagtaaccgtagcgcctgcttccggactccctcataaagaagaggccggaaaaggatctgctttgggcacacctgccgcagctgagcctgtaaccccaacaagtaaggccggtagcggtgcacctggcggtacaagtaaaggacccgctgaagaatctagagtgcggcgtcataagcatagcagcgaaagtcctggcagagacaaaggcaagctcagccggttaaaacccgcaccacctcctcctcctgctgccagtgccggtaaggctggaggcaaaccctcacagtccccctcgcaagaggccgctggtgaggctgtgttgggagcaaagacaaaagccacatcgcttgtggatgctgtaaacagcgatgcagccaaaccttcacagccaggagaagggctgaaaaagcctgtgctgcctgccactccaaaaccccagtccgccaagccgtccgggactccaatctcccccgctcccgtgcccagtacactgccctctgccagttctgccctggccggtgaccagccatccagcactgccttcatacccctaattagtaccagggtctccctgcgtaagacgagacagcccccagaaaggatcgccagcggagccatcaccaaaggtgtagtgctcgattctaccgaggccttgtgtctggcgatcagccggaacagtgagcagatggcgtcgcattctgcagtgttggaagccggaaagaacctgtacacattctgcgtgtcgtacgtggacagcattcagcagatgaggaataaatttgccttccgggaggctatcaacaagctagagaataacctgcgcgaactgcagatttgccctgcgacagctggcagcggcccagcggcaacccaggacttttcaaagctgctttcaagcgtgaaggagatctccgacatcgttcagcggtag

SEQ ID NO: 27652 - DNA, 195 bp, Artificial Sequence
  Description of Artificial Sequence: Synthetic coding sequence
atgggtcagcagcctggaaaggttctgggggatcagagaaggccttccctgcccgcactgcattttataaagggagctgggaaaaaggagagcagtcgtcacggaggaccccattgtaacgttttcgtggagcaggccctgcagcgtccagtggcatccgattttgaacctcagggacttagtgaggcagcttag

SEQ ID NO: 27653 - DNA, 486 bp, Artificial Sequence
  Description of Artificial Sequence: Synthetic coding sequence
ggcaggcccggtaggtcccgggcaagaggcggtggtgaggggggttggcgaggagggggaagagcaggtagggcagggcctgagcctggacccagggcagggaggggggtgcctgcgccagactgttggagaggaaaaatgttggagatttgtctgaaactcgtgggctgcaagagtaagaaagggcttagttccagctcaagttgttatctggaggaagccctgcaaagacctgtggccagcgatttcgagccccaggggctgagtgaagctgctcgctggaactccaaagagaacctgctcgctggaccctctgagaacgatccaaacctcttcgtggccttgtatgactttgtcgcttccggcgacaacacactgtctatcacaaagggagaaaagcttcgggtccttgggtataaccacaacggagaatggtgcgaagcacagaccaagaacggacaaggttgggtgccctcaaattactag

SEQ ID NO: 27654 - DNA, 2838 bp, Artificial Sequence
  Description of Artificial Sequence: Synthetic coding sequence
ctgaggctgttgcgcgagcccctgcagcatccagggagagtcgggagcagttcattcaacggaggcagacgcgcacaccaccacgccccactgagcagcccaaaggctcagcaggcacactgcctatggtgtgtgcctcagctgcggcaagtgggagacggcacgcacgggcatcatcatgaggcacagggaggaggccagtatggagaggtgtacgagggcgtgtggaaaaaatacagcctgacagtggcagtgaaaaccctgaaagaggataccatggaagtagaggagtttctcaaggaggcagccgtcatgaaagaaataaagcacccaaacctggtgcagttgctgggggtgtgtacacgggagcctcccttttacataataactgagttcatgacatacgggaatctgttggactatctgcgcgagtgcaacagacaggaggtcaacgcagtcgttcttctgtacatggccactcagattagtagcgctatggaatacctggaaaagaaaaattttatccacagggatctcgcagccagaaactgccttgtcggagaaaaccacctagtgaaggtggccgactttgggctgagtagactgatgacgggtgatacttacacggcccacgccggtgctaaatttcctatcaaatggaccgccccagagagccttgcttacaataagtttagcataaaaagcgatgtttgggcattcggagtgctgctctgggagattgcaacatatggcatgtcaccctacccaggcattgatctgtcccaagtttatgagctgctggaaaaagactataggatggagcggccagaaggttgcccggaaaaagtgtatgaactcatgcgggcatgctggcagtggaatcctagtgatcgcccatctttcgctgagattcatcaggcgttcgaaaccatgttccaggagtccagcatttccgacgaagtggaaaaagaacttggcaagcagggggtacgcggagcagttagcacactgttgcaggccccagagctgcccactaaaaccagaacatcaagacgagcagcggaacaccgcgacacgaccgatgtgcctgagatgccccatagtaaaggtcagggggaatcagacccgcttgatcatgaaccggctgtgtcccccttgctgccaaggaaggagcgaggccctcccgagggcggactcaatgaagatgagcgtctgctgccaaaagataaaaagactaacctgttctcagccctgatcaagaagaaaaagaagactgctccaactccacccaagcgctctagttccttccgggaaatggacgggcagcctgaaagacgcggtgccggagaggaagaaggtcgcgatatcagcaatggggcactggcattcacccccttggacacggctgatccggctaagtccccgaagccatcaaacggcgcaggggtacctaatggagcacttcgcgagtctggcggtagcggcttccgctccccccacttatggaagaaaagctcaaccctcacatctagtcgccttgctaccggagaagaagaaggcggtggttcatcttctaagcggtttctgaggtcatgttcagcctcttgcgtgccacacggagctaaggacacggagtggcgaagtgtaactcttccacgagacctgcagtcaactggcaggcaattcgactcttccaccttcgggggacataagtcggagaaacctgctctgccgaggaaacgagcaggtgagaaccggtccgaccaagtgactcgcggaactgtaacgcccccacctcgcctggtgaagaagaatgaggaggcagcggacgaagtctttaaggacatcatggagagctcacctggtagttctccccctaacctgactccgaagcccctgcgcagacaagtcactgtggctccagcctctggtctcccacacaaagaagaggccggaaaaggttctgccctgggcacacccgctgcagcagaacccgtgacaccaacctctaaggccggtagtggggcacccggaggtacgtctaaaggcccagccgaagaatcgagggtgaggcggcacaagcactcttcagagtcacccggaagagacaaaggcaagcttagcagactgaagccagcacctccacctcctccagccgcaagcgccggaaaggccggtggcaaaccttcccagtctccctcacaggaggcagcgggtgaggccgtgttaggggctaaaacaaaagccacatctttggttgacgcggtaaatagcgatgctgctaagccgtctcagccgggagagggactgaaaaaaccagtccttccggctacccccaaacctcagtccgcaaagccaagtggtacccctattagcccagctccagtgccctctacgctgccttcagcctcgtccgccctggctggagatcagccgtcatcgacagcattcatccctcttatttcaaccagggtgtctcttaggaaaacaagacaaccgcctgaaaggattgctagcggcgcaattacgaagggagtggtccttgactccaccgaggcgttatgcctggcaatcagcaggaactccgagcagatggccagccacagcgctgtgctggaagccggaaaaaatctctatacgttttgcgtaagctatgtggatagcatccagcagatgcggaacaaatttgccttccgcgaggcgatcaataagctggaaaataacttacgagaactgcagatctgccctgcaacggccggaagcggtcccgctgcaacccaggatttcagcaagctcctgtccagtgtaaaggaaatcagcgatatcgtgcagagatag

SEQ ID NO: 27655 - DNA, 2649 bp, Artificial Sequence
  Description of Artificial Sequence: Synthetic coding sequence
atgggcccatggtctaggagtctatctgcattgctgcttctgcttcaagtgagctcttggctctgccaggaacctgagccatgccatcccggtttcgacgcagaatcctacacattcaccgttccacgtcggcacctggagagagggagagtcctgggaagggtgaactttgaggattgtacagggcgacagcggactgcgtattttagccttgacacaaggttcaaggtcggaacagacggggtgattaccgttaagcggccacttagatttcataatcctcagatccactttctcgtctatgcctgggattctacatacaggaagttttctacaaaagtcacactgaatacagttggccaccatcacagaccgcctccacatcaggcaagtgtcagcggaatccaagccgaactgctgacctttcccaacagcagccctggcctgcgcagacagaagcgggactgggttattccacccatctcttgtcctgagaacgagaaggggccattccccaaaaacctggtgcagataaagtctaacaaagataaggagggcaaggtgttttattcgatcacagggcagggagccgacaccccccctgtaggagtgtttatcatcgagagagagaccgggtggctgaaggtgaccgaacctctcgacagggaaagaatagccacctacaccctctttagccatgctgtctccagcaacggcaatgccgtggaggacccaatggaaattctcatcaccgtaaccgaccagaatgacaacaaacctgagttcactcaagaagtgtttaagggctccgtaatggaaggtgcccttccaggtacgtccgtgatggaggtcactgccactgatgccgatgatgacgtgaacacttacaatgcagcaatcgcttacacgattctatcccaggaccccgagctccccgacaaaaacatgttcacaattaaccgcaatacaggcgtgatctccgtcgtgaccacaggcctggatcgcgagagcttcccaacatatacgctagtcgtgcaggctgcagaccttcagggggaaggactatccactacggcaaccgcagttattactgtgacggacacaaacgacaatccgccaattttcaatcctaccacctacaaagggcaggtgcctgagaatgaggcaaacgtcgtgattaccactttaaaagtcactgacgccgatgccccaaatacacccgcttgggaagctgtctatactatcctgaacgacgacggtgggcagtttgttgtaaccactaatcccgtgaacaatgatgggatcctgaagaccgcgaaaggcttggattttgaagccaagcagcagtatattctccacgttgctgttacaaacgttgtgcccttcgaggtgagtttgacaaccagcaccgccacagtgacggtggacgttctggacgtgaatgaagctccgatctttgtccctccagagaaaagggtggaagtttccgaagatttcggtgtgggccaggaaattacgtcctatacagcacaggaacccgatactttcatggagcagaagattacttatcgcatctggcgcgataccgctaattggctggaaataaatcccgatacaggagccatctctacacgagctgagctggaccgagaggattttgagcatgtaaagaactctacatacactgcactcatcatcgccactgataacgggtctccggtcgctactgggactggcaccctcctgctgattctgtctgacgtgaacgacaatgccccaattcccgaacccaggaccatcttcttctgtgagaggaaccccaagccccaggttatcaacatcattgatgccgatcttcctccaaatactagtcctttcaccgccgaattgactcatggtgctagcgcgaactggaccatccagtataatgaccccacccaggaatcaatcatacttaaacccaagatggccctggaggtgggagactataaaatcaatctcaaacttatggacaaccagaacaaggatcaggtgacgactctggaagtctccgtatgcgactgcgagggcgcagccggtgtctgcagaaaagctcagccagtggaggcgggattgcagatccctgccatactcgggatcctgggcggaatcctggccttactgatccttattttactcctcctcctgttcctgaggagaagggccgtggtgaaggaacccttgttacccccagaggatgacacacgggataatgtgtattactatgacgaagaggggggtggggaagaggatcaggattttgatctgtcacagttacacaggggactggacgctcgcccagaagtgacccgcaacgacgtcgcaccgaccctgatgtcggttccacggtacctcccccgtcctgcaaacccagacgaaataggcaattttatcgatgaaaatttgaaagcagccgatactgaccccaccgcaccaccgtacgacagcctccttgttttcgattacgagggaagtggaagcgaggcagcctctctgtcttccctcaattcctcagagtcagacaaagaccaagattatgattatttgaacgaatggggcaataggttcaagaaattagcagatatgtacgggggtggcgaagatgattag

SEQ ID NO: 27656 - DNA, 1944 bp, Artificial Sequence
  Description of Artificial Sequence: Synthetic coding sequence
atgggaccttggtcccgctcccttagcgccctgctgctccttttgcaggtgagttcttggctctgtcaggagcctgagccttgccaccccggttttgatgctgagtcctacacatttacagtgcctcggaggcatctggagcgcggaagagtcctgggcagagttaacttcgaggattgtacaggccgtcagcgtactgcctattttagcctggacactcgctttaaggttgggacagacggcgtcattacagtgaagcgaccactgcgcttccataatccccagatccatttcttggtgtatgcctgggactccacctaccgaaaatttagtactaaggtcaccctcaacaccgtaggtcaccatcatcgcccaccccctcaccaagctagtgttagtggcattcaggcggaacttctgacttttcccaattccagccctggtctgaggcggcagaaacgtgattgggtgattcctcccataagctgcccggagaacgagaaaggtccgtttccaaagaacttagtacaaatcaagtcgaacaaagataaagagggaaaagtgttctacagcataactggtcagggtgcagatacccctcccgtcggcgtgttcatcatcgaacgggagacgggctggctcaaggtgactgaaccactggatagggagcgcatcgcaacatacaccctcttcagtcatgccgtgtccagcaatggcaacgccgtcgaggaccccatggaaattctcatcacagtgactgatcaaaatgataataagccagagtttacacaagaggtgttcaagggttcagtcatggagggggcactgccgggaacaagcgtcatggaggtgactgctacagacgccgacgacgacgtcaacacctacaacgctgctatcgcctacactatcttgtcacaagaccccgagctgccggacaagaacatgttcaccattaaccgaaacaccggggttatatcagtggtgactaccggtttggatagggaatccttcccaacctatacacttgtggtgcaggccgctgacctacaaggagagggactgtctactactgccactgccgtcataaccgtgactgatacgaatgacaatcctcccatcttcaacccaacaacgtacaaggggcaggttcccgagaacgaagccaatgtggtgatcaccactctaaaggtgactgacgcagacgcacccaacacaccagcctgggaggctgtgtataccatactaaatgacgacggtggccagttcgtggtgaccactaaccccgtgaacaacgacggcatcctgaaaaccgctaaggggctcgacttcgaggccaagcagcaatatattctgcatgtggccgtcactaatgtggtaccctttgaggtgagcctaactacttccaccgccacagtgacagtggatgtccttgacgtaaacgaggctccgatttttgtaccccctgaaaagagagtcgaagtgtcggaagacttcggggtgggccaggaaattactagctatacagcccaggaacctgatacgtttatggaacagaaaatcacttatcgaatttggcgcgataccgcaaactggttggagataaatcccgataccggcgcaattagcacgagggctgaattggaccgggaggactttgagcatgtgaaaaacagtacctacacagcgttgattattgccaccgacaatggttctcccgttgccaccggcaccggcactcttttgctgattctatcggatgtcaacgacaacgccccaataccagaaccacggaccatattcttttgtgagcgtaaccccaagcctcaggtgatcaatattatagacgccgatctcccccctaatcttgccagtcaatcaattggaataacggacatgagtcactgtacatgccccgcacctcagttacccgcaatcttttag

SEQ ID NO: 27657 - DNA, 2703 bp, Artificial Sequence
  Description of Artificial Sequence: Synthetic coding sequence
atggggccttggtcacgtagtctatcagctctgctgctgctcttgcaagtgagcagctggctgtgccaagaacctgaaccttgccacccaggcttcgatgcagagtcatacacatttactgtgccgcgacgccacctggagcggggaagagtcctcggtagagtgaatttcgaggattgcactgggagacagaggactgcttatttttcactcgataccaggttcaaggtgggaacggatggggttatcactgtgaaacgcccactgagatttcacaacccgcagatccactttctggtatatgcgtgggattctacctatcgaaagttctccacaaaggtgacgcttaataccgtgggacaccatcaccggccacctccccaccaagcttcagtatccggtattcaggcagagttgctgacgttccccaactcaagtcctggcctgcggagacaaaagcgggattgggtgatccctccaattagctgcccggaaaacgagaagggcccattccctaaaaacctggttcagatcaagtccaataaggacaaggaggggaaagtcttctattctattaccggccagggagccgatacgccaccggttggtgtgttcatcatcgagagagagactgggtggctcaaggtgaccgaaccactggaccgcgagcgtatcgcgacttacaccttgtttagtcacgcggtgtcaagtaacgggaatgccgtggaggatcccatggagatcttgattaccgtcactgatcagaatgacaataaaccagagttcactcaagaggtttttaaaggtagtgtcatggagggggctctcccaggcacaagtgtcatggaggtgactgctacggacgctgacgacgacgtgaatacctacaacgcagctattgcttacacaattctgtctcaggaccctgaactgcctgataagaatatgtttaccatcaaccgaaacacaggcgttataagcgtggtgacaaccggtctcgaccgcgagtccttcccgacctatacactcgtggtccaagccgcagacctgcagggcgagggcctgtcaactacagctaccgctgtcataactgttacagataccaacgataaccccccaatctttaacccaacaacttacaaaggccaggttcccgagaatgaagcaaacgttgtaattacgactctgaaggttactgatgctgatgcccctaatacccctgcttgggaggctgtttatacaatccttaacgacgacggtggacaatttgtcgtcacaaccaacccagttaacaatgacggaattttaaagaccgcaaaattggcccgttgcagaaactggcacccccatagttgctcctacccatgccctctcggtttggattttgaagcaaagcagcagtatattctgcacgtggcagtgacaaatgtcgtgccattcgaggtgtcgcttactacttccaccgcaaccgttaccgtagacgtgttagacgtcaatgaagcccctatctttgtgccaccggaaaagagggtggaggtttctgaagactttggcgtgggacaggagatcacgagttacacggcccaggagccagatacatttatggagcagaaaataacctataggatttggagagatacagccaactggttggaaatcaatccagatactggcgctatatccacacgcgctgagctcgacagagaagatttcgaacacgtgaagaattcaacttatacggcgctgatcatcgctacggataacggctccccggtcgccacgggaacaggcacattgctgctgatcctgagcgacgttaatgataatgcgccaattcctgaaccacgcaccattttcttctgtgagcgcaatcccaagccacaggtcatcaacattattgacgcagatttgccccctaataccagcccctttaccgccgagcttacgcacggagcctccgctaactggactatccagtacaacgatccaacacaagagagcataatcttgaagccaaagatggctttggaggttggggactacaagatcaacctcaaactcatggataaccaaaacaaagatcaggtgaccacactcgaagtgtctgtctgcgactgtgagggcgcagcgggagtgtgccggaaggcccagcccgttgaagccggtctccagatccccgcaatactaggtattttaggcggaattttagctctactgatcctgattcttttactgctgctcttcctgagaaggcgcgctgtcgtcaaggagcctctgctccctccggaggatgacactcgcgataacgtgtactattatgatgaggaggggggaggcgaggaggaccaggacttcgatttgtctcagctgcaccgagggctggacgctcgccctgaagttactagaaatgacgtcgctcctacgctcatgagcgtcccccgatatctccctagaccagccaatcctgatgagatcggaaacttcattgatgaaaatctgaaggctgccgataccgacccaaccgcgccaccatacgacagcctgctggtgtttgactacgagggctccggatcggaagctgccagcctctcctctttgaacagttccgagtccgacaaggatcaggattatgattacctcaatgagtggggaaatcgctttaaaaagcttgcagacatgtacggcggaggcgaagacgattag

SEQ ID NO: 27658 - DNA, 2466 bp, Artificial Sequence
  Description of Artificial Sequence: Synthetic coding sequence
atgggtccatggtccagatccctctccgccctactattactgctgcaggtttcaagctggttgtgccaggagcccgagccttgccatcctggctttgatgctgaatcgtacacatttacagtcccaagacggcacctggaaagaggaagagtgttagggagggtgaattttgaagattgcaccggaaggcagagaacggcttatttttctctggacacaaggttcaaagtgggcacagatggggtcattactgtcaagaggccgctacggtttcacaatccacaaattcacttcctggtatatgcctgggactcaacctaccgtaagtttagtacaaaagtgactctgaatacagtgggtcaccatcaccgaccccctccccatcaggccagtgtgtctggcatccaggctgagctcttgaccttcccaaacagcagccctggtcttaggaggcagaaacgcgattgggtcattccacccatctcatgcccagagaacgagaagggtccatttcctaaaaatctggtacagataaaaagcaataaagacaaggaaggtaaggtcttctatagtatcacgggccagggcgcagacaccccacctgtgggggtattcatcattgagagggagaccggatggctgaaggtcacagaacccttggatagagaaagaatcgccacatacaccttgttttcccatgcagtctcttctaacgggaatgccgttgaagatccaatggagatattgattacagtcacagaccagaacgataataagcccgaattcactcaggaagttttcaaaggaagtgtgatggaaggcgcactgcccggaacttctgtaatggaagtgacggcgaccgacgcagacgacgatgtgaatacctacaacgctgctatcgcttacaccattttgtcccaagatccggagctccctgataagaacatgttcaccatcaatcggaatacgggtgtgatttccgtggtgactaccggcctggatcgggagtctttcccaacatacacactggtggtacaagcagctgacctgcagggagaggggctatcaacgactgcaaccgcagtgatcacagtgacagacaccaatgataatcctccgatttttaatccaactacagggcttgacttcgaagcaaaacagcagtatattctccacgtggcagtgactaacgtggtgcccttcgaggtgtctcttaccaccagtacagcgaccgtgacggtcgatgtgctggatgtcaacgaagccccaatcttcgtgcctccggaaaagcgagtcgaggtgagcgaagactttggcgtgggacaagagattacttcttatactgcccaggaaccagatacctttatggagcagaaaataacttaccggatttggcgagacacagccaactggttggaaatcaatccggacactggcgcaatctctacaagggcagagctcgatagagaagatttcgagcacgtgaaaaatagcacctatactgctctaatcatcgctaccgacaatggatctcctgtggctactggaacaggtactcttctgctcattctcagtgacgtcaacgacaatgcccctatacctgagccaagaaccatctttttctgtgagcggaatcccaagccacaggtgattaatataattgacgccgacttgcctcccaacacaagtcccttcaccgctgagctgacacacggcgcaagcgccaactggacgatccagtacaatgaccccactcaggaaagcatcattctgaaacccaagatggctcttgaggtgggagactataaaatcaacctcaaactaatggacaatcagaataaagaccaggttaccactctagaggttagtgtgtgcgattgcgaaggggctgccggagtgtgtcggaaggcccagccggtggaggccggtctgcagatcccggcaattcttgggatactggggggaatcctggctctccttatcctgatcctccttctcctgttgtttttgcggcgtagggctgttgtcaaagagcccctgctgccgcctgaagacgatacccgggataacgtgtactattacgatgaggaaggtggcggagaggaggatcaggatttcgacttatcccagctgcatagaggtttggatgccagacctgaagtaactcgtaatgatgttgctccaactctgatgagtgtgccaaggtatctgccacgccctgcaaaccctgatgaaattggcaattttatagacgaaaatctcaaggcggctgataccgaccctactgcgccaccatatgattctctcctggtgttcgattacgagggctctggctcagaagccgctagcttatcctctctgaactcctcggaaagcgacaaggaccaggattatgactatttgaatgagtggggtaaccgctttaaaaagttggccgacatgtatgggggaggcgaggacgattag

SEQ ID NO: 27659 - DNA, 2391 bp, Artificial Sequence
  Description of Artificial Sequence: Synthetic coding sequence
atgaaagagaattattgtctgcaggccgctctggtttgcctagggatgctgtgccattctcacgccttcgctccggaacggagagggcacttacgtccaagctttcacggacatcatgaaaagggaaaggagggtcaggtgctgcagcgatctaaaagaggctgggtgtggaaccagttctttgtcatcgaagaatacacaggccctgatcccgtgctggttggcagactgcattccgacattgacagtggcgacggcaacattaaatacatcctctccggtgaaggtgccggtactatttttgtgatcgatgacaaatccggaaatatacatgcaacaaaaaccctggatagggaagaaagggcccagtacactttaatggcccaagcagtcgacagagatactaacagacctcttgaaccccctagtgaattcatcgtcaaggtgcaggacattaacgacaatccacctgaattcttgcatgagacataccacgccaatgtacctgaaagaagcaatgtgggaacctcagtgatccaggtcaccgcctcagacgccgacgacccaacctacgggaatagtgccaaactggtttactcaattctcgaaggccagccgtatttcagcgtcgaggctcaaactggcatcatccgcaccgccctgccgaacatggatagagaagccaaggaagagtatcatgttgtcattcaggccaaagatatgggcggacacatgggaggactgagcggcacaaccaaggtgacaataaccctcacagacgtcaacgataacccaccaaagtttccacagtctgtctatcaaatgtccgtttctgaggccgctgttccaggggaagaagtaggtcgagtcaaagctaaagatccggatattggtgagaacgggttggtcacatacaacattgtagacggggatggcatggaaagcttcgagatcacaaccgactacgaaacccaggaaggggtgatcaaactgaaaaagcccgtggattttgaaaccaagcgcgcttactccctgaaggtagaagctgctaacgtccacattgatccaaaattcatttctaatggccctttcaaggatacagtgaccgttaaaatctctgtggaggatgccgatgaacctcccatgttcctggcaccctcctatatccacgaggttcaagaaaacgcagcggctggaactgtggttggcagagtccacgccaaggacccagacgccgctaattcccctatcaggtacagtatagaccggcacacagatcttgacagattttttaccatcaacccagaagatggattcatcaagacaactaagccccttgatcgtgaggagacagcctggctcaatatcacagtttttgcggcagagatccacaacagacaccaggaagccaaggtccctgtggcaattagggtgctagatgttaacgacaatgcacccaagtttgccgcaccttatgaggggtttatctgtgagtccgatcagacaaagcccctgtcaaatcagccgatcgttactatctctgccgacgacaaagatgacaccgctaatgggcctcggttcatcttctctctgcctccagaaatcatccacaatcctaatttcaccgttcgggataatagagacaataccgccggtgtgtatgcacggagaggcggattttctcggcaaaagcaggacctgtatctactgcccattgtgatttccgacgggggaatccctcccatgtccagtactaatacactcactattaaggtgtgcggatgcgacgtgaacggcgcactcctgtcctgtaacgcggaagcctacatcctaaatgctggtttgtccaccggcgcactcatagccattcttgcttgcattgtgattttattagtgatagtggtgctctttgttactcttcgccgacagaaaaaggagcccctaatagtgtttgaggaagaggatgtcagggaaaacatcattacatatgacgacgaaggcggaggagaagaggacacagaagcttttgacatcgctacactccagaatccagacggcattaatggtttcatccctcggaaagacatcaagcccgagtaccagtacatgcctagacctggacttcggccagctcctaattccgttgacgtcgatgactttattaataccagaatccaagaagccgacaacgaccctaccgcccctccctacgacagtatacagatttacgggtacgagggcaggggcagcgtggccggatcccttagcagtctggagtctgctactactgacagcgacctggactatgattatctgcagaactggggcccaaggttcaagaagcttgctgatctgtacggatctaaagatacttttgatgatgactcgtag

SEQ ID NO: 27660 - DNA, 2082 bp, Artificial Sequence
  Description of Artificial Sequence: Synthetic coding sequence
atgaaagagaactattgcttgcaggcagctcttgtgtgtctgggaatgctgtgccactcccatgcttttgcaccagagcgaagagggcacctgcggccaagcttccacgggcatcacgaaaaaggaaaagagggccaggtcctacagaggtccaagaggggctgggtatggaatcagttctttgtcatcgaagagtatactggccctgatccagtgctggtcgggagactgcacagtgacatcgattcaggtgacggcaacatcaagtacatcttgtccggcgaaggagctggtacaatttttgtcattgacgacaagtcaggaaatatccacgcaaccaaaacattggatagagaagaacgggcacaatatacactcatggcccaagccgtagatagggacactaaccgtccactagagcctccaagcgagttcatcgtgaaggtccaggacatcaatgacaacccacctgagttccttcatgaaacttatcacgccaacgtgcctgaacgctccaatgtcggaacttcggttattcaggtgactgcctccgatgctgatgatcccacttatggaaatagtgccaagctggtctactctatactggaggggcagccatatttcagtgtggaggctcagaccggaattatacggaccgccttaccaaacatggaccgggaggccaaggaggagtaccatgttgtcatccaggcaaaggatatgggcggtcatatggggggattgtccggaacgacaaaggtgaccatcacacttacagacgttaatgacaaccccccaaaattccctcaatcagtgtatcagatgtctgtgagtgaggccgcagtgcctggcgaagaggtcggcagggttaaggccaaggatccagacataggggaaaacgggttggtgacgtacaacatcgtggatggcgacggaatggaatctttcgagattaccactgactacgaaacgcaggaaggcgtgattaagctgaagaaacccgttgacttcgagacaaagcgggcttacagtcttaaggtcgaagcggctaatgttcatatcgaccctaagtttattagcaatggcccattcaaggatacagttaccgtaaagatttcagtggaagacgccgacgagcctccaatgttcctggctccgtcctatattcatgaggttcaggagaatgccgcagccggaaccgtggtgggccgtgttcatgctaaggaccccgatgcagcaaacagtcctatcagatacagcattgatcgacatacagatctcgacaggttcttcacgatcaacccggaagatggttttatcaagactacgaaacccttagaccgcgaggagacagcttggctaaacattacagtttttgccgctgaaatacataatcgtcatcaggaagcaaaggtccctgtggcgattcgggttctagacgtcaacgacaacgccccaaaatttgccgctccatacgagggatttatatgcgagtccgatcaaacaaagccactgtccaaccaaccaatcgtgacaatcagcgccgacgataaagatgataccgccaatggaccgagatttatcttctctctcccacctgaaattatccacaatccaaacttcaccgtgagggataacagggacaatacagcgggagtgtatgctcgccgtggtggcttcagtaggcaaaagcaggatctttacctacttccaattgttatttcagatggagggatccctcctatgtcgtccacaaacaccctcactattaaggtgtgcgggtgcgatgttaatggcgctttactaagttgtaacgccgaagcctatatccttaacgctgggcttagtaccggagctctcattgccatactagcatgtatcgtcatccttctgggatgccccagcctgatggagcctccgagcccacgagaggacatgaggctgttatacctcggctttcagctgatgctgttcagctacgtgaaagtgaaccggaggttttgcttgctaggcgtcttcatcaagttgccattcctctacgtcgttgcgaccgagagccccaccacactgaccagtttgtag

SEQ ID NO: 27661 - DNA, 516 bp, Artificial Sequence
  Description of Artificial Sequence: Synthetic coding sequence
atgaaggagaattactgcctgcaggccgcactcgtgtgtctaggaatgctctgccactcccatgcctttgctccagagagaagaggccacctcagaccgagctttcatggtcaccatgaaaaaggaaaggaaggacaggttttacaacggagcaagcgaggatgggtgtggaatcagtttttcgtgattgaggaatatacagggccagatccagtcttagtcggcagactgcattccgatatagattctggagacggcaatattaagtacattctgtcaggtgagggagcaggtacgattttcgtgattgacgacaagagcggcaacatccatgctactaaaacactggatcgggaggaaagggcacaatatactctcatggctcaagcagttgatagagacactaaccgtaactcactcagcaggtcacgtactctgatgaccaccctccggtcttcttgcactcgacctataatgcccacctgtctgcggggacccatgtgggtgcgaacgtag

SEQ ID NO: 27662 - DNA, 2340 bp, Artificial Sequence
  Description of Artificial Sequence: Synthetic coding sequence
atgggtccaggcctagccgctagacgtctgcgccctccctcccgcgctccggagattactgtgttctccgcgcaacggccttgcgatatcccgtcttgctgtcatctcctctcagatcaaagtgatgggtggagcgtgctacagaaactcgccgcatctattcaatgggttaagaaactgcatagtgatatagacagtggagacggcaacatcaaatatatcctctccggggagggcgctggcacgatctttgtcatcgacgacaagtccggaaatattcacgcaaccaagaccctggacagagaggagagagcccagtacacgttgatggcccaggcagtggatagggacactaatcggcctctcgagccacccagtgaattcatagtgaaggttcaggacattaatgacaaccctcccgaatttcttcacgaaacctaccatgcgaatgtgccggagcgaagtaacgtgggaaccagtgttattcaggtgactgcaagtgacgcggacgaccctacctatggcaatagtgccaaactggtttacagtatcttggagggacagccatacttctctgttgaagctcaaaccggtattattcgtacagccttacccaacatggatcgcgaggctaaggaagaataccacgttgtcattcaagcaaaggatatgggcggacacatggggggattgtcgggaaccacaaaggtaaccatcacattgacggacgttaatgacaatcccccaaaattcccccagtccgtctaccagatgagtgtatcagaagcggctgttcccggagaagaagtgggaagagtcaaagcaaaggatcccgacattggcgagaatgggttagtgacctataacatcgttgacggggatggaatggaatcctttgagataacaacagactacgagacacaggaaggggtgataaaattgaagaagccagtcgactttgaaactaagagagcatacagtttaaaagtggaagcagctaacgttcacattgatcccaagttcatctctaatggtccatttaaagatactgttacagtaaaaatcagcgtggaggacgccgatgagccccctatgttcctcgccccatcatacatccatgaggtccaggagaacgcagctgcaggcacagttgtcggacgtgttcacgctaaggatcccgatgcagcaaattccccaattcgttatagcatcgacagacacacagatctggaccgattcttcacaattaacccggaagacggcttcattaagaccactaagcccttagacagggaagagaccgcatggctaaacatcaccgtatttgctgctgaaattcacaacaggcaccaagaagccaaagtgcccgtggctatacgcgtactcgacgtaaacgataacgcacctaagttcgcagcaccatacgaaggtttcatctgcgagtcagaccaaaccaaacccctgtcaaaccagccaatcgttacaatcagtgctgatgacaaagatgacactgctaacgggccaaggttcattttcagcttgccgcctgagattatccataaccctaacttcaccgtacgagacaacagagataacaccgctggagtgtacgcccgacgcggaggcttttcccggcagaaacaggacctgtatctcctgcccatcgttatctccgatgggggaatcccaccaatgtcttctacaaacacactgaccattaaggtatgtggctgtgacgtcaacggggcactgctgtcctgcaacgctgaagcatacattttaaatgcaggcttgtcgactggtgccctcattgctatactggcttgtatagtgattctgttggtgatcgtggttctgttcgtgacactaaggcgccagaaaaaagagcccttgatcgtatttgaggaggaagatgttcgcgagaatatcatcacttacgacgatgaagggggaggtgaggaagatactgaggctttcgatatcgccaccctgcagaatcctgacggtatcaatggcttcattccaaggaaagatatcaagccagaatatcagtatatgcccagacctggcctgcgccctgcgcctaattccgtcgacgttgacgactttataaacacaaggatacaagaggccgataatgatcccaccgccccaccatacgattccattcagatttatggatacgagggtcggggatctgtcgccggtagtctttcctccctcgagagcgccaccactgattctgatttggattacgattacctgcagaactggggaccgagatttaagaaactggcagacctatacggtagtaaggacactttcgatgatgattcctag

SEQ ID NO: 27663 - DNA, 528 bp, Artificial Sequence
  Description of Artificial Sequence: Synthetic coding sequence
atgcagccccgaaccccccttgtgctgtgcgtccttttaagccaggttctgctgctcacttcagccgaagacctggattgcacacctgggttccaacagaaagttttccatatcaaccagcccgctgagttcatcgaagatcagtctatccttaatctaacattctctgattgtaaaggcaacgataagctgcgttacgaagtctcctcaccctacttcaaagtaaattcggacggcggtctggtggccttgcgaaatataacggcggtaggcaagaccttattcgtgcacgcacggacaccccatgcagaagacatggcagagctggtgattgtcggcggaaaggacattcaaggcagtcttcaggacatttttaagttcgcccgaacttctccagtcccgaggcagaagcggagtatcgtggtgagtccgatacttatacctgaaaaccagcgacagccattcccccgagacgtgggcaaaatgaagatttggcaggtgctgtgcctcgccagatggctcacttag

SEQ ID NO: 27664 - DNA, 2142 bp, Artificial Sequence
  Description of Artificial Sequence: Synthetic coding sequence
atgcagccccgtacaccccttgtgctgtgtgtgcttctgagccaggtactgctccttaccagcgctgaagacctagattgcacacctggctttcagcagaaggtgttccatataaatcagcccgcagagtttatagaagaccagtctatcctgaatctgacattctcggattgtaaagggaatgataagttacgctacgaggtgtccagcccatacttcaaagttaattcagacggaggactcgttgctttgaggaacatcacagctgtgggtaagacgctgttcgtgcatgccagaactcctcatgcagaagatatggccgagctggtgatcgtggggggaaaagacatacagggcagcctgcaggatatattcaaattcgccagaacctccccggttcctcggcagaaacgatctattgtagtgagccccattctaatcccagaaaaccagcggcaacccttccctagggacgtcggaaaagtggtcgacagcgatcgccctgaacggagtaagtttaggctcaccggaaagggggtcgatcaagaacccaagggcatcttccgtattaatgaaaacacaggatctgtgtccgttacgcgcaccctagatcgggaagtaatcgccgtgtatcaattgttcgtagagaccactgatgtgaacggaaagactctggaggggccagtgccactggaggttattgttattgaccagaatgataaccggccaatcttccgggaaggcccttacataggtcatgtcatggaaggcagtcctacgggcacgaccgtgatgagaatgaccgcttttgatgcagatgatccagcaactgataacgcactcctgagatacaacattagacaacaaacccccgacaaaccatcccctaatatgttttatatcgaccccgagaagggcgacattgtgactgtcgtcagcccagctctgttagaccgggagacgctcgaaaatccaaagtatgagctgataatagaagcccaggatatggctgggctcgacgtggggctgacaggcacagcgacagctacaattatgatcgacgacaagaacgatcatagccctaagtttaccaagaaggagttccaggctactgtagaagagggagccgtgggagttatcgtgaacctgaccgttgaggataaggacgatcccaccacaggagcatggagggcagcatatacaatcatcaacggcaacccaggtcagtccttcgaaatccacaccaacccccaaacaaatgagggaatgctttctgtggtgaaacctttggattatgaaatctctgcttttcacacactgttgataaaagtggaaaatgaggatcccctggtgcccgacgtgagttatgggccatcttcaaccgcaacagtccacatcaccgtcctcgacgtaaatgagggcccagtattctaccccgacccgatgatggtaacaaggcaggaggatctaagtgtgggttctgtgcttctgacagttaacgctacagaccccgatagcctgcagcaccagacaatccgctactcagtctacaaagaccctgcaggatggctcaacatcaatcctatcaatggcacagtcgacactactgcagtgcttgatagggagagtcccttcgtggataactcggtgtatactgcactgttcctggccatagattcaggcaatccgccagcaaccggaacaggaacccttctaattacccttgaagacgtgaatgacaatgccccatttatatacccgacagtggcggaggtctgtgacgacgctaagaatttgtctgtggtgattctgggcgcaagcgacaaagatctgcaccccaacactgacccctttaaattcgaaattcacaagcaggctgtgcctgataaggtttggaagatcagtaaaatcaataacacccacgcgttggtttcactcctgcagaatctgaacaaggccaactacaatctccctataatggtgacagacagcggaaagccgcctatgaccaacattaccgatttaagggtacaggtctgctcctgccgcaacagtaaggtggactgtaacgccgcaggagccctccgtttctccctgccatccgttctgcttctgtcgttattctcccttgcctgcctctag

SEQ ID NO: 27665 - DNA, 2283 bp, Artificial Sequence
  Description of Artificial Sequence: Synthetic coding sequence
atgaagacaccccctggtgcctcaagccggaccaaatgttcgagggaactcaggtctttttgcgccttctcctgccccagggctaaacaacccacatgcactgcctggttcccccagcaagaacatccctcggagaatggccctcagatgccaggaagggacccgcctgcagctagcaccatgcaagtattgctcctcacttcagccgaggacctggactgtacaccaggtttccaacagaaggtgtttcatattaaccagcctgcagagttcattgaagatcagtccattttgaatttgaccttctccgactgtaagggcaatgataagttacgctatgaggtgagctcaccctacttcaaggttaacagtgacgggggactggtggccctaagaaatattacggctgtggggaagactttgtttgtccacgcgcgtacaccccacgctgaagatatggcagagcttgtaattgtgggcggaaaagatatccagggatctctccaggatattttcaaatttgcacggacaagcccagtccccaggcagaagcgaagtatagtggtgagccccattctgattcctgagaaccagcggcaaccctttccccgagacgttggtaaggtcgttgactctgaccggccagagaggtccaagttcagattgactggaaagggggtggaccaggagccaaaggggatctttagaatcaatgaaaacaccggttcggtatcagtgactaggacgctcgatcgagaagtgattgcggtgtatcaattattcgtagaaactacagacgtgaatggtaagactttggaagggcctgtgccactggaagttattgtaatagaccagaatgacaatcggcctatcttccgcgaggggccttacataggacatgtgatggaaggctcaccaaccgggaccactgtgatgcggatgaccgctttcgacgctgacgatcccgctacggataatgcattgctgagatacaacattagacagcaaacacccgacaaaccctctccaaatatgttttacattgatcccgagaaaggcgatattgtcacagtggtgtcgccagcgttgctggacagggaaacactggagaatcccaaatacgagctgattatagaggcccaggacatggccggactggatgttggattgaccggaaccgcaacggccacgatcatgattgacgataagaatgaccactctcccaaattcactaagaaggagtttcaggccaccgtggaggagggcgcagtcggcgtgatagttaacctgacggtggaggataaggacgaccctactacgggtgcctggcgggctgcctacacaattatcaacgggaatcccggtcagtcgtttgaaattcacacaaatccccaaacgaatgaggggatgctgtctgtggtgaaacccctagattacgagatctccgccttccatactttgctgatcaaggttgaaaacgaggacccactagtccctgatgtctcctacgggccttccagcactgcaaccgttcatatcaccgtcttggatgtcaatgagggaccggtcttctatcccgaccctatgatggtcaccagacaggaggatctgtccgttgggtcagtcttgttgacagtgaatgcaacagatcctgacagtctgcagcatcaaacaatccggtacagtgtctacaaagaccctgctgggtggctcaatattaaccccatcaatggtaccgttgataccacggccgttctagaccgggagagccccttcgtcgacaatagcgtgtacacagcactttttcttgcaatagattcgggcaatcccccagcaaccgggaccggtacgttgcttataactttggaagacgttaacgacaacgcaccattcatctacccaactgtggcagaagtgtgtgatgatgctaaaaatttgagtgtcgtgatcctgggcgcttcagataaggacctgcatccgaatacagatccctttaaatttgagattcataagcaagccgtaccagacaaggtgtggaagatctctaaaatcaacaacacccacgccctggtatcactactgcaaaatttaaataaagcaaattataacctgcccatcatggtgacagactccgggaaacctcctatgaccaacattactgaccttcgcgttcaagtctgcagctgcagaaatagcaaagtcgattgtaacgccgctggggctctgcgcttctctttgccgagcgtactgttactttcgttattctccttggcgtgcaaatag

SEQ ID NO: 27666 - DNA, 2142 bp, Artificial Sequence
  Description of Artificial Sequence: Synthetic coding sequence
atgcagcctagaacacccttagtgctctgtgtgctgctaagtcaggtgctgctgctgacgtccgccgaggacctggattgcacacctgggttccaacagaaagtgtttcatatcaatcagccagcagagttcatcgaagatcaatcaatccttaacctgacattctccgattgtaaaggcaacgacaaactaagatacgaggtgtcgtcaccttacttcaaggtcaacagcgacgggggattagtggcactccgcaacataaccgcagtcggtaaaacactgtttgtacatgctagaacacctcatgcggaggacatggccgaacttgtaatcgtggggggaaaagatatacaaggaagcctccaggacatattcaaatttgccagaacaagccccgttccgcgacaaaagcgtagtatcgtggtgagcccaattctgatcccagagaaccagaggcagccgttccctcgagacgttggcaaggtggttgactcggaccgcccagagaggtctaagttccggctgactgggaaaggtgtcgaccaagagcccaagggtatcttccgaatcaacgaaaacacaggttcagtaagcgtcacgaggaccctagatcgggaggtgatcgctgtgtatcagcttttcgtggaaacaactgacgttaatgggaagactctggaaggtccagtacctctggaggtgatcgtgatagaccagaatgataacagaccgatcttccgggaaggtccgtacatcggtcatgttatggagggttctccaacagggactactgtcatgaggatgaccgcgttcgacgccgatgaccccgcaacagataacgccctgctacgttataatataaggcaacagacccccgataagccaagcccaaacatgttttatattgatcctgaaaaaggagatatcgtgacagtcgtgtctcctgccttactagatagggagactctggagaatcccaagtacgagcttatcattgaggctcaggacatggcagggttagacgtggggctgacgggcactgcgacagccaccataatgatagacgataagaacgatcatagtcccaaatttacaaaaaaagagtttcaggcgactgtggaagaaggagctgtgggagtcatcgtcaatctgacagtggaagataaagatgacccgactacaggcgcatggagggctgcttataccatcatcaacggtaatcccggtcagagtttcgagatccacacgaatccacagaccaacgagggtatgttatccgttgttaagccactagactacgaaatctcagcctttcatactttactgatcaaggttgaaaacgaggaccctctggttcctgacgtttcttacgggccatcatcgaccgctactgtgcatattaccgtcctcgatgtgaatgaggggccagtgttctatccggaccccatgatggtgacccggcaggaggatttatccgttggttccgtgctgttaaccgtgaacgccaccgatccggacagcctgcagcaccagacaattcgctactctgtgtacaaagaccccgcaggatggctgaatattaaccctatcaatgggaccgtggataccactgcagtcctcgatagagagagccccttcgtcgataattccgtttacactgcccttttcctggctatcgactccggaaaccccccagctacaggcacgggcaccctccttattacactcgaagatgtgaatgataatgctccatttatatatccaactgtggcggaagtgtgcgacgatgccaaaaatttatctgtggttattctgggggcaagcgacaaagacctacatcccaataccgaccccttcaagtttgaaattcacaagcaggcagtgcctgacaaagtttggaagatctccaagattaataatacccatgccttggtatccctcctacaaaaccttaataaggcaaactacaaccttcctatcatggtgaccgactccggcaagcctcccatgacaaatattaccgatctccgtgtacaagtatgttcttgccgcaacagcaaggtagattgcaatgcagccggagccctgcgattttcactgccctctgtcctgctactgagtctgtttagcctcgcgtgcaagtag

SEQ ID NO: 27667 - DNA, 573 bp, Artificial Sequence
  Description of Artificial Sequence: Synthetic coding sequence
atgcagccaaggacacccctggtgctctgcgtcctgctttcacaagtgctgctgcttacctcagcggaggatttggactgcacgcccggattccaacagaaagtttttcacatcaatcagcctgccgagttcatcgaggaccaatcaatcctcaacttaaccttttcagattgcaaaggcaacgataaactgaggtatgaagtttcctctccttatttcaaagtgaattccgacggagggctggtggctctgagaaatatcaccgctgttgggaagaccctgttcgtgcacgctcggaccccccacgccgaggacatggctgagctcgtgatcgttgggggtaaagatatccagggcagtctgcaggatattttcaagtttgctcggactagccccgtgcctcggcagaagcgttctatcgtggtgtcaccaatcctcatcccggaaaatcagcgacagcctttcccaagagatgtaggcaaacgaacacacaacccaatcaatagcgagctgctcctaaacgaggggatcaccgctgatctgaatccctgtattactatcctcgccatatag

SEQ ID NO: 27668 - DNA, 528 bp, Artificial Sequence
  Description of Artificial Sequence: Synthetic coding sequence
atgcagccacggacccccctggtactgtgtgtgctgttgagccaggtccttttgctgacctcagctgaagatctggattgtactccaggttttcagcagaaggtgtttcatattaaccagccggctgagtttatcgaagatcagtcaattctgaacctgacatttagcgattgtaagggaaacgataagctgagatacgaagtcagctcgccgtatttcaaagtcaacagcgatggcggactggtggcactccgtaatattacagctgtcggcaaaacactctttgtccacgctcgcactccacatgccgaggatatggcagaactggtgatcgtcggtggaaaggacatccaaggaagccttcaggatattttcaagttcgctcgaacatctcctgtacctcgccagaaacggtccatcgttgtgagccccattctgataccagaaaatcagcgacagccgttccccagagacgttggtaagatgaagatctggcaggtactgtgtctggcacggtggctgacatag

SEQ ID NO: 27669 - DNA, 2025 bp, Artificial Sequence
  Description of Artificial Sequence: Synthetic coding sequence
atgcaaccaagaactcccttagtgctgtgcgtgctcttgagccaggtgctgctgctcacgtctgcagaggacctggattgtacacccggatttcagcaaaaagtgtttcacattaaccagcccgctgagttcattgaagaccagtctatcttgaatctgactttcagcgactgcaaggggaacgacaagctccgatacgaggtttcttccccatacttcaaggttaatagcgacggaggcctggtggctctacggaacatcactgcagtaggaaaaactctttttgtgcacgcgaggaccccacatgccgaggatatggctgagttggtgatcgtgggaggtaaggacatacagggtagtctccaggtggtcgattccgaccgacccgagcgatccaaattccgcctgacaggtaagggcgtcgatcaggagcccaaaggtattttcagaatcaatgagaacacaggctccgtttccgtgacacgcacgctggatagggaggtgattgccgtgtatcagttgttcgttgagaccacggacgtgaacggcaagacactggaagggcctgtgccactggaggtgatcgtcatcgatcagaacgataatcggccaattttccgggaggggccatatatagggcatgtgatggagggttcccccaccggtaccacagttatgcggatgacagcattcgacgcggacgaccctgcaacggataacgctctgttgaggtacaacattcgacagcagacgccggacaaacctagcccgaacatgttttacatcgaccctgaaaagggggatattgtgacagtcgtgagtccagctctgctagaccgcgaaacactggagaacccaaagtacgaattgatcatagaggcacaggacatggcaggcttggacgttggtttaacaggaactgccactgcgactatcatgatcgacgataagaatgaccatagccctaagttcaccaagaaggaattccaggctaccgttgaggagggcgcagtgggagtgatagtgaacctcacggtcgaagacaaggatgacccaaccactggagcttggagagctgcctatacaatcatcaacggaaatcctggccagtccttcgagattcacaccaacccccagacaaacgaaggtatgctgtctgtagtgaaaccattggattatgagatctccgctttccacaccctgctgatcaaggtcgagaacgaagaccccctggtgcctgatgtatcttacggaccaagttctaccgcaaccgtccatattacagtcctggacgtcaacgagggccctgtgttttatccagatcctatgatggtgactcgccaagaagacttgagcgtgggcagcgtactgctgacagtcaatgctaccgaccccgactccctgcagcaccagacaattcggtattctgtgtataaggatccagcaggatggctcaatatcaacccgatcaatggcaccgtcgacactacagccgtgctcgacagggaaagccccttcgtggataactccgtgtacactgcgctctttctggcgattgatagtggcaacccaccagcgaccggcaccggcacactgctgatcacgctggaagacgtgaacgacaatgcacctttcatttatcccacagtggctgaggtatgcgatgacgccaaaaacctttcagtcgtgatcctaggggcttcagacaaagacctgcaccccaatacggatccgtttaagtttgagattcataaacaggccgttcctgacaaagtgtggaaaatttccaagatcaacaatactcacgcactggtaagcttgcttcaaaacctgaacaaagctaactacaacctacctataatggtgacagactctggtaagccgcctatgactaacatcactgatctgcgcgtccaggtgtgttcctgtcgcaacagcaaggtcgattgtaacgctgccggtgcactacgcttcagcctcccctctgtcctgctcctgagtctgttctctcttgcctgcaagtag

SEQ ID NO: 27670 - DNA, 1248 bp, Artificial Sequence
  Description of Artificial Sequence: Synthetic coding sequence
atgcagcctcgcacgcccctagtcctgtgtgtgctcctttcccaagtggccttactcgatcgagaaacactcgaaaatcccaagtatgaactcataatcgaagcccaggacatggcgggtttggacgtgggattgacaggaaccgcaacagcaacaatcatgattgacgacaaaaatgatcactcacccaaattcacaaagaaggagttccaggctaccgtggaggaaggggctgtcggtgtgatagttaacctgacagtggaagacaaagatgatcccacaaccggggcatggcgggcagcatacaccattattaacgggaatccgggacagtccttcgagatccacacaaacccacaaactaacgaagggatgcttagcgtggttaaacccctggactacgaaatatctgctttccatacattgttgatcaaagtcgaaaatgaggatccgctcgtgccggatgtgtcgtacgggccaagcagtactgcaacagtgcacatcaccgtcctggacgttaacgagggccctgtgttttacccagaccctatgatggtgactagacaggaggacctgagtgtgggctccgtactcctcactgtgaacgccaccgatccagactctctgcagcaccagactataaggtattcggtgtataaggacccagctgggtggttaaacattaaccccataaatggaaccgtggatacaaccgccgtgctggatcgcgaaagcccattcgttgacaacagtgtctataccgcattatttctggctatagatagtggaaaccccccagcaactggtacagggactttactgatcacactggaagacgtgaatgataacgcccctttcatttaccctacggtggccgaggtctgcgatgacgccaaaaacctctccgtggtgattctgggagccagcgacaaggacttacaccccaacactgatcctttcaaatttgaaattcataaacaggccgtccctgataaagtctggaagatcagcaagataaacaacacacatgctctggtgagcctgctgcagaatctgaacaaggccaattacaacctccctatcatggtgacagactctggaaaacctcctatgaccaacattaccgacctcagggttcaggtatgcagttgcaggaattcgaaggttgactgcaacgccgctggggcattgcggttttccctcccatctgtgctgctactttctctttttagcctggcctgtaaatag

SEQ ID NO: 27671 - DNA, 819 bp, Artificial Sequence
  Description of Artificial Sequence: Synthetic coding sequence
atgcagcccagaacaccgctcgtcctgtgtgtccttctctcccaggtactgctgctgaccagtgccgaggatcttgactgtacacccggttttcaacaaaaagtgttccatataaatcaaccggctgagttcatcgaggaagacttatccgtcgggtccgtcctgctaaccgtaaacgccacagatccagacagtctccaacatcagaccattcgctattctgtctacaaggacccagctgggtggctgaatatcaacccaataaacgggacagtggacacaactgcagttctggaccgagagtctccattcgtggacaattctgtttacactgcactgttcctcgctatagactccgggaacccccctgccacagggaccggaacactcctgatcaccctggaggatgtgaatgataatgccccatttatctacccgacagtagccgaggtatgtgatgacgctaagaatttgtccgtggttatcctgggggcatctgataaggatctccatccgaacacagaccccttcaaatttgagatccacaagcaggccgttcccgacaaggtgtggaagataagcaagataaacaatacccatgcccttgttagcctcttgcagaatctcaacaaggcgaactacaacctaccgataatggtgacggacagcggtaagccacctatgaccaatatcaccgatctgagggtgcaagtttgtagttgccgcaattccaaagtggactgcaacgccgctggtgctcttcgcttcagcctcccctcagttctcctcctctcccttttttcactagcttgcaaatag

SEQ ID NO: 27672 - DNA, 1212 bp, Artificial Sequence
  Description of Artificial Sequence: Synthetic coding sequence
gtggtgtctccagctctgctcgatcgggaaaccctggaaaatccaaaatatgaattaattatcgaagcccaggatatggcgggattagacgtcggattgaccggaacagctaccgcgacaatcatgatcgacgacaaaaacgatcactcccccaaatttacaaagaaggaatttcaagctaccgtggaggaaggggcagtgggggtcatcgtaaatctgacagtggaggacaaggacgatcctaccaccggtgcttggcgggcagcctacacaataattaacggcaacccaggccagagtttcgaaatccacaccaatccccagactaacgagggcatgctgtccgtggtgaagccattggactatgagatttccgcttttcacactctgttgattaaagtggagaacgaggacccactagtgcccgatgtttcttatggtccctcttccacagcaacagtgcacatcaccgtactggacgtgaatgaagggccagtcttttaccccgatccgatgatggtgaccaggcaggaagacttgagcgtgggaagcgtgcttctgactgtcaatgctacagatccggattcactacaacatcaaacaatccggtactcagtgtacaaagacccagccggatggctgaatatcaaccctatcaatggcacagtggataccacagcagtgctggatagagagtccccatttgtggataattccgtgtacaccgcgctttttctggcaatcgactcaggcaaccccccagcaactggcaccgggacattgctcatcaccctcgaggatgtcaacgacaacgcaccatttatttatccaacagtggctgaagtgtgtgacgatgccaaaaacttatcagttgtgattctgggcgcatcagacaaagatctccatcccaacacagaccctttcaaattcgagatccataagcaggcagtgcctgacaaagtgtggaaaataagcaaaataaataatactcatgctttggtcagcctactccagaacctgaacaaggctaattataacctgccaataatggtcacagacagtggaaaacccccaatgacaaatattactgacctaagggtgcaggtgtgttcttgccggaacagcaaagtggactgtaatgcagccggagctctgaggtttagtttgccttcggtccttttgctgtctctcttcagcctcgcctgtctttag

SEQ ID NO: 27673 - DNA, 2721 bp, Artificial Sequence
  Description of Artificial Sequence: Synthetic coding sequence
atgtgccgcattgccggagccctgaggaccctcttacctctgctggccgcactgttacaggcgagtgtggaagcctcaggagaaatcgccttgtgtaaaacgggcttccctgaggatgtgtatagcgcggtgctgtctaaagatgtccatgagggccagccattactgaacgttaaattttctaattgcaatggaaaacgtaaggtccaatatgaatcctctgaacccgcagattttaaagtggacgaggatggtatggtgtacgctgtacggagcttcccactcagctctgaacatgctaagttcctcatatacgcccaagacaaggaaacccaggaaaagtggcaggtcgccgtgaaattgtcactcaaaccaacactgaccgaggaaagcgtcaaggagagcgccgaggtagaggagatagtgttcccacgccaatttagcaagcatagcgggcacctacagagacagaaaagagattgggtgataccccctatcaacctccctgagaatagtcggggaccgttccctcaggagttggtcagaatccgcagtgacagggacaaaaacctgagcctgcgctattctgtgacagggccaggagcagatcagccgcctactgggattttcataattaatcctatctctggacagctaagcgtaacaaaaccgctcgatcgggaacagattgccagattccaccttcgcgcacacgcggtggacatcaacggaaaccaagtcgagaaccccattgacatcgtgataaatgtgattgatatgaacgataaccggccagaatttctccatcaggtctggaacgggacagtgccagaaggtagtaaaccaggcacttacgtgatgactgttacagcaatcgatgccgatgatcccaacgctcttaacggaatgctcaggtatcgtatcgtgtctcaggccccttccacaccatcccctaacatgttcacaattaacaatgaaacaggggacatcattaccgtcgctgctggactggatagagaaaaggtgcagcaatacaccttgatcattcaggcaacggatatggagggtaaccccacgtacggcctgtcaaacacagctaccgccgtgataacggtcaccgacgtcaatgataacccccctgaattcacagccatgacgttttacggggaagttcctgaaaatagggtggatatcatcgtggctaatctaactgtgaccgacaaagaccagccccatactccagcttggaatgcagtgtacaggataagcggaggagaccccactggcaggttcgcaattcagaccgacccaaactccaatgacggattggttacagtggtgaagcctatcgactttgagacgaaccgaatgtttgtcttgactgtcgctgctgagaaccaggttcctctcgcaaaaggaatccagcatccgcctcagtcaacagccactgttagcgtaaccgttattgacgttaacgagaacccatattttgctccaaatcctaagattatccggcaggaggaggggcttcatgcaggcacaatgctaacgactttcactgcccaggaccctgataggtacatgcagcagaatatccggtataccaaattgtcagatccagcaaactggctgaagattgaccctgtgaacggacagattacgaccattgccgtgttggatcgagaatcccccaacgtgaagaataacatctacaatgctacattcctggctagtgacaatggcatccccccaatgagcggaactggaacccttcagatatacctgctggacattaatgacaacgcaccacaggtgttaccacaagaagctgagacctgcgagacaccagacccaaactctataaatatcacagccctggactacgatatcgatcccaacgccggtccgtttgctttcgatcttccgctgtctcccgtgaccatcaagagaaattggactatcacccgactcaatggggatttcgcccaactgaacttgaagatcaaatttctcgaggcagggatctacgaagtcccaattattatcactgactcgggaaatcctccaaaatccaatatctcaattctgcgggtgaaggtgtgccagtgcgactctaacggcgactgtacagacgttgaccgaatcgtcggagcaggcttgggaactggagccattattgctatcttactgtgtataattatactcctgatattggttttgatgtttgtcgtatggatgaaaagaagagacaaggagaggcaggcaaaacagttattaatcgatccagaagatgacgtgagagacaatatcctcaagtacgacgaagagggaggaggagaagaggaccaagactatgacttatcccagctacagcaacctgacaccgtggagcctgacgcgattaaaccggtgggcatcaggaggatggacgagagacccattcatgctgagcctcagtatcccgttaggagtgccgcacctcatcccggtgacatcggagacttcattaacgagggactgaaggccgcagacaatgatcctactgcacccccttacgactctttattggtgttcgattatgaaggcagcgggtccactgccggaagcctctccagtctgaattccagttcttctggcggagagcaagactacgattacttgaatgactggggacctagattcaaaaaacttgctgacatgtatggcggaggcgacgactag

SEQ ID NO: 27674 - DNA, 2628 bp, Artificial Sequence
  Description of Artificial Sequence: Synthetic coding sequence
atgttccttctgcggaggtatgtgtgtatcttcactgaaaagttgaaaaatcaggccgaactatacgtattcctaagcgtcaaattcagcaattgcaatggaaaaagaaaggtccaatatgaatcgtctgaacctgccgacttcaaagtggatgaggatggaatggtttacgccgtccggtcattccctctgagctcagaacacgctaaattcctgatttatgcccaagacaaagagactcaggagaaatggcaggtggccgtcaagctgtcactgaagcccactttgacagaagaaagcgttaaagagagcgcggaagttgaggagattgtttttcccaggcaattcagtaaacattccggccatctccagcgtcagaaacgagattgggtgatccctcctatcaacttgccagaaaatagccgaggccctttccctcaggaactggtgagaattcgttccgacagagacaaaaatttatcccttcggtacagcgtgactggtccaggcgctgaccagcctccaacaggcatcttcatcatcaacccgatttccggacaattgagcgtgactaagccattagacagggagcagatcgcccgttttcatctgagggcccacgccgtcgacatcaacggcaatcaggtcgagaaccctatcgatatcgtgatcaatgtcatagatatgaatgataataggcctgagttcctacaccaggtttggaatgggacagtccctgagggatctaagcctggtacttacgtcatgactgttacagctatcgacgcggacgaccctaatgcattaaatggcatgctccggtaccgcattgtttcacaagcaccttccacccctagccctaatatgtttacaattaataatgagaccggggacataataaccgtagcagctgggctagatcgggagaaggtgcagcaatacactctgatcatccaggcaacagatatggaaggcaaccccacctatggcttgtccaacaccgccacagctgtcataactgttaccgacgtgaatgataatcccccagagttcaccgccatgacattctacggtgaggtgccagaaaaccgtgtcgatataatcgtggcgaacttaactgtaacagacaaggaccaaccacacactcccgcatggaatgctgtgtacaggatttccggaggggaccccactggaagattcgccatccagacagaccctaatagtaatgacgggctcgtgaccgtcgtaaagcccatcgacttcgaaaccaacagaatgttcgtgctcaccgtggcagcagagaaccaggtcccattggctaaagggattcagcacccaccacagtctaccgctaccgtctccgttactgtcatcgatgtcaatgaaaacccatacttcgcacctaatcctaaaattattcgacaggaggaaggccttcacgccggtaccatgttgacaacgttcacagcccaggacccagacagatacatgcagcagaacattaggtacaccaaattgagtgatcccgctaactggctaaagatcgatcccgtcaatggccaaatcaccaccatcgcagtgctggacagagaatctcctaacgtgaagaacaacatttataacgccacattcctggcatccgataatggaatcccacctatgagtggcaccggtactctgcagatttaccttttggatatcaacgacaatgcccctcaagtgttaccgcaggaagctgagacatgcgagactccagacccgaatagcataaacatcaccgctctggattacgacatagacccaaatgctgggccattcgcctttgatttacccttgagcccagtgaccatcaagcggaattggacaataacccggttgaatggcgatttcgcccaattaaaccttaaaattaaattcctggaagccggaatttatgaagtgccaattattatcacagacagcggtaaccccccaaagtctaatatatctatcctgagagtgaaggtttgtcaatgtgattccaatggcgattgcactgacgttgaccgaatcgtgggcgcaggcctgggcaccggcgctatcattgcgatcttgttgtgtatcattatcctgctcattctggtgctcatgttcgttgtttggatgaaaagaagagacaaggagcggcaagccaagcaactgctgattgatcctgaagacgatgtgcgtgataacatattgaaatacgacgaggagggcggtggtgaggaggatcaggattacgatctctctcagttgcagcagccagacaccgtcgagccagatgccatcaaacccgtcggcattcgtcgaatggacgaacggccaattcacgccgagccccagtacccagtcagaagtgccgctccccaccccggtgatatcggtgactttatcaacgaaggtctgaaagctgctgacaatgatcctacggcccctccttatgacagtctgctggttttcgactatgagggcagcggctcgacggctggtagtctgagcagtttaaactcgagcagcagcggcggagaacaggattacgactatctgaacgactggggaccccgattcaagaagctagccgatatgtatggcggtggcgacgattag

SEQ ID NO: 27675 - DNA, 2355 bp, Artificial Sequence
  Description of Artificial Sequence: Synthetic coding sequence
atgcaacggctgatgatgcttctggccacatccggagcgtgtctaggtctcttggccgttgcagccgttgcggcagccggagcgaatcccgcacagcgggacactcactcgctactgcccactcacagacgtcagaagagggactggatctggaaccagatgcatatagacgaggaaaagaataccagtttgccacatcacgtggggaagatcaaatcatccgtgtcccgcaagaacgccaagtatctgctgaaaggagagtacgtagggaaggttttccgtgtcgatgccgagactggtgatgtattcgccattgaaagattagatcgggaaaatatctccgagtaccacctgaccgccgttattgtagacaaggataccggtgaaaaccttgaaaccccgtcctcatttactattaaggtccacgatgtgaacgataattggccagtcttcacacatagactcttcaacgcttccgtacctgagtctagcgccgtgggcacgtcagttatttctgtcacagcggttgacgctgatgacccaactgtgggcgatcatgcctccgtaatgtatcagatactgaaaggcaaagagtacttcgctatagacaattccggcagaataatcaccattactaagtcactcgaccgtgaaaagcaggcaaggtatgagatcgttgtggaggctagagacgcacagggcctgcggggagacagcgggacggcaacagtgttagtgactctccaggatatcaatgacaacttccctttctttacacaaacaaaatacacctttgtggttccagaagacaccagggtaggcacttcagtcggcagcctctttgtcgaggatcccgatgagcctcagaaccgcatgacaaaatactcaatcttaaggggagattaccaggacgcgttcactatagaaaccaatcctgcgcataacgaggggatcattaagccaatgaaacccttggattacgaatacattcagcaatactcatttatagtcgaggcaaccgacccgacaattgatctgcgctatatgagccctcccgctgggaaccgggcacaagtgataatcaatatcaccgacgtcgatgagcctcctatatttcagcagcctttttaccacttccagctgaaggaaaatcaaaagaaaccactaatcgggaccgtgctggccatggacccagacgccgctcggcactcaatcggatactcgatcagacgcacatctgacaagggacaattttttcgggtaaccaaaaagggggatatctacaatgagaaggagcttgatagggaggtgtatccttggtacaatttaaccgtcgaggccaaagagcttgactcaactggaactccgactggaaaggagtctattgtgcaggtgcatatcgaggtgctggatgaaaacgataacgctccagagttcgccaaaccataccagccaaaagtctgcgaaaacgctgtgcatggtcagctggtgcttcaaatcagcgccatcgacaaggacattaccccccgaaatgttaagttcaagtttatcctgaacaccgagaataatttcaccctgacagataatcacgataacactgcaaatataaccgtgaagtatggtcagtttgatagagaacacacgaaggtccattttttgcccgtagtgatctccgacaatggtatgccaagcaggacaggaaccagcaccctcactgtcgccgtctgtaaatgtaatgaacagggggagttcaccttctgcgaggatatggccgcacaagtgggggtcagcatacaggctgtggttgccatcctcctctgcattctcaccatcacagtcatcacgctgctgatttttctgaggcgccgtttgagaaaacaggcacgggctcacggaaagagtgtgcccgagatccatgaacaactggtgacttacgatgaagagggaggaggtgaaatggacaccacgagctacgacgtgagcgtgctgaattccgtgcggaggggcggtgccaaaccaccacggcctgccctggacgctaggccatctctctatgcccaagttcaaaagccccctcggcacgctcctggagcacacggaggacccggtgaaatggccgctatgatcgaagtgaaaaaagatgaggccgaccacgacggagacggccctccttacgacacactccacatctacggctacgaaggctcagaaagcatagccgaaagcttgagctcgctggggactgacagcagtgattctgacgtggattatgacttcctaaatgattggggaccaaggttcaaaatgctggcagaattgtatgggagtgacccacgcgaagaactactgtactag

SEQ ID NO: 27676 - DNA, 2010 bp, Artificial Sequence
  Description of Artificial Sequence: Synthetic coding sequence
atgcagcggttaatgatgttactggcaacatccggagcgtgtctcggtctgctggccgtagcagctgttgctgcagctggtgccaaccctgcccaacgagacacgcactctctgcttccaactcataggcggcagaagcgcgattggatttggaaccagatgcacattgacgaggagaagaacacgagcctgccccaccatgtgggcaaaattaagtcgtcagtctcacggaaaaatgcgaaatacctcttgaagggggaatacgtgggaaaagtgtttcgcgtcgacgcagagacaggcgatgtttttgccattgaacggcttgacagagagaatatctccgagtaccacttgacagctgtgatagtcgacaaggatacgggggaaaatctggaaaccccctcatcgtttaccatcaaggtccatgatgtgaacgataattggccggtttttacacatcggctattcaacgcgtctgtcccagaatcaagcgcagttgggaccagcgtgataagcgtcaccgccgtcgatgccgatgaccccaccgtgggggaccacgccagcgttatgtatcaaattctgaaggggaaggagtactttgcaattgacaattccgggcgaattattactattaccaagtccctggatagggagaagcaagcccgttacgagattgtcgttgaagccagagatgcacaaggactgagaggagactccggtacagcgaccgtgcttgtcaccctgcaagatattaacgataacttcccatttttcacacaaacgaaatacacctttgttgttccagaggatacgcgcgtgggaacgtctgtcggctccctgtttgttgaagaccccgacgagccccagaaccggatgacgaagtattctattctgagaggcgactaccaggatgcttttactatagagactaaccccgcacacaacgagggcatcatcaaaccaatgaagccactggactatgagtatatccaacagtactcctttattgtcgaggcaactgatcccaccattgatttaaggtatatgtcccccccagccggtaaccgagctcaggttatcatcaatatcaccgatgtggacgaacccccaatctttcaacagcccttttaccatttccagctggtgctacagatttcagccatcgacaaagacattacaccacgcaatgtaaaattcaagttcattctgaatactgagaataattttacattaactgacaatcatgacaacaccgccaacattactgtaaagtacggccaatttgaccgcgagcataccaaagtccacttcctgccggtggtgatcagcgacaacggtatgccaagtaggacaggcacgtccacgcttactgtggcagtgtgtaaatgcaatgagcagggggaattcacattttgcgaggatatggccgctcaggtcggtgtgagcattcaggcagtagtagctatcctgctttgtatccttacaattacagtaattacgcttctcattttcctaaggagacgactgaggaagcaggcaagggcacacggaaaatccgtgccagagattcacgaacagctggttacctacgacgaggagggcggtggggagatggacacaacaagctacgatgtgagcgttttaaactctgtccggagagggggagccaaaccccctaggcccgctctggatgccaggcctagcctgtacgcccaggttcagaagcccccacggcatgctcctggagctcacggtggcccaggtgagatggccgcaatgattgaggtcaagaaggacgaagctgatcacgacggagatggccctccctacgatactctgcacatttacggctacgagggctcggaaagcatagcagagtctctgtcatccctcgggactgatagtagcgattcagacgtcgattatgattttctgaacgactggggacctcggttcaagatgctggcagaactgtatggctccgaccccagagaggagctcttatactag

SEQ ID NO: 27677 - DNA, 672 bp, Artificial Sequence
  Description of Artificial Sequence: Synthetic coding sequence
atgcctagcaggaccggcacctccacactgactgttgctgtgtgtaaatgcaacgaacagggggagttcactttttgcgaggatatggctgcccaggtcggcgtgtcaattcaagctgtagtggcaatactcctttgtatactgactattactgtaatcaccctgctgattttcctgagaaggaggctccggaaacaggcgagggcccacggcaagagcgtgcctgaaattcatgaacaactggtgacgtacgatgaggaaggtggcggagagatggatacaacctcctacgatgttagcgtcctgaactccgtccgacggggtggcgcaaagcctcctcggccagcattagacgcaaggccatccttatatgctcaggtccagaagccgcctcgacacgccccaggcgctcacggcggaccaggggaaatggccgctatgattgaagtgaagaaggacgaggcagaccatgatggtgacggacctccctacgatacgcttcacatttacggatacgagggcagcgaatccattgcggaatcactgagcagcctcggaacagacagctcagatagtgatgtcgattatgatttcctcaatgattggggaccaaggtttaaaatgctcgcagagttatacggctccgatccaagggaagagctgttatactag

SEQ ID NO: 27678 - DNA, 1578 bp, Artificial Sequence
  Description of Artificial Sequence: Synthetic coding sequence
atgccatcaacttgctcaaaggagaacatgtgggctagatccagcggttccatgcagcggcaggagacatgctcaccccttcgcgctcagaatagaatgacaaagtattccatcctacgcggtgattatcaggatgccttcacaatcgagacaaatcccgctcacaacgaaggtatcattaagcccatgaagccactggattacgagtatatccagcagtactctttcattgtggaggccacagatcccaccattgacctgaggtatatgtccccccctgcaggtaacagagcccaagtgattataaacataactgacgttgatgagccccctatcttccagcagcccttctatcatttccagcttaaggagaaccagaaaaaacccctcattggcaccgttctggccatggatcctgacgcagcccgacattctataggctatagcattagacgaaccagcgacaagggacagttttttcgggtgacaaagaaaggagacatttacaacgaaaaggagctggatcgggaggtctacccttggtataatttaacagtggaggccaaggaactggacagcacgggaacacccaccggtaaggaatccattgtgcaggtgcacattgaagtactcgacgagaatgataacgcccctgagttcgctaaaccatatcagcctaaggtctgtgaaaatgcagtacacggacaactagtactgcagatttcagccatcgacaaggacatcaccccaagaaatgtcaagttcaagtttattcttaacactgagaataattttacactcacggacaaccacgacaatacggcaaacattactgtgaaatatggccaattcgatagagaacacactaaagttcacttcctgcctgtcgttatttctgataatggtatgccctcccggactggaacaagtactttaactgtggcagtgtgcaagtgcaatgagcagggagaatttaccttctgcgaggacatggccgctcaggttggggtgtccattcaggcggtggtcgctattttactatgcattctaaccattaccgtgatcactttgctgatcttccttagacggagacttagaaaacaggcgagagcacacggcaagagcgtgcctgagattcatgagcagcttgtaacctatgacgaggaggggggaggggaaatggacaccacctcctatgatgtgtctgtattgaattccgtcaggaggggtggggctaaacctcctcgccctgctcttgatgcacgtcccagtctgtatgcacaggtacagaaaccgcctagacatgcgcctggcgctcatggagggcctggggagatggccgctatgatcgaggtgaagaaggacgaggccgaccacgacggcgacgggccaccatacgacactctccacatctatggttatgagggctccgagtctattgccgagtccctcagctcattgggaacagatagcagtgacagcgacgtggattatgattttttaaatgactggggccctagatttaagatgttagccgagttatatggatcggatcccagggaggagctgctctactag

SEQ ID NO: 27679 - DNA, 2373 bp, Artificial Sequence
  Description of Artificial Sequence: Synthetic coding sequence
atgcgcacttatcggtattttctgctgttattttgggtaggacagccttaccctactctgtcgacacccctgtccaagcgtacatccgggttccccgctaagaaaagagcattggagctgtctggaaatagtaagaatgagctcaatcgatccaaaagaagttggatgtggaaccagttcttcctgctcgaggagtatactgggtcggactatcagtatgtaggaaagctgcatagtgatcaagataggggtgacgggagtcttaagtacatattgagtggcgatggcgctggagaccttttcattattaatgagaacacgggcgacattcaagccaccaaacgactggatagggaagaaaagccggtgtacattttgagagcacaggcgatcaacagaagaactggcaggccagtggaacctgaatcagaatttatcataaagatacacgatatcaatgacaacgaacccatattcaccaaagaggtatacactgcaaccgttccggaaatgtcagacgtggggacattcgtggtgcaagtgactgccaccgatgcagatgacccgacctatggaaacagtgccaaagttgtatactccatcttacaaggccagccctacttctctgtagagtcagaaaccgggatcatcaagacagctctcctcaacatggatcgagaaaaccgtgagcaatatcaggtggtgatacaggccaaggatatgggcggacaaatgggaggactcagcggtaccactaccgtcaatattaccctcaccgacgtcaatgataaccctccgaggtttcctcagtcaacgtaccagtttaagacccccgagtccagcccgccaggaacccccattggcagaatcaaagcatccgacgcggatgtgggagagaatgccgagatcgagtactccattacagacggggaaggactcgatatgtttgatgttatcactgatcaggagactcaagaaggcatcatcaccgttaagaagcttctggattttgaaaagaaaaaggtatacaccctcaaggtggaggcttccaacccatacgtggagccccgtttcctgtatcttggacctttcaaagactccgctacggtcagaatcgtggttgaggatgtcgatgaacctcctgttttcagcaaactggcctacattctgcagatccgggaggacgcgcaaattaacacaacaattggaagtgtcacagctcaggatcccgatgcagctcggaatccagtgaagtatagcgtggatcggcacacagacatggaccgaatattcaatatcgattccggtaatggatctatttttacctccaagctcctagatagagagactcttctttggcacaacattacagtcatagccaccgaaatcaacaacccaaagcaaagttcccgcgttcctctgtatattaaagtcctggacgtcaatgacaatgccccagagttcgccgagttctacgagacttttgtctgcgagaaagctaaggccgaccagctgatacagactcttcatgccgtggataaagatgacccttattctgggcaccagttctcattttcattagcccctgaggccgcaagcggctcaaacttcacgatccaggacaacaaggataatactgccggaatccttactcgtaaaaatggctacaaccggcatgaaatgtctacatacttattgcccgtggttatatcagataatgactatccagttcaaagttccaccggcactgtgaccgtgagagtttgtgcatgcgatcaccatggcaatatgcagagctgtcacgctgaggctctgatacaccctaccgggttgtctactggtgctctggttgctattttgctatgcattgtcattctattagtgactgtggtcctttttgctgctctccggaggcagcgcaagaaggaaccactcataatttccaaagaagacattcgcgataacattgtgtcctacaatgatgaaggagggggagaggaagatacccaggctttcgatattggtacactgcgtaatcctgaggctattgaagataacaaactgaggagggacattgtgccggaagctctgttcctgccccgaaggaccccaactgccagagataatacggacgtgcgagattttattaatcagagacttaaggaaaatgatacagaccccaccgctcccccttacgactcgctagcaacatatgcctacgagggcaccggttccgtggcggacagccttagctccttagaatccgtcactaccgacgccgaccaagactatgactacctgtccgactgggggcctaggttcaagaaactagcggacatgtacggtggcgtggactccgacaaggatagctag

SEQ ID NO: 27680 - DNA, 576 bp, Artificial Sequence
  Description of Artificial Sequence: Synthetic coding sequence
atgggtggaagcggaagccgactcagcaaggagctcctcgcagagtaccaggatctgacctttttaacaaagcaggaaatattactcgctcatagaaggttctgtgaactccttcctcaggagcagcgctcagttgaatcaagcttgcgcgcacaggtgcccttcgaacagatcctatctctgcctgagctgaaggcgaatccatttaaagagagaatctgcagggtcttttccactagccccgctaaggattcactgtccttcgaggactttcttgacctgctctcggttttttctgacacggcgacacccgacatcaagtctcactatgctttccggatttttgattttgatgacgacggtacgctgaaccgagaggatctgagccggctcgttaattgcttgactggagaaggcgaggacacacgtttatctgcatccgagatgaagcagctaattgacaacatcctcgaagagagcgatatcgacagagacgggaccattaacctttccgaatttcagcacgtgattagccgcagcccagacttcgcatccagctttaaaatcgttttgtag

SEQ ID NO: 27681 - DNA, 237 bp, Artificial Sequence
  Description of Artificial Sequence: Synthetic coding sequence
atgagcgaagtgctgccctacggggatgaaaagctgagtccctatggcgacggcggagacgtgggccagatattctcctgccgccttcaggatacaaacaattttttcggcgcaggccagaacaagcgcccaccaaagctgggacagattggtcgatctaaaagagtggtgatagaagacgatcgaattgacgatgttctcaaaaacatgaccgataaggcccctcccggagtgtag

SEQ ID NO: 27682 - DNA, 1563 bp, Artificial Sequence
  Description of Artificial Sequence: Synthetic coding sequence
atggagggcggacccgcagtgtgctgtcaagaccccagagccgaactagtggaacgagtggccgcaattgatgtaacccatttggaagaagctgacggaggcccagaacccacacggaatggggtggatccccctccacgagccagagccgcaagtgtcataccaggcagtacttcacgactcctccctgccagaccttccttgtccgctcggaagctgagtctgcaggaacggccagccggttcctacctcgaggcacaggcaggcccatacgctacgggacccgcttctcatataagccccagagcctggcggagacctacaatcgaatcccatcacgtagcaatcagcgatgccgaggactgcgtacaacttaatcaatacaagttgcagagcgagatagggaaaggcgcttacggcgttgtgcgcctggcttacaacgaaagtgaggatagacactacgccatgaaggtcctttcaaaaaagaagttactcaagcagtatgggtttccgagacgaccccctccaaggggaagtcaggctgcccagggcggaccagcaaaacagctgctgccattggagcgagtgtatcaagagattgcaatcttgaaaaagctagaccacgtaaatgtggtgaaactcatcgaggtgctggacgacccagccgaggacaacctctacctcgcactccagaatcaagctcagaacatccagttggatagcacaaacatcgccaaaccccacagcttgctgccatccgaacaacaggacagtggctctacctgggccgcacggtctgtgtttgatctgttgcgtaagggaccagtaatggaggtgccttgtgacaagccattctccgaagaacaggctcgcctgtaccttcgggatgtcatcctcggactggagtatctgcactgccaaaagatcgtacatagggacatcaagccctcaaatctattgcttggcgacgacggccacgtgaagatcgccgactttggggtgagcaatcagtttgaaggaaatgacgcccagctgtcctccaccgcaggaacgcctgctttcatggcgcctgaagcgatcagtgattctggccaatctttttccgggaaggcgcttgatgtttgggccacaggcgtcaccctatactgtttcgtgtatggaaagtgtccgttcattgacgatttcattctggctctacaccgtaagatcaagaacgaacccgttgtttttccggaagagcctgagatctcagaggaactaaaggatctcatcctcaaaatgttggataaaaaccctgagacccgtatcggggttcccgacatcaagctgcatccttgggtcacaaaaaatggagaggaacctctgccctctgaggaagaacactgcagtgttgtggaggtgaccgaggaagaggtaaagaacagtgtgagactgattccaagctggactacagtgatcctggtgaagtcaatgctcaggaaaagaagcttcggtaatccatttgaaccacaagccaggagggaagagaggagcatgagtgcacccggaaatctgctcgtgtag

SEQ ID NO: 27683 - DNA, 1518 bp, Artificial Sequence
  Description of Artificial Sequence: Synthetic coding sequence
atggagggcggacccgcagtttgttgccaggacccacgagcggagttagtggagcgcgtcgccgctattgatgtgacgcacttggaagaagctgacggaggccctgaacccactcgcaacggcgtggacccccctccccgagctcgcgctgctagcgtaataccaggtagcacatctagactgcttcccgcacgccctagcctgagcgcccgaaagctgagcctgcaggaaaggcctgccggatcctacttagaggcgcaggccggtccctatgcaacaggccctgcttcacacatctcacctagggcctggagacgacctacaatcgaaagccatcacgtcgctattagcgacgctgaggactgtgttcagctgaaccagtacaagttacagtcagaaatcggaaaaggcgcatatggggttgtaaggctggcatataacgagagcgaagatcgtcattacgccatgaaagtgctgtccaagaagaagctcctgaaacaatacggctttcctcggcgaccaccccctcgaggcagccaagcagcacaggggggacctgccaagcagttactcccactcgagagagtctatcaggaaatcgccatccttaagaagttggatcatgtgaatgttgttaagctaattgaggtgctggacgatcctgctgaggacaacctgtatctggtgtttgacctgctgcgaaagggccctgtgatggaggttccatgcgacaaacctttcagcgaggaacaggccaggctctatctcagggacgtgattttgggacttgaatacctgcattgccaaaagatcgtgcatagggacattaaaccgtcaaatttactcctgggagatgatggacacgtaaaaatcgctgattttggcgtgtcaaaccagttcgagggaaacgacgcccaactgagctccacagccggaacccccgcttttatggcgccagaggccatatccgatagcgggcaatcttttagcggcaaagcactggatgtctgggctactggcgtgacattatactgcttcgtttacggtaagtgcccctttatcgatgacttcatcctcgccctacacaggaagatcaagaacgaacctgtggtctttcctgaggagccagagatttcagaagagctgaaagacctcattttgaagatgctcgataagaatcctgagaccagaatcggcgtgccagacatcaaactgcacccgtgggttacgaagaatggtgaagagcctctcccaagcgaggaagaacactgcagcgtggtagaagtcacagaggaggaggtgaagaattcggttcgcttgataccctcctggaccactgtgatactggttaagtctatgctgaggaagagatcatttggaaacccatttgaaccccaggcgaggcgggaggagaggtccatgagcgcccctggcaatctgctggtcaaagaaggatttggggaagggggtaaatcccccgagctgcctggagtccaagaagatgaggctgcgagctag

SEQ ID NO: 27684 - DNA, 1599 bp, Artificial Sequence
  Description of Artificial Sequence: Synthetic coding sequence
atgcagtttggtaagctatggtgcggctgcagtggcgaatttccaacacgtctgcgtcggagaactccactgacagaggccatggaaggtggacctgctgtttgttgccaggatcctagagccgagctggtagaacgagtcgcagccattgatgtgacccacctggaggaggccgacgggggaccagagccaacaaggaacggagtggatccaccccctagggcccgagccgcttccgttataccgggaagcacatcgaggctgttgcccgcacggccatcgttgagtgctaggaaactgtctctgcaagaacgaccggcaggttcatatctcgaagctcaggccggaccttatgccaccggcccagccagtcacatttcccctcgtgcctggagaaggccaacaatagaaagtcatcatgtggcaatatccgatgccgaggattgcgtccaactcaatcagtacaagcttcagtccgagatcgggaaaggtgcatatggcgtggttcgcctggcctacaacgagtccgaagaccgacattatgcaatgaaagtgctgtcgaaaaaaaagctcttaaagcaatacggctttccacgtagaccaccacccagaggctcccaggcagcgcagggtgggccagcaaagcagctgttacctttagagcgagtctatcaggagatcgccattctcaaaaagctagatcacgtgaatgtcgttaaactgatcgaagtccttgatgacccggcagaggacaatctgtacctcgtgtttgaccttctgcggaagggaccagtgatggaggtgccatgcgacaagccattcagtgaggagcaggccagactctacctgagagatgtgatattgggactggaatatctgcactgtcagaaaatcgtccatcgagacatcaagccctcaaatttgttactgggcgacgacggccacgtaaagatcgcagattttggagtctcaaatcagtttgaaggaaatgacgcccagctgtcgagcactgctggtaccccagcattcatggctcccgaagccatttccgattctggacagtcattctccggcaaggcgctcgatgtttgggccactggcgtgaccttgtattgcttcgtatacggcaaatgcccattcatcgatgacttcatactcgcactgcacaggaaaataaaaaatgaaccggtggtcttccctgaagagcccgagatcagcgaggagctgaaagatctgatactgaagatgctcgacaagaaccccgagactaggattggcgtgcctgatattaagttacacccatgggttaccaagaacggtgaagaacctttacctagtgaagaagaacattgttctgtggttgaggttaccgaggaagaggtaaaaaattccgttcgtttgattccttcttggacaacagtgattctagtgaaatctatgctgagaaagcgttcattcgggaatcctttcgaacctcaagccaggcgcgaagagagatcaatgtcagctcccggtaatctcctggtcaaggaggggttcggggaggggggtaaatccccggaactccccggagtgcaggaggacgaggcggctagctag

SEQ ID NO: 27685 - DNA, 1632 bp, Artificial Sequence
  Description of Artificial Sequence: Synthetic coding sequence
atggaggggggacctgccgtgtgctgccaagacccccgagcagagctggtggagagggtggctgccattgacgtgacccatctggaggaagctgacggaggtccggagccaacccgcaacggagtggatcctccccctagggctcgcgctgcaagcgtgatccccggatcaacctcgcgcctgctgcctgctcggccatcattgtccgctaggaagttatctttgcaagaacggcctgccggttcatacttagaggcccaggccggaccttacgcgacaggaccagcctctcacataagtcccagagcctggcgcaggccgaccatcgagagccaccacgtggccatcagtgatgccgaggactgcgtccagctgaatcaatacaagctccaatcagagattggaaagggggcatacggagtggtacgcttggcctacaacgaatccgaggaccgccactacgcaatgaaagttctttccaagaagaaactgctgaagcagtacgggttccctcgtcgccctcctccgagaggatcccaggccgcacaaggaggtcctgcaaaacagcttctgcctctggagagagtctatcaggaaatcgcgattctgaaaaaactcgatcatgtgaacgtggttaagctaattgaagtactcgatgaccccgcagaagacaatttgtacttggcactgcaaaaccaagcgcagaatattcagttagacagcactaatattgcaaaaccacatagtctgctgccgagcgaacaacaagattcagggtctacatgggccgctagatctgttttcgacctgctgcgcaaaggacccgttatggaggtaccatgcgataagccattcagcgaggaacaggcccgactttacctgcgcgacgtgatcttggggctggaatatttgcactgtcagaaaatcgttcaccgagacatcaagccgtcaaacctgctgcttggcgacgatggccacgtgaagattgccgattttggtgtcagcaaccagttcgagggaaatgatgcacagttgtccagtactgcgggaactccagctttcatggctccagaggctatcagcgacagtggacagtctttttcaggtaaggcgctcgacgtgtgggcaaccggggtgactctgtattgcttcgtttacgggaagtgcccctttatcgatgatttcatactcgcccttcataggaagatcaagaatgaaccagtagtgttcccagaggagcctgaaatctcagaagagctgaaggacttgattttgaaaatgctagataaaaatccggagacccgtattggagtcccggatatcaaactgcacccttgggtgacgaaaaacggcgaagagccgctgccgagcgaggaagagcactgttccgtggtggaagtcactgaggaggaagtcaagaacagcgtccgcctcatccctagctggaccaccgtaatccttgtaaagtccatgcttcgaaagcgctcctttgggaatccgttcgaacctcaggcacgcagggaggagcgaagcatgtccgcccctggaaacctgcttgtaaaggagggctttggcgagggcggtaaaagtccagagctccccggagtccaggaagatgaggccgcttcatag

SEQ ID NO: 27686 - DNA, 1695 bp, Artificial Sequence
  Description of Artificial Sequence: Synthetic coding sequence
atggatgatttcgagagacgtagagaactgaggaggcagaaacgggaggaaatgaggctcgaagccgagaggatcgcttaccagcggaacgatgatgatgaggaggaagcagctagggagcggaggaggcgggcaaggcaggaacgactgcgccagaaacaggaagaggagagcctcggccaagtgacagatcaagtggaagtcaatgcccaaaacagcgttcctgacgaggaggcgaagactactaccactaatacgcaggtggagggggacgacgaagccgcattcctggagaggctggcgcgacgcgaggagcggcgtcaaaagcggttacaggaggcactggagcggcagaaggaatttgatcccaccatcaccgacgcatcacttagcctgccctccaggagaatgcagaacgataccgccgagaacgagaccacagaaaaggaagaaaagagtgagtccagacaggaacggtacgaaatcgaggaaacagaaacagtaacgaaatcttaccagaagaacgactggcgggacgcagaagagaataaaaaggaagataaggagaaagaagaggaggaggaggaaaaacccaagcggggtagcatcggagagaaccagggcgaggaaaaaggcaccaaagtgcaggcgaagcgcgagaagctgcaggaggacaaacccacatttaagaaagaggagataaaagatgagaagatcaaaaaggacaaggaacccaaggaggaggttaaatccttcatggatcgtaaaaaaggcttcaccgaggtgaagtcgcaaaatggcgaattcatgactcataagctgaagcacacagagaacactttctcacgtcctggcggtagagcaagtgttgatactaaggaagcagagggcgctcctcaagtggaggccggtaagcgacttgaagagctgcgcagacgacggggagaaacagaaagtgaagagttcgagaaactcaaacagaagcagcaggaggccgcacttgagctggaggagctcaagaaaaagagggaagagagaagaaaagtgctagaggaggaggaacagcgccgaaagcaggaagaagccgataggaaacttagggaggaagaggagaagcggcgtttgaaggaggaaatcgaacgcagaagagccgaggctgccgagaagcgccagaaaatgccagaagacggccttagcgatgacaaaaaaccgtttaagtgcttcacacccaagggatctagcctgaagatcgaagaacgtgcagagtttctgaacaaaagcgtgcagaagtcctcaggcgttaagtctacgcaccaggctgctatagtgtctaaaattgactcacgtctggagcagtatacctcggcaattgagggaacaaagtctgctaagcctactaagcctgccgcatctgatctgccagtgccagcagaaggcgtgaggaatatcaagtcaatgtgggagaaaggaaacgtgtttagcagccccaccgcagctgggacaccaaataaggaaacggccggtctgaaggtgggggttagctcccggataaatgagtggctcaccaagactccagacgggaacaagagtcccgctcccaagccctcagatctacgccctggcgatgtgtctagcaagcggaacctgtgggagaagcaaagtgtagacaaggtcacttcccctactaaggtctag

SEQ ID NO: 27687 - DNA, 2382 bp, Artificial Sequence
  Description of Artificial Sequence: Synthetic coding sequence
atggatgacttcgagcgcaggagggagctacggagacagaaacgggaggaaatgcgactagaggcggaacggatagcttaccagaggaatgacgatgacgaggaggaagccgcaagggagaggcggagaagagcacgacaagagcggttgaggcagaagcaggaggaagagagtctgggccaggtaacagaccaggtcgaggtcaatgcacagaacagcgtaccggacgaggaagccaaaactactacaacaaacacacaggttgagggtgacgatgaggccgcattcctggagagactggctaggagggaggagaggaggcagaaacggcttcaggaggccctagagagacaaaaagagttcgatcctaccatcacggatgcctcgctatccctgccctctcgtaggatgcagaacgacacagcagagaacgaaaccacggaaaaagaggagaaatccgagtccaggcaagagaggtacgaaatcgaagagactgaaaccgtaacgaaatcttaccagaagaacgactggagagatgcagaagaaaacaagaaggaagacaaagagaaagaagaggaggaggaagagaagccgaagcgcggatcgattggcgagaaccaggtcgaggttatggtggaggaaaagaccacagagagccaggaagagacggttgtaatgtcactgaaaaatgggcagatctcttctgaggagcccaagcaggaggaggaaagagaacagggttcggatgagattagccatcacgaaaaaatggaggaagaagataaagagcgtgccgaggctgagagagcgaggctggaggctgaagagcgcgagagaatcaaggcagaacaggacaagaagattgctgacgaaagagccaggatcgaagccgaagagaaggcagctgcccaagagagggaaagaagagaagccgaggaacgcgagcgcatgcgcgaggaggaaaaaagggcggctgaggaaagacagcgcataaaggaggaggagaagcgggcagctgaagagcgccaaagaatcaaggaggaggagaaaagagcagctgaggaacgtcagcgaatcaaagaagaagagaaacgcgcagcagaggaacggcagcgagctcgtgccgaggaagaagaaaaggctaaggtggaggaacagaagagaaacaagcagctggaagagaagaagcatgctatgcaggagacaaagattaagggtgagaaggtagagcagaagattgaaggaaaatgggtgaatgagaagaaagcccaagaggacaagctgcagacggccgtattgaaaaaacagggtgaagagaagggtacaaaagtccaggccaagcgggagaaactccaggaggacaaacctaccttcaagaaggaagaaatcaaggacgagaaaattaagaaagacaaagaaccaaaggaggaagtcaagagtttcatggatagaaaaaagggattcacagaagttaaaagccagaatggggaatttatgactcataagctgaaacacacagagaacacatttagtaggcccggaggacgagccagcgttgacactaaggaagctgagggggcaccgcaggttgaagccggtaagcgactcgaagagctgcgcagaaggagaggggaaactgagtccgaggaatttgagaaactcaaacagaagcagcaggaagctgctttggaattggaggagctcaagaagaaaagggaagagagacgcaaggtgctggaggaggaggagcagcgcagaaagcaggaggaggccgacagaaaactgcgggaagaggaagagaaaagacgcctgaaggaggaaatagagcggcgacgtgcagaagctgccgaaaaacgccagaagatgcctgaggatgggctaagcgatgacaagaagccattcaagtgcttcacacctaaggggtcttccctgaagatcgaagaaagagcggagttcctgaacaagagcgtccagaagagcagcggagtaaagtccacacatcaggcagccattgtgtctaagatcgactcgcgactggagcagtacacctctgctattgaaggaactaagagcgctaagccaacaaagcccgctgcatcagacctgcccgtacccgctgagggagtgcgcaacattaagagcatgtgggagaaggggaatgtgtttagtagcccgaccgccgctggtactccaaataaagagaccgctgggctgaaagtgggagtgagcagccggatcaatgagtggctcacgaagactcctgacgggaataagagccccgcaccaaagccaagtgacctgagacccggtgacgtctcatccaagcggaacctgtgggaaaagcaatctgtggacaaggtaacaagtcccaccaaagtgtag

SEQ ID NO: 27688 - DNA, 1617 bp, Artificial Sequence
  Description of Artificial Sequence: Synthetic coding sequence
atggatgattttgagcgccgtcgtgagttacgtcggcagaagagagaagagatgcggctggaagcagaaagaattgcgtaccaacgcaatgatgatgacgaggaggaagcagctcgtgaacgacgcaggagagccaggcaggagcgtctccgccagaaacaggaagaggaatcactggggcaggtgaccgatcaggtggaggtaaatgcccagaattcagtccccgacgaggaggcaaagacaacgacaacaaacacccaggtagagggggatgacgaggcagcttttctggagagactggctaggcgagaggaacgacgccagaaacggctgcaggaggccctggagaggcagaaagaatttgacccaacaataactgatgccagcctgagccttcccagcaggagaatgcagaacgacacagcagagaacgaaactaccgagaaagaagagaaatctgagagtcgtcaggaaagatacgagatcgaggaaaccgaaaccgttactaagtcataccaaaagaacgattggagagatgctgaagaaaacaagaaggaggataaagaaaaggaagaagaggaagaagaaaagccaaagagaggctccattggagaaaaccagatcaaagatgagaagattaaaaaagacaaagagcctaaggaggaagttaagagctttatggaccgcaaaaagggattcaccgaggttaaatcgcagaatggggaattcatgacacacaaactgaaacacacagagaatactttctcccgacccggaggcagagcgtctgtggacaccaaggaggccgagggcgctccgcaggtcgaggcaggaaagagactggaagagctgcggcgacgcagaggcgagacagaatccgaggaatttgagaaactgaagcaaaaacagcaagaagccgcattggagctggaggagctgaaaaaaaagagagaggaacgccgaaaggtgctggaagaggaggagcagcggagaaaacaggaggaggccgaccgcaaactccgcgaagaggaggagaagcgtagactgaaggaggagatcgagcgccgaagggctgaggctgcagaaaagcgacagaagatgcctgaggatggtctcagtgacgacaagaaaccctttaagtgtttcactcctaaaggttcttccctgaagatcgaagagcgggctgaatttctgaataaatccgtccagaaatcatctggcgtgaaaagtactcatcaggccgcaattgtgtccaagatcgatagcagactggaacagtatacatctgcaatcgaaggcaccaaaagtgccaaacctacaaaacccgctgccagtgatctaccagtgccagcggagggagtgcgcaacattaaatcaatgtgggagaaaggcaacgtgttcagtagcccgaccgcagcgggaactccaaacaaagaaaccgccggtttgaaagtgggtgtatcctcgagaatcaatgagtggttgaccaagactcctgacggaaataaatctcccgcaccaaaaccatctgacctgcgccctggtgacgtgtcctccaagcggaacttatgggagaaacaatcagttgataaggtgacatccccgaccaaggtgtag

SEQ ID NO: 27689 - DNA, 1677 bp, Artificial Sequence
  Description of Artificial Sequence: Synthetic coding sequence
atgctgggagggtccggatcacacggacgacgttcactcgccgcactttcccaaatcgcttatcagcggaacgacgatgatgaagaggaggccgcacgggagcgcagacgacgagcgcgacaggaaaggcttagacagaaacaggaggaggagagcctgggccaggtgactgaccaggtggaggttaacgcgcagaattccgtgcccgatgaggaagcgaagacaaccacaactaacacccaggtggaaggggacgatgaggcggctttcttagagaggctggctagacgcgaggagcggaggcaaaaacgcttacaggaagcattggaaaggcagaaagaattcgaccccaccattactgatgccagtctgtcactgccttcccgcaggatgcaaaacgataccgctgagaatgagaccacagaaaaagaggagaagtccgaatccaggcaagaaagatatgaaatcgaggaaaccgaaaccgtaacgaaaagttaccaaaagaacgattggcgcgatgctgaagaaaataaaaaggaggacaaggaaaaagaagaggaagaggaggagaaacctaaaaggggtagtatcggtgaaaaccagggcgaagagaaagggacaaaggtccaggcgaaaagagagaagctgcaggaggataaaccaacatttaaaaaagaggaaataaaggatgaaaagatcaaaaaagataaagaaccaaaagaagaggtcaagagctttatggataggaagaaaggatttaccgaggtaaaatcccaaaatggagagttcatgactcataagcttaagcacacagaaaataccttctccaggcctgggggacgcgcatccgtggataccaaggaagccgagggagctccgcaagtcgaggctggtaaaaggctggaggagctgagacggcgtcgcggagagactgaatcagaggaatttgaaaagctcaaacaaaagcagcaagaggcagcccttgagttggaggagctgaagaaaaagcgtgaggagcggagaaaagtgctcgaagaggaagaacagagacgcaagcaagaagaggccgaccgcaagctgcgggaggaggaagaaaagaggcgactgaaggaggaaatcgagcggcgaagagccgaagcggctgagaagcgacagaagatgcctgaggacggcctctcagacgacaagaagccattcaaatgttttacacctaaaggaagtagtttaaagatcgaggagcgagccgagtttctcaataaaagtgtgcagaaaagtagcggggtgaaaagtactcaccaagcggcaatagtgtcaaagatcgatagtcgccttgaacaatacacatccgccatcgagggcaccaaaagcgccaagcctaccaagcccgctgcatccgacctccccgttccagcagagggtgtgcgaaatatcaaatccatgtgggagaaggggaatgtgttctcctcccctacagcagccggaacaccaaataaggagacagctgggctcaaggtaggggtctcgagtaggatcaacgagtggctcaccaaaactcctgatggtaacaagtcccccgctcccaagccttctgatctaaggcctggggatgtgtcgtctaagagaaacctgtgggaaaagcagtctgtagataaagtgacctccccgaccaaggtgtag

SEQ ID NO: 27690 - DNA, 1617 bp, Artificial Sequence
  Description of Artificial Sequence: Synthetic coding sequence
atggatgatttcgaacgacgacgagaactgcgaaggcagaagagggaagagatgcgtttggaggccgagagaatcgcctatcaacgcaatgacgacgatgaagaggaagctgccagagagcgtcgcagacgggctaggcaggagaggctgagacagaaacaggaggaagagtcactgggacaggtgacagatcaggtggaggtcaatgcccagaattcagtccctgacgaggaggccaagacaacaacgaccaacacccaggtagaaggagatgacgaagcagcctttctggagagactggctcgtcgcgaagaaagacggcaaaaaaggcttcaggaagcgctggaacggcagaaggagtttgacccgaccatcacagatgcaagcctcagcctgcccagccgccgaatgcaaaacgacaccgctgaaaacgagaccaccgagaaggaagagaagtctgaatcacgccaggaaagatacgaaattgaggagacagagaccgtcacaaaaagttaccagaagaatgattggagggacgctgaggagaacaagaaagaagataaagagaaggaggaggaggaggaggagaaacccaagcgtggctctattggcgagaaccagattaaagatgaaaagattaagaaagacaaggagcccaaggaagaggtcaaatctttcatggataggaagaaaggcttcactgaagtaaaatcccagaatggagagtttatgacacataaactcaaacatacagaaaacacattcagcagaccaggtggacgtgcctccgtggacacgaaggaagccgagggggctccacaagtagaggctggcaagaggctggaggagctgaggcggcgtcgaggcgagactgagtcagaagagttcgagaaactaaagcagaagcaacaggaggccgctctggagctggaggagctcaagaaaaaaagagaagagagaaggaaagttttggaagaagaggagcagcggcgtaagcaggaagaggccgatcgcaagttgcgagaggaggaggagaagcggaggctgaaggaagagatcgaaagaagacgagccgaagcagctgagaaacgccagaagatgcctgaagatggattaagcgacgacaaaaagccctttaagtgcttcacccccaagggcagctctctgaagatagaggaaagggccgaattccttaacaagagcgtgcagaagagctcaggcgtgaaatcaacccaccaggctgccatcgtgtccaagatcgattctaggctcgagcagtacacttccgcgattgagggcacaaagagcgccaagccaactaaacctgccgcaagtgacctgccagttcctgcagagggcgtccgtaacattaagagtatgtgggaaaaagggaatgtgttctcgagtcctacagcggcaggtaccccaaacaaagaaaccgccggtttgaaagtgggggtgtccagtcgcattaacgagtggcttactaagacccccgacgggaacaagtcaccagcacccaagccttctgacttgcgccctggagacgtttcaagcaagagaaatctgtgggagaagcagagcgtcgataaagtgacttctcccaccaaggtgtag

SEQ ID NO: 27691 - DNA, 1692 bp, Artificial Sequence
  Description of Artificial Sequence: Synthetic coding sequence
atggatgactttgagagaagacgagagctacgccgacagaagcgcgaggagatgaggctggaagctgaaaggattgcataccagcgcaacgatgatgatgaggaggaggccgcaagggagaggcgcagacgcgctagacaagagagactcagacagaagcaggaggaagaatctctcggccaagtgacggaccaggtggaggttaatgctcagaattctgtaccggatgaagaagccaagacgaccactactaacacacaagtcgagggagacgatgaagctgctttcctggagaggctggcgcgacgagaggaacgccgacaaaagcgcctccaagaggctctggagcgacagaaggagtttgaccccacaatcacagatgcctctctgagtctgcccagtaggcggatgcagaacgacacagcagaaaacgagaccactgagaaggaagagaagtctgagagcagacaagagcggtacgaaattgaggagacggagacagtaactaaaagctatcagaaaaatgattggagagacgcggaggagaacaagaaggaagacaaggagaaagaagaagaggaagaggaaaagccgaaacggggatctattggggaaaatcaaggggaagagaaaggtacgaaagtgcaggcaaagagagaaaagctccaggaagacaagcctacttttaagaaagaagaaattaaggatgagaaaatcaagaaggataaggaacctaaagaagaggtgaagtctttcatggatcggaagaaagggtttactgaagttaagagtcaaaacggggagttcatgacacataagcttaagcatacagagaacaccttctcaagaccaggcggtagagccagcgtggatactaaggaggccgaaggcgcaccgcaggtggaagcaggtaagagactcgaggagctgagaagacggagaggagaaaccgaatcagaagagtttgaaaagcttaaacagaagcagcaggaagctgccttagaacttgaggaattgaaaaagaaacgggaagagcggaggaaggtgcttgaagaagaagagcagcgacgcaagcaggaagaagctgatcgcaaattacgagaggaagaggaaaaaaggcgcctgaaggaagaaatcgagcggaggagggctgaggctgctgaaaagcgacaaaagatgcccgaggacggactaagcgacgacaaaaaaccgtttaagtgcttcaccccgaaaggctcctcattgaagatagaggagcgtgctgagtttttaaacaaatcagtgcagaagtcaggcgtgaagtctactcaccaggcagcgatcgtaagtaagatagattctcgcctggagcagtacactagtgctattgagggtacgaagagcgccaagccaactaagccagcagccagcgacctgcctgttcccgcagagggcgtgcggaatataaagtctatgtgggaaaaaggcaacgtcttctcttccccaaccgcggcaggtacccccaataaggagacagcaggcttgaaggtgggtgtgagctctcggatcaacgagtggctgactaagacaccagatgggaacaaatctccagctcctaaaccctccgatctaaggccaggagatgtgtcatcaaaacgcaacctgtgggagaaacaaagcgttgataaggtaacatctcctacaaaagtttag

SEQ ID NO: 27692 - DNA, 1599 bp, Artificial Sequence
  Description of Artificial Sequence: Synthetic coding sequence
atgctcggaggttctggatcacatggcaggcggagcctcgccgctctttctcagatcgcctaccaacggaacgatgacgacgaggaggaggcggcacgcgaaagacgacgcagagctagacaggaaaggctacggcagaagcaggaggaggaaagcctcggtcaggttactgaccaggtcgaggtgaacgcgcagaattcagtccctgatgaagaagccaagaccacaaccacaaatactcaggttgagggggacgacgaagctgcattcctggagcgccttgcgaggagagaagaacggaggcagaaacggttacaggaagctctggagcgccagaaggaatttgatcctacaatcacggatgcttccttatccctgccctcccgacgcatgcagaacgacacagcagaaaacgaaactaccgaaaaggaggagaaaagcgaatctcgtcaggagcggtatgaaatcgaagagaccgagacagtgaccaaaagctaccagaagaatgattggcgggatgctgaggagaacaagaaagaggacaaggagaaagaggaggaagaggaagaaaaaccaaagagaggttccattggtgaaaaccagattaaggacgagaagatcaagaaagacaaggagccaaaagaggaagtgaaatcttttatggaccgaaaaaaggggttcacggaggtcaagtcccagaatggggagtttatgacgcacaaactcaagcacacggaaaataccttctctagacctggtggtcgcgcaagcgtggacacgaaagaagctgaaggtgcccctcaagttgaggccggaaaacgcctggaggagcttcgaaggcgccgtggcgagactgaaagcgaagagtttgaaaagctaaaacagaaacaacaggaggccgctctcgagctggaagagcttaaaaagaaaagggaagagaggcgtaaggtgctggaggaggaagaacagcgacggaaacaggaagaggcagacagaaagctgagagaggaggaggagaagcggcgtctcaaggaggaaattgaacgcagaagggcggaagcggcagagaagaggcagaaaatgccagaggatggactgagcgacgataaaaagcccttcaaatgtttcactccaaaggggagcagcctgaagattgaggagagagccgagtttttaaataagtccgtgcagaaatctagtggcgtgaaaagtacacatcaggctgcgattgtttccaagatcgacagccgactggagcaatatacttctgccatcgaaggcaccaaaagtgctaaaccaacgaaaccggcagcatccgacctgcccgtacctgccgagggagtgcgcaatataaagtctatgtgggagaagggcaatgtctttagctccccaacggccgcaggtacacctaacaaggagaccgctggcctgaaggttggagtctcctcccgtatcaatgagtggctgacaaagactcccgatgggaacaagtcccctgcgcctaagccttctgacctgagacccggtgatgtcagtagtaaacggaacctgtgggagaagcagtccgtagacaaggtcacaagtcccacgaaggtctag

SEQ ID NO: 27693 - DNA, 528 bp, Artificial Sequence
  Description of Artificial Sequence: Synthetic coding sequence
atgccagaagacggactttctgatgataagaaacctttcaagtgctttacaccaaaaggttctagtctgaagatagaggaacgggctgagtttctgaacaagagcgtccagaaatccggcgttaaaagtacccatcaggcagccattgtatcaaagattgattccagactggagcagtatacatctgcaattgagggaaccaagagtgcgaaacccacaaagccagcagcgagtgatcttcctgtccctgccgagggagttcgcaacattaaatccatgtgggagaagggaaacgtgttctcctctcccacagcagccggtacccctaacaaagagactgctggtcttaaggtgggggtctcaagtcgaataaatgagtggttgaccaagacccccgatggcaataagtccccagctcccaagcctagcctgacattttgcagctcacttttcggattatggctgattggcaatctactcctgcttccaagctttctgccgctcttgcccgagtgggtcttcctgtag

SEQ ID NO: 27694 - DNA, 219 bp, Artificial Sequence
  Description of Artificial Sequence: Synthetic coding sequence
atggatgactttgaaagacgaagagaacttcgaagacagaagagagaggagatgcgtctcgaggcagagcgcattgcgtaccaacgcaacgatgacgacgaggaggaggccgctcgagaacgacggaggagagcacgacaagaacgacttcgtcagaagcaggaggaagagtcgctggggcaggttactgaccaggtggaggtaaacgcccagaactag

SEQ ID NO: 27695 - DNA, 1380 bp, Artificial Sequence
  Description of Artificial Sequence: Synthetic coding sequence
atggatgattttgagaggcgcagagagctcaggcgccagaaaagggaagagatgcggctggaggcagaacgcatcgcctaccaacggaacgacgacgacgaggaagaggccgcaagggagcgcaggcgcagagccaggcaagaacggcttcgtcaaaagcaggaagaggaaagcctgggtcaggtgactgatcaagtggaggtaaatgcccaaaactccgtgccagacgaagaggccaagactacaaccactaatactcaagtggagggcgacgatgaggcagcatttctcgaacgcctggctaggagagaggagcgtcggcagaaacggctccaagaagctctggagcgccagaaagagttcgaccccaccatcaccgacgcctctctgtcactcccttctcgcagaatgcaaaatgataccgctgagaatgaaactacagagaaggaagagaagagcgagtctagacaggaaagatatgagatcgaggaaaccgaaacagtgacaaaatcatatcagaaaaacgattggcgggatgctgaggaaaataagaaggaagataaggagaaagaagaagaagaagaggagaagcccaaacggggatcaatcggcgagaaccagataaaggacgagaagatcaaaaaagacaaggaacctaaagaagaggttaaatcgtttatggatcgtaagaagggatttactgaggtgaaaagccagaatggcgagttcatgacgcataaactgaagcatactgaaaacacttttagccgtcctggcggtcgcgcttcagtggatacaaaggaggccgagggggctccacaagttgaggcagggaagagacttgaggaactgaggaggaggcgcggtgagacggagagcgaagaatttgaaaagctcaagcagaagcaacaggaggccgcactggagttggaggaactgaaaaagaaacgggaagagaggagaaaggtccttgaagaagaggagcagcggaggaagcaagaagaggccgatagaaagctgcgggaggaggaggaaaaacgtaggttaaaggaagagatcgagagacgacgggctgaggcggcagagaaacggcagaagatgcccgaagacgggttgtctgacgacaagaaacccttcaagtgctttacccccaaagggtcctctctgaagatcgaagagcgagccgaatttcttaataagtctgtgcaaaagagtagtggcgtcaagtctacacatcaggctgccatcgtgtccaagatcgattccaggttggagcagtacacatcagctattgaagggacaaagagcgccaagccaacaaaacccgcagccagtgatctgccagttcccgctgagggagttagaaatattaaatcctag

SEQ ID NO: 27696 - DNA, 219 bp, Artificial Sequence
  Description of Artificial Sequence: Synthetic coding sequence
atggacgacttcgaacgcaggagggagttgcggagacagaagcgagaggaaatgcgattagaagcagagcgcattgcatatcagcgtaacgacgatgacgaggaagaagcagcgagggagcgtcggagaagagcacgccaggagcgcttaaggcaaaagcaggaagaagagtccctgggccaggtgacggaccaggtcgaggtgaacgcacagaactag

SEQ ID NO: 27697 - DNA, 1632 bp, Artificial Sequence
  Description of Artificial Sequence: Synthetic coding sequence
atgacctcctacatgaaggtagaccgtcaatggaatgccgaaatattggaactcatactgggtactggacagctgtccactggccaaatcgcctatcagcgcaacgacgatgacgaggaggaagcagccagggaaagacggaggcgtgcaagacaagagcggctccgccagaaacaggaagaagagtccttgggccaggttacggatcaagtcgaggtaaatgcacaaaattctgtgcccgatgaggaagccaagaccaccactacaaatacacaagtggagggggacgacgaagctgccttcctcgaaaggctggcacgaagggaggaacgacgtcagaagcgattacaggaggcacttgagcgccagaaggaatttgatcccacaataactgacgcatctctgtcattgccctcccgtaggatgcagaacgacactgctgagaacgaaactactgagaaggaggaaaaatctgagtcccgacaggagcgctatgaaatcgaggaaacagaaacggttacaaagtcctatcagaagaatgattggagagacgccgaggaaaacaagaaagaggacaaagagaaagaagaggaggaggaagaaaagccaaagcggggatcaattggcgagaatcagatcaaagacgagaagattaagaaagataaagagcctaaagaggaagtgaagtcattcatggataggaagaaggggtttactgaagtgaagtcgcaaaacggggagttcatgacccacaaactcaagcataccgagaacacttttagtagaccaggcggtagggcatctgtcgacacgaaggaggctgaaggagcgcctcaggtggaagcagggaagagactggaggaacttcgaaggaggcggggagaaaccgaatccgaggagtttgaaaagttaaagcagaaacagcaggaagccgcactggagctggaggagctgaagaagaaacgcgaggaacggcgaaaagtgctggaggaagaggaacagcgtcggaaacaggaagaggctgacaggaaactgcgggaggaggaggagaagaggcgtcttaaagaagagatcgagagacgcagggctgaggcagctgagaagaggcagaaaatgcccgaagacggtttgtcagacgacaaaaagccatttaagtgtttcacccctaagggctcatctctcaaaattgaagagcgggcagagtttctgaacaagtccgtccagaagtcctccggagtcaaaagtacccatcaagctgccatcgtgtcgaagatagacagcaggttagagcaatatacctccgccatcgaggggaccaaaagtgctaagccgacaaaaccagcagcctctgacttacccgtgcccgctgagggagttagaaacatcaagtctatgtgggagaaaggtaatgtcttttccagccccactgcagcagggaccccaaataaagagaccgccggtctgaaagtcggtgtaagttccagaatcaatgaatggctgactaaaacacctgatggcaataagtcccctgcccctaagccgagcgatcttaggcccggtgacgtttccagcaaacgcaacctgtgggagaagcagagcgtggataaagtgacgtcgcctactaaggtgtag

SEQ ID NO: 27698 - DNA, 3975 bp, Artificial Sequence
  Description of Artificial Sequence: Synthetic coding sequence
atggcagatagcctttacaacatacgcctcttgcgggaattctcaaatgagtacctaaacaagtgtttctatctgacacttgaggacatgctgtacgctccactggtcttgaagcctaacgtgatggtgttcattgctgaactcttctggtggttcgaaaatgtgaagcctgattttgtgcagcctcgcgatgtacaggaattgaaagacgctaaaacagtcttgcaccagaaaagcagccgaccccctgtacctatatcaaacgccacgaaacggtcgtttcttggcagcccagctgccggaaccctggcagagctgcagccaccagttcagcttcccgctgaaggatgtcatcgtcattatctgcatcctgaagagcctgagtatctaggaaaggggaccgcagctttcagtccgtcccatccattactgcctttacgacagaaacaacagaagtccattcagggcgaagatatcccagaccagcgtcacagaagtaactccctgacacgggttgatggccagcctcgcggagctgctattgcttggcctgagaagaagactcgccctgccagccagcctacacctttcgccctgcatcatgccgcttcatgcgaggtcgacccttcctctggagactccatctcgttagcgaggagtatttcaaaagatagcctagcaagtaatatagttaatctgaccccccagaatcaacctcacccaactgctacaaaaagtcacgggaagtctctgttatccaacgtgtccattgaggatgaggaagaggagctggtggctattgtcagagcagatgtcgtgccccaacaagcagatcctgagttccctagggcctcccccagggccctcggattgactgccaatgcgaggagcccccagggacaactcgatacctctgagtctaagcccgactcgttcttcttggagccacttatgccggctgtcctcaaaccagccaaggaaaagcaggtgataacaaaggaagatgagcgtggagaaggaagaccaaggagtatcgtgtctcggaggccatcagagggaccacagccccttgttaggcgaaaaatgactggatcacgcgaccttaatcggacttttactccaataccttgctcggagtttcccatgggcatagaccctacagagacagggcctctgtctgtggaaaccgcgggagaggtgtgtgggggaccacttgcacttgggggttttgacccattccctcaggggccaagtacagatggattctttctgcacgttggacgagctgatgaagacacagaaggcagactctacgtatcctgcagcaagagtccaaattcacatgattccgagccttggacacttctgcgacaggatagtgattctgacgtggtagatatagaggaagctgagcacgattttatgggggaagcccaccctgttgttttttctcgatatatcggtgaggaggagagcgcgaagcttcaggaggatatgaaggtaaaagagcacgaagacaaagacgatgcttcaggcaggagtagcccctgtctatccacagcttcccagatgtcgtctgtttccatggccagtggtagcgtgaagatgacgagctttgccgagaggaagctgcaaagactgaattcttgtgagaccaagtcaagtacctcttccagccagaaaaccacccccgacgcttcagagtcgtgccctgcgcctctgacgacatggcgtcagaagagggaacagagcccaagtcagcacggtaaagaccccgctagtctgttggcaagtgaactggtccagctccatatgcagctagaagagaaaaggagggctattgaggctcagaaaaaaaagatggaggccttgtccgcgaggcagcgactgaagcttggaaaggccgctttcttgcacgttgtgaagaaaggcaaggccgaggccgctccacctctccggcctgaacacttcgccaaggagtacagccagcacaacggcgaggactgcggcgatgccgtgtcgaaaacggaggacttcctcgtgaaggaggagcaaagagaagagctgcttcatgagccacaggatgtggacaaggagtctcttgccttcgcccaacagcacaaggccaaagatccggtggcccttcatgaactggagaggaataaagtgatttcagccgctttactcgaggatacggtgggggaggtggtggatgtaaatgaatgcgatctgagcattgagaagcttaatgagaccataagcacgctccaacaggccattctaaaaattagtcagcagcaggagcaactcttaatgaagagccccactgtcccggtccctgggtcgaagaacaattctcaggatcataaggtgaaagcccctgtgcactttgtggagccgctcagcccaaccggagtggctggacatcgcaaggcaccacgcctcggtcagggccgtaacagtcgaagcgggagaccagcagaactcaaggttcccaaggaccgccctcagggctcaagtcggtccaagactcctacgccaagcgtggagaccctgcctcacctacgccctttccctgctagcagccatcctcgtactcccaccgaccctggcctggactctgccttggaaccatctggagacccccacggtaagtgtttgttcgatagctaccgacttcacgacgaatcaaaccagaggaccctgacactctcctcctccaaggatgctaatattctgagcgagcaaatgagcttgaaggaggttctggatgcgtccgtgaaggaagtcggatccagcagctcagacgtgagcgggaaggagtcagtgccggtcgaggaacctctgaggtcacgggctagtttaatcgaagtcgaccttagcgatcttaaggcccctgacgaggacggtgagctcgtgtcactggatgggtcagcagacctcgttagcgaaggagaccagaaaccaggggtgggcttcttcttcaaagatgaacaaaaagcagaagacgagctggccaagaagagggccgcattcctactgaaacagcagcgcaaagcggaagaagcccgtgtgcgtaaacagcagctcgaggccgaggttgaactgaaaagagatgaggccaggcgtaaagcggaagaagacagggtaagaaaggaggaggagaaagcaagaagagagctgatcaaacaagaatatcttcggaggaagcagcagcaaattttggaggagcagggcctgggaaagcccaagtcaaaacctaaaaagcctcgcccaaagtccgttcacagggaggaatcctgcagtgatagtgggacaaagtgtagctcgacgcccgataatctgagccggacacagagcggctcctctctgagtcttgcatccgccgcaactactgaacccgagtctgtacactccggaggaacaccatcccagcgggtggaatctatggaggctctaccaattctgagccgaaatccaagccgtagtactgacagagactgggagactgcttccgctgcaagcagcttagcaagcgtcgcagagtataccggcccaaaactgtttaaagagccgtcatctaagagtaacaaacccattatacataacgccattagtcactgttgcctggcaggcaaggtgaatgagccccataagaactctatcctggaggaattagagaagtgtgatgcgaatcattatattattcttttccgcgatgccggatgccaattcagggctttatattgttattatcccgacaccgaagagatttataagctaacaggcaccggccctaagaatatcacgaagaagatgatagataagttatacaagtatagcagcgaccgcaagcagtttaacttgatccccgctaaaacgatgtctgtgtcagtggacgccctgacaatccataaccatttatggcaacccaagagacccgcagtcccgaagaaggcccaaaccagaaaatag

SEQ ID NO: 27699 - DNA, 4809 bp, Artificial Sequence
  Description of Artificial Sequence: Synthetic coding sequence
atggtggatgcatccggtcgcgcagctgctgaaggatggcgaaaaatggaggcccctccggacggggcagccgacctggtccctttggatcggtatgacgccgctcgggctaaaatcgccgctaacctccaatggatttgcgcaaaggcgtacggtcgggacaacatccctgaagacctgcgagaccctttctatgttgaccagtatgaacaggaacatatcaagccaccggtcatcaagctgctgctctcatcagagctatactgccgggtctgttcactcattctgaagggtgatcaggtggccgcattgcagggtcaccaaagcgtgatccaggcactgagtcgcaaaggcatctacgtaatggaatctgatgatacccctgtaactgagtctgacctgtcaagagcccctatcaagatgtctgcccacatggcgatggtggacgctcttatgatggcgtacacagtggagatgatctccatcgaaaaggtggtcgccagcgtgaaacgtttcagcacgttctccgcgtcgaaggaactgccctatgacctcgaggacgcaatggtgttttggattaacaaagtgaacctgaaaatgcgtgaaattaccgagaaggaagtgaaactgaagcagcagctccttgaatcacccgctcaccaaaaggtgagataccggagggaacacttaagcgcgaggcaatccccttattttcctctcttagaagatcttatgcgcgatggcagcgatggcgctgctctgcttgcggtcatccactactactgccccgagcagatgaagttggacgatatctgcttgaaggaggtcacaagcatggcagactctttgtataacatacgcctcttaagggaattttctaacgagtacctgaacaaatgcttctatctgacactggaagacatgttatatgccccactcgtccttaaaccaaacgtcatggtcttcattgcagagttgttttggtggtttgagaatgtcaaacccgacttcgttcagccacgggacgtccaagagctcaaagatgccaagacagtgctgcatcaaaagtcgtcacgtccccctgtccctatttcaaacgctactaaacggtcattccttggctctcccgctgcaggcactctggccgaacttcagccgccagtgcagctgccagccgagggttgtcaccggcattacctgcaccctgaagaacccgaatacctgggaaagggcacggctgcgttctccccctctcaccccctgctgcctctgcgccaaaaacagcagaagtcaattcaaggagaagatattcccgaccagaggcacagaagcaactcacttacaagagtggatgggcagcctagaggggctgctattgcctggcctgaaaaaaagacgaggccagcatcccagcctacaccatttgccctacaccacgctgcttcttgcgaagtcgatccatcttcgggtgactctataagtttagccaggagtatcagcaaagacagcctcgcaagtaatatcgtgaatcttacaccgcaaaaccagccccatcctaccgcaaccaagagccacgggaaatcactgctgtccaatgtttcaattgaagatgaggaggaagagcttgtcgcaatcgtgcgtgcagacgtggtgccgcagcaagccgatccagagttccctcgcgcaagtcctcgtgccctcggccttaccgccaatgccagaagtcctcagggacaactagatactagtgaatccaagccagacagcttttttctagaacctttgatgcctgcagtcttaaagcctgcaaaagaaaaacaggttatcactaaggaggatgagcggggagagggtaggccaaggtccattgtgagcagacgcccaagcgagggaccccagccccttgtccggaggaaaatgacagggtccagagatctgaatcgcacttttactccaatcccgtgcagcgaatttcccatgggcatcgaccctaccgaaacaggtccactgtcagtcgagacagccggagaggtttgcggtggacccttagccttaggcggtttcgatccgttccctcaaggcccttcgaccgatgggttttttcttcacgttggaagagctgacgaagataccgaagggaggctgtacgtaagctgtagtaaaagccctaatagtcatgacagtgagccatggacactgcttagacaggacagcgacagcgatgtggtcgatatagaagaggctgaacacgactttatgggtgaagcccatcctgtggtgttctcccgatatataggggaagaagagtccgctaaattgcaggaggatatgaaagtgaaggaacatgaggacaaggatgacgccagcggaagatctagcccatgcctttccactgctagtcagatgagctccgtgagcatggcctccggttcggttaagatgacctctttcgccgaaaggaagcttcaaaggctgaacagctgtgagactaaaagctctacgtcgagtagccagaaaacaactcctgacgcctccgaaagttgccctgcacctctgactacatggagacagaaacgcgaacagtctcccagtcagcacggaaaggatccagccagtttgttggcctcggaacttgtgcagctgcatatgcagcttgaggagaaacgacgcgctatcgaggcacagaagaaaaagatggaggcactgagcgcacgccagagactcaaactggggaaggcagcatttctgcatgtcgtgaagaaggggaaggctgaggccgcaccgcctttacggccagagcattttgccaaggagtacagccagcacaacggcgaagactgtggggacgccgtgtccaagacagaggactttctggtgaaggaagaacagagagaagagctcctgcatgaaccacaggacgtcgacaaggaaagtcttgcctttgctcaacagcacaaagccaaagatccagttgccctacacgagctggaacgcaataaagtcattagcgccgcactcctggaggacaccgtgggtgaggtagtggacgtaaatgagtgcgacctgagcattgaaaagctgaacgaaacaatttcgacactccagcaggcaatcctcaagatctctcaacagcaggagcagttactgatgaaaagccctacggtccccgtccctggctccaagaacaatagtcaggaccataaggtcaaagccccagtgcactttgtggagccactaagcccaacaggcgtggcaggtcatcgtaaggctcccagacttggccagggcagaaactctaggtccggacgacctgccgaattgaaggtgccaaaagatcgaccccagggttcgtcacgctcaaaaactcctacaccttctgtggaaacactgccccacctccgtccctttcccgcatccagtcaccctaggacaccgacggacccgggactggatagtgccttggagccatccggagaccctcatggaaagtgccttttcgatagctatcgcctgcacgatgagtcgaaccagcgcactctcactctgtccagctcaaaagatgctaatattctcagtgagcagatgtctctgaaggaggtgttggatgccagtgtgaaggaggtcggttcttctagttctgacgtctccggaaaggaatctgtccccgtcgaggagcccctacgcagtcgagcctcgctgattgaagttgatctgagtgatctgaaagctcctgacgaggatggagaactggtgtccctcgatggcagtgctgatttggtttcagaaggagatcagaaaccgggtgtggggttcttttttaaggacgaacagaaagccgaggatgaactggccaagaagcgagccgcattcctgcttaaacaacaacgaaaagctgaagaggcaagagttcgtaagcagcagctcgaggctgaagtcgagttgaaaagggacgaagctaggcgcaaggctgaggaggatagagtgcgcaaagaggaagaaaaagccaggcgggaactcatcaagcaagagtatctccgacgcaagcaacagcaaatcctggaggagcaaggtctcggaaagccaaagagcaaaccaaaaaaaccaagacccaagtctgtgcaccgcgaggagagttgtagcgactctgggacaaagtgtagcagtactcccgataatttgtcccgcacgcagtccgggtcttccctgtctttggcgagcgcagcaaccaccgagccagaatctgtgcacagtggtggcaccccttcacagagagtcgagagcatggaagccctgcctatcctgagtaggaacccttcccgttccacggatagagactgggaaacagctagcgctgctagttcattagcctcggttgctgagtacactggcccaaagctatttaaagaaccttccagcaagtctaataaaccgattattcacaatgctatatcccattgctgcctggcaggcaaggttaacgagccgcacaaaaacagcatcctggaggagctcgagaaatgcgatgccaaccattacataattcttttcagggacgccggatgccagtttcgcgctctctactgctactatccagacactgaagaaatctataaacttactggtactgggccaaagaatattactaagaagatgatcgacaagctgtacaagtacagctccgaccgaaagcagttcaatttaattccagccaaaaccatgtccgtgagcgttgacgccctaacaattcataatcatctgtggcaacccaaaagacccgctgtgccaaagaaggcccagaccagaaaatag

SEQ ID NO: 27700 - DNA, 4842 bp, Artificial Sequence
  Description of Artificial Sequence: Synthetic coding sequence
atggtggacgcaagcggcagagcggcagccgaaggttggcgaaagatggaggcccctccagacggagcagcagatctggttccactggatcgatatgacgctgctcgcgctaaaatcgctgcgaacttgcaatggatttgtgctaaagcttacggaagggataatatacctgaggacctgcgagacccattctacgtggaccagtatgaacaagagcacatcaaacccccagtgatcaagctgctgctgtcctccgagctatactgtcgggtgtgctctttgatactcaagggagaccaggttgccgctctccagggtcaccaaagcgtgatacaggccctctcccggaaaggaatttatgtaatggagagtgatgacactcccgtcactgagtccgacttaagccgcgctcctattaagatgagcgcgcatatggctatggtggacgcactgatgatggcatacactgtagaaatgatcagcatcgagaaggttgttgcctccgtgaaacggttctccaccttcagcgctagtaaggagcttccatacgacctagaagatgctatggtattctggatcaataaggtgaatttgaaaatgcgcgaaatcactgaaaaagaagtgaagctaaagcagcaactgctggaatccccagcccaccaaaaaagcccctcaaaatggtattggaaactggtccccgtgaggtatcgcagggagcacttgagcgccagacagagcccatatttccccctcctggaagatctcatgagggatggcagtgacggggcagccctcttggctgttatccactattattgccccgaacagatgaaactcgatgatatctgtctcaaggaagtcacctcaatggccgacagcctctacaacattagattgcttagagaattctcaaacgaatacctaaacaagtgcttttatctcaccctagaggatatgctgtacgcccctcttgtccttaagccgaacgttatggtgttcatagccgagctcttctggtggtttgagaatgtgaagcctgattttgtgcagccgagggacgtgcaagaactgaaggacgccaaaaccgtgctgcatcaaaaatcaagccgccctccggtgcccatctccaacgcaacaaagcggtctttcctgggcagtcccgctgctggcactctggccgaactccaacccccagtacaacttcctgcggagggctgccacagacactatcttcaccccgaggagcccgaatacctgggcaagggaacagccgcattctctccatctcatccgctgctgcctctgagacagaagcaacagaagtcgattcagggggaggacatccctgaccaacggcatcgatctaatagtctgacccgagtggacggtcaacccaggggggcagctattgcttggccggagaaaaagacccggccagcaagccagccaacccctttcgctctccatcacgccgcttcctgcgaggtcgatccgtctagcggcgattctattagcttggcacgcagcatctctaaggatagcctcgctagcaatatcgtgaacttgactccacaaaaccagccacatcccacggcaacaaaatcccatggtaagtctctgttgtccaacgtgagcattgaagacgaagaagaggagctggtcgccattgtgagggccgacgtggtgccacagcaagccgacccagagttcccacgggctagccctcgggcattgggtttgaccgcaaatgctcgcagcccacaggggcagctggacacctcagaatctaaacccgattcattttttctggaacccctgatgcccgctgttctgaagcctgcaaaagagaaacaggtcattaccaaggaagacgagagaggagaggggaggccacggtctattgtcagtcggagaccctcagaaggaccccagccgttggtgcgtcgcaaaatgacgggatcaagagacttaaaccggacctttactccaatcccttgctcagaatttcccatgggaattgatcctacagaaaccggtccgctgagcgtggaaacagccggagaagtatgtgggggtcccctggcattgggcggatttgacccttttccgcaaggcccttcaaccgatggcttttttttgcatgttggcagagctgatgaagacaccgaaggtcgtctttatgtctcctgttccaagagccccaactcgcatgattcagagccctggactctgttaaggcaggactccgactcagatgtcgtggatatcgaggaggctgaacacgatttcatgggtgaggcccacccagttgtgttctcccgctacatcggcgaagaagaatccgccaagctccaggaggacatgaaggtaaaggagcatgaggacaaagatgacgcctccgggagaagtagtccgtgtttaagcaccgcttcgcagatgagctctgtgtccatggcctcagggagtgtgaagatgactagtttcgctgagagaaaactccagagactgaactcctgtgagactaaatcatctacttcaagttctcagaaaacaacacctgatgccagcgaatcatgccctgcccctctgaccacttggagacagaaaagagagcagtcaccttcccagcatggaaaagaccctgcctcgttgctcgcatctgaacttgtgcagctccacatgcaactggaggaaaagagaagagctattgaggctcagaagaagaaaatggaggccctttcagcgagacagaggctcaagctgggaaaggctgcttttttgcacgttgtcaagaagggaaaggcagaggccgcaccacccctgcggccagagcatttcgccaaagagtacagccagcacaatggcgaagactgtggcgatgccgtgagtaagaccgaggatttcctcgtgaaagaggagcagagggaggaacttctgcacgagcctcaggatgtggataaggagagcctggcatttgcgcagcagcacaaagccaaggatccggtagcattgcatgagctcgaacgaaacaaggttattagcgctgcactcctcgaagacaccgttggggaggtggtggacgtcaatgagtgtgatttaagtatcgagaagctgaacgaaactatttccacactccagcaggccattctcaagattagccagcagcaggagcagctgctgatgaaaagccctactgttcctgttcctggttccaagaataattctcaagatcataaagtcaaggctcccgtgcacttcgtggagcccctctcccccactggtgtggccggacaccggaaggctccaaggctggggcagggtcgaaattccagaagcggcagacccgctgaacttaaggtgcctaaggatcggcctcagggcagcagtcgaagcaaaacccccactccttccgttgaaaccttgccacacctcaggccctttccggcttcaagtcacccgcgaacacccaccgaccccggtctggatagcgcactggagccttccggtgatcctcacgggaagtgcttatttgactcgtatcgcctgcacgatgagtcaaaccagcggacgcttaccttatcgagctctaaggacgcaaacattctcagtgagcagatgtccctgaaggaagttctggatgccagcgtgaaggaggtcggttcaagcagttccgacgtcagtggcaaagaatcggtaccggtcgaggagcccctgaggtcccgcgcatcattaatcgaggtagacctgtccgatctgaaagccccagacgaagatggtgagctggtgagtctagatggctctgctgacctcgtgagcgagggggatcagaagcctggtgtgggatttttttttaaagatgagcagaaggctgaggatgagctggctaagaagcgcgcagcttttctgctcaaacaacaacgaaaggccgaggaagcgagggtgcggaagcagcaactcgaagctgaggtggaacttaaacgagacgaagcgagacgcaaggctgaagaggacagggtgcgtaaggaggaggagaaagctagaagggagttgatcaaacaagagtacctgcgtaggaaacaacagcagatattagaggaacaaggacttggaaagcctaaatcgaaaccaaaaaaaccaagaccgaagtccgtacaccgagaggagagctgctccgactccggtacaaaatgctcgtcgacaccagataacctttcacgaactcagtccggcagttccctctctctcgcatcagccgctactaccgagcccgagagcgttcacagtgggggtacaccatctcaaagagtcgagtcgatggaggccctgcccatcctgtcccgaaacccttctcggtcaacggacagggactgggaaaccgcctccgccgcttcctcactcgcgtcagtcgctgagtacacaggtccaaagttgttcaaggaaccatcctctaagtcgaacaaacccattatccataacgccatctctcattgctgtcttgcaggcaaggtcaatgagccccacaagaactccatccttgaggaattagagaaatgtgatgcgaaccactatataattctgtttcgggatgctggatgccaatttcgcgcactgtactgttactacccggacaccgaggaaatctacaagctgaccggcactggcccaaaaaatattacaaagaaaatgattgataagctctataaatacagtagcgatagaaagcagtttaacttaatccccgctaaaactatgagcgtgtctgtggatgctctcacaattcacaatcacctttggcagccgaagagacccgctgtcccgaaaaaagcccaaacccgaaaatag

SEQ ID NO: 27701 - DNA, 1983 bp, Artificial Sequence
  Description of Artificial Sequence: Synthetic coding sequence
atgcggatgccatcctctacatgggcccgaattatgtcaagctgcggctgtgacgcttgcagagtcggacccagttcggttatgcggccaagcccacggtacccacgcgcttgggtgacccgcacatgggtccccatccccccacgcccaatggcctccagtggatctgtccctagggattgctggctgctagcagctatcgcaagcctgacactaaatgacactctgcttcaccgcgtggtcccgcacggtcagagctttcagaatgggtacgctggcatttttcacttccagctgtggcaattcggcgagtgggttgatgtcgtagtggacgacctcctgcccatcaaagatggtaaactggtattcgtgcattccgccgaaggcaatgaattctggtctgcactgcttgaaaaagcatacgcaaaggtcaatggctcctatgaagccctgtccgggggtagcacgagtgaggggtttgaagatttcaccggtggagtgactgaatggtatgagctgcgaaaagcccctagtgatctttatcagatcatccttaaggcattggaacggggatccttattgggctgtagtatcgatatctcatcagtgctggatatggaggctataacgttcaaaaagttagtgaaaggacacgcctactcagtgaccggtgctaagcaagtgaattaccgcggacaggttgtgagccttattaggatgagaaacccatggggtgaagtggagtggaccggggcttggagcgattcaagctccgaatggaataacgtggatccatacgaacgcgatcaacttcgtgtaaaaatggaagatggcgagttttggatgtccttccgggactttatgagggagttcacgcgtcttgaaatctgtaaccttacccctgatgcactgaagtcgcgcactattagaaaatggaacacaactttatacgaggggacatggcggcgaggctccaccgccggtgggtgccggaactaccccgcaaccttttgggtcaacccacagttcaaaattcgattggatgagaccgacgacccggacgactacggcgatagagagtcagggtgcagcttcgtcctagccctgatgcagaagcaccggcgtcgcgaacgtagatttggaagggacatggagaccatcgggttcgcagtgtacgaggtgcccccagaactggtgggccagcctgcggtccatctgaagcgggactttttccttgctaacgcttcacgggctagatctgagcagttcattaatttgcgggaggtgtctacacgcttccggctgccgcctggagagtacgtggtcgtcccgagcacgttcgagcctaataaggagggtgattttgttttgcgtttcttctccgagaagagcgctgggacggtggaactcgacgatcagattcaggctaacctgcctgacgagcaggtcctgtctgaagaagagatcgacgagaattttaaggctctgtttcggcagttggcaggtgaagatatggaaatatctgtgaaagagctgagaaccatcctgaataggattatctctaaacataaggacctgcgtacgaaaggattctcactggagagctgccggagtatggtaaacctcatggaccgtgacgggaacgggaagctcgggctcgtggagttcaacatcctgtggaacaggataaggaactacctgagtatctttaggaaattcgatctcgacaagagcggctcaatgagtgcctacgagatgcggatggccattgagtccgccggtttcaagctgaacaagaaactctatgaacttattattactcggtactcggagcccgatcttgccgttgattttgataacttcgtctgttgcctagtccggctcgagacgatgtttcgcttttttaagaccttggacaccgatttagacggggtggttacatttgacttgtttaaatggctgcagctaactatgtttgcctag

SEQ ID NO: 27702 - DNA, 2145 bp, Artificial Sequence
  Description of Artificial Sequence: Synthetic coding sequence
atgagcgaggaaattattactcccgtctattgtactggcgtgtctgcccaggtacagaaacaaagggctcgagaactcggtctgggacggcatgagaacgcaataaagtatttaggtcaagactacgaacagctacgggtgcggtgcttgcaatctgggactctcttccgggacgaagcttttcccccagtgccccagtcccttggctataaagacctggggccaaacagctccaaaacatacggaataaagtggaaaaggccgaccgaacttctctctaatccgcagttcattgttgatggtgcaacaaggacagacatttgccagggggctctgggagattgttggctgctcgccgcaattgcctcccttactctcaacgacaccctactgcaccgcgtggtcccacacggacagtcattccagaacgggtacgcaggcattttccactttcaactgtggcagttcggcgagtgggtcgacgtcgtggtagatgatttgctccctatcaaggatggtaagctggtatttgtgcatagcgccgaagggaacgaattttggtccgctctcctcgaaaaggcttacgcaaaggttaacgggtcatacgaggccctgtcaggcggatccacgtccgagggtttcgaggatttcacggggggagttaccgagtggtacgagctgcgaaaagcccctagtgatttgtaccagattatccttaaagccctcgaacgcggatcactactgggatgttccatagacatcagttccgttcttgatatggaggccattacctttaaaaagctggtgaagggccacgcttacagcgtcaccggcgctaagcaggtgaattacaggggacaagttgtgagtcttatccgtatgaggaacccatggggcgaggtcgaatggacgggcgcttggtcagattctagtagcgaatggaataacgtggacccatatgagagagaccaactccgcgtaaaaatggaggatggagaattttggatgtcctttagggatttcatgcgagagttcacacggctcgaaatatgtaatctcacaccagacgctctgaaaagcaggaccattaggaagtggaataccacgctgtacgaaggtacctggagaagaggatccactgctggcggatgtagaaattatcccgctaccttttgggtgaaccctcaatttaaaattagactagatgagaccgacgatcccgacgactacggggacagagagtccggatgctcgtttgtcctggctctgatgcagaaacacaggcgcagggagcgccgattcgggcgagacatggaaactatagggttcgcagtgtacgaagtgccaccggagctcgtaggtcagcccgctgtgcatttaaagcgagacttcttcctggccaatgctagtcgggctcgaagcgagcagtttattaacctaagggaagtctcaacgagatttcggctccccccaggcgaatacgttgttgtgccatctactttcgaacctaataaggaaggcgacttcgtgctgcggttcttctctgaaaagtctgccggaactgttgagttggatgatcaaatccaggcaaacctcccagacgagcaagtgcttagcgaggaagagattgatgaaaactttaaagctctgttccggcagctagccggtgaagacatggagatcagcgtgaaggaactccgaaccatccttaatcggatcatatcaaaacacaaggacctacggacaaaagggttctccctcgagtcctgtcggagcatggtgaatttaatggacagagatggaaacggcaagttaggtctggttgagtttaatatcctgtggaacaggatacgcaactacctgtccatatttcggaagttcgatctcgacaagtctggttccatgtctgcctacgagatgcgcatggccatcgagagtgccggattcaagctaaataagaaattatatgagctgattatcacaagatactccgaacccgacctggcagtggacttcgataatttcgtatgttgtctcgtgaggctagaaactatgttccgattttttaaaaccctggacacagacttggacggagtggtgaccttcgatctgttcaagtggcttcagctgaccatgttcgcctag

SEQ ID NO: 27703 - DNA, 2145 bp, Artificial Sequence
  Description of Artificial Sequence: Synthetic coding sequence
atgagcgaagagataatcacccctgtgtactgtactggtgtcagcgcacaggtccaaaaacaacgcgctcgggagctcggactgggcaggcacgaaaacgctatcaaatacctgggccaggattacgagcaactgagagtacgatgtctgcaatccgggactctgtttcgtgacgaggcatttccaccagtgcctcagtctctgggatacaaggatctgggccctaattcctcaaagacttacggaatcaagtggaagcgccctacggagcttctctctaacccacagtttatcgttgacggcgctacccgcaccgacatctgccaaggcgcattaggcgattgctggcttctcgcagcaattgcgtccttgacgctcaatgatacccttttacaccgagtggtcccgcatggacagtctttccagaacggttatgctggaattttccacttccagctgtggcaatttggcgagtgggtagatgtagtggtggacgacctcctgccgatcaaagatggtaagttagtatttgttcacagtgccgaaggaaatgaattctggtccgcgctgctcgaaaaagcctatgcaaaagtgaatggctcctacgaggctctgtccgggggttcgaccagcgagggatttgaagattttactggcggtgttaccgaatggtacgaactccgaaaagctccgtcagatttgtaccagataatccttaaagccctagagcgcggaagcctgctgggctgctctattgacatttcaagtgttcttgacatggaagctatcacttttaagaaacttgtgaagggacacgcctactcagtaactggggctaaacaggtgaattaccgcggacaagtcgtgagtctgatccgtatgagaaatccatggggcgaggtggagtggacgggagcatggtcagacagcagcagtgaatggaataacgtggatccatacgaaagagatcagctccgggtgaaaatggaggacggagagttctggatgagtttcagagattttatgcgcgagttcacacggctagagatttgcaacctcaccccggacgctcttaagtcacgtactatccggaaatggaatactaccctgtacgagggaacttggcgacgaggctccaccgccggaggatgccggaattatccagcaaccttctgggttaatccacagttcaaaatcaggttggacgaaacagacgatccagatgattacggggaccgagagagcggctgcagtttcgtcctcgcattaatgcagaaacaccgtcgtagagaacgacgctttggtagagatatggaaactattggttttgccgtttatgaagttccaccagagttagttggacaacctgccgtgcatctcaagcgagatttctttctggctaacgccagcagggcaagatcggagcaatttatcaacttgagagaggtgtccacccgctttcggttgcctcctggcgagtacgtagtagtgccttcgacattcgagccaaacaaggagggggacttcgtactgcggttcttcagcgagaagtccgcagggacggtagagctggacgaccagattcaagccaatctaccggatgaacaagtactgtcagaagaggagatcgatgaaaatttcaaggcccttttcagacagctggctggtgaagacatggagatctccgtaaaggagttgcgcaccattctgaatagaattattagtaaacacaaagaccttcgcaccaaaggcttcagtctcgaatcttgtcggtccatggtgaatctgatggatcgagacggcaatgggaaattgggattggtggagtttaatatcctgtggaatcgaatccgcaactacctgtccatattccggaagtttgatctcgacaagagcggttccatgtccgcctatgaaatgcggatggccattgagagcgccggtttcaagctcaataaaaagctctacgagctgataatcactaggtatagtgaaccagatctcgcagtcgacttcgacaacttcgtctgttgccttgtgcgtctggagacgatgttcaggtttttcaaaacactggatacagatcttgatggggtcgtaactttcgatttattcaagtggttgcaactgacaatgttcgcttag

SEQ ID NO: 27704 - DNA, 489 bp, Artificial Sequence
  Description of Artificial Sequence: Synthetic coding sequence
atgagcgaggagattatcacgccagtgtattgtaccggggtttccgctcaagtccagaagcagagagccagggagctgggcctgggtcgccacgagaatgctatcaaatatcttggccaggattacgaacagctgagagtgagatgcctgcagtctggaactctctttagggatgaggctttcccccctgttccacagagcctgggatataaggatcttggtcctaattctagtaagacctatggaattaagtggaagcgacccactgaacttctgagtaatcctcaatttattgtggacggcgctacccgtaccgacatctgtcagggcgctcttggagactgctggctgctggcagccattgcatcattgacgctaaatgatactttactccaccgagtcgttccccatggccaaagctttcagaacggttatgctggcatcttccacttccagctgtggcagttcggtgaatgggtggacgtctag

SEQ ID NO: 27705 - DNA, 2145 bp, Artificial Sequence
  Description of Artificial Sequence: Synthetic coding sequence
atgagcgaggagattataacgccagtgtattgcaccggcgtctctgcccaggttcagaaacagcgggctagggagctaggattgggtagacacgaaaacgccattaaatatctcggccaggactatgaacaactcagggtacggtgcctccagagcggtactttatttagagatgaggctttcccacctgttcctcagagtctggggtacaaggacctcggtccaaattcctcaaagacatatggcatcaagtggaagagacctaccgagctgctcagtaatcctcagtttatcgttgatggggcaacccgtacagatatctgccaaggagcacttggcgattgctggcttttggccgcaatcgcttctctcacacttaatgacacactcctgcatagagtagttcctcatggacaaagcttccaaaatggatacgcaggcatttttcattttcagttgtggcagttcggagagtgggtggatgtggtcgtggacgacctcctcccgattaaggatggaaagttagtgttcgtccattccgcggagggcaatgagttttggtcagccctgctggagaaagcctatgcaaaagtcaacggttcctacgaggcactctccggtggctctacatctgagggattcgaggactttactggcggagtcaccgagtggtatgaactgcgcaaggctccaagtgacctgtatcagatcatcctgaaggctctcgaacgcggaagcctcctcggctgtagcatcgatatcagctcagttctggacatggaggccatcacattcaaaaagctggtcaaggggcacgcatactcagtgaccggcgctaaacaggtgaactaccgcggacaggtagtgtcattaatacgaatgcgcaatccttggggcgaggtggagtggaccggagcgtggagcgattcttcctcagagtggaacaacgtcgacccttatgagcgtgatcagcttcgagtgaagatggaggacggcgagttctggatgtccttccgcgactttatgagagagttcacacggctggagatctgcaatctgacaccagacgcattaaagtcccgtactattcgcaaatggaatacaacactgtatgagggaacctggagacggggttcgaccgccggtgggtgtcggaactatccggcaactttctgggtgaatccacagttcaaaataaggctggatgagacagacgatcccgatgattacggcgatcgcgaatcagggtgtagtttcgtgttagcactcatgcagaaacatcgccgtcgagagcgcagatttggccgagatatggagaccataggcttcgctgtatatgaagtcccacctgagctggtcggacaacccgcagtgcacctcaaacgcgatttttttctggccaacgccagccgtgcaagatcagagcagtttatcaacctaagagaggtgtccactcgctttcggctgccgcctggagagtacgtggttgtgcccagcacattcgaaccaaataaagagggcgactttgtactgcgatttttttctgagaaaagcgccggaaccgtggagctggacgatcagatccaggccaatctgccggatgagcaggtgttgagcgaggaggaaatcgatgagaatttcaaggccttgtttagacagttggccggagaggatatggagataagcgtgaaggagctcaggaccatcctgaaccgcataatctctaagcacaaggatctgaggactaaaggattctctctggagagctgccgcagtatggtgaacctaatggacagggacggaaacggcaagttaggcctggtagaattcaatatcctttggaatcgaataagaaactacctgagtatcttcagaaagttcgacctggataaaagtggctccatgagtgcctatgaaatgaggatggctatcgaatcagctggattcaaactgaacaagaaactctatgaattgatcatcaccagatactccgagccggatttggcggtcgacttcgacaattttgtctgctgtctggtccggcttgagacaatgtttagattcttcaagaccctcgataccgacctcgatggcgtggttacttttgacctgttcaagtggctgcagctcacaatgttcgcgtag

SEQ ID NO: 27706 - DNA, 459 bp, Artificial Sequence
  Description of Artificial Sequence: Synthetic coding sequence
atgagcgaggagattatcacccccgtttactgcaccggtgtttctgctcaagtgcaaaagcaacgggcaagggaactgggtttaggccgacacgagaatgccatcaaatacttaggccaagactacgaacaacttagggtgagatgcctccagagtggcacactgtttcgagacgaggcattcccacctgttccgcaaagcttgggatataaggatctcgggcctaactcatctaaaacctacgggattaagtggaagcgcccaacagagctcctcagcaatccgcagtttatcgtggatggcgctactcggaccgatatttgccagggagctctgggggactgttggttgttggccgcaattgcttccctcacactaaacgacacactcctccaccgtgtggtgcctcatggccagagtttccaaaatggatacgccggtatattccactttcaatag

SEQ ID NO: 27707 - DNA, 489 bp, Artificial Sequence
  Description of Artificial Sequence: Synthetic coding sequence
atgagcgaagagataattacccccgtctactgcactggcgtgagtgcccaggtccagaaacagagggctcgcgaacttggcctggggaggcatgagaatgccatcaagtacctggggcaggactacgagcaacttcgtgttaggtgtctgcagtcaggaaccctcttcagggatgaggcttttccaccggtgccgcagtccctgggctacaaagacctggggccaaactcctcaaagacttacggcataaaatggaaacgcccaacagaactgctgtctaatccccagtttatcgtcgacggtgcgacaaggactgacatttgccagggcgcactcggagattgttggctgctggccgctatagcctcacttaccctaaacgacacactgctgcacagggtggttccccacggccaatcttttcagaacgggtatgccggaatatttcatttccagttatggcagtttggtgaatgggttgacgtatag

SEQ ID NO: 27708 - DNA, 492 bp, Artificial Sequence
  Description of Artificial Sequence: Synthetic coding sequence
atgagcgaggaaatcataacccctgtgtactgcactggcgtgtccgctcaggtacagaagcagagggcaagagaactgggcctgggcagacatgaaaatgccattaaataccttggacaggactatgagcagctcagagtgcgttgcctacagtctgggacgctttttagggacgaagcttttcccccagtaccccagtcacttgggtataaagatctcggccctaattcaagcaagacctacggcatcaaatggaagaggcccaccgagctcctatcgaatccccagtttatcgtcgatggcgcaacccggaccgatatctgtcagggcgcattgggcgattgctggcttctcgccgctatcgcatccttgaccctgaacgacactttgctccatcgtgtcgttccccacggacagtcatttcagaacggctacgccggaatcttccattttcaactgtggcaatttggcgaatgggttgacgtagtctag

SEQ ID NO: 27709 - DNA, 576 bp, Artificial Sequence
  Description of Artificial Sequence: Synthetic coding sequence
atgagcgaagaaattatcacacccgtatattgcactggggtgtctgctcaagtccagaagcagcgtgctcgggagctcgggctgggcaggcacgaaaatgcaattaagtatctgggacaggactacgagcagctcagagtgaggtgcttacaatcaggtacgctgttcagagacgaggcttttccgccagtcccacagtctcttggatacaaggacctagggccaaactcaagtaagacgtatgggatcaaatggaaaaggccaacagagctcctgtcaaatccccagttcatcgtggatggtgccacaaggacggatatatgccagggcgcactcggcgactgttggctgctcgccgctatcgcttcacttacgctgaacgatacgttgttgcatcgtgtggtgcctcacgggcagtcattccagaatggctatgcaggcatttttcacttccagttgtggcagtttggggaatgggtcgacgtcgtggtggacgacctgctgcccatcaaagacgggaagctcgtattcgtgcactccgctgagggaaacgagttctggagtgctctgctctag

SEQ ID NO: 27710 - DNA, 513 bp, Artificial Sequence
  Description of Artificial Sequence: Synthetic coding sequence
atgagcgaggagatcataactccagtgtactgtaccggggtttccgcccaggtccaaaaacagcgggctcgagaactgggtctcggtaggcacgaaaacgccataaaatatcttggtcaggactatgagcagctgagggtgagatgtttgcagtcgggtacattgttccgggacgaggcctttcccccagtgccacagtcactgggctacaaggacctcggaccaaatagtagtaagacttacggaatcaaatggaaacgaccgaccgaactcctgtccaacccgcagtttatcgtcgatggggcaacccggaccgatatctgtcagggggcattgggggattgttggcttctggccgcaatcgcatcacttactttgaatgatacactgttgcatagggtcgtgccacatggccagagctttcagaacggttatgctggaattttccacttccagctgtggcagttcggcgagtgggtggacgttgtcgttgacgatcttctgcccatatag

SEQ ID NO: 27711 - DNA, 369 bp, Artificial Sequence
  Description of Artificial Sequence: Synthetic coding sequence
atgtcagaggagatcattacacccgtatactgcacaggcgtctcagcgcaggtgcagaagcagcgtgccagggagctggggctggggagacatgaaaatgccataaagtaccttggccaggactatgaacagcttcgggtgcggtgcctgcaaagcggcacactctttcgggatgaggcgttccctcccgttcctcaaagcttaggttataaggatctcgggcctaactcctctaagacctatgggattaagtggaagagaccaacagagctgctgagtaatcctcaattcattgtggacggcgcaacgagaaccgacatttgtcagggcgctctgggtgattgttggttgctggccgcaattgcatag

SEQ ID NO: 27712 - DNA, 192 bp, Artificial Sequence
  Description of Artificial Sequence: Synthetic coding sequence
atgtctgaggagattatcacaccggtctactgtactggggtgagcgcccaagtgcagaaacagcgagctagagaattgggacttggtaggcatgaaaacgcaattaagtatctcgggcaggactatgagcagctgcgggtgcggtgtctgcaatccggcacacttttccgagacgaggccttcccaccttag

SEQ ID NO: 27713 - DNA, 2145 bp, Artificial Sequence
  Description of Artificial Sequence: Synthetic coding sequence
atgagtgaagagattatcacaccagtgtactgcacgggtgtgagcgctcaagtccagaagcagcgcgcacgggagctcggattgggcagacacgagaacgcaattaagtacctggggcaagattacgagcagttgcgagtgaggtgtttgcagagtggcaccctttttagagatgaagcttttcccccagtcccacaatccttgggatacaaagatctcgggccaaactctagcaagacttatggcataaaatggaagcgacccactgagctgctctctaatccccagttcatagtcgacggagccactcgcactgatatctgtcagggagctttgggagactgttggttgctggccgctatcgccagcctgactctgaatgacacactgctacacagagtagtgccacatggccagtcttttcagaatggatatgcgggaatcttccactttcaactgtggcaatttggtgagtgggtggatgttgtcgtggacgacctacttccgataaaagatggaaaactggtgttcgtccattcagcagaaggcaatgagttttggtctgccctactggagaaggcttacgctaaggttaacgggagttacgaggccctttcaggcggttctacaagcgaaggattcgaggactttacgggaggcgttaccgagtggtacgaattgagaaaggcccctagcgacctttatcagatcatcttaaaggctctggaaagaggctccctcctgggttgttcaattgacatcagctctgttttggacatggaggcgatcacatttaagaagttggtgaagggccatgcatactcagttaccggagcaaagcaggtgaattaccggggacaggtggtgagcctgattcggatgcgcaacccttggggagaagtagaatggaccggggcatggagtgattcatcttccgagtggaacaatgtggatccgtatgaaagggaccagctgagagttaagatggaggacggggaattttggatgagttttagggatttcatgcgcgaatttactcgcctggaaatctgcaatctgacccctgatgccctaaaatcgagaacaatccgtaaatggaacacgaccttatacgagggaacttggagaagagggagtaccgcaggcggttgtagaaactacccagctaccttctgggtgaacccccagttcaaaattcgcctggacgagactgatgatccggacgactacggtgaccgggagagtggatgtagcttcgttctggcactgatgcaaaagcatcgaaggcgcgagaggagattcggacgtgacatggaaacaatagggtttgccgtatatgaggtccctcctgagctggtgggccagcccgctgtccacctcaaacgggacttctttctagcgaatgccagtcgcgctaggtccgagcaattcatcaacctccgggaagtgtctacgaggttccgtctcccacccggtgagtacgtcgtggttccaagcacgtttgagcctaacaaagagggtgattttgttctccggtttttctctgagaaaagcgccggaacagtggagctcgatgatcagattcaggccaacttgccagacgagcaagtgctcagcgaggaagaaatagacgagaatttcaaagccctgttcaggcagttagcgggtgaagacatggaaattagcgtgaaggaattacgcactattctcaaccgcatcatatcaaagcataaggatctcagaacgaagggcttctctctcgaatcatgtcgttcaatggtcaacctcatggatcgagacggaaacggcaaattgggactcgttgagttcaatatcctgtggaaccgcatccggaactatctttccattttccggaaattcgacctggacaagagtggttccatgtctgcctacgaaatgcgtatggccatagagtccgccggtttcaagcttaataagaaactatacgaactgattattacaaggtattccgagccagatctagctgtagactttgataacttcgtctgctgcctcgtcaggctggagaccatgtttagattttttaaaacattggacaccgatctagatggtgttgtaacctttgacctgtttaagtggctgcagctcaccatgttcgcatag

SEQ ID NO: 27714 - DNA, 2145 bp, Artificial Sequence
  Description of Artificial Sequence: Synthetic coding sequence
atgtcagaagagattatcaccccagtatattgcacaggggtatccgcccaggtgcagaaacagcgggcaagagagcttggtcttgggaggcacgaaaatgcaatcaaatatctcggacaggattatgaacagctcagggtccgatgtctccagagcggtacgttgttccgagacgaggcgttccctcctgtgccacaaagcttgggctataaggatcttgggcctaattcctccaaaacatatgggataaagtggaagcgcccaaccgagctgttaagtaatccccagtttatagttgatggagccaccaggacagacatctgccaaggagccttgggagactgctggctattagcggcaattgcctctctgactcttaatgatactctactgcacagggtggtcccccacgggcagtcattccaaaatggatacgccggaatttttcacttccagctctggcaatttggagagtgggtcgacgtcgtggtcgatgatttactgcctattaaagatggcaagcttgtgtttgtgcatagcgccgaagggaatgagttctggtcagctctgctcgagaaggcttatgccaaggttaatgggagctatgaggcgttatccggcggatcaacctctgaaggatttgaggatttcacgggcggagtgacggagtggtacgagctgcgaaaagcccctagtgatctttaccagattattctgaaagcactggaaagaggttccttgcttgggtgttcgatcgacataagcagtgtcctcgacatggaagccattacatttaagaagctggtaaagggtcatgcatatagcgttactggagcaaaacaagtcaactataggggacaggtggtttcactgatacgcatgaggaatccttggggcgaagtcgaatggactggtgcatggagcgattcgtcatcagagtggaacaacgtggacccctatgaacgcgatcaacttcgtgtaaagatggaagatggcgagttttggatgagctttcgggacttcatgagagaattcaccagactggagatctgcaacctgaccccagacgccctgaaatcccgcaccattcgcaaatggaatacaactctttatgagggaacttggagaaggggcagcacagccggtggttgcagaaactacccagctactttctgggtaaacccccagtttaaaattagactggatgaaacagatgatccggatgactacggcgatcgcgaatccggctgcagtttcgtattggccctgatgcagaaacataggagaagggagcggaggtttggcagggacatggagactatcggtttcgctgtctacgaagttccaccagagctggtcggccaaccagccgtgcatctcaaaagggacttcttcctagccaatgcttctcgagccagatctgaacaatttattaatctgagggaggtgtccactcggttcaggcttccgcctggagagtacgtggtggtgccctctaccttcgaaccaaataaggagggggacttcgtgctgcgtttctttagcgagaaatcagccggaaccgttgagctggatgaccagattcaggctaacttgcccgatgaacaagttctgtctgaggaggagattgatgaaaacttcaaagctctattcaggcaattggccggagaggacatggagattagcgtgaaggagctcagaacgatcctcaacaggatcatcagtaagcacaaagacttgaggaccaagggcttcagcttggagagctgccgctctatggtaaaccttatggaccgagacggcaacggcaagctcgggttagtggaattcaatatcctctggaatcgcattaggaactatctgtcaatcttccgcaaatttgacctcgataagagcggcagtatgtctgcctacgagatgcgaatggctatcgaatcggctgggttcaaactcaataagaagctatacgagcttatcattacacgctacagcgagccagatcttgccgttgatttcgacaatttcgtgtgctgtttagttcgcctggagacaatgttccggttctttaaaacactggacactgatcttgacggggtcgtcacctttgatcttttcaagtggctccagcttaccatgtttgcttag

SEQ ID NO: 27715 - DNA, 447 bp, Artificial Sequence
  Description of Artificial Sequence: Synthetic coding sequence
atgagtgaagagattatcaccccagtctactgtaccggggtgagtgctcaggtgcaaaagcagcgggctcgcgaactggggcttggcaggcacgaaaacgccattaagtatctggggcaagattacgagcaactgcgtgtgcgctgcttgcagagtggcactttgttccgagatgaggccttccctcctgttcctcaaagtcttggatacaaggatttgggtccgaatagctcgaagacctatgggattaagtggaagagaccaaccgagcttcttagcaatccccagtttatagttgacggggctacccggacggacatttgtcagggcgcattgggcgactgttggttacttgcagctatcgcctctctgacactgaacgacacactcctacatagagtcgttccccacggtcagagctttcagaatggatatgccggaatatag

SEQ ID NO: 27716 - DNA, 411 bp, Artificial Sequence
  Description of Artificial Sequence: Synthetic coding sequence
atgagcgaggaaatcattacaccagtgtattgcactggcgtgtccgctcaggtgcagaagcagagggctagagagttaggtttgggccgtcatgagaatgctatcaagtatctgggccaggactacgaacagctaagggtgcggtgtcttcagtcaggaaccttgttcagagatgaagcattccctccggtcccccagtctttgggctacaaggatttgggtcccaattcttcgaagacctacggaatcaaatggaagaggccaacagaacttctgtcaaatccacaattcatcgtggacggcgctaccaggacagatatatgtcaaggtgccctcggcgactgttggttgttggctgccattgcttctctcaccctaaacgatacattactccatcgtgtcgtaccgtag

SEQ ID NO: 27717 - DNA, 2103 bp, Artificial Sequence
  Description of Artificial Sequence: Synthetic coding sequence
atggcaggcattgctgcaaaacttgccaaagatcgcgaggccgctgaaggccttggatcacacgatagggccatcaagtacttgaaccaggattacgaagcccttcggaatgagtgcttggaggctggcacgctgttccaagatccctcttttcccgctatccctagtgcgctagggtttaaagagcttgggccatattcatccaagacaagaggcatcgagtggaaacgccctacagagatctgcgcagatccacagttcattatcggcggagcaacgaggaccgatatatgccagggagcccttggcgattgctggctgctcgccgcaatagcttctctcacgctaaatgaggagatcctggccagagtcgttccactgaaccaatcgtttcaggagaattacgcgggtattttccactttcagttctggcagtacggggagtgggtggaggtcgtcgtggatgaccggctgcctacgaaggacggcgagctgctattcgtccattctgccgagggaagcgagttttggagcgccctattggagaaagcctacgcaaagatcaacgggtgctatgaggctctgagcggcggtgccacaacagagggcttcgaagactttactggtgggattgctgagtggtatgaactgaagaaaccccctccaaatctgtttaagatcattcaaaaggcactgcagaaaggatccctcctcgggtgttcaatcgatataacctccgctgccgatagtgaagccatcacctttcagaaactggtaaagggtcacgcctactctgtcacgggcgcagaggaggtagagtcaaatggctctctgcagaagctgattagaatccgtaacccctggggggaggtggagtggactggtaggtggaacgacaattgtcctagctggaacaccatcgatcccgaggaaagagaacggctcactagaaggcacgaggatggggaattctggatgtcctttagtgactttctgcgtcactacagcagactggagatctgcaacctcaccccggatacgcttacttccgatacatataaaaagtggaagttgacaaagatggacggcaattggcgcagagggagcacagccggtggctgcaggaactatccgaatactttttggatgaatccccagtatctgatcaaactggaggaggaggatgaagacgaggaggacggtgaatctggatgcacatttctggtgggcctgatccagaaacaccggagaagacagaggaagatgggtgaagatatgcacactatcggtttcggaatatacgaagtgccggaagaattaagtggccagaccaacatccacctgagtaagaattttttcctcactaacagggcccgagagcggtccgacacttttatcaatctcagagaggtgctgaataggttcaaacttcctccaggtgaatacatattagtgccttcaacatttgagccaaacaaggacggagatttttgcatcagggtgttttctgagaaaaaggcagattaccaggcagtcgacgatgagatagaggccaacttagaggagtttgacatctccgaggacgacatcgacgacggtttcaggcgtttgttcgcccaactcgcaggagaagacgccgagatcagtgctttcgagctccaaacaatcttgagacgggttttggcaaaaagacaggacatcaagtcagatgggttctccattgagacgtgcaagatcatggtggacatgctggacagcgatggctctggcaagctgggccttaaagagttctacatcctgtggacaaagatccagaagtatcagaagatttatcgagagattgacgtggacaggtcagggacaatgaattcctacgagatgcggaaggctctggaggaggcaggcttcaaaatgccatgccagctccatcaggtaatcgtggctcgattcgcagatgaccagctaatcatcgattttgataatttcgttcgctgcctggtccggctggaaacactgtttaaaatatttaagcagttggatccggaaaacacgggaaccatcgaactggacctcataagctggttgtgttttagtgttctctag

SEQ ID NO: 27718 - DNA, 2190 bp, Artificial Sequence
  Description of Artificial Sequence: Synthetic coding sequence
gctcctggtcccggtcgagccccagcagagcgctccgctgaatctccccgtcctttttcagcgcagtatggaagacgcgatcgcagcatggcgggaatcgctgcgaaactggcaaaagaccgggaagcagccgaggggctgggctcccacgatcgggcaatcaaatacctaaaccaggattatgaggccctccggaatgaatgccttgaggccggaactctgtttcaggatcctagtttccctgctatcccttcagcacttggcttcaaggaacttggcccttatagctctaagactagaggcatagagtggaaacgaccgaccgaaatctgtgccgatccacagtttatcattggcggagccacacggaccgatatctgtcagggagccctcggcgattgttggctgctggcagctatcgcttctttaaccctcaacgaggaaattttagcgagagtggtgcctctgaatcagtcttttcaggaaaactacgctggaatctttcatttccagttctggcaatatggcgagtgggtcgaagtcgtcgtcgacgataggctacctactaaagatggtgaacttctgtttgtgcactctgcagaaggctctgagttctggtccgctctcctggagaaggcttatgccaaaatcaacggctgctatgaggccttgagcggcggtgccacaaccgagggcttcgaggacttcacagggggaattgcagagtggtatgagctgaaaaaaccacccccaaacctgttcaaaattatccagaaagctctgcagaaaggctccctgttgggatgctctatcgacatcacatccgccgcagacagtgaagctattactttccagaagctggtgaagggtcacgcatacagcgtaacaggggctgaggaggtggagtccaacggatctctccagaagcttatccgaattaggaacccatggggggaagtggagtggactggcaggtggaacgataattgcccgtcctggaacactatagatcctgaggaaagagagagattgaccaggcgccacgaggacggcgagttttggatgtcattcagcgacttcctaagacactacagtcgactggagatttgtaatttgacgcccgacaccctgacatcagacacctacaaaaaatggaagctcaccaagatggacggtaattggcggagagggagcaccgcagggggttgtagaaactatcccaatactttttggatgaatcctcagtatctgattaaattagaagaagaggatgaggacgaggaggacggcgagtcaggctgcacctttctggtgggcctgatccagaagcacagacgcaggcaaaggaagatgggcgaagacatgcacaccatcggatttggtatttacgaggtacatcctcagttgtccggtcagaccaatatacacttgtcaaagaactttttcctgaccaacagggctcgcgagcgcagtgacacctttattaatttaagggaagttctcaatcgatttaaacttcccccaggggagtatatcctggtgcctagtactttcgagcccaataaagacggcgacttctgcatcagggtcttctctgagaagaaggccgattaccaggcggttgatgacgaaatcgaagctaacttggaagagttcgacatctctgaggatgatattgacgatggattcaggagattgtttgcccagctggccggagaggacgcagaaatctcagccttcgaactccagaccattctgaggcgcgtcctggccaagcgtcaggatataaagagtgacggattctccatcgagacatgcaagattatggtggatatgcttgactctgatggctctgggaaacttggcctgaaggagttttacatactgtggacaaagattcagaagtaccagaagatctaccgggaaattgacgtggacaggtctggaactatgaattcctatgagatgaggaaagcactagaggaggccggttttaaaatgccctgtcaactgcaccaggtgatagtggcacggttcgctgacgaccagcttataattgactttgataactttgtccgatgcctcgttcggctggagaccctgtttaagatatttaagcaactagaccctgagaataccggcaccatagaactggacctgatcagttggctttgtttcagcgtgctgtag

SEQ ID NO: 27719 - DNA, 1869 bp, Artificial Sequence
  Description of Artificial Sequence: Synthetic coding sequence
atggagatctgcgccgacccgcagttcattattggaggagcaacgaggacggatatttgtcaaggcgcactcggcgattgttggctcctggccgcaatcgcctccctgaccctgaacgaagagattctagctcgcgtagtccccttaaaccagtcttttcaagaaaattacgcagggatcttccacttccagttctggcagtacggggaatgggttgaggtagtcgtggatgatcgactgcctaccaaggacggagagttactattcgtccatagcgctgaaggctctgaattttggtcagctctcttggagaaagcttatgccaagatcaacggctgctacgaggcactctctggaggggctacaaccgaggggtttgaagacttcacaggcggaattgccgaatggtatgaactaaagaagcctccacccaacttattcaaaataatacagaaggccctccaaaaggggtctctgctggggtgttccatagatatcactagcgccgcagatagcgaagcaattactttccagaagttggtcaagggccacgcctacagcgtaactggcgcagaggaggtggaaagtaacgggagtctgcagaagttgattagaatccgaaatccctggggtgaagtcgagtggacaggaagatggaatgataactgtcccagctggaacactattgaccctgaggagcgcgagcggttgacaaggcggcatgaggatggagagttctggatgagtttcagcgactttctgaggcattattcccggcttgaaatctgcaatctgactcccgatacccttacgtccgatacatacaagaagtggaagctgactaagatggacggcaactggcggagaggctccaccgccggtggctgtagaaactaccccaacactttttggatgaaccctcagtacctaatcaagttggaagaagaagatgaggacgaggaggatggcgagagcgggtgtaccttcctggtaggactaatccagaaacacagacggaggcagaggaaaatgggtgaagacatgcatacaatcggattcggcatttatgaagtacctgaagaactcagtggccaaactaacattcatctctccaaaaatttctttctcacaaatcgggctcgagagagatcggacacattcattaacctgcgcgaagttctcaatcggtttaagctaccaccgggtgaatacatcctcgtgccatccacattcgagcccaataaggacggcgacttttgtatccgagttttcagtgaaaagaaggcggactaccaggcagtggacgacgagatcgaggctaatctagaagaattcgacatcagcgaggacgatattgacgatggctttaggaggctgtttgcccagctggccggagaagacgccgaaatcagcgctttcgaattgcaaacaattctgaggcgcgtattggccaaaaggcaagatatcaaaagtgacggattttccattgagacctgcaaaatcatggtagatatgctggactcagacgggagtggcaaactgggactcaaggaattctacatcctttggaccaaaattcaaaagtatcaaaaaatttatcgagaaatcgacgtggacaggtctgggactatgaacagctacgagatgcggaaagctttggaggaggcaggttttaaaatgccctgtcaactccatcaggtgattgtggcgagattcgcagacgaccagctgatcatcgacttcgataacttcgtccgctgcttagtaagactggagacattgtttaaaatatttaagcagctggaccccgagaatacgggaactatagagctggatctaatttcttggctctgtttcagcgtgctttag

SEQ ID NO: 27720 - DNA, 396 bp, Artificial Sequence
  Description of Artificial Sequence: Synthetic coding sequence
atggagatatgcgctgacccgcagtttattataggaggggctactcgcaccgacatctgtcagggagctctcggcgactgctggcttttggcagccatcgcatcgctgacccttaatgaggagattctagcccgtgtggtgcctttaaaccagtcattccaggagaactatgcgggtatttttcactttcagttctggcagtacggagagtgggtggaagtagttgttgacgaccgactgccaaccaaggatggggagctgctctttgttcactcagctgaaggatctgagttctggtcggcactgctggagaaagcttacgcgaagatcaatggctgctatgaggcccttagcggcggagcgacaaccgaaggatttgaggacttcacgggctag

SEQ ID NO: 27721 - DNA, 156 bp, Artificial Sequence
  Description of Artificial Sequence: Synthetic coding sequence
atgaagaatcgggaagccgcaagggagtgtcggagaaagaaaaaagagtacgttaagtgtttggagaaccgggtcgcggtgctggagaatcagaacaaaacactgattgaggaactgaaggcactgaaggacctgtactgtcacaaatccgattag

SEQ ID NO: 27722 - DNA, 984 bp, Artificial Sequence
  Description of Artificial Sequence: Synthetic coding sequence
atgaccatggagtcgggcgctgagaatcagcagtcgggtgatgcagccgttaccgaagctgagaaccagcagatgaccgtgcaagcacagccacagatcgccaccctcgcgcaggtgtcaatgcctgccgcacacgccacctcaagcgcacctacggtaaccttggtgcagctgccgaatggccagaccgtgcaggtacacggcgtcatacaggccgcacagccatcggtcatccaatcaccccaggttcaaactgtacagatatcaacgatcgccgaaagcgaggatagccaggaaagcgtggatagtgtgaccgactcacagaagcggagagagatcctgagccgtcgaccctcttaccgaaagatcctgaatgacctctccagcgatgcacctggcgtgccccgtattgaggaagaaaagtctgaagaagaaactagcgcacctgcgatcacgaccgtgaccgtacccactccaatctaccagacatcatcagggcagtatatcgcgatcactcagggaggtgctatccagctggctaacaatggtacagacggcgtgcaggggttgcaaaccctgaccatgacaaacgcagccgctacccagcccggaactacaattctacaatatgcgcagacgacagatggccaacagatcctggtgccaagcaatcaggttgtcgttcaggcggcttcaggtgatgtgcagacctatcaaatccgcaccgctccaacaagtaccatcgctcccggtgtagttatggcctcctcgcctgccctgcctacgcagccagcagaagaagccgcaaggaagagggaagttcgactgatgaagaatcgggaggccgcacgggaatgcagacgcaagaagaaggaatacgttaaatgtctggagaacagggtcgcggtgctggagaatcagaataaaaccctgatcgaggaacttaaagccctgaaggacctttactgtcacaagagcgactag

SEQ ID NO: 27723 - DNA, 693 bp, Artificial Sequence
  Description of Artificial Sequence: Synthetic coding sequence
atgaccatggaaagcggtgccgagaaccagcagagcggtgatgcggctgtgactgaggccgaaaaccagcagatgactgtacaggctcagccgcagattgctaccctggcacaggtctctatgccggctgcccacgccacgtccagcgcacctaccgttacactcgtccagctgccaaatggacagaccgtccaagtccatggggtgatccaagcagcccagccctctgtcatccagtctccgcaggtacagacagtgcagagttcctgtaaggatctgaaaaggctattttcaggcacacagatctcaaccatagccgagtcagaagactcccaggaatccgtggactctgtgaccgatagccagaaaaggcgggagattctttcgaggcgaccaagctacagaaaaatccttaacgacttgtcctctgacgcacccggagttcctcgcattgaggaagagaagtcagaggaagaaacttcagctctgcctactcagcccgcagaagaagccgctcgcaaaagagaagtccgattaatgaagaatcgtgaggctgcaagagagtgtcggaggaaaaaaaaggagtacgtcaagtgtcttgagaaccgggtggccgtcctggagaaccaaaacaagactctgattgaagagctgaaagctcttaaagacctgtactgtcataagagtgattag

SEQ ID NO: 27724 - DNA, 240 bp, Artificial Sequence
  Description of Artificial Sequence: Synthetic coding sequence
atgacaatggagagtggtgcagagaatcagcaaagcggtgacgctgctgtaactgaagctgagaatcaacagatgaccgtgcaggcccaaccccaaatcgccacacttgcacaggtgagcatgccagcggctcacgctaccagctcagcgccaactgttaccctggtccagctccccaacgggcagaccgtccaggtgcatggagtgattcaagccgctcagcctagcgtcattcagtag

SEQ ID NO: 27725 - DNA, 984 bp, Artificial Sequence
  Description of Artificial Sequence: Synthetic coding sequence
atgaccatggagagtggagccgagaatcaacagtccggcgatgccgcagttaccgaggctgagaatcagcagatgacggtgcaggcacagcctcagatagccacactagctcaggtcagcatgcccgcagctcacgcaacaagctcagctcctactgtgactctggtgcaattgccgaacggacagacagttcaggtgcacggagtgattcaggcagcccagcctagcgttatccagagcccacaggtccagaccgtccagatttcaactatcgcagagagcgaagatagccaggaaagtgtggatagtgtgactgatagccagaaacgaagggaaattctgagtagacggccatcataccgtaagatcctaaacgacctgagtagcgacgccccaggggtccctaggattgaagaagagaagtctgaagaagagacctcagcaccagccatcaccacagtgactgtccctactccgatttaccagacaagcagtggacagtatatcgcaatcacccagggtggggcaatccagctggcgaataacggcacagatggggtgcagggattgcaaaccttgaccatgaccaatgcagctgctacccagcccggaacaacaattctgcagtatgctcagacaacagacggacaacagattctggttccctcaaatcaggtggtcgttcaggcagcgtccggagatgtccagacgtaccagatcaggaccgcaccgacaagtactatcgccccaggcgttgtgatggccagctcgcctgccctgccaacacagcctgcagaagaggccgctcgcaaacgagaggtaagactgatgaaaaatagggaggccgcacgtgaatgtcggcgaaaaaaaaaagagtatgtcaaatgcctcgaaaatcgggttgcggtgctcgaaaaccaaaacaaaaccttaatcgaggaactgaaagctcttaaggatctttactgtcacaagtccgattag

SEQ ID NO: 27726 - DNA, 1026 bp, Artificial Sequence
  Description of Artificial Sequence: Synthetic coding sequence
atgacgatggaaagcggcgctgagaatcagcagtctggtgatgccgctgtgacggaggccgagaatcagcaaatgaccgtgcaagcccagccccagatcgccacactcgctcaagttagcatgcctgccgcacacgctacaagcagtgccccaaccgttacgctggtccagttgccaaacggccagacggtgcaggtgcacggcgttatacaggctgctcagccctcagtcatacagtctccccaggtccagactgtgcagagttcctgcaaagaccttaaacgccttttcagcggcacacaaatcagcacaatcgctgaatctgaggactcgcaggaaagcgtggattcggtcaccgattcacagaagcggagggagatactcagcaggcggccatcgtaccggaaaatcctgaatgacctttcttctgacgcgccaggtgtaccacggatcgaggaggagaaatctgaagaggaaacaagtgctcctgcaattactaccgtgactgtgcctactcccatctatcaaacttcatccgggcagtatatcgctattacccagggtggcgcaattcagttggccaataatgggacggatggcgttcagggacttcagacacttacaatgactaatgcagccgcaacccaaccgggaacaactattctgcaatatgcccagacgacagacgggcaacagattcttgttccttctaaccaggtggttgttcaggcagcctctggggatgttcagacgtatcagatccgaaccgccccaaccagcactatcgcacccggtgtggtgatggcctccagccccgctctgcctacgcagcccgcagaggaagccgctagaaaaagagaagtccgcctaatgaagaaccgggaggctgcacgggagtgtcgtcgcaagaagaaagagtatgtgaagtgcttggagaatcgcgtcgccgtgctcgagaatcagaataagacactgatcgaggagctgaaggccctgaaagatttgtactgtcacaagtctgactag

SEQ ID NO: 27727 - DNA, 549 bp, Artificial Sequence
  Description of Artificial Sequence: Synthetic coding sequence
atgaccatggagagtggcgcagaaaaccagcagagcggtgacgccgcagtcacggaagcagagaatcagcagatgaccgttcaagctcaaccacaaatagcaacgctcgcacaggtaagtatgcctgcagctcatgctacctccagcgctcccaccgtgactctggttcagcttcctaacggtcagacggtgcaggtgcatggtgtcatccaggcggcacagccgtcagtgattcaaagtccccaagtgcagacagtacagtcctcatgtaaagacttgaagcggctctttagcggcacccaaatctcaaccatcgctgaaagcgaggactcccaggagagtgtggattccgtgacagactctcagaaacggagggaaattctgagcaggagacctagctatcgcaaaattctcaatgacttgtcaagtgacgcccctggagtcccgaggatcgaggaagagaagagcgaagaagagaccagcgcaccggctattaccaccgtcactgtccccactcctatttaccaaacaagctctggccaatactag

SEQ ID NO: 27728 - DNA, 399 bp, Artificial Sequence
  Description of Artificial Sequence: Synthetic coding sequence
atgacaatggagtccggggcagaaaatcagcagtcaggcgacgcagccgtgacagaggctgagaatcagcagatgacagttcaagcccaaccacagattgctacactggctcaagtctctatgccagctgcccacgccacctctagtgcccctacagtgacgctggtgcagctgcccaacggtcagacggtgcaggtgcatggggtcattcaggccgcacagcctagcgtgattcagtccccacaggttcagacagtccagtcttcttgtaaggatctcaagagattgttttccggcactcagatcagtacgatcgctgagagtgaggacagccaagaaagtgtggactcggtcacagattcccagaaaagacgggaaatactcagcaggcggccatag

SEQ ID NO: 27729 - DNA, 705 bp, Artificial Sequence
  Description of Artificial Sequence: Synthetic coding sequence
atgacgatggagtctggtgcggagaaccagcagagtggggatgccgcagtcacagaagcagagaatcagcaaatgaccgtccaggcccaaccacaaatagcaactctggcccaagtgtccatgcccgctgcccatgccacatcttcagcgccaacagtcaccctcgttcagctgcccaatggccagacagtgcaggtccatggtgtaatccaggccgctcagccatcagtcattcagagtcctcaggttcagactgttcagatttctacgatcgccgagagcgaggattcacaggaatctgtggactccgtgacagattcacagaagcgaagagagatcttgtcccggaggccctcgtacagaaaaatcttgaatgacctgtctagcgacgccccaggagtccccagaatcgaggaagagaagtccgaggaggaaacctcggcccctgcaattaccaccgtgactgtgcccacacccatctatcagacaagctccgggcagtatattgccatcactcagggtggcgctatccagcttgccaacaacggtacagatggcgtgcaggggctgcagacactgaccatgactaatgccgctgccacccagcctggaaccacaatcctgcaatacgctcagacgacggacgggcaacaaatattagtgccgtcaaatcaagtagtcgtgcagggaacccagaaattgtag

SEQ ID NO: 27730 - DNA, 462 bp, Artificial Sequence
  Description of Artificial Sequence: Synthetic coding sequence
atgcccgcagcacatgctacctcctctgcccctactgtgacccttgtgcaattacccaatggccaaactgtccaggtccatggggtcattcaagccgcacagccctctgtcattcagagtcctcaagtgcagaccgtccagagcagttgtaaggaccttaaacgactcttctccggtacgcagatatcaactatagcagagagcgaagacagtcaggagagcgttgacagcgtcactgactcccagaagcggagggaaattttatcccgtagaccttcttaccggaagatcttgaacgacctcagctccgacgccccaggggttccacgaatcgaggaggagaaaagtgaagaggagacatctgctccggctatcactaccgtgacagtccctactccaatctaccaaacctccagcggccagtacacatatctacgggacaccacttattcctgccaatag

SEQ ID NO: 27731 - DNA, 1998 bp, Artificial Sequence
  Description of Artificial Sequence: Synthetic coding sequence
atggctcacgagatgattggtacgcagattgtgaccgagcgcctggtcgcactgctggagagcggaacagagaaggtccttctgatagatagtcggccattcgtggaatacaacacaagccacatacttgaagccatcaatatcaactgtagcaagctgatgaagaggcggcttcagcaggacaaggtgctgatcaccgaactgatacagcactcagccaagcataaagtcgacatcgactgttcccagaaagtcgtggtgtacgatcagtcatctcaggacgttgctagcctttcaagcgactgtttcctgaccgtgctccttggcaagctagaaaaatctttcaatagtgtgcatctgttagccggagggttcgccgagtttagcaggtgttttccgggtctgtgtgagggtaaatctacattagtccctacatgtattagccaaccatgtctccctgtggcaaacatcggccctactaggatcctaccaaacctttacctcgggtgccagagagatgttctcaataaggaattgatgcaacagaacggaatcggctatgtgctgaacgcctcaaatacgtgccccaaacccgacttcattccggagagccatttcttaagagtgccagtgaatgacagtttttgcgagaagatcttaccttggctcgacaagtcggttgattttatcgaaaaggccaaagcctctaacgggtgtgttttggtgcactgtctggcgggaattagtcggagtgccacaatcgccatcgcttacatcatgaagagaatggacatgtccttggatgaggcttacaggtttgtgaaggagaaacgtcccacaatctctccaaactttaattttttgggtcagttactggactatgagaaaaaaatcaagaaccagactggtgcatccggccctaagtcgaaactgaaactgctgcacctggaaaaaccgaacgagccggtacctgccgtcagtgagggagggcagaaaagcgagactccactgtcacctccatgtgctgatagcgccacaagtgaggctgcaggccaaaggcctgtgcacccagctagcgtcccatcggtgccttcagtccagccatcacttttagaggacagtccccttgtgcaggctctgtccgggcttcacttgagcgctgaccgacttgaagatagcaataagttaaagcggtctttctcactcgacataaagtctgtatcctactctgctagtatggccgcttctttacatggctttagttcctcagaggatgccctggaatattacaagccttcaacaacacttgacggcaccaacaaactttgccagttttcacccgtacaggagttatctgagcagacccccgaaacgtccccagataaggaggaagcatccataccaaaaaagctgcagactgctcgtccaagcgactcacagtccaaacgattgcacagcgtccgcacctcctcctccggtactgctcagaggtctctgctttccccactgcacaggagtggctcggtagaagacaactaccacacaagctttttgtttggactatcgaccagccagcagcatctgaccaagtcagccggattgggcctgaagggatggcacagtgatatcctggcccctcagacatctacaccaagcctgacatctagttggtactttgcgacggagtcaagccacttctactcagcctctgcaatttatggaggttcggcgtcttattctgcctatagctgctctcagctacctacttgcggagatcaggtttattctgttcgcagaaggcagaaaccttcggacagagcagactctcggagaagctggcacgaagagtcacccttcgagaaacaatttaagcgccgatcatgccagatggaattcggcgaatcaattatgagcgagaatcggtctcgtgaggagctcggcaaggtcggaagtcaatcttcgttctcaggatccatggaaattatcgaggtgagctag

SEQ ID NO: 27732 - DNA, 939 bp, Artificial Sequence
  Description of Artificial Sequence: Synthetic coding sequence
atgcgcatgttgcttgccttgcttgctctttccgcagcccgaccatcagctagcgctgagtcccactggtgttatgaggtgcaggccgaatcttccaattacccatgtctggtacctgtgaagtggggaggaaattgccagaaagaccgtcagtccccgattaacatagttactactaaggcgaaagtcgacaagaagctgggcaggttcttcttctctggttacgataaaaagcagacttggacagtgcaaaataatggacactcagtgatgatgcttctagaaaataaagcaagcatcagtggtggcggactgcccgcaccatatcaggccaagcaactccacctgcattggtctgatctcccctataagggctccgagcattcattagatggagagcattttgcaatggaaatgcatattgtacacgaaaaagaaaaaggcacaagtcgcaacgtgaaggaggcacaggatcctgaggatgagattgcggttctggcctttctcgttgaagctggcactcaggtcaacgaaggctttcagcccttggtcgaggcactgtctaatatcccaaaaccagagatgagtaccacaatggcagaatccagccttctggatctgctacccaaggaagagaagctccgccattactttcgttacctcgggtccctgaccaccccgacctgcgacgagaaagtggtttggactgtgttccgggaaccgatccagctgcaccgggagcagatactcgctttctcacagaagctgtactacgacaaggaacagactgtgagcatgaaggacaacgtccggccattacagcaacttgggcagcggactgtgattaagtctggagccccaggtcggccattgccttgggcgctgccagcactgttggggcctatgctggcatgcctgttagcagggtttctgcgttag

SEQ ID NO: 27733 - DNA, 1380 bp, Artificial Sequence
  Description of Artificial Sequence: Synthetic coding sequence
atggctcccctgtgtccctccccttggctgcccctgctgatccctgcgcctgcccctggactcaccgtccagctcttgcttagcctgctgctcctggtaccagtgcacccgcagcgcttgccacgcatgcaggaggacagccctcttgggggaggcagcagcggcgaggatgaccccctgggcgaggaggatctcccttccgaggaagatagtccccgtgaagaagacccaccaggcgaagaagaccttcctggggaagaagatttgcctggtgaagaggacctccctgaggtgaagcctaagagcgaagaagaagggagcttgaaactggaggacttgcccacggtggaggcccctggcgatcctcaggaaccccagaataacgcacatcgggataaggagggcgatgaccagtcacactggaggtatggcggagatccaccctggccccgtgtgagccctgcctgcgctggcagatttcagagtcccgtcgacattagacctcagctggcagccttctgcccagctctgcgcccactggaactgttaggttttcagttaccgccacttcccgaattgcggcttaggaataacggacattcggtgcagttgacgcttccacctggactggaaatggccttaggcccaggacgggaatacagggctctccaactgcacttgcactggggcgcagctggacggccaggatccgagcatacagtcgaaggacaccggtttccagccgagatacacgtggtacacttgtctacggccttcgccagggtcgacgaagcccttggacggcctggcggactggcagtgttggctgccttcctggaggagggtcctgaggaaaatagcgcatacgagcaactgctgtctaggcttgaggagattgccgaggaaggctccgagactcaggtccccggattggatatttcagcacttttgccttccgacttctctcgatactttcagtatgagggtagtctaactaccccaccctgcgctcaaggagtgatttggactgtgttcaatcagacagttatgttgtctgctaaacagctgcatacactcagcgatacactgtggggtccaggcgactctagattgcaactcaattttcgcgctacgcagcctctgaatggtagggtaatagaagcgagcttccccgctggggtcgacagctcccccagggccgctgagccagtgcagttgaacagttgcctggcggcaggagatatcttggccctggtgtttgggctgctattcgcagtgacatcagtggctttcttggtccagatgcgcagacaacaccggcgaggcaccaaaggtggcgtgagttaccgcccagccgaagtggccgagactggggcttag

SEQ ID NO: 27734 - DNA, 1071 bp, Artificial Sequence
  Description of Artificial Sequence: Synthetic coding sequence
atggcccctttatgccctagcccatggcttcccttgttgatcccagcacctgccccagggctcacagtgcaattgctactgtcccttctactcctggtgccagtacatccccagcggctgcctcggatgcaagaggactcccccctgggaggtggtagttcaggagaagatgacccgttaggggaagaagatctcccaagcgaggaggacagcccccgagaggaagatcccccaggcgaagaagatcttccaggtgaagaagatctgccaggcgaggaggatttgcccgaagtgaagcccaagtcagaagaagagggcagcctgaagttagaggacttacctaccgtcgaggctcctggtgatccacaagaaccacagaacaatgcacaccgggacaaagagggagatgatcagagtcactggaggtacggcggtgaccctccgtggccacgggtttcacctgcttgcgctggacgtttccagagtcccgtagacatcaggccccagttggccgctttctgtccagccctgcgtcctctggagctcctgggattccagttacctccccttccagagctgcggctgcgcaataacggccatagtgtccaactgacacttccaccaggactcgaaatggccctgggacccggacgcgaatatcgggctctgcagctgcatctccactggggagccgctggcagaccaggctcggagcatacagtggaggggcatcggttccccgcagagatccacgttgtgcatttgtcaactgccttcgccagggttgacgaggcactcgggagacctgggggactggccgttctcgccgcttttctcgaggagggccctgaggaaaactccgcctacgagcagttgctctcaaggttggaggagattgctgaggaggggtccgagacccaggtgcccggactagacatcagcgccctcctgccctcggacttctctcggtatttccaatacgaaggatctctaacaacccccccatgcgcacagggcgtcatttggaccgtgtttaatcagaccgtaatgttgagtgctaaacaatcctag

SEQ ID NO: 27735 - DNA, 2775 bp, Artificial Sequence
  Description of Artificial Sequence: Synthetic coding sequence
atgccaggtccatcccctggccttcggagagccctcctcgggctctgggcagccctcggtctcgggctgtttggcctctcagctgtctcgcaggagcctttctgggccgatctccagccaagagtggcttttgtcgaaagaggtgggtctctctggcttaattgctctacgaactgtcctcggccagaaagaggtggcctcgagaccagcctgcgcaggaatggaacccagcgcggactcaggtggctggcaagacagttggtggacatccgtgaaccagaaacccaacctgtgtgtttttttagatgcgcgagacgaaccctgcaggccagaggactgatccgaacctttcagcgacccgatcgagtcgagcttatgccactgccgccatggcagcccgtcggggaaaactttacactgtcctgccgggtcccaggagcgggaccacgagccagccttactctgacactcttgagaggagctcaagagctgattcggaggagctttgccggagagccaccaagggccaggggagctgtgctgacagcgaccgtcctcgctaggagagaagaccatggcgctaacttttcctgcagagccgaactggatctccgcccacatggcttggggctgttcgagaactcaagcgcacctagggagttacggactttttcactgagccctgatgctcccaggttggccgctcctcggcttttagaagtgggaagtgagagacctgtgtcgtgcaccctcgacgggctgtttcctgcttctgaggcaagagtctacttggccctaggcgatcagaatctgagcccagatgtgaccctggagggggacgccttcgtggcgaccgccaccgcaaccgcctctgcagaacaggaaggcgctcgccaactggtttgtaacgtgacactgggaggagaaaatcgggaaacccgcgagaacgtaaccatttacagcttccccgctccactgttgacgctcagtgagccttccgtgtctgagggtcagatggtgacagtaacctgtgccgcaggcgctcaagctctcgttaccttagaaggggtacctgccgctgtgccaggacagcctgcacagttacagctcaacgcaactgaaaatgatgacagacgtagtttcttttgcgacgcgactctggatgtcgacggggagaccttgattaaaaacaggtccgcagagctgcgtgttttgtacgctcctaggctggacgactctgactgtccaaggagctggacgtggcccgaaggacccgagcagacattaagatgtgaggcacgaggtaacccagagccctctgtgcattgcgcgcgtagcgacgggggtgccgtgttggcactaggcttactcggcccagtgactcgggctctgtccgggacatatagatgtaaggctgccaatgaccaaggagaagccgtgaaagacgtcaccctcacagtggaatatgctccagcacttgacagtgtgggctgtcctgagcggattacttggttggaagggacggaggcgtccctctcttgtgtagcccacggagtgccacccccagacgtcatctgcgttcgaagcggggagctgggcgcagtgatagaaggactgctccgggtggcccgagagcatgctggtacataccgctgtgaggcaacgaaccctcggggatcggctgcgaagaacgtagcagttactgtggagtatggacccaggttcgaggagccttcttgtccatcaaattggacgtgggtggagggatcgggccgtctcttttcctgcgaggtcgatggcaagccacagcccagcgtgaaatgcgtcgggagcgggggagccaccgagggcgtgctgcttccactggctccgccagacccttcaccacgtgcgcctaggattcctcgggtgctggctccgggtatttacgtgtgtaatgcgaccaaccggcatgggtctgtggctaagaccgtcgtggtttcggcagagagcccccctgagatggatgagagcacttgtccttcacatcagacttggctggagggcgcagaagccagtgctcttgcatgcgcagcacgcggacgcccatcacctggggttcggtgctctcgggaaggcatcccctggcctgaacagcagcgggtgtctcgggaggatgccggaacatatcactgcgtcgcaactaacgcccatggcaccgatagtcgtaccgtgactgtgggcgtggagtaccgtcccgttgttgctgaattagccgcttcgcctccaggaggcgttcggcctgggggaaacttcactcttacctgccgcgctgaagcttggccccctgcacaaatttcctggagagcacccccaggggctctgaacatagggctttcatctaataacagcacactaagcgtggcaggcgctatgggctctcacggtggcgaatatgagtgtgcagccaccaatgctcacggcaggcacgctcgacgcatcaccgtaagagtagctgggccatggctgtgggtggctgtggggggagccgctgggggtgctgctctattggcagccggtgctggtttggctttttatgtgcagtcgacagcctgtaagaagggtgaatataacgtccaggaagccgagtcatctggtgaggcagtgtgcctgaacggggctggcggtggagccggaggagccgcaggagctgagggtggaccagaagccgctgggggagctgcggagagccctgccgaaggagaggtgtttgctattcagttgacctctgcttag

SEQ ID NO: 27736 - DNA, 1263 bp, Artificial Sequence
  Description of Artificial Sequence: Synthetic coding sequence
atggaatccccaagcgctcctccccatcgatggtgtattccatggcaacgtttgctgcttaccgcaagtttgctgaccttctggaatcctcctacaacagccaaactcacaattgagtctacccctttcaacgtggcggaaggaaaggaagtgttgctgctcgtccacaacctgccacagcacctcttcggctattcgtggtataagggagagagagttgacggcaaccgtcagattataggatatgtcataggcacacagcaagctactcccggtccagcttactccggcagggaaataatttatccaaatgctagcctcctgatccagaacattatccagaacaaactctctgtggaccactccgatcccgtgattctgaatgttctgtacgggccagacgaccctaccatcagcccctcttacacatattaccggcctggggtcaatctgagtctgagttgtcacgccgcaagcaaccccccagcgcagtactcctggctcatagacgggaacattcagcagcacacacaggagctgtttatctccaatattaccgagaaaaactcgggcctgtacacctgccaagctaataactccgcaagcggtcacagtagaactacagtgaagacgattaccgtgagcgctgagttgcccaagcctagcatttctagcaataatagcaagcctgtggaggacaaggatgccgtagcgttcacttgcgagccagaagcacagaacaccacgtatctgtggtgggtaaacggccagtccctccctgtgagccccagactccagttgagcaacggaaatcgcaccctgacactcttcaatgttacccggaacgatgccagggcttacgtgtgtggtatccagaattctgtgtctgccaatcgctcagatcctgtgaccctcgacgtgttgtatggtcctgatacccccattatctctccccctgattcttcttatctctccggtgcgaacctaaacttatcatgccatagtgcttccaatccctcgccccagtactcctggaggatcaatggaatcccacagcaacatacacaggtgctgtttattgccaaaattacaccaaacaacaatgggacctatgcctgctttgtgagcaacttggcgactgggagaaacaacagcatcgtgaagagtatcacggtcagcgcctcaggtacatcccctggactgtcagccggtgccaccgtggggatcatgataggagtgctagtgggtgtggccctgatctag

SEQ ID NO: 27737 - DNA, 2109 bp, Artificial Sequence
  Description of Artificial Sequence: Synthetic coding sequence
atggaatctccaagcgcccctccacatcggtggtgcattccctggcagagactgttgctgactgcctccctgctgaccttttggaacccccctaccaccgctaagctcaccatcgagtctacaccatttaacgtcgccgagggaaaagaagtgctccttctggtgcacaatctcccccaacacttgttcggctattcctggtacaaaggggaacgcgtagatgggaatcgtcagataatcgggtacgtgattgggacccagcaagcgacacccggtcctgcatattctgggcgtgagatcatataccccaacgcatctctccttattcaaaacattattcagaacgatacagggttttacacccttcatgtaatcaagtctgacctggtgaatgaagaggcaaccgggcaattcagggtataccccgaattacctaagccttcaattagcagtaataacagtaaacctgtggaagataaggacgctgttgccttcacctgcgagccagagactcaggacgcaacgtatctgtggtgggtgaacaatcagtcattgccggtgtcgccccgtctgcagttatccaatgggaaccgcacattgacccttttcaacgtcacccgaaacgacaccgcctcatataagtgtgaaactcaaaatcctgtgagcgctcgacgttcggactctgtaattttaaacgtcttatacgggccagacgcacccactatttcacccctcaatacttcttatagatcgggtgaaaacctcaacctctcatgccatgcagccagtaatccccctgctcagtactcttggtttgtcaatggaacatttcaacagagcacacaggagttatttatacccaacattaccgtaaacaactcaggcagctacacatgtcaggcccacaattcggacacagggctcaatcgaaccactgttacaaccatcactgtgtacgccgaacctcctaagccttttatcacatccaataactctaaccctgtagaggatgaggacgccgtggccctgacctgcgagcccgagatccagaataccacttacctgtggtgggttaacaatcaatctttgcctgtgtcaccaaggttgcaattgagcaacgacaaccgcacactcaccttgctttcagtgacaaggaatgatgttggcccttacgaatgtggtatccagaacaagttatccgtggaccattctgatcccgtgatcttgaacgtgctctacggccctgacgatcctactatctctccatcttacacttactacagacccggagttaacctctccctcagctgtcacgcagcttcaaacccacctgcccagtactcatggttgatcgacggcaacatccaacagcacacgcaggagctatttatatccaacatcactgagaagaatagcggcttgtacacctgtcaagccaataacagcgctagtggccactctaggactacagttaagacaatcacagtctccgccgagctgcccaagccatcaattagctctaataatagcaagccggtggaggataaggatgccgtagccttcacatgcgagcctgaagcccaaaacacgacgtatttgtggtgggttaacggccagtccttaccggtttcgccgcgtctgcagctaagtaatggaaacaggactctcacattattcaacgtgacaagaaacgatgcacgcgcatatgtgtgcggcattcagaactcggtcagcgcaaacagatcggaccccgtaaccctggacgtcctttacgggcctgacactccgatcattagccctcctgatagctcgtacctgagcggcgctaatctgaatttgagctgccatagcgcctccaatcctagcccccaatacagctggcgaattaacggcataccccagcagcacacccaggtcctgttcattgccaagatcacacccaataacaacggtacttatgcatgcttcgtcagcaatctggccacaggaagaaacaatagtatcgtgaaaagcattactgtctctgccagtggcacttcacctggtctcagcgctggtgcaaccgtgggcattatgatcggcgtgctcgttggcgttgcccttatctag

SEQ ID NO: 27738 - DNA, 1035 bp, Artificial Sequence
  Description of Artificial Sequence: Synthetic coding sequence
atgggaccacctagtgcacctccgtgcaggctgcacgtaccgtggaaggaggtcttgctgaccgcttccctgctgaccttctggaatccgccaacaaccgccaaactgactatcgagtccacacctttcaatgtggccgaaggaaaggaggtgctgctgctcgcacacaaccttcctcaaaatagaatcggctattcctggtacaaaggcgaaagagtcgacggcaacagtctgatcgtgggctacgtgatcggcactcagcaagctacaccaggacctgcatattcaggtcgtgaaaccatctaccccaacgcctctcttctgatacagaacgtgacccagaacgatacaggcttctataccctgcaggttataaagtctgacctcgtgaacgaggaggccaccggtcagtttcacgtgtaccctgaactgccgaagccttctatctccagtaataatagtaatccagtggaggacaaggacgccgtggccttcacttgtgaaccagaggtacagaatacgacttatttgtggtgggtaaatggccaaagccttcccgtgtcccctagactgcagctgtcgaacggaaacatgaccctgacactactgagtgtcaagcggaatgacgccggttcctacgagtgcgaaatccagaatcccgcatccgcaaataggtccgaccctgtcactctgaacgtgctgtacggccctgacgggcctacaataagcccaagcaaagcaaactacagaccgggagagaacttaaatttgagctgccatgccgcaagcaatccccctgctcagtactcttggttcatcaatgggacatttcagcaaagcacccaggagcttttcatccccaatatcactgtgaataactccggatcatatatgtgccaagctcacaactccgccacaggtctgaatcgcacaacggtcaccatgatcactgtgagcggaagcgcgcctgtgctcagcgcagtggccacagttgggattacaatcggggtcctcgctcgggtggccttgatatag

SEQ ID NO: 27739 - DNA, 1977 bp, Artificial Sequence
  Description of Artificial Sequence: Synthetic coding sequence
atggtgccgcgtttgctgttgcgagcatggccacggggaccagcagtgggccctggcgcacccagtaggccactgtccgctgggtccgggccaggacaatacttgcaacgttccattgtgcccaccatgcactaccaagattcactgcccaggctaccaattcccaagctggaggacacaatccgtaggtacctctcagcgcagaagcctctgctgaatgatggccagttccgcaagaccgaacagttctgtaagagtttcgaaaatgggatcgggaaagaattgcacgagcagctggttgcactggataaacagaataagcatacatcatacattagcggaccatggttcgatatgtatctcagcgccagggactctgtggtgcttaacttcaatccattcatggcatttaatcctgaccccaagagcgagtacaacgaccaattgaccagggcaacaaatatgaccgtctcagccataaggtttctcaaaactctgagggccggtcttctggaaccagaggtcttccaccttaatcccgcaaagtcagacacaattacctttaagcggctcatccgatttgtgccatctagcctgagttggtatggggcatatttggtgaacgcctaccccctggacatgagtcagtacttccggctctttaacagtacccggctgcccaagccgagccgtgatgagctgttcacggatgacaaggctcgccacctgttggtcctgcgtaaagggaatttctatatatttgacgtgctcgaccaggatggaaacatcgtctcgcccagcgagatccaggcccatctgaagtatatcctatctgactcaagtccggcacccgagttccccctggcttatctgacaagcgaaaatcgcgatatctgggccgaacttcggcagaagctcatgagtagcggaaacgaggaatctctgagaaaagtcgattcagcagtgttctgcctttgcctagatgacttccccatcaaggatttggtccacctcagccacaacatgcttcatggcgatggaacaaatagatggtttgacaaatccttcaacctgatcatagccaaagacggatctaccgccgttcattttgaacatagctggggcgacggagtggctgtactacggtttttcaacgaagtgttcaaagacagcactcagacccctgccgttaccccccagtctcagcccgcaacaaccgatagcactgtcacagttcagaaactcaatttcgaactcacagatgcactgaagactggcattaccgccgcaaaagagaaatttgatgccaccatgaagactcttaccatcgactgcgtccaattccaacgaggtggtaaggagttcttaaagaaacaaaaactgtctcctgacgcagttgctcagttagcatttcagatggctttcctgcggcagtacggccagacagtggcaacctatgagtcatgcagtacagctgcattcaaacacggcagaacagagacgatccggccagcctctgtgtacacaaagcgttgctcagaggcttttgtgcgcgagccatccaggcactccgcgggtgagctccaacaaatgatggtagaatgctctaaataccacgggcagctgacaaaggaagcagccatggggcagggcttcgatcggcatctgttcgctttgcggcacttagctgccgcaaaggggatcattctgcccgaattatacctagaccccgcatacggacagattaatcacaacgtgctcagtacatcaaccctctcatccccagccgtgaaccttggcggttttgctccagttgtgagcgacggcttcggcgtgggatacgctgtgcacgacaactggatcggatgtaacgtaagctcgtacccaggtcgcaacgctagagaattcctacagtgcgtggagaaagccctagaagacatgttcgacgccctggagggaaagagtattaagagctag

SEQ ID NO: 27740 - DNA, 1077 bp, Artificial Sequence
  Description of Artificial Sequence: Synthetic coding sequence
atgagggccactcccctggccgcaccggcaggttcattgtccaggaaaaagcggttggagctggacgataatctggacaccgagagacctgtgcagaagcgagctcgctccgggcctcaaccccgactccccccatgcttgctgccactgtccccccctactgcaccagacagggccacggccgtagctacagcaagtcgactcggtccctatgtgttactggagcctgaagaggggggtagagcataccaggccctccattgtccaacgggaaccgagtacacttgcaaggtctatcccgttcaggaggctttagctgtccttgagccttatgccagattgcctccacataaacacgtggccaggcctactgaggtccttgcaggtacacagctgctttatgctttctttacacgcacccatggcgatatgcatagcctcgtgaggagtcgtcacaggattccagagcccgaggccgcagtgctattccgccagatggctacggctctggcgcattgtcatcagcacggccttgtgctgagggacctgaagctctgcagattcgtctttgccgaccgtgagcgcaagaagctcgtcctggaaaacctagaagattcttgtgtgctgaccggcccagatgactctctgtgggacaaacacgcatgccctgcatacgtgggcccagagatactgtcaagccgcgctagttactcaggaaaagccgctgacgtctggtcactgggagtcgccctgttcactatgcttgccggacactatccctttcaagattctgagccagtgctgctgtttggaaaaatccgtcggggagcttacgctctgcccgcaggtctgtctgccccagcccgatgcctcgttcgctgtctcctacggagggagccagccgagcggctgacagcgacagggatattgctgcacccttggcttagacaagatccgatgcctttggctccgactcgaagccacctatgggaagctgcccaggtcgtacctgatggtctcggcctcgacgaagccagggaggaggaaggagatcgcgaggttgtcttatacgggtag

SEQ ID NO: 27741 - DNA, 1176 bp, Artificial Sequence
  Description of Artificial Sequence: Synthetic coding sequence
atgtctggaccggtgcccagcagggcccgtgtctacacggatgtgaatacacaccgacctcgcgagtactgggattacgagtcacacgttgtggagtggggcaatcaggacgactatcagctggtccgtaagctcggcagaggaaaatatagcgaggtgttcgaagctattaatatcaccaataatgaaaaggtagttgtgaagatcttaaagccagtcaaaaagaagaaaatcaagagggagattaaaattttggaaaaccttagaggagggcctaatatcataaccctcgccgacattgtcaaggaccctgtgagtcgtacgcccgctttggtgttcgaacatgtaaataatactgattttaagcagctgtatcagacattaactgattatgacatccggttttacatgtatgagatattaaaggcattggattattgtcattcaatgggaatcatgcatcgggatgtaaaaccccacaacgtgatgattgaccatgagcacagaaaactgcgcctaatcgattggggcctcgccgagttctatcaccctgggcaagagtataatgtcagggttgcatcaaggtattttaagggtccagagctcttggtagactatcagatgtacgattatagtttagatatgtggtccttgggatgcatgctggcttctatgatttttaggaaagagcccttcttccatggccatgataactacgatcagctggttagaattgccaaagttctggggaccgaggacctctatgattacatagacaagtacaacatcgagctcgacccaaggttcaacgacatactgggcaggcactcccgcaaaaggtgggagagatttgtccattccgagaaccagcatcttgtgtctcctgaggctctggacttcctcgataagctccttcgatatgatcaccagtctagattgaccgctcgagaagctatggagcatccctacttctacaccgtcgtcaaagatcaggcaaggatgggaagcagcagtatgcccggaggctcaacaccagtcagcagtgctaacatgatgagtggaatctcctctgtgccaacaccttccccactcggacccctggccggatctcctgttatcgctgccgcaaaccccctcggaatgcccgtacctgcagcggctggcgcacagcagtag

SEQ ID NO: 27742 - DNA, 1194 bp, Artificial Sequence
  Description of Artificial Sequence: Synthetic coding sequence
atgtccggacctgtcccctcccgagccagagtatacacagatgtgaacacacatagacctagagagtactgggattacgagagccacgtcgtggaatggggcaaccaggatgattaccaattggtgcgcaaacttggccgaggcaagtactcagaagttttcgaagccattaacatcaccaataatgaaaaagttgtagtcaagattctgaaacccgtcaaaaaaaaaaaaatcaagcgcgagattaagatactggagaatctgaggggtgggcctaacatcatcactctggcagatattgtgaaggaccctgtatcccgtacccctgccctggtgtttgagcatgttaataacacagacttcaagcagctataccaaacacttaccgattacgacatccgcttttacatgtatgagatactgaaggccctggattactgccactcaatggggatcatgcatagagacgtgaaaccccataacgtcatgattgatcatgaacatagaaagttgaggctgatcgactggggacttgctgagttttatcatcctgggcaagagtacaacgtgcgcgtggccagtcgctattttaagggacctgaattgttagtcgattaccaaatgtatgactacagcttggacatgtggagcttggggtgtatgttagcatctatgattttccgaaaagagcctttcttccacggccatgataattacgatcagcttgtccgtattgctaaagtgcttgggaccgaggatttgtatgattacattgacaaatataatatcgagctggatcctagattcaacgacattctgggcaggcactcacgaaagcggtgggaaagattcgtacatagtgagaatcagcaccttgtctcccccgaggcattggatttcctcgacaagcttttaagatatgaccaccagagcaggctgacggctagagaggctatggagcacccgtacttctataccgtggttaaggatcaagccagaatgggatcatcctcaatgcccggtggcagcaccccagtgtccagtgccaatatgatgtccggaatctcttccgtgcccaccccatcccctctgggaccccttgctggcagccctgtcatcgcagccgctaacccactcgggtgcttgttccagctccccctgaggtccgcagtcaccgccctgtcagtttcctag

SEQ ID NO: 27743 - DNA, 768 bp, Artificial Sequence
  Description of Artificial Sequence: Synthetic coding sequence
atgtacgagatattgaaggctttggattactgtcactccatgggcattatgcaccgggacgtcaagccacacaacgtcatgattgaccacgaacaccgaaaactacggttgatcgattggggattagccgaattctaccatcccggtcaagagtacaatgtgagggtagcttctaggtacttcaaaggcccagagctgctggttgattatcagatgtacgattactccctggatatgtggtcattgggatgcatgcttgccagcatgatcttccgcaaggagcccttttttcatggacacgataattacgatcagcttgtcagaatcgcaaaagtcctgggaacagaggatctgtacgactatatcgacaagtataatatcgagctcgatcctcggttcaacgacattcttggccgacattcccggaaaaggtgggagcggtttgttcacagcgaaaatcaacacttagtatcccccgaggccttggattttctggataaactgctcaggtacgaccaccagagtcggctgaccgctagagaggctatggaacatccatacttttacaccgtggtaaaagaccaggcaagaatggggtcttcaagtatgccgggtgggagcacaccagtgagctcagcaaacatgatgtctggcatctcgtccgtccctacaccttctcctcttggccctctggccggatctccagtgattgccgcagcaaatccattaggaatgcccgttccagctgctgctggggcacaacagtag

SEQ ID NO: 27744 - DNA, 1158 bp, Artificial Sequence
  Description of Artificial Sequence: Synthetic coding sequence
atgagcggcccagttccatctcgcgctagggtctacactgatgtgaatacacaccgcccaagggagtactgggactatgaatcacacgtcgtcgaatggggaaaccaggatgactatcagctggtcagaaaactcggcaggggtaagtacagcgaagtcttcgaggcaatcaacatcaccaataacgaaaaagttgtggtcaagatactgaagcccgtgaaaaagaagaagatcaagagggaaatcaaaattctcgagaatcttcgaggagggcctaatatcattacgctcgccgacatagtcaaagacccagtctcaaggacaccagccctggtgttcgagcatgtgaacaacacagacttcaaacagttataccaaactcttacggactacgacatccgcttttacatgtatgaaatattgaaagctttggattactgccacagtatggggataatgcaccgggacgtcaagccccacaatgtaatgattgatcatgaacataggaagctgcggcttattgattggggtctcgccgaattctatcaccccggtcaggaatacaacgtaagagttgcctcaagatactttaaaggccctgaactgttagtggattaccagatgtatgactacagcctggacatgtggagtctggggtgcatgctggcaagcatgatattcaggaaggagcccttcttccacggtcatgataattacgaccagctcgttagaattgctaaggtcctgggaacagaggacctgtacgactatatagataagtacaacattgagctagatcccagatttaacgacattctcggccgtcacagcagaaagagatgggagaggttcgtccactcagaaaatcaacaccttgtcagtcccgaagcattggatttccttgataagctgctgcgatacgaccatcaaagtcgtctaactgccagagaggcgatggaacacccatacttttacacagtcgtgaaggatcaagcaaggatggggtcaagttctatgccgggaggatcaacaccagtgtcatcagccaatatgatgtctgagatgaaattctgcagggtcgcacaagccggactagagcttctctcctcaactgtgtaccctccctggccacctaaggtactgcggttggaagcctag

SEQ ID NO: 27745 - DNA, 1053 bp, Artificial Sequence
  Description of Artificial Sequence: Synthetic coding sequence
atgcctggcccagcagcaggtagtagggcacgggtgtatgcggaggtaaatagcctgcgttcgcgagaatattgggactatgaagcacacgtcccatcctgggggaaccaggatgattaccagctggtccgcaaactgggaagggggaaatatagtgaggtgttcgaagcgataaatattaccaacaacgagcgggtcgtggtgaagatcctcaagccagtgaagaaaaagaaaatcaaaagagaggttaagattctggaaaacctcaggggtggaaccaatattataaagttgattgacacggttaaagaccccgtatctaagacacccgcactggtgttcgaatacatcaacaacactgacttcaagcagctgtaccagatcctgaccgacttcgacatacgtttttacatgtacgaactgctgaaagcactggactactgccatagcaagggcattatgcacagggacgtgaagcctcacaatgtgatgattgaccaccagcagaagaaactcaggctaatcgattggggcctggccgagttttatcacccagcccaggaatacaacgtgcgggtggcctcccggtattttaaaggcccagaactgcttgtcgattaccagatgtacgactactcattagatatgtggtcgctggggtgtatgctcgccagcatgattttccggagagaacccttctttcatggacaagacaactatgaccagctggtgagaattgccaaggtcttagggacagaggagctctatgggtacttgaaaaaatatcacatagatctggacccgcattttaatgacattctggggcaacacagtaggaagcgatgggagaactttatccactctgagaaccggcacctcgtgtctcctgaagcccttgatcttctggataaactcttaaggtatgaccaccagcaacggctaacggccaaggaggccatggagcatccatacttctaccctgtggtgaaggagcaaagccagccatgcgccgataatgccgtactgagttccggacttaccgctgcgaggtag

SEQ ID NO: 27746 - DNA, 600 bp, Artificial Sequence
  Description of Artificial Sequence: Synthetic coding sequence
atggaggctcgggacaagcaggtgctacggagcttacgcttggaactgggggcagaggttctcgttgaggggttggtacttcaatacctgtaccaggaaggcattttaactgaaaatcacatccaggaaattaatgcccagaccacaggccttaggaagactatgctcctgctggacattttgcctagtagaggaccaaaggcttttgacaccttccttgatagcctgcaggagttcccttgggttagagagaagctcaagaaagctcgggaagaggcgatgacggacctgccagcgggagacaggctcactggcatcccatctcatatcctgaactcttccccttctgatcggcaaatcaaccagctggctcagagattaggacctgagtgggaacccatggtgctgagccttgggctgtcacagaccgatatttatagatgcaaggcaaaccacccccacaacgtgcagagtcaggtcgtagaggctttcatacgctggcgacagcgatttggcaagcaagctaccttccagtcactgcacaatggccttagggccgtagaggttgaccccagcctgctcctccatatgcttgagtag

SEQ ID NO: 27747 - DNA, 366 bp, Artificial Sequence
  Description of Artificial Sequence: Synthetic coding sequence
atggaggcccgagacaagcaggtactaaggagcctccgcctcgaactgggggctgaggtcctggtagaggggctggttcttcaatatctgtaccaggagggaattctcaccgagaatcacatccaggagatcaatgcacagaccaccggcctgcggaagactatgttgttgctagatatactgccatcccgcggacctaaggctttcgacaccttccttgattcactccaagaattcccctgggtgcgcgagaaattgaagaaggcacgcgaagaggctatgaccgatcttcccgcagagatgcgcaaattaaggccaaaggattctgttacatgtttagcgagccagctgacctggcgcttttag

SEQ ID NO: 27748 - DNA, 600 bp, Artificial Sequence
  Description of Artificial Sequence: Synthetic coding sequence
atggaggcaagagacaagcaggttctcagaagtctgcgcctcgaacttggtgcagaggtactggttgagggattagttctgcagtacctgtaccaggagggcatattgactgaaaatcatatccaggaaattaatgcccagaccaccggtttgcgcaaaactatgttactcctggatattctgccgtctcgtggccctaaagctttcgacacgtttctcgattccctccaagaatttccgtgggttagagagaaactgaagaaggctcgcgaggaggctatgactgacttgcctgccggtgaccggctgacggggataccctctcacatactcaacagtagccccagcgataggcagattaaccagcttgcgcagcgcctgggtccagagtgggagccaatggttctttctctgggcctgagccagaccgatatatacagatgcaaagcgaaccaccctcataatgtgcagtctcaggtggtggaagccttcattaggtggcgacaacgcttcggtaagcaggcaacgttccagtctctgcacaatggcctgcgcgctgtggaagttgacccaagcctcttgttgcacatgttggaatag

SEQ ID NO: 27749 - DNA, 312 bp, Artificial Sequence
  Description of Artificial Sequence: Synthetic coding sequence
atggaggccagagacaaacaagttctacgctccctgcgtcttgagctcggagccgaggtactcgtcgaaggacttgtgctgcagtacctataccaggaaggaattctgaccgagaaccatatccaggagatcaatgcccagaccactgggctccgaaaaacaatgctgctgctcgacatccttccttccagggggccaaaggcctttgatactttcctggactccctgcaggagttcccttgggtccgtgagaaactgaaaaaggccagagaggaagccatgaccgatcttcctgccggatgttggccttag

SEQ ID NO: 27750 - DNA, 1443 bp, Artificial Sequence
  Description of Artificial Sequence: Synthetic coding sequence
atgtccgccgaagtgatccatcaggtggaagaagcattggacaccgacgagaaagagatgctgctgttcctgtgcagggatgtcgccatcgatgtagtccctcccaacgtgagagatctgctagatatccttcgtgagaggggcaaactgtcggtgggagacctcgctgaactgttgtaccgtgtgagaagattcgatcttttgaagagaatcctgaagatggaccgtaaggccgtcgagacccacctcctcagaaacccacacttagtaagcgactacagggtgcttatggcagagattggtgaagatttggataagagcgacgtgtcaagtttaatcttcctcatgaaggactatatgggcaggggtaaaatcagtaaagagaagtcatttcttgacctcgtagtggagctcgagaaactcaacttggtagcaccagatcagctggacctacttgagaagtgtctaaaaaacattcacaggattgatctcaagacgaagatccagaagtacaaacagtcggtgcaaggcgcaggcacctcatatagaaacgtgctgcaggcggcaattcagaaaagcttgaaagatccctccaataactttcgtctccacaatggaaggagtaaggagcagcgattgaaggagcaactgggcgctcagcaagagccagtaaaaaagtctatccaggaatcagaggcttttctgcctcagtctatccccgaagaacggtacaaaatgaagtcaaagcccctggggatttgcctgattattgactgcattggcaatgagaccgagctgctgcgcgacacctttacatctctgggctacgaggtgcagaagtttttgcatttgtctatgcacggaatctcacagatcctgggccagttcgcttgcatgcccgagcaccgcgattatgattcattcgtttgcgtgctcgtgagccgaggcggatctcagagtgtgtacggagttgatcaaacacattcaggacttccgctgcaccatatcagacggatgttcatgggggattcatgcccatatcttgccggaaaacctaagatgtttttcatccaaaactatgtggtgtcagagggtcagttggaagatagcagtctgctcgaagtcgatggccctgccatgaagaacgtggagttcaaggcccagaaacgtgggctgtgcactgtgcacagagaggctgatttcttttggtctttatgcacggcagacatgagcttacttgagcagtcacactcgtccccctcgttatacctccaatgcctgtcacagaaactgcggcaagagcgcaaaagacctctgctggacctccatattgaactaaacggatatatgtacgattggaactcccgggtctcagccaaagagaagtactatgtgtggctgcagcacactctcaggaagaaactgatcctgagctatacttag

SEQ ID NO: 27751 - DNA, 1389 bp, Artificial Sequence
  Description of Artificial Sequence: Synthetic coding sequence
atgtctgctgaagtaatccaccaggtggaggaagcccttgacaccgatgagaaagagatgctgttgtttctgtgccgggatgtggccattgatgttgttcctccaaacgttcgtgatctgctggacattctcagagaaaggggtaagctgtcagtgggtgatctcgcggaactcctatatagagtccggagattcgatctgctcaagcgcatattaaaaatggataggaaggctgtggagacacacctgctccggaacccacacctcgtgagcgattatcgtgttctgatggccgaaatcggcgaggaccttgataagtcagacgtcagctcattgattttcctaatgaaagattatatgggcaggggcaaaatttcaaaggagaagtccttcctcgacctcgtggtagagctggagaaactgaacctggtggcccctgaccagctcgacctgttagagaagtgtctgaagaacattcatcgaattgatctcaaaacgaagatccagaagtacaagcaatctgtgcaaggggcaggaaccagctacaggaacgtgttgcaggcagctatccaaaagagcctaaaggacccgtccaacaactttcggctccacaacggacggtcgaaggaacagcggctaaaggagcagctgggcgcacagcaggagccagtgaagaagtctatccaggaatcagaagcatttctgccacaatcaatacccgaggaacgttacaagatgaagagtaaacctctcgggatatgtttgattatcgactgcattgggaacgagaccgaacttctgcgggatacatttacgagcctaggctacgaagtccagaagtttctgcacctcagcatgcacggtatatctcaaatccttggacagtttgcctgcatgccggagcaccgagattacgactcttttgtgtgtgtcttggttagcaggggtggttctcagtccgtctacggagttgaccaaactcactccggtctgccattgcatcatatcaggcgaatgtttatgggtgatagttgtccatatctggcaggaaaacctaagatgttttttatacaaaactacgtcgtatctgaaggccagttggaggatagctctctgctcgaagtagacggtcccgcaatgaaaaatgttgagtttaaagctcagaagagaggtctgtgtactgtccacagggaggcagatttcttttggtcgctgtgcaccgctgacatgtcattgctggagcagtcccactcttcacctagcttgtacctgcagtgtctgagccagaagttgagacaagagcgcggtactatccccggatctggaatcacagaatccaaagatatgcacttctcctcacttggctgcattttgctggatgtcttgtag

SEQ ID NO: 27752 - DNA, 1047 bp, Artificial Sequence
  Description of Artificial Sequence: Synthetic coding sequence
atggctgaaatcggggaagacctggacaagagcgacgtctcttccttgattttcctgatgaaagattacatgggacgtgggaagatttcaaaggagaaatccttcctggatttagtggtggaactggagaaattgaatctggtggcccctgaccaactggatctcctggagaaatgtctcaagaatatccaccggatcgacttgaaaaccaagatacagaaatacaaacagtctgtacagggtgcaggcacatcctaccggaatgtgcttcaggctgccatccaaaagtcccttaaagatccctcaaataactttcgcgaggaaccagtcaagaaaagcattcaggagtcggaagccttcctgccacagtccatccccgaggagaggtacaaaatgaaatccaagcccctggggatctgtcttatcatcgattgcattggcaatgaaacagagctgctcagagacaccttcacatcactaggctatgaggttcagaagtttttgcacctgtctatgcatggaatcagtcagatccttggacaatttgcctgcatgcccgagcaccgggactatgactcgttcgtgtgcgtgctggtatcaagaggcggttcccaaagcgtgtatggggtggatcagacccattcgggactgcccctgcaccatattcggcgaatgttcatgggagactcctgcccttacttagccggaaagccaaagatgttctttatccagaactacgtggtctccgagggacagctggaggattctagcttgctggaagtcgacggcccagcgatgaagaatgtcgaattcaaagcccagaagcggggactgtgtacagttcaccgtgaagcagatttcttctggagcctgtgcactgctgacatgtccctgcttgaacaatcacactcaagccccagcctttacctccagtgtctctcccaaaagctcaggcaggagcgcggaacaattcctggatccggaataaccgaatcaaaggatatgcacttctcttctttagggtgcatccttttggacgtgctctag

SEQ ID NO: 27753 - DNA, 903 bp, Artificial Sequence
  Description of Artificial Sequence: Synthetic coding sequence
atgtctgctgaggtgattcaccaggtagaggaggctttagacaccgacgagaaggaaatgttactgtttctgtgtagggatgtggccatagatgtggtaccacctaacgttcgggacttattggatatactacgggaacggggaaaactatcagtaggggatttggccgagctgttgtacagagtccggcgattcgatctcctgaagaggattctgaagatggaccgcaaagcagtggaaacacatctgcttcgcaatccccacctggtgagcgactaccgcgtgctcatggctgagattggtgaagatttggataagtcagatgtgtcttcactgatcttcctgatgaaagattatatgggacggggtaagataagtaaagaaaagagtttcttggacctcgtagtggagctcgaaaaattaaatttagtcgctccagatcagctggatctactggagaaatgtctgaaaaatatccacagaatcgacctgaaaaccaagattcagaagtataaacagtcagtgcagggcgctgggacgtcctataggaatgtcctgcaagccgctattcagaaatccctcaaggatcctagcaataatttcagactgcataatggcaggtcaaaagaacagcggctaaaggaacagctgggtgcccagcaagagccagtaaagaaatcaattcaagagtcggaggcttttttgcctcagtccattccagaagagcgttacaaaatgaaatcgaaaccacttggaatctgtctgataatagattgcattggcaatgaaaccgaaaacgcgcatagctggatttttaccctcaattcaatggccacttgtatgataggtacagctgagttcctgcccagaaggaatattatgagcggctgttctaccctttag

SEQ ID NO: 27754 - DNA, 753 bp, Artificial Sequence
  Description of Artificial Sequence: Synthetic coding sequence
atgtcagccgaagtgatccaccaggtggaagaggccctggataccgatgagaaggagatgctactttttctctgccgggacgtggcaattgacgtcgttcccccaaatgtgagagacctcctcgatatactgcgcgagcggggtaagctgtcagtcggggacctggctgagctcctgtaccgcgttcgcaggttcgatctgctaaagcgcatcctcaaaatggaccggaaggccgtcgaaacccacttgctgaggaaccctcacctggtctctgactaccgcgtattaatggctgagataggtgaagatctggacaaatccgatgtatctagcctgatatttctgatgaaagactatatgggaagaggaaaaatctcgaaagaaaagtctttcctggacctggtcgtggagctggaaaaacttaacttagtggcaccagatcagctggatctgctcgagaaatgcctgaaaaatatccatagaatcgacttgaaaacgaagatccaaaaatacaaacagagcgggggatggaacggaacctggatgacaaaggcctcattctcactatggttggaaattgcaagcttgtatattcttcatatacctgacctacctaccccgctgccatgcatcttcatgatttccgcgaaatgttgccaggctgtgttaaacatttccgtattcaaaaaggagagcgggatctgtaccggatggcaaagttatggacactccggggtcctgcacgtgtgttag

SEQ ID NO: 27755 - DNA, 357 bp, Artificial Sequence
  Description of Artificial Sequence: Synthetic coding sequence
atgagcgcagaggtgattcaccaggtggaagaagccctggacaccgatgagaaggagatgctcttattcctttgtcgagatgtggcaattgacgtggtcccgccaaatgtccgcgatttgttagacattctcagggagagagggaagctatccgtcggagacctggctgagctcctgtacagggttaggaggttcgacctactgaaacggatcctaaagatggatcggaaggccgtggagacacatctgctgcgaaaccctcacctcgtgtccgactaccgagtcctgatggcagaaataggagaagacctggataagagtgacgtttcatcccttatcttcttaatgaaggactag

SEQ ID NO: 27756 - DNA, 1443 bp, Artificial Sequence
  Description of Artificial Sequence: Synthetic coding sequence
atgtcagcagaagtcatccaccaggttgaggaagcgcttgacaccgacgaaaaggaaatgttactgttcctgtgccgggatgttgcaattgacgtcgtgccaccaaatgttcgcgacctcctggatattctgcgggaacggggtaagctttcagtcggcgatttggccgagctgctctaccgggtgagaaggtttgacctactgaagcgtattttgaaaatggacaggaaggctgtcgaaacacatttgctacgcaatccccacctggtctctgattacagggtcctgatggctgaaattggtgaggatcttgacaagagcgatgtgtcgagtctgatatttctcatgaaagattatatgggcagagggaagatctctaaagagaaatcttttctggatctggtggtggagctggagaagttgaacctggtagcaccagatcagcttgacctcctggagaaatgccttaaaaatattcatagaatcgacctcaagacgaagatccagaagtacaagcagagtgttcagggcgcagggacaagctatcgaaacgtactccaggctgccatccaaaagtccttgaaggatcctagcaacaactttcgtctacataatggtagatcaaaggagcagcgactgaaagagcagctgggcgctcaacaggaaccagttaaaaaaagcatccaggagtctgaagcatttctaccacagtctatacccgaggaacggtataagatgaaatctaagcctctggggatttgcttgattatcgattgcatcggcaatgagaccgaacttctgcgcgacacctttacatcactgggatatgaagtgcagaagtttttgcatctgagcatgcatggcatcagccaaattcttggccagtttgcgtgtatgccagaacaccgcgattacgatagctttgtctgtgtcttggtgagtcgaggcggatcccagagcgtgtacggtgtcgatcagactcattcaggcctgccactgcatcatatacggcgtatgtttatgggtgactcttgtccttacttggcagggaaaccaaagatgtttttcatccagaattacgtggtctcagagggacagcttgaggatagctcccttctggaggtcgatggccctgctatgaagaatgtcgaattcaaagcgcagaagagaggactctgcacagttcacagagaggccgattttttctggagcctctgcacggcagacatgtccctgttagagcagagtcatagctctccatcattgtatctgcagtgtcttagtcaaaaacttcgccaggagaggaagagaccgctgctcgatttgcatatagaattgaatggttatatgtatgactggaacagcagggtttccgccaaagaaaaatactatgtctggcttcaacatactcttaggaagaagctcatcctctcctacacatag

SEQ ID NO: 27757 - DNA, 189 bp, Artificial Sequence
  Description of Artificial Sequence: Synthetic coding sequence
atgtccgccgaggttattcatcaagtggaggaggcactcgacactgacgagaaggagatgcttctgttcctgtgcagagatgtggccattgatgtggttccccctaacgtgagggatttgctggatattcttcgagaacgcggtaagctgtccgttggagacctcgccgagctcttatatcgggtttag

SEQ ID NO: 27758 - DNA, 195 bp, Artificial Sequence
  Description of Artificial Sequence: Synthetic coding sequence
atgagcgccgaggtgatccaccaggttgaggaggcattggacacagatgagaaggaaatgcttctgtttctctgccgtgatgtagctatcgacgtggtcccgcctaacgtccgcgatcttctcgacatccttagagagcgagggaaactgtcagtcggagatctggctgagctgctgtatcgcgttcgtcgctag

SEQ ID NO: 27759 - DNA, 390 bp, Artificial Sequence
  Description of Artificial Sequence: Synthetic coding sequence
atgtctgcagaagtgatccatcaggttgaagaggcactggatactgacgaaaaggaaatgttactgtttttgtgtcgcgatgtggccatagacgtggtgccgcctaacgtcagggatctccttgacatactgcgggaacgcggaaagttatctgtcggcgacctcgccgagttgctttatcgtgttagaagattcgatctcctgaagcgcattctaaagatggataggaaagctgttgagacacacttattaagaaacccgcatttggtgtccgattatagagtactgatggctgagatcggtgaagatctggacaagagtgatgtgtcgagcctgatctttctcatgaaggattatatgggacgcggtaaaataagtaaagaaaagtag

SEQ ID NO: 27760 - DNA, 1155 bp, Artificial Sequence
  Description of Artificial Sequence: Synthetic coding sequence
atggccgaaatcggggaagacctggataaatcggatgtctcttccctaattttccttatgaaggattacatggggcgagggaaaatttcaaaggaaaagagctttctggacctagtcgtggaactggagaagctgaatctggtagccccagatcaactcgacctgctggagaaatgcctgaaaaacattcaccgaatcgaccttaaaacgaaaatacagaagtataagcaatcagtgcagggggctggaacttcttatcgcaacgtactccaggccgctatccagaagtcacttaaggacccgtcaaacaacttcagacttcacaatgggcgtagtaaggaacagagactgaaggaacagctgggtgcacagcaggagccagtgaaaaaatccatccaggaatctgaggccttcctgccccagtcaattccggaggaacggtataagatgaagagcaagccccttgggatctgtcttattatagattgtattgggaatgagacagagttactccgggacaccttcacgagcttgggctatgaggtacagaagtttctgcacctgagcatgcatgggatcagtcaaatactcggccaattcgcttgcatgcctgagcatcgtgactatgactcatttgtgtgcgttctcgtatctagaggtggttcacaaagcgtgtacggcgtggatcagactcacagcggtctgcctctgcatcacattaggcggatgtttatgggggacagctgcccatatcttgccggaaagcctaagatgttcttcattcagaattacgtggtgagcgaaggccaattggaggattcatcactacttgaggttgatggtcccgcaatgaaaaatgttgagtttaaggcgcaaaagaggggactgtgtactgtgcaccgagaggcagacttcttctggtcgctgtgcaccgctgatatgtctctgctagaacagtcacacagttccccttcgttgtaccttcagtgtttgtcccaaaagctgagacaagaacggaagaggcccctccttgatctacatattgagctgaacggttacatgtatgactggaatagccgtgtttcggctaaagagaaatattacgtttggctgcagcatacccttaggaagaagctcatcctgtcttatacctag

SEQ ID NO: 27761 - DNA, 666 bp, Artificial Sequence
  Description of Artificial Sequence: Synthetic coding sequence
atgtctgctgaggtgatccaccaggtcgaagaagccctcgatacagacgagaaggagatgttgctgttcctctgcagagatgttgccatcgacgttgtcccacctaacgtgcgggatctcctggatatcctgagagaacgtggcaagttaagcgtgggcgatctggctgaactgctctatagggtgcggcgtttcgatttactgaagcggatactaaagatggatcgaaaggctgtggagactcaccttttgaggaatcctcacctcgtctccgactacagggttttgatggctgagattggagaagacctggacaagtctgacgtgagctccttgattttcttaatgaaagattatatggggagaggaaagataagcaaggaaaagagcttcctggatttagtcgtggaacttgagaagttgaaccttgtagccccagaccaactcgatctgctcgaaaaatgcttaaaaaatatccacaggatcgacctgaaaaccaaaatccagaagtataaacaatctgtgcagggtgctggaacctcgtacaggaacgtgcttcaggccgcaattcagaagagtctgaaagacccaagcaataatttccggatgattaccccgtatgcccattgtcctgatctgaagattcttggcaactgctccatgtag

SEQ ID NO: 27762 - DNA, 1338 bp, Artificial Sequence
  Description of Artificial Sequence: Synthetic coding sequence
atgtccgccgaagtcatccaccaggtcgaagaggctctggacaccgatgagaaggagatgcttctattcctctgcagagatgtggcaattgacgtcgtgcctcccaacgtcagagacctgctggacattttgagggagcgcggtaagctgtcagtcggcgacctggctgagctgctgtatagagtgagacggttcgatctcctgaaaagaatcctaaagatggataggaaggccgtggaaacccatctgctgcgcaatccccacctagtgtcagactatagagttttgatggctgagatcggcgaggatctggacaaatccgatgtgtcctcgttgatattccttatgaaggactacatgggcagaggaaagatcagcaaagaaaagtcgtttctcgacctcgtggtcgagctggagaagctgaacttggtggcccctgatcagctggatctcctcgagaagtgtctaaaaaacatccatcggattgatcttaagacaaagatccaaaagtacaagcagagtgtccaaggtgctgggaccagttatcgcaatgttcttcaggccgctattcaaaaatccctcaaagacccatccaacaactttcgatccatacctgaagagcgctacaaaatgaagtccaaaccgctcgggatctgtttaattatcgactgtataggcaacgagacggagttgctgcgggacacgttcacctctctagggtacgaggttcagaagttccttcatctgagcatgcacgggatcagtcaaatcttgggccagtttgcctgcatgcctgaacacagagattatgactctttcgtctgcgtactcgtaagtagaggcggaagtcagtctgtgtacggcgtggatcagactcattcaggccttccccttcatcacatccgaaggatgttcatgggcgattcctgcccctatttggctgggaagccaaaaatgtttttcattcagaactatgttgtttcagagggacaattggaggactcaagtctgctggaagtggacggtcccgctatgaaaaacgtagaatttaaggcacagaaaagggggttatgcactgtgcaccgcgaggcagacttcttttggagtttgtgtaccgccgacatgtctctgctggagcagagccacagctctccctcactgtacttgcagtgtctgagccagaagctccggcaagagagaaaacgtccactgctggacttgcatatcgaattaaacggctacatgtacgactggaattcaagggtgagtgccaaggagaagtactacgtatggcttcagcatacactgcgaaagaagttaatcctgtcttacacctag

SEQ ID NO: 27763 - DNA, 1152 bp, Artificial Sequence
  Description of Artificial Sequence: Synthetic coding sequence
atggccgataaggtcctgaaagaaaagcgtaagctgtttattcgctctatgggtgagggtaccatcaatggactgctcgacgaactcctgcaaactcgcgtgttaaataaagaagaaatggagaaagtgaagagagaaaacgctacagtgatggataagacgagagcactgatcgactcagtcatcccgaaaggcgctcaggcctgtcagatttgcattacatatatttgtgaagaggactcttatctcgctggtacattgggactgagcgctgcccctcaggcggtgcaagataacccagcaatgccaactagtagcggttccgaggggaacgtaaagttgtgctcgctggaagaagctcaacggatatggaagcagaaaagcgccgaaatatatcctatcatggacaaaagctcccggacacgtctggccctgataatctgtaatgaggagtttgactccatcccacgcagaacgggagccgaggtggacatcacaggcatgactatgttgttgcagaatctagggtactcagtggatgtcaagaaaaacttgactgcatctgatatgacaactgagctggaagccttcgcgcaccggcctgagcacaagacaagtgactccacgttcctagtctttatgtctcacggaatcagggagggcatctgtgggaagaagcattcagaacaggtcccagacattttgcagctgaacgcaatttttaatatgctgaacaccaaaaactgcccttctctgaaagacaagccaaaggtgattataatccaggcatgtcggggagactcccccggagtggtgtggtttaaggacagtgtcggtgtgtctggaaatctgtccttgccaaccacagaggaattcgaggacgatgctatcaagaaggcccatatcgagaaagacttcatcgcattctgttcatccacccctgacaacgtgtcttggcgtcaccctaccatgggcagcgtcttcataggccgactgattgaacatatgcaggaatacgcttgttcctgtgatgtcgaagagattttccgaaaggtaaggttctccttcgagcaaccagacggcagagcacagatgcccaccacggaacgggtcacattaacgaggtgcttctacctgtttccaggtcattag

SEQ ID NO: 27764 - DNA, 792 bp, Artificial Sequence
  Description of Artificial Sequence: Synthetic coding sequence
atggccgacaaagtactcaaggaaaaacggaagctgttcatcagatctatgggcgaagcccctcaggcagtccaggataaccctgctatgcccacatcctccggcagtgagggaaacgtgaaactctgttctctggaagaggcccagaggatctggaagcagaagtccgcggagatttaccctattatggataaatccagtcggacaagactcgcactgatcatttgtaacgaggaattcgattcaattccaaggcgcaccggagctgaggttgatattaccggaatgaccatgttgctgcaaaacctggggtattccgtggatgtgaaaaaaaatcttacggcaagtgacatgaccaccgagctggaggcatttgcccacaggccggagcacaagacatcggattcaacttttctcgtgtttatgagccacggcattcgagagggcatatgcggcaaaaaacactcggagcaggtcccggatatcctccagctcaatgccatcttcaacatgttaaatactaaaaactgccccagtcttaaggataagccaaaagtaataattattcaagcttgcaggggtgacaatgtgagctggaggcatccgaccatgggctcagtgttcattggtcggctgattgagcacatgcaggaatacgcatgttcctgcgatgttgaggagatctttcggaaggtgcgatttagtttcgagcagccagatggtcgagctcaaatgcccacaacagagagagtcacactgacaaggtgcttctacctattccccggtcactag

SEQ ID NO: 27765 - DNA, 267 bp, Artificial Sequence
  Description of Artificial Sequence: Synthetic coding sequence
atggctgataaagtgttaaaggagaagcgcaagctgttcattaggtctatgggagaagacaatgtgagctggagacacccaacaatgggttccgtattcataggcaggctaatcgagcacatgcaagaatacgcttgcagctgtgacgtggaggagatctttaggaaagtgagattcagctttgaacaacccgacggcagggcccaaatgccaactacagagcgcgtgaccctcacacggtgcttttacctgttccccggacattag

SEQ ID NO: 27766 - DNA, 1152 bp, Artificial Sequence
  Description of Artificial Sequence: Synthetic coding sequence
atggcagataaggtcctcaaggaaaagcggaaactgttcatcaggtcaatgggggaagggactatcaacgggctcttggatgaactgctgcagacccgtgtgctgaataaggaggaaatggaaaaggtgaagagagagaacgctactgttatggacaaaacccgcgcactgatcgacagcgtgatacccaagggagcccaggcttgccagatttgcattacatatatttgcgaggaggactcctacctagctggcactctcggactgtcagccgctccacaagctgtgcaggataaccccgctatgcccacatcttcaggctccgaagggaacgtcaaactttgttccctagaggaagcgcagcggatatggaagcagaaaagcgctgagatttatcctataatggataaaagttctaggacccggctggctctgataatatgtaacgaagaatttgactccatccccaggcggacaggcgctgaagtcgacattactggcatgacaatgctgctgcaaaatctcggttattctgttgatgtcaaaaagaacctgactgcatcagatatgacaaccgagcttgaagcttttgcccaccggcctgaacacaagacctccgactcaacgttcctagtgttcatgtcccacggaatccgagaaggaatatgcgggaaaaagcattctgaacaagtccctgacatactgcagctcaatgctatatttaacatgctcaatacaaagaactgcccaagtctgaaggataagcccaaagtgatcatcatacaggcctgtcgcggtgacagccccggagtcgtctggtttaaggactcagttggagtgtcaggaaacctgagtctgccaaccactgaggagtttgaggatgatgccattaagaaagcccatatcgagaaagactttatcgccttctgctcctccaccccagacaacgtgtcatggagacaccccaccatgggcagtgtctttatcggacgcctgattgaacacatgcaagagtatgcctgctcctgcgacgtggaggaaatcttccggaaagtgcggttcagctttgagcaacctgacgggagggcacagatgccgactaccgagcgcgtgacactcacgcggtgcttttatttatttccaggtcactag

SEQ ID NO: 27767 - DNA, 267 bp, Artificial Sequence
  Description of Artificial Sequence: Synthetic coding sequence
atggctgacaaagtgctgaaggagaagcggaagctgtttatcaggtcaatgggcgaggataatgtgagctggagacaccccaccatggggtcagttttcatcgggagactgatcgagcacatgcaggaatacgcatgctcatgcgatgttgaggaaatattcagaaaggttcgcttctcatttgaacagcccgatggcagagcgcagatgcctactacagagcgcgtgacccttacacggtgcttctatctgttccctggacactag

SEQ ID NO: 27768 - DNA, 1215 bp, Artificial Sequence
  Description of Artificial Sequence: Synthetic coding sequence
atggcagacaaggtgcttaaggaaaagcggaaactgtttatacgctccatgggcgagggcacaatcaacgggttactggacgagctgctccagacccgtgtgctgaacaaggaagagatggaaaaggtgaagcgggagaacgcgaccgtaatggataagacaagagcactgattgattcggtaatccctaaaggcgctcaggcttgtcagatctgcattacttacatttgcgaagaagattcttacctggctgggaccctaggactcagtgctgaccagacttccggtaactaccttaacatgcaagattcacagggggtattgtctagctttcctgctccgcaggccgtgcaagacaatcccgctatgcccacctcctctggttcggaagggaacgttaaactctgctccctggaggaagcccagcgaatttggaagcagaaatccgcagagatctacccaataatggacaagtcatctagaacacgcctggccctgattatctgtaatgaggagttcgattctatcccgaggcgaaccggggctgaggtagacatcactggaatgaccatgcttctccagaacttggggtattccgtggatgtgaaaaagaatctgactgccagtgatatgaccaccgaacttgaagctttcgcccatcggccagagcacaagaccagcgacagtactttcctggtatttatgtctcacggaatacgcgaaggcatctgtggcaaaaagcatagcgaacaggtgcccgatattctgcagttaaatgcgatcttcaacatgctgaacaccaagaattgtcccagcctgaaagataaaccgaaagtcatcattattcaggcatgccgtggtgattcacccggagttgtttggttcaaggatagcgttggtgtttccgggaatctgagtctgcccacaaccgaggagtttgaggacgatgctataaagaaagcccacatcgaaaaggatttcattgctttctgctcttctacgcctgataatgtgagttggaggcacccaacaatggggtccgtgtttattggtcggttgatcgaacacatgcaagaatacgcttgttcctgcgacgttgaagaaatcttccgcaaggtgcggttctcctttgaacagcccgatggtcgcgctcagatgcccacaacagaacgggtcacgctgactcgctgcttttacctgtttccaggccactag

SEQ ID NO: 27769 - DNA, 792 bp, Artificial Sequence
  Description of Artificial Sequence: Synthetic coding sequence
atggcggacaaagtgctgaaagaaaaacggaagctgttcatcagatcaatgggcgaagcccctcaggcagttcaggacaatcccgcaatgcctacttcctcaggaagcgagggcaatgtgaagctctgttccctggaggaggcccaaagaatttggaaacagaaatctgctgaaatataccccattatggataagagctcacgaactagattggccttaattatttgtaatgaggagttcgacagcattccacgaagaacgggcgctgaagttgatatcacaggaatgaccatgctccttcaaaatctcggttactctgtggacgttaaaaaaaatctaaccgcctccgacatgaccaccgagcttgaagcattcgcgcaccggcctgagcacaagacctcagactctaccttcctagtgttcatgtctcacgggatacgcgagggtatctgcggtaaaaaacattctgaacaagtgcccgacatactccagctaaacgctatttttaatatgctgaatactaagaactgccctagtctgaaggacaaacccaaggttataatcattcaggcctgtcgcggagataatgtctcctggagacaccctactatgggctctgtcttcatcggccgactgatagagcatatgcaggagtacgcctgctcttgtgacgtggaagagatttttagaaaggttcgcttttcttttgaacaacccgatggcagggcccagatgccgacaacagaacgcgtgacgcttaccagatgtttttatctcttccccggacactag

SEQ ID NO: 27770 - DNA, 1152 bp, Artificial Sequence
  Description of Artificial Sequence: Synthetic coding sequence
atggccgacaaggttttgaaggaaaaacgcaaactctttattcggagtatgggagaaggaactattaacggcctattggacgaactccttcaaaccagggttctgaataaagaagaaatggaaaaggtcaaacgggagaatgccacggttatggacaagacaagagctctaattgatagtgtgatccccaagggggctcaggcctgccagatctgtattacctacatatgtgaggaagacagttatttggccggtacactcggcctgtccgccgcaccgcaggccgtgcaagataatcccgctatgcccacatcaagcggatccgagggtaacgtgaagttatgctcactggaagaggcccagaggatttggaagcaaaagtccgccgaaatatatcctatcatggataaaagctctcgtaccagactggcactgataatatgcaacgaggaattcgactctattccaaggcgcacgggcgcagaggtagacatcacagggatgactatgctgctccagaacctcggctacagtgttgacgtcaaaaaaaatcttacggcttctgatatgactaccgaactggaagcgttcgcccatcgcccagagcacaaaaccagcgattcaacattcctggtttttatgtcccacggaatcagggaagggatctgcgggaaaaaacatagtgaacaggttcctgacattctgcaactaaacgctatttttaacatgctgaacacgaagaattgcccgtcattgaaggataaaccaaaagtgattattatccaggcatgccggggtgattctcccggtgtagtatggtttaaagactctgtgggtgtatctggcaacctcagcctccccaccaccgaggagttcgaggacgatgcgattaagaaagcccacattgaaaaagacttcattgctttttgctcctctacacctgacaacgtctcctggagacacccaacaatggggtctgtttttattggacgtctgattgagcatatgcaagagtacgcttgctcctgtgatgtggaagagatattccgaaaggtccggttctccttcgagcagcccgacggtagagcccagatgcccaccacggaacgcgtgacacttactcggtgcttctatctcttcccaggccattag

SEQ ID NO: 27771 - DNA, 936 bp, Artificial Sequence
  Description of Artificial Sequence: Synthetic coding sequence
atggctgacaaagtcttgaaggagaagagaaaactgtttatcaggtccatgggcgaagctccgcaagcagttcaagataacccggctatgccgaccagcagcggctctgaaggaaacgtgaagctgtgttccttggaagaagcccaacgcatctggaaacagaagtcagccgagatataccccatcatggataagtccagcagaactagactggcactcatcatttgtaacgaggaatttgattccatccccagaaggaccggagccgaagtagacatcaccggtatgacaatgcttttgcagaacctcgggtattcagtggatgtcaagaagaacttgactgcttcagatatgactactgaactagaagcttttgcgcacaggccggagcacaagacttctgacagtacttttctggtgttcatgtcacacggaatcagagagggcatatgtgggaaaaaacattcagaacaggttccggatattctccagcttaacgcaattttcaatatgctaaacacaaaaaactgcccctccctcaaagataagcctaaagtgataatcattcaggcctgtcgaggcgacagcccgggagttgtatggtttaaggactccgtcggagtgtctggcaatttaagtctccctaccactgaggaatttgaagatgatgccatcaaaaaggcacacattgagaaagactttatcgcgttctgctcttctactccggacaatgttagttggcgccaccccaccatgggctccgtattcatcggaagactgatcgagcacatgcaagaatacgcgtgttcctgcgacgttgaagagatcttccggaaagtacgcttttcctttgagcaaccagatggccgagcccagatgcccacaactgagcgagtgactctgactaggtgtttttatttgtttcccggacactag

SEQ ID NO: 27772 - DNA, 906 bp, Artificial Sequence
  Description of Artificial Sequence: Synthetic coding sequence
atggagaaggtgaagcgggagaacgccaccgtgatggataagacgagggccttgatagacagcgtaatccccaaaggggctcaggcctgccaaatttgcatcacatatatttgcgaggaagatagttatctggcaggcacactgggccttagcgctgatcagacgtccggtaactacctcaacatgcaggattcccaaggtgtattgtctagcttccccgcacctcaggctgtgcaggataatccagcgatgccaacctcaagcggaagtgagggcaacgttaaactgtgcagcttagaggaggcacagcggatttggaagcagaagagcgccgagatttatcccattatggataaatccagccggacccgcctcgcacttatcatctgcaacgaagagtttgattcaatccccaggcgcactggcgctgaggtggacattaccggcatgactatgctcctccagaatttgggatactcagtggatgtgaagaagaacctaacggcttctgatatgacaacggagttagaagctttcgctcacaggccggaacacaagacctctgattctacattcctcgtcttcatgagccatggaattcgcgagggcatatgcggaaaaaagcactctgagcaggtgccagacattctgcagctgaacgcgatcttcaatatgctgaacacgaaaaactgtcctagtctgaaagataagcccaaagtgatcataatccaggcctgtaggggcgattcaccaggtgtcgtgtggttcaaggatagcgtcggtgtgtcaggaaacctgtccctgcccacaactgaagagttcgaagacgacgctatcaaaaaggctcatatcgagaaggactttatagccttttgcagtagcacccccggtaagtcccagagttag

SEQ ID NO: 27773 - DNA, 333 bp, Artificial Sequence
  Description of Artificial Sequence: Synthetic coding sequence
atggcagacaaggtgctcaaggagaagagaaaactgtttatacggagtatgggcgaggggaccatcaatggtctcctcgatgagctgcttcaaacgcgggttctgaacaaagaagaaatggagaaagtcaagagggagaatgcgacagtgatggacaagacaagggccctgatcgactcggtcatccccaagggagcgcaggcctgtcagatctgtattacatacatctgcgaagaagattcttatttggccggtacgttgggactcagtgctgatctgtccaacaatgggcaagttaaacctcatacctcctgcagtcattacctgcagtag

SEQ ID NO: 27774 - DNA, 267 bp, Artificial Sequence
  Description of Artificial Sequence: Synthetic coding sequence
atggccgacaaggtgttgaaggaaaagagaaagctctttatccgctctatgggcgaggacaacgtttcatggcgccacccaaccatgggatccgtcttcatcggtagactgatcgagcacatgcaagagtacgcctgtagctgtgatgtcgaggagatctttcggaaggtgcgctttagtttcgagcagcctgacggcagggcacaaatgccaacaaccgaacgggtcaccttgactcgatgcttctatctgtttccagggcattag

SEQ ID NO: 27775 - DNA, 1215 bp, Artificial Sequence
  Description of Artificial Sequence: Synthetic coding sequence
atggccgataaagtgctgaaggagaagaggaagcttttcattcggagcatgggcgaagggaccatcaacggactcctggatgagctgctgcagacacgagtgctgaataaggaggagatggaaaaagtcaaaagagagaacgccaccgtcatggacaagacacgggcactgattgacagcgtcatcccaaagggtgcgcaggcttgccagatttgcataacctacatatgcgaagaagatagttatctggccggtacgctggggttatcagcagatcagactagcggcaactaccttaacatgcaggacagtcagggcgtactctccagcttcccggctccccaggccgtgcaggacaatccagccatgcccacctcctccggcagtgagggcaacgtgaagctgtgctccctggaggaggcgcagcgaatctggaagcagaagtctgccgaaatctacccaatcatggataagtcctccagaactaggctggccctgattatctgcaatgaggagttcgacagcattcctcggaggaccggggctgaggtcgacattactggaatgacgatgttactccaaaacctgggttatagcgtggatgtgaagaagaatctgacagccagcgacatgacaactgagctggaggccttcgcccatagacctgagcataagacgtctgattccacttttctggtctttatgtcgcatggtatccgcgagggtatctgcggcaagaaacacagtgaacaggtgccagatattcttcaactgaatgctattttcaatatgctcaacactaaaaactgtccctcgctcaaagataagcccaaggtgattattatacaggcttgccggggagattcaccaggtgttgtgtggttcaaggacagtgtgggagtctctggaaatctctcactgccaactacggaagagtttgaagatgatgcaattaaaaaggcacacatcgaaaaagattttattgcgttctgcagctctacccccgacaacgtgtcctggaggcacccgacgatgggcagcgtgttcatcggaaggcttattgagcacatgcaggaatatgcatgttcttgtgacgtcgaagagatttttcgcaaggtgaggttcagttttgaacaacccgacggtagggcccagatgcctactacagaaagagtgactctgacaaggtgcttttacctgtttccaggacattag

SEQ ID NO: 27776 - DNA, 792 bp, Artificial Sequence
  Description of Artificial Sequence: Synthetic coding sequence
atggcagataaagtgttgaaggagaaacgaaagctctttatccgttccatgggcgaggcccctcaggcagtccaagacaatcccgctatgcctacctctagcggatccgaagggaatgtgaagctctgcagtttggaagaggcacagcgtatctggaaacaaaaatccgccgagatttatccaataatggataagagcagtagaacgagactagcgctgattatctgcaatgaggaattcgattctattcctcgcagaaccggtgccgaggtggatataaccggaatgactatgctgttacagaacttagggtatagcgtcgatgtgaagaagaacctgaccgcgagcgacatgactaccgaactggaggcattcgctcatcggcctgagcacaaaactagtgactccactttcctggtgtttatgtcacacggcattcgcgagggtatttgtgggaaaaagcatagtgagcaggtgcccgatatcctccagcttaatgctatattcaatatgcttaatacaaaaaactgtccgtcactgaaggataagcctaaagtcatcatcatccaggcctgccggggagacaatgtttcctggcgccaccccaccatggggtctgtattcatcgggcgtttgatcgagcatatgcaggagtacgcttgttcctgcgatgtggaggaaatatttcgtaaggtcagattttcctttgagcagcctgatgggcgagcacagatgcctacgacggaacgcgttacgttgacccgctgcttctatctgttccctggacattag

SEQ ID NO: 27777 - DNA, 1368 bp, Artificial Sequence
  Description of Artificial Sequence: Synthetic coding sequence
atgaagagtcagggacagcactggtactctagctcggataagaactgcaaagtctccttcagagagaaactgttaataattgactcaaacctgggtgtccaagatgttgagaatctcaaattcttatgtatcggccttgttccgaataaaaaactggaaaagagctcaagcgcaagcgatgtgttcgagcacctgttggccgaggacttgctttctgaggaggatcccttctttctggccgagcttttgtatatcatacggcagaaaaagctgctgcaacatctcaactgcactaaggaagaggtggagcggctgcttccaaccaggcagagggtgtctctgttccgcaatcttctgtacgaattaagcgaaggaatcgactcagagaatctgaaagatatgatcttcttgcttaaagacagtttgcctaaaacggagatgacctcactgagttttctagcattcctggagaaacagggcaaaatcgacgaagacaacctgacttgcctcgaggacctgtgcaaaacagtggtgccaaagctgttgagaaatatcgaaaagtataaaagggagaaagctattcagattgtgacaccaccggttgacaaagaggccgaatcctatcagggagaagaggaactggtcagccagacagacgttaagacatttctcgaggccctgccccaggagtcatggcagaacaagcatgcgggatctaatgaaatcttgagccacgtgtttcaatggcttggatttacagtgcacattcacaacaatgtcaccaaggtggaaatggagatggtactgcaaaaacagaaatgtaaccccgctcatgctgatggcgactgctttgtcttctgtatattaacccacggcaggtttggagctgtgtattctagtgatgaggcgctgatccccattcgggagataatgtcccattttactgccctccaatgccctagactagccgaaaagcccaagctcttcttcatccaagcttgccagggggaagagattcaaccatccgtgagcatcgaagctgacgctcttaaccccgagcaggctcccacctccctgcaggactccatacctgccgaagctgattttttgctgggccttgctaccgtgcctggttatgtatcatttcggcacgtcgaagaggggtcttggtacatccagtccctgtgcaaccacttgaaaaaactcgtcccccgacacgaggacatactatccatcctcactgcggtgaatgatgacgtcagccggagggtcgacaaacagggcacaaagaagcagatgccccagcctgccttcacacttcgaaaaaaacttgtgttcccagtgccactagatgctttatcactgtag

SEQ ID NO: 27778 - DNA, 1437 bp, Artificial Sequence
  Description of Artificial Sequence: Synthetic coding sequence
atgaagtcacagggacagcactggtactcctcgagtgataagaactgcaaggttagcttccgtgagaagctgttgattatagactcgaacctgggagttcaagatgtcgaaaacctgaaatttctgtgtattggcctggtgcccaacaaaaagttggagaagtcctcttcagctagtgatgttttcgaacatttgctcgccgaagacttgctgagcgaggaggaccccttcttcctggcggagctgctgtacataatccgacaaaagaagctgctccagcacctgaactgcactaaggaggaggtggaacgtctgctcccaacaagacagagagtgagcttgttccgcaatcttttatacgagctgagtgaaggaatcgactcagaaaatctgaaggacatgatcttcttacttaaggattccctgcctaaaacggaaatgactagccttagcttcttggcttttctcgaaaaacaaggaaaaattgacgaggacaatctgacgtgtttagaagatctttgcaagactgtcgttcctaaactgttgcggaacatcgagaaatataagcgggagaaagccattcagattgtcaccccacctgtggataaggaggcggagagttaccagggtgaggaagagctggtgtcccagaccgacgtgaaaacttttctcgaggccctgcctagagccgcagtttatagaatgaaccgaaaccaccggggtctgtgcgttatagtgaacaaccatagtttcactagtctgaaggatcgacaaggcacacacaaggacgctgaaattctgagccacgtgttccagtggcttggctttacagtccacatccataataacgtcactaaggtggaaatggagatggtccttcagaaacagaaatgcaatcctgctcatgccgatggagattgctttgtcttttgtatcctgacgcatggaaggttcggagccgtgtattcctccgacgaggcgttgataccaatccgcgaaataatgagccattttacggcgctacagtgtccacgtctcgctgagaaaccaaagctgtttttcatccaagcctgtcagggggaggaaatccaaccaagcgtgtctattgaagcagacgcgttgaaccccgaacaggcacccacaagtctccaggacagtataccggctgaggccgatttcctcctgggcctggctacagtgcccggatacgtttccttcaggcacgtggaggaaggaagctggtatattcagagtctgtgcaatcatctcaaaaagctggtgccacgcatgttaaaatttctcgaaaagaccatggagatccggggtcggaagaggacggtgtggggagcaaagcagatatcggccacgtcactgcccacagccatctctgctcagaccccccgacccccaatgagaaggtggtcttctgtgtcctag

SEQ ID NO: 27779 - DNA, 1566 bp, Artificial Sequence
  Description of Artificial Sequence: Synthetic coding sequence
atgaaatcccagggacagcactggtatagtagtagcgacaagaattgcaaagtatcttttagagagaaactgttgattatagactccaatctaggtgtgcaggatgtggagaacctgaaattcctttgcattggcctggttcctaataaaaaactggaaaagtcaagctccgcctcagacgtgttcgagcacctcttagctgaggatttgcttagcgaggaagatccatttttcctggctgaactgctctacatcatacgccagaagaaactgttacaacacttgaattgcaccaaggaagaggttgaacgcctcctccccactcgacaacgggtcagtttgttcagaaacctgctttacgagctcagtgagggcattgactccgaaaacttgaaagatatgatctttctgctgaaggacagtttacctaagaccgaaatgacatcgttgtctttcctcgccttcttggaaaagcagggtaagatcgatgaggataacttgacctgcctggaggacctctgtaaaaccgtcgtgcccaaactcctgcgcaatatcgagaaatataagcgcgaaaaagcaatccagatcgtgacaccacccgtcgataaggaagctgagtcttaccaaggagaggaggagctggtaagtcagacagatgttaagacatttctagaggcactgccacaggagagctggcaaaacaagcatgccggaagtaacggtaacagagccaccaacggtgctccaagcctggtgagccgtgggatgcagggtgcctcagctaacacactgaattctgagacttcaacaaaacgggctgcagtctatcgaatgaatcggaaccacaggggactctgcgtgatcgtgaacaatcacagttttacgtctttgaaagataggcaaggcacccacaaagatgccgaaatcctgagccatgttttccaatggctagggttcacagtccacatccacaataacgttaccaaggtcgagatggaaatggtcctccagaagcagaagtgcaaccccgctcatgctgatggcgattgtttcgtgttctgcattctgacacacggcaggtttggcgctgtgtactcctccgacgaggctttgatacctattcgggagattatgtcacatttcactgctctacagtgtccccgactcgccgagaagccaaagctgtttttcattcaggcctgccagggggaagaaattcagccttctgtttctatcgaggctgacgcgctgaatcccgagcaagcgcctacctcactgcaggactcaatcccagccgaggctgattttttgctgggccttgcaactgtaccgggatatgtgagtttcagacacgtagaagaaggttcatggtacattcagtccctctgtaatcacttaaagaaactggtgcccagaatgttaaagttcttggagaaaactatggagatccgcggtaggaagcggacagtatggggggctaaacagataagtgctacttcactcccaactgctatctcggctcagaccccgcgacccccaatgaggcggtggtcttctgtgagttag

SEQ ID NO: 27780 - DNA, 1569 bp, Artificial Sequence
  Description of Artificial Sequence: Synthetic coding sequence
atgaaaagtcagggtcagcattggtactcttccagtgataaaaattgtaaagtctcattcagggaaaagctgttgatcatcgattccaatctgggtgtccaagatgtcgagaatcttaagttcctgtgcattgggctcgtgcctaataagaaattagaaaaaagtagctccgcgagcgacgtatttgagcacctgttggctgaagacctactgagtgaggaagacccttttttcttagccgagcttctatatattattcgacagaaaaaattgctccaacacctcaactgtacgaaggaagaagtcgaacgcttgctgcctactcgccagcgggtgtcactttttaggaacctgctgtatgagttatccgaaggcatcgattcagagaacctgaaggacatgattttccttttaaaggattctctccctaagacggaaatgactagtctcagtttcctggcattcctggagaagcagggaaaaatcgacgaggacaacctcacatgcctggaggacttgtgcaagacagtggtgccaaaactgctacgaaacatagagaaatataaacgggaaaaggctattcaaatcgtcacacccccagtggacaaagaggcggaatcctaccagggcgaagaggaactggtgtcgcagacagacgttaagactttcttagaggccctgccgcaggaatcgtggcagaataaacacgccggatccaacggaaatagggcgacgaatggggcaccaagcctggtgagtaggggaatgcaaggcgctagcgccaacaccttaaatagtgaaaccagtacaaaacgagcagctgtttataggatgaaccgcaaccatagagggttgtgcgtcatcgtgaacaaccattcatttacttctctgaaggaccggcagggcacccacaaggacgcagagatcctgagccatgttttccagtggctgggtttcacggtgcacattcataacaatgtgaccaaggttgaaatggagatggtcctgcagaagcaaaaatgcaatccagcacacgctgacggagactgtttcgtgttctgcatattgacccatggcaggttcggcgctgtgtactcttcagatgaggccctgatacccattagggagatcatgagccatttcacagccctacagtgcccaaggctagctgaaaaaccgaaactgttctttatccaggcttgccagggcgaggagattcaaccaagcgtgtctatagaagcagatgcactgaaccctgagcaagcacccaccagtctgcaggactctatacccgctgaagccgattttttactagggctggccaccgtgcccggatatgtctcatttaggcatgtggaggagggatcttggtatatccagagtttgtgtaatcatttgaaaaagctagtgccaagacacgaagacattctgagcattctcacggccgtcaatgacgacgtatcccgacgagttgacaaacagggtaccaagaaacagatgccccagcctgcctttacacttagaaaaaagctcgtgttccctgttcccctcgacgccctcagcctgtag

SEQ ID NO: 27781 - DNA, 1440 bp, Artificial Sequence
  Description of Artificial Sequence: Synthetic coding sequence
atgaagtctcaggggcagcactggtacagcagttcagacaagaactgtaaggtctcatttagagaaaagttgctgatcatagatagcaatctgggagtgcaggatgtggagaaccttaagttcctgtgtatcgggttagtgcccaacaagaaactggagaaatccagctccgctagcgatgtgttcgaacatcttctggctgaagacctcttatctgaggaggatcctttcttcttagcagaactcctttacatcattcgccaaaaaaaacttttacagcatctgaactgtacaaaggaggaggtcgagcggttactcccaaccagacaaagggtatctttgttcaggaatctactgtatgaactgtccgaagggattgatagtgaaaaccttaaagatatgattttcttgcttaaggacagtctgcccaagacagagatgactagcctgtccttccttgcattcctagagaagcaagggaagatagatgaggacaatctgacctgtctggaagacctgtgcaagacagtcgttcccaagttgttgaggaatatcgaaaaatataaaagagaaaaagctatccagatcgtcacaccacccgtcgacaaagaggcggagtcttatcagggtgaggaagaactggtgtcccaaactgatgtgaaaacatttttggaagccctgcctcgggcagccgtgtatcgaatgaatcgcaatcaccgaggcttgtgcgtgattgtcaacaatcattccttcacttctcttaaagacaggcagggaacacacaaggacgctgagatcctctcacacgtcttccagtggctgggatttacagtgcacatccataataacgtgaccaaggtcgagatggagatggttctccaaaaacaaaagtgtaatcctgcacatgccgacggcgactgctttgtgttttgtatcttaactcatggacgctttggcgctgtctacagtagcgacgaagccttaatacccatccgggagatcatgtctcactttaccgccctccaatgcccccgactggccgaaaagccaaagctatttttcattcaggcctgtcagggcgaggaaatacagccatctgtctccattgaggctgatgctttgaaccctgagcaagcaccaactagcctgcaggatagtattcctgcagaagccgacttcctgctcgggctcgctacagttccgggatacgtgagctttaggcacgtggaggagggctcatggtacatccagtccctgtgcaatcatttgaaaaaattggtaccacgccacgaagatatcctgtccatactgactgccgtcaacgacgacgtcagtagaagggtggataagcagggcaccaagaagcagatgcctcagcccgcattcacattaaggaagaagctcgtcttcccagttcccctggacgctttgagcttgtag

SEQ ID NO: 27782 - DNA, 822 bp, Artificial Sequence
  Description of Artificial Sequence: Synthetic coding sequence
atgaaaagccagggccagcactggtatagcagcagcgacaaaaactgcaaggtctccttccgggagaagctactcatcatcgatagcaatctaggagtccaggatgtggagaacctaaaatttttatgtataggcctggtccccaacaaaaaactcgagaagagcagtagcgccagcgacgtctttgagcatctgctggccgaagacctactgagcgaagaagatcccttctttctagccgagttactttacattatcagacagaaaaagctactgcagcacctgaattgtacaaaggaagaagtggagagactcctgccaacacggcagcgtgtgagtctgtttcgcaacctgctgtatgagctcagtgaaggcattgactctgagaaccttaaagatatgatattcttgctgaaagactccctccccaaaaccgaaatgacatcattgagtttcctggcttttctggagaagcagggcaagattgacgaagataacctcacctgcctggaggacctgtgcaagacggttgttccaaaacttctgcggaacatagaaaagtacaagcgggagaaggcaattcaaatagtgacccccccagtggacaaggaagccgaaagctatcagggggaagaagagctcgtttctcagacagatgtgaagacgttcctggaggctttaccccaggagtcctggcagaacaagcatgcaggctcaaatgaaggctcctgtgtgcaggacgagagtgaaccacaacggccactgtgtcactgccagcaacctcagctctacttgcccgaggggcagacgaggaatccatag

SEQ ID NO: 27783 - DNA, 1533 bp, Artificial Sequence
  Description of Artificial Sequence: Synthetic coding sequence
atggccgcagctgcccttcgggatcctgcacaggtgccggttgccgcagacttattaacagaccacgaggaaggatacgtaactttcgaggatgtagccgtttacttttcacaggaggagtggagactcctcgatgacgcccaacgactgctgtaccgaaatgtgatgcttgaaaattttactctgctggctagtctcggcttggcttcctccaagacccatgagatcacccaactggaatcatgggaagagcctttcatgccagcctgggaggtggtcaccagcgctatcccaagaggttgctggcacggggctgaggctgaggaggccccagagcagatagccagtgtcggcctgttgagtagcaacatccaacagcatcagaagcaacactgcggcgaaaaaccactgaagaggcaggaaggacgggtacccgtgttgcgttcttgtaaggtgcacctgagcgagaagtccctgcaaagcagggaggttggaaaagcactgcttattagttccggggtccttaaacaccaggtgacccatactggtgagaaatctcacagatcttccaaaagtcgtgaggccttccacgccggaaaacggcattacaaatgtagtgaatgtggtaaagcatttggtcagaagtacttgctggtccaacatcagcggcttcatgcaggtaagaagacctacgaatgttcagaatgcggtaagctgtttcgggacatgagcaatttgttcattcatcaaatagtgcatacgggtgagagaccatacggctgcagcaactgcggaaagtccttttcccgcaatgcccatttaatcgagcatcagcgagtccacaccggagagaagccttttacctgtagcgaatgtggaaaggcttttcggcacaattccacccttgtacagcaccataagatacataccggtgtgaggccctatgaatgctctgagtgcggcaaactattctcttttaacagctcgctgatgaagcatcagcgcattcacacaggggagaggccctacaaatgctctgaatgcgggaaattctatagtcataaatctaacctgatcaagcattggagggtccacaccggtgaacgcccatacaagtgttctgattgcggaaagttttttacgcagtgttctagccttatgcagcaccaaaaagtgcacaccggggagaaacctttcaaatgcaatgagtgcgggagattctttagggagaacagtaccttggtgcgacaccagagggttcatacgggcgctaaaccgtacgagtgcagagagtgtggaaaatttttttcccagtcctcaactctgatgcagcacagaaaggtgcacatcggagaaaaaccctttaagtgcaatgagtgtggaaggctgtttagagagaactctagcctggtgaaacaccagagagtacacactggggcaaagccatacgaatgcagagaatgcgggaagttctttcgccataactccagcctgtttaagcacaggcgcatacacactggtgaaatgcagtag

SEQ ID NO: 27784 - DNA, 729 bp, Artificial Sequence
  Description of Artificial Sequence: Synthetic coding sequence
atgtctaatccacggtctctcgaggaggaaaaatatgacatgagcggtgctcgtcttgctctaatcctctgcgtgacaaaggctagggagggatcagaagaagacctggacgcgctagagcatatgttccgccaactacgcttcgagtcaaccatgaagcgcgatcccacagccgagcaatttcaagaggaactcgagaagttccagcaggccatcgattcccgtgaagatcctgtgtcttgtgctttcgtggtgttaatggcacacgggagagaggggtttttgaagggagaggacggcgagatggtcaagttagaaaacctgttcgaggcgctcaataacaaaaattgtcaagctctccgggctaagccgaaggtgtatattattcaggcctgccggggtgagcagagagaccccggagagaccgtgggcggtgacgagatcgtaatggtgatcaaggactctccacagaccattcccacctacaccgatgctttacatgtctatagtactgtggaagggtatatagcctaccgccatgatcagaaaggctcttgctttatacagacactggtggacgtgtttacgaagaggaaagggcatatcctggagctgctgacagaagtgacaagacgcatggccgaggctgagttagtgcaggagggaaaggcacgcaaaacaaatccagagatacaaagcacactgcggaagaggctctacctccagtag

SEQ ID NO: 27785 - DNA, 1359 bp, Artificial Sequence
  Description of Artificial Sequence: Synthetic coding sequence
atggctgcgccatcagcgggatcatggagtacatttcaacacaaagagctcatggcggcagataggggaagacgtatcctcggcgtttgcgggatgcaccctcaccatcaagaaacacttaagaagaatcgagtcgtgctcgccaagcagttgctgttgtcagagctgctagagcatttgctggagaaagacatcatcacgttggagatgagggaactcatccaggccaaggttggatccttttctcagaatgtcgagctgctgaacctgctccctaaacggggaccccaggcattcgacgctttctgtgaagcgcttcgagagacgaagcagggacacctagaagacatgctgctaactaccctgagcggactgcaacatgtcttgccccctttgtcttgtgattacgacctcagcctaccctttcccgtgtgcgaaagctgcccactctataagaaacttcgattgtccaccgataccgtggaacactctttagataacaaggatggcccagtgtgcctccaggtcaagccatgcacccccgaattctaccagacccattttcaactcgcctatcgcttgcagagtcggcctcgaggactcgctctagtgctgagcaacgtgcactttactggggaaaaggagttggagtttaggagtggcggtgatgtggaccactctactcttgtcacactatttaaactgctcgggtatgatgtccacgtgctatgtgaccaaactgcccaggaaatgcaggagaaattgcagaacttcgctcagctccctgcacatcgcgtgacagactcttgtatcgtggccttgctgtctcacggggtggagggggctatatatggagtggatggtaagttgctgcaactccaggaagtgtttcagctgtttgataatgcaaactgtcctagtctccagaataagccaaaaatgttttttatccaggcttgccgtggcgatgagacagataggggagtcgaccagcaggatgggaaaaaccatgctggttctccgggatgtgaggagtccgacgcaggcaaagagaaactccccaaaatgagattaccaacacgtagtgatatgatatgcggctatgcatgtctgaagggcactgccgcaatgcggaacacaaagcgcggatcctggtacatcgaagccctcgcccaggtgttctcagagcgcgcatgcgacatgcacgtggctgacatgctggtgaaagtgaacgctctgatcaaggatagagaaggatatgcacccggtaccgaatttcataggtgtaaggaaatgtccgagtactgcagtaccctttgccggcacctttatctgttccctgggcatccccctacctag

SEQ ID NO: 27786 - DNA, 327 bp, Artificial Sequence
  Description of Artificial Sequence: Synthetic coding sequence
atggcagcgccatcagcaggctcctggtcaacctttcagcacaaggagctcatggcagcagatcggggaaggcgaatcttgggagtctgcggcatgcacccgcaccatcaggagacgctgaagaaaaatcgggtggtattggccaagcagctgttgttaagcgagctgctggagcatctgctcgagaaggatatcatcactctggagatgagggagctcatccaggccaaggtagggtccttcagtcagaacgtcgagctgttgaacctcctgcctaagcgaggccctcaagcctttgacgccttctgcgaggcccttcactcatag

SEQ ID NO: 27787 - DNA, 942 bp, Artificial Sequence
  Description of Artificial Sequence: Synthetic coding sequence
atgcacccccaccatcaggagacacttaaaaagaaccgcgtggtcctggcaaagcagttgctgctgtcggaactgttggagcacttgctggagaaggacattatcacgctcgaaatgcgggagctgatacaagcgaaggtaggctccttctctcagaatgtggaactcctaaatctgcttccaaagcgtggccctcaggcgtttgatgccttttgcgaggctctcagggagaccaaacagggacacctggaagacatgttgcttaccaccctctcaggcctgcagcacgtgctaccaccgctctcatgtgactacgacctttccctgccatttccagtctgcgagtcttgtccgctgtataagaagttgaggctctcaacagatacggttgagcatagcttagataacaaggacggacccgtttgcctgcaggttaagccctgtactccagaattttaccagacccatttccagctcgcctatcgtctgcagagcagaccaagggggctggccctcgtgttatccaacgttcacttcacaggggagaaggagctggagttccgcagcggcggagacgtggatcacagcacactcgttactctttttaagctactgggttatgatgttcacgttctttgtgaccagactgcccaggagatgcaggagaagctgcaaaactttgcccagttgcccgctcacagagtgaccgatagctgcattgtcgctctgctatcacacggtgtggagggagcaatctacggcgtcgacggtaaactcctgcagttacaggaagtgttccagctgttcgataatgctaattgtcccagcctgcaaaataagcctaaaatgtttttcattcaggcctgtcgcggagccggtgcaataggatcgctgggccatctgctgttgttcactgctgccaccgccagcctcgctctctag

SEQ ID NO: 27788 - DNA, 993 bp, Artificial Sequence
  Description of Artificial Sequence: Synthetic coding sequence
atgcttaagctgaaaacgaaattcgggagttggcaaactctttgcaagaggagcaatgtctggcaggacaaatgcttcttcaagccgtttaacatcgaccagataagtccaaataaaaaggcccatccaaatatggaggcaggccctcctgaaagtggggagtccactgatgccctgaaactttgtccccacgaagaattcttgcgactgtgtaaggaacgcgcagaggaaatctatcctatcaaagagaggaataatcgcaccagactcgccttgatcatctgtaacaccgaattcgaccatctccctccccgaaatggagcggattttgatattactggtatgaaggaactgctggagggcctcgactacagtgttgacgttgaggagaacttaaccgctcgtgacatggagtccgcccttcgagcgttcgctacccggccagagcataagtcttcagactcaactttcttggttcttatgagccacggcatcttggaaggcatttgtggtaccgtgcacgatgagaagaagccagatgttcttttatacgacacaatttttcaaatcttcaacaacaggaattgtttatctcttaaggataaacctaaggtcatcatcgtacaggcctgccggggagctaataggggcgaattatgggtccgcgatagtcctgcgtctctggaagtagcctcatcacagtccagcgagaacttagaagaggatgcagtatataaaacccacgtcgagaaggatttcattgccttctgtagttccacaccccataatgttagctggcgcgattcaactatgggttccatttttataacacagttaatcacctgttttcaaaaatactcatggtgttgccacttagaagaggtgtttagaaaggtgcagcaatcattcgaaacgcccagagctaaggctcagatgcctacgattgaaaggctgagcatgactcgctatttctacctgttcccagggaactag

SEQ ID NO: 27789 - DNA, 444 bp, Artificial Sequence
  Description of Artificial Sequence: Synthetic coding sequence
atggccgaaggaaaccatcgaaagaaacctttgaaagtgctcgaaagcctgggaaaggacttcctcaccggagttctggataacttagtggagcagaacgtgctgaactggaaggaagaagagaagaagaagtattatgatgcaaagactgaagacaaggttcgcgtcatggccgattcaatgcaggagaaacagcgtatggcaggacagatgcttctccagactttcttcaacatcgaccagatatcgcccaataaaaaggcccacccaaacatggaggccggaccacccgagtcaggcgagagtacggacgctcttaagctgtgcccacatgaggagtttcttaggctgtgcaaagagcgggctgaggagatataccccattaaggaaagaaataacaggacaaggctcgctctcatcatatgcaatacagaattcgactag

SEQ ID NO: 27790 - DNA, 1134 bp, Artificial Sequence
  Description of Artificial Sequence: Synthetic coding sequence
atggcggagggaaaccacagaaaaaagccgcttaaggtacttgagtcgctcggcaaagacttcctgacaggcgtgctggataacttagtagaacagaacgtgctgaactggaaagaggaggagaagaagaagtattatgacgcaaagactgaggataaagttagggtgatggccgacagtatgcaggaaaagcaacggatggcgggacaaatgctgctgcagacctttttcaatatagatcagatttctccgaataaaaaggcccaccccaacatggaagcgggacccccagagtcaggggagagtaccgacgcattgaaactttgtccccacgaagaattcctgaggttgtgtaaagaaagggcagaagagatttatcccattaaggaaagaaacaataggacaagactcgcgttaataatttgtaatacagagttcgaccacctgccacctagaaatggcgctgattttgacattactggcatgaaagaactgctcgaggggctagattatagcgtcgacgttgaggagaatcttactgcccgagatatggaaagcgccttgcgcgcttttgctacccggccagaacataaaagcagtgactccactttcctggtcctgatgagtcacggaatattggaggggatctgtggaacagttcacgacgagaagaaacccgacgtgctgctgtatgataccatttttcagatctttaacaaccggaactgtttgagcctgaaagataagccaaaggttatcatcgtccaggcatgccgcggtgccaaccgtggcgagctgtgggtgcgcgacagtcccgcaagcctggaagtggcatcctctcagtccagcgagaatctggaggaagatgccgtttataagacacacgtggagaaggactttatcgccttctgttctagtacacctcacaatgtgtcttggagagattctactatgggctccatattcatcacacagttaattacctgttttcagaaatactcatggtgttgtcacctcgaggaggtgttccgtaaggtgcagcagtccttcgagacgccaagagcaaaagcccaaatgccaaccattgagcgactttctatgactcggtatttttatttgtttcccggtaattag

SEQ ID NO: 27791 - DNA, 1305 bp, Artificial Sequence
  Description of Artificial Sequence: Synthetic coding sequence
atggctgaggattctggcaaaaagaagagaagaaagaatttcgaagccatgtttaaaggaattctgcagtctggcctggataattttgtgattaaccatatgctgaagaataatgtcgctggccaaactagcatccagacccttgtgccaaacacagatcagaaatcaacatccgtcaagaaggacaatcacaagaagaagaccgtcaaaatgctggagtacctgggcaaagatgtgctccatggtgtatttaattaccttgccaagcacgacgttctcaccctgaaggaggaagaaaagaagaagtactatgataccaagatagaggataaggcgcttattctcgttgactccctgaggaaaaatcgcgtggcccaccaaatgttcacgcagacactgctcaatatggatcagaagattacgtctgtgaagcctcttctgcagatcgaagccggtccaccggagagcgctgagtctacgaatatacttaagctgtgtcctcgcgaagaattcttgaggctctgtaagaagaaccacgacgagatatatcccatcaagaaacgagaggatagaaggcgactcgctctcatcatttgtaacacaaaattcgaccatctacccgcacgtaacggagctcattatgacattgtgggcatgaagcgcctgctgcaggggcttggttatactgtggtggacgaaaagaacctgacagccagagatatggagagcgtgctgagggcttttgctgcacgtcctgaacacaagtccagcgactccactttcctggtcctcatgtctcatggaattctagaaggcatctgcggcacggcccacaaaaagaagaaacccgacgtcctcctgtatgacaccattttccaaatatttaacaatcggaactgcctaagcctcaaggacaaaccaaaggtgatcatcgtgcaagcttgtagaggcgagaagcatggcgagttgtgggtgagggatagcccggcatccctggcacttatctcttcccagtcttcagaaaacctcgaagcagacagcgtgtgtaagatccatgaagagaaggactttatcgccttttgttcttctaccccacacaatgtgtcttggcgagaccgaacccgcggttctatttttataaccgagctgatcacctgtttccagaagtattcttgctgttgtcatctaatggagatcttccgaaaggtgcagaagtcgttcgaggtgccccaggcaaaagcgcagatgccgacaatcgagcgggctactctgactcgcgacttttacctttttcctggaaattag

SEQ ID NO: 27792 - DNA, 402 bp, Artificial Sequence
  Description of Artificial Sequence: Synthetic coding sequence
atgctaaagaacaacgtagcgggacagacatccatccagaccctagtacccaatactgaccaaaaatccacctcagtcaagaaggacaaccataagaaaaagactgtgaaaatgcttgaatatttgggcaaggatgtgctgcatggtgtgttcaactacctggccaagcatgacgttcttacactgaaggaggaggagaagaaaaagtactatgacacaaaaatcgaggataaggctctgatccttgttgattctttgcgtaaaaatcgggtggcgcatcaaatgtttactcagacactgctgaatatggatcagaaaatcacatctgttaaacatttatcaaataaaaaggagcggggaccccagacccccggtagccaccatatgcagtacaaagtctag

SEQ ID NO: 27793 - DNA, 1344 bp, Artificial Sequence
  Description of Artificial Sequence: Synthetic coding sequence
atggcagctgtgccgcgtgtggaaggtgtgttcatcttcctgatcgaggacagcggcaagaagaagcgcaggaaaaatttcgaagctatgttcaagggcattctccaatcaggattagacaacttcgtgatcaaccacatgttgaaaaataatgtggccggacagactagtattcagacgctagtccccaatactgaccagaaatctacctcggtgaaaaaagacaaccataagaagaagaccgttaagatgcttgagtatttgggcaaggatgtgctgcacggggtgttcaactacctggcgaaacatgacgttcttacgctaaaggaggaggaaaagaagaaatattacgacactaaaattgaagacaaagccctaattctcgtagactccctccgaaaaaaccgggttgcccatcagatgttcacacaaaccctcttaaatatggatcagaaaattacttcagtcaagcccctcctccagatcgaagcaggcccaccagagagtgctgaatcaaccaatattctaaaattatgcccacgggaggagtttcttcgactgtgtaagaaaaatcatgacgagatctatcctatcaagaaaagagaagatcgaaggcgtttagcgctgattatatgcaacaccaagttcgatcatctgcctgctcgtaatggtgcgcattatgatattgtggggatgaaacggcttctgcagggtcttggttataccgttgtggatgaaaaaaatcttaccgccagggatatggagagcgtgctgcgtgcgtttgcggcaaggcccgagcataagtcatctgatagcacttttttggttttaatgtcccacggcatacttgaagggatttgtggaaccgctcacaagaagaaaaagcccgatgtactgctgtatgatacaatattccagattttcaataaccgcaactgtcttagtctgaaagataaaccaaaggttatcatcgtgcaggcatgtcgcggtgagaaacacggcgaactgtgggttagggactcaccggctagtctggcattgatttccagccaatcgagtgagaatttggaagctgattccgtctgcaaaattcatgaagagaaggacttcatcgccttttgtagctctactccccacaacgtctcttggcgagatcgcaccagggggagcattttcatcaccgaactgatcacatgttttcagaagtactcatgctgttgccatctgatggaaattttccgtaaagtgcagaagtcctttgaggtgcctcaggcgaaggcccagatgcccactattgaacgggcaacactcacgcgtgacttctacctgtttccaggcaattag

SEQ ID NO: 27794 - DNA, 879 bp, Artificial Sequence
  Description of Artificial Sequence: Synthetic coding sequence
atggcggctctcctgcaaattgaagctggacctccggagagtgcagagtctaccaatatcctaaaactttgccccagggaggagtttctcaggctgtgcaagaagaaccatgatgagatctatccaattaagaaaagggaagatagaaggcggctggcactcataatttgcaatacgaaatttgatcacctcccggcacgtaacggcgctcactacgacattgtgggaatgaagagactcctgcaagggcttggttatacagttgtagacgagaagaatctcaccgccagggatatggagagtgttctgcgggcatttgctgctcgtcccgaacataagtcctctgactctacattcctcgttctgatgagccatggcattcttgaggggatttgtgggaccgcacataaaaaaaaaaagccggatgtactcctctatgatacaatctttcaaatttttaacaaccgtaattgcctttcactgaaggacaagccaaaggtgatcatagttcaggcatgcagaggcgagaagcacggcgagctgtgggttcgagatagcccagccagtctggccctgataagctctcaatcttcagagaacctggaggctgactcagtttgtaaaattcacgaagagaaggacttcatcgcgttttgcagttctaccccgcataacgtgagttggagagaccggaccagaggatcaattttcatcactgagcttatcacatgtttccagaaatactcatgttgttgccatcttatggagattttcagaaaggtccagaagagtttcgaggtgccacaggccaaggcacaaatgcccacaatcgaacgcgcaacattaaccagagatttctatctgtttccaggcaactag

SEQ ID NO: 27795 - DNA, 1131 bp, Artificial Sequence
  Description of Artificial Sequence: Synthetic coding sequence
atggcagaagacaaccataaaaagaagacagtgaagatgctagaatatctcggcaaagatgttctgcacggggtgtttaattaccttgcaaaacacgatgtgctgacccttaaagaggaggaaaaaaaaaagtattatgacaccaaaatcgaggataaagctctcatcctcgtggacagtttgcgtaaaaatcgggtggctcaccagatgtttacccagaccttactgaatatggatcagaaaattacctctgttaaacctctgctgcagatcgaagccggacccccagaatctgccgaaagtacaaacatactgaagctctgccccagggaggaattcctgagactctgcaagaaaaatcatgacgagatttaccccattaaaaagcgtgaggatagacggaggctcgcacttattatttgtaataccaagttcgatcacttacctgccaggaatggagctcactacgatatcgtgggcatgaagcggctgctgcaagggcttgggtacacagttgttgacgagaagaacctcactgctagggacatggaatcagttttgcgcgcattcgcagccaggcctgaacataaatctagcgactctacatttctggtcctaatgtcacatggcatattggaaggtatttgtgggacagctcacaagaagaaaaagcctgatgtacttttgtacgacactatctttcaaattttcaataaccggaattgtctgtctctcaaagataagcctaaagtcattatcgtgcaagcctgccgcggtgaaaagcatggcgaactgtgggtgagggactcgccggcatctttggccctaatctcgagccaaagttccgagaatctcgaggctgacagcgtttgcaaaattcatgaggagaaggatttcatcgctttctgctcttccacaccacacaacgtgtcctggcgggacagaacgagaggctctatctttatcactgagttaattacctgttttcaaaaatacagctgttgctgccatctgatggagatattccgtaaagtgcagaagagcttcgaagttccgcaggccaaggcacaaatgcctacaatcgaacgagcaactttgacccgggacttctaccttttcccaggcaattag

SEQ ID NO: 27796 - DNA, 1344 bp, Artificial Sequence
  Description of Artificial Sequence: Synthetic coding sequence
atggccgctgtgccccgagtagagggcgtgtttatatttctgattgaagatagtggcaagaagaaaaggcgaaagaacttcgaggccatgtttaaaggaatactacagtccgggctcgacaacttcgttataaatcatatgcttaagaacaacgtcgccggacagacctctatccagaccttggtgccaaataccgatcaaaagtccacatctgtcaagaaggacaaccacaaaaagaagacggtcaagatgctggaatatctggggaaagatgtgcttcatggtgtgtttaactacctggccaaacacgatgttcttaccttgaaggaagaggaaaagaagaagtattatgatactaaaatcgaggacaaggcactgattttagtggatagcctgaggaaaaatcgcgtggcccaccagatgttcacccagacacttctcaatatggaccagaagatcaccagcgtgaaaccactcctccaaatcgaagcaggaccgcctgagtcagctgaaagtacaaacatactgaaactttgcccgagagaggaatttctgcgcctgtgtaaaaagaaccatgacgagatttatcctattaaaaagagagaggatagacgcagactcgccctaatcatctgtaacaccaaattcgatcacctgcccgctcgaaacggcgctcactatgatattgtgggaatgaagcgtctgctgcaggggctgggttacaccgtggtggacgaaaaaaatctaactgccagagatatggagtctgttctgcgggctttcgctgcgcgaccagagcataaaagttccgattctactttcctggtgctgatgagccatgggatcctggagggtatctgcgggaccgcacacaaaaaaaagaaacccgatgttcttttgtatgacaccatctttcagatctttaacaataggaactgcctatcccttaaggataagccgaaagtcatcatcgtgcaggcctgccggggtgagaaacacggagagctatgggtgagggacagccccgcttctttggctctgatctcatcccagtcatccgagaacttggaggcagactccgtgtgtaagattcatgaagaaaaggattttattgcgttctgttccagcacccctcacaacgttagttggagagaccgtacccgaggatccatttttattactgaactgattacctgtttccagaagtattcctgttgttgtcacctcatggaaatttttcgcaaggttcagaaatcctttgaggttccacaggccaaggctcagatgcccaccattgagagagctactttaaccagggatttttatctcttccctggtaattag

SEQ ID NO: 27797 - DNA, 879 bp, Artificial Sequence
  Description of Artificial Sequence: Synthetic coding sequence
atggccgcattactgcagattgaagctggcccaccagagagcgccgaatccaccaatattttaaagctgtgtcctagagaagagtttttgaggttgtgcaagaaaaaccacgatgaaatttacccaattaaaaagcgagaggatagacggcgactggctttgatcatttgcaataccaagtttgatcacctgccagcaaggaacggtgctcattacgacatcgtcggaatgaaacgcttactccagggcctgggttataccgttgtagacgaaaaaaatcttacggcacgcgacatggagtctgtcctgagagctttcgctgccagacccgagcacaaatctagtgatagcacattcctcgtgcttatgtcccatgggattctggaggggatctgtggcactgctcacaaaaaaaagaaacctgatgtcctactgtatgacacgattttccaaatcttcaataatcgaaactgtctttcgctcaaggacaagcctaaggttatcattgtgcaggcttgtagaggcgagaaacacggagagctgtgggtgcgggacagccccgctagcctggcactgatttcaagtcaaagctcagagaatttagaggccgattctgtttgcaaaatacatgaggagaaggatttcatagcattttgttcttcaacacctcataacgtctcatggagagaccgaactagagggtcaatttttataaccgaactaataacctgtttccaaaagtacagttgctgctgccacctgatggagatctttaggaaagtccagaagagttttgaggtaccacaggccaaggctcaaatgccaactattgagcgagctaccttaactcgggacttctacttatttcccggtaattag

SEQ ID NO: 27798 - DNA, 882 bp, Artificial Sequence
  Description of Artificial Sequence: Synthetic coding sequence
atgtcaagtgcatcggggcttcgaaggggacaccccgcagggggtgaggagaatatgacggagaccgacgccttttacaagcgagagatgttcgatccggctgaaaagtacaaaatggatcacaggcggaggggaatcgccctcatcttcaatcacgagcgatttttctggcatctcactctgcccgagaggcgagggacctgcgcagacagagataatttgaccaggagattctcagatctaggcttcgaagtgaagtgctttaacgacttaaaagccgaagaattgttgctaaaaatccatgaagtaagcactgtcagccacgccgacgccgattgctttgtgtgcgtctttctgtctcacggtgaggggaaccatatctacgcttatgatgcaaaaatcgagatccaaactctgactggcttgttcaaaggcgacaagtgccatagtctggtcggcaagcctaagattttcatcatacaggcgtgccgtggaaaccagcacgatgtgcccgtgataccactggacgtcgtagacaatcagactgaaaagctggatacaaacattaccgaggtcgacgcagcaagcgtctatactctgcccgctggtgctgacttcctcatgtgctattcggtcgccgaaggatattacagccaccgggaaacggttaacggtagctggtacattcaggacttatgtgaaatgctgggtaaatatggaagcagcttagagttcactgagctcctgacactggtgaaccggaaggtgtctcaacgtcgcgtcgacttctgtaaagaccccagcgcaattggtaagaaacaggtgccatgctttgcctctatgttgacgaagaagctccacttcttcccaaagagcaattag

SEQ ID NO: 27799 - DNA, 615 bp, Artificial Sequence
  Description of Artificial Sequence: Synthetic coding sequence
atgagctcagctagtgggctgagaagggggcatcccgctgtttccacagtttcccacgctgacgccgactgtttcgtttgtgtttttctctctcacggtgagggtaatcacatttatgcgtacgacgccaaaatcgaaattcaaactctgacaggattgtttaagggggacaagtgtcattccctggtgggtaagccaaaaatcttcatcatccaggcctgccgtggcaaccagcacgatgtccctgtcatccctttagatgtggtcgataatcaaactgagaagcttgatacaaacattactgaggtggatgccgcatccgtgtacacattgccagcaggagcagatttccttatgtgttactctgttgccgagggctactactcacaccgggaaactgtgaacggaagctggtacatacaggacctgtgtgaaatgctgggaaaatatggctccagtctggaatttactgagctcctgactctcgttaatcggaaagtctcacagcgaagggttgacttttgcaaagatcctagcgctataggaaaaaaacaggtgccatgttttgcatccatgttgactaaaaaactccattttttccccaagagcaactag

SEQ ID NO: 27800 - DNA, 912 bp, Artificial Sequence
  Description of Artificial Sequence: Synthetic coding sequence
atggcagatgatcagggttgcatcgaagagcagggggtggaagatagtgctaacgaagattcagtggatgccaagccagatagaagctcattcgtgccctcactctttagcaaaaagaagaagaatgttacaatgcgctccatcaagacgacccgagaccgggtaccaacctatcagtacaatatgaacttcgagaagttgggaaagtgcattattattaacaacaaaaattttgacaaagttactgggatgggggtgcgtaatggcaccgacaaagatgcggaggccctcttcaaatgcttccgctccctcgggttcgatgtcattgtgtataatgattgcagttgtgctaagatgcaagatctcctgaagaaagcatccgaggaggaccacactaatgccgcttgttttgcctgcattttgctttcacacggggaggagaatgtaatctatgggaaggacggcgtgacacccatcaaggatctcacagcccactttagaggagatcgttgcaaaaccctcctcgaaaagcccaagctgttcttcatacaggcctgtcggggtaccgaacttgacgacggtattcaggccgactctggccctatcaatgatacagacgcaaatcccagatataagattcccgtcgaggccgatttcctgttcgcctattccacggtgcctggctattattcatggagaagccctgggcgaggatcctggttcgttcaggccctgtgctccatactggaggaacacggcaaagatctcgagatcatgcaaatactcactcgggttaacgatagagtagccaggcatttcgagtcccagagcgatgacccacattttcatgagaagaagcagattccatgtgtggttagtatgttgaccaaggaactctatttctcccaatag

SEQ ID NO: 27801 - DNA, 912 bp, Artificial Sequence
  Description of Artificial Sequence: Synthetic coding sequence
atggctgatgaccaggggtgcattgaagagcagggcgtggaagacagcgccaatgaggatagcgttgatgctaagccagataggagctctttcgttccatccttattcagtaaaaaaaaaaaaaacgtaacaatgagatccatcaagaccacccgggatagagtgcccacctatcaatataacatgaattttgaaaagttaggcaaatgtatcatcatcaacaataagaatttcgacaaggtcacaggaatgggagtccgcaacggcaccgataaagacgccgaggccctcttcaagtgctttagatcacttggctttgacgtcattgtgtataacgattgtagttgcgcaaagatgcaggatttgcttaaaaaggctagcgaagaggatcacactaatgccgcttgttttgcatgcatcctactctcacatggggaggagaacgtgatctacggcaaagatggcgtgaccccgatcaaagaccttaccgcacattttaggggtgatcggtgtaaaactctattagaaaaacctaaattgtttttcatccaggcatgtcggggaaccgaactagatgatggcattcaggcagacagcggacctatcaacgatactgacgctaatccaagatataagatcccagtggaagccgattttttgttcgcttactcaacagtccccggttactactcatggagaagcccagggcgaggtagctggtttgtccaggcactttgctcgatactggaggagcacggcaaggatcttgaaatcatgcaaattctcactagagtgaacgatagagtggctagacacttcgagtcccaatcggatgatccccatttccacgagaagaagcagatcccctgcgtagtgagtatgctgaccaaggaattgtatttttctcagtag

SEQ ID NO: 27802 - DNA, 663 bp, Artificial Sequence
  Description of Artificial Sequence: Synthetic coding sequence
atggccgacgaccagggttgcatcgaagaacaaggtgtcgaagactcggccaacgaagactctgtggacgctaagcctgatcgctcaagctttgttcccagtctgtttagcaagaaaaagaaaaatgttaccatgaggagcatcaaaaccacacgcgatagggtacctacttaccagtacaatatgaacttcgagaagttaggaaaatgtataattattaacaacaaaaacttcgacaaagtaaccggaatgggtgtcaggaatggaaccgataaggatgcggaggcactgtttaaatgcttccgatccctagggttcgatgtcatcgtctataatgattgctctgttactcaggcaggtgtccagagacgggatcttgggagactccaacctccccctccacgctttaaacaatatagctgtctatccctgctgtcatcgtgggactacaggcacgcaccacccaggttagccaacttttgcatcttccgccgagagggatttcgacacgtaggtcaggccggactcaaactgctggcgtctagcgatcctcccacctccggctcccaatctgccggtataactggtgtatcactccatacacaaccacagattatgaaagtgtctctgcgccattgtaacacttttatctgttttgcttag

SEQ ID NO: 27803 - DNA, 912 bp, Artificial Sequence
  Description of Artificial Sequence: Synthetic coding sequence
atggcagacgaccaggggtgtatcgaggaacaaggggtggaggactcagcgaatgaggatagtgtggacgccaagccagatcggagctcttttgttccaagcctatttagcaagaagaaaaaaaatgtcactatgcggagcattaaaactacaagagatcgggtcccaacttatcagtacaatatgaacttcgaaaaacttggaaagtgtattatcatcaacaataaaaattttgataaggtcacgggtatgggcgtgcggaatggaactgataaggatgccgaggctctgtttaagtgcttcagatcccttggattcgacgtgatagtctacaacgattgcagttgtgcaaagatgcaggaccttcttaagaaagcctctgaggaggaccatacaaacgcagcatgcttcgcttgcatcctactgagccacggcgaggaaaatgtgatctatgggaaagacggcgttacgccaatcaaagacctgactgcgcattttcgcggtgaccgttgcaagaccctcctggaaaaaccaaaactgttctttattcaggcgtgtagagggaccgagcttgacgacggaatccaggcggacagcggtcctatcaacgacacagacgcaaacccacggtataaaataccagtggaagccgatttcctgttcgcctatagcaccgttccgggttattattcttggcgatctccaggcagaggtagctggtttgtccaggccctgtgcagcattcttgaagaacatggaaaggatctggaaataatgcaaatcctgacccgggtaaatgacagagtggcacggcatttcgagagccagtcagacgatcctcattttcatgagaaaaagcaaattccatgtgtcgtttccatgctaactaaagaactctacttcagtcaatag

SEQ ID NO: 27804 - DNA, 663 bp, Artificial Sequence
  Description of Artificial Sequence: Synthetic coding sequence
atggctgacgaccaagggtgtattgaagaacaaggagtggaagatagtgcaaacgaggactcggttgacgctaagcccgaccgtagttcgtttgtaccctcattgttttctaagaagaagaaaaacgttaccatgagatcaatcaagactactagggatcgcgtgccgacataccagtacaatatgaattttgagaagctcggcaaatgcatcattattaacaataaaaacttcgataaggtcactgggatgggggtacgaaacggcactgataaggatgctgaagcactgtttaagtgcttcaggtcactcgggttcgacgttatcgtgtacaacgactgctcatttactcaggctggagtacagaggcgcgacctcggacgcctgcaacctcccccacctaggtttaagcaatactcttgtttgtcactgctgtctagttgggattaccggcacgccccaccgaggctagctaatttttgtatcttccgtagagagggatttagacacgtgggtcaggccggactcaaactccttgcctcctctgaccccccaacttcaggctctcagtctgccggaataacgggtgtgagcctacatactcagcctcagatcatgaaagtttctctgagacactgcaatacctttatctgcttcgcatag

SEQ ID NO: 27805 - DNA, 1011 bp, Artificial Sequence
  Description of Artificial Sequence: Synthetic coding sequence
atggattgtgtcggttggcctccaggcaggaaatggcatctggagaaaaataccagctgtggtgggtcctctgggatctgtgcctcttacgtcacgcagatggccgacgaccagggttgcatcgaggagcagggcgttgaagattccgctaacgaggatagtgtcgatgccaaaccagaccgatcatcgtttgtgccttcgcttttttcaaagaaaaagaagaatgtgacgatgcgctcaattaaaaccacccgggacagggtaccaacatatcagtataacatgaattttgagaagctaggaaagtgcatcatcatcaacaataagaatttcgataaagtgaccgggatgggcgtccgtaacggcacagacaaagatgccgaggctttgttcaaatgctttagaagcctgggctttgacgtgatcgtgtataatgattgttcttgtgccaagatgcaggacttactaaaaaaggcctccgaggaggatcacactaacgctgcctgttttgcctgcatcctactcagccatggagaagagaatgttatctatggcaaagacggggtgacccccatcaaggacctcacagcccacttccgcggtgacaggtgtaaaaccttactggagaagccgaagctcttctttatccaggcatgcagaggaacggaactcgatgatgggatccaggctgatagtggcccaattaatgacaccgacgctaaccccaggtacaagatcccagtcgaagccgattttctcttcgcttatagcacggtaccgggttactatagttggaggagcccgggacggggaagttggtttgtacaggcgttgtgttcgatcctcgaggagcacgggaaggatctcgagatcatgcagattctcaccagagtgaatgaccgtgtggcccgtcatttcgagtctcagtcagatgaccctcatttccacgagaaaaaacagatcccttgcgttgtcagcatgctgactaaggaactgtacttctctcagtag

SEQ ID NO: 27806 - DNA, 762 bp, Artificial Sequence
  Description of Artificial Sequence: Synthetic coding sequence
atggccgacgatcaaggctgtattgaagagcagggcgttgaggatagcgccaacgaggactccgtcgacgcgaaacccgaccgctcatcgtttgtgccctccctcttcagtaagaagaagaaaaatgtgacaatgcggagcataaaaaccacccgcgatcgggtcccaacatatcaatataacatgaactttgagaaactgggtaagtgtattatcattaataacaaaaatttcgataaagtcaccggcatgggtgtccgcaacggtaccgataaggatgcagaggcccttttcaagtgctttcgcagtctcggatttgacgtgatcgtttataacgattgctcatgcgcgaagatgcaggacctccttaagaaagcttctgaggaggatcacacgaatgctgcctgcttcgcgtgcatcctgctgtcgcacggcgaggagaatatggagagctgcagtgtcactcaggctggcgttcagaggagagacctcgggaggctccaaccccctcctcctcgcctggctgagggcccttcacttatgatggcttcgcgccctacacgcggacccagcatgactcaaatgttgattctggataccaggagtcaatggaagctcacctccagcagcccaattccgcgttttcaagctataacgcggggtggggcacaggaggaggcaccgggtctctgcaaaccctctgcaccgagttggcggtccacggagaaaacatggaagtcctgtaggagcagtcccggttag

SEQ ID NO: 27807 - DNA, 669 bp, Artificial Sequence
  Description of Artificial Sequence: Synthetic coding sequence
atggccgacgaccaaggctgtatcgaagaacagggagtggaggatagcgctaacgaggattccgttgatgccaagcccgaccggtcatctttcgtaccatctttgttctctaaaaagaagaagaacgtcaccatgagatccattaaaacaactcgcgaccgcgtgcccacctatcaatacaatatgaacttcgagaagctaggaaaatgtatcattattaataataagaattttgacaaggtgacaggaatgggcgtgaggaacggcactgacaaagatgcagaagcgctatttaaatgcttccggtccctcggctttgatgttatcgtgtataatgactgcagctgtgccaagatgcaggatttgctgaagaaagctagtgaggaagaccacaccaacgctgcctgcttcgcctgcatcctgctgtcacatggtgaggaaaacgttatctacggcaaagatggtgttacacctattaaggatcttaccgcacatttcagaggagatcgatgtaagacactccttgagaagccaaagctgttcttcattcaggcttgcaggggcacagaattagatgacggcatccaggctgattctggaccgattaacgacacagacgctaatcccagatataaaatcccagtggaggcggacttcctatttgcttag

SEQ ID NO: 27808 - DNA, 795 bp, Artificial Sequence
  Description of Artificial Sequence: Synthetic coding sequence
atggccgacgatcaaggttgtatcgaggaacagggggtggaggacagcgcaaatgaggattcagtcgacgccaagccagatcggagcagcttcgtgccaagtctctttagcaagaagaaaaaaaacgtcacaatgcgatccatcaagacaactcgggaccgagtgcctacttaccaatacaatatgaactttgagaagctggggaaatgtataattatcaacaataagaacttcgataaggtgacaggcatgggtgtgcggaacggaacagacaaggacgccgaagccttgttcaagtgcttccgatctttggggtttgatgttatcgtctacaacgattgtagctgtgccaaaatgcaagacttgctgaaaaaagcaagtgaagaagaccacaccaacgccgcttgctttgcctgcatcttgttcttcatccaggcttgtcggggaaccgagctggacgacggtattcaggccgacagcggcccaatcaatgataccgatgccaacccccgatataagatccctgtggaggcagattttctgttcgcatattccacagtgccgggttattattcttggagaagtcccggtcgcggatcctggttcgtccaggccctgtgttctatcctggaagaacacggaaaggatctcgagattatgcaaattctgacccgcgtgaacgaccgtgtggccagacatttcgagtcccagtctgatgatcctcatttccatgagaagaaacagatcccatgcgtggtgagtatgcttactaaggagctctatttctcccagtag

SEQ ID NO: 27809 - DNA, 837 bp, Artificial Sequence
  Description of Artificial Sequence: Synthetic coding sequence
atgcagagggggctgtttagcgacggtgatacgagcaagaaaaaaaagaacgtaactatgagatcaatcaagaccacacgcgatagggtgccgacgtatcagtataatatgaacttcgaaaagctggggaaatgcatcatcatcaacaacaagaatttcgacaaggtgactggaatgggagtccggaatggaaccgacaaagacgccgaggccctattcaaatgtttcaggagcctcggcttcgatgttatcgtgtataatgactgcagctgtgcgaaaatgcaggacctcctgaagaaggcctctgaggaggaccacactaatgcagcttgtttcgcttgcatcttgctaagtcacggagaggagaacgtgatttacggcaaggacggcgtcacgcctatcaaagatttgacagcccactttaggggcgacagatgtaagacgcttctcgagaagccgaaactcttttttattcaggcttgtcgcggtactgaactggatgacggtatccaggccgactctgggcctataaacgatacagatgccaaccctcgatataagatcccggtggaagcggattttttatttgcctacagcacggtgccgggttattactcctggagatcccccggtcgcggaagttggttcgtgcaggcgttgtgtagcatccttgaagagcacggaaaggatttagagatcatgcagatacttacacgggtgaatgaccgagtggcaaggcatttcgagagccagtcagacgaccctcactttcacgagaagaagcagatcccctgcgtcgtatcgatgctcacaaaagagctgtactttagccagtag

SEQ ID NO: 27810 - DNA, 1188 bp, Artificial Sequence
  Description of Artificial Sequence: Synthetic coding sequence
atggatttctcccgaaacctgtacgacataggggagcagctggactcagaagatctggcaagcctgaaatttttgagtttagattacatcccgcaaaggaagcaggagcctataaaagatgctctaatgctgtttcagaggctgcaggagaaacggatgcttgaggagtccaacttaagctttttgaaggagctgctctttcggatcaacagattggatctgctgataacctatctgaacacgcgcaaggaggagatggaacgcgaactgcagaccccgggtagggctcagatctccgcatacagggtcatgctgtaccagatttcagaagaagtgagtcgctcagaactccgatcctttaagttccttctccaggaggaaatctctaaatgcaaactggatgacgacatgaatctgcttgacatatttattgagatggaaaaacgcgttattttaggcgaaggcaaattagatattttgaagcgggtgtgtgctcagataaataaatccctgctgaagattatcaacgactacgaagagtttagcaaaggtgcccttacgaccacattcgaagagctccatttcgagatcaagcctcacgatgactgcacggtggagcagatatatgaaatactgaagatataccagcttatggatcactctaatatggactgtttcatttgctgcatcctatctcacggcgacaagggtatcatctacgggaccgatggtcaagaagcacccatttacgaactgacgtctcagttcactggactgaagtgtccctccttggcagggaagcccaaggtctttttcattcaggcctgtcaaggtgacaactaccagaagggaattcccgtggagaccgactccgaagagcagccttacctggaaatggatttgagctccccgcaaactcgctacatccctgatgaagcggatttcctgcttggaatggctaccgtgaataactgcgtgagttataggaacccagccgaggggacctggtacatacagagcttgtgccaatctttgcgcgagagatgccctcgaggtgatgatatcctcacaattttaacagaagttaattatgaggtgtctaataaggacgacaaaaaaaacatgggcaagcaaatgccgcagcctaccttcactctgcggaagaagctggtcttccctagcgattag

SEQ ID NO: 27811 - DNA, 1491 bp, Artificial Sequence
  Description of Artificial Sequence: Synthetic coding sequence
atggatttcagcaggaacctgtatgacatcggagaacagttggacagtgaggatctggcttctctaaaatttctatcccttgactacatcccccagcgaaaacaagagcccatcaaggatgccctcatgctatttcagcgcttacaggagaaacgcatgctggaggaaagcaatctcagctttctgaaagagctcctgttcaggatcaataggctggacttactgattacctatctcaatacacgaaaagaagagatggagagggaactccagacacctggccgtgcccagatctctgcctatcgctttcacttctgtaggatgagctgggcagaagcaaattcccaatgccagactcagtcggtacccttttggaggcgcgtagatcacttactgatccgcgtaatgctgtaccagatttccgaagaagtcagtaggtccgaactacgctctttcaaatttctgttgcaagaggaaattagtaagtgcaagttggacgatgatatgaacctgctggatatctttatcgagatggagaagagggtgatactgggggaaggcaaactggatatccttaaacgtgtgtgcgcacaaatcaacaaaagtctgctgaagattattaatgattatgaagaattttcaaagggcgaagagctgtgtggtgttatgaccatctctgactccccccgagaacaagatagcgaatcccagacgctcgacaaagtataccagatgaagagcaagccgcgtggatattgtctgatcatcaacaaccataactttgctaaggccagggagaaggtccctaagctgcatagcatcagggacagaaatggtacccaccttgatgccggagcattaaccactactttcgaggaactacattttgagatcaaacctcacgacgactgcaccgtggagcagatatacgaaatcctgaaaatctaccagctcatggatcacagcaatatggactgctttatctgttgcattttgtcccatggcgacaagggcatcatctatgggacggatggtcaggaagcccctatctacgagctgacaagtcagtttacaggtctgaaatgcccctctctggctgggaagcctaaggtgtttttcatccaggcatgtcaaggtgacaactaccagaaaggtatcccagtagaaacagatagcgaagaacaaccatacttagagatggatctgagctctccacagacgaggtacattccagacgaggctgactttctgctgggcatggctactgtgaacaattgcgtgagctatagaaacccggctgaaggaacttggtatattcaatcactgtgccagtccctgcgggagaggtgtcctcgtggcgatgatatcctcactatcctgacggaagtaaactacgaggtgagtaataaggacgacaaaaagaatatgggaaaacaaatgcctcaacctacttttactctccgcaagaaactggtcttcccctctgattag

SEQ ID NO: 27812 - DNA, 1395 bp, Artificial Sequence
  Description of Artificial Sequence: Synthetic coding sequence
atggatttcagtagaaacctgtatgatataggggaacaactggattctgaggacctggcctccttaaagttcctcagccttgattacatccctcagcggaaacaggagccaattaaggacgccctcatgctgtttcagcgtctgcaagagaagcgaatgctggaagagagcaacttatctttcctgaaggagctactgtttcgaatcaatcgtctggatcttttaattacttacctaaacacccggaaggaagagatggaacgggagctgcagacccccggacgtgctcagattagcgcatatcgggtgatgctctatcagattagcgaggaagtgtctcggagcgaactccgtagctttaagtttcttcttcaggaggaaatctcaaagtgtaaattggatgacgacatgaatctgctggacatcttcatcgagatggagaagcgggtcatcctcggtgaaggtaaactcgatatcctcaagcgcgtctgcgctcaaataaataaatctctcttaaagataatcaatgactatgaggagttttccaagggggaagaactttgcggagtaatgacaattagcgatagcccaagggagcaggactcggaatcccagacacttgataaagtctatcagatgaaaagcaagcctcggggatattgccttataattaataatcataatttcgcaaaggctcgcgagaaagtgcctaagcttcatagtattcgggatcgcaacggaactcacctggatgccggtgctttgactaccaccttcgaagagcttcactttgagattaagccccacgacgattgtacagtagagcaaatttacgaaatactcaagatctaccagctgatggaccactccaatatggattgttttatttgttgcattctgtcacatggggacaagggaataatctatggcacagacggacaagaggcgccaatctacgagctgacctctcagtttactggtctgaagtgcccgtctctcgctggaaagccaaaggtgtttttcatccaggcctgccagggagacaactaccaaaaagggatcccagtggaaaccgactccgaagaacagccctacctggaaatggatctgtcaagcccacaaacccggtatattcctgacgaggccgatttcctccttggaatggctacagttaacaactgcgtgtcttaccggaatcccgctgaaggaacttggtatattcagagtctgtgccagtccttacgtgaaaggtgtccacggggagatgacatcctgacaattctaaccgaagtgaactacgaggtgtcgaacaaagacgataaaaaaaatatgggcaagcagatgcctcagcctactttcacactgcggaaaaagctggtctttccttctgactag

SEQ ID NO: 27813 - DNA, 1617 bp, Artificial Sequence
  Description of Artificial Sequence: Synthetic coding sequence
atggagggtggcagacgagccagagtagtcatcgagtcgaagcgaaacttcttcctgggcgcttttcccactccatttcctgctgagcacgtcgagctggggaggttaggggattctgaaaccgccatggtgcccggtaaaggcggagctgattatatcctcctccccttcaaaaaaatggacttcagccggaatctttatgatatcggggaacaactagattcagaggatctcgcaagtctgaaatttctgagtttagactacatccctcagagaaagcaggagcccataaaggatgccctaatgctctttcagcggcttcaagagaagcggatgcttgaagaaagtaacctgtctttcctgaaggagctcctttttcgcatcaataggctggaccttctgatcacataccttaatacccgcaaggaggagatggagagagagctgcagacgcctggacgcgcacagatcagtgcctacagggtgatgttatatcagatttcagaggaggtcagtcggtccgaattgagatccttcaaatttctgctgcaggaagaaatatccaagtgcaaactggatgatgatatgaacctgctggatatctttatcgaaatggaaaaaagagtaattctgggtgagggcaaactcgatatcctgaagagggtgtgcgctcagatcaacaagtctcttcttaagattatcaacgactatgaagagttcagtaaggaaaggagcagctcgctcgaaggcagtcctgacgaattcagcaatggcgaggaactgtgcggggtaatgaccataagtgattcacctagagagcaggactcagagtcccagactctggataaagtgtaccaaatgaagagtaaaccgcgaggctactgtctgattatcaacaaccacaatttcgccaaagcccgtgaaaaggtaccgaagctacacagtattcgagatagaaatggtacccatttagatgccggtgctctgaccaccactttcgaagaactgcattttgagattaaaccccatgacgattgcactgtggagcagatttacgagattctgaagatctaccagctaatggaccactcaaacatggactgcttcatctgctgtattttgtcccatggggacaaaggcattatttacggtaccgatggacaggaggcaccaatctacgagctgacctcacagttcacagggcttaagtgtcccagtctggcgggaaagccaaaagttttctttattcaggcgtgccagggagataattatcagaagggcatcccagtcgagaccgacagtgaagaacaaccttacctcgagatggacctcagcagcccccagactaggtatattccagacgaggctgattttctactgggcatggccacagtgaacaactgtgtgtcttataggaaccctgcagaggggacttggtacattcaatcgctgtgccagtccctgagagagcgatgcccacgaggcgacgatatcctcaccatcctgactgaagtcaattacgaggtgagcaataaggatgataagaagaatatgggtaagcagatgcctcagcctacctttactcttcggaagaaactggtgttcccctcagattag

SEQ ID NO: 27814 - DNA, 708 bp, Artificial Sequence
  Description of Artificial Sequence: Synthetic coding sequence
atggacttcagccgaaacctttacgatataggcgagcagcttgacagtgaagatctggctagtctgaagttccttagcctggactatattccccagaggaagcaagagccaataaaagatgctcttatgctctttcagcgcttgcaggaaaagaggatgcttgaggaatccaatctctcgtttcttaaagaactgctgtttcgcataaacagattagacctcctgattacctaccttaacaccagaaaggaagaaatggaaagagaactgcagacccccggaagagcccagatcagcgcttacagagtcatgctgtatcagattagcgaagaagtgagcaggagcgaattgagatccttcaaattcctcctgcaggaggagatttcaaagtgcaaattggacgacgacatgaaccttctggatattttcattgaaatggagaaacgtgtgatccttggcgagggcaagttggacatactaaagcgggtgtgcgcacaaattaacaagtctctcctgaaaattattaacgactatgaggagtttagtaaagagcggtcctccagcctggaaggatcacctgatgaattcagtaacgattttggtcagagcctgccgaatgagaagcagacctctggcatcctctcggatcaccaacagtcacaattttgtaagtccacgggcgagtcagcgcaaacgtcccagcattag

SEQ ID NO: 27815 - DNA, 708 bp, Artificial Sequence
  Description of Artificial Sequence: Synthetic coding sequence
atggatttctctagaaacctttatgacatcggggaacagcttgactccgaagatctcgcatcgctcaagttcctcagtctggactatatcccacagcgcaaacaggagcccattaaagacgctcttatgttattccagcggctgcaggaaaagcgcatgctggaggagtctaacctcagtttcctaaaggaactgttgtttcggattaacagattggatctcctaataacatacctcaataccagaaaggaggaaatggagagagagctccaaacccccggtagggcacagatctctgcctaccgtgtgatgttgtatcagataagcgaagaagtttccagaagcgaattgcgttcttttaaattcctgctacaggaggagattagcaagtgtaagttggacgatgatatgaatcttcttgatattttcattgagatggagaagcgagttatcctcggcgagggtaaactggatatcttaaagcgagtatgcgctcagatcaataaatcccttctgaaaatcatcaatgattacgaggagtttagtaaggaacgatcttcatcccttgagggcagcccagatgaatttagcaacgattttgggcagagcctccctaatgaaaaacagacaagtgggattttgtctgatcatcaacagagccagttctgcaagtccaccggtgaatcggctcagactagccagcattag

SEQ ID NO: 27816 - DNA, 837 bp, Artificial Sequence
  Description of Artificial Sequence: Synthetic coding sequence
atggatttttcccgaaacctctatgatattggtgaacagctagactccgaagatctggctagcctgaaattcctaagtctcgactacatccctcagagaaagcaagagcctattaaggacgccctaatgctctttcagagactgcaggaaaaaaggatgctcgaggagagcaacctcagcttcctgaaggagctcctttttcggatcaatcgcctggatctgttgatcacctacctgaacacaagaaaagaagaaatggagagggagctgcaaactcccggacgcgctcagatcagtgcctatagagtcatgctctaccagataagcgaggaggtctctagatccgagctgcggagcttcaagttccttttacaggaggagatatctaaatgcaagctggacgacgatatgaatctgttggatatctttatcgagatggagaaacgtgtgattttgggtgagggaaagctagacattctgaagcgcgtttgtgcccagatcaacaagagcttactgaaaatcattaacgattatgaggagtttagtaaaggcgaagagttgtgcggagttatgacaatctctgactcacccagggagcaggactcagagtcccagactctcgacaaagtgtaccagatgaaatcaaagcccagaggatattgtctgattatcaacaaccacaactttgccaaggccagagagaaagtgcctaaactgcactccatacgggacaggaacgggactcacctcgatgccggaagccactccgtggcccaggcgggtgtacagtggtgtgacctgagcagtcttcagcctccaccaccttggtttaagtag

SEQ ID NO: 27817 - DNA, 1395 bp, Artificial Sequence
  Description of Artificial Sequence: Synthetic coding sequence
atggacttcagtagaaatctctacgatattggagagcagcttgacagcgaggatctcgcctctttaaagttcctctctctggactatatcccccagagaaaacaggagcccataaaagacgccctaatgctattccagcggcttcaggagaagaggatgcttgaggaatctaatctgtcgttcctgaaagaacttctctttcgcatcaaccgactggacttgctgattacttatttgaatactcggaaggaagagatggaacgagaactgcagacacctggccgtgcccaaatatcagcatatagggtgatgctttaccagatatccgaggaggtttctcgcagtgagctaagatcctttaaatttttgttgcaggaggagattagcaaatgcaagttggacgacgatatgaacctgttagatatttttatcgagatggaaaagcgagtcatcctgggagagggcaagctcgacatcctgaaacgggtctgcgcacagatcaacaaatctctcctgaagatcatcaacgactatgaagagttttcaaaaggtgaggaattgtgcggtgttatgacaatctccgacagccctagggaacaagattccgagagccaaacattggacaaagtgtatcagatgaaaagcaagcctagaggttattgcctgattatcaacaatcataacttcgcaaaggcacgcgagaaggtgccaaagctacacagcattcgcgaccgcaacgggactcatctggacgcgggagctttgacgaccacttttgaggaattgcacttcgaaatcaagccacacgatgactgtaccgtggaacagatttatgaaattttaaaaatttaccagctgatggaccattccaatatggattgttttatctgttgcattttgtcacatggggataagggtattatctatggaacagatgggcaggaggcacctatatatgaactcacatctcagtttactggtctcaagtgtccatcgcttgccggaaagccaaaggtcttcttcatccaggcttgtcagggggacaactatcagaagggtattcctgtggaaacggactcagaggagcaaccgtacctcgagatggatctctcctctccccagaccagatacatccctgacgaggcggattttctgctgggcatggccacggtgaacaactgcgtatcttataggaacccagccgagggaacctggtatatccagtctctgtgtcaatccctcagagaaaggtgtccgagaggggatgatattctgaccattctcactgaggtaaactatgaagtgtccaacaaggacgataagaagaatatgggcaagcagatgccacagccaactttcactctgcgcaaaaaactggtgttccctagcgactag

SEQ ID NO: 27818 - DNA, 663 bp, Artificial Sequence
  Description of Artificial Sequence: Synthetic coding sequence
atggacttctcccggaatctctatgacattggagagcagcttgacagcgaggatctggctagtttgaaatttctgagcctggactacatcccgcaacgcaagcaggaaccaatcaaagacgcccttatgctgttccagcgcttgcaggagaagaggatgctggaggagtccaacctgagtttcctgaaagaactgcttttcaggatcaatcggctggacctgctgatcacctacctgaacacacgcaaggaggagatggaacgagagctccagacccccggacgcgcacagatatcggcatatagggtgatgctatatcagatttccgaggaggtgagccgctccgagctccgcagttttaaattcctactacaggaagagatcagtaagtgtaagttggatgatgatatgaacctgctggacatctttattgagatggaaaagcgcgtgatactgggagaggggaagctggatattctcaagcgcgtctgtgcacagatcaacaagtctctgctgaaaatcattaatgattatgaggaattctctaaggacttcggccaaagtctacctaatgaaaaacagacctctggcatactgtcagatcatcagcagtctcagttttgcaagtccaccggcgaaagtgcacagacctcacagcactag

SEQ ID NO: 27819 - DNA, 597 bp, Artificial Sequence
  Description of Artificial Sequence: Synthetic coding sequence
atggacttcagcagaaacctgtatgacatcggcgaacaactggacagcgaggacctggcctctctgaaatttctgtctctggactatattccccaaagaaagcaagagcccatcaaagacgccctgatgctctttcagaggctgcaggaaaaacgaatgttggaggaatccaacctgagcttcctaaaggagttgctgtttcggatcaaccgcttagatctcttgattacgtacttgaacactaggaaagaagaaatggaaagagagctgcaaacccctggtagggcacagatatcggcttatagggtgatgctttaccagataagcgaagaagtctccagatcagagctccgctcctttaagttcctgctccaagaggaaatatcaaaatgtaaactggacgacgatatgaacctcctagacattttcattgaaatggaaaaacgcgtgatcttgggggagggaaaactagatattttaaaaagagtctgtgcccaaattaacaaatctctcctcaagatcatcaacgattatgaagagtttagcaaagaaagaagctcttctttggagggcagcccggacgagttctctaactag

SEQ ID NO: 27820 - DNA, 351 bp, Artificial Sequence
  Description of Artificial Sequence: Synthetic coding sequence
atggacttttcacgcaatctttacgatatcggggagcagttagacagcgaggacctcgccagtctcaaattcctaagcctggattacattccacagaggaagcaggaacccatcaaggatgcactcatgctgttccagaggctgcaggagaagaggatgcttgaagagtcaaatttgtcctttcttaaagagctgctattcagaatcaatagactggacctgctgatcacctatctcaataccagaaaagaggaaatggagagagagctgcagactcccggtcgggcacagatttccgcctatcgagttatgctatatcagattagtgaagaagtgagccgatctgagtag

SEQ ID NO: 27821 - DNA, 1440 bp, Artificial Sequence
  Description of Artificial Sequence: Synthetic coding sequence
atggatttctccaggaatctgtacgacattggtgaacagctcgacagcgaagacctcgcttctcttaaatttctgtcattggattatatccctcaacggaaacaggaacccataaaggatgccctcatgctgtttcagcgtttacaggaaaaacggatgcttgaggagagtaatctgtcttttctcaaagaactgctgtttagaattaatagacttgaccttttgatcacttacttgaacacacggaaggaagagatggagagggagctgcagacacctggacgcgcacaaatctctgcctaccgcgtgatgctttaccagatttctgaggaggtttctcgatccgagctgcggagtttcaagttcctcttgcaggaagaaatatccaagtgcaagctggatgacgacatgaacctgctcgacattttcattgaaatggaaaaacgggtgattttaggggagggtaaactcgatatcctgaagcgggtgtgtgcgcagatcaacaagagcctccttaagattattaacgactacgaagaattcagcaaggagagatccagctcattagaggggagcccggacgagttttctaatggtgaggagctgtgtggggttatgactatcagcgacagtccaagggagcaagattctgagtctcagaccctggataaggtttaccagatgaagtctaagcctaggggctattgtctcataatcaataaccacaactttgcaaaagccagagaaaaagtgcccaaactccactcaatcagggaccgcaacgggacgcatctggacgctggcgctttaaccactacctttgaggaactccattttgaaatcaagccccacgacgactgtaccgtggaacaaatctatgaaatccttaagatttatcagcttatggaccacagcaacatggattgcttcatatgctgcattctcagtcacggtgataaggggattatctatgggacagacggacaagaggcccctatttatgaacttactagccaattcaccgggcttaagtgcccgagcctagctggcaagccgaaggtgttctttattcaagcttgccaaggggacaactaccagaagggtatccctgtggaaaccgacagcgaggaacagccgtatttggagatggacttatcctcaccccaaacgaggtacattcctgacgaagctgattttctgctcgggatggccacagtcaataattgcgtctcttacaggaatcctgccgaaggaacttggtacattcagagcttgtgtcagtccctgcgcgagagatgcccaagaggagacgatatactgactatcctgaccgaggtgaattacgaggttagcaataaagacgacaagaaaaatatgggcaagcagatgcctcaaccgacctttactctgcgaaaaaaactggtttttccctctgattag

SEQ ID NO: 27822 - DNA, 375 bp, Artificial Sequence
  Description of Artificial Sequence: Synthetic coding sequence
atggacttcagtagaaatttgtatgacataggagagcagttagattctgaggatctggccagcctgaagttcctatccctcgattatattccccagcgtaaacaggaacccatcaaggatgccctgatgttgtttcaaagactccaagagaagcggatgctagaggagagtaaccttagctttttaaaggagctgctgttccgaatcaaccgcttggacctgctcatcacctacctgaatacaagaaaggaggaaatggagagagaattacagacacctggcagagcacagattagcgcctatagagtcatgctgtatcagatcagcgaagaagtcagtcggtccgagctgagatcatttaaattcctactgtag

SEQ ID NO: 27823 - DNA, 630 bp, Artificial Sequence
  Description of Artificial Sequence: Synthetic coding sequence
atggactttagtcggaacctctacgacatcggagaacagctcgattcggaagacctcgcatccctaaaattcctgtccctggactatatacctcaaagaaagcaggaacctataaaggacgcactcatgctatttcaaaggcttcaagaaaagcgcatgttagaggaatcaaatctgtcttttcttaaggaactgctgttccggattaacagactggatttgcttatcacatacctaaatactcgaaaagaggaaatggagcgggaactccagaccccgggacgagcccagatctctgcctaccgagtgatgctgtaccagatctcggaagaagtgagtcgttccgagctccgttctttcaaattcctgctgcaggaagagatctccaaatgtaagctcgacgatgatatgaatctcctggatatctttatcgaaatggagaagagagtcattctgggcgagggcaagctagatatcctgaagcgggtttgtgctcagattaacaagagcctgctgaagatcatcaatgattacgaggaattttccaaggacttcgggcagtcacttccaaatgaaaagcagacgtcaggcattctgagcgaccaccagcaatctcagttctgcaagtag

SEQ ID NO: 27824 - DNA, 1251 bp, Artificial Sequence
  Description of Artificial Sequence: Synthetic coding sequence
atggatgaggctgataggagacttcttcgcagatgcagactgaggctcgtggaggagctccaggtcgatcaactctgggatgccctcctgtcccgggaacttttccggcctcatatgattgaggatatccaaagagcagggtccggttctaggcgcgaccaagcgaggcaactcatcatagatcttgaaaccagagggtctcaagcgctgcccttgtttatctcatgcctggaagatactggacaggacatgttggcgtctttcctgcgaacaaaccgtcaggcagccaagctgtcaaagccgacccttgaaaacctcaccccggtggtactgcgacctgagatcagaaaaccagaggtgctgagacccgagacccccagacccgtcgatatcggttctggaggcttcggggatgtgggcgcactcgagtcactgagagggaacgccgatcttgcttatatcctcagtatggagccgtgtggtcactgcttaattatcaataatgttaatttctgtagagaaagcggactccgtaccagaactggctccaatattgattgtgagaagctgcgtcgtcgtttttcgagccttcacttcatggtggaggtcaaaggtgacctaaccgcaaagaaaatggtgctagccctcttagagttggcccaacaagatcacggagcccttgattgctgcgtcgtcgtgatcttgtcccatgggtgccaggcgagccacctgcagttccccggagccgtatatggcacagacggatgccccgtttccgtggagaaaattgtgaacatcttcaatggcaccagctgtccctcccttggtggaaaacctaagctgttctttattcaggcgtgcggaggggaacagaaagaccacggatttgaggtcgcttctacaagtccagaagatgagtctcccggatctaacccagagcccgacgccacgccctttcaggaaggcttgcgcacctttgaccagctggatgctatatcttccctccctacacctagcgatatcttcgtctcctattctacattcccgggatttgtgagctggagagatccaaagtcagggtcatggtatgtggaaaccctggacgacattttcgaacaatgggcacacagtgaagacctgcagtcgctgctgctccgggtagccaatgccgtcagcgtgaaaggtatctacaagcaaatgcctgggtgttttaattttctccggaagaaactattttttaaaacatcttag

SEQ ID NO: 27825 - DNA, 801 bp, Artificial Sequence
  Description of Artificial Sequence: Synthetic coding sequence
atggatgaagctgatcgaagactcttgcgcaggtgtcggctccgactcgtggaagagctgcaagtggaccaattgtgggacgcactgctgtcccgggagctttttcggccacacatgatcgaagacatccaacgcgctggttcaggatcccgacgcgaccaggccagacagttaataatcgatctcgagactcgtggctctcaagccctaccactgttcatctcttgtcttgaggatactggccaggacatgctggcatccttcctgagaacaaaccgccaagctgccaaacttagcaagccaactcttgaaaacctcacccccgtggtgctgaggccggagatccgaaagccagaggtgctaaggcctgaaacaccccgacccgtggacatcgggtctggagggtttggggacgttgaacagaaagatcatgggtttgaggtagcatcaacttcaccggaggatgaatccccaggctccaatcccgaacctgacgcaacgcctttccaggagggactgcggactttcgaccaattagatgcaatatcgagtcttcccacaccctccgatatatttgtttcctattccacattccctggattcgtgtcttggcgcgacccaaagagcggctcttggtatgttgaaaccctcgacgatatctttgaacagtgggcgcattccgaagaccttcaatccctgctcctaagagtggctaatgccgtctcagttaaggggatctataaacaaatgccagggtgcttcaactttctgagaaagaagctatttttcaagactagctag

SEQ ID NO: 27826 - DNA, 603 bp, Artificial Sequence
  Description of Artificial Sequence: Synthetic coding sequence
atggagccttgcggccattgtctgatcatcaacaacgtgaatttctgtcgggaaagcggactccgcaccaggactggctccaacatcgattgtgagaagctgaggaggaggttcagttcactgcattttatggtcgaagtaaagggcgaccttaccgccaaaaaaatggtccttgctcttttggaactggctcagcaggatcacggcgctctggattgttgcgtggtggtcatcctgtcgcacgggtgtcaggcaagccaccttcagtttccaggggctgtgtacggaaccgacggttgtcctgtctcagttgagaagattgtgaacatcttcaatggtacttcatgcccctcactgggtggcaaaccaaaactgttcttcatccaggcctgtgggggtgggtttgtgagctggcgagacccaaagtccggctcttggtacgtggagactcttgatgatattttcgagcagtgggctcattcggaggacctccagagcctgctgttgcgggtagctaatgctgtaagcgtcaaaggcatttataagcagatgccagggtgctttaatttccttaggaaaaagcttttcttcaagacttcttag

SEQ ID NO: 27827 - DNA, 1002 bp, Artificial Sequence
  Description of Artificial Sequence: Synthetic coding sequence
atgcttgcctcattcctacgcactaaccggcaggctgccaagctcagtaaacctaccctcgaaaacttaacacccgtcgtcctccgcccagaaatcagaaagcctgaagttctgagacccgagactcctcggcctgtggacatcgggtccggaggattcggagacgttggcgctctagagtccttgagggggaacgcggacctagcatacatactgagcatggaaccttgcgggcactgtctgatcattaataacgtcaacttttgccgggagtctgggttgagaacaagaacagggagcaacattgactgtgaaaagctgagaagacggttctcaagccttcacttcatggtcgaggtgaagggcgacctcacagctaaaaagatggttctggctctactggaattggctcagcaagatcacggagcactggactgctgtgtagtcgtgatcctgagccatggttgccaagccagtcacttgcagtttccgggtgccgtgtacgggactgacggctgccccgtttcagtggagaagatcgtcaatatttttaatgggaccagctgtcctagccttggagggaaaccaaagctgttcttcatccaggcatgtggcggagaacagaaagatcatggattcgaggtagcctcaacctcccctgaagatgaaagtccagggtcaaaccctgagccggatgccaccccttttcaggagggtctgcggacgtttgaccagctcgatgccatttcttcactaccgacaccctccgacatattcgtctcttactcaacgtttccaggctttgtgtcttggcgcgaccctaagtcagggagctggtatgtggagactttagacgatatttttgaacagtgggctcattcggaggacctccagtccctattactacgtgtagcaaacgccgtgagcgttaaggggatttataaacagatgcctggatgcttcaatttcttaaggaagaagcttttctttaaaacgtcctag

SEQ ID NO: 27828 - DNA, 765 bp, Artificial Sequence
  Description of Artificial Sequence: Synthetic coding sequence
atggacgaagcagatcgcaggttactgagaagatgtcggttgaggctggttgaggaactgcaggtcgaccaactgtgggatgcactcctctcccgggagctgtttcgtccgcatatgattgaagacattcagcgcgctgggagcggtagcaggcgggaccaggcaaggcagctgatcatagacctggaaactcggggttctcaggctcttcccctttttatcagttgcctggaagacaccggccaggatatgctggcttcctttcttcgcaccaatcgacaggccgctaaacttagtaagccaaccttggaaaatttgactccggtggtactaagacccgagattaggaaacccgaagtgctgaggcccgagactcctcggccagtggacatcgggagcggcggttttggagacgtgggggctctcgagagcctgcgtggcaacgctgaccttgcatatatactctcaatggagccatgtgggcactgtctgatcatcaacaatgtgaatttttgcagagaatcaggactcagaacaaggacaggaagcaatatcgattgtgagaagcttaggcgcagattttcatcgctgcatttcatggtggaggtgaagggcgacctgaccgcaaaggccagccatctgcagtttcccggtgcggtatatggcacggacgggtgtccagtgtccgtagagaaaatcgtgaatatctttaatggcactagttgtccttccctgggcggaaaaccaaaattattcttcatttag

SEQ ID NO: 27829 - DNA, 801 bp, Artificial Sequence
  Description of Artificial Sequence: Synthetic coding sequence
atgctcgctagcttcctgcggacaaacagacaggccgctaaactttctaaaccaacactggagaacctgacacccgtggttctgaggcccgaaattcgcaaaccagaggtattgcggccagagactccaaggcccgtggacataggaagcggtggatttggcgatgttggagctttggagtctcttcgtggcaatgcagacctcgcttatatcctcagtatggagccttgcggtcactgcctaatcatcaacaacgttaatttctgccgggagtctggattacgcactcgcactggtagtaatatcgattgcgagaaactcaggaggaggttctcatcactgcactttatggtagaggtgaaaggcgacctgacggctaagaaaatggtcttggccttgcttgaactggcgcagcaggatcacggggcactcgactgttgcgtggtcgtcattctgagtcacggctgccaggcgagtcatctgcaattcccgggagccgtttatggcactgatggttgcccagtcagtgtggaaaaaatagtgaacattttcaatggaacttcctgtccaagcctgggcggaaagcccaagttgttcttcattcaggcatgtggaggggagcagaaagatcatggattcgaggttgcctcaacatccccagaagatgagtctcccggatcgaaccccgaacccgacgcaactccatttcaggagggtcttagaacgttcgatcaacttgatgctattagcagcctgcccacccctagtgatattttcgtgagctattcaacctttccttag

SEQ ID NO: 27830 - DNA, 1266 bp, Artificial Sequence
  Description of Artificial Sequence: Synthetic coding sequence
atggatgaagcagaccgaagactgcttcgcagatgtcgtttacgtctagtggaggaactgcaggtggaccagctgtgggacgctctactatctcgcgagctgtttaggccacacatgatagaggatatccagagagctgggtctggcagtaggcgagaccaggcgaggcagctcatcatcgacctcgagactcgtggatcacaggccctgccactgttcatctcttgtctggaggatactggacaggacatgctggcctcatttttaaggaccaaccggcaggccgcaaagctcagcaaaccgactctcgaaaatctgacccccgtcgtgctgcgacctgagatccgaaaaccggaggtactaaggcccgagactccccgtcccgttgatatcggatccgggggattcggcgacgttggggctctggaatctctcagaggaaacgccgatctcgcctatatacttagcatggaaccgtgcggccattgtctgattattaataacgttaatttttgccgtgaaagcgggctgcgcacccggaccgggtcgaacatcgattgcgagaaacttaggagaagattctcgtctctgcatttcatggttgaggtgaagggggatctgactgctaaaaagatggtgctggccctgctagagctggcccagcaagaccacggcgcactggattgctgtgtggtggtaatcctgtcacacggatgtcaggcctcccatctgcagtttccaggtgccgtctatggcactgatggttgtccagttagcgttgagaaaatcgtaaacatttttaacggaaccagctgtcccagcctcggcggtaaaccaaagttatttttcatacaggcatgcgggggtgaacagaaggaccatggcttcgaagttgcctctaccagcccggaagacgagagtccgggatctaaccctgaacctgatgctactccatttcaagaaggtctgaggaccttcgaccaacttgatgccatctctagtctcccaacaccttccgacatatttgtttcttatagcacattcccgggttttgtgagctggcgggatcccaagagtggatcctggtatgtggaaaccctggacgatatctttgagcagtgggcgcattctgaggatctccagtcactgttgctgagagtgtctgccgcatttctgtgtaagggtgaaggacggcttcttagaggaagcgtgagctcatggggatggggcttcggtgtgtcccgcgctggacccaaccaggggtag

SEQ ID NO: 27831 - DNA, 2721 bp, Artificial Sequence
  Description of Artificial Sequence: Synthetic coding sequence
atgaccgccgtacatgctggaaatattaactttaagtgggaccctaaatcgcttgaaatcaggaccctggctgtggagagattactggagccactggttactcaggttaccacgctggtcaacacgaactcgaaggggccaagcaataagaaacgaggtcgaagcaaaaaagcccatgtcctggctgcctctgtcgaacaggccaccgaaaatttcttagagaaaggtgacaaaatcgccaaggagtcccagttcctgaaggaagaacttgtggccgcagtggaggatgtgcgcaagcaaggagacctgatgaaggccgctgccggagagttcgctgacgacccttgttcatcggtgaagcggggtaacatggtgagagcagccagggccttactttcagctgttactcgcctgctgattctggctgacatggctgacgtttacaaactcctggtgcagctgaaggtggttgaagatggcatcctgaagttaagaaatgctggaaatgagcaagatctaggcatccagtacaaggctttgaaaccagaggtagacaaattgaacatcatggctgccaaacgccagcaggagctcaaggatgtgggccaccgtgaccaaatggccgctgcacgcggtatccttcagaaaaatgtccctattttgtatactgcctcccaggcttgcttgcagcaccccgatgtggccgcttataaagcaaaccgggacttgatctataagcagctgcagcaggcggtaactgggatctctaacgcagctcaggcaaccgcatccgatgatgctagtcagcatcaaggcggagggggaggagagttggcatacgccctgaataactttgacaaacagatcatcgttgatcccctgagtttttccgaggagcgattccgaccttccttggaagaaaggttggaatccatcatctccggggcagctttgatggcagactcgtcctgcactcgggatgatcgacgggagagaattgtcgcggaatgcaacgccgtgcgtcaagccttgcaggatctgctctctgagtacatggggaacgcgggtcgtaaggaacgatctgatgccttaaattccgcaatcgacaaaatgacgaagaagacgcgggatctcagacgccagctgcggaaagccgttatggatcatgttagcgactcgttccttgagactaacgtccctctgttagttttgatcgaggccgctaagaacgggaacgagaaggaggtgaaagagtacgcacaggtgtttcgcgagcatgcgaataaactgatcgaagtcgcaaatctcgcatgttctatttctaataacgaggaaggcgttaaattggttagaatgtcagcgtctcaactggaggcgttatgtccccaagtgattaacgcggcattagcactggcggcaaaaccacagagcaaattagctcaggagaatatggacctgttcaaagaacagtgggagaagcaagtgcgcgtgctgacagacgcagtggatgatattacatccattgatgatttcctagctgttagcgaaaaccacatcctagaggatgtgaataaatgcgtgattgctctgcaggagaaggacgtcgatggattggatagaacggccggagctataagaggacgggctgctagagtgattcacgtggtcaccagtgagatggacaactatgaacccggagtctatacagagaaagtacttgaggcaactaaattgctgtcaaatactgtcatgccacgtttcaccgaacaggtggaagctgcagtagaggctttgtctagcgacccggcacagcccatggacgagaacgagtttattgatgcatcccgcttggtgtatgacgggatccgggatatcagaaaggctgtgcttatgatacgtactccagaagagcttgacgattctgatttcgagactgaggattttgacgtgcgctcacggacgagcgtgcagaccgaagacgatcagctgatcgccggtcagagcgcccgtgccattatggctcaattgcctcaggagcagaaggcaaagatcgccgaacaggtcgcttctttccaggaggagaaatctaaactggacgcggaagtctcaaagtgggacgatagtggcaatgatattattgttctggccaaacaaatgtgtatgatcatgatggagatgaccgactttactcgtggaaaagggcctctcaagaacacttctgacgtgatatcagccgctaagaaaatcgctgaggctggaagccggatggataaactggggcgaaccatcgccgatcattgtcccgacagcgcgtgtaaacaggacttgctcgcatatctgcagaggatagctctgtactgccaccagctgaatatctgtagcaaggttaaggcggaggtacagaacctcggcggtgaactggtggtttccggagtggactccgccatgagccttatacaggcagctaaaaatctgatgaacgcggtcgtgcagaccgtgaaagctagctatgtggccagcaccaagtatcagaagtcgcagggcatggcctcacttaacctgcccgcagttagctggaagatgaaggctcccgagaagaaaccactggtgaaaagggaaaagcaggacgaaacccagacgaagatcaagagggcctctcagaagaagcacgtgaatcctgtgcaggctctgtcggagtttaaggcaatggactctatatag

SEQ ID NO: 27832 - DNA, 2412 bp, Artificial Sequence
  Description of Artificial Sequence: Synthetic coding sequence
atgaaggctgcagctggagagtttgctgacgatccctgtagcagtgtgaagcggggaaacatggttagagctgctcgagccctcctctccgcagttactcggctcctgatcttggctgacatggccgatgtgtacaagctgctggtgcagctgaaggtcgtggaagacggaatacttaagcttcgtaatgctgggaacgagcaggatctggggatccaatacaaggcgctgaaacctgaggtggacaaactgaatatcatggccgcaaagcggcagcaggaactgaaggacgtcggacatcgagaccaaatggccgcagccaggggaattctccagaagaatgttcctatcctgtataccgcttcacaggcctgtctgcaacacccagacgttgccgcttacaaggctaaccgtgatttgatatacaaacagttacagcaggcagtgaccggtatatcaaacgcagcccaggccacggcgtcagatgatgctagtcaacatcaggggggtggcggaggcgagctggcctacgctctgaataacttcgacaagcaaatcattgttgatcccctttctttctccgaggaacgcttccgcccatcccttgaagagcggttagagtctatcattagtggggcagccttaatggccgacagcagctgcactcgggatgacaggcgcgaacgaatcgtcgcagaatgcaatgcagtcaggcaggccctacaggatttactgagcgaatacatgggcaacgccggacggaaggagcggagtgatgctctgaattctgcaatcgataagatgaccaagaaaactagagacctgcgtcggcagcttcgcaaggccgtcatggatcatgttagtgactcatttcttgagactaatgtacctttattagttcttattgaagccgctaaaaacggcaacgagaaggaagtgaaggaatacgcacaggtttttagggagcacgctaataaactcatcgaggtggcgaatctggcctgctctatatccaataatgaagaaggtgtgaagcttgtgaggatgtcagcaagtcagctggaggccttatgtcctcaggtgattaacgcggcactggcactggcagctaagccccagtctaaattggcccaggaaaacatggacctctttaaagagcagtgggagaaacaagtgcgtgtgttgacagacgccgtggacgacattacatccatcgacgacttcctggcagtttcagagaaccacatccttgaagacgtaaacaagtgcgttatcgccctccaggaaaaggacgtggatggtctggacaggaccgccggtgcaatcaggggcagagcagccagagtcatccacgtcgtgacctcggagatggataactacgagccaggcgtatacaccgagaaagttcttgaagctactaagctgttatctaatacggtgatgcctcgatttacggagcaggtcgaggccgctgtggaggctctctccagtgaccctgcccagcctatggatgagaacgaatttattgatgcttcacgtctggtttatgatggaatcagagacatccggaaggccgtattgatgatcagaactccagaagagttagatgacagcgatttcgagacagaagatttcgacgtgcgttccaggacgagcgtccagactgaagacgatcaactcattgccggacagtccgcacgggcaatcatggcccagctcccacaagagcaaaaggccaagattgctgagcaggtggcgtcatttcaggaagagaaaagtaagcttgatgcagaagtctccaagtgggacgattctggcaatgacatcattgtgctggccaagcagatgtgtatgattatgatggaaatgaccgactttaccaggggcaaaggcccactgaagaacacaagtgatgtaatatctgccgcaaagaaaatcgcagaggctggctctcgaatggacaagttaggtcgtaccatagcggatcactgtccagatagcgcatgcaagcaggaccttctagcctacctgcagagaattgcactgtattgccatcagctgaatatctgttccaaggtgaaagcagaggtccagaatctgggtggtgagctggtggtctctggagtcgacagcgccatgtcgctcatccaggccgctaaaaacctgatgaacgcggtcgtgcagaccgtgaaagcgagctatgttgcatccaccaaatatcaaaagagccagggaatggccagcctaaacttaccggcagtttcatggaaaatgaaggcaccagagaagaagcctctggtcaaaagagaaaagcaagatgaaacacagactaagatcaagcgggcatcacagaagaaacacgttaacccagttcaagccctcagcgagtttaaagcaatggacagtatctag

SEQ ID NO: 27833 - DNA, 357 bp, Artificial Sequence
  Description of Artificial Sequence: Synthetic coding sequence
atgaccgctgtccacgctggaaacatcaacttcaagtgggaccctaagagtcttgagatacggactttagccgttgagcggctgctagagccactggtaacccaggttacaactctagtgaataccaattccaagggtccatccaataagaaacgtgggaggagcaaaaaggcacacgtcctagccgctagcgtggaacaggccactgagaactttctagagaaaggggataagatcgccaaggagagccagttcttgaaagaagagttagtggcagccgtagaggacgtgaggaagcagggcgacctgatgaaggccgctgccggtgagttcgcagacgacccttgcagctcttag

SEQ ID NO: 27834 - DNA, 420 bp, Artificial Sequence
  Description of Artificial Sequence: Synthetic coding sequence
atgaccgccgttcacgccggtaacattaacttcaagtgggacccaaaatccctcgaaatccgtacccttgccgtggaacggctgcttgaaccactggtcacccaggtgactacactcgtgaacacaaactctaagggcccatcgaacaaaaagagggggagatccaagaaggcacacgtgcttgccgcatccgtggaacaggccacagaaaactttctggaaaaaggagacaaaatcgctaaggagtctcagttcctgaaggaggaattggtagctgccgtggaggacgttagaaagcaaggcgatctaatgaaagccgcagcaggcgagtttgcagatgacccatgctcaagtgtaaagcgtgggaatatggtgcgggctgccagagcgttacttagcgcagtcactcgcctgctttag

SEQ ID NO: 27835 - DNA, 648 bp, Artificial Sequence
  Description of Artificial Sequence: Synthetic coding sequence
atgacagccgttcatgctggcaacatcaattttaagtgggatcccaagtccctcgagatcagaacactcgctgttgagcgattgctggagcccctggtcacacaggtgactaccctcgtaaatacgaatagcaaaggtccgtcgaataaaaagcgcggtcgtagcaaaaaagcccacgtccttgctgcgtcagttgagcaggcgacagagaactttctggagaaaggagacaaaatcgctaaagagtctcagttccttaaggaagagcttgtggccgctgtggaagatgtgagaaagcagggtgatctgatgaaagccgctgccggagaattcgcagacgacccatgctcatcagttaagagggggaatatggtgcgagccgcaagggccctgttgtctgccgttacccgattgcttatcctggctgacatggccgatgtttataagctgctggtgcaacttaaggtcgtggaggacggcatcctgaagcttcggaacgctgggaatgaacaggatttgggcattcaatataaggctttgaaaccagaagtcgacaagctcaatatcatggctgccaagcggcaacaagaactgaaagacgttggccatcgggaccagatggccgctgctagggggatactgcagtag

SEQ ID NO: 27836 - DNA, 306 bp, Artificial Sequence
  Description of Artificial Sequence: Synthetic coding sequence
atgacggctgtccatgccggaaacatcaactttaaatgggacccgaaatctctggagattagaaccctcgctgttgagcgcttgctggaaccgttggtcacccaggtcaccacattagtgaataccaatagtaaggggccttccaataagaaacgcggtcgctccaaaaaagcacacgtcctggcagccagcgtcgagcaggccacggaaaatttccttgaaaaaggcgataaaatcgcgaaagaaagtcaatttctgaaggaagaactggtggcagcagttgaggatgtaaggaagcaggggtag

SEQ ID NO: 27837 - DNA, 372 bp, Artificial Sequence
  Description of Artificial Sequence: Synthetic coding sequence
atgactgccgtacatgctggcaacatcaactttaagtgggatcctaagagcttggaaatccgtacccttgctgtagagcgattgcttgaaccgctggtgacccaggttacaacacttgtgaataccaattctaaaggcccaagcaacaagaagcgcggtcggtctaaaaaggcccacgtgctcgcggctagcgtcgagcaggctaccgagaactttctcgagaaaggtgacaagatcgccaaagagtcccagttcctcaaagaagaattagtggcagccgtggaagatgtgaggaagcagggggatcttatgaaagccgctgctggggaattcgcagatgatccatgttcaagcgtaaagcgcggaaattag

SEQ ID NO: 27838 - DNA, 471 bp, Artificial Sequence
  Description of Artificial Sequence: Synthetic coding sequence
atgacagccgtgcatgccggaaatataaactttaagtgggatcccaagagcctggagatcagaaccctcgcagtcgaacgcctgctcgagccattagtgacccaggtgacgacactcgtgaacaccaattcgaagggcccatctaacaaaaagcgcggtcggtcaaagaaagctcacgttctcgcggctagcgtggagcaggccacagagaactttctggagaaaggagacaaaatcgcaaaggaatcacagttcttaaaagaagagctggtggcggcagttgaggacgttcgcaaacagggcgatcttatgaaggcggcagcaggagagtttgctgacgacccctgctcatctgtgaaaagaggaaacatggtccgggcagctcgagctcttctctccgcagtgaccagactcctgattctagccgatatggctgacgtgtacaagctgctcgttcagctgaaggtgtag

SEQ ID NO: 27839 - DNA, 285 bp, Artificial Sequence
  Description of Artificial Sequence: Synthetic coding sequence
atgaccgcagtccatgcaggaaatataaactttaaatgggaccctaaatcgttggaaatcagaacgttggccgtcgagcgcttgctggaacccctggttacacaggttacaaccctggttaatacaaatagtaagggtccaagtaacaagaaaagaggcagaagcaaaaaggcgcacgtattggcagcctctgtggagcaggcaaccgagaacttcttagagaaaggggacaaaatcgcaaaggagtcccaattccttaaggaagaactcgtggcagctgtctag

SEQ ID NO: 27840 - DNA, 2790 bp, Artificial Sequence
  Description of Artificial Sequence: Synthetic coding sequence
atgacagccgtacacgctggtaatatcaatttcaaatgggatccaaagagtctggaaatacgtactttggccgttgaacgactcttggaacctttagttactcaggttacaaccctggttaacacaaatagcaagggtcctagcaacaaaaagagaggtcgaagcaagaaagcccacgtcctggctgcatcggtcgaacaggcaactgagaacttcctcgagaagggagataagattgctaaagaaagtcagttcctgaaggaagaactggtggccgcagtggaggatgtcaggaaacagggggatctgatgaaagccgcagctggcgagttcgccgatgatccctgctccagcgtgaaaagagggaatatggtgcgcgcagcccgagccctactgtcggctgtgactagattactgattcttgccgacatggctgacgtctataagctcctggtgcagttaaaagtagtcgaggacgggatcctgaaactgcggaacgccggtaacgaacaggaccttgggattcaatacaaggcccttaagccggaggtcgacaaattaaacataatggccgcaaagcggcagcaggagttgaaggacgtggggcaccgggaccagatggcagctgcccgtgggatactccagaagaatgtgcccatcctgtacaccgccagccaagcctgtttgcagcatccagatgttgccgcttacaaggccaatcgcgaccttatctataaacagttacaacaggcagtgactggaatctcaaacgctgcccaggctacagcctctgacgacgcttcgcagcaccaggggggtggcggaggggaattagcctatgcactgaataactttgacaaacagatcattgtagaccccctgagttttagcgaggagcggttcaggccctccctggaagagaggctggaatccatcatctcgggggcagccctcatggctgacagctcctgtacccgtgatgatcgccgtgagcggatcgtagcagagtgcaatgcagttaggcaggccttgcaggacttgcttagtgagtacatggggaacgcaggccgaaaagagcggtccgacgcccttaactccgccatcgacaaaatgaccaagaaaacgagggatttacgtcgacaactccgaaaagctgtgatggatcacgtgagcgattcttttctggaaaccaacgttccccttcttgtcttgatagaggcagcgaaaaatggcaacgaaaaggaggtgaaagaatatgcgcaggtctttcgagagcacgcaaataaattaatcgaggtggccaacctagcttgttccatctctaacaacgaagagggagtcaaactggtccgcatgtccgcctctcagctagaggccctttgcccccaggtaatcaatgcggcattagctctggccgcaaagccccaatcaaaactggcacaggaaaatatggatctattcaaggagcagtgggaaaagcaggtgcgtgttctgacagacgctgtagatgatatcacctccatcgatgactttcttgccgtatctgagaatcacatactcgaagatgtcaacaaatgcgtgattgccttgcaggagaaggacgtcgatggcctggaccgaaccgctggagccattagaggcagggccgctagagtgattcacgtggtgaccagcgaaatggacaattacgaacctggggtctacacggagaaggtgttggaagcaaccaagcttctctcaaatactgttatgccacgattcacagagcaggtagaggccgctgtagaggccctgtcctccgatcccgcacagcctatggacgagaatgagttcattgatgcctcccgcctagtgtatgacggaattcgggatatacgtaaggcggtgcttatgatacgtacacctgaggaactggatgacagcgactttgaaacggaggatttcgatgtacgaagcagaacttcggtgcagactgaggatgaccagctgattgctggacagagcgcccgagccattatggcccagctcccgcaagagcagaaagctaaaatcgccgagcaggttgcctcctttcaggaagagaaatcaaagctagatgctgaggtatccaaatgggatgattctggaaatgatattattgtcttggccaaacagatgtgcatgatcatgatggaaatgacagatttcaccaggggcaagggccctctgaagaacacatccgatgtgattagcgcggcaaagaagatagcagaggcgggatctaggatggacaagttgggcagaactatagcggatcactgtccagattccgcttgtaagcaggatctccttgcttatctgcagaggattgccctgtattgccaccaattgaacatctgctcaaaggtaaaggccgaggtccagaacctgggcggtgagttagtggttagcgggaattgcgacacctgtggagccttacagggattgaaagggtggccccctcctctgtgtgccacccattgggtcgatagtgcaatgtcgctgatccaggcggctaaaaacctaatgaatgcagttgtgcagaccgtgaaggcatcctatgtcgcatctactaaatatcaaaaaagtcagggcatggccagtctgaatctgcccgctgtgagctggaagatgaaggcgccagagaaaaaaccactggtgaagcgagaaaaacaagatgagacacagaccaagataaagcgagcgagccagaagaaacacgtcaaccctgtgcaagcactgtctgaatttaaagcaatggattccatttag

SEQ ID NO: 27841 - DNA, 1611 bp, Artificial Sequence
  Description of Artificial Sequence: Synthetic coding sequence
atgaccaagaagactcgagacttgaggcgtcagctgaggaaggcagtgatggatcatgttagcgattcttttcttgagactaacgtgcccttgctggtactcatcgaagctgcaaaaaatggaaacgagaaggaggtcaaggagtatgctcaggtgttccgagagcatgccaacaaactgattgaggtggccaatctggcttgttccattagcaacaatgaggagggtgtcaaacttgtaaggatgagcgctagtcaactcgaagcgctctgtcctcaggtcatcaatgccgctctggccctggccgcaaagccacagagcaagctggcgcaggagaatatggaccttttcaaggagcagtgggaaaagcaggtccgagtgttaaccgatgctgtggatgatattactagcatcgacgattttctagccgtcagcgaaaaccacattctcgaggatgtcaataaatgcgtcattgcactgcaggaaaaggacgtggatgggctggacagaacagccggagctatccgaggacgcgcagccagggtgatccacgtagtcacatccgaaatggataattacgaacctggagtatatacggaaaaggttctcgaggcaactaagctcttaagcaataccgtgatgcctcggttcaccgaacaggtggaagctgctgtcgaggccctgtcctcagaccccgcacagcccatggatgagaacgaattcattgatgcctccaggctggtgtacgatggcatcagagatattaggaaagcagtcctgatgatccgaacacccgaggagttagatgactccgattttgaaacagaggattttgacgtgaggtccagaacctccgtgcagaccgaggacgatcagctgatcgctgggcagtccgccagagctatcatggcccagcttccccaggagcagaaagctaagatcgccgaacaggttgccagttttcaagaagaaaaatctaaattagatgccgaagtcagcaagtgggacgactcgggtaatgatattatcgttctcgcaaaacagatgtgtatgatcatgatggagatgaccgatttcactagaggaaaaggaccgctcaagaacaccagtgacgtgatctcagccgcaaaaaagattgcagaggctggctctcggatggacaaactgggaaggacaattgcagaccactgcccagactccgcctgcaagcaggacttgcttgcctatcttcagcgaattgccctttactgccatcagcttaatatctgctctaaagtaaaggccgaggtgcagaatttgggcggagagctggtcgtaagtggagttgacagtgcgatgagcctgatacaggccgcaaaaaatctgatgaacgcagtcgtgcagacagttaaggccagctacgtcgcatctaccaaatatcagaagagccagggcatggctagcctcaatcttccggcagtctcttggaagatgaaggcgccagagaaaaagcccctagtcaaacgcgaaaagcaggacgagacccagacaaaaattaaacgggcttcccagaagaagcacgtcaatcctgtgcaggctctttcagaatttaaagcaatggactccatctag

SEQ ID NO: 27842 - DNA, 2676 bp, Artificial Sequence
  Description of Artificial Sequence: Synthetic coding sequence
atgaccgccgtgcatgcgggtaacatcaatttcaaatgggatccaaagagtctggagattaggaccctagcagtggaacggctgctggagcctctagtgacacaggtcacaacccttgtgaataccaattccaaaggcccttcaaataaaaaaagaggaaggtccaaaaaggctcacgtgctggcagccagcgtggagcaggccaccgagaattttctcgagaaaggcgacaagatagcaaaagaatctcagttcttaaaggaggagctagtggccgctgtcgaggatgtgaggaaacaaggggatcttatgaaagccgctgcgggagagttcgcggacgatccctgttcgtctgtgaaacgaggaaacatggtccgagccgcaagggcgcttcttagcgcagttactagactcctcaaagtggtggaggacggcatcctcaagctccggaacgcagggaatgagcaggatttaggcattcagtacaaggcccttaaaccagaagttgacaagctcaacatcatggccgcaaaacgacagcaggagcttaaggacgttgggcacagggatcagatggccgctgctcggggtatccttcagaagaacgtcccaatcctgtacaccgcgtctcaggcctgcctgcagcaccccgatgtggccgcttacaaagccaaccgagatctcatctacaaacagctgcagcaggctgtcacgggtatctcaaacgctgcccaggccaccgcgagtgacgacgctagccagcaccaggggggaggcggtggagagttagcctacgccctgaataactttgataagcagatcattgttgatccactgagttttagcgaagaacgatttaggccctcactggaagaacggttggagtctattatttccggtgccgctcttatggccgattcctcttgcacacgggacgaccggagagaaaggatcgtggcagaatgcaacgctgtgaggcaagccctccaagacctgctctccgagtatatgggaaatgccggacgaaaggagcgctcagatgccctaaacagtgcgatcgacaagatgacaaagaaaacgcgggatctgcgtcgccaactcagaaaagccgtaatggaccacgtctctgattcatttcttgagactaacgttcctctcctggtccttatcgaagcagccaagaacggtaacgagaaagaagtgaaggaatatgctcaggtatttcgagagcacgcgaacaaactgatagaagttgctaatctggcttgctccatttccaataacgaagagggagttaaactcgtccggatgtctgcgagtcaactggaagctctctgtccacaagtcattaatgccgcattggcacttgcggctaagccacagagcaagctggctcaggagaacatggatctgttcaaagagcagtgggagaaacaggtacgcgtgctgacggacgctgtggatgacataacctcaatcgacgactttcttgccgtgagcgagaaccatattctggaggacgtaaacaaatgtgtgattgcactgcaagaaaaggatgttgacggcctggaccggacagccggagccattcggggtcgggctgcgcgagtcatccacgtcgtaaccagcgagatggataactacgagcccggagtgtatactgagaaggtgctcgaggcaaccaagctgttaagcaatacggtgatgcctagatttacggaacaggtagaagccgctgtggaagccttatctagtgaccccgcacagcccatggacgagaacgaatttatcgatgcttcccggttggtttacgacgggatccgggacatccggaaggccgtcctcatgattcggacccctgaagagctcgacgacagcgacttcgaaaccgaagatttcgacgtccgttcccgtacctctgtccagaccgaggatgaccagctgattgctggccaatcagccagagcgattatggcacagctccctcaggagcagaaagccaagatcgctgaacaagtagcctcttttcaggaggaaaaatctaagctcgacgccgaggtgtctaaatgggatgatagtggtaacgacataattgtcctagctaaacagatgtgtatgatcatgatggaaatgactgacttcacaagaggcaagggcccactgaagaataccagcgatgtgataagcgcagcgaagaagattgcagaggctgggagccgcatggataagttgggaaggaccattgctgaccattgccctgactcggcatgcaagcaagacctgctagcttacttgcaacggattgctctgtactgtcaccaactgaacatatgcagtaaggttaaagctgaggtgcagaatcttgggggagagctagtggtgtctggggttgactcagccatgtctctcatccaagcagcgaagaatctcatgaacgcggtggtccagaccgtaaaggccagctacgtggcttccaccaagtaccagaagtctcagggaatggcatccctgaacctgcctgcagtgtcatggaaaatgaaggccccagaaaagaaaccactagtaaagcgcgagaagcaggatgagacacagaccaagatcaagagggccagtcaaaagaaacatgtgaacccagttcaggcattgtcagaattcaaggctatggactcaatttag

SEQ ID NO: 27843 - DNA, 2346 bp, Artificial Sequence
  Description of Artificial Sequence: Synthetic coding sequence
atggccacacaggctgatctgatggagctggacatggccatggaaccagacaggaaagcagccgtgagtcattggcagcaacagtcgtacttggactccggaatacacagcggagccactaccactgcaccctctttaagcggaaaaggcaatcccgaagaagaggatgtggatactagccaggtcctgtacgaatgggaacagggcttctctcaatctttcactcaagaacaggtggcagacatagatgggcagtacgccatgactagggctcagcgagtccgcgcagccatgttccccgaaaccctggatgaaggtatgcagattcccagtacccagttcgatgcagcacatcccactaatgtgcagcgtcttgctgaaccttctcagatgctgaaacatgccgtagtcaatctaatcaattatcaggacgacgcagagctggctacccgcgctattccagagcttactaagcttctgaacgatgaggatcaagtggtggtgaataaagcggcagtcatggtacaccaattatcgaaaaaggaagcctccagacacgctatcatgcggagtccccagatggtgagcgcgatcgtgcgcacaatgcagaataccaatgacgtcgagacagcacgctgcactgcaggaacactgcacaatctgagtcaccatagggaagggctgctggccatctttaagtccgggggtattccggctctggtcaagatgctgggatcacctgtggattcggtactgttctacgctataactactcttcataatttactgctgcatcaggagggagcaaaaatggcagttcgtctcgccggaggtctgcagaaaatggtagcgctgctgaacaagacaaacgttaagttcctagccatcacgaccgactgcctccagatcctcgcatatggtaatcaagagtcaaaactgataattctcgcgtccggtggccctcaggccctggtcaatattatgagaacgtatacctacgaaaagctactgtggacgacgtcccgcgtactgaaggtcctttctgtgtgcagttcaaacaaacctgcaatcgtcgaagcagggggaatgcaagcacttggcttgcacttgaccgacccctctcagagacttgtccagaattgtctttggacactgcgcaacctgagtgatgctgctacaaaacaggagggaatggagggattactgggtacacttgtgcaactactaggcagcgatgacatcaatgtggttacttgcgccgcaggcatcctttcaaatctcacttgcaacaattacaagaacaagatgatggtgtgtcaagttgggggtatagaagctctcgtcaggactgtgctgcgggctggagatcgcgaagatataacggagccggctatatgcgcactccgacatctaacatcacgccatcaggaagccgaaatggcgcaaaacgctgttaggcttcactatggtttaccagtggtggtaaagctacttcacccgcctagtcattggccactcattaaggctaccgttggcctcattcgcaacctcgccctctgtccggctaatcacgcaccactgcgcgaacagggcgcaatccccaggctcgtccaactgttagtacgtgcccaccaggacacacaacgaagaactagcatgggaggcacacagcaacaattcgttgagggcgtcaggatggaagagattgtggagggctgtaccggggcattacatattttggctagggatgtgcacaataggatcgtgattaggggcctgaacaccattcctctgtttgttcaacttttgtactcccccattgaaaacatccagcgggttgctgctggtgttctttgtgagctcgcccaggacaaagaggctgctgaggccatagaagctgagggtgccacggctccgctgacagagttgctgcactctcgtaacgagggcgtggccacctacgccgctgccgtgttgttccggatgagtgaagataagccacaggactataagaagaggctatctgtggaactcacgagttctctgttccggacagaacctatggcctggaatgaaactgccgatctggggttagacataggcgcacagggggagccactcggctataggcaggacgatccctcttatagatcctttcatagcggcggatatggccaggacgcccttggcatggaccctatgatggaacatgagatgggcggtcatcatccaggcgctgactatccagtcgacggcttgcctgacctgggtcacgctcaagacctaatggacggtttgcctcccggtgattccaaccagttggcatggtttgataccgatttgtag

SEQ ID NO: 27844 - DNA, 2346 bp, Artificial Sequence
  Description of Artificial Sequence: Synthetic coding sequence
atggccacccaggcagacttgatggaattagacatggccatggagccggacagaaaagcagcagtgagtcactggcaacagcaaagctatctggattcaggaatacattccggagcaacaacaactgcaccatctttgagcggcaagggcaacccggaagaggaggatgtggatactagtcaagtgttgtacgaatgggaacagggcttctcccaatcattcacccaggagcaggtcgccgacatcgacggccagtatgcgatgacccgcgcacagagggtccgggcagcaatgtttccggagaccctggatgaagggatgcagattccatctactcagtttgatgccgctcatcctactaacgttcagcgtctggccgaaccttcccagatgctcaagcacgccgtggtcaacttaattaactaccaggacgatgccgagttggctacgcgggcaattcccgagttgactaagctcttgaacgacgaggatcaggtggtagtgaataaagccgctgtgatggtgcaccagttaagcaagaaagaagctagccggcatgctatcatgagatctccacagatggtttctgccattgttcgaactatgcagaatacgaacgatgtggaaacggcacgttgcacggctgggacactgcacaatctaagtcaccaccgcgagggcctgctagctatcttcaagtcaggtggcattcccgctctggtcaagatgctcggctcacccgtggacagcgtactcttctacgctatcactactctacataatctgctcctccatcaggagggagcaaaaatggccgtgcggctggccggaggcttgcagaagatggtcgctctcttaaataagacgaacgtgaagttcttagcaattacgactgactgcctacagatcctagcatacggaaaccaagagtccaagctcattattttggcctctggcggtccccaggccctggtcaatattatgcgcacctacacctacgagaagctcctctggaccaccagccgggtgttgaaggtattatccgtgtgtagttccaataaacccgctattgtcgaagccggtgggatgcaggctctcggtttgcacctgaccgacccgagccagaggctcgttcagaattgcttgtggaccttgagaaacttgtcggacgcggctaccaaacaggagggaatggagggtctgctaggcactctggtacagctactgggctctgatgacatcaacgtggtcacttgcgcagctggaatactgagcaatttgacttgcaacaactacaagaacaagatgatggtatgtcaagtgggtggcatagaggcactggtacgcactgtgttgcgggctggagaccgggaggatatcacggaaccggctatatgcgccctgagacatttgacaagcagacaccaagaggcagaaatggcccaaaacgctgtacgccttcactacggattgcccgttgtggttaagctcttacatcctcctagtcattggccgctgattaaggcgaccgtcggactcatccggaatctcgccctctgtcccgcaaaccacgcgcctctgagagagcagggagccattccgcgtctggttcaactgttggtaagggcccaccaagacactcagcgcagaaccagtatgggcggtacacagcagcagtttgttgagggcgtgcgtatggaagagattgttgagggttgcacgggtgccctccacatcctcgcccgagatgtgcataaccggattgtcatccgtgggttaaataccatcccactctttgtgcaactgctgtactcccccattgaaaacatccagcgggttgctgccggtgttctctgcgaactcgcccaggacaaagaggccgctgaggccattgaggcggaaggagccacggcccctctgaccgagctactgcatagtcgtaacgagggggttgcaacgtatgccgctgctgtactgtttaggatgtcagaggacaagccccaagattacaagaagagattgagcgtggagctaacttcatcccttttccgtacagagcctatggcgtggaacgagacagcggatctaggtctggatatcggtgcgcagggtgagcccctcggttacaggcaagatgacccttcctatcgctcctttcacagtgggggatacggccaagatgccctaggtatggaccccatgatggagcacgaaatgggaggtcatcatcctggtgctgattacccagtggatgggctacctgatctcggccatgcccaagaccttatggacgggcttccgcctggggatagtaatcagctggcgtggttcgacacggacttgtag

SEQ ID NO: 27845 - DNA, 2346 bp, Artificial Sequence
  Description of Artificial Sequence: Synthetic coding sequence
atggcgacacaggcggacttgatggagcttgacatggccatggagccagaccgcaaagctgcagtctcacattggcagcagcagtcttacctggatagcggcattcactctggcgctaccactaccgctcctagtttgagtggaaaaggcaaccccgaggaagaagatgtagataccagtcaagtgctgtacgaatgggaacagggcttttctcagtctttcacccaggaacaggtggcagacattgatggtcagtacgccatgactcgagcccaaagagttagagctgccatgttccccgaaaccctggacgaaggaatgcagatccccagcacacagtttgacgcagcacaccctaccaacgtccagagactcgcagagccatcccagatgctgaagcatgccgtagtaaacctcattaattatcaggacgatgctgagctcgctacaagggcaatccctgagcttaccaagctgcttaatgatgaagatcaggtggtagtcaacaaggccgctgttatggttcaccaactcagtaaaaaggaggctagtcgacacgccattatgcgatctccccagatggtgtcagccattgtccgcacaatgcagaacaccaatgacgtggagaccgcgagatgtactgccggaacgttacacaacctgtcccaccatcgcgagggcctgctggctatattcaagtccggcggaattcccgctttagtgaaaatgctgggatctccggttgactccgtgctcttctacgcaattactacgctgcacaacctcttgctgcatcaagagggagccaaaatggctgttcgcctggctggcggtctgcagaaaatggtggcattgttgaacaaaactaatgtgaagttcctggccatcaccaccgactgtctacagatactggcctatgggaaccaggagagcaaactgatcatcctcgcatctgggggaccacaggctctggtcaacataatgcgcacttatacgtatgagaaattgctgtggaccactagtagagtactaaaggtcctgtctgtatgctcaagtaataaacctgccatcgtggaagccggagggatgcaggcactagggctacacctaacagacccaagtcagcgacttgtgcagaactgtttgtggactctgagaaacctctccgatgcagccacgaagcaggagggtatggagggattgctgggcacgctggttcagctgctcgggtctgatgatattaacgtcgtcacatgcgcagcaggtatcctgtcaaatttaacgtgcaacaattataaaaacaagatgatggtttgccaagtgggaggaatcgaagcgctcgttcgcactgtgctacgcgcaggggatcgggaggatataactgaaccggcaatctgtgccttaaggcacttgacatcccgccaccaagaggcagagatggcccaaaatgccgtcagattgcattatgggctgccggtggtcgtgaaactcctgcaccccccatcacattggcctctgattaaggcaaccgttggacttatcaggaacctggcgctgtgccccgctaaccacgccccattgcgggagcaaggcgctatcccacggctcgtacagctgctagtgagagcacatcaggacacccagaggagaacatctatgggaggaacgcagcagcaattcgtggagggcgtgagaatggaggagatagtggaagggtgtaccggagccttgcatatcttggctagggatgttcacaatagaatcgtgatcaggggtttgaacaccattcccttattcgttcagctcttatactcccccatagagaatatccagcgagtggctgcaggcgtcctgtgtgagctcgcccaagacaaagaggctgccgaagccattgaagcagaaggcgcaactgcgcctctcaccgaactgttacatagtcgcaacgaaggggtagccacgtacgcagctgccgtgctttttcgaatgagcgaagataagccacaagactacaaaaaaagattatcggtggaactgacatccagtctatttcgaacagaacctatggcctggaacgaaaccgctgacctgggcttggacatcggagcccaaggtgagccactgggatacagacaagacgacccttcctacaggagttttcacagcggagggtacggccaagatgccttaggcatggatcccatgatggagcacgagatgggcggacatcaccccggtgctgattaccccgttgatggcctccccgatctggggcatgcgcaagacttgatggatggcctcccgccaggcgactccaaccagcttgcatggtttgatacagatctctag

SEQ ID NO: 27846 - DNA, 2346 bp, Artificial Sequence
  Description of Artificial Sequence: Synthetic coding sequence
atggccacgcaggctgatttaatggaactcgacatggccatggagccagaccgcaaagcagctgttagtcattggcaacagcaatcctatctcgatagcgggattcattctggggctactacaactgccccatccctgtccggtaagggtaatccggaagaggaggacgtggatacgtctcaggttctgtatgagtgggagcaggggttctctcagtcatttacccaggagcaggtcgctgacatcgacggccaatacgctatgacccgagcccaaagggttcgcgctgcgatgtttcctgaaacactggacgaaggcatgcagattccctctactcagtttgacgccgcacaccccactaacgtgcagcgacttgctgaaccctcacaaatgttgaagcatgccgttgtaaacctcatcaactatcaggatgacgccgagctggccacccgcgcaataccggaactgacaaaactccttaacgacgaggaccaggttgtcgtgaacaaggcagctgtcatggtacaccagctgagcaaaaaggaagcatctcgacacgcgatcatgaggtcaccccagatggtgtccgcaattgtgaggaccatgcagaataccaatgacgttgaaaccgcaaggtgtaccgcaggaacactgcacaatctcagtcaccacagagaagggctgctcgctattttcaagagtgggggaatcccagctcttgttaagatgctgggctctcccgtggacagtgtactattttacgccatcacgaccttacacaacctcttacttcatcaggaaggggcaaagatggccgtgcgcctggcaggcggtttgcaaaaaatggtggccctgctgaataaaacaaacgtaaagttcctagcgatcactaccgactgcttgcagatcttagcttatggcaaccaagagtcaaagctgattatcctagcgtccggaggccctcaggcgctcgttaacatcatgcgcacatatacttacgaaaagctcctttggacaacaagccgagtgctgaaggtgctttctgtgtgctcatctaataagccagctatcgttgaagcgggaggtatgcaagccctaggactgcacctgaccgacccatcccagcgccttgtgcagaactgtctgtggactctcagaaatctctcagacgccgcaacaaaacaggaagggatggaggggttgctcggcaccttggtgcagctcctggggtctgacgatatcaacgtagttacatgcgcggcagggattctgtcgaatttgacatgcaataactacaagaataagatgatggtgtgccaagtgggaggaattgaggcccttgtccgcaccgttttacgagcgggagaccgagaggatattaccgagcctgccatttgcgcccttcggcatcttacatctaggcaccaggaggcagagatggctcaaaacgcagtgcgtctacattatggattacccgttgttgtgaaactgctgcatccgcctagtcattggccactgattaaagccacagtagggctaattcgcaacctggcactttgccccgctaaccatgccccactccgggagcagggtgcaatacctagactcgtgcagctgctggtcagagcccatcaggatacgcagaggaggacctctatgggtggcacacaacaacagtttgtcgaaggcgtaagaatggaggaaatcgtcgaagggtgcaccggggctctgcacattttagccagagatgtgcacaatcggatagttatccgaggactgaatacaattccactctttgttcagctattgtacagtcctatagaaaatattcagagggtcgcggctggcgttctgtgcgaactcgcccaggataaggaggctgcagaagcaatcgaagccgaaggtgctaccgctcccctcaccgagctgttacattccagaaatgaaggcgttgccacatatgcagcagccgttttgtttcggatgtcagaggacaaacctcaggactataaaaaaaggctatctgttgaactcacttcctccttgttcaggactgaacctatggcatggaacgaaacagccgacttgggcctcgacattggagcgcagggagaaccgcttgggtatcgccaggacgacccttcttacagatcattccactccggtgggtacggccaggacgcccttggcatggatcctatgatggagcacgagatgggaggccaccaccctggtgcagattaccctgttgacggattgcctgatctcggccatgctcaggatttaatggatggccttccgcctggagacagtaaccagctcgcgtggtttgacactgacttatag

SEQ ID NO: 27847 - DNA, 453 bp, Artificial Sequence
  Description of Artificial Sequence: Synthetic coding sequence
atggccacccaagccgacttgatggaactggatatggccatggagcccgatcgaaaagccgctgtgtcccactggcaacagcagagctacttagattccggtatacacagtggagcgaccactacagcgcctagtctatcagggaaaggaaaccctgaggaagaagacgttgacaccagtcaagttctttacgaatgggagcagggcttcagccagagcttcacccaagagcaagtggcagacattgatggacagtacgccatgactagggcccaacgggtgcgcgctgctatgttcccggagaccctggatgaaggcatgcagataccttcaacacagttcgacgctgcacaccctacaaacgtccagcgcttagctgagccgtcacaaatgctcaagcatgctgtggtgaatctgatcaactaccaggacgatgcagagcttgccacttag

SEQ ID NO: 27848 - DNA, 42 bp, Artificial Sequence
  Description of Artificial Sequence: Synthetic coding sequence
atggcaacccaggcagatttaatggaactggatatggcttag

SEQ ID NO: 27849 - DNA, 303 bp, Artificial Sequence
  Description of Artificial Sequence: Synthetic coding sequence
atggccacacaggccgatctcatggaactggatatggctatggaacctgaccgcaaggctgcggtttctcattggcagcagcaatcctacctggactccggcattcattccggagcaaccactaccgccccatccctaagcgggaaaggcaaccccgaagaggaggacgtggacacctctcaagtgctgtacgaatgggaacaaggcttttcccagtcctttacacaggaacaggttgctgatattgacgggcagtacgcaatgacccgggcacagcgggttagggcggcaatgtttccgtag

SEQ ID NO: 27850 - DNA, 327 bp, Artificial Sequence
  Description of Artificial Sequence: Synthetic coding sequence
atggctactcaagctgatttgatggaactggatatggccatggagccggatagaaaagctgccgtgtctcactggcagcagcagtcctacctcgatagcggtatccattccggggcaaccacaactgctcctagcctctccggcaagggcaatccagaagaggaggacgtggatacgagccaggtgctctacgagtgggagcaggggttcagtcagagctttactcaggaacaggtggccgatattgatgggcagtatgcgatgacccgagctcagagggtgagagctgctatgttccccgagactctcgacgaagggatgcaatag

SEQ ID NO: 27851 - DNA, 2325 bp, Artificial Sequence
  Description of Artificial Sequence: Synthetic coding sequence
atggagctggacatggctatggagcccgacagaaaagcagcggtgtctcactggcagcagcagtcctatctcgattccggaatccacagcggcgcaaccacgactgcacccagtttgagcggcaagggtaatcccgaagaagaagatgtcgatacctcccaggtgctctacgaatgggagcagggattctctcagagctttacacaggaacaggtggccgacatcgatgggcagtatgcaatgactcgcgctcagcgcgtgagagcggcaatgttccctgaaaccctggatgagggaatgcagatcccctcaacgcagttcgacgcagcacatccgacgaacgttcagcggcttgccgagccttcccagatgcttaaacatgctgtggttaatctgatcaactaccaggacgacgccgaactcgcaacccgcgctattcctgaactcacgaagctattgaacgacgaagaccaggtggtggttaataaggctgcagtcatggttcatcaactgtcgaaaaaagaagcgtccagacacgcaatcatgcgatctccccagatggtttccgcaattgtgcggaccatgcagaatacaaacgacgtggaaacagccagatgcaccgctgggacactgcacaacctcagccatcaccgcgaaggacttttggcaatattcaagtccggaggtatacccgcattagttaaaatgctcggtagcccagtggactcggtcttgttctacgctattacaacactgcacaatttactgttacaccaagagggggctaaaatggccgtaagactggcgggagggctgcaaaagatggtggccctgctgaacaaaactaatgtcaagttcctggccatcactacagactgtttacaaatcctcgcctatggaaatcaagaatccaagcttattatcttggcctcaggtggacctcaagctcttgtcaatatcatgaggacatatacgtacgagaagctcttatggacgacaagtagagttttaaaagtgctcagcgtttgcagctctaataaaccagccatcgtcgaagccggagggatgcaggctcttggacttcatctcactgatccgtcccaacggctggtgcagaactgtttgtggacactgcgcaacttgtctgatgcggctaccaagcaggagggtatggagggtctcttgggaactctggtccaattgctgggaagcgacgacattaatgtggtgacttgcgcagcagggatcctctcaaacctaacctgcaacaattacaagaacaaaatgatggtctgtcaggtgggaggaatagaggcactcgtgcgcacagtcctgagagccggagatagggaggacatcaccgaaccagccatttgtgcgctgagacacctaacaagccgccatcaggaggccgagatggcacagaatgccgtcagattacactatggcctccctgtggtggtgaaacttctccaccctccttcccattggccgcttatcaaggctacagttggtctgatccgaaacttagccctgtgtcccgcaaatcatgcccctctgcgcgagcagggggctattcccaggctagtgcagctgctggtgcgtgcacaccaggatactcagcgacgaacatcaatgggcggtactcagcaacaatttgtggagggggtaagaatggaagagattgttgaaggctgcactggcgctctccatatcttagcgcgagacgtgcataataggatcgtgatccgaggcctgaatactatccctctattcgtccaactgctgtacagtccaatcgaaaatattcagagagtggctgccggagtgctctgcgaattggctcaggacaaagaagccgctgaggccattgaagccgaaggcgcaactgcccctctgaccgaactgctgcactcaagaaatgaaggagtggcgacttacgccgctgcggtgctcttccggatgagcgaagacaaaccgcaagattacaagaaacgcctttccgtggagctaactagctcactgtttcggaccgagcccatggcatggaatgagactgcggaccttggcttggacatcggggctcagggtgagccactgggttatcgacaagatgatccctcataccggtcattccactccggcggatacggccaggatgctctaggtatggatcctatgatggaacacgaaatgggtggacaccaccccggagccgattatcctgtggatggtctccccgacctggggcatgcacaggacctgatggatgggttgccccctggcgactcaaatcaacttgcatggttcgatacagacctctag

SEQ ID NO: 27852 - DNA, 1020 bp, Artificial Sequence
  Description of Artificial Sequence: Synthetic coding sequence
atgtggcaattgtgggcctccctctgttgtctgctggtgttggccaacgccagaagtagacccagctttcaccccctgagtgatgaactcgtgaattacgtgaacaagaggaatacgacatggcaagcaggacacaatttctataatgtggatatgtcctatctgaagcgactctgtggcacctttctcgggggtccaaagccaccacaacgggttatgttcacagaggatctcaaactcccagcgagcttcgacgcccgagagcagtggcctcagtgccccaccatcaaggaaattagagaccagggatcttgtgggtcttgctgggctttcggggctgtggaagcaatctcggacaggatctgcatccataccaatgctcacgtcagcgttgaggttagtgctgaggatctgcttacttgctgcggatccatgtgcggggatggctgcaacggcggataccctgcagaggcatggaacttttggacacgaaagggcctggtcagcggtggcttatacgagagtcacgtcggctgtagaccatattctattccaccttgcgaacatcacgtaaacgggtctagacctccttgcacgggagagggagacacgccaaagtgttcaaagatttgtgaacctgggtattccccaacatataagcaggacaagcactatggctacaattcctattccgtgtcgaacagtgagaaggacattatggcagagatatacaagaatgggccagtggagggagcattcagcgtctactctgactttctgttgtacaagagtggtgtctaccagcacgtgacaggagagatgatggggggacacgcaatccggatcctgggatggggagtggaaaatggcacaccctactggttagtagcaaacagttggaacaccgattggggtgacaatgggttcttcaaaattctgcgcggacaagatcactgtggtattgagagtgaagtggtggctggcatcccacgtaccgatcagtattgggagaagatctag

SEQ ID NO: 27853 - DNA, 1020 bp, Artificial Sequence
  Description of Artificial Sequence: Synthetic coding sequence
atgtggcaactgtgggcatctctgtgttgtctcctcgtactggccaatgccagaagcagaccttctttccaccccctgtcggatgagctggttaactacgtgaataagcggaatactacatggcaggctggtcacaatttttataacgttgatatgagctacttaaagagactatgtggcacctttctgggtgggcctaagcctccccagcgggtgatgttcactgaggacctcaagctgcctgcgagctttgacgccagggaacagtggcctcagtgccccactatcaaggaaattcgcgaccaggggtcatgcgggagctgttgggccttcggcgctgtcgaagcgattagcgatcgtatatgtatccataccaacgcccatgtatcggtggaagtctccgctgaggatctgctgacatgctgtggcagcatgtgtggggacggctgcaatgggggttacccagccgaagcctggaacttctggaccagaaaggggctcgtgagcggcggtctgtacgagtcccatgtggggtgtcgcccttacagtatcccaccatgtgagcaccatgtgaacggaagtcgtccaccctgcacgggcgaaggtgatacacccaagtgcagcaaaatttgtgaacccggatatagcccaacctataagcaggataagcactacggatataactcttattctgtgtccaactctgagaaagatatcatggcagaaatttataagaacgggcctgtcgaaggagcatttagtgtctactcggacttcctgctttacaagtccggtgtctaccagcacgttacaggagagatgatgggcggacacgccatcaggatcctgggatggggtgttgagaacgggaccccgtattggttggtagccaacagttggaatacagactggggcgataatggctttttcaagatccttaggggccaggatcattgtggcattgagtctgaggtcgtggctggtataccacggacagaccaatactgggaaaagatatag

SEQ ID NO: 27854 - DNA, 333 bp, Artificial Sequence
  Description of Artificial Sequence: Synthetic coding sequence
atgtggcagctatgggcttcattgtgctgtctgctcgtccttgccaacgctaggagtagaccttcattccaccctctgagcgacgaactagtaaactatgttaataaacgaaacactacctggcaggctggccataatttctacaacgtggacatgtcttatttgaagcggctctgtggcacttttctcgggggtccaaagcctccccaaagggtaatgtttaccgaggatctcaaactaccggctagcttcgatgcccgagaacaatggccccagtgtccaacgataaaggaaattagagatcagggctcatgcgggagctgctggctgtag

SEQ ID NO: 27855 - DNA, 1020 bp, Artificial Sequence
  Description of Artificial Sequence: Synthetic coding sequence
atgtggcagctgtgggcctctttatgttgtctgctggttcttgcaaatgcgcgttctaggccctcctttcaccccctttctgacgaactagttaattatgtcaacaagcgcaacacgacttggcaagccggacacaacttttataacgttgacatgagctaccttaagcggctttgcgggacatttctgggcggtcctaaaccaccccagcgagtcatgtttacagaggatctgaaactgccagcctccttcgatgccagagaacagtggccacagtgccccacaattaaggagatcagagaccaaggttcttgtggctcttgctgggctttcggagccgttgaagctatctccgaccgaatctgtatccacaccaacgctcacgtgagtgttgaagtgtccgccgaggaccttctcacatgttgcgggtcaatgtgtggggacggctgtaatggcggatacccggctgaagcatggaacttctggacgcgcaagggtttggtcagcggcggattatatgaatctcatgttgggtgccgtccctactccatccccccatgtgagcaccacgtgaacggctctagaccaccttgcacaggcgaaggtgacacccccaaatgttccaagatctgtgaacccggatatagcccgacttacaagcaggataaacactacgggtacaatagctatagcgtcagcaattccgagaaggacatcatggctgaaatctataagaacgggccagtggaaggagccttttcagtctattcagatttcctgctctataaatccggggtctaccaacatgtaactggagagatgatggggggacacgccatcaggatccttggctggggagtggaaaatgggacaccatattggctggtggcgaattcctggaacacagactggggggacaacgggttttttaagatattacgtgggcaggatcactgtgggattgagtcagaggtcgtcgccggaatccccaggacagaccagtactgggaaaaaatttag

SEQ ID NO: 27856 - DNA, 1020 bp, Artificial Sequence
  Description of Artificial Sequence: Synthetic coding sequence
atgtggcaactttgggctagcctgtgttgtcttctcgtattggccaacgccaggagtcggcctagtttccaccctctgtctgatgagctggtcaactatgtcaacaagcggaacacgacctggcaggcaggacataacttttacaacgtggacatgagttacctgaaaaggctgtgcggcacatttctaggaggtcctaagcccccacagagggttatgtttactgaagatctgaaattacctgcctcctttgatgccagggagcagtggccccagtgtccaactatcaaggaaattagagaccaaggatcatgtggctcttgttgggccttcggggcagtggaggcgatcagcgacaggatctgcatccatacaaatgctcatgtgagcgttgaggtgtccgcagaggatctactgacctgctgcggcagcatgtgcggcgatgggtgtaacggcggataccccgctgaggcctggaacttttggaccagaaagggattagtgtcaggcggtctctacgaaagccatgtggggtgtcgtccctattctattcctccctgtgaacaccatgtcaatgggagcaggcccccttgcaccggcgagggagacacgccgaaatgttctaagatttgcgaacccggatattcaccaacttataaacaggacaaacactatgggtataatagctactccgtgtcaaattccgaaaaggatattatggccgaaatctataagaatggccctgtcgaaggcgcattttcggtctactccgacttcctgctttacaagtctggcgtctatcaacatgtgaccggagaaatgatgggtggacacgccattcgaattctgggatggggtgtagaaaatggtacgccttactggctggtcgctaacagttggaacactgactggggcgacaatggatttttcaaaattcttaggggacaggaccattgtggcattgagtctgaggtagtcgctggcatacctcgcacagaccagtactgggagaaaatttag

SEQ ID NO: 27857 - DNA, 1020 bp, Artificial Sequence
  Description of Artificial Sequence: Synthetic coding sequence
atgtggcagctgtgggcctccctctgctgcctcctggtacttgccaatgccaggtctcgaccatcgtttcatccactcagcgatgagctggtgaactatgtgaacaagagaaatacgacatggcaagccggtcataacttttacaatgtagatatgtcgtatctaaaaaggctctgcggcacttttctcgggggtcccaagccaccacagcgcgtgatgtttacagaggacctaaagttgcccgcaagctttgacgcaagggagcaatggcctcagtgtcctactataaaggaaatccgcgatcaggggtcctgtggatcttgctgggccttcggcgcagttgaggcaataagcgatcgcatctgtatccatactaatgcgcacgtgtctgtagaagtttctgctgaggacctgctgacctgttgcggctcaatgtgcggagacggatgtaacgggggatatcccgctgaagcctggaacttctggacaaggaagggactggtgtctggcggtctctacgaaagtcacgtcgggtgtcggccttactcaataccgccttgcgaacaccacgtgaacgggagtcgccctccctgcaccggcgaaggagatacacccaagtgctcaaagatctgcgagccgggatattccccgacctataagcaggacaagcactatggttacaactcctatagcgtgtcgaatagtgagaaggatatcatggcggaaatctataaaaacgggccagtagagggagccttcagcgtctacagcgactttttgctgtacaaaagtggcgtgtaccaacacgttacgggtgagatgatggggggtcatgccattagaatcctaggctggggggtcgaaaacggcacaccttactggctggtggctaattcatggaacacagactggggcgacaacgggttttttaagattctaagagggcaggaccattgtggaatcgagtccgaggtcgttgctggaatcccacgcacagaccaatattgggaaaagatctag

SEQ ID NO: 27858 - DNA, 1020 bp, Artificial Sequence
  Description of Artificial Sequence: Synthetic coding sequence
atgtggcagctttgggccagcctttgctgtctgctggttctggccaacgcccgttcccggccttcttttcaccctctgtctgacgaactcgtgaattacgtgaataagcgaaatactacatggcaggccggacacaatttctacaacgtcgatatgtcttatttgaaaaggctgtgcggcacctttctgggtggaccgaagcctcctcagagagtcatgttcaccgaggatcttaaacttcctgccagttttgacgcaagagaacagtggccacaatgccctacaatcaaggagattagagatcagggatcctgtggcagctgttgggccttcggcgctgtggaagccatctctgaccgaatttgtattcacactaacgcacacgtatctgtcgaggtgtccgcagaggacctcctgacctgctgcggtagcatgtgtggcgatgggtgtaacggtgggtatcccgctgaggcctggaacttctggactaggaaggggctggtcagcggaggattgtatgaatcccacgtcggatgtcgaccttacagcataccaccctgcgagcatcacgttaatgggagtagacctccctgtacaggcgagggggacacaccaaaatgttccaagatctgtgaaccaggctatagtcccacctataagcaggacaaacactatggatataattcttactccgtctctaactccgaaaaggatattatggccgaaatttataaaaatggtcctgtcgagggagccttcagtgtgtactctgacttcttactctacaaaagcggagtctatcagcacgttaccggagaaatgatgggaggacatgctatcaggatactaggttggggtgttgagaatggtactccttactggttagtggcaaacagctggaacactgactggggtgacaatgggttcttcaagattctgagaggacaggaccactgcgggattgaaagtgaggtggtcgcgggaatacctcggactgatcagtactgggagaagatttag

SEQ ID NO: 27859 - DNA, 1020 bp, Artificial Sequence
  Description of Artificial Sequence: Synthetic coding sequence
atgtggcaactctgggccagtttatgttgcttgcttgtgctcgctaatgccaggtccagaccttccttccatccactctccgacgaactggtgaattatgtaaacaagcggaacacaacgtggcaagccggtcataatttctacaatgtcgatatgagctatctaaaacgactttgtggcaccttcctaggtggccctaaacctcctcagagagtgatgtttacagaagacttgaaattgccggcatctttcgacgcacgtgagcagtggccacagtgccccaccattaaagaaatcagagaccaaggctcctgcgggtcttgttgggcttttggagctgttgaggcaattagtgacaggatttgtatccatacaaacgcccacgtaagtgtcgaggtatctgccgaggatttgttaacgtgctgtggaagcatgtgcggcgatggatgtaatgggggatacccagcagaagcttggaatttttggactcggaaaggattagtgagcggagggctatacgaatcccacgtgggctgccgaccatattcaatccctccctgtgagcaccacgtgaatggcagcaggcccccttgcaccggagagggagatactcctaaatgtagcaaaatctgtgaaccaggctattccccaacttataagcaggacaaacactacgggtacaactcctactctgtgtctaacagcgaaaaggatatcatggctgagatttataagaatgggcctgtggaaggtgcttttagtgtctacagcgacttcctcctgtataaatccggggtgtatcagcatgtgaccggcgagatgatgggaggacacgccatccgcattctaggttggggtgtggagaatggcacgccctattggttagtagctaactcttggaatacggattggggtgacaatggattctttaagattcttcgcggacaggatcactgtgggatcgagagcgaggtggtagccggaatcccaaggaccgatcagtattgggagaaaatatag

SEQ ID NO: 27860 - DNA, 1020 bp, Artificial Sequence
  Description of Artificial Sequence: Synthetic coding sequence
atgtggcagttgtgggcctccctctgttgcctgctagtgctcgctaatgcacggagcaggccctctttccatccacttagcgatgaactggtcaattatgtcaacaaacggaatacaacctggcaggcagggcacaacttttataatgtggacatgtcctatctcaagagactgtgtggtaccttcctggggggtcccaagcctcctcagcgggttatgtttaccgaggacctgaaactcccggcatcattcgacgccagggaacagtggccacagtgccccaccataaaagaaatacgggatcagggctcttgcgggagttgttgggcatttggcgcagtggaagctatttccgataggatctgtatccatacaaacgcacacgtgtctgtggaagtctccgccgaagacctgttaacctgttgcgggtcaatgtgcggcgacgggtgtaacggaggttatcctgccgaagcatggaacttttggacacgcaagggcctggtgagcggtggcctgtatgagtcccatgtgggctgcaggccttattccatcccaccctgtgagcaccacgtgaatggttcacggccaccttgtacaggagagggagacactcccaagtgcagcaaaatatgcgagcccggttacagccctacttacaagcaggataagcattacggctacaattcatattccgtcagcaattccgaaaaggacattatggccgaaatctataagaatggcccagtggagggcgcattctctgtgtattcagactttttattatataaaagcggggtgtaccagcacgtgaccggggaaatgatgggaggtcatgcaattcgcattctgggatggggcgtggaaaatgggacgccctactggcttgtggctaactcctggaacacggactggggggacaatggcttcttcaaaatcctgagagggcaggatcactgcggtattgagtcagaagtcgtggcagggattccccgtacagatcagtattgggaaaagatctag

SEQ ID NO: 27861 - DNA, 831 bp, Artificial Sequence
  Description of Artificial Sequence: Synthetic coding sequence
atggatatgaatagaagggcaagctgccttctgcccgatctgtgcgggcagggatggggctggcggctctttccagcatcctgtgcctacctgggaagcgtgccctggcgagtttggggtttaggaggcttattagctcccctcgcggcagctggcggtggaagtacttctgggctgggtcatctcggctccacgcagtggtctggcgagttagtggtgctgctttcagaggtatttatcagggggtgcctgttttcgtgtaacggcggatatccggctgaggcttggaatttttggacccgtaaaggcctggtgtctggtggcttgtacgagtcccacgtgggctgccggccatacagtatccctccatgtgagcaccatgttaacgggagcaggccaccctgtaccggcgagggtgatactcccaagtgttctaagatctgtgagcccggatactctccaacttacaagcaagataagcactacgggtataatagttactccgtgagcaatagtgagaaagatataatggccgagatttacaaaaatggcccagtcgagggggcattcagcgtatactcagactttttactttacaaaagtggggtttaccaacatgttaccggagaaatgatgggaggacacgccattagaatcctggggtggggcgtggagaacggcacaccttactggctggtcgctaatagttggaacacagactggggtgataatggtttcttcaagattttacggggtcaggatcattgcggtattgagagtgaggtagtggcagggattccaagaactgaccaatactgggagaagatttag

SEQ ID NO: 27862 - DNA, 738 bp, Artificial Sequence
  Description of Artificial Sequence: Synthetic coding sequence
atgcccggagcagggccactcagcatcccttgcaggatgtcctgggctttcggcgcagttgaggctataagcgaccgaatctgcatccacaccaacgctcacgtgtctgtggaggtatcagccgaggatctactgacctgctgcgggtctatgtgtggagacgggtgtaacgggggataccctgccgaagcctggaacttttggacacgcaaaggacttgtgtccggcggtctgtacgagtcccacgtcgggtgccgcccatactccatccctccctgtgagcatcatgtgaacggtagccggcctccctgcaccggagagggcgatacacctaaatgttctaaaatttgtgagcctgggtatagccccacatacaagcaggacaagcattacggctacaactcatatagtgtcagtaacagcgagaaggatatcatggccgaaatttacaagaacgggccagtggagggggcattttctgtttactcggactttctgctgtacaaaagcggagtgtaccaacacgtcaccggcgagatgatgggtggccacgccatcaggatattgggttggggggtcgagaatgggaccccatactggctggttgcaaattcctggaatactgattggggggacaatgggttctttaagatccttaggggccaggaccactgcggtattgaaagcgaggtagtggctggaatccctagaacagaccaatactgggagaaaatttag

SEQ ID NO: 27863 - DNA, 1239 bp, Artificial Sequence
  Description of Artificial Sequence: Synthetic coding sequence
atgcagccaagttcgctgctgccactcgcgctttgcctcttagctgcacctgcctctgcattagtgcgcattccattacataagttcactagcatacgtcgaactatgtctgaggtgggcggatcagtggaggacttgattgcaaagggacccgtgtccaaatactcgcaggctgtccccgcagttaccgagggcccaattcccgaggtgctgaagaactacatggacgcccagtactatggcgagatcggcattggcacacctccacagtgcttcaccgtggtgttcgacacaggtagttccaatctgtgggtgccttccatacactgcaaactcctcgacattgcctgttggattcaccacaagtataactctgacaagtcttccacgtatgttaagaacggaacttctttcgatattcactatggttcgggttccttgtccgggtacttgagtcaagataccgtgtcggtcccttgccagtctgctagttcggcttcagcgctgggaggcgtcaaggttgagcgccaggtcttcggggaggccacaaaacaaccagggataaccttcatagcggctaagtttgatggcatccttggcatggcttatcccagaatatccgtaaataatgttcttcctgtgttcgacaacctcatgcagcagaaactggtggatcagaatatttttagcttctatctttcacgggatcccgatgcccagccagggggagaactgatgctaggaggcacagattctaagtactataagggctccctgtcatatctgaacgtgacgagaaaagcgtactggcaggtgcatctcgatcaggtcgaagtggctagtggattgaccctatgcaaagaagggtgcgaggccatcgttgatacaggaactagtctgatggtgggtccggtggatgaagtgcgggagctgcagaaggcaattggtgctgtgcctcttatccagggtgagtatatgattccttgcgagaaagtttctacactcccagccatcacgttaaagctagggggaaagggctacaagctgtcccctgaggactacaccctgaaggtaagccaggccggaaaaaccctctgtctctccgggtttatgggaatggacatccctccaccatcagggcctctgtggatcctgggtgacgtttttatcgggagatactacactgtgtttgacagggacaacaatagagtgggcttcgccgaggctgcccgtctttag

SEQ ID NO: 27864 - DNA, 1002 bp, Artificial Sequence
  Description of Artificial Sequence: Synthetic coding sequence
atgaatcctacgctgattctcgccgctttttgccttggcatcgcctccgcaaccctgacgttcgatcactcgctggaggcgcagtggaccaaatggaaagccatgcataatcgactctacggaatgaatgaggaaggatggaggagggctgtgtgggagaagaatatgaagatgattgaacttcacaatcaggaatacagagagggaaagcatagtttcacaatggcaatgaatgcctttggcgacatgacatcagaggagtttagacaggtaatgaacggtttccaaaatagaaagccgagaaaaggaaaagtgtttcaggaaccactcttttatgaagcgccacgctctgtcgactggagagaaaagggttacgtgactcctgtgaaaaatcagggccagtgtggctcttgctgggccttcagtgctaccggggctctcgaagggcagatgttccgaaagacaggcagactgatctctctttccgaacaaaacctggtcgattgttcaggtccacagggaaacgagggttgtaatggcggacttatggattatgcttttcagtatgtgcaagataatggcggattggactcagaagaatcttatccttacgaggctacagaggaaagttgtaaatataaccctaagtattctgtagccaacgatactggatttgtcgacatcccgaagcaagagaaggcactcatgaaggctgtggccactgttggacccattagtgtcgctattgatgccggacacgaaagctttttgttctacaaagagggaatctatttcgagccagactgcagttccgaggatatggatcacggcgtgctcgtggtcgggtacggattcgagagtactgagtcagacaataacaagtactggctggtaaaaaacagctggggcgaagaatggggaatgggcggatatgtcaagatggctaaggacagacgcaatcactgtggcattgcgtctgcagctagctatcccacagtatag

SEQ ID NO: 27865 - DNA, 678 bp, Artificial Sequence
  Description of Artificial Sequence: Synthetic coding sequence
atgaaccccacattaatactggccgctttctgccttgggattgcttccgctactcttacctttgaccacagccttgaggcacagtggaccaagtggaaagccatgcataacagactctatggaatgaacgaggaagggtggcgcagggccgtctgggaaaagaatatgaagatgatagagttacacaatcaggagtacagggagggtaagcactcttttactatggcgatgaacgcctttggggatatgacctcggaagagttccgtcaagttatgaatgggtttcagaacagaaagccaaggaaggggaaagtattccaggaacccctgttctatgaggcgccaagaagcgttgactggcgagaaaaagggtatgtaactccagtgaaaaatcaaggccagtgtggttcctgctgggcatttagcgctacaggtgccctggagggccagatgtttaggaaaaccggacgcctgatcagtctgagcgagcagaatttagtcgattgcagtgggccacagggcaacgagggttgcaacggagggctcatggactatgcatttcaatacgtgcaggataatggtggtctcgattccgaagagagttacccatacgaagcaactgtcagcggcgctccttgccaccactcttccagcgcatttggcaggtggaccttgtag

SEQ ID NO: 27866 - DNA, 1002 bp, Artificial Sequence
  Description of Artificial Sequence: Synthetic coding sequence
atgaatccaacattaatccttgctgcattttgcctgggtatcgcctctgccacactgaccttcgaccactcacttgaagcccagtggaccaagtggaaggcaatgcacaacagactgtatggtatgaacgaggagggctggaggagagcagtgtgggaaaagaacatgaaaatgattgagcttcataaccaggaataccgggagggcaagcactcctttaccatggctatgaacgcctttggcgatatgacatctgaggagtttcgacaggtgatgaatggcttccagaatcggaagccaagaaagggaaaggtgttccaggagccactgttctacgaggccccaagatccgtagactggcgtgaaaaggggtatgtcacgcccgtcaaaaaccaggggcagtgcggctcttgctgggctttctcagcaacaggggctcttgaagggcagatgtttcgcaagaccgggaggctaatcagcctcagtgagcaaaatttggttgactgcagcgggcctcagggaaatgagggctgcaatgggggactaatggactatgcctttcagtatgttcaggataatgggggtctggattcggaggagtcttatccatacgaggcaactgaggagtcatgcaaatacaacccaaagtacagcgtggctaatgacacaggatttgtggatattcctaagcaagagaaggcattgatgaaggctgtcgccacagtgggccctatctccgtggctattgatgctggccacgagtctttcctgttttacaaagaagggatatacttcgagccagactgttcttcagaggatatggaccatggcgtgttggtggtgggctatgggtttgaatccacagaaagtgacaataacaagtactggcttgtgaaaaattcctggggagaggaatggggaatggggggttacgtcaagatggccaaggaccgcaggaatcattgcgggatcgctagcgctgccagctaccctactgtatag

SEQ ID NO: 27867 - DNA, 120 bp, Artificial Sequence
  Description of Artificial Sequence: Synthetic coding sequence
atgaacccaacactgatcctagccgcattttgtctcggaattgcaagtgccactttgacattcgaccactcattggaggctcaatggaccaaatggaaggcaatgcataacaggctgtag

SEQ ID NO: 27868 - DNA, 444 bp, Artificial Sequence
  Description of Artificial Sequence: Synthetic coding sequence
atggccgacgaactttctgagaaacaggtctacgacgcccacacaaaggagatcgatctcgtcaaccgggatccaaaacatctgaatgacgatgtggtgaagatagattttgaagacgtaatcgccgagccagagggaacccacagtttcgacgggatatggaaggcctctttcacgactttcacggtgaccaagtactggttctatcgccttctgtctgctctgttcggcatccctatggctctgatctggggtatttactttgccatccttagtttcctgcacatctgggccgtggtaccttgtatcaagtctttcctgattgaaatccagtgcatctcgcgggtgtatagcatctatgtgcacaccgtgtgcgaccctctgtttgaggcggttggaaagatcttctcaaatgtgaggatcaacctgcagaaagaaatatag

SEQ ID NO: 27869 - DNA, 444 bp, Artificial Sequence
  Description of Artificial Sequence: Synthetic coding sequence
atggcagatgagctgagcgaaaaacaggtttacgacgcacatactaaggagattgatctggttaacagggatcctaagcacctcaatgacgacgttgtcaaaattgatttcgaggacgtgatcgcggagccggagggaacacactctttcgacggcatttggaaagcgagttttaccactttcacagtcactaaatactggttttacagactcctgtcggcactgtttgggataccaatggcgcttatttggggaatttatttcgcaattctgtcatttcttcacatctgggccgttgtgccatgcattaaatcatttttgatcgagatccagtgtattagcagagtgtactccatttatgtccataccgtgtgtgaccctcttttcgaggccgtgggaaagatcttctccaacgtgcgcatcaacttacagaaggagatttag

SEQ ID NO: 27870 - DNA, 537 bp, Artificial Sequence
  Description of Artificial Sequence: Synthetic coding sequence
atgagcggcggaaaatacgtagactctgaaggccacctgtacacggttcctatcagggagcaggggaacatctacaagcctaataacaaagcaatggctgatgaactgtcagagaaacaggtgtatgatgcccacaccaaagaaatcgaccttgttaatagggacccaaaacacctgaatgacgatgtggtgaagattgactttgaggacgtcattgctgagcccgagggcacacactcttttgacggaatatggaaggcgtcatttacaacctttactgtgactaaatattggttttaccggctcctgtctgctttatttggtatccctatggcgctgatatggggcatttactttgcaatattgtcatttctccatatctgggccgtggtgccatgcattaagtcatttttgattgagatccagtgcatctccagggtgtatagcatatacgtgcataccgtttgcgacccactatttgaagcagtggggaagatcttcagcaatgtcagaatcaatctgcagaaggagatctag

SEQ ID NO: 27871 - DNA, 345 bp, Artificial Sequence
  Description of Artificial Sequence: Synthetic coding sequence
atggccggaggaaaagcagggaaggatagtggaaaagccaaggctaaggcagtaagcagatctcagagagccggactgcagttccctgtgggacgcatacaccgccatctgaaaaccaggaccacgagtcacggcagagttggcgctacagccgctgtgtatagcgccgctatactcgagtatcttacggcggaagtgctggagctggccggaaacgcttccaaggatctgaaggtgaaaaggattacaccaaggcatctccagttggctatacggggtgacgaggaacttgatagcctgattaaagcaaccatagccggaggggaaaagagacggtgttcatag

SEQ ID NO: 27872 - DNA, 339 bp, Artificial Sequence
  Description of Artificial Sequence: Synthetic coding sequence
atgggacttgagacggagaaggcggacgtacaacttttcatggatgacgacagctattctcatcatagtggtctcgaatatgccgaccctgaaaagtttgccgattcagatcaggatagggacccacaccggctaaatagccacctgaaggatttcaatgctttctgcaaagacctccctaatggctcagccttttcggctgacaacatggaagaatgtgaccggtgctaccattgttcaatcgtctatgaaaggaggaccatgctgctcttctgtcagcctgctactgagccgggactgaacacctggacccccggactggagatcggcattctctag

SEQ ID NO: 27873 - DNA, 342 bp, Artificial Sequence
  Description of Artificial Sequence: Synthetic coding sequence
atggggctggaaacggagaaagctgacgttcaactgtttatggacgatgattcctattcccatcattccggactggagtacgctgaccctgagaaattcgcggactccgaccaggatagggatccccaccgcctgaatagtcacttgaaactggggttcgaagatgtcattgctgagcccgttacgacacattcgttcgacaaagtgtggatttgtagccacgcgctgttcgaaatttcaaagtacgttatgtacaaatttcttaccgtgttcttagccattccgctggccttcatagccggtattctcttcgcgactctttcctgtctgcacatctggtag

SEQ ID NO: 27874 - DNA, 1038 bp, Artificial Sequence
  Description of Artificial Sequence: Synthetic coding sequence
atgcagcggctggttgcatgggatcctgcttgccttccactgccaccacctccaccagcctttaagagtatggaggtagccaacttctattatgaagccgactgtctagctgctgcctatggaggtaaggccgcaccagccgctcccccagctgccagacctgggccacgacccccagccggagagttagggtctatcggtgaccacgaaagagctatcgacttttccccatacttagaacctcttggtgcgcctcaggcccctgctcccgctaccgccacggacaccttcgaggccgcaccgccagcacctgcacccgcacccgcttcttcagggcagcaccatgacttcctgtccgatctcttcagcgatgactacgggggaaaaaactgcaaaaagcctgctgagtacgggtatgtttcacttggacggctgggggcagcaaagggcgctctgcacccgggatgttttgcccctctgcatcctccccctcccccaccccctcccccagccgaacttaaggcagagcccggattcgagcctgccgattgcaagcggaaagaggaggcaggggcaccaggtggcggagccggaatggcggctggcttcccttatgctctgcgtgcctacctgggctatcaggccgtacctagcggtagctcgggttccctgtccacgagcagctcttcctctccccctggcaccccatcccctgccgatgcaaaagcgccacccaccgcctgttatgctggggctgccccagctccgtcacaggtgaaatccaaagctaaaaaaacggtggataaacactccgatgagtacaagatccgcagggaaaggaacaatatcgctgttaggaagtcacgtgacaaagcgaagatgcggaacttggaaacacagcacaaggtcttggaactgacagcagagaatgaaagactccaaaagaaggtggagcagctgagtagggagttgtctactctgaggaatttgttcaaacagcttcctgagccccttctcgcatctagtggccactgttag

SEQ ID NO: 27875 - DNA, 2184 bp, Artificial Sequence
  Description of Artificial Sequence: Synthetic coding sequence
atggagggagatgcggtcgaggcaatcgtcgaagagtccgaaaccttcattaaaggaaaagagcgaaaaacttaccagcggaggagagaagggggtcaagaggaagatgcgtgccacctgcctcaaaaccagacagacggaggtgaggtggtgcaggatgttaatagttctgtgcagatggtgatgatggagcaactggaccccacactcctgcaaatgaagactgaagtcatggagggcacggtggcgccagaggctgaggccgcagtagatgatacgcaaattatcacactccaggtcgtgaacatggaggaacaacccatcaatataggcgaactgcagctcgtccaggttcctgtgccagtaacagtaccagtcgcgaccactagcgtcgaagaactgcaaggcgcttacgagaacgaggtaagcaaggagggactggccgagtcagaaccaatgatctgtcatacactgccgcttccagagggctttcaggtcgtcaaagtgggcgctaatggcgaagtcgagactctcgaacaaggtgaactccctccacaggaggacccctcatggcagaaggacccagattatcagcctcctgccaaaaaaactaaaaagacaaaaaagagcaagcttcggtacaccgaggagggcaaagatgtcgatgtgagcgtgtacgactttgaggaggaacagcaagaaggattactctctgaagtcaatgcagagaaggttgtggggaatatgaagccaccaaagccgaccaagatcaaaaagaaaggcgtgaaaaagacttttcagtgcgagctttgctcatatacctgtcctcggcgatcgaatctggacaggcacatgaaatcccataccgatgagcgccctcacaaatgtcatttgtgcggcagagccttcaggacggttaccctgctcagaaaccatcttaatacacacactgggactcggccacacaagtgtccagattgcgacatggcatttgtgacaagcggcgagctggtgcggcatcgacgttataaacacacccacgagaagccgtttaagtgcagcatgtgcgactatgcctccgtggaagttagcaaacttaagcggcatatccgttctcacacgggcgaacgtccatttcaatgttccctgtgttcttacgcctcccgagacacctacaaattaaaacggcacatgaggactcatagcggagaaaagccgtatgagtgctatatatgccacgctcggttcactcagagcgggacaatgaagatgcacattctccagaagcacaccgagaacgtcgccaagttccattgcccgcactgcgacaccgttatcgccagaaagtctgacctgggtgtccacctccgcaagcagcactcgtacattgagcaggggaagaagtgtagatattgtgacgccgtgtttcacgagcgttatgctttgattcagcatcagaagtcccacaaaaatgagaagagatttaagtgcgaccaatgcgattatgcatgcaggcaggaacggcacatgatcatgcacaagagaacccacactggcgagaagccatatgcatgtagtcactgtgataagacctttcggcagaaacagttgctggacatgcacttcaagaggtaccatgatcctaactttgtgcccgctgcattcgtgtgtagcaagtgcgggaagacatttactcgcagaaataccatggcgcgacacgccgacaactgtgctggacccgacggcgtggagggcgaaaatggcggtgaaacaaaaaagagcaagaggggtcgaaagcgtaaaatgcgttctaagaaggaagattcctcagattccgagaacgcggagcccgatttggacgataatgaagatgaagaagaacccgctgtcgaaatcgagcctgagcccgagccgcaacccgtgacgcctgcaccgccacctgctaaaaaaagacgcggaaggccacctgggcgaacgaaccagccaaagcagaatcagccaacagcaattattcaggtcgaagatcaaaatactggcgctatcgagaacatcatcgtggaggtgaaaaaagagccagacgccgaacccgctgaaggagaggaggaagaagcccagcctgcagccaccgatgcacctaacggagatctcacacctgagatgattctcagcatgatggatcgatag

SEQ ID NO: 27876 - DNA, 1200 bp, Artificial Sequence
  Description of Artificial Sequence: Synthetic coding sequence
atggctttcgtgaccagcggggaactggtccgacacagaagatataagcacactcatgagaagccctttaagtgttcaatgtgcgattatgcctccgtggaggttagtaagctgaagcgccatattcggagccatacgggtgagagaccctttcagtgtagcttatgttcctatgcctcacgggatacgtataaactgaaacggcatatgaggacccactccggcgaaaagccctatgaatgctacatttgccatgctaggttcactcagtcagggactatgaaaatgcacatccttcaaaagcatacagagaacgttgcaaagtttcactgtccccactgtgatacagttatcgccagaaaatccgacctgggagtgcacctcaggaagcaacattcgtacattgagcaagggaagaagtgcagatattgtgacgccgtgttccacgaaagatacgcccttatccagcaccagaagtcccacaaaaatgagaagcgcttcaagtgtgaccagtgtgattatgcctgcagacaggagcgccacatgatcatgcacaagcggacacataccggcgaaaaaccttacgcttgtagtcattgtgataaaacgttcagacagaagcagttacttgatatgcacttcaagcgttatcatgacccaaacttcgtacccgctgcattcgtgtgtagtaagtgtggaaaaaccttcactcggagaaacactatggcaagacatgctgataattgcgctgggccagacggtgtggaaggagagaacggaggagaaaccaagaaatctaagcgtggaagaaaaaggaaaatgcggtctaagaaggaggattcatccgactctgagaacgccgagccggatctggacgacaacgaagacgaagaggagcccgctgtggagatcgagcccgagcccgagccacagccggtgactccggcacccccaccagctaagaagagacgcggtaggcccccaggcagaacaaaccagcctaaacaaaaccagccgacagcaattatccaagttgaggatcaaaacacaggagcgatcgaaaacattatcgtggaggtgaaaaaagaaccagatgccgagccagccgagggcgaggaggaggaggcacagccagccgcaacagacgctccgaatggggatctcacacctgagatgattctgtccatgatggatcggtag

SEQ ID NO: 27877 - DNA, 1128 bp, Artificial Sequence
  Description of Artificial Sequence: Synthetic coding sequence
atggaaagggcctcctgtctcctccttctcctgctccctctggtgcacgtgagtgcaaccacacccgaaccatgtgaactagatgacgaagactttagatgcgtctgtaatttttccgagcctcagcccgactggtccgaggccttccagtgtgtatctgctgttgaggtcgagattcacgcgggaggactcaatctggaaccatttctaaagcgggttgatgcggatgcggatccacgccagtacgccgacaccgtgaaggccctcagggtccggagactgaccgtgggagcagcgcaggtgccagcccagcttctcgtgggcgcactgagagtgctggcatattcgcgcctgaaggagctgacacttgaggacttgaaaatcacagggacaatgccgcctctccccctggaagccacaggtctggccctgagttccttaagattgcgtaacgtttcgtgggctactggacgtagctggctcgctgagctccagcaatggctgaagcctggactaaaggttctgtcaattgcacaagcccactctccagctttttcctgtgaacaagtaagagcttttcctgctcttacatcgctagacttatccgacaatcccggactcggagagcggggtctgatggcagcgctgtgcccccacaagtttccagctattcagaacctggcgctgcgaaatacaggaatggaaacacccactggcgtgtgtgccgcactggccgcagccggagtccagccgcactctctggatctctctcacaacagcttacgggctacagtgaatccctccgctccacggtgcatgtggtctagcgcactgaacagcctgaaccttagctttgccggactggagcaggtgccaaaaggactgcccgctaagctgcgggtgctggatctctcgtgtaatcgacttaacagggctccacagcccgatgagctccccgaggtggataatctcaccctagacggcaaccccttcctggtcccgggaaccgccctaccccacgaaggatccatgaatagcggagtcgtgccagcctgtgctaggagcaccttatccgtaggtgtctcgggcactctggtcctgttacagggtgctcgaggcttcgcctag

SEQ ID NO: 27878 - DNA, 1128 bp, Artificial Sequence
  Description of Artificial Sequence: Synthetic coding sequence
atggagcgggcatcttgtctgctgctgctgctactgccactggttcacgtgtcggccaccacccctgaaccgtgcgagctggacgacgaagacttcagatgtgtttgtaatttcagcgagccccagccagattggtcagaagccttccaatgcgtgtcagcggtggaggtggaaatccacgccggtgggctaaacctggagccttttttaaagagagtcgatgccgatgcagatcctaggcagtacgccgatactgtgaaggcccttcgcgtgaggcggcttacggtgggagctgcccaggtgcccgctcaactccttgtgggagctctgcgagtattagcatatagtcgactgaaggagctcacgctggaagatctcaaaattactggcacgatgcctcctctgcccctggaggctacaggcctggctcttagcagcctcagactgcggaacgtgtcttgggctacaggcaggtcatggttagcagagctacagcagtggcttaagcctgggcttaaggtattgtcaatcgcccaagcccacagcccagctttctcttgtgagcaagttcgcgcatttcccgcattgacgtctttagatctttccgataatcctggcctcggggaaagaggcttaatggcggcactgtgcccacacaagttccctgcaatacagaacctcgcccttcggaatactgggatggaaactcccacgggagtgtgcgctgccttagcagctgccggtgtacagcctcactcgttagatctgagtcacaactcattaagagccacagttaaccctagcgctccacggtgcatgtggtcttctgctctgaacagcctcaatctttcatttgctgggttggaacaggtacctaagggattgcctgctaaattaagagtactggatctcagctgcaacaggctgaaccgcgcaccgcagccagacgaacttcccgaggtcgataatcttaccttagacggaaacccttttttggtgcccggaactgccctgccccatgaaggaagcatgaactcaggggttgtccccgcatgtgctaggtcaacattatcagtgggtgtgtccggaactttagtcctgctgcagggcgctcgcggttttgcatag

SEQ ID NO: 27879 - DNA, 402 bp, Artificial Sequence
  Description of Artificial Sequence: Synthetic coding sequence
atgagcttcccctgtaagtttgtggcgtctttcttgctgatatttaatgttagctccaagggtgctgtgagtaaagagatcacaaacgccctagagacatggggcgcattgggtcaggacatcaatttggacattccttcattccaaatgtctgacgatattgatgacatcaagtgggaaaagacctcagataagaaaaagatagcccaattcagaaaggaaaaagaaacattcaaagaaaaagatacttataaactgttcaaaaacggaacactcaagattaaacacctcaaaactgatgaccaggacatttacaaggtttccatttacgatacaaagggcaaaaacgttctggaaaagatctttgacctaaagatccagggcaaatgttcctttccctag

SEQ ID NO: 27880 - DNA, 1056 bp, Artificial Sequence
  Description of Artificial Sequence: Synthetic coding sequence
atgagttttccgtgtaagttcgttgcatcattcctgttgatcttcaacgtgtcgtcaaagggcgctgtgtcaaaggagatcacaaacgcacttgaaacctggggtgccctggggcaagatatcaacctggatattccttctttccagatgtccgatgatatcgatgacattaagtgggaaaaaacatcggacaagaaaaagatcgcccaattccgcaaggagaaagaaacatttaaggaaaaggatacctacaagctgttcaaaaacggaactctgaagatcaaacacctgaaaacagatgaccaggacatttacaaagtatctatctatgacaccaaaggaaaaaatgtcttagagaagatcttcgacctaaagatccaagaacgcgtttctaaacccaagatctcatggacctgtatcaacactaccctgacctgtgaagtcatgaacgggacagaccccgagctgaacctctatcaggacggcaaacacttgaagctatcccaacgggtgattacacacaagtggaccacatctctgagcgccaagttcaagtgtacagctgggaataaggtctctaaggaatcgagcgtcgaacctgtatcctgccccgagaagggcctggacatatacctcataatcggcatatgtggcggagggtcactcttgatggtttttgtggcgttgctggtgttttacataaccaagaggaagaaacagaggtctcgccgaaacgacgaagagttggagacaagggcacatagagtggccacagaggaaaggggaaggaagcctcatcaaatcccagcgtccactccacaaaaccccgcaacctctcagcaccctccaccacctccaggccatcgctctcaggcgccaagccatcggccaccgccacccggacatcgggtgcagcatcagccacagaagagaccgccagccccaagtggaacacaggtacaccagcagaaaggcccaccgctgcccaggcctcgcgtgcaaccaaagccaccacatggagccgctgaaaatagtctctctcccagctcaaactag

SEQ ID NO: 27881 - DNA, 2544 bp, Artificial Sequence
  Description of Artificial Sequence: Synthetic coding sequence
atgcatctgctgggtccatggctactgctgctcgttctggaatatctcgcattctcagattctagtaaatgggtgtttgagcaccctgagactctgtacgcttgggagggtgcttgcgtctggattccatgcacttatcgcgcactggacggggatctcgagtcttttattctttttcataacccagagtacaacaaaaatacgagcaagtttgacggaacacggctgtatgagtcgacaaaagatggcaaggtgccctctgagcagaagagggtgcagttcctgggggataagaataagaactgtaccctgtctatccacccggtgcatctgaacgacagcggccaactgggactccgaatggaaagcaaaacagagaagtggatggagcgaatccatttaaacgtgtccgagcgccctttcccgcctcacatccagctaccgccagagatccaagagagccaagaagtgactctgacatgccttcttaatttctcctgctacggatacccgattcagttgcaatggctgttggagggagtgccgatgcgccaggccgcagtgactagcacctcactgactatcaagagcgtcttcactcggagtgagctgaaatttagcccacagtggtcccaccacggcaagatcgtaacatgccagcttcaggatgcggatggaaagttccttagcaatgacaccgtgcagcttaacgtgaagcacacccccaagctcgagattaaggtcaccccatccgacgccatagttagagagggagactcagtaacaatgacctgcgaggtatcatcaagcaaccccgagtacaccaccgtgagctggcttaaggatggcaccagcctaaaaaagcagaacacctttacactgaacttgcgagaggtaacaaaggatcaaagtggcaagtactgctgtcaagtgtctaacgatgtggggccaggcaggtctgaagaagtgttccttcaggtccagtatgcgccagagccctccacagttcagatactccactcgcccgctgttgagggaagccaggtagaatttctatgcatgtctctcgcaaacccactccccactaattatacatggtatcataacggaaaggagatgcagggtcgaaccgaggagaaggtccatattcccaaaattctgccgtggcacgcgggaacctattcgtgtgtggcagaaaacatccttggcaccggacagcgaggtcccggagccgagctggacgtccagtatccacctaaaaaagtaactacagtcattcagaatccgatgcctatccgagaaggtgatacagtgacactgtcttgtaactacaattctagtaatccaagcgtgacacggtatgaatggaaaccccatggggcttgggaggaaccatcactgggcgtgttgaagatacagaatgtaggatgggataatactaccatcgcctgcgcggcatgcaatagctggtgttcctgggcatctcccgtggcactgaatgtgcaatatgccccaagggatgtgagagtaagaaaaattaagccattatcagagatacactccgggaactcagtgagcctccagtgcgacttctcctcatctcatccaaaggaggtccagttcttctgggagaagaacggcagactcctaggaaaagaaagccagctgaacttcgatagtattagccccgaggatgcagggtcctactcttgctgggtgaacaatagcatcgggcaaaccgccagtaaagcgtggaccttggaggtcctctatgcgcctagaagactaagggtgagcatgagccctggcgatcaggtcatggagggcaagtcagccaccctgacttgcgaatcagacgctaacccccctgtcagccattacacctggttcgactggaataatcagtccctgccgtaccatagccagaaattgagacttgaaccagtgaaggtgcaacacagcggagcttattggtgccaggggaccaacagcgtaggcaaggggcgttccccattgagcacacttaccgtgtattactcacccgagacgatcggtcggagagtggccgtcggtctgggaagctgcctagccatcttgatcctcgccatctgtggtctcaaactgcaacgaaggtggaaaagaactcagtcccagcagggcctacaagaaaacagtagtggccagtctttcttcgtgcggaacaagaaggttcgacgtgctccgctctcagaggggccacatagtcttggttgttataaccccatgatggaagatgggatatcctataccactttgcgatttcctgaaatgaatattcctcgaacgggcgatgccgagtcctcggagatgcagcggcctcctcctgactgcgatgatacagttacctattcagcactccacaagcggcaggtgggagattatgaaaacgtgatcccagatttccccgaagatgaggggatccattactccgagctgattcaattcggtgttggcgaacgaccacaggcgcaggaaaacgtcgattatgtgattctcaagcactag

SEQ ID NO: 27882 - DNA, 1989 bp, Artificial Sequence
  Description of Artificial Sequence: Synthetic coding sequence
atggagagcaagaccgagaaatggatggagcgcattcatctaaacgtgtctgagcgcccattcccacctcacattcagctgcctcccgagatccaggaaagtcaggaggtgacacttacctgcttgctgaatttttcttgctatggctatccaatccagttgcaatggttgcttgaaggggtgccaatgaggcaggcggcagttactagtacaagcctgacaattaagtcagtcttcacaaggagcgagctcaagtttagtccccagtggagccatcacggtaaaatcgtgacgtgccaactgcaggacgcagacggaaagtttctcagtaatgacactgtgcagttgaacgttaaacatacccccaaattagaaatcaaagtgacacctagcgatgctatcgtgcgggaaggagactcagtcactatgacctgcgaggtcagctcttccaatccagaatacacaacagtgtcatggttgaaggatggaacctccctgaagaagcagaacaccttcaccctgaacctccgagaggtgacaaaagaccagtctggcaagtattgctgccaagtgtcgaacgacgtcggacctggtcgctcagaagaagtgttcctgcaggtacagtacgcccctgagccttcgacagttcagatcctccatagtcctgctgtggagggtagtcaggtcgagttcttgtgcatgtccttggctaaccctttgcccactaactacacatggtaccataatggcaaggagatgcagggcaggacagaggagaaagttcacataccaaagatcctgccatggcatgccggtacttattcttgtgtggcagaaaatatcttggggacaggccagcgtggtccgggagctgagcttgatgtgcagtatcccccaaagaaggtcaccaccgtcatacagaatcccatgcctatccgggaaggtgatacggtgacactgagctgcaactataattcatctaatccctccgtcacgcggtacgaatggaaacctcatggagcatgggaggagccatcgctaggcgtgctgaaaatacagaatgtgggctgggacaacacaactattgcctgcgcagcatgcaacagttggtgttcatgggcatcacctgtagccctgaatgtccagtatgcccctagggatgtgcgagtgcggaagattaaaccgctcagcgagatccattccgggaatagcgtgtcgctccagtgcgactttagctcaagccatcccaaagaggtccaatttttctgggagaaaaacggacggttgctcggaaaggagagtcagctaaattttgatagcatttcacctgaggacgccggatcctacagttgctgggtgaataattccattggacagacggcatccaaggcttggacactggaggttctgtatgctcctaggagactgagggtgtctatgtccccgggtgaccaggtgatggaaggcaagagtgcgactctaacttgtgaaagtgatgcgaatcctccggtgtcgcactatacctggtttgattggaacaatcaaagcttaccgtatcactctcagaagttgcgcctggaaccagtcaaagtacagcactctggggcttactggtgccagggcaccaacagcgtggggaagggcaggtctcccctcagcacactcacggtgtactactcccctgagaccatcggtagaagggttgccgtgggcttgggatcctgcctggccatcctgattctggcaatttgtgggcttaagttgcagcggagggacgcggaaagctccgaaatgcagcgtcctcctccagactgcgacgatacggtgacatactctgccctccacaaacgccaggtgggagactatgaaaatgtcatccccgattttcccgaggacgaaggtatacattattcggaacttattcaatttggagtaggagaaagaccacaggcacaggaaaatgtcgactacgtaatcttgaagcactag

SEQ ID NO: 27883 - DNA, 2013 bp, Artificial Sequence
  Description of Artificial Sequence: Synthetic coding sequence
atgcacctcctcggtccatggctcctacttctggtcttagagtaccttgccttctctgacagttccaaatgggtatttgagcatcctgagaccctttacgcttgggagggcgcttgtgtttggataccgtgtacctacagagcgttggacggggaccttgagtcattcattctgtttcataacccggagtataataagaataccagtaagttcgacggtactcggctgtacgaaagcaccaaggatgggaaggtgccatccgagcaaaagcgggtgcaattcttaggcgataaaaataaaaattgtacattgtcaattcaccctgtccacctgaacgattctggacagttgggcctcaggatggagtccaaaacagaaaaatggatggaaagaatccacctgaatgtatccgagaggccttttcctcctcacatccaactgcctcctgagatccaagagagtcaggaggttaccctgacctgcctccttaacttttcatgctacggctaccccatacagttgcagtggctcctggagggagtcccaatgcggcaggcagctgtaacttcaacttcattaaccattaagtcagtttttacaagaagcgagttgaagtttagtccccagtggtcccatcatgggaagatcgtgacctgtcaactgcaggatgcagacgggaagtttttaagcaatgataccgtacagctgaatgtgaaacaccccccaaagaaggttactaccgtcattcagaaccctatgcccatcagagagggggataccgttacattgagctgtaattacaacagtagtaatccaagcgtaacccggtacgagtggaaaccccacggcgcttgggaagagccttccctaggggtgctgaaaatccagaatgtggggtgggataatacaactattgcatgcgcagcttgcaatagttggtgcagttgggcaagccccgtggcacttaatgtccagtatgccccacgggatgtccgtgttcggaaaattaagcccctatccgagatccacagcggaaatagcgtatccctccagtgcgacttctccagttctcaccctaaagaagtgcagttcttttgggaaaagaatggccgactccttggtaaggaaagtcagctgaactttgactcgatcagccccgaggacgctggctcctattcctgttgggtgaataattctattggacagacagcaagcaaggcttggacactcgaggtgttgtatgcacctagacggctcagggtctctatgtcgcctggtgatcaagtcatggagggcaaatccgccacacttacttgcgaatccgatgctaatccgcctgtctcacattacacctggtttgactggaacaaccagtcccttccatatcattcccagaagctccggctcgagcctgttaaggtgcagcattccggagcctattggtgccagggtaccaatagcgtgggaaagggacgaagccccctctccactctcacagtctactacagccccgaaactataggaagaagggtggctgttggccttggtagttgtctggctatactgatactggctatctgtggcttgaagctccagcggcgatggaagaggactcagtcccaacaggggctccaggaaaactcctccggtcaatctttttttgtgcggaacaaaaaggtgcggcgtgcgccattgtcggaggggccacactctctcggttgctataatccgatgatggaggacggaattagctatactacgctccggtttccagaaatgaatataccaagaaccggggatgctgagtcaagcgagatgcagcggccaccccctgattgcgacgacacggttacctacagcgcactgcacaaacggcaagtgggcgactacgagaatgtcatcccagactttcccgaggatgaaggaatccattacagcgaactcattcagtttggagtcggtgagaggccccaggcccaggaaaatgtagactacgtcatattaaagcactag

SEQ ID NO: 27884 - DNA, 2028 bp, Artificial Sequence
  Description of Artificial Sequence: Synthetic coding sequence
atgtccctttggctgttggagggtgttccaatgagacaggctgccgtcaccagtacttccttgaccatcaaatcagtattcacccgaagcgagctcaaattttctccccagtggagccaccatgggaaaatcgtcacgtgccagttgcaggacgccgatgggaagtttttgagtaacgacaccgtgcagctgaatgtcaagcacactcctaaactggagatcaaggtgaccccctccgacgcaatcgtccgggaaggcgattcagtaacaatgacctgtgaggttagctcaagtaatcccgaatacaccactgtcagttggctaaaggatggcacctctctgaagaagcaaaataccttcactctcaatctgagagaggttactaaagatcaatcaggaaaatactgttgtcaagttagcaacgacgtcggaccgggtagatccgaggaagtgtttctgcaagttcagtacgctcctgagccctctacggtccagatcctccacagcccagccgtcgaaggttcacaggtagaatttctctgcatgagtctcgcaaacccgctgcctaccaattacacgtggtatcacaatggcaaggagatgcagggcaggacagaggagaaagtgcatatccctaaaattctgccttggcatgccggaacttactcttgtgttgccgaaaatattctcggaactggccagcgcggtcccggagctgagcttgatgtacaatatccacctaaaaaggtcaccacagtcattcaaaaccccatgcctatcagagaaggggataccgtaactctcagctgcaattacaactcctctaatccttctgttacgaggtacgagtggaaaccccacggcgcatgggaagaaccgagccttggcgtattgaagatccagaatgtaggctgggacaatacaaccatcgcatgcgccgcatgcaattcttggtgctcttgggcttctcccgtggctctgaacgttcaatacgcccctcgcgatgtacgcgtgcggaagattaaacccctgagtgaaattcattctggaaatagcgtgagtttacagtgtgacttctctagctcccacccgaaagaggttcagttcttctgggagaagaatggaaggctgctgggaaaggaatcccagctgaatttcgatagtatttcccccgaggatgctggtagttactcctgttgggtcaacaacagcatcggccagaccgccagcaaagcgtggaccctggaggtgctttatgcccctagacggcttcgggttagtatgagccccggtgaccaagtgatggaaggcaagtcagctaccttaacttgtgagtcagacgctaatccaccagtgtcgcattacacctggttcgattggaacaatcaaagtttgccgtatcactctcaaaaactgcgtttggaacctgtcaaggtccagcacagcggagcttattggtgccagggcaccaatagcgtgggtaaaggccgatcaccactctccacacttacagtgtactacagcccagaaactattggccgtagggtggccgtgggtctgggatcttgtctggcaattctgattctagccatctgcggactgaaattgcagcgccgttggaaacggacccagagccagcagggactgcaggaaaacagttcgggccaatctttcttcgtgcgaaataaaaaagtgagacgagctccactcagtgaggggcctcactccctgggctgctataaccctatgatggaagacggcatatcatacacaaccttaaggttcccggaaatgaatataccacggactggggacgcagagagctccgagatgcagagaccgccaccagattgtgacgatactgtcacctattcagccctgcacaaacgacaggttggtgattacgaaaatgtgattcccgactttccagaagatgagggcatacactactccgagctcattcagttcggagtgggagagcgtccccaggctcaggaaaatgttgactacgtcattttaaagcattag

SEQ ID NO: 27885 - DNA, 2280 bp, Artificial Sequence
  Description of Artificial Sequence: Synthetic coding sequence
atgcacctcctggggccatggcttttgctactggtattagaatacttggctttctccgacagctccaaatgggttttcgagcatcccgaaacattgtacgcctgggaaggtgcatgtgtgtggattccatgcacttaccgcgctctggacggggatctggaatcatttatcctgtttcacaaccctgaatacaataagaatacaagcaagtttgatggtactcgtctctatgagagtacaaaagacggcaaggtaccaagcgagcaaaagagggtccaatttctaggggataagaataaaaactgcacattgagtatacatccagtgcatttaaacgactccggtcagctgggtctccgcatggaaagtaaaaccgagaagtggatggaacgtatacacctgaacgtttccgagcggccattcccgcctcatattcagctcccacctgagatccaggaatcacaggaggtgactctgacctgccttctgaacttcagttgctacggatatccgattcagttacaatggcttttagaaggcgtccctatgcggcaggctgccgttacctccacgtcattgactattaaaagcgtcttcactcgatccgagttaaaatttagccctcagtggagccatcatggaaagattgtcacctgccagctacaggacgccgacggtaagttcctgagtaacgatacagttcagctcaatgtgaagcacaccccaaagctggaaattaaggtcacaccatccgatgcaatcgtacgagagggagactctgtgactatgacctgcgaggtctcaagcagtaacccggagtataccaccgtatcttggctgaaggatgggacgtctcttaaaaaacagaataccttcaccttaaacctcagggaggtgactaaagatcaaagcggtaaatattgctgtcaggtgtcaaacgacgtcggacctgggcgttccgaggaagtttttctgcaggtgcaatacccaccaaagaaagttacaaccgttatccagaatccaatgcccatccgtgaaggggatactgtgaccttatcatgcaactataatagcagtaatccaagcgtgacacgctacgagtggaagccacatggggcttgggaagaaccgtcactcggggtgttgaagattcagaacgtgggatgggacaacaccacaatcgcttgtgctgcttgcaactcttggtgctcctgggcatcccctgtcgcacttaatgtacagtatgcccctcgggacgtcagggttagaaagataaagcccctgtcagaaattcactctggaaacagcgtttccctccaatgcgacttctcctctagtcatcccaaagaggtgcagttcttctgggaaaaaaatggacgtttgctagggaaggaatcacaattgaatttcgatagtatcagcccagaggatgccggttcttatagttgctgggtcaataactccatcggtcagaccgctagcaaagcctggacattagaggtactctatgctcccagacgcctccgcgttagcatgagccccggtgatcaggtcatggaaggcaagtcagccaccctcacttgcgagtctgacgccaacccaccggtcagtcactacacgtggttcgactggaacaaccagagcctgccctatcacagtcagaagctgcgtctggagcctgtaaaagtgcaacacagcggggcttactggtgtcaaggcacaaattccgtgggtaagggacgcagcccgctgagcaccctgacagtatattattcccctgagactattgggagacgcgtcgcagtagggttgggcagctgcctggccatcttaatactagccatatgtggcctgaaattgcaaagaaggtggaagcgcacccagtctcagcagggtttgcaggagaacagtagtgggcagtctttcttcgtgaggaataaaaaggttaggcgagcccctctctccgagggaccccactcactcggatgttacaatccgatgatggaggacggaatctcctataccaccctcagatttccagaaatgaacatacctcgcacgggcgatgctgagtctagcgagatgcagagacccccaccagattgtgatgataccgtcacgtattctgcgctgcacaagcggcaagtcggcgactacgaaaacgttattcccgacttccctgaagacgagggcattcattactctgagctgattcaattcggagtcggagaacgaccgcaggctcaggaaaacgttgactatgtgatacttaagcactag

SEQ ID NO: 27886 - DNA, 2256 bp, Artificial Sequence
  Description of Artificial Sequence: Synthetic coding sequence
atgcacctcctgggcccttggctgctgctactggttttggaatacctcgcattcagtgattcttctaaatgggtgtttgaacatccagagacgctgtacgcctgggagggggcatgcgtctggattccttgtacttacagagccttagatggcgacctggagtccttcatcctgttccacaatcctgagtacaacaaaaacacatccaaattcgatggtacaaggctatatgaatccacaaaggatgggaaggtgcctagtgaacagaaaagggtgcagtttctcggtgataaaaacaagaactgcactctgagcattcatcccgtgcatctgaatgatagcggccaactgggtcttcgaatggagtccaagactgaaaaatggatggagcgcatccacctcaatgtgtctgaaaggccattcccccctcacattcagctgccccctgagatccaagaatcccaggaagtgactctcacatgccttctcaattttagttgctacggatatcctatccagctgcagtggcttctggaaggcgtccctatgagacaggcggctgtgacaagcacttccctaacaattaaatctgtatttactcggtccgaactaaagttctccccacagtggtcccaccatggaaagatagtaacgtgtcagctgcaggacgcagatggcaaatttctgtctaatgacacagtccagctgaacgtcaagcacaccccaaagctggagatcaaagtgactccgagcgacgctatcgtgcgggagggtgactcagtgaccatgacatgcgaagtgtcttcatctaacccagaatatactaccgtgtcgtggctaaaagacggaacgtccctgaagaagcagaatacctttacgctgaatcttcgtgaagttacaaaggaccagtccgggaagtattgttgccaggtgagtaacgacgtagggccaggtcgatcggaggaggtcttcctgcaggttcagtatgcacccgagccaagcaccgtgcagatactccattcaccagccgtggaaggcagccaggtcgagtttctgtgcatgtcactggcaaatcctctacctactaattacacatggtaccacaacggtaaggagatgcaaggcagaaccgaggaaaaggtccacattcccaaaatcctcccctggcacgccggtacatactcatgtgtggctgaaaacatacttgggactggccagagaggccctggtgcagaactggacgtgcagtaccctccaaaaaaagtgacgacagtgatccagaatccgatgcccataagagagggagatacagtgacgctgtcatgcaactataattcctcaaatcccagtgtgacacgctacgaatggaagcctcatggtgcctgggaagagccttccctcggcgtgctgaaaatacaaaatgtgggttgggataacactacaatcgcctgcgcggcatgtaactcttggtgctcttgggcaagcccggtggcactcaatgttcagtacgcgcctagagacgttcgggtgcgcaaaatcaagcctcttagtgaaatccactcaggaaattccgtgtcccttcaatgcgatttcagcagctctcatcctaaagaagtgcagtttttttgggagaagaatgggagactgcttggaaaagagagccagctcaactttgattcaatctcaccagaggatgctgggtcctactcttgctgggtcaacaattccatcggacagacagcatccaaagcttggacactggaggtcctgtacgctcctcggagactgcgggttagcatgtcacctggggaccaggtgatggaggggaaatcagctaccctgacctgcgagtccgatgcaaatcccccagtgagtcactatacctggttcgattggaacaatcagtccctaccttatcatagccagaagctgagactcgagccagtaaaggtgcagcactcaggcgcatactggtgccaaggcacgaatagtgtgggaaaaggcaggtcaccactttctacattaacagtctattattcacccgagaccattggtcggagagtggcagtgggcctgggaagttgcctggctatccttattttagctatctgcggcctcaaactgcagagacgatggaaacgaactcagagccaacagggactgcaggagaactcctcagggcaaagcttctttgttaggaataaaaagcgctgtcgcgtgctgcgtgacgccgaaacatctcccggattgaggtag

SEQ ID NO: 27887 - DNA, 783 bp, Artificial Sequence
  Description of Artificial Sequence: Synthetic coding sequence
atggcacgccctcacccctggtggctctgtgtgctgggtaccctcgttgggctttccgcaaccccggctccaaagtcgtgccccgagcgacactactgggcccaaggcaagctctgctgtcaaatgtgtgagccaggaacttttcttgtcaaagattgtgatcagcataggaaggccgctcagtgtgatccctgtattccaggcgtttcattcagccctgaccatcatactcgccctcactgtgagagctgcaggcattgcaactccggcctgttggtgagaaattgtaccatcaccgccaatgcagagtgtgcctgcaggaatgggtggcagtgccgtgataaagagtgtacggaatgcgatccgctcccaaaccctagcctaaccgctcgatctagccaagctctgtctcctcacccccagccaacacatcttccatacgtgtccgaaatgttagaggccaggacagcaggacacatgcaaacactggctgatttccgtcaattacccgctcggacactgagcacacactggcctccccagagaagtctttgttctagcgattttattcgcatccttgtgatcttctctggcatgttcctggtcttcactcttgctggggctctcttcctacatcagcgccgtaaatataggagcaataaaggggaaagccccgttgaacccgcagagccttgtcactactcgtgccccagagaagaggagggaagcacaatcccaattcaagaagattaccgtaaaccggagccagcctgctccccatag

SEQ ID NO: 27888 - DNA, 1158 bp, Artificial Sequence
  Description of Artificial Sequence: Synthetic coding sequence
atgctagtgaggcgcggagccagagccggaccacggatgcccagaggctggaccgccctttgccttctctctctcctgccctcagggttcatgtccctagataacaacggaaccgccacaccagaactgccaacacaaggcactttttcaaatgtctctaccaacgtttcctaccaggagactaccacacccagtacgctggggagtacgagcctgcaccctgtgtcacagcatggtaatgaggccactaccaacattacggaaaccaccgtaaagttcacatccacctctgtcatcacatccgtgtacgggaacactaactcctccgtgcaatcacagacatcagttatcagcaccgtctttacaacaccagccaacgtgtctactcctgaaacgacgctcaagccgtctctgtctcctggcaacgtatcagacctgagtactactagcaccagtctggcgacttcacccaccaagccatataccagttccagccccattttgagcgacataaaagccgagattaaatgctctggcattagggaggtaaaactgacccaggggatctgcctagagcagaacaaaacttcttcttgcgctgaattcaaaaaagatagaggagaggggctcgcccgagtgctctgcggcgaggaacaggctgatgctgacgcgggtgcccaggtctgctccttactgctggcacagtccgaggtccgacctcaatgtctactcctggttctagccaaccggacggagatctctagcaagctgcagctaatgaagaagcaccaatcggatctgaaaaagttgggaatactggactttaccgagcaagacgtcgccagtcaccagtcctatagccaaaagaccctcatcgctctcgtgacaagcggcgctttgctggccgtgcttggtataacagggtatttccttatgaaccgcaggagttggagtccgaccggcgaacggctgggtgaggacccctattacactgaaaatggcggtgggcagggctattctagtggacctggcacttcgcctgaagcccaaggaaaagcgagcgtaaatagaggggctcaggagaatggaacaggccaagccacatctaggaatggacacagcgccaggcaacacgtggtggccgatactgagctctag

SEQ ID NO: 27889 - DNA, 987 bp, Artificial Sequence
  Description of Artificial Sequence: Synthetic coding sequence
atgctggttagacgcggtgcgagagctgggccacgaatgccgagaggctggacagctttgtgcctgttatccctactgccctcaggatttatgtcactggacaataacggcacagcaaccccagagctgcctacacagggcacgttttcaaacgtttccacgaatgttagctaccaagaaaccaccacaccgagtaccctggggtccacatctctgcaccccgtctcccagcacgggaatgaggctactactaatatcaccgagaccaccgtcaagttcactagcacatctgtgatcacaagcgtgtacggtaatactaattcttccgtccagtcccagactagcgtgatcagcaccgtgtttacaacccctgccaatgtgagcacgccagaaacaaccctgaagcccagcctatcgccaggcaatgtttccgatctgtctactacttcaacaagcctagccacaagtcccacaaaaccgtacacaagtagtagccctattttgagcgacatcaaagcagagattaaatgttccggaatccgcgaggtgaaattgacgcaaggcatctgccttgaacaaaacaagacatcatcctgtgccgaatttaaaaaagacagaggtgagggtttggctagagtgctttgtggcgaggagcaggccgacgctgatgccggagcgcaggtttgcagtctcttgctggcccaatctgaagtgcgccctcagtgcctgcttcttgtacttgctaacagaactgagatcagcagtaaactccagcttatgaagaaacaccaaagcgaccttaaaaagctagggatccttgattttaccgagcaggatgttgcctcccaccagagttatagccagaagactttgattgcgctggtgacatccggcgcactattggcggttttgggtatcacaggttacttcctgatgaatcgaaggagctggagccctacaggcgaaagactcgaactagagccttag

SEQ ID NO: 27890 - DNA, 684 bp, Artificial Sequence
  Description of Artificial Sequence: Synthetic coding sequence
atggacttcgggccaggccgtctgttcagattcttctcttactgtgtagtagctcatatccaacttgccgtgttctttttctcagtcggaattctcgagacaaggattctgcttgctgacggcgcagagtttaagaaggacagaggagaggggctggcacgagtgctttgcggggaggaacaggcagatgctgatgctggtgctcaagtgtgttccctcctgctagcacagtccgaggtccggccacagtgccttcttctcgtgctcgccaacaggacagaaatcagcagcaagctgcaactgatgaagaaacatcagtctgacctgaaaaaactggggatcctggacttcacggagcaggacgtggcttcccatcagtcctattcccagaaaacactgattgcgctggtgacctcaggcgcactgctggctgtcctgggaataactggctatttcctgatgaacagaaggtcctggagcccaaccggcgaacgcctaggcgaagatccgtattatactgagaatgggggaggccagggttacagcagtggcccaggtacatctccagaagcgcagggcaaagcctccgttaataggggcgcacaggaaaacggtactgggcaggcaacctcacggaacggacactccgccagacaacatgttgtagccgacactgaattgtag

SEQ ID NO: 27891 - DNA, 1068 bp, Artificial Sequence
  Description of Artificial Sequence: Synthetic coding sequence
atgagcctcgacaacaacggtacagccacaccggagctccccacccagggaactttctccaacgtcagtactaacgtctcttaccaggaaactactacgcccagcacactggggtcaacatcactccatcccgtgtcacagcatggtaatgaggctactacaaacatcactgagacaaccgtgaaattcacaagcaccagtgtcatcacaagcgtgtacggcaataccaatagtagcgtgcaatcacagacttcagtaatcagtacagtgttcaccacaccggctaatgtgtccactccagagaccacattaaaaccctcattgtcacctgggaacgttagtgacctgtcgaccacatcaaccagtcttgccacaagccctacaaaaccatatacctcctcgtctcctattcttagtgacataaaggctgaaatcaagtgcagcggaatcagagaggtaaagcttacacagggcatatgcttggagcagaataagacctcctcctgcgccgaattcaagaaggatcggggagagggactcgcacgagttttgtgcggtgaggaacaggccgatgccgacgccggagctcaagtctgcagtctattactggcacagtctgaggtgaggccccaatgcctcctgctggttctagctaatagaaccgagatttccagcaagctacagttaatgaaaaagcaccaatccgacttgaaaaaactggggatcctcgacttcactgagcaggacgtcgctagtcaccagtcatactcccagaaaacactcatcgctctggtgaccagtggcgctctcctggcggttttaggaattacaggctacttcctgatgaaccggaggagttggtcacctaccggggaacggctgggcgaggacccttattacaccgagaatggagggggtcaaggttacagttctggtcccggaacctcacccgaggcgcagggaaaggcttctgtcaatcggggtgcccaggagaacgggaccggacaagctacatcaaggaacggacactccgcacgacagcacgtggtcgcagatacagaactgtag

SEQ ID NO: 27892 - DNA, 753 bp, Artificial Sequence
  Description of Artificial Sequence: Synthetic coding sequence
atgtttctgcaaatgtatcccacaaagaaactgcagcatcttgtgccccttgaagtgcccgcttgtactctgtgcctcaatatggctatgcggcctcagcagactagccaggcagagatcaagtgcagcgggatcagagaggtgaagctgacacagggaatatgtcttgagcaaaataaaacgtcgtcctgtgccgaattcaagaaggaccgaggcgaggggctcgcgcgtgtcttatgcggcgaggagcaagccgatgcggatgctggggcacaagtctgtagtctgttactggcacaaagcgaagtgcgacctcaatgtctcctgctggttcttgctaacagaacagaaattagcagcaagctgcagctgatgaaaaaacatcagtctgacttgaaaaaacttggcattcttgatttcacagaacaggatgtggcgagccatcagtcctattcacagaaaactctgatcgccttagtcaccagcggcgcactgttggccgtcctaggcataacgggatatttcctgatgaatcggaggtcatggtcgccaaccggagaaagattaggggaggacccatattacactgaaaatgggggaggacagggatacagctctggaccaggaacatccccagaagcccaggggaaggccagtgtgaacaggggtgcacaggaaaatgggacaggccaagccacaagcaggaacggacattctgctcggcagcatgtggtcgccgacacagagctgtag

SEQ ID NO: 27893 - DNA, 516 bp, Artificial Sequence
  Description of Artificial Sequence: Synthetic coding sequence
atggagcactcaacttttttgagtggccttgtcctagctacactactctctcaggtcagcccttttaaaattcccattgaggagttagaggatagggtattcgtgaactgcaacactagcatcacttgggtggaaggcactgtcgggactctgctgtccgatatcacaaggttagacttgggtaagcggatattagatccaagagggatatacaggtgtaacgggacggacatatataaggataaggagtcaacagtccaggtgcattataggatgtgccagtcttgcgttgagcttgatccagccaccgtcgccggtattatcgtgacagacgtcatcgctacactgctcctagctttgggtgtgttctgtttcgctggacatgagactggccgactcagtggagcagctgatactcaagcgctgctgcgcaacgaccaggtgtaccaacccctgcgggatcgagatgacgcccagtatagtcatcttggaggcaattgggcacgcaataaatag

SEQ ID NO: 27894 - DNA, 384 bp, Artificial Sequence
  Description of Artificial Sequence: Synthetic coding sequence
atggaacactccacatttctctccgggcttgtgctggccactctgctgtctcaggttagccctttcaaaataccgatcgaggagttggaagacagagtgtttgtgaactgcaataccagcattacttgggtcgaaggcaccgtgggcacactcctttccgatatcacgagactggatttagggaagcggatactcgacccacgcggaatttacagatgcaatggaaccgacatctacaaggacaaagaatctactgtgcaggtgcactaccggacagccgacacccaggcactgctcagaaatgaccaggtgtatcagcccctgagggaccgcgatgatgcccaatattctcatttgggaggtaattgggcgcgaaataaatag

SEQ ID NO: 27895 - DNA, 1377 bp, Artificial Sequence
  Description of Artificial Sequence: Synthetic coding sequence
atgaatcgaggggtgcctttcaggcacctgctcctggttctgcaattggccctcttgcccgctgctacccaggggaagaaggtcgtgctcgggaagaagggggacaccgtagagcttacctgtacagctagccaaaagaagtctattcagttccattggaaaaattcaaatcagatcaaaatactcgggaaccagggcagtttccttaccaagggaccatcaaagcttaacgaccgcgctgatagccgccgatccctatgggaccaaggcaattttcctttgatcattaaaaaccttaagatcgaggacagcgacacttacatctgcgaagtggaggatcagaaggaagaagtgcagctgctggtctttgggctgaccgctaactctgacacacacctgctccagggacaatcattaacgctgaccctggagtcacctcctggctcctctcccagtgttcagtgtcgctccccgagaggtaagaacattcaggggggaaagaccttatctgtttcccagttagagttgcaggatagcggcacctggacctgcaccgtgctgcagaaccagaaaaaggtagaatttaaaatcgatatcgtggtgctcgctttccaaaaagcttcatcaatcgtgtataagaaggaaggggaacaagtggagttctccttcccactggccttcaccgttgagaagctgactggaagcggagagttgtggtggcaggcagaaagagcatcctcaagtaagtcctggatcaccttcgacttgaagaataaagaggtgtctgttaagcgtgtcacccaagaccctaagctgcagatgggtaaaaagcttcccctgcatctcacccttccacaagcgctcccacagtacgcgggatccggtaacctgactctagccctggaagcgaagacaggaaagctgcatcaagaagttaatctggtggttatgcgggctacgcagctgcagaaaaacctcacctgcgaagtttggggtccaaccagtcccaaacttatgctcagcctcaaactggagaacaaggaggctaaggtttcaaagagggagaaggctgtctgggtgcttaatcctgaggctggcatgtggcagtgcctgttgagcgatagcggccaggtgctgcttgaatccaacataaaggtccttcctacatggtcaactccagtgcagcctatggctctgattgtgctcgggggtgtagccggattgctccttttcatcggcttgggcatatttttttgcgtaagatgtaggcaccgcagaaggcaggctgagcgcatgagccagatcaaacgccttctgtcggagaaaaagacctgccagtgtccccatagattccagaaaacatgttctccaatatag

SEQ ID NO: 27896 - DNA, 723 bp, Artificial Sequence
  Description of Artificial Sequence: Synthetic coding sequence
atgatcgagacgtataaccagacatctccacgttcagcagccactggcctacctatctccatgaaaatattcatgtatctcctgacagtcttcctgataactcagatgatcggctcagccctattcgcagtgtatttacaccgtcgtctcgacaagatcgaggacgaacggaatcttcatgaggattttgtgttcatgaagacaattcagcgctgtaatactggagaaaggtccctgtccctgctgaactgcgaggagattaagagtcaattcgaaggttttgtgaaggacatcatgcttaacaaagaagagacaaagaaagaaaattccttcgagatgcaaaaggtgctccagtgggctgagaagggctactacacaatgtccaacaacttggtcacattagagaacggcaagcaattgacagtcaagagacaggggctctactacatttacgcacaggtcaccttttgcagcaaccgtgaagcctcttctcaagctcccttcattgcatccctatgcctgaaatctccgggacggtttgaacgaatcctgttgagggccgcaaatacccactctagcgccaaaccatgcggccagcaaagcatccatctgggcggtgtgtttgaactgcagcctggggcaagtgtttttgtgaatgtcacagaccctagtcaggtgagtcacgggacaggcttcacttcatttggtctgctgaagctctag

SEQ ID NO: 27897 - DNA, 786 bp, Artificial Sequence
  Description of Artificial Sequence: Synthetic coding sequence
atgattgagacgtacaatcagacaagcccccgaagcgcagcgaccggacttcccataagtatgaaaatctttatgtatctgctgaccgtgtttcttatcacccaaatgataggctccgctctatttgccgtgtatctccatcgcaggctagataaaatcgaagatgagcgaaacctgcatgaggactttgtgttcatgaagactattcagaggtgtaacacaggtgagcgttcgctttctctgctgaattgtgaagaaatcaagtcccagtttgagggcttcgtcaaggatataatgctgaacaaagaggagaccaagaaggagaacagcttcgaaatgcaaaagggagaccagaacccacaaatcgcagctcacgtcatatcagaggcctcatcaaaaacaacatcggttctgcaatgggctgaaaagggctattataccatgtctaacaatttggtgaccttggaaaatggtaaacagctcaccgtgaagcggcagggcctttactacatatacgctcaggtgactttttgctctaatcgggaagccagcagtcaggcaccattcattgcttcgctctgcctgaaaagcccagggagatttgaacgcattttactgcgcgctgcaaacacccactctagcgctaagccatgtggccaacagtccatacacttaggcggagtattcgaattacagcctggcgctagtgtcttcgttaatgtaacagatccatcccaagtgagtcacggcaccggcttcacctcttttggtctgttgaagctgtag

SEQ ID NO: 27898 - DNA, 612 bp, Artificial Sequence
  Description of Artificial Sequence: Synthetic coding sequence
atggtgaggctgcctctgcagtgtgtgctgtggggttgtctgctgaccgccgtacaccccgagcccccaacagcctgtagagaaaagcagtacctgattaactcccagtgctgttccctgtgtcaaccaggacaaaagttggtgtctgactgtacggagttcactgaaacagaatgcctcccctgcggggagagtgaattcttggacacctggaaccgtgagacacattgccaccagcacaaatactgcgaccccaacctcggccttcgggtacagcagaagggaacatcagagacagacacaatctgcacttgtgaggagggatggcattgtaccagcgaagcgtgtgagagctgtgttctccaccgatcatgctcccctgggtttggagtgaagcagattgccactggagtttctgacactatctgcgagccatgccctgtcggcttcttttcaaacgtttcctctgcattcgaaaaatgtcacccgtggacacggtcacctggatccgctgaatcccctggaggagaccctcatcaccttcgagatcctgtgtgtcaccctctcggggcaggactctaccagaagggaggtcaggaggccaaccagtag

SEQ ID NO: 27899 - DNA, 786 bp, Artificial Sequence
  Description of Artificial Sequence: Synthetic coding sequence
ggaaggagtcccctccggacacgggatagagtcttgaccaactgggaggatggactgaccgtcgcttatggtgcagtgaagctgatccaatcactgtccctccagcctgttggctggcagcagaactggggcctcagcagtcccccaacaatgttgcttccttcacgcgctcagtcacctactgagttgccccttgctccgttggcagagccaaacacagggtgttcatctctgttatcctggcacagcaccagaggcgagttgcacctgtgggctctggggcttggacagatgggtggtagcaagtgtggtagtcccctgtcacctttggcccctaccctggaagcgctgcgcagaccatggtgcgggcagcaaggcgctgggggaactcggggtatttcgaccgaccccccaagcggaaaaggcggacgcgcatggggacgggaccccctacccagggaggggctactaaggggcaccgctgcccctgccgctggaggtgatctgaccccctgcctgagcagacctcctacacctagtcgcaatccgcgaagaagtatcttccccaccatcttcctggctcctacgctcctactgcagtgccgcagactctacatggacgcaaaccgctcccctcgcagaatggccaagcgggttgcatcacagtgccgcagagacagtgaggccgctcctacacaagaatgcggacacgttgggaagcaggccgtgggtcagagagcttggtgctgttgctgctgcggcgtcagagtcaggggatggcactag

SEQ ID NO: 27900 - DNA, 834 bp, Artificial Sequence
  Description of Artificial Sequence: Synthetic coding sequence
atggtacgattacctcttcaatgcgtcctatggggctgcctgttgacagcagtgcatcccgagccgccaactgcctgcagagagaagcaatacctgatcaattctcagtgctgctctctgtgccagccagggcagaaattggtcagtgattgcacagaattcacagagacggaatgccttccctgtggggagtccgaattcctggatacatggaatcgggagactcactgtcaccagcataagtattgcgacccaaatctgggtttacgagtccagcagaaagggacaagcgaaaccgatacaatttgcacgtgcgaggaggggtggcactgcacttccgaggcttgcgagtcatgcgttttgcaccgcagctgctcccctggctttggtgtcaaacagattgcaaccggggtttctgacacaatttgcgaaccatgcccagtaggctttttctcgaacgtctcaagcgcttttgagaaatgtcacccttggacctcttgtgaaacaaaggacctggtcgtacagcaggccggtaccaacaagacagatgtggtgtgcggccctcaggacagactccgtgccttagtggtcattcctatcatcttcggcatcttgtttgccatcctgctggtcctggtgttcataaagaaggtggcaaaaaagccgaccaataaggcccctcaccccaagcaggaaccacaggaaataaactttccagacgacctcccaggaagtaataccgcggcacccgtccaggaaactttgcacgggtgccaacccgtgacccaggaggacgggaaagaaagccgcatcagcgtccaggaacgacaatag

SEQ ID NO: 27901 - DNA, 1086 bp, Artificial Sequence
  Description of Artificial Sequence: Synthetic coding sequence
atggacaaattttggtggcacgctgcctggggactgtgcttggtacctctgtcattagcacagatcgacctcaacattacttgccgattcgccggagtttttcatgttgaaaagaacggcaggtacagcatttccagaaccgaggccgctgatctgtgtaaagccttcaactcaactcttcccacgatggcccagatggaaaaggcactttctatcggatttgagacatgccgttacggctttatcgaaggacacgtggtcatcccacgcattcaccccaattctatctgtgcagccaacaatactggggtgtatatcttgacgtcaaacacctcccagtatgatacttattgtttcaatgccagcgcccctcctgaggaagattgcacgagtgtcacagatttgcctaatgcctttgatggcccaattactatcaccatagtgaacagagatggtacacggtacgtgcagaaaggtgagtacagaaccaaccctgaggacatctatccgagtaaccctactgatgacgacgtctctagtggctcctcttctgagaggagctccacatccgggggttacatcttctatacttttagcactgttcaccctattccggacgaggatagcccctggattaccgactcaaccgacagaataccagccaccagggatcaggacacttttcatcccagcggcggttcacatacaacccacggctccgagagcgacggacactcccacgggagccaggaaggaggagcgaacaccacaagtggccctatcagaactccccagatacctgagtggctcattatcttggcctcattgttagctctggccctcatacttgcagtgtgcatcgctgtgaattctcgaagaagatgcgggcagaagaagaagctggtgataaattcaggaaatggagcggtggaggatagaaagccgagcggattaaacggggaagctagtaagagtcaagaaatggtccatttagttaataaggaaagttcagaaacgccagatcagttcatgaccgccgacgaaaccagaaatctgcaaaacgtggatatgaaaattggcgtctag

SEQ ID NO: 27902 - DNA, 420 bp, Artificial Sequence
  Description of Artificial Sequence: Synthetic coding sequence
atggacaagttttggtggcatgcggcatgggggctctgtcttgtgccactgagtctcgcccagatcgacctgaatatcacctgcagatttgcgggagttttccacgtcgagaaaaacggcaggtattcaataagcaggaccgaagccgctgatctctgcaaagcgtttaactccactctgccaactatggcccagatggagaaagccttgagcattggattcgagacatgttcactgcactgcagtcagcaatcaaagaaagtgtgggctgaggaaaaggctagcgatcagcaatggcagtggagttgcggtgggcaaaaggctaagtggacgcaacggcgaggccagcaggtatccggcaacggagcattcggggagcaaggcgtcgtgagaaactctcgtccagtttacgactcctag

SEQ ID NO: 27903 - DNA, 1023 bp, Artificial Sequence
  Description of Artificial Sequence: Synthetic coding sequence
atggataaattctggtggcacgccgcttggggtttgtgcctggtcccactctcactggcccagatcgatttgaatatcacctgtcggttcgccggtgttttccatgtggagaagaatgggcgatacagcatcagtcgtacagaagctgcagatctgtgcaaagccttcaacagcacactgccaactatggcccagatggaaaaggctctaagtatcggctttgagacctgccgttacggctttattgaaggccacgtggtgatacccaggatccaccctaattccatttgtgcagctaataacactggagtgtacattcttacttctaacacatctcagtatgatacatactgcttcaatgcttccgcaccgccagaggaagactgtacgtcagtgacggatctcccaaatgcctttgacggacctattactattacaatagtgaacagggatggcaccaggtatgtgcaaaagggagaatatagaacgaatcccgaagatatctacccatccaaccccactgatgacgacgtaagttctgggagctctagcgagaggagcagcacgagcggcggatacatcttctataccttctccacagtgcatccaatccctgacgaagattcgccctggattacagacagtaccgatagaattcccgctacgcggcattcacacggcagtcaagagggtggggcaaatacaactagtggaccgatccggaccccccaaatacccgaatggcttatcatcctcgcttctctgctggccctcgctttaatattggccgtctgtatcgcagtgaattccaggcgcaggtgtggtcagaagaaaaagttagtgatcaactcgggcaacggcgcagttgaggatagaaagcccagcggcctgaatggggaagctagcaaatcgcaggagatggtacacctagtaaacaaagagagttccgaaacaccagaccagttcatgactgccgatgagacgcggaacttgcagaatgtggatatgaaaattggggtttag

SEQ ID NO: 27904 - DNA, 1191 bp, Artificial Sequence
  Description of Artificial Sequence: Synthetic coding sequence
atggataaattttggtggcacgccgcttggggcttatgtctcgtgcccctgtcattggcccagattgatctcaacattacatgtaggttcgccggagtgttccacgtggagaaaaatggcagatattcaatctcacgtactgaggctgcggacctctgcaaagccttcaatagcactctgcctaccatggcacagatggaaaaggccctatcaataggtttcgagacttgcaggtacggctttatagagggccatgtcgtgatcccgcgaattcatccgaacagcatttgtgcggcaaacaacactggggtgtatatactgactagcaacacctcccaatatgacacttattgcttcaatgccagcgcaccacctgaagaggattgcactagcgtgacagacctccctaacgcctttgacggccctatcacaatcaccatcgtcaatcgggatggcacacggtacgtgcagaaaggtgaatataggaccaaccccgaggacatttacccttcaaatcctacagatgacgatgtctcatccggttcatcgtcagagcggtccagtacaagtgggggttatatattctatacattctcgactgtgcatcccattccagacgaggattctccatggatcactgatagcacagacagaatcccagctacaaacatggattcgagccactcgatcacccttcaacctacagccaaccccaatacaggtttagtagaagacctcgacagaacagggccattgagcatgaccactaggcgcgaccaggacacttttcacccaagtggaggcagccatactactcacggttctgaaagcgacgggcatagccacggctcacaggaggggggagctaacactaccagcggcccaatcaggacacctcaaatccccgagtggctcatcatcctggcgagtctcctcgccctcgctctgatcctggcggtctgcattgcagtgaattctagaagacgatgtggtcagaaaaaaaaactggtaattaacagtggtaacggagctgtggaagatagaaagccaagtggtttaaatggcgaggcatcaaagagccaggagatggtgcacttggtcaataaggaatcatcagagacgccggatcagttcatgaccgctgatgagactcggaatctccaaaacgtcgacatgaaaattggcgtctag

SEQ ID NO: 27905 - DNA, 2100 bp, Artificial Sequence
  Description of Artificial Sequence: Synthetic coding sequence
atggacaaattctggtggcatgccgcatggggcctctgcctggtccctctatccttggcccagattgatctcaatattacttgtcgcttcgccggtgtgtttcatgttgagaaaaatgggaggtactcaattagcagaaccgaagctgctgacctttgcaaggcatttaattcaacactgcccactatggcgcagatggagaaggccctctccatagggttcgaaacctgtcgttacggttttatagagggtcacgtggtgattcccaggattcacccgaactcaatttgtgccgctaacaataccggtgtatatattctaacgagcaacacatcgcaatacgatacctactgtttcaacgcctcagccccacccgaggaggactgcacttccgtcacggatcttccgaatgcattcgacggcccaattacaattactatcgttaaccgggacgggactagatacgttcagaaaggagagtacaggactaatccggaggatatatatcccagcaatcctaccgatgatgacgtgtcctctggctcctcctcggagcgcagctcgacttctgggggttacatcttctacaccttctccacagtgcatcctatacccgacgaggacagtccgtggatcaccgatagcaccgacaggattccagccactagcacatcctccaacactatctctgccggttgggaacccaatgaggaaaatgaagatgaacgggatcgccacctaagtttttcaggctccggcattgacgatgatgaggatttcatctcatcgacaatcagcacaacacccagagccttcgaccacactaagcagaaccaggactggacccagtggaacccatctcactctaaccccgaagtcctgctgcaaacaaccaccaggatgaccgacgtcgacaggaacgggacaacggcctacgaggggaattggaacccggaggcccacccccctctcattcaccacgagcaccatgaggaagaggagacaccgcactccacgagcacaatccaagccaccccttcttcaactaccgaggagaccgctacgcagaaagagcaatggtttggaaaccggtggcatgaaggatacaggcaaactccaaaggaagattcccacagtactaccggcacagctgctgcatcagctcatacgtcccacccaatgcagggcagaacaacacccagtcccgaagacagttcctggaccgacttcttcaatccgatctcacatcccatgggcagaggccaccaagctggacggagaatggatatggacagttcgcactctataactttacagcctacggctaatccaaataccggactcgtcgaagacctggaccggacagggcctttgagtatgactacccagcagagtaactcacagtcttttagcacatcccacgagggcctagaagaggacaaagatcatcccactacctcaacactcacaagcagtaatcggaatgacgtgaccggcggacgtcgcgaccctaaccacagcgaaggatccaccaccctgctggagggatatacttctcactacccccacaccaaagaatcccggactttcatcccagtgacctccgcaaagacaggctcatttggagtgacggcagtgaccgtcggtgactcaaattctaacgtgaatcgctctctctccggcgaccaggacacgttccacccttccggcggatcccacacaacacacggcagcgaaagtgatgggcactcccatggttcgcaggagggtggggcaaacaccacgtctggacctatcagaacgccccagatccctgagtggctgattatcttggcatcactgctggccctggcgctcattctggccgtctgcatagccgtgaactcccgaaggcgatgtggccaaaagaagaagctcgtcatcaatagcggcaatggggctgtggaggatcggaagccatccggcctgaatggggaggcctccaagagccaggaaatggtccacctggtgaataaggagtcttccgagacacccgaccagttcatgacggcagacgaaacccgtaatttgcaaaacgtggatatgaagattggagtgtag

SEQ ID NO: 27906 - DNA, 243 bp, Artificial Sequence
  Description of Artificial Sequence: Synthetic coding sequence
atggacaagttctggtggcatgcagcatggggcctatgcctagtacccctgtctttagctcaaattgatctaaatattacctgccgcttcgctggagtgttccatgtagaaaaaaatggacggtactccattagtcggacagaggccgctgacttgtgcaaagcttttaatagcaccctccctacaatggcccagatggagaaagctttaagcattggctttgagacgtgctcttccacttag

SEQ ID NO: 27907 - DNA, 2229 bp, Artificial Sequence
  Description of Artificial Sequence: Synthetic coding sequence
atggacaagttttggtggcacgcggcttggggtctgtgtctggtcccgctgagcctcgcccaaatcgacttaaatattacgtgtcggtttgcaggtgtgtttcacgtcgagaaaaacggccgatattctatctcccgcacagaggctgcagatctttgcaaggccttcaattctacactccctacaatggcacagatggagaaagcactctcaatcggctttgaaacatgccggtatggattcattgaaggccacgttgttatccctcggattcatcccaattctatctgtgctgccaataatacaggtgtgtacattctgacatctaatacatcccagtatgacacgtactgcttcaacgcatctgcaccccctgaggaggactgcacctccgttaccgatctgccgaacgcctttgatggcccaattacaatcaccattgtgaaccgggacggaactaggtacgtgcagaaaggcgagtaccgcactaatccggaagacatttacccttccaacccaactgatgacgacgtgtccagtggcagcagctccgaacgctccagtacatcgggcggatatatcttctacacattctcaactgtccatcccatccccgacgaggactcaccctggatcacagacagcacagacaggattcctgccaccacattgatgagtactagcgccactgctacagaaacagccacaaagcggcaagagacatgggattggttttcatggcttttcctgccctcagagtccaagaatcatttgcacactacaacccagatggcaggcaccagctcgaacactatttccgcaggctgggagccaaatgaagaaaatgaggatgaaagagacagacacttgagcttctccgggtccggtatcgatgacgacgaagactttatcagcagtacaatatctacaacacctagggctttcgaccacaccaaacaaaaccaggattggacccagtggaatcctagtcactctaatcctgaagtcctgctgcagacaacaacacgaatgaccgacgtagaccggaatggaaccaccgcctacgaggggaactggaaccctgaggcacatccgccactcatccatcatgaacaccacgaggaggaggagaccccccactccacaagcacaatccaggctacacccagttcaacaaccgaggaaacggctactcagaaggaacagtggtttggcaacagatggcatgaagggtaccggcagacacccaaggaggattcgcactctaccactggcacagcggctgcctcagctcacacgtcccaccccatgcaaggccgtacgacgcctagccctgaggactccagttggacagacttcttcaatccaatttcccatccaatggggcgagggcaccaggccggtcgtcgcatggatatggactccagccactctatcactttgcagcccaccgcaaatccaaatacaggcctggttgaggatttggataggacgggaccattgtctatgacaacacagcagagtaatagccagtctttcagtacatcccatgagggtctggaggaagacaaagaccaccccaccacttctacattgacatcctccaatcggaacgatgttaccgggggtaggcgcgaccccaatcactcagaaggatccaccacacttttagagggctatacatctcattacccgcacactaaagagtctcgcactttcatacctgtgacgagcgctaaaacaggcagcttcggggtgaccgcggtgacagtcggggactctaacagtaacgtaaaccgaagtcttagtggcgaccaagatactttccatccgtcgggtgggagccatactacccacggatcagaatccgatggacatagtcatgggtcccaggaaggcggagcaaacaccacgagcggcccaattagaacccctcaaatcccagagtggttgatcattctggctagtctgttggcattagctctcattcttgctgtgtgcatcgcggtgaattcacgcaggcggtgtggacagaagaagaagcttgtgattaattccgggaatggcgcagtggaggatcggaagccctcgggcttgaacggcgaagcgagtaaatctcaggagatggtgcacctagttaataaagagagttctgaaactcctgaccagttcatgaccgccgatgaaaccagaaatttacagaacgtggatatgaagattggagtatag

SEQ ID NO: 27908 - DNA, 2145 bp, Artificial Sequence
  Description of Artificial Sequence: Synthetic coding sequence
atggataagttttggtggcacgctgcttgggggctttgcctcgtgccactgagtctggcacagatcgatcttaacatcacgtgccggttcgctggagtctttcatgtagagaaaaacggaaggtacagcatctctcggaccgaggcagcggatctctgcaaggccttcaattctacccttccaacaatggcacagatggaaaaggcactctcgatcgggtttgagacctgcagatatggattcatcgaaggacacgtcgtgattcccagaatccacccaaatagcatctgtgctgcgaataataccggcgtgtatattctgacaagcaacacaagccagtatgatacatattgttttaacgcttccgctcccccagaggaagattgcacaagcgtcacagatctacccaatgcttttgatggtcccatcaccatcacgattgtgaaccgcgacggcaccaggtacgtgcagaaaggcgagtataggaccaacccagaggatatctatccttcaaaccctaccgatgacgacgtgtccagcgggagctcctcagaaaggtcatctacatctggaggatacattttttacaccttttccaccgtacacccaatccccgatgaggatagtccctggatcactgactccacagacaggataccagccactacgttgatgtccacctctgccacagcgaccgaaacggcaaccaagcgccaggagacatgggactggtttagctggctctttctcccttcagaaagcaaaaatcatctgcacactaccacccagatggcgggaacatccagcaacaccatcagtgccggatgggaacctaacgaagaaaacgaggatgaacgcgacagacacctgtcattcagtggctcggggattgacgacgatgaggactttatatcttcgaccattagcaccactccccgagctttcgatcacaccaagcagaatcaggattggacccagtggaacccttcacattccaaccccgaggtgcttttgcaaacaaccacacgcatgaccgctgacgttgatcgcaatggcaccacagcgtacgaggggaactggaaccctgaagcccacccccctctcatccatcacgaacatcatgaggaggaggagacccctcactccacctcaacaatacaggccacgccaagttcgactaccgaggaaaccgccacccagaaagagcagtggtttggtaacaggtggcatgagggctatcgacagacccctaaggaggattctcattccacaaccgggaccgccgctgcttcagctcatacctctcatccaatgcagggaagaaccacaccatcccccgaagacagtagctggaccgatttctttaaccccatttcacaccccatggggaggggccaccaggccggtaggagaatggatatggacagttctcactccatcaccctccagcctacagccaaccccaatacgggcttggtggaagatctcgacagaacgggaccacttagtatgactacgagaaatcggaacgacgtaaccggcggtcgcagagaccctaatcattctgaaggctctacaactttgctggagggctacacttcccactacccccacaccaaggagtcgcgcaccttcatcccagtgaccagtgctaaaactgggtcattcggagtgacagccgtgaccgttggcgactcaaatagcaacgttaatcggtctctgtctggcgatcaggacactttccacccctccggcggaagccacactactcacggttcggagagtgacggtcactctcacgggagtcaggagggaggagcgaatacgacaagtggccctattagaacaccacagataccagaatggctcattatcctcgcatccctcttggctctggctctgattctagctgtgtgcatagccgtaaactcccgtcgcaggtgcggtcagaaaaaaaaactggtgatcaactccggcaatggggcagtcgaggaccgcaagccgtccggtctaaatggggaagcttccaagtcacaggaaatggtgcatctggtaaataaggaatcttccgagacacccgaccagttcatgaccgctgatgagacaaggaacctccagaatgtcgacatgaagattggcgtctag

SEQ ID NO: 27909 - DNA, 1482 bp, Artificial Sequence
  Description of Artificial Sequence: Synthetic coding sequence
atggacaagttttggtggcatgccgcatggggcctttgtttggtgcccctgtccttagctcagatcgatctcaatattacttgccggttcgctggcgtgtttcacgtggagaaaaacgggcgttacagcattagcaggacagaagccgcagatctctgcaaagcattcaatagcacactccctacaatggcccagatggaaaaggctttgtctatcggctttgagacttgtcgatacggattcattgagggtcatgtggtgatcccaaggatccaccccaattccatttgcgcagccaataatacaggcgtctatatcctgacgagcaacaccagtcaatacgatacatactgcttcaatgccagtgccccaccagaggaagattgcaccagcgtcaccgacctccctaatgccttcgatggaccaatcacgataacaatcgtcaatcgtgacgggacccgttacgtccagaagggggaatacagaaccaaccctgaggacatctatccatcaaatcctaccgacgatgatgttagcagtggcagtagctcagaacgaagtagcacaagcggaggatacatcttctacacattctctacagtgcatcccataccggacgaggactccccgtggataacggatagcacagacagaatcccggctactaatatggattccagccactccattaccctacaacctactgcgaaccccaacaccggactcgtggaggatctcgaccgcacggggcctctttccatgacgacccagcagagtaacagccagagttttagtacttcccacgaggggctagaagaggacaaagaccatcccacgacttctactttgacatccagcaataggaacgacgtgacagggggacgtcgggatccaaatcatagcgaggggagtacgacactgctggaaggttatacttctcactatccacataccaaagaatctcggactttcattcccgtgacaagcgctaagactgggtcctttggcgtgacagctgtgacggtgggagactcaaattccaatgtcaaccgctctctgtcaggtgaccaggacacgtttcaccccagcgggggatcccacaccacacacgggagtgagtccgatgggcattctcacggttctcaggaaggaggcgcaaacactaccagtggcccaatccgaactccgcaaatccccgagtggcttattattctggcatccttgctggcattggcccttatcttagcagtgtgtatcgccgtcaatagccgtagacggtgcggccaaaaaaagaaactcgtgatcaatagcggaaatggagctgtggaagataggaagccctccggactgaacggcgaagctagtaagagccaagagatggttcatctcgtgaataaagagagctccgaaactccagatcagttcatgaccgccgatgagacaaggaatttgcagaatgttgacatgaagatcggggtgtag

SEQ ID NO: 27910 - DNA, 1290 bp, Artificial Sequence
  Description of Artificial Sequence: Synthetic coding sequence
atggacaaattctggtggcacgcagcatggggtctttgtctcgtccctctgtccctggcccagatcgacctgaatatcacctgcagattcgctggcgttttccatgttgaaaaaaacgggagatacagcatttcacgtactgaagccgctgacctctgtaaagcttttaattccaccttgccaacaatggcccaaatggaaaaagcgctcagcattggatttgagacttgccgctacggctttattgaggggcacgtggtgattccaagaatccacccaaactctatctgcgctgcgaacaatactggcgtttatatactgacatctaatacatctcaatacgatacatactgtttcaacgcgagcgctccacctgaggaagattgtacatctgttactgaccttccaaacgcttttgacggacccattactataaccatcgtaaacagagatgggactagatatgtgcagaaaggcgagtaccgtaccaatcctgaggacatctacccaagcaacccaactgatgatgacgtctcgtcaggctcaagctctgaaaggagctccacaagtgggggttatatcttttataccttcagcactgtgcaccccatccctgatgaagactccccttggatcaccgactctactgacagaattcccgctacgaaccggaatgacgtgaccggcggtagacgggatcccaaccactctgaggggtcaacaacccttttggagggatacaccagtcactatccacatactaaagagtcccgaaccttcatccccgtcacctcagccaaaaccggatcattcggtgtgacagccgtgacagtgggtgactctaatagcaatgtcaaccgctcactcagcggggatcaggacactttccacccatcggggggatcacatacaacacacgggagtgaaagcgacggacattctcacggaagccaggaaggaggcgctaacacgactagtggccctattagaacaccacagatccctgagtggctgattatcctggcctctcttctcgcactggcgctgatcctggccgtgtgcatcgccgtaaattcacggagacgttgtggtcaaaagaagaaactggtcataaattctggaaatggcgctgtcgaggacagaaaaccgtctgggctgaatggggaagcctcaaaatctcaggaaatggttcacctggtgaacaaggagtcatccgaaacccccgaccagttcatgacagctgacgaaactcgaaacctccagaatgttgacatgaaaatcggcgtttag

SEQ ID NO: 27911 - DNA, 2025 bp, Artificial Sequence
  Description of Artificial Sequence: Synthetic coding sequence
atggacaagttttggtggcacgctgcttggggcctgtgtctcgtcccgttgagcctggcgcagatcgatttaaacattacctgtaggtttgcgggagtgttccacgttgaaaagaatggcagatactctatctccagaaccgaagctgccgatctctgtaaggccttcaattctaccctgcccaccatggcccagatggagaaagccctgagtatcggttttgaaacttgtcgatatggattcatcgagggccacgtcgttatccctagaatccatccgaatagtatctgcgccgcaaacaacaccggagtgtatatcttaaccagtaacacatcccagtatgacacttattgttttaacgcatcagcccctcctgaggaggattgcactagtgtaactgacctgccaaatgccttcgatggcccaatcaccattaccatagtcaacagggacggaactcgatatgtccagaaaggggagtaccgtaccaatccggaagacatctacccaagtaaccccaccgatgacgatgtcagctctggaagctccagtgagcgatcttccaccagcggaggttacattttttacacctttagcactgtgcatccgatccccgacgaagactccccctggataaccgactctactgaccggatcccagccacaacactgatgagcacttcggctactgctactgagaccgctacaaaacgacaagagacttgggactggttcagttggttattcctgccatccgaatccaagaatcatctccacacaaccactcagatggcaggaacctctagtaacaccataagcgcaggctgggaacccaacgaggaaaatgaagatgaaagggataggcacctttcctttagcgggagtggcatcgatgacgacgaagactttatatctagcactatctccacaactccgagagcctttgaccacactaaacagaaccaagattggacccagtggaatccaagccatagcaatccagaagtgctgctccaaaccactacccgcatgaccgatgttgaccgcaacgggactacagcttacgaaggaaactggaatcctgaggcccaccctcctctcattcatcatgagcaccatgaggaggaagagactcctcactccacatctacgattcaggcaactcccagctcaaccaccgaggagactgcgactcagaaggagcagtggttcggtaataggtggcatgaggggtaccgccagacaccaaaggaagatagccacagcactacaggcactgccgcagcttccgctcacacatcccatcccatgcaaggtcggacaacgcccagcccagaagatagctcatggaccgatttcttcaaccccatctcacacccaatggggagaggacatcaggctggaagacgtatggacatggatagtagtcatagtattaccctgcaacctaccgccaaccctaatacaggtctggttgaagacctagaccgcaccgggcctttaagcatgactacccagcagtctaatagccagagtttttccacctcccatgaaggtttggaagaggacaaagatcatcctacaacctccaccctaaccagcagccgggaccaggatactttccacccctccggtggcagtcatactacccacgggtcagaatctgatgggcattcacacggaagccaggaagggggagctaacaccacaagcggccctatcagaacacctcagatccccgagtggctaataatcctggcctcactcttggcgctggcccttatcctggccgtctgcatagcagtgaacagcagacggcgatgcggccagaagaaaaagctcgtgattaacagtggtaacggggcagtggaagaccggaagcctagtggcctaaacggcgaggcctctaagtcccaggagatggtccatctggtgaacaaagaaagctcagaaactcccgaccagttcatgacagctgacgaaacacgcaacctccagaacgtggacatgaagattggcgtgtag

SEQ ID NO: 27912 - DNA, 2100 bp, Artificial Sequence
  Description of Artificial Sequence: Synthetic coding sequence
atggataagttctggtggcacgccgcttgggggctgtgtttggtgccactgtctctggcccagatagaccttaatatcacctgtcggttcgccggagtatttcatgtcgaaaagaatggcagatattctatatcccgaacagaggcggctgacttgtgtaaagctttcaattcgaccctgcccacaatggctcagatggaaaaagcactgtcaattggatttgagacatgcaggtacggattcatagagggccatgtggtcataccaaggattcatcccaacagcatctgcgccgcaaacaatactggtgtgtatatcctgacgtccaatacatcccagtatgatacgtactgcttcaatgccagcgcccctcctgaggaggactgcacatccgtgaccgatctgcccaacgctttcgacggacccattaccatcaccatcgtaaaccgggacggcacacgatacgttcagaagggcgaataccgcacaaaccccgaagacatatatccttctaatccgacagatgatgatgtgagcagcgggagcagcagtgagcgcagcagcaccagtggagggtatatcttttacacattcagcacggtgcatcccatacctgatgaagactcgccatggatcaccgattccacggaccgaatcccagctacgacactgatgtccactagtgccaccgcaaccgagacggcaactaaacgccaggaaacatgggactggttttcatggctgttcctgccctctgagtccaagaatcacctccataccacaacgcaaatggcgggaacctcgtcgaatacgatctctgctggctgggaaccaaatgaggaaaatgaagatgagagagacaggcacctttcattcagcgggtctggcatcgacgacgacgaggacttcatcagttccaccatctccacgacgccccgtgcctttgatcacacgaagcagaaccaggactggacgcagtggaatccgagccacagcaaccctgaggtcctgttgcagactacaacgaggatgaccgatgtggatcgcaacggaaccaccgcctatgaaggcaactggaatccagaggctcaccccccactgattcaccatgagcaccatgaggaggaggaaactccccactcaacgtctactactgcatccgcgcatacttcacatcccatgcaggggaggacgacaccaagccctgaggacagcagttggacagacttttttaatcccatcagccaccccatggggcgaggacaccaagctggcagacgaatggacatggactcttctcattcgatcacacttcagcccacggccaacccaaatactgggttggttgaggatctggaccgcactgggccacttagcatgaccacccagcagtcaaactctcagtccttctcgaccagccacgagggcctggaagaggataaagaccacccgacgacctctacactgacttcatcgaacaggaatgatgtgaccggtggtaggcgtgaccccaatcactctgaaggctctacaacactcctggaagggtacacatcgcactatccccacacaaaggagagcagaactttcatccctgtaaccagcgcgaaaaccggctccttcggtgtgaccgccgttactgtcggcgactcgaactctaacgtgaatcgtagcctctctggtgatcaggacactttccatccgtccggaggctcgcacaccactcacggttctgaatccgacggccattcacacggttcccaggagggaggggcaaatacaacatccggacccatccgaacaccccagataccggaatggctcatcatactcgcgtcactgctggctctagctctcattctagccgtgtgtatcgcggtcaatagtaggagaagatgcgggcagaagaagaagttggtgatcaatagtggcaatggagctgtggaagaccggaagcctagcggactcaatggcgaggcatcaaaatcacaagagatggtgcatctcgtcaataaagaaagcagcgagactccggatcagttcatgactgctgacgaaactaggaacctgcagaatgtagacatgaagatcggcgtctag

SEQ ID NO: 27913 - DNA, 237 bp, Artificial Sequence
  Description of Artificial Sequence: Synthetic coding sequence
atggacaagttctggtggcatgctgcctggggcttgtgtctggttccactgagtctcgcccaaatcgacttgaacatcacatgtaggtttgcaggagtctttcatgtggaaaagaacgggagatactccatatctcgtaccgaagccgcagacctctgcaaggcatttaactccacactgcctaccatggctcaaatggaaaaagccctaagcattggattcgaaacgtgcagatag

SEQ ID NO: 27914 - DNA, 885 bp, Artificial Sequence
  Description of Artificial Sequence: Synthetic coding sequence
tgagacaagttctggtggcatgctgcctggggcctgtgcctggtgcctctctctcttgcccagatcgaccttaatatcacgtgccgctttgcgggagtgtttcacgtggaaaagaacggcaggtatagcatcagccggaccgaagcagctgacttgtgtaaagcatttaacagcactttacctaccatggctcagatggagaaggcgctcagtattggatttgaaacctgccgctatggtttcattgaaggccacgtggtgatcccgaggattcaccctaattctatatgcgcagccaataacaccggagtctacatcctcacatccaacacctctcaatatgacacttattgctttaacgcctctgcccctccagaagaagattgcacttccgtgaccgatcttcccaacgccttcgatggcccaataaccatcaccatagtgaaccgcgacggcacaagatacgtgcagaagggcgagtatcggactaatcccgaggacatctatcctagcaatcccactgatgatgacgtgtcctccggatcatcgagcgagaggagcagcacatccggaggctacattttctacacctttagcaccgtacatccaatccctgatgaagatagcccatggattaccgacagtacggacaggatcccagcaaccagggaccaggacaccttccacccatcaggtggcagtcacactacccacgggtccgagtctgatggtcacagccatggcagccaggaaggtggtgccaatactacgtccggccctataagaaccccccagatacccgaatggctcattatcctggcctccctgcttgcactcgcactgattctggctgtgtgtatcgcagtaaacagcagaagatcctag

SEQ ID NO: 27915 - DNA, 918 bp, Artificial Sequence
  Description of Artificial Sequence: Synthetic coding sequence
atgtggccgctcgtggccgctctgctgctgggtagcgcctgctgtgggagcgcccagctcctgttcaataaaaccaaaagtgtcgaattcacattctgtaatgatactgttgtcataccttgtttcgtgaccaatatggaagctcagaacactaccgaggtgtatgtgaaatggaaatttaaaggaagagacatatacacatttgatggggcattaaataaaagtacagtccccaccgatttctctagtgcaaagattgaggtgtctcaattactgaaaggcgatgctagtctcaagatggacaagagcgacgctgtcagccacaccgggaattacacatgtgaggttaccgaactaacacgcgaaggcgaaacaattattgagcttaagtacagagtagtgtcctggttcagtcccaatgaaaacattctgattgtgatttttccaatattcgctatccttttattttggggacagtttggaattaagactttaaagtaccggtcaggcggtatggacgaaaagaccatagcccttcttgtggccggacttgttatcacggttattgtaatcgtgggcgcaattctgttcgtgccaggagaatactcactaaaaaatgcgactgggttgggtctgatcgtgacatctacaggaatcctgatcctccttcattactatgtcttcagcacggccatcggtctgacttcctttgttatcgccattctggtcatacaagtgatcgcctatatcctggccgtggtgggcttatcactctgtatcgccgcatgcataccaatgcatggtccacttcttatctctgggctgtcaattctggccctcgctcagctcctcgggttggtgtacatgaagttcgtcgccagcaatcaaaaaacgattcagccgccacggaacaattag

SEQ ID NO: 27916 - DNA, 972 bp, Artificial Sequence
  Description of Artificial Sequence: Synthetic coding sequence
atgtggcctttggtcgcagcgctattgttgggatcagcttgttgcggctctgctcagttactcttcaataagacaaagtcggtcgagtttaccttctgtaatgataccgtggttattccttgcttcgttacaaatatggaggcccagaacacaaccgaagtttatgttaagtggaaattcaagggaagagacatctatacatttgacggggctctgaacaagtccacggtacccaccgacttttcttcagcgaagatcgaggtctctcagcttttgaagggcgatgcttcccttaagatggataagtccgacgccgtgtcacacaccggcaactacacctgtgaggtgactgagcttaccagagagggagagactatcattgagctgaagtaccgcgtagtgagctggttcagtcccaacgaaaacatcctcatcgtcatttttcctattttcgccatcctgctgttctgggggcaatttggtatcaaaacactgaagtatcggtctggcggaatggacgaaaaaactattgctcttctggtggctggcttggttattacagtgatcgttatagttggggcaatccttttcgttcccggagagtacagtctgaaaaacgcaacaggattaggactcatcgttaccagtaccggaattctgatactgttgcactactacgtgttttccaccgccattggcctcacaagctttgttatcgcaatcttagtgatccaggtgatcgcctacatcctggccgtggtgggactgagtttgtgtattgccgcttgtatcccgatgcacggaccattgcttatctcaggtctgtcgatattggcgctggctcagctgctcggtctggtttacatgaagttcgtggcaagcaatcagaagacgattcagcctccacgaaaagcagtggaagaacctttgaacgcgttcaaagaatccaagggcatgatgaatgacgaatag

SEQ ID NO: 27917 - DNA, 1488 bp, Artificial Sequence
  Description of Artificial Sequence: Synthetic coding sequence
atgccgatggggagcttgcagccgctggcaactctgtacctgcttggaatgcttgttgccagctgtctaggcagactgagctggtatgaccccgatttccaggcacggctaacccgctctaattccaaatgccaaggacagcttgaggtgtacctgaaggacggatggcatatggtttgtagtcagagctggggacgaagttctaagcagtgggaggatccttcccaggcctctaaggtgtgtcagcggctcaactgcggtgttcccctgagtcttggccctttccttgtaacttacactcctcagagttctatcatttgttacgggcagcttggaagtttcagcaattgttcacactccagaaacgacatgtgtcattccctgggactaacttgtctagagcctcagaagactacccccccaacaacacgtccacccccaaccaccactccggaaccaaccgcccctcccagactccagctcgtggcccagtcaggcggacagcattgtgctggagtggtggaattttatagtggttcactggggggtaccatatcgtacgaggctcaggacaagacgcaggatctggagaacttcctgtgcaacaacctgcaatgtggatctttcctgaaacacctaccagagactgaggcagggcgagctcaagatcccggtgagcccagagaacaccagcctctcccaatacagtggaaaattcaaaatagtagttgtacgagcttggaacactgtttccgtaaaatcaagcctcaaaagagtggccgtgttctagccctgttgtgctccgggttccagcccaaagtgcaatcccgcttagtcggtgggtcgagtatttgtgaggggaccgtcgaagtgaggcaaggcgctcaatgggcagccctgtgcgatagctcaagcgctcgctcttctctgagatgggaggaggtgtgtcgggagcaacaatgcgggtccgtgaactcatatcgcgttctagacgcgggagacccaacctcaagaggcctcttctgcccccaccagaaactgtcccagtgccatgagctttgggagcgcaattcctactgcaagaaggtgtttgtgacctgccaagatccaaacccggcaggactggccgcaggcaccgtggccagcattatcctcgccctggtgctcttggtggtattacttgttgtgtgtggaccgctggcatataaaaagctggtgaaaaaattcagacagaaaaagcagcggcaatggatcggccctactggcatgaaccaaaacatgtcctttcacagaaatcatacggccaccgtcagaagccacgcagaaaatccgaccgcatcccacgtggacaacgagtattctcagccaccacgaaactcacatctgtctgcttaccccgcactcgagggcgcacttcataggtcctccatgcagcctgataacagcagcgacagcgactatgatctgcacggtgcacagaggctgtag

SEQ ID NO: 27918 - DNA, 582 bp, Artificial Sequence
  Description of Artificial Sequence: Synthetic coding sequence
atgccagaagagggcagcggatgtagtgtaagacgccgaccctatggatgtgtgctccgggcagctctcgtgcccttggttgccggtcttgtcatatgcctcgtcgtttgcatccaacgatttgcccaagcacagcagcagcttccactggaatcccttgggtgggacgtcgcagagcttcagttgaaccacacagggcctcagcaagacccaaggctctactggcaagggggtcccgcactcggtcgttcttttctacatggtcctgaattagacaaaggccagctacgcatacaccgggatgggatctatatggtccacatacaggtaactctcgcgatctgctcttccacaacagcaagccgccatcaccctacaaccttagccgtgggtatttgcagcccagcttctcgatctatcagtctgctgcgattatccttccaccagggttgcactatcgcctcccagcgtctcaccccattagctaggggcgataccctttgtacaaacctgaccggaaccctgctgccctctagaaataccgacgagaccttttttggagtacaatgggtgcgtccatag

SEQ ID NO: 27919 - DNA, 627 bp, Artificial Sequence
  Description of Artificial Sequence: Synthetic coding sequence
atgcccgaagaggggagcgggtgttcagtcaggaggcgtccctatgggtgcgttctgcgtgccgctctcgttcctttggtagcgggattggtgatttgtttggtcgtctgcattcagaggttcgcccaagcccaacagcagctgcccctggagtcgctgggctgggacgtggcagagttgcagctcaatcacaccggtccacaacaggaccccaggttatactggcaaggaggtcccgctttgggcaggagtttcctgcatggccctgaacttgacaagggacaacttcgtattcaccgggacggaatatacatggttcacatccaggtcactctagccatttgcagctccacaaccgcatctcgccaccaccccaccactcttgccgtggggatttgttcacctgcttcaaggagcattagcctcctgcgcctgtcgttccaccagggcttatttgggttttggaattggggcttgaaagtcaagtgtttccttcggcatcttatctggaccgcccactgtttcatcccccttacacagctggtgtttatgcaggccttgcagtcctggagaaaccatcattgcagccactttaccgatgaggagaatcggggtgttaatcggtag

SEQ ID NO: 27920 - DNA, 1305 bp, Artificial Sequence
  Description of Artificial Sequence: Synthetic coding sequence
atgtcggcagacggcgcagaggccgatggcagcacacaagtaacagtcgaagagccggtccagcagccatccgtagtggaccgggttgcgtcgatgcctctgattagctccacatgtgacatggtctccgccgcttatgcatcaaccaaagagagttaccctcacatcaagacagtctgcgatgcagcggaaaagggagttcgtaccctcactgcggctgcggtatccggggctcaaccaattttatcaaagttggaaccccaaatcgccagcgcctccgaatatgcccacaggggcctggataaactagaggaaaatctgccgatcttgcaacagccaacagaaaaagtgttagctgacaccaaggaactagtgtcctcaaaggtctccggcgctcaggagatggtctcctccgcgaaggataccgtggccacgcagctgagcgaggccgtcgatgctacacggggtgcagtccagagcggagtggacaagaccaaatccgtggtgacaggcggagtgcagtccgtgatgggctcccgtctgggccagatggttttgtccggtgtggatacagtcttaggtaagtccgaggagtgggctgacaatcatctgcccttgacggatgccgaattagctcgcattgctacgagtcttgatggctttgacgtggcttccgtgcagcagcagcggcaagaacagagttactttgtccggcttggaagcttgagtgaaagactgagacaacacgcttacgagcacagtctgggcaaattaagagcaacaaaacagcgggctcaggaggccctactgcagctgtcccaggtgctctcactcatggaaactgtgaaacagggggtggaccagaaactcgtggagggacaagagaaactgcaccagatgtggctgagctggaaccagaaacagttacagggccctgagaaagaaccacctaaaccagagcaggtggagtccagggctcttacaatgtttagggatattgcacagcagttacaggcgacctgcaccagcttgggatcttcgattcaggggctgcccaccaacgtgaaggatcaagttcaacaggctaggaggcaggtcgaagacctccaggccacgttttcgtctatccattccttccaagatctctcctccagtatactggctcaaagcagagaaagagtggcgtcagcccgagaggctttagaccacatggtggaatacgtcgcccagaacacccccgttacttggttagtcgggcctttcgcccctggcattacagagaaggcccctgaagagaagaaatag

SEQ ID NO: 27921 - DNA, 567 bp, Artificial Sequence
  Description of Artificial Sequence: Synthetic coding sequence
atgcctggaggcccaggggtgctccaggccctgcccgcaacaatctttctcctcttcttgcttagtgcggtgtacctcggccctggatgccaggccttgtggatgcacaaagtgcccgcatctctgatggtctcactgggcgaggatgcacacttccaatgcccacacaactctagcaacaatgcgaacgtaacctggtggcgagttttgcacggaaattatacttggccgccagagttcctgggcccaggagaggaccccaacgagccccctcctcgacccttcttggatatgggagagggaacgaaaaatagaattatcacagctgaggggatcatcctgctcttctgtgctgtggtccctggcacattgctgctcttcaggaagcggtggcagaatgaaaagctcgggctcgacgccggagatgagtatgaggatgagaacctgtacgaaggtctgaatctcgacgattgctcgatgtatgaagacatctcacgcggactgcagggcacctaccaagacgtggggtccctgaacataggagatgttcagctggagaaaccctag

SEQ ID NO: 27922 - DNA, 867 bp, Artificial Sequence
  Description of Artificial Sequence: Synthetic coding sequence
atgggtcacacgcgcagacaaggcacttcccccagcaagtgcccttatctgaacttttttcaactgcttgttctggctggtctgtctcatttttgctcaggggtgatacacgtcactaaagaggttaaggaggtggccactttaagttgtggacacaacgtttccgtggaggagttagcacagacaaggatctattggcaaaaggagaagaagatggtcctgactatgatgtctggagatatgaacatctggccggagtacaagaatcgaacaatcttcgacatcacaaataacttaagtattgtcatccttgccttgaggccaagcgacgagggaacgtacgagtgcgtggtgctgaaatatgaaaaggatgcttttaagagagagcacctggccgaagttactctcagcgtgaaggccgacttcccgacgccctccatttctgactttgagatccccacaagcaatatacgtcgcatcatatgcagcaccagcggtggctttccggagccacatctatcctggttagagaacggggaagagctaaatgctattaatacgaccgtgtcgcaggatccagagacagaactgtacgctgtctcaagtaagctggattttaacatgaccacaaatcattctttcatgtgtctgatcaagtatggtcatctgagagtcaatcagaccttcaattggaacaccactaaacaagaacacttcccagacaatctgctgccgtcatgggccatcacgttgatatcagtgaatggcatatttgtgatttgttgcctaacatattgcttcgccccacgttgcagggaacgcagaagaaatgaacggctgcgacgcgagagtgttagacccgtgtag

SEQ ID NO: 27923 - DNA, 489 bp, Artificial Sequence
  Description of Artificial Sequence: Synthetic coding sequence
atggggcacactcggaggcagggaacgtctccgagtaaatgtccctacctgaacttctttcagttgcttgtgctcgccggtctatcacatttctgtagcggcgtgatccatgtgacaaaagaagtgaaggaggtggctacattatcatgtggccacaatgtgagcgtagaggagttggctcagacacgcatatattggcagaaggaaaaaaaaatggttttgacaatgatgagcggtgatatgaacatttggcccgagtacaagaacaggaccatctttgacataacaaacaacctgagcatcgtgattctggccttgaggccaagcgatgaaggaacatatgaatgtgtcgtcttgaagtacgagaaagatgcctttaagcgagaacatcttgcagaagtgacactgtccgtcaagggattcgcacccaggtgccgcgaacggcgacgaaacgagcgccttagacgcgaaagtgtgcggccagtgtag

SEQ ID NO: 27924 - DNA, 771 bp, Artificial Sequence
  Description of Artificial Sequence: Synthetic coding sequence
atgggccacactagacggcagggcacctcgcctagcaagtgtccatatctgaactttttccagctcctcgtgctggcagggcttagccatttttgttcaggagtgattcacgtgactaaggaggttaaggaagtggctacactgtcttgtggacataatgttagcgtggaggagctggcacaaactagaatatactggcaaaaggaaaagaagatggtcttgactatgatgtctggggacatgaatatatggcctgagtataaaaacagaaccatctttgatatcacaaacaacctttcaatcgtgatcttggcgctgagacctagcgatgaaggcacatacgagtgcgtagtgcttaagtatgagaaggacgcctttaaacgggaacacctggccgaggtcacactgtcagtaaaggccgactttcctactccatccatcagcgactttgagattccaacgagcaatattcggcgtattatctgtagcaccagcgggggatttccagaaccgcatttgagttggctagagaacggagaggaactgaacgctataaatacaactgtgtcgcaagaccccgaaacggagttgtacgccgtttcatctaagctagattttaacatgactacaaatcacagcttcatgtgtctgatcaagtatgggcatttaagagtaaatcagacttttaattggaacacaagctttgctcccaggtgcagggagagacgcaggaatgagcggcttcggagggaatccgtgaggcccgtttag

SEQ ID NO: 27925 - DNA, 867 bp, Artificial Sequence
  Description of Artificial Sequence: Synthetic coding sequence
atgggccacacaaggaggcagggaactagcccttcaaaatgtccctatctgaattttttccagcttcttgtcctggctggcctatcccatttttgcagcggggtcatccacgtgacgaaagaggtaaaagaagtcgcaacgctctcttgtgggcataacgtgtctgtggaggaactggcccagacgcggatttattggcaaaaggaaaagaagatggtgcttactatgatgagcggtgacatgaacatttggcccgaatataaaaaccgtaccattttcgatattactaataacctgtcaatagtcatcttggccctccgacccagtgatgaaggaacctatgagtgcgtcgtgctcaagtacgaaaaggacgctttcaagagagagcatttggccgaggtgacgctgtctgtaaaggccgattttccaaccccctctatttctgactttgaaatcccgacaagtaacatccggcgtatcatttgttcaaccagcgggggttttccagaaccccatctgagctggctcgagaacggggaagagctgaatgccatcaacaccaccgtgagccaggatcctgaaacagagctctacgccgtaagcagcaagcttgactttaatatgaccacaaaccatagttttatgtgtttaatcaagtatggacatcttagagttaaccagacattcaattggaacaccaccaagcaagaacacttccctgataaccttctccctagttgggccatcacccttatttcagtaaatggcatcttcgtcatctgttgtctgacttactgctttgcaccacgttgtcgcgagcgacggaggaacgaacgcctacgcagagaatctgtgagacctgtgtag

SEQ ID NO: 27926 - DNA, 456 bp, Artificial Sequence
  Description of Artificial Sequence: Synthetic coding sequence
atgtccataccattctccaatacccattacagaattccccagggatttggcaatttgctagaaggactgacccgcgagatcctcagggaacagcccgacaatatccctgcttttgccgctgcctattttgagtccctcctcgaaaagcgcgaaaagactaatttcgatccggctgaatgggggagcaaagtggaggataggttttacaacaaccacgctttcgaagagcaggagccccctgaaaagagtgaccccaaacaagaagagtctcaaatatctggtaaggaggaagaaaccagcgtgacgatcctggattcttctgaggaggataaggagaaggaggaggttgccgcagtcaagattcaggccgcttttaggggccatatcgctcgggaggaggccaaaaagatgaagactaatagcctgcagaatgaggaaaaagaagagaataagtag

SEQ ID NO: 27927 - DNA, 729 bp, Artificial Sequence
  Description of Artificial Sequence: Synthetic coding sequence
atgggctccgcgtgtataaaggtcacaaagtacttcctctttttgttcaacctgatattcttcattcttggcgctgtgatcctgggcttcggcgtctggatcctcgcagacaagagttctttcatcagtgtcctgcaaaccagtagttcctccctgagaatgggcgcatacgtgttcatcggcgtcggagcagtaactatgctcatgggctttctggggtgcattggggctgtgaacgaggtgcggtgcctcctcggcctgctcaaacaggagatggggggtatcgttactgaactcatcagagactacaatagtagcagagaagattcccttcaggacgcatgggattatgtccaagcccaggtcaagtgctgcggctgggtgtctttttacaactggactgacaacgccgaacttatgaaccgacccgaggttacttacccatgctcctgcgaagtcaagggcgaggaggacaactcgctctcggtgcggaaaggcttttgtgaggcgccaggcaatcgaacccagtcaggtaatcacccagaagactggccggtttaccaagagggatgcatggagaaggtgcaagcctggctccaggaaaacttaggcattattctaggggtcggagtcggcgtggccatcattgagttgttgggtatggtgcttagtatatgcctctgtaggcacgtgcatagcgaggattattcaaaagtgccaaaatactag

SEQ ID NO: 27928 - DNA, 207 bp, Artificial Sequence
  Description of Artificial Sequence: Synthetic coding sequence
atgggcagtgcgtgtatcaaagttaccaagtactttctattcctcttcaacctcatattcttcatcctgggcgctgtcattctcggcttcggggtgtggattctagctgataagtctagtttcatttccgtgttgcagaccagctctagcagtctgcgcatgggcgcatacgtctttatcggagtgggtgcggtaacgatgctatag

SEQ ID NO: 27929 - DNA, 117 bp, Artificial Sequence
  Description of Artificial Sequence: Synthetic coding sequence
atggggtctgcatgtattaaagtaaccaagtattttcttttcctttttaacctcatttttttcattctgggggctgttatactgggattcggcgtctggattctggctgacaagtag

SEQ ID NO: 27930 - DNA, 318 bp, Artificial Sequence
  Description of Artificial Sequence: Synthetic coding sequence
atgggatctgcctgcattaaagtgaccaaatattttctctttctgttcaaccttattttctttatcctcggcgcagttattctgggattcggcgtatggatcctcgccgacaaaagctctttcattagcgtcctccaaacctcctcctcatctctgagaatgggtgcctacgtttttatcggagtcggagcagtgaccatgttgatggggtttctcgggtgcatcggggcagtgaacgaagtgagatgtctcctgggactctacttcgcgtttcttttgctaatcttaatagctcaagtgacagctggggcactctag

SEQ ID NO: 27931 - DNA, 327 bp, Artificial Sequence
  Description of Artificial Sequence: Synthetic coding sequence
atggggtccgcctgtattaaagtgaccaagtatttcttgttcctgttcaatttaatattttttatcctcggggctgtgattttgggatttggtgtatggatcttggcagataagtcatcttttataagcgtgctccagacatcttcttcgtctctgcggatgggtgcttacgtattcatcggcgtgggagctgtaacaatgctgatgggctttttgggctgtatcggtgctgtgaatgaggtgaggtgcctactgggcctgtacttcgcatttctgctgctgattctcatcgcccaggtcaccgccggtgcactgttttatttctag

SEQ ID NO: 27932 - DNA, 708 bp, Artificial Sequence
  Description of Artificial Sequence: Synthetic coding sequence
atggccttgcccgtcaccgctctcctgctgcccctggccctgctccttcatgctgctcgaccttcccagttccgggtaagccctctcgataggacctggaatttgggtgagactgttgagttaaagtgccaggtgttgttgagcaaccccacctccggctgctcctggctgtttcagcccaggggggctgccgcatcacccactttcctgttgtatctgagccaaaataaacctaaggctgcggagggacttgatacccaaagattttcaggaaagagactgggggatacattcgtgctgaccctgtccgactttagacgggaaaatgagggctattacttctgtagtgccctgagcaattccatcatgtactttagccatttcgtgccggttttcttacccgctaaacctacgacgactcctgccccaagaccacctacccccgcacctacaatagctagccagcctctttccctaaggcctgaagcctgcagaccagccgctgggggagccgtccacacccggggactggacttcgcgtgcgacatttacatatgggcgccactagcgggtacttgcggggtcctattactgagccttgttattacgctatattgcaaccaccgcaatcgacggagggtttgtaagtgtccacgtccagtcgtgaaaagcggcgataaaccctctctaagcgcgagatacgtctag

SEQ ID NO: 27933 - DNA, 597 bp, Artificial Sequence
  Description of Artificial Sequence: Synthetic coding sequence
atggcgctcccagtgaccgccttgctgctgcctctcgctctgctgctgcacgcggcacggccttcccagtttagggtgtccccgctcgaccgcacgtggaacctcggagagacggttgagctgaaatgtcaggtcctgcttagtaatcctacctctggctgttcctggctgttccagcctcgcggagccgcagcttcgccaactttccttctgtatctcagtcagaacaagcctaaagccgcagagggtctcgatacacagcgatttagcggtaaacgcttgggagatacctttgtcctgacccttagcgactttcgacgagaaaacgaggggtattacttttgcagcgccctgagcaattctataatgtatttctcacactttgttcctgtgttcctccctgcgaaaccgactacaacccccgctcccagaccacctaccccagctccgactatcgcttcccagccgctgagcctgaggccagaggcctgtcgaccggctgccggtggggctggaaacagacgcagggtgtgtaaatgccctcgacccgtagtcaagtctggcgataaaccatcactatccgcccgttacgtttag

SEQ ID NO: 27934 - DNA, 708 bp, Artificial Sequence
  Description of Artificial Sequence: Synthetic coding sequence
atggccctgccagtgacagcgctgctcctgccgctggctcttctgttacacgcggctaggccttcccaattccgggttagcccccttgatagaacttggaaccttggggaaactgtagaattgaagtgccaggtgttgctgagtaatcctacgtctggctgctcttggctttttcagccgagaggcgctgcagcttcccctactttcttgctgtacctctcacagaacaaacctaaagccgctgagggcctggatacccagagattctctggcaaacgtttaggagatacatttgtcctaactctatcagacttcagaagagaaaatgagggctattacttttgcagcgcactgtcaaacagcatcatgtacttttctcactttgtccccgtgtttctcccagcaaaaccaaccaccaccccagcacctaggccacccacccccgctccaaccatagccagccagcccctgtcactccgaccggaggcatgtcgtccggcagctggcggagccgtccacaccaggggtttagacttcgcatgtgatatttacatctgggcgccactggccggaacctgcggagtcctactgctgtcactagtgatcaccctgtattgcaaccatagaaatcgacgtagggtctgcaagtgtcccaggccagtggttaaatccggagacaagcctagtttgagcgctaggtatgtttag

SEQ ID NO: 27935 - DNA, 597 bp, Artificial Sequence
  Description of Artificial Sequence: Synthetic coding sequence
atggctcttcctgtgactgctttacttctcccactagccctgctgctgcatgctgcgaggccgagccagttcagagtaagccccctcgatcgtacttggaatctaggagagaccgtggaactgaaatgtcaggttttactttctaaccctacctcaggatgcagctggttgttccagcctcgcggagccgctgcatcacccacgttcctcctgtacctgagccagaacaagcccaaggccgctgagggcctcgacacccagagattcagcggcaaaagattaggcgacaccttcgttctgacattatccgactttcgcagggaaaacgaaggctactacttctgcagcgcactgtccaactcaataatgtactttagccacttcgttccggttttcttgccagtgcatacccggggattggattttgcctgcgatatatacatttgggcccctctcgcaggtacctgtggagtattgttgctgagtctcgtgatcaccctgtactgtaatcacagaaacaggcggcgagtgtgtaagtgccccagacccgtcgtgaaaagcggggataagcccagcctgtccgccaggtacgtatag

SEQ ID NO: 27936 - DNA, 663 bp, Artificial Sequence
  Description of Artificial Sequence: Synthetic coding sequence
atggccctccctgtgaccgcacttctgctccctcttgccctgctgcttcacgctgcgagacccagccagttccgggtgtctccactcgatcgaacatggaacctcggcgagaccgtggaattgaagtgccaagtgctgttgagcaacccaacgagtgggtgtagctggctctttcagccgcgaggcgcagctgcctcacccacctttctgctgtacctgtcccagaacaagcctaaggccgcagagggacttgatactctttcagatttccggagagaaaatgaaggctactacttctgttcagctctttctaactccattatgtacttttcccacttcgtgccagtctttttacccgctaagccaacgactacccctgctccacggccacccacccccgcaccgaccatagctagccagcccctgagtctcaggcctgaggcctgtcggcctgccgcagggggagcagtgcatactagaggactggatttcgcctgtgatatctatatttgggcacctttggcagggacctgtggcgtgctgttactctctctggtgattaccttatactgtaatcacaggaaccgtcgacgtgtttgtaaatgtccgcgaccagtcgtgaagtctggtgacaagccatccctttcagcgaggtacgtgtag

SEQ ID NO: 27937 - DNA, 597 bp, Artificial Sequence
  Description of Artificial Sequence: Synthetic coding sequence
atggctctgcccgtgaccgcgcttctgctgcccctagcattattgctccacgctgcacgtccatcccaatttcgtgtcagcccgcttgacaggacatggaatcttggcgaaacagtggagctcaagtgtcaagttctcctgagtaacccaacgtctggctgtagttggttattccagcccaggggcgctgctgcctcgcctactttcctgctctatcttagtcagaacaagccaaaggctgccgaagggctcgatacccagcgcttctctggaaaacgactgggtgacacatttgtccttactctttcggactttcgtcgggaaaacgagggctattacttctgctctgcactctcaaacagtatcatgtacttcagtcacttcgtccccgtgtttctgccagctaagcctactaccacccctgcaccgaggccacctacaccagctccaacgatcgctagtcagcccctatccctccgccctgaggcttgccgcccagccgctggaggagctggcaatcggcgtcgtgtttgcaaatgccctcggcctgtcgttaagtccggggacaagccaagcctgagcgctcgttacgtttag

SEQ ID NO: 27938 - DNA, 831 bp, Artificial Sequence
  Description of Artificial Sequence: Synthetic coding sequence
atgagaaatcaagccccaggccgtcctaaaggcgcaacatttccaccgcgtcggcctaccggttctcgcgctcctcccctcgcacccgagctcagagctaagcagcgtccgggagagagggtaatggccctacctgtgactgctctccttctccctctggccctgctgctgcacgccgctcgcccttcgcaattcagagtgtcacctctcgatcgcacctggaacctgggagaaacagtggagcttaaatgtcaggtgctactgtccaaccccacgagtggatgctcctggctctttcagcccaggggagcagctgcctcaccgacttttctcctgtacctgagccagaacaagcctaaggccgcagagggcctggatacccagcggttcagcggaaagagactgggagacacctttgttctgacactctctgacttcagaagggagaacgaaggctactatttctgtagcgccttatcgaacagtattatgtatttctctcacttcgttccagtgtttttgcctgctaaacccactacaactccagctcccagaccccctacgcctgcacccactatcgcgagtcagccactcagcttgcgccctgaggcctgtaggcctgcagccggtggtgcagtccacacacgtggcctggattttgcctgtgatatttacatttgggcccctctagccggaacctgcggggtcttactgctaagccttgtgatcaccctgtattgtaatcaccgcaataggaggcgtgtgtgcaaatgtccccgtcctgttgtcaagagcggggacaaacctagccttagcgctcggtacgtgtag

SEQ ID NO: 27939 - DNA, 240 bp, Artificial Sequence
  Description of Artificial Sequence: Synthetic coding sequence
atgagccataaacagatttattactccgacaaatacgacgacgaggaatttgaatacaggcacgtgatgctccccaaggatatcgctaaacttgtgccgaagactcatttgatgtcagagtcagaatggcggaacttgggcgtgcagcagtcccagggatgggttcattatatgatccacgaacctgagccacacatcctgctttttcggagaccgctgcctaaaaaacctaagaagtag

SEQ ID NO: 27940 - DNA, 204 bp, Artificial Sequence
  Description of Artificial Sequence: Synthetic coding sequence
atgtctcacaagcagatatactacagcgataagtacgatgacgaggaatttgagtaccgtcatgtcatgttgcccaaagacattgcaaaactggtgccaaaaactcacctgatgtcggagagcgaatggaggaacttaggtgttcagcagagccagggctgggtgcactacatgatccacgaaccgggtcagtgcaccggctag

SEQ ID NO: 27941 - DNA, 192 bp, Artificial Sequence
  Description of Artificial Sequence: Synthetic coding sequence
atgcgcacacggcatgtaatgcttccaaaagatattgcaaaacttgtgcctaaaacccatctgatgtcagaatccgaatggagaaatctcggggtgcagcagtcacaaggatgggtgcactatatgatacacgaaccggagccgcacattctgcttttccgcagacctctcccaaaaaaacccaaaaaatag

SEQ ID NO: 27942 - DNA, 240 bp, Artificial Sequence
  Description of Artificial Sequence: Synthetic coding sequence
atggctcacaaacagatctattatagtgacaaatatttcgacgaacactacgagtacaggcacgttatgttgcctagagaattgtcaaagcaggtgcctaagactcatttaatgtctgaggaagagtggcggaggctcggagtgcagcagagtctcggttgggtgcattacatgattcacgaacccgagccccatatcttactgttccgtcggccactgcctaaagatcagcagaagtag

SEQ ID NO: 27943 - DNA, 1533 bp, Artificial Sequence
  Description of Artificial Sequence: Synthetic coding sequence
atgcatcctctgcagtgcgtcctgcaagtgcaacgttccctcggctggggacccttggccagcgtgagctggcttagtttacgtatgtgcagagctcatagttcattgtccagtaccatgtgcccctcgcctgaacggcaggaagatggggctcgaaaagatttcagttccagactcgctgccggacctaccttccagcatttcttgaaatctgcctctgccccacaggaaaaactgtcctctgaggtggaggaccctccaccatacctgatgatggacgaactgctcggacggcagcggaaagtgtatttagaaacttacggatgccagatgaatgtaaacgatacagagatcgcgtggtctatcttgcagaaaagcggctatcttaggacttcaaatcttcaagaagctgatgtaattctcttagtcacttgctcaataagggagaaggcggaacagacaatctggaatcggctgcaccaactgaaagctctgaaaaccagacgcccaaggagccgcgtcccactgcgcataggcattctggggtgtatggccgaacgcttgaaggaagagatcctgaatagggagaagatggtggatatcctggccggaccagatgcttaccgggacctgccacgcctgctggccgtggctgagagtggccaacaggccgcaaacgttttgctgagtcttgacgagacatatgctgatgtcatgcccgtgcagacctccgctagcgccacgagtgcattcgttagcatcatgcggggttgtgataacatgtgttcttattgtattgtcccattcacgcgcggacgggaaaggagtagacccattgcctctatcctcgaagaagtgaaaaaactgagcgagcaagtgctgcagttaatccatgaacgcgataacatctgcaagcagattcatctcccagcacaatcaggatcaagccgggtgctggaagccatgaggcgaggttacagccgagaagcctacgtagagcttgtacaccatatcagagaaagcatcccaggggtcagcctcagttctgacttcatagccggattctgtggggaaaccgaagaggatcatgttcagacagtatctctactcagggaagtacagtacaacatggggtttttgttcgcatattccatgcggcagaagacgagggcttaccaccgacttaaggatgacgtcccggaggaggttaagttgaggcgcttggaagagctgattaccattttccgagaggaagctaccaaagctaatcagacatcggtagggtgcacacagctggtgctggtggaagggctgtccaagagatcggcaacggacctgtgtggacggaatgacggaaatctgaaagtcattttccccgacgcagagatggaagacgtgaacaacccaggccttagggtgcgcgctcaaccgggtgattatgtgttagtgaaaatcacgtcagcctctagtcaaactctgcgcggtcacgtgttgtgtaggaccacactgagagattcctctgcatattgctag

SEQ ID NO: 27944 - DNA, 1764 bp, Artificial Sequence
  Description of Artificial Sequence: Synthetic coding sequence
atgcatcccttgcagtgcgtgctgcaagtccagcgatccctaggctggggtcccctggccagcgtgtcctggctgtcccttagaatgtgcagggcacactcatccctgagctccaccatgtgcccgagccctgagagacaggaagacggggcacggaaggatttctctagccgactagccgctggccctacatttcagcactttctgaagtctgcctccgctcctcaggaaaagcttagctcagaagtcgaagacccgccaccgtacctcatgatggacgaactactgggacgccagcgcaaggtgtacctagaaacttatggatgccagatgaatgttaatgatacagagatcgcctggtcgatactccagaaatcggggtaccttagaacaagcaatctgcaggaggcagacgtgattttgctggtgacctgctccatcagggaaaaggccgagcaaacaatttggaacaggcttcaccaactaaaagctctgaagacacgacggccacggtcacgcgttccgcttcggatcggtatcttgggttgcatggccgagcgcctgaaagaagagattttgaatagagaaaaaatggtggatattctagctggcccagatgcatatcgggacctcccccgactgctggccgtggccgagtctggacagcaggctgcaaatgtgctgttaagtctggatgagacttatgccgatgtgatgccagtgcaaacctccgcttccgccacgtccgccttcgtatccatcatgcgtggatgcgacaatatgtgctcatactgcattgtcccattcacaagggggagggaaaggtccagacctatcgccagcatcctggaggaggtaaagaagctctcagaacagggcttgaaggaggtaacgctgctcggacaaaatgtaaacagttttcgagataactcagaagtccagtttaattccgccgtgccaaccaacctgtcacgcggattcacaacaaattataagaccaagcagggtggtctgaggtttgcacacctgctggaccaggtgtcacgtgtggaccctgagatgcgaattagatttacatccccccatcctaaggattttccagacgaggttcttcaattgattcacgagcgcgacaatatttgtaagcagatccacttaccagcccagagcgggtcaagtagagtattagaagcaatgagaagagggtacagcagggaagcttatgtggagctggtgcaccatatacgcgaatccattccaggggtgtccctaagctcagacttcattgccggtttctgtggtgagacggaggaagatcatgttcagacagtgtctctgctgagggaggttcagtataatatggggttcctgttcgcttattcaatgaggcaaaagacaagggcttaccaccgcctcaaggacgatgtgcctgaagaggtgaaactccggagacttgaagaactcatcaccatttttagagaggaagcgactaaggccaaccagacttctgtcggctgcacacagctggtgctcgttgaaggcctctctaaaaggtccgctactgacttgtgcggaaggaatgatggaaatctgaaggtgatttttcccgatgccgagatggaagatgtgaacaaccctggcttacgcgtgcgcgcacaacccggtgactatgtgctggtgaagatcacctccgctagttcccagactttacggggtcacgtattgtgtcgtacaacactgcgtgactcgagtgcctactgctag

SEQ ID NO: 27945 - DNA, 1806 bp, Artificial Sequence
  Description of Artificial Sequence: Synthetic coding sequence
atgcacccactgcagtgcgtcctacaggtgcagaggagtctcgggtgggggcctctggcctccgtatcatggctgtctctacgtatgtgtagggctcatagcagtctctccagtaccatgtgtccgtccccggagcgccaggaggacggggctcgcaaagatttctcctccagacttgcagctggtccaaccttccagcattttctcaaaagcgcttctgctccccaagaaaagctttctagcgaagttgaggatccccctccttacctcatgatggatgagcttctgggcagacagagaaaagtgtatcttgaaacatacggctgtcagatgaatgtcaatgacactgagattgcgtggagcattctgcaaaaatccggatacctccggacaagcaatttacaggaggccgacgtgatccttctggtgacgtgttccattcgtgaaaaggccgagcagacgatctggaaccgcctccaccagttaaaagccttgaagacacgcagaccacggtctcgggtgcccctgaggatcggaatcctcggatgcatggcggagagactgaaggaagagattttaaaccgcgagaagatggttgatattctggcaggcccagatgcttaccgagatttaccgaggctgctggccgtggccgaaagcggacaacaggctgccaatgttcttctctctctggatgagacctacgccgacgtaatgcccgttcagactagtgccagtgccaccagcgccttcgtgagcattatgcgtggatgtgacaacatgtgttcctactgcatcgtgccatttaccagaggccgagaaaggagccgacctatcgcttctatacttgaagaggttaagaagctgtcagaacaggtgtttctaccacctcgcccaccaaaggtgctgggactgcagggactaaaggaggtgacattgttaggacagaacgttaactcctttcgtgacaattccgaagttcaattcaacagtgcagtcccaactaatttgagccggggttttactacaaattacaaaacaaagcagggagggctcagatttgcccacctgctcgatcaagtctctagagtagatccagagatgagaattcgattcaccagccctcatcctaaagacttccctgatgaggtgctccagttaatccacgaaagagataatatttgcaagcaaattcatctcccagcacaatccggttcctcaagggtgctcgaagcaatgagaaggggatacagccgtgaagcctacgtcgaactggtccaccacatccgggagtcaattcctggggtgagcctctcttctgacttcattgccggtttctgtggcgaaacagaagaagatcacgtgcagacagttagtctgctgagagaagtccagtataatatggggtttctgttcgcatattctatgcgccaaaagactcgagcctaccaccgcctgaaggacgacgtgcccgaggaggtgaagctccgccgtctagaggagctgataacaattttccgagaggaggccaccaaagccaaccagacttctgttggctgcacccagttggtgctagtagaggggctttctaagagatccgccactgacctatgcggccgtaatgacggcaatcttaaagtcatttttcccgacgccgagatggaagacgtgaataatcccggtctgcgtgtccgggctcagcctggcgattacgtacttgttaagatcacatccgcaagttctcagacgttaaggggacacgtgctttgccgaaccactctgcgagactctagcgcctattgttag

SEQ ID NO: 27946 - DNA, 984 bp, Artificial Sequence
  Description of Artificial Sequence: Synthetic coding sequence
atgaacgtcaacgacacagaaatcgcctggagcattctgcaaaaaagcggttatctgcggacaagcaacctgcaggaagctgatgtaattctgttggtgacctgttccatccgcgaaaaagcagagcagacaatttggaacaggttgcaccagctcaaagcactcaaaacccgtagaccgagatcaagggtgcccttgaggatcgggattctaggatgtatggccgaacggttgaaagaggagatcctcaaccgagagaaaatggtcgacatcctggccggaccagatgcatatagagatttgcccaggctgctcgccgtggcggagtcgggccaacaggccgctaatgtactgctgagcctcgacgagacctacgccgatgtcatgccagtgcagacatccgcgtcggccacatctgcgtttgtctattcgagggaggcgtatgttgaacttgtgcaccatatcagagaatcaatacccggagtctcattgtcaagtgacttcatcgctggattctgcggagaaacagaagaagaccacgtccagacagtgagccttctcagggaggtccagtataatatgggattcctttttgcctactcaatgaggcagaagacccgtgcctatcatcgactcaaggatgacgtaccagaagaagtgaagctccggaggctcgaggaactcattacgatattccgggaagaggcaacaaaggcaaaccagacgtctgtcggatgtacccagttggtattagttgaggggctgtctaagagaagcgccaccgacctctgcggcagaaacgacggcaacttgaaggtgattttccccgatgccgagatggaggatgtcaacaacccagggcttcgcgtcagagcccaacccggtgattatgtccttgtcaaaataacttccgcctctagccagactcttcgcggacacgtgctctgcagaaccactctaagggattcttctgcatattgttag

SEQ ID NO: 27947 - DNA, 1494 bp, Artificial Sequence
  Description of Artificial Sequence: Synthetic coding sequence
atgatggatgaactcctcggtcgccagagaaaggtgtatctggagacatacggctgtcagatgaatgtcaacgacactgagattgcctggtctattctacaaaaaagtggttaccttcgcacctcgaatctacaggaggctgacgtgatcctgttggtgacctgctccatcagagaaaaggccgaacagacgatctggaaccgcctgcatcagttaaaggccctgaagactcggcgtccccgaagccgggtccccctgcgcatcggaatcctgggatgcatggccgagcgattaaaggaagagatcctgaatcgcgagaagatggtagacatcctcgcaggccctgacgcctaccgcgatttgcccagactgttggccgtggcagagagcggtcaacaagccgcaaatgtcctgctgagtttggatgaaacttatgccgatgtcatgcctgtgcagacaagcgcctctgccacttctgccttcgtttctataatgcggggttgtgacaacatgtgtagttactgcattgtacccttcacgcgcggtagagaacgctctagacccatcgcaagtattctagaagaggtaaagaaactgtccgagcagggccttaaagaggtgactttgctggggcaaaacgtcaactcctttcgagataattcggaagtccagtttaactctgccgtcccaacaaacctgtcccgcggatttactacgaactacaagaccaagcagggaggcctgaggttcgcgcatctcttagaccaggtgtcacgggtggatccggagatgcgcattcggtttactagtccacatcccaaggattttccggatgaggttctacagctgatacacgagcgcgataatatttgtaagcagatccacttgcctgcccagtcaggtagctctcgggtattagaggcaatgcgacggggatactctcgcgaggcatacgttgaacttgtgcatcatataagagagtcaattcccggagtgtcgctaagctcggactttatcgcaggcttttgcggcgaaactgaggaagaccatgtgcaaacggtgtctctcctgagagaggttcagtacaatatgggatttctgttcgcatatagcatgcgacagaagactagagcctatcacagactgaaagacgacgtgccagaggaagtgaaattgagaagactcgaagaattgattacaatctttagggaggaagccactaaagctaatcagacttccgtaggttgtactcagttggtgcttgtggaggggctcagcaaaaggagcgctaccgatttatgcggacggaacgatggtaatctcaaggtaatttttccagatgctgagatggaagatgtgaataatcccggactgagggtaagagctcagccaggggactatgtacttgtcaaaatcacctcagcctcctcccaaacgctaagaggacatgtactatgcaggaccactctacgagacagtagtgcttactgctag

SEQ ID NO: 27948 - DNA, 1281 bp, Artificial Sequence
  Description of Artificial Sequence: Synthetic coding sequence
atgcatcccctccaatgtgtcctgcaagtacagcggtctctgggctgggggccactcgccagcgtgtcttggctctcactgagaatgtgtcgagcgcatagttccctcagctccactatgtgcccatcgcctgagcgccaagaagatggagcacgcaaggacttctcttctcgcctggccgctggacccacattccagcactttttgaagagcgcaagcgccccacaggagaagttgtcttctgaagttgaagatcctcctccttacttgatgatggacgagctgctgggaaggcagcgcaaggtgtacctggagacctatggttgccaaatgaacgtcaacgacactgaaatcgcctggtctatcctgcagaagtctggctacctgaggacttccaatctgcaagaagccgacgttatccttctggtcacctgcagtatccgggaaaaggccgaacagactatctggaataggctccatcagctgaaggcactgaagacccgtcgccctcggtcaagggtgccactgagaattggaatcctggggtgtatggctgaaaggctcaaggaagagatactcaaccgggagaaaatggtggatattctcgctggcccagacgcctaccgtgatctcccccgactgctggccgtggcggagtctgggcagcaggctgctaatgtcctcctcagtctggatgaaacctatgccgacgtcatgcccgtgcagacctctgccagtgcaacatccgccttcgtctctataatgagaggttgtgacaatatgtgcagctactgtatcgttcctttcaccagggggagagaaagatcccgacctattgccagtattctggaagaggtgaagaagctgtcagaacaggggttaaaagaggttactctgctgggtcagaacgtcaacagctttcgggataacagcgaggtccagttcaactcagctgtgcccacaaacctcagcagaggcttcaccaccaactacaaaacaaaacagggagggctgagatttgcacatctcctcgaccaagtttctagagtggacccggaaatgcgaatcagatttacctctccacatccaaaagattttcccgacgaggtgcttcaactaatccacgagcgggataacatttgcaaacagattcatctccctgcccagtcaggatcctctagggtcctcgaggccatgagacggggttattccagggaagcttatgtagagctggtccatcacatccgtgagagtattcctgaggatactggcatatcttag

SEQ ID NO: 27949 - DNA, 1122 bp, Artificial Sequence
  Description of Artificial Sequence: Synthetic coding sequence
ggcgatgggcagaatctgtttaccaaggatgtaactgtgatcgagggagaggtggcaaccatctcttgccaggtcaataagtcagatgacagtgtcattcagttgctgaaccctaatcggcagacgatttacttcagagattttcggccattgaaagacagccgattccaactgctgaacttctccagctcggaactcaaagtgtccctgaccaatgtatctatatctgacgaagggcgttatttctgtcagctttatacagaccctccacaggaatcttatacaactattaccgtgctggttcctcccaggaatcttatgatcgatatccaaaaggataccgcagtcgaaggggaggaaatcgaagtgaactgcacggccatggcaagcaaacctgctactactatcaggtggttcaagggtaataccgagctgaagggcaaatccgaggtggaggaatggagtgatatgtacacggtgactagtcaactcatgttaaaagttcataaggaagatgacggcgtccccgtcatctgtcaggtcgagcatccggctgtcacagggaatttgcagacccagcgctatcttgaggtgcaatacaaaccccaggtgcacatacaaatgacataccccctgcaaggacttactagagagggtgatgcgttagaactcacatgcgaggctattggaaaaccccagcctgttatggtgacatgggtcagagtcgacgatgagatgccacagcatgctgtgctgtccgggccaaacctctttatcaacaatcttaataaaactgacaacggaacgtatcgttgcgaagcatctaatatagttggaaaggcccacagcgactatatgctgtatgtgtacgactcccgggcaggagaagagggctccattcgggcagtcgaccacgcagtgatcggtggcgtagtagccgttgtcgtgttcgccatgctgtgcctgctgatcattctggggaggtatttcgccagacataaaggtacgtattttacccatgaggcgaagggcgctgatgacgccgctgacgcagatacagctatcatcaatgcagagggcggtcagaataactccgaggagaaaaaagagtattttatttag

SEQ ID NO: 27950 - DNA, 1329 bp, Artificial Sequence
  Description of Artificial Sequence: Synthetic coding sequence
atggccagcgtggtgcttcccagcggaagccagtgtgccgctgcagctgctgctgccgctccccctggattgaggctgcggctgttgctcctgctctttagcgccgctgcactgattcctaccggagacggccaaaatctgttcactaaagacgttaccgtgatcgagggggaggttgcaactatctcttgccaggtgaacaaaagtgacgactctgtgatacaactcctgaacccaaatcgacagaccatatatttccgcgacttccgtccactgaaagatagccgctttcagttattaaacttttcctcttccgaacttaaagtctcgctcactaacgtctccatcagtgatgaaggccgatatttctgccagctgtacaccgacccaccacaagaaagttatacgactattaccgttttggtccctccgaggaatcttatgattgatatacagaaggacacagccgtggagggagaagaaatcgaggtaaactgcactgccatggcatctaagccggctacgaccatccgatggttcaagggtaataccgagctgaaaggtaagtccgaagtggaggagtggagtgacatgtataccgtcacatcccagttgatgttaaaggtgcacaaggaggacgacggtgtgccagtgatctgtcaggtggagcatcctgccgttaccgggaatttacagacccagcggtacctggaggtacaatacaaaccgcaggttcacatccagatgacctaccctttgcagggactgacgagggagggcgatgcactcgaactaacctgcgaggcaattggaaagccacagcctgtgatggtgacgtgggtacgtgtcgatgacgaaatgcctcagcatgctgtcctgagcggaccaaacctgtttattaacaatctcaacaaaacggataacggcacgtaccgttgtgaagcttccaacatcgttggtaaagcacatagcgattacatgttgtacgtttacgaccctccgacaacgattcctcctcctactaccacaaccacaaccaccacaaccacaaccaccacaatcctgacaattatcacagacagtcgggcaggcgaggaagggagcatcagggctgtcgaccatgccgtcattggcggtgtggtggccgtcgtcgttttcgccatgctgtgtctgcttataatactgggcaggtacttcgctcgccacaagggaacttatttcacgcatgaagcaaaaggtgctgacgacgctgcagacgctgataccgccattataaatgccgagggtgggcaaaacaatagcgaggagaagaaggagtattttatctag

SEQ ID NO: 27951 - DNA, 384 bp, Artificial Sequence
  Description of Artificial Sequence: Synthetic coding sequence
atgctctacgtgtacgatcccccaacgactattcctcccccaactaccacgacaacaaccaccaccacgactaccacaaccattcttactattatcacggatacaaccgccaccactgaacccgctgtccacgactctcgcgcaggtgaagagggctcgatccgcgcagtggaccacgccgtgatcggaggagtggtcgctgtggttgttttcgccatgctctgtctgctaatcatcctgggcagatatttcgcgagacataagggaacctatttcactcacgaagctaagggcgctgacgacgccgcagacgctgatacagcgattattaacgccgaaggtggtcagaacaattcagaggagaagaaagagtatttcatttag

SEQ ID NO: 27952 - DNA, 1245 bp, Artificial Sequence
  Description of Artificial Sequence: Synthetic coding sequence
atggcaagtgttgtattacccagcggaagccagtgtgcagcagcagccgctgccgctgccccacccggtctgcgcctacgtctgctactcctcctattctctgccgcagcccttatacctactggtgatggacagaacctgtttactaaggacgtgaccgtgatcgagggcgaggtggcaactatttcttgtcaggtcaacaaatctgacgactccgtgattcagctgcttaatcccaatcgccagaccatctatttcagggatttccggcctctcaaagacagcagattccagttactgaacttttcctccagcgaactgaaagtcagtttaacaaatgtctccatctccgacgaaggacgatatttttgtcagctgtacaccgatccccctcaggagtcgtataccaccatcactgttcttgttccaccgagaaacctgatgatagacatacagaaggatacagccgtggagggagaggagatagaagtgaactgtaccgcaatggcatcaaagcccgctactacgatccggtggtttaaagggaacacagagttaaaaggaaagagcgaagtcgaggagtggtcagatatgtacacggtgacatcccagcttatgctgaaggtgcataaagaggacgatggagtgccagtaatctgtcaggttgaacacccagccgtgacaggtaacctgcagacccagcgatacttggaggtccaatataagcctcaggtgcacatacagatgacctaccctctccagggtttgacacgggaaggggatgccttagagctgacgtgtgaagcaatcggtaagccccaaccagtgatggtgacatgggtgagagttgatgatgaaatgccacagcacgccgttttgtcaggcccaaacctgttcattaacaatctgaacaaaactgacaatggcacctaccgctgcgaggcatccaacatagtgggcaaggctcactccgattatatgctctacgtgtacgattcaagagcaggggaagaaggctccatcagggctgtagaccatgcggtgattggcggagtagtggcggtcgtcgtgttcgctatgctttgcctactaataattttgggcagatacttcgcgagacacaaaggcacctattttacccacgaagccaagggcgctgacgatgcagctgatgccgacaccgccatcattaatgccgaggggggtcagaacaattctgaggagaaaaaagagtacttcatttag

SEQ ID NO: 27953 - DNA, 5346 bp, Artificial Sequence
  Description of Artificial Sequence: Synthetic coding sequence
atgactacttaccgcgctatacctagcgacggagtggatctggccgctagttgtggcgctagagttggcgacgtgctccccggtcctcatacgggagactacgctcctttgggattttgggcacaaaatggatccatgtctcagcctctcggtgagtcccccgcaacagccactgccactgctactgcgacgactcgccctagtccgactacacccgctatgcctaagatgggtgtgagagctcgcgtggctgactggccccctaaacgagaggccctcagggagcacagcaaccccagtccatcccaggatactgatggtaccaaagctaccaagatggcccacagcatgcggagcatccaaaacggtcagcccccaaccagcacccccgcatctagtgggtctaaggcgtttcataggctttcacggcgtcgtagtaaggatgtggaattccaggatggctggcccaggtctccaggcagggccttccttccgttgagacacagaagttctagcgaaatcaccctttccgagtgtgatgcagaagatgcaggtgagcctcgcggtgctaggcacaccggggctctcccactgttccgggagtatggtagtacaagctccattgacgttcaggggatgccagaacagtccttctttgacattctgaacgaatttaggagcgaacagcccgacgctcggggttgccaagcgctgaccgagttgctcagagccgatcctggtcctcatctaatgggcggtgggggtggggcaaagggagactcccacaatgggcaacctgccaaagacagtcttcttccccttcagcctaccaaggaaaaggagaaggctcgcaaaaaacctgccagaggcctgggcggtggcgacaccgtggactctagcatcttccgcaagctgaggagctcaaaacctgagggcgaagcaggaaggtctccaggcgaggccgacgagggaaggtccccaccagaggcctcccgtccctgggtgtgtcagaaatcattcgcacacttcgacgtgcaatcaatgctctttgatctgaacgaggccgctgccaaccgggtatccgtgagtcagagacgaaatacaactactggtgcaagcgccgcttcagcggcaagcgccatggcctctctgacggcctcacgtgcccattctcttggcggattggacccagctttcacatcaaccgaagacctgaactgtaaggagaaccttgaacaggatctcggggacgacaattcgaacgaccttctgttgagttgcccccactttagaaacgaaatcggaggggagtgtgagcggaatgtgagtttctcccgcgcatccgtagggagcccaagcagcggtgagggccatctggccgaaccggcattgtcagcctaccgcacaaacgcctcaatctccgtgcttgaggtgcctaaggagcagcagaggacccagtcccgacccagacagtatagcatcgaacacgtcgacctgggcgcacgctattaccaggattacttcgtgggaaaggaacatgccaattattttggggtggacgagaagctgggcccagtcgctgtgtcgattaaaagggagaagctcgaggatcacaaggaacatggcccacagtaccagtatagaattatcttcaggacacgcgagctgatcacgctgaggggaagcattctggaggacgcgacacctaccgccactaagcacggcaccggcagaggtcttcccctgaaggatgcgttagagtatgtgattcccgaactcaatatacattgtctgcgactagcactgaacacccccaaagtcaccgagcagcttctcaaactggacgagcaaggactctgtcgcaaacataaggtgggaatcctgtactgcaaggctgggcagtcctccgaagaagagatgtacaacaacgaagaggccggtcccgcatttgaagagtttctatcccttataggagagaaagtgtgcctcaaaggatttactaagtacgcagcacagctggacgtcaaaacagacagcaccgggactcactcactctacacaatgtaccaggattacgagattatgtttcacgtgtccaccctcctaccctacacacctaacaatcgccaacaactgctacgtaagagacacatcggtaatgatatcgtaacaatcatcttccaagaaccaggcgctctgccatttacccccaaaaacatcaggagccactttcaacatgtgtttatcattgtgagagtacacaacccctgtactgataacgtgtgttacagcatggccgtcacccgcagtaaagatgcccctccttttggtcctcccatcccttcagggaccacctttaggaagtccgatgtctttagagactttctattggccaaggtgattaatgctgagaatgccgcacataaaagtgataaatttcatactatggcaacgaggactcgccaggagtacctaaaggacttagccgaaaactgcgtctctaatacccccatcgatagtaccggaaagtttaatctcattagtttgaccagcaagaaaaaggagaagacaaaggcgagagcaggggctgaacagcattccgctggggcaatcgcgtggcgcgtggtggcccaggactatgcacagggggttgagattgattgcatactggggatcagtaatgaatttgtcgtacttctcgatctccgtactaaagaggttgtcttcaattgctactgtggcgatgtgataggttggacgccagattccagcacattgaaaattttctacgggaggggagaccacattttcctgcaggcgactgaaggatcagttgaagatatccgcgagatcgtacagcgcctgaaagttatgacatctggatgggagacagttgatatgacactccggcgaaacgggttgggtcagttgggcttccacgtcaaatacgacgggaccgtcgccgaggtcgaggactatggctttgcttggcaggccggacttagacaaggcagccgacttgtggaaatctgcaaggtcgccgtcgtgactctgactcacgaccagatgattgatcttctcaggaccagcgtgactgtcaaggtggtgataattcccccttttgaggatggaactccgcgaagaggttggcctgagacctacgatatgaacacctccgaaccaaaaactgaacaggaatctatcacgcctgggggacgtcccccttaccgcagtaatgccccttggcaatggtcagggcctgccagtcataatagtctgcctgcttctaagtgggctacccccaccacaccagggcatgcccagtctctgagccgcccactgaaacagacgcctatagtccctttccgagagagccagcctcttcattctaaaagacctgtgagtttccctgaaacgccttacactgtaagccccgctggcgctgatagagtccccccttataggcagccatctggctctttctctactcccggatcagcaacatacgtcagatataaaccctctccagagagatacactgctgcaccccatcctctcctgtctctggatccacacttctctcacgatggcacatcctctggcgacagtagttcaggaggactcacgtcccaggaaagcaccatggagagacagaagcccgaacctctgtggcacgtgcctgcccaggccaggttatcagctatagcaggaagttctggcaacaagcatccctcccgccaggatgctgctggaaaggacagccctaatcggcactcaaaaggcgaaccccagtacagctcccacagctcctcaaataccttgtcatctaatgcctcatccagtcactcggacgaccgatggtttgatcctttagatccactcgagcccgagcaggatccattgagtaaggggggatcaagcgactcaggaatcgatacaactctgtacacaagctctcccagctgcatgtcactagccaaggcaccccgacccgctaaaccacataaaccccctggctctatgggactgtgtggtgggggacgagaggctgctggaaggagccatcatgctgacaggcggcgtgaggtgtcgcccgctcccgctgtggcaggccaatcaaagggctacagaccgaaattgtactccagtggctcatctacccctacagggctggccggtggttcaagagaccccccacgccaaccgtccgacatgggctctagagttggctatcccgctcaggtgtataagacagcatccgcggagacacccaggccatctcaactggcacaaccttcaccctttcaactctctgccagcgtcccaaagtcatttttttctaagcagcctgtacgcaacaagcacccaaccggctggaaaagaaccgaggagccaccgccaaggccactgccgttttccgatcccaagaaacaggtggatacaaataccaagaacgtatttggacagcctcgcttaagagcctcattacgggacttgcgctcgcctcgcaagaactacaagtccaccatcgaggacgatctgaagaaacttataatcatggacaacctgggccctgaacaggagcgggacacaggccagtctccgcagaaagggttgcagaggacactgtcagacgaatcgctgtgtagcgggcgtcgcgaacctagctttgccagccctgctggattggaacccggacttccctccgacgtcctgtttacttccacatgtgcctttccttcttcaacactccctgcacgtcgtcagcatcagcaccctcatccgccagtcggcccaggagccacacccgcagcaggcagcggcttcccagaaaagaaatccactatttcagcgtcagagctgtctctcgctgacggccgtgatagacccctaaggaggctcgaccctggcctgatgcctttgcccgacacggctgccggtttagagtggagttcattggtaaatgctgccaaagcgtatgaagtgcagagggccgtgagtctttttagtttaaacgatcctgctctgagtcccgatatccccccagcccatagccccgtccattcccacctgtccctggagaggggacccccaaccccccgtaccactcctacgatgtcagaggagccaccacttgatttgacagggaaagtgtaccagctcgaggtgatgctcaagcagcttcatacagacttgcagaaggaaaagcaggataaggtggtccttcaaagcgaagtcgccagtctgagacagaacaaccagcgcttgcaggaggaaagccaggctgcaagcgagcagctcaggaagtttgcggagattttctgtagggaaaaaaaagaactctag

SEQ ID NO: 27954 - DNA, 660 bp, Artificial Sequence
  Description of Artificial Sequence: Synthetic coding sequence
atggaagcggctagagactacgcgggtgccttgatcagacctttgaccttcatgggcagccagacaaaacgcgtcttgtttactccactgatgcatccagcgaggccttttagagtgagcaaccatgacaggtctagccggaggggggttatggcatcctccctccaggagcttatctcaaagacacttgatgcattggtgatcgccacagggctggtgactctggtgttagaggaggacggaaccgtggtggatactgaagaattcttccagacactgggagacaacacccacttcatgattctggaaaaaggccaaaaatggatgcccggttcccagcacgtgcctacttgtagtcctccgaaaaggtccggaatcgccagggtcacgtttgatctgtatagactgaatccgaaggatttcataggatgcctaaatgtcaaggctaccatgtatgagatgtactcagtgagctacgacataagatgcaccggcttaaagggactgctgcgttcactgctcaggtttctgtcttacagcgcgcaggtcactggacaattcctgatctacctcgggacatatatgctgcgagtcctcgatgataaggaagaacgcccaagcctgagatcccaggcaaaggggaggttcacctgtggctag

SEQ ID NO: 27955 - DNA, 660 bp, Artificial Sequence
  Description of Artificial Sequence: Synthetic coding sequence
atggaatatttatcagcgcttaacccatcagacttattaaggtccgtgtcaaacatctcctctgagttcggaagaagagtgtggacatctgccccacctcctcaacggccatttcgcgtatgtgatcataagcgtacaatccgcaagggtctgacggctgccacccgacaggagttgctggcaaaagctctggaaaccttacttctgaacggcgtcctaacattggtactggaagaagatggaacagccgtggactcggaggatttcttccaactgctcgaggatgatacctgtttgatggtgctgcagtccggccagtcttggtctccaactcgatcaggggttctaagctatggcttaggtagggagcggcctaaacactccaaagatatcgccagatttacttttgacgtctacaagcaaaacccaagggatttgtttgggagccttaatgtcaaagcaactttttacggtctttatagcatgagttgtgacttccagggtctgggacctaaaaaggtgctgagggagctcctcagatggacatccaccttacttcaggggcttggccatatgcttctgggcattagctctacgctccgccacgctgtggagggggctgagcagtggcagcagaaaggtcgcctgcatagttactag

SEQ ID NO: 27956 - DNA, 660 bp, Artificial Sequence
  Description of Artificial Sequence: Synthetic coding sequence
atggaatacctcagtgcacttaatccttccgatctgcttagatcagtgagtaatatctcttccgaattcgggcgacgggtctggacatctgctcccccaccacagcggccttttagagtgtgtgatcacaagcgtaccataagaaaaggccttacagctgctacacgccaggagctgctcgccaaagccttggagactctgctcctgaacggtgtcctcacattggtcctggaagaggatggcacagctgtggactcagaagatttttttcaactcctcgaggatgacacatgtctcatggtcttgcagtccggacaatcctggtcacctacacgatctggggttttgagttatgggctggggcgtgaacgccctaaacactcgaaggacatcgcgagatttacttttgacgtgtacaaacaaaatcccagagatctattcgggtccctcaacgttaaggcaacattctacgggctctattcaatgtcttgcgacttccagggactagggcctaagaaggtgctgcgagaactcctgagatggaccagcacactgctgcagggattaggccacatgttgctggggattagctctactctccgtcatgcagtggagggcgcagaacagtggcagcagaaaggtaggttgcacagttattag

SEQ ID NO: 27957 - DNA, 660 bp, Artificial Sequence
  Description of Artificial Sequence: Synthetic coding sequence
atggagtatctttctgcattaaatcctagcgacttgttgcggagtgtgtcgaatatatccagtgaattcgggagacgagtatggaccagtgcgccacccccacagcggccatttcgagtctgtgaccataagagaaccatccggaagggcttgactgccgcaacacgacaggaactgctggccaaagcgctcgagactctgctgttgaacggcgtccttaccctagtgttggaagaggatggtacagctgtggactctgaagatttcttccagttactggaggatgacacatgtttgatggttctgcagtcaggacagtcctggagtccaacccgcagtggcgttttgagctatgggcttggtcgagagaggcccaagcacagtaaggacattgcaagattcacttttgacgtctacaagcaaaacccacgtgaccttttcgggtcgttgaacgtgaaagctacattttacggcctatattcaatgagctgtgattttcagggcctagggccaaaaaaggttctgcgggaattgctgcgctggacaagcactcttttgcaggggcttggacacatgctactggggatctcgagtacactgcgtcacgccgtcgagggtgctgaacagtggcagcagaagggcagactgcattcatactag

SEQ ID NO: 27958 - DNA, 660 bp, Artificial Sequence
  Description of Artificial Sequence: Synthetic coding sequence
atggagtacctgagcgctctaaatccatctgatctgcttcgcagcgtgtctaatatttctagtgaattcggcaggcgtgtttggacatctgcccctccgcctcagcgacctttcagagtttgtgaccacaagcggacaattagaaaggggcttacggctgctacacgacaagaactgctggcaaaagcactggaaaccctgcttctcaatggagttctaacactagtgctggaggaagatggcaccgcagtagattcagaggacttttttcagcttctggaggatgatacctgcctgatggtccttcaatccgggcagtcttggtcacctacccgatcaggcgttctttcttatggcctgggaagggaacgcccaaaacattctaaggacatcgctaggttcactttcgatgtgtacaaacaaaatccacgggatctctttggatcgttgaatgtcaaagcaaccttctacgggctgtattcaatgagttgcgacttccagggtcttggaccaaaaaaggtgttgagggaactgttacgatggacctccacgctgttgcagggtctcggccatatgctgcttggcatctctagcaccctgcggcatgccgtagagggcgctgaacagtggcagcagaaagggagattgcattcgtattag

SEQ ID NO: 27959 - DNA, 1860 bp, Artificial Sequence
  Description of Artificial Sequence: Synthetic coding sequence
atgaacctggagcgcctcaggaaaagggtccggcagtacctcgaccaacagcagtaccagtctgccctcttttgggctgataaggtcgcatcactgtcccgggaacctcaggatatctactggctagcacagtgcctatacctgacagctcagtaccatagagcggcacacgccctccgtagtcggaagctggataaactgtatgaagcatgtaggtaccttgcagctcgttgccactacgccgcaaaagaacatcagcaagctctggacgtgctcgacatggaagagcctatcaacaagcgattgttcgaaaagtacctgaaggatgagagtggctttaaggacccgtcgtccgattgggagatgtcgcaaagtagcattaagagttctatttgtctgttaagggggaagatctacgatgctctggataaccgcacactggctacctatagctacaaggaggccctcaaactagatgtgtactgttttgaggccttcgatctcctgacatcgcaccatatgctgactgcgcaggaagagaaggagctgctggagtccctaccccttagtaaattgtgtaatgaggagcaagagctcctccggtttctgttcgagaataaactgaagaagtataacaagccgtcggagactgtcattccagagtctgtggacgggttgcaggagaatttggacgtggtggtgagcctggcagaacggcactactacaactgtgacttcaaaatgtgttacaaattaacctccgtcgtcatggaaaaggacccctttcatgctagctgcttgcctgtccacatcggaacgcttgttgagctcaacaaggcgaatgaactattctacctgagccataagttagtggacctttatccaagtaaccctgttagctggttcgccgtgggctgttattacctgatggttggtcacaagaatgaacatgcaaggcgctatttgagcaaggccactaccctggagaaaacttatgggcctgcgtggatcgcttacggccacagcttcgccgtggaaagcgaacatgatcaggcgatggctgcgtacttcactgcagcccagttaatgaagggctgtcatctgcctatgctgtacatagggctcgagtacggcttgacaaataactctaaactggcagagagattctttagtcaagcattgtccattgccccagaggacccttttgtcatgcatgaggttggagtggtggccttccagaacggcgaatggaaaaccgcagagaaatggtttctggatgctttggaaaagatcaaagctatcggcaatgaagttaccgtggacaagtgggaaccgctgctgaacaatctgggccatgtgtgcaggaaattgaaaaaatatgccgaggccttggattatcaccgccaggccctggtgctcatccctcagaatgcttctacctattcagcgatcgggtacatccactccctgatggggaacttcgagaatgcggtggactacttccatactgcactcggtctgcggagagacgatacattcagtgtcacaatgctcggccactgtattgagatgtatattggcgattccgaggcttacattggcgcagatattaaggataagctgaagtgttacgactttgatgtccacaccatgaagaccctcaaaaatatcatctcacccccttgggactttcgcgagtttgaggttgagaaacagaccgcagaggaaacagggcttactccgcttgaaacctctaggaagacgcccgattcccggccatccctggaagagacgttcgagattgagatgaacgagtccgacatgatgctggagacatctatgtccgaccactccacttag

SEQ ID NO: 27960 - DNA, 1428 bp, Artificial Sequence
  Description of Artificial Sequence: Synthetic coding sequence
atggaagaacctatcaataaaagactcttcgagaaataccttaaagatgagtctggctttaaagatccaagtagcgattgggagatgtcgcaaagttctattaagagcagtatttgcctccttcgcggaaaaatctacgacgccctggacaatcgtaccttggccacctacagctataaagaagccttgaagttggatgtctactgcttcgaagcattcgatcttctcacgtcacaccatatgctcactgcccaggaggagaaagaattgctggaaagcctacctcttagcaaactctgcaacgaggagcaggagctactcaggttccttttcgagaacaagttaaagaaatacaacaaaccatcggagaccgtcatccccgaaagcgtggacggccttcaggagaacctggatgtggtggtaagccttgctgagcggcactactataactgcgatttcaagatgtgctataaactgacgtctgtggtcatggagaaagatcctttccacgcgtcttgcctgccagttcacatcggcactcttgtggaattaaataaggctaacgaacttttctacctctcccataagctggttgacctgtatccgtcaaacccagtctcctggttcgcagttgggtgctactatctcatggtgggccacaagaacgagcatgccagacggtatctttcgaaggcaaccacacttgaaaagacatacggcccagcttggattgcatatgggcacagcttcgccgtggagtccgaacatgaccaggcgatggcggcatatttcactgccgcacagctgatgaagggatggaaaactgccgaaaagtggttcctggatgctctggaaaaaatcaaggccattggaaatgaggttaccgtagacaagtgggagcctctactcaacaaccttgggcacgtgtgtaggaagctgaaaaagtatgctgaagccctggattaccaccgacaggccctcgtgctgatcccccaaaatgccagcacttacagcgctattggatacattcatagcttaatgggaaacttcgagaatgccgtcgattactttcatacagccttagggctgcggcgagacgacactttctccgtgactatgttgggacactgcatcgagatgtacatcggggactctgaagcttatatcggcgcagacatcaaggacaaactgaagtgctatgatttcgacgtccatacgatgaagacacttaagaatattatttccccaccttgggatttccgagagtttgaggtggaaaaacagaccgcagaagagaccggcctaacccctttagaaactagccgcaaaactccagattcacggccttccctggaagagacttttgagatcgagatgaatgagagcgatatgatgctggaaaccagtatgtcggaccattccacctag

SEQ ID NO: 27961 - DNA, 1863 bp, Artificial Sequence
  Description of Artificial Sequence: Synthetic coding sequence
atgaacctagaaaggttgcgtaaacgcgtgaggcaatacctcgatcagcagcagtatcagtccgccctcttttgggccgataaggtcgcaagcctgagccgcgaggagcctcaggatatttattggctcgcccagtgcctttacctcaccgcgcagtatcaccgcgctgctcatgccttaagaagccgcaagttagacaaactgtatgaagcatgtcggtacttggccgctcggtgtcattatgccgctaaggagcatcaacaagcgctcgatgtgctcgatatggaggagccaatcaacaaaaggttatttgagaaatacctgaaggatgagtccggattcaaagatccaagctctgactgggagatgtcacagtccagtatcaagtctagtatttgcctgctgcgcggaaagatttacgatgcactagacaatagaacattggcgacctattcatataaagaggccctgaaattggatgtgtattgttttgaagcgtttgacttactgaccagtcaccacatgctgactgcgcaggaggagaaggaactgctggaaagcttaccgttgagtaagctctgcaacgaggaacaagaactcctgcgtttcctgttcgaaaataaactgaagaaatacaataagcccagcgaaactgtaatcccagagagcgtggacgggctgcaggagaacttagatgtcgttgtttccctcgctgagaggcattactacaactgcgatttcaaaatgtgttacaaacttaccagcgtagtgatggagaaggaccctttccatgccagctgtttgccagtccatataggcaccctagtggagctgaacaaggccaatgagttattttacctgagtcacaagctagtggatctgtatccctcgaacccagtaagctggtttgcagtgggatgttactaccttatggtgggtcacaagaacgaacacgctagaagatatctgtccaaggcaaccactctagagaaaacctacggtcccgcatggatcgcctacgggcatagcttcgctgtcgagtcagagcatgaccaggcaatggcagcgtactttaccgctgcgcagcttatgaagggctgtcacttgccaatgctgtacatcggattggagtacggactgactaacaactccaagctggccgaacggtttttttctcaagccctgtccatcgcccctgaagacccattcgtgatgcacgaggttggggtcgtagccttccagaatggtgagtggaagactgccgagaagtggtttctcgatgctctggagaaaatcaaggcaattgggaacgaggttacagtggacaagtgggagccactgctaaataatctggggcacgtttgtcgaaagctcaaaaagtatgccgaggcacttgactaccatcggcaggctcttgtcctcatcccccagaacgcttccacctacagcgctatcggctatattcatagcctgatgggaaacttcgagaatgctgtcgattacttccatacagcacttggccttcgcagggatgacaccttttctgtgacgatgctgggccattgcattgagatgtacatcggggattcggaggcctatattggggctgacataaaagacaagctgaagtgttacgactttgatgtgcacactatgaaaacgctgaagaacatcatcagccccccttgggatttccgcgaatttgaagttgaaaagcaaaccgccgaggagaccggcctaacacctctcgagacgagtaggaagacacccgacagtcgtcccagtcttgaggagacgtttgagattgagatgaatgagtccgatatgatgttagagacttcgatgtccgaccattcgacatag

SEQ ID NO: 27962 - DNA, 1863 bp, Artificial Sequence
  Description of Artificial Sequence: Synthetic coding sequence
atgaaccttgaacgcttgcggaagcgagttagacaataccttgatcagcagcagtatcagtctgccctgttttgggctgacaaagtcgcctccctatcccgcgaagagccccaggacatctattggcttgcccagtgcctatacttgactgcccagtaccaccgagctgctcacgctctgcgaagtagaaagctggataagctgtacgaagcctgccgatatctcgccgcacggtgccattatgctgcaaaggaacatcagcaagccctcgatgtattggacatggaggaacctatcaataaaaggctcttcgaaaaatacttgaaggatgagagcggctttaaggatccatccagcgactgggagatgtctcagtctagtataaaatcatcaatctgcctgcttaggggaaagatctatgatgccttggacaaccgcactctggctacttatagctataaagaggcgttaaaactggatgtctactgtttcgaggcgttcgatctgctgactagtcatcacatgctgaccgctcaggaagagaaggagttattggagtccctcccactgagtaagttgtgcaacgaggaacaggagcttttgaggttcttatttgagaataagttgaaaaaatataacaagccatcagagacagtcatccctgagagtgtagatggattgcaagaaaatctcgacgtcgtagtcagtctagcagagcgccactactataactgcgacttcaagatgtgctacaagttgacctccgtggttatggagaaggatcccttccacgccagttgtctgcctgtccatattggcacattggtggagctgaataaggctaacgagttattttatctatcacacaaattggtagatttataccccagcaatccagttagttggtttgctgtgggatgttactatcttatggtgggacataaaaacgaacatgccaggcgctaccttagcaaagccaccactctggagaaaacctatggtccggcttggatcgcatatggtcatagcttcgcagtggaatcagagcacgaccaagccatggcggcatatttcaccgctgcgcagctaatgaaaggatgccacctgcccatgctctatattggtttagaatacggactgactaataactccaaactagctgaacggtttttctctcaagcacttagcatcgcccctgaggaccccttcgtcatgcacgaagtcggcgtggtggccttccagaacggcgaatggaagaccgctgaaaagtggttcctggacgccctcgaaaaaattaaggcaatcgggaatgaagtgaccgtggataagtgggaacctctgttgaacaacctcggtcacgtgtgccggaagctgaagaagtacgccgaagctctcgattaccacaggcaagctctggtgctaatccctcagaatgctagcacttacagtgccattggctatattcattcgctcatgggaaactttgaaaatgctgttgattattttcataccgccctcggcctgcggagagatgatacattttctgtgactatgctgggccattgcattgagatgtacattggcgacagcgaagcttatatcggcgctgacatcaaggacaagctcaaatgctacgattttgacgtgcacaccatgaagaccctcaaaaatatcatttctccgccatgggacttccgggagttcgaagtggagaagcagactgccgaggaaactggcctaaccccccttgaaacttcacgaaaaaccccagattcgcgaccctctctcgaagagacttttgagatcgagatgaacgagtccgatatgatgcttgaaacatctatgtccgatcatagcacgtag

SEQ ID NO: 27963 - DNA, 1581 bp, Artificial Sequence
  Description of Artificial Sequence: Synthetic coding sequence
atggaagaacctatcaataagcggttattcgagaagtacctgaaagatgagtcaggctttaaagacccaagttcagactgggaaatgtcgcagagctcaattaaatcaagcatatgtcttttaagaggcaaaatctacgacgccttggataaccgcacactggccacttatagctacaaggaggctctcaaacttgatgtgtactgttttgaggcatttgacctactaacatcccaccacatgctgacggctcaggaagaaaaggagctactggagagtctcccactaagcaaactgtgtaacgaggagcaagagctcctcagattcttatttgaaaataaactgaagaagtataacaaaccatcggagactgtgatcccggagtcagtcgacggcctccaggagaatcttgacgtggtagtctccctggccgagcgccactactacaattgcgatttcaagatgtgttacaaactgacctccgtagtgatggagaaagatccattccatgcgagttgtctgcccgtacacattggcaccctcgtcgagcttaataaggcaaatgagctgttctacctgtcccataaactggtcgatctgtaccctagtaatcccgtctcatggtttgcagttggttgctattacctcatggtgggccacaaaaacgagcacgccaggcggtatctgtctaaagctacgacactcgagaagacttacggaccagcatggattgcttacggccactcgtttgccgtggaatccgaacatgatcaggctatggctgcctatttcactgcagcccagttgatgaaagggtgccatcttcccatgctatatattggactcgaatacggattgacaaacaactccaaattggcagagcgatttttttcacaggcattgtccattgcccctgaggaccccttcgtgatgcacgaggtaggcgtggtagccttccagaacggggagtggaaaacggccgaaaagtggtttctggacgctctcgagaagattaaagccatcggcaacgaagtgacggtggataagtgggagccactgctaaataatctgggccatgtgtgtcggaagctgaagaagtatgccgaggcactcgactatcacagacaggccctggtgctgatcccacagaatgcatctacctattctgccatagggtacatccactccctgatgggcaattttgaaaacgccgtggattacttccatactgctctcggcttgagaagagacgacacattttccgtaacgatgctcgggcactgtatcgaaatgtatatcggagactcggaggcctatattggggctgacatcaaggacaagctgaagtgctatgacttcgacgttcacacaatgaaaactctcaagaatataatctctcctccttgggattttcgtgaattcgaggtggagaagcagaccgctgaagagactggcctgaccccccttgagacaagtagaaagacacccgattccagaccctccctggaggagacctttgaaatcgagatgaatgagagtgacatgatgctagagacgtccatgtccgatcacagtacatag

SEQ ID NO: 27964 - DNA, 1581 bp, Artificial Sequence
  Description of Artificial Sequence: Synthetic coding sequence
atggaggaacccattaataaaaggctcttcgagaagtacctgaaggatgaaagtgggtttaaagaccccagctctgactgggaaatgtcccagtcttctataaaatcaagcatttgtttgctgcgcggaaaaatctatgacgccctcgacaatcgcaccctggctacttacagttataaggaggcgcttaaattggatgtatattgcttcgaggcctttgatttacttacatcccaccatatgctgaccgctcaagaagaaaaagagttgttggaatccctccccttgagcaagctttgcaatgaagagcaagagctactgaggttcctgttcgagaacaagctgaagaagtataataaaccaagtgagactgttatccctgagagcgttgacggattgcaagaaaacctggacgtcgtcgttagccttgccgagcgtcactactacaactgcgacttcaaaatgtgctacaaactaactagcgtggtaatggaaaaggacccattccatgcttcctgtctccccgtgcacattggcaccttggtggaactgaataaggccaacgagctgttctacctgagccataaattagttgacctctacccgtccaacccggtttcatggttcgccgtggggtgctactacttaatggtcggccacaagaatgagcacgccaggcgttacctgtctaaggccacaaccctggagaagacatatggccctgcatggatcgcctatggtcactcttttgccgtcgagagcgaacatgatcaggccatggcagcatactttactgccgctcagctcatgaaaggctgccatctgccaatgttatatattggtctggagtacggtctcactaacaatagtaagctggctgagagattcttctcccaggccctgtctatagctccagaggacccatttgtgatgcatgaggtgggggttgtggcattccaaaacggcgaatggaaaacagccgaaaaatggtttttggatgcccttgagaagatcaaggccataggcaatgaggtgacggtggacaagtgggaaccactgctgaacaacctgggccacgtgtgtcggaagctaaagaagtatgctgaagcactggattaccatcgtcaggccttagtcctaattcctcaaaatgctagcacatacagcgcaatcggctacatacacagcctgatgggaaacttcgagaatgctgtcgactacttccacactgctctcggacttagacgcgacgatacttttagcgttactatgcttggacactgtatcgagatgtatattggggactctgaggcatacatcggtgccgatatcaaggataaattaaaatgttacgatttcgacgtgcatacaatgaagaccctcaagaacatcatttctcccccttgggattttcgagagttcgaggtcgagaaacaaacagctgaggagaccggcctcaccccattagagacttcacgtaaaaccccagactccaggccatctctggaagaaacgttcgaaattgagatgaatgaaagcgacatgatgcttgagactagcatgtctgatcattcaacttag

SEQ ID NO: 27965 - DNA, 1428 bp, Artificial Sequence
  Description of Artificial Sequence: Synthetic coding sequence
atggaggagccaatcaacaagagactgttcgagaagtacctcaaagatgaaagcgggttcaaagacccgtcaagtgactgggagatgagccagagctcaattaagtcatctatttgtctgcttcgcggaaagatctacgatgccctggacaatcgcacccttgcaacctattcatataaggaggccctgaaactggacgtgtactgctttgaggccttcgacctgctcacctcccaccacatgctgactgctcaggaagagaaggaactgctcgaaagcctcccccttagcaagctatgcaacgaggagcaggaactccttagattcctgttcgagaataaattgaagaaatacaataaaccaagcgagacagttataccagaaagcgtcgacggtctgcaagagaatctggatgtcgttgtgtcattggccgagcgacattattataattgtgattttaaaatgtgttacaaactaaccagcgttgtgatggagaaagacccattccatgcgagttgcctccctgtgcacattgggacccttgttgagcttaacaaggccaacgagttattttacctgtctcacaaactcgtggacttgtatccctccaatccagtgagctggttcgccgtgggatgctactatctgatggtcggtcataaaaatgaacatgctcgcaggtacttaagcaaagctacaactcttgagaaaacatatggtccggcatggatcgcctacggccacagctttgcagttgaatctgagcatgaccaggcaatggctgcatacttcacggctgcccagttaatgaaagggtggaagaccgcagagaagtggttcctggacgctctggagaagattaaggccattgggaacgaggtcactgtggacaaatgggagcccctgctgaacaacctgggtcatgtatgccggaagctgaaaaagtatgcagaggcgcttgactaccacaggcaggcactggttctgatccctcagaacgcgtcaacctattccgccatcggttacattcactccctgatgggcaattttgaaaatgccgtggattactttcacaccgctctcggcctgcggagggatgacaccttcagcgtcaccatgctcggccattgtatcgaaatgtatataggggatagcgaggcctatatcggtgctgacattaaggacaaacttaagtgctatgacttcgacgttcacacgatgaaaacgctgaaaaatatcataagccccccatgggattttcgcgaatttgaggtggaaaagcagaccgccgaggaaaccggcctgacccccctagaaacttcacgtaaaacacctgactccaggccttcccttgaagagacattcgaaatcgaaatgaatgagagcgacatgatgctcgagacatcaatgtccgatcacagcacgtag

SEQ ID NO: 27966 - DNA, 1500 bp, Artificial Sequence
  Description of Artificial Sequence: Synthetic coding sequence
atggctcaattcgctttcgaaagcgacctgcactcgctgttgcagctggatgcaccgattcctaatgcccctcccgctcgctggcagcggaaggctaaggaggcggctggcccagccccaagccccatgcgggctgccaatcggagccacagtgctggcaggactcccggtagaaccccaggcaagagctcttccaaggtgcagaccacccctagcaaacctggaggagacaggtatatcccacaccgttctgccgctcaaatggaagtggcatccttccttttgagcaaggaaaaccagccagagaacagccagacgccgactaaaaaagagcaccagaaagcctgggcacttaacctcaacggattcgatgtggaagaggccaagatcctgaggctgagcgggaaacctcagaacgcacccgaaggttaccagaatcgtctgaaagtcctgtacagccagaaggctactcccggaagttcccggaaaacttgcagatacattcccagtttgccagacaggatactggatgctccagagatccgtaatgactactaccttaatcttgtggattggagctcgggtaacgtgctagccgtggctctggataactcagtgtacctctggtcagccagttccggcgatattctgcagctccttcaaatggagcagcctggggaatacatctcgagtgtcgcctggattaaggaagggaactacttggccgttggaacatctagtgctgaggtgcagctgtgggatgttcagcaacagaaacggctacgaaacatgacgagtcactccgcgcgagtcgggtctctcagctggaactcctatatactgtcttccggaagtaggtccgggcatattcaccatcacgacgttcgagttgcagaacatcatgtcgcaactttgagcggccattcccaggaggtgtgcggactgcggtgggccccagatggccgacatctcgcttctgggggaaatgataacctagttaatgtatggccctctgcacccggagaaggaggctgggtcccattgcagacatttacgcagcaccagggtgctgttaaggcagttgcatggtgtccatggcaatcgaacgttctggccactggaggaggcacctctgatcggcacatacgtatctggaacgtgtgtagtggcgcttgcctgtccgcagtggatgctcactcccaagtatgcagcattctttggagcccacactacaaagaacttatctccggtcatggattcgcacaaaatcagctggtcatctggaaatatccgacgatggccaaagtggcagaactgaagggccacacaagtagggttctcagtctgacaatgagccctgacggggctacggtcgcctctgctgccgcagatgaaacattacgcctgtggagatgcttcgaactcgatccagcacgtaggagggaaagagaaaaggcctccgccgcaaagtctagtctgatccaccagggcatcaggtag

SEQ ID NO: 27967 - DNA, 1500 bp, Artificial Sequence
  Description of Artificial Sequence: Synthetic coding sequence
atggctcagttcgccttcgagtctgatttacacagccttctgcaactggacgcacccatacccaatgcccctccagcaagatggcagcggaaggccaaggaagccgcaggaccagcccctagccccatgagagctgccaatagatcccactccgccggtaggaccccgggacggacacccggtaagtcatcaagtaaggtccagaccactccaagtaagccaggcggtgatcgatacattccccatagaagcgccgctcaaatggaggtggccagtttcctgttgtcaaaggagaatcagccggaaaatagtcagaccccaactaagaaggagcatcagaaggcctgggcgctgaatctcaacggatttgacgtcgaggaggctaagatactgcgactcagcggaaagccacaaaacgcacccgaaggctatcagaaccggctgaaggttctgtacagtcagaaggcgaccccaggctcttcaagaaaaacatgtagatacatacctagcctacctgacagaatcctggacgccccagaaattagaaatgattattatcttaatttagtggattggtcctctggaaacgttctggccgtcgctctggacaattcagtgtacctttggtccgcaagcagcggcgatatcctccagttgctccaaatggagcagcccggagaatacatctcctctgtcgcatggatcaaagaagggaactacctcgccgttgggaccagtagcgcagaagtgcagctctgggacgtacagcaacaaaagcggctgagaaatatgactagccactcagccagagtggggtcactgagttggaattcatacatattgtccagtggcagtcgctcgggccatatccatcatcacgacgttcgcgtggccgagcatcacgtagctactctcagtggtcacagccaggaagtctgtggcctgcggtgggctcctgatggccgacacctggcctctggaggaaacgacaacctggtgaacgtgtggccctcagccccaggtgaagggggttgggtgccactccagacgttcacgcaacatcagggtgccgttaaggcagtagcgtggtgcccctggcaaagcaatgtgttggctaccggtggcggaactagtgatcggcacatccgaatttggaatgtctgcagtggcgcatgtctctcagccgttgatgctcattctcaggtgtgtagcatactctggtctccacactacaaagagctcatctcgggacatggcttcgctcaaaaccagctggtaatctggaagtatccaaccatggccaaagtggcggagctgaaaggccataccagcagagtcctgagtctgaccatgagtcctgatggcgctacggttgcttcggccgctgctgatgaaacgcttcgactctggcgttgttttgagctggatccggctcggaggagagagcgagagaaagccagcgctgccaagtctagtctgatccaccagggcattcgttag

SEQ ID NO: 27968 - DNA, 1428 bp, Artificial Sequence
  Description of Artificial Sequence: Synthetic coding sequence
atggcacagttcgccttcgaaagcgacttacattccctcctccagctggatgctcctattcccaacgccccacccgctcggtggcagcgcaaggcaaaggaagctgccggtcccgctccctctcccatgcgcgctgccaatcggtctcactccgcgggacgaacccctggacgtacacccggtaagagctcctccaaagtgcagacaacacctagcaaggaaaatcaacctgagaattcccagacccccaccaaaaaggaacaccaaaaagcctgggccctgaacttgaacggttttgatgttgaagaggcaaagatcctgcgcttgtcgggcaagccacagaacgcgccagagggataccagaaccgcctgaaagtcctctactctcaaaaagcaactcctggttcaagcagaaaaacatgtcgatatatcccttctctgcccgacagaatattagacgctccagagatccggaatgactattacctcaatctagtcgattggagtagtggaaatgtgctagcggtcgcgctggataattctgtgtacctgtggtctgcatcatccggggacatattacaactgctccagatggaacagcctggagaatacatatcctctgtcgcttggatcaaggagggaaattacttagccgtgggtaccagctccgcggaggttcagctgtgggacgtgcagcaacaaaagcggttgcgcaacatgacgtcccacagcgcccgagtcggatccctctcgtggaatagttacattctttcaagtggttccagatcagggcacatccaccaccacgacgtgcgggttgctgagcatcacgttgcgacactgagtggacactcgcaggaagtttgcggattacgctgggcccctgacggtagacacctggcatcaggaggtaatgacaatcttgtgaacgtttggcccagcgcccctggcgaaggtggttgggtgccgctacagactttcacccagcaccagggcgctgtgaaggcagtggcttggtgcccttggcagagtaacgtgctggccacaggcggaggcacctcagataggcatattagaatctggaatgtgtgtagcggggcttgtctgagtgccgtagacgcacatagtcaggtgtgcagcattctgtggagtccacactacaaggaacttatctctggacacgggttcgcccagaaccagctggtcatttggaagtacccaactatggcaaaggttgcagagctcaagggccatacgtcccgagtcctcagtttaaccatgagccctgacggagctactgtggcatcagctgcggcagatgaaactctacgcctatggcggtgttttgaactggatcccgctcggaggcgagagcgagaaaaggctagtgctgcaaagtcctcattgattcaccagggcattcgctag

SEQ ID NO: 27969 - DNA, 1422 bp, Artificial Sequence
  Description of Artificial Sequence: Synthetic coding sequence
atgtccacggagctgttctcttcaacgcgagaagagggctcgagtgggagcggcccttccttcaggtcaaatcagaggaagatgttgaatctcctgttggagcgagacacatccttcaccgtgtgcccggatgttcccagaacccccgttggcaagtttctgggtgacagcgcaaacctttctattctcagtggcggaactcctaaaagatgtctggatctaagcaacttgtcatccggcgagattactgccacacaattgacgacctcagcagacctggatgaaaccggacaccttgattcatcaggactacaggaggtgcacttagccggaatgaatcatgatcaacacctcatgaaatgctcacccgctcagttactatgcagcactccaaacgggcttgatcggggtcatcgcaaacgtgatgccatgtgctctagcagtgccaacaaggaaaacgacaacggtaacctggttgattctgaaatgaaatacctgggatcacccatcacgactgtgcctaagctcgacaagaaccccaacctgggagaagatcaggctgaagagattagtgacgaactgatggagttctccctgaaagatcaggaagctaaggtctcgaggtcgggcctgtacagaagtccgagtatgcccgagaacttgaataggccacgattgaagcaggttgagaaattcaaggacaatactatccctgacaaagtgaagaagaaatatttctcaggccaaggcaagttaagaaagggtctgtgtttgaagaagaccgtctccctgtgtgatattactattacacagatgcttgaggaggacagcaaccagggacaccttattggagacttctccaaggtgtgcgctctgcctacggtatcagggaagcatcaggatctgaaatacgttaatccagaaacagtcgcagctttgttgtccgggaagtttcagggccttatcgagaagttttacgtgattgattgccggtacccttatgagtacctgggtggacatatccagggcgctctcaacttgtatagccaggaagaactgtttaacttctttctgaaaaagcccatcgtcccactggatacacaaaaacggattataatagtgtttcattgtgagttcagttcagaaaggggccctcggatgtgccggtgcctgagagaagaggaccgctctttaaaccagtatccagcactgtactacccagaactctatatcctcaagggcggatatagagacttttttccagagtacatggaactgtgtgagccgcagagctactgccctatgcaccaccaggaccataaaacagagctgcttagatgtcgctcacagagcaaggtacaggagggggagcggcagcttcgggagcagatagcactgctggttaaagatatgtccccatag

SEQ ID NO: 27970 - DNA, 1203 bp, Artificial Sequence
  Description of Artificial Sequence: Synthetic coding sequence
atgtccacagaactgttttcaagtacaagggaggagggctcgagtggatccggaccttctttccgctcaaatcagcgcaagatgctgaatctcctgttagagagggacacaagctttactgtgtgtcccgacgtgccacgcacaccggtgggcaagttcctgggagatagcgccaatctgagcatcctgagcgggagtcccggtttctttcgtactagcgggtccgctttttcttgggacgataacgggaacctggtggatagcgagatgaaatacttgggatcaccaattacaacagtacccaagctggataagaatccaaacttaggcgaagaccaagccgaagaaatcagtgatgagttgatggaattctctctgaaggaccaggaggctaaagtctcccgatcaggtctgtatcgctccccgtcgatgcctgagaacctgaatcggcctcgtctcaagcaggtagagaagttcaaggacaacacaatacctgataaagtgaaaaaaaagtacttctccggccagggcaagctccggaaggggttatgcctgaagaagaccgtttctctttgtgacataactatcactcagatgcttgaagaggacagcaaccagggccacctgattggggatttcagtaaggtgtgtgcgctcccaacagtgtctggaaaacatcaagatttgaaatatgttaacccagagactgtggccgcactgctgtccgggaaattccaggggcttatcgagaaattttacgtaattgactgtcggtatccctacgaatacctgggcggtcacatccagggtgcattaaacctctattcccaggaggaactcttcaatttcttcctgaagaagccaatagtgccactggatacacagaaacgcattatcatcgtgtttcattgcgaattcagctccgagagaggtccacgcatgtgccgatgtctgcgcgaggaagacagatcgcttaaccagtaccccgctctctattatccagagctgtacatcctgaagggcggatatagggattttttcccagagtacatggagctgtgcgagccccagtcatattgtcccatgcaccatcaggaccacaagactgagctgctgcgctgtcgcagtcaatcgaaggtccaagaaggcgaacggcagctcagagagcaaatcgcacttctggttaaagacatgtctccgtag

SEQ ID NO: 27971 - DNA, 1332 bp, Artificial Sequence
  Description of Artificial Sequence: Synthetic coding sequence
atgtctaccgagctcttctccagcacacgggaggagggaagttccggctccggcccttccttcaggtcaaaccagaggaagatgcttaacctgctcctcgagagggacacatcattcaccgtttgcccagacgtgccaagaacccccgtcgggaaattcctgggggacagtgccaacctctccatactgagcggcggaacaccaaaaagatgcttggatctgagcaatctgtcctccggcgagatcacagctactcagctgacaacgagcgctgacttggatgagaccggccatctcgacagctctggactgcaggaagtgcacctggccggtatgaaccacgatcagcatctgatgaagtgttccccagacaacggcaacctagtagattccgaaatgaagtatcttgggtctcccatcaccacagtgcccaagctggacaagaaccccaacctgggggaggatcaggcggaagaaattagtgatgaattaatggaattcagtctgaaggaccaagaagcaaaagtatctagatccggcctctataggtccccttctatgcccgagaaccttaataggccccgattgaagcaggtggagaagtttaaagataataccattcctgacaaagtgaagaaaaagtacttctcaggtcagggtaagttgcgtaaagggctgtgtctcaaaaaaactgtaagcctctgtgacatcaccataacacaaatgctggaggaagattccaatcagggacatctcatcggagatttttccaaggtgtgcgccctcccaacagtgagcgggaaacaccaggatctgaagtacgttaaccccgagacggtcgcggctctgttatcaggcaaatttcaaggactaatcgagaaattctacgttattgattgccgctacccttatgagtatttgggcggtcatatccaaggggcactcaacctttacagccaggaagaactgtttaatttctttctaaaaaaacccatcgtgcccctggacacccaaaaaagaatcatcatcgtcttccactgcgaatttagctctgagagaggacccaggatgtgtaggtgtctgcgagaagaggacagaagcctaaatcagtaccctgcactctactaccctgaactctacatcctaaaggggggttaccgtgactttttcccggagtacatggagctatgtgagcctcagagctactgtccaatgcaccatcaggatcacaagactgagctactgaggtgccgatcccaaagtaaggtacaagaaggagaaagacagcttagggagcagatcgccttactggtgaaagacatgtccccatag

SEQ ID NO: 27972 - DNA, 1293 bp, Artificial Sequence
  Description of Artificial Sequence: Synthetic coding sequence
atgagcacggaactgttcagttccaccagagaggagggaagttccggcagtgggccatcattcaggtctaaccagcgcaagatgctgaacctgctgctggagagagatacctctttcaccgtctgtcccgacgtgcctcgaacacccgtgggcaaatttttgggggactctgccaacctgagtatcctgtcaggttcacctggcttctttagaaccagcggttccgccttcagctgggatgcgcaactcctttgctctactcctaatgggctggatcggggacaccgtaagagagacgccatgtgcagctcttccgccaataaagagaacgataacggtaatctcgtggacagtgagatgaagtatcttggcagccctattaccacagtgccaaagctagacaaaaaccccaaccttggagaagaccaggctgaagaaatatcagatgaactcatggaattttcactgaaggaccaggaggccaaggtttctcggagtggcttgtatcggtccccgtcaatgccagaaaacttaaaccggccacggctcaagcaggtggagaagttcaaagacaacacgattcccgacaaggtgaaaaagaagtacttctcaggccaggggaagctccgcaagggcctatgcctcaagaagaccgtcagcctctgtgatatcaccattacacagatgctggaagaggactccaatcaaggacacctcataggggatttttcaaaagtgtgcgcactcccaacagtgagtggcaagcaccaagatctgaagtatgtgaatcctgagaccgtggccgcactcctgtccggcaaatttcagggactgattgaaaagttctatgttatcgactgtaggtacccctatgagtacctgggcggacatattcagggcgcactcaatctgtatagtcaggaagagctgtttaactttttcctgaaaaaacctatagtaccacttgacacccaaaaacgcatcatcattgtgtttcattgtgaattctcatctgagcggggtccaaggatgtgtcggtgcctgcgggaggaagaccgatccctgaaccagtaccctgcactgtattatccagagctatatatcctgaaaggcggatacagggatttctttccagagtatatggagctatgtgaaccgcagtcatattgtcctatgcatcatcaggatcacaagaccgaactcctcaggtgtaggagccagtcaaaggtgcaggaaggagaacgccagctgcgggagcagattgctctgttggtaaaagatatgagcccgtag

SEQ ID NO: 27973 - DNA, 1203 bp, Artificial Sequence
  Description of Artificial Sequence: Synthetic coding sequence
atgtccacagaactcttctctagcacccgcgaagagggttcaagcggatccggaccaagtttcagaagtaaccagcgaaagatgcttaacctgcttctagagcgtgatacatcatttactgtatgtcccgacgttccaaggactcctgttggcaagttcttgggcgattccgccaacctcagcattctgtccgggagccccggattcttccggactagcggcagcgcgttctcttgggatgataacggaaaccttgtggatagtgagatgaaatatctggggagccctattaccacggtgcccaaacttgacaaaaacccaaaccttggagaagatcaggccgaggagatttctgacgagttgatggagttcagcctgaaggaccaggaagccaaggtatccaggtccggactatacaggtcccctagcatgccagaaaatctgaatagaccccgactgaaacaagtggaaaagttcaaagacaacaccatccccgacaaggtcaaaaagaagtatttttcgggccaaggcaaactgcgaaaaggactctgtctcaaaaaaacggtcagtttgtgcgacataaccattacgcagatgttggaagaagacagtaaccagggacacctcatcggcgacttttccaaggtctgcgctcttcctactgtttccgggaagcatcaggatctaaagtatgtcaaccccgagaccgtggccgcattgctatccggaaaatttcagggcctgattgagaaattttatgtcattgattgcaggtatccttatgagtatttgggagggcacatccagggggctctgaatctctactcacaggaagaactgttcaatttttttctgaaaaagcctatcgtgcctttagacactcagaagcgtatcattatcgtctttcactgcgagttttcatcggaacgaggacccaggatgtgccgctgcctacgggaggaagaccgaagccttaatcaatacccagcgttatactaccccgagctgtatatcctgaaaggcggataccgggattttttccccgaatacatggaattgtgtgagcctcaaagctactgccctatgcaccaccaagaccacaaaaccgagttactgaggtgtagatcacaatcaaaagtgcaggagggggagcgacagctcagagagcagatcgccctcctggtgaaagacatgtcaccctag

SEQ ID NO: 27974 - DNA, 750 bp, Artificial Sequence
  Description of Artificial Sequence: Synthetic coding sequence
atgagcaccgagctcttctcatcgacccgggaagaaggcagttctggctctggcccatcttttcgctctaatcaacggaagatgctgaacctactgttggagcgggacacctcttttactgtctgtcctgatgttccccgaactcccgtcggcaagttcctaggagattctgcgaacctgtctatcttgagtggcggtactcctaagaggtgtttagatcttagcaatctgagttcaggcgagatcacggccacacagctgactacttccgccgatctcgatgagacgggccacttagactcctcaggactccaggaggtgcatctagcgggtatgaatcatgatcaacacttgatgaaatgttctccagcgcagcttctgtgctctacaccaaacggactcgaccgtggccacaggaaaagggatgccatgtgtagctcctctgccaacaaggagaacgataatggcaacctggtggactcggaaatgaagtacttagggagccctattactactgttcccaaattagataagaaccccaacctaggagaggatcaagccgaagagatttccgatgagctgatggaattttcactcaaagaccaggaagccaaggtgtctcggagcggtctgtatagatctcccagcatgcctgagaacctcaatcgtcctaggttgaaacaggtggagaagttcaaggataacaccattcccgacaaggttaaaaaaaagtattttagcggacagtag

SEQ ID NO: 27975 - DNA, 1422 bp, Artificial Sequence
  Description of Artificial Sequence: Synthetic coding sequence
atgtccactgagctattttcctcaacacgcgaggaaggatcatctggatctggaccatcttttcggtccaaccagagaaagatgttaaacttactactagagcgcgacacctccttcaccgtgtgcccagacgttcctaggacacccgtggggaaatttcttggtgacagcgccaacttgtcaattctaagcggaggtacaccaaagagatgtctggacctgtctaacctcagcagcggcgagattacggccacgcagttaacaacttctgcagacctggacgaaaccgggcatctggattcttctggactgcaggaggtccacctggcgggaatgaaccatgaccagcacctgatgaagtgtagcccagcgcagctcctgtgttccacacctaatggactggaccggggacacagaaagagagacgccatgtgctcctccagtgcaaacaaggagaatgataacggtaaccttgttgatagcgagatgaaatatctgggtagcccaataacaaccgtgcctaaattggacaagaaccccaaccttggcgaggaccaagctgaagagattagcgacgagttgatggaattttcgctgaaggaccaggaggcgaaggtcagtaggagcggattgtaccggtcacccagcatgcccgagaatctaaatagaccaagattgaagcaggtcgagaagttcaaagataatacgatacctgataaggtgaaaaaaaaatacttctcggggcaagggaagctacgaaaggggctgtgtcttaagaagactgtcagtttgtgtgatataacaatcacccaaatgctagaagaggacagtaaccagggccacctcataggcgattttagcaaggtgtgtgcgttacccactgtgtccggaaagcaccaggacctgaagtatgtaaaccccgagactgtagcagccctcctatctggcaaattccaggggctaatagagaagttttacgtgatcgattgcagatacccttatgagtacctggggggtcacattcaaggagccctgaacctgtatagccaagaggagctatttaacttctttttaaaaaagcccattgtccccctcgatactcagaagcgcattatcatagttttccactgtgagtttagctccgaacgcggtcccagaatgtgtcggtgccttcgagaagaggacaggtcgctcaaccagtacccagccctctattacccagagttatacatcctgaagggaggataccgcgatttcttccctgagtacatggagctgtgcgaaccgcagtcgtattgcccaatgcaccaccaagaccataaaaccgagcttttacgctgccgcagtcaatcaaaggtgcaagagggtgaaaggcagctgcgcgaacagatcgccctgctcgtgaaggatatgtctccctag

SEQ ID NO: 27976 - DNA, 1473 bp, Artificial Sequence
  Description of Artificial Sequence: Synthetic coding sequence
atgtccgaggaagcccgattttgcttcagccccggagagaacagcaaaactatgtccaccgaactgtttagcagtacgagagaggagggctcctctggttccggaccaagcttccggagcaaccagcgcaagatgctgaacctgttgttggaaagggacacatcatttaccgtctgtcccgatgtaccacgaacccccgtgggaaagtttctaggagacagcgccaatctgtctatactatcagggggaactccaaagaggtgtttggacctgtccaacttgtcctcaggcgagattaccgcaacacagctcacaacaagcgcggacctggacgaaacaggccatctcgactcctctgggttgcaagaggtgcacttagctggtatgaatcatgatcagcacctcatgaaatgttctccagctcagcttttgtgctcgactccaaatggcctcgatagagggcatcggaaaagggacgctatgtgttccagcagcgcaaacaaggaaaatgacaatgggaacctcgtggatagtgaaatgaagtacctgggatctccaataaccacagttcctaaacttgacaaaaacccaaacctgggagaggatcaggcagaggagatttccgacgagctcatggagttcagtctgaaggatcaggaagctaaagtgtctagatccggcttataccgaagcccctcgatgccagagaaccttaacagaccacgtctgaagcaggtagagaaattcaaggacaacaccatccctgataaagtgaaaaagaaatacttttccggccaaggcaaactgcggaagggcctgtgcctgaaaaaaactgtctccttatgcgacattactattacccaaatgcttgaggaggatagtaatcaaggccatctcattggagatttttcgaaggtatgtgcgctgccaaccgttagcggcaaacaccaggacctcaaatacgtgaatccagagaccgtagccgcattgctgagcggcaagttccaggggctaattgaaaagttctatgtgatcgattgtaggtatccttatgaatatttgggcggacatatccaaggcgctttgaatctgtacagccaagaggagttgttcaactttttcctaaaaaagcccatcgttcctttggatactcagaagcgaattatcattgtgttccactgtgaattcagttccgagagggggcctaggatgtgtaggtgcctgcgcgaggaagacaggagcctgaaccagtacccagccctctattaccccgagttgtacatcctcaaagggggataccgggacttcttccccgagtacatggaactgtgtgagccgcagtcttattgccctatgcatcaccaggaccacaagactgagcttttacggtgtcggagccagagcaaagtgcaggagggcgagcggcaactacgggagcagatcgccttgctcgtgaaagacatgagtccatag

SEQ ID NO: 27977 - DNA, 288 bp, Artificial Sequence
  Description of Artificial Sequence: Synthetic coding sequence
atggaaggtggattcggcagcgactttgggggttctggaagcgggaaactggatcccggactcatcatggagcaagtgaaggtgcagattgcggtcgcgaacgctcaggaactcttgcagagaatgacagacaagtgcttcagaaaatgtatcggcaagccaggaggctcccttgataatagcgaacagaaatgcatcgctatgtgtatggataggtacatggatgcctggaatacagtgtccagagcatataactccagactgcagagagagagagccaatatgtag

SEQ ID NO: 27978 - DNA, 576 bp, Artificial Sequence
  Description of Artificial Sequence: Synthetic coding sequence
atgcagactataaagtgtgtggtcgtcggagatggcgcagtggggaagacttgccttctgatttcttatacaacaaataaattccccagtgagtatgtccccacagtgtttgacaactacgcagtgacggttatgataggaggagaaccatatacgttgggactgttcgatacagctgggcaggaagattacgacagactccgcccactgagttacccacagaccgatgtctttctggtttgttttagcgtggtgagtccatcctcattcgaaaacgtgaaagagaaatgggtcccagaaatcacacaccactgtcccaagacaccatttctactcgtggggacacaaatcgacctcagagacgaccctagcactatcgaaaaattggcaaagaacaagcagaaaccgatcaccccagaaacagccgaaaaattagcaagagacctgaaagcagtgaagtatgtggagtgctccgccctaacgcagcgcggactgaagaacgtcttcgacgaggctattttggccgcacttgaaccacccgagacgcagcctaaaaggaagtgctgcattttttag

SEQ ID NO: 27979 - DNA, 576 bp, Artificial Sequence
  Description of Artificial Sequence: Synthetic coding sequence
atgcagactataaagtgcgtcgtggttggagacggcgcagtgggtaaaacatgtctgctgatcagttacacaactaacaagtttccctccgagtacgtccccaccgttttcgacaattatgccgttacggtgatgatcggcggagaaccgtacacgctgggcctgttcgacaccgctggacaagaggactacgatcggctccgcccactttcgtatccacagactgatgtctttcttgtgtgcttttcagtcgtgagcccctctagctttgagaacgtcaaggagaagtgggtgcctgaaatcacgcaccattgccccaagacccccttcttactggtcggaacgcagatcgatctgcgtgatgatccgagcacaatagagaaactggctaaaaacaaacagaagccaataacccctgaaacggcagagaaactggcccgtgacttaaaggccgtgaagtatgtggagtgctccgcactcacacaaaaggggctaaagaacgtgtttgatgaggctatcctggcagccctggagcctcccgaaccaaagaagtctcgaaggtgcgtactactgtag

SEQ ID NO: 27980 - DNA, 576 bp, Artificial Sequence
  Description of Artificial Sequence: Synthetic coding sequence
atgcagaccatcaagtgcgtagtcgttggcgacggcgcagtaggaaagacttgcctccttatttcttatactaccaataaattcccctctgagtatgtccccacagtgttcgacaattacgcagtgacagtcatgatagggggagagccttataccctgggcctctttgataccgcaggtcaagaggattacgataggctcagacctctgagttatccacagacggacgtgttcttagtttgctttagcgttgtgtcacccagttcctttgagaacgtaaaggagaagtgggtgccagagatcacacaccactgccccaagacacctttcctgcttgtcggaacccagatcgatttacgggacgacccatccaccatcgagaaactggccaagaataagcagaagcctatcactcccgagactgccgaaaaactggctcgggacctcaaggctgtgaagtatgttgagtgttccgccttgacacagaagggactgaaaaacgtcttcgacgaggcaatcctagccgctcttgaacccccagaacctaagaagagtagaaggtgcgtgcttctctag

SEQ ID NO: 27981 - DNA, 411 bp, Artificial Sequence
  Description of Artificial Sequence: Synthetic coding sequence
atgcagaccattaaatgtgtcgtggtgggagatggcgcagttgggaagacctgcctccttatcagctacactaccaataagtttccttccgagtacgtccctactgtctttgataactatgctgtcacagtgatgattggaggggagccatacaccctaggactcttcgatactgctggacaggaagattatgaccgtctgcgtccgttgagttatcctcagactgacgtctttctcgtgtgttttagtgtagtctcaccgagctctttcgagaacgtcaaggagaaatgggtgcccgagattactcatcactgccccaaaaccccctttctgctcgtgggcacccaaatcgacctccgtgacgatccctctactatcgagaagttggccaagaataagcagaagccctag

SEQ ID NO: 27982 - DNA, 702 bp, Artificial Sequence
  Description of Artificial Sequence: Synthetic coding sequence
atgagcccagatattttgcataataagcaaatctctatcggtatctgcaccgactatttggatttctcatgggtcaactacatccactttaaacagctgaaaaaccagtggaaagtcagaagaggcgacacaggtttcgcccgtagtgctggccgtcagaacagctctagacaggattctaacgaatggtggtctcagtttggggaggtatgtcccacaagctggaatgaagtcttcgacaattacgctgtgaccgttatgattgggggagagccctatacgttagggctattcgacacagccggtcaggaggactatgaccggcttagaccattgtcttaccctcagaccgacgtgtttctcgtttgtttttcggtggtgtcacccagctctttcgaaaacgtgaaagaaaagtgggtccccgagatcacacaccactgcccgaagacaccatttctcctggtcgggacccagattgatctgagagacgatccatccaccatcgaaaagctggctaagaataagcaaaaacctattaccccagagactgcagagaaacttgcacgagatctcaaggccgtgaaatacgtggagtgcagcgcccttactcagaagggactcaaaaatgtcttcgatgaagccatactcgcagctttggaaccgcctgagccgaagaaaagccggaggtgcgtgttgctctag

SEQ ID NO: 27983 - DNA, 1269 bp, Artificial Sequence
  Description of Artificial Sequence: Synthetic coding sequence
atgaattccggccactcctttagtcagacgccctctgcaagcttccatggggcagggggtggctggggcagacccagaagcttcccaagagcaccaacggtgcatggaggggcaggcggagctcggattagtctgagttttaccacccgcagctgccccccacctggtgggagctggggctctggtagaagttctccgttgcttggcggaaatgggaaggccactatgcagaatctgaatgatcggctcgcgtcctaccttgagaaagtcagggctttggaggaggccaacatgaagctggaatcaaggatattaaaatggcaccagcagagggaccctgggagtaaaaaggactactcacaatatgaggagaacatcactcacctacaggagcagatcgtggatggcaaaatgacaaatgctcagattattcttcttattgataatgcacgaatggctgttgatgattttaatttaaaatacgagaacgaacactcattcaagaaggacctcgagatcgaggtcgaaggcctaaggcgtacgctggacaatttgactatcgtcacaacagatctggagcaagaagtcgaggggatgcgcaaagagcttattttgatgaagaaacaccatgagcaggagatggagaaacatcatgtcccttcagactttaatgtgaacgtgaaagtggatacggggcctagagaggaccttataaaggttcttgaagacatgaggcaagagtacgaactaattataaagaagaaacaccgcgacctggacacctggtacaaggaacagtccgccgctatgtcccaggaggcagcaagccccgctacggtacagagtcgccagggcgacattcatgagttaaagagaacattccaagcactggaaatcgatttgcaaacacagtatagcaccaagagtgcgctcgaaaacatgctgagtgaaactcaaagtcgttatagctgtaagctgcaggacatgcaagagattatctcccactacgaggaggaacttacacagctgaggcacgagctggaacgccagaataatgagtaccaggtgcttctgggcatcaagacgcatctggagaaagagatcacaacttatcgcagactgctggaaggcgagtccgagggcaccagggaggaatccaaaagttcaatgaaggtgtccgctacacctaaaatcaaggccattacacaggagacaattaatggtcgactcgtgttatgtcaggtcaacgaaatccagaagcacgcatag

SEQ ID NO: 27984 - DNA, 1596 bp, Artificial Sequence
  Description of Artificial Sequence: Synthetic coding sequence
atggctgacgtcttgtccgtgctgcgacagtacaacatacaaaaaaaggagatcgtggttaagggagacgaggtaatttttggggagtttagctggccaaagaatgtgaaaacaaactatgtcgtatggggaactgggaaggagggacagccccgtgaatattataccttggattctattctgttcctcctgaacaatgtccacttatcccatcccgtgtatgttcgccgagcagccaccgagaacatccctgttgttcgcagaccagataggaaggatctcctcgggtatctgaacggcgaggcctctacttccgcatcgatcgatcgaagcgctccactagaaattggcctgcagcgtagcacacaagtgaagcgggctgcagatgaggtcctggccgaggccaagaaaccccgaatcgaggacgaggaatgcgtcagattggataaggaaaggctcgccgcacgcctcgaagggcacaaggaagggattgtgcagacagaacagatcaggtctctgagcgaggctatgtcggtggagaagatcgcagctataaaggcgaagatcatggccaaaaagcggtccactatcaaaacagatttggacgacgacatcacagccctgaagcagcgatccttcgttgatgccgaggtggatgtaacaagggatatcgtctcaagagagcgggtgtggcgtacccggaccaccatccttcagtctacgggaaagaactttagcaagaacatcttcgctatcttgcaaagtgtcaaggcacgggaggagggacgagcaccagaacagcggcctgccccaaacgcagctcctgtggaccccactctgcgcactaaacagccaatacccgcagcctacaacaggtacgaccaggagagattcaagggtaaggaggaaacagagggcttcaagattgatactatggggacttatcatggcatgacactaaaatcagtgacagagggggcttcagccaggaagacccagactccagccgctcagccggtgccaaggcccgtttctcaggcgagaccaccccctaaccaaaaaaaagggtcaagaactcccatcatcatcatccctgctgccactaccagcctaattacaatgctgaacgcaaaagaccttctccaggatctcaaatttgttccttccgatgagaagaaaaagcaggggtgccagcgcgaaaacgagaccctcatccagcgcaggaaagatcagatgcagccagggggaactgctattagtgtgactgtgccatatcgcgtggtcgaccagcccctcaaactgatgcctcaggactgggatcgcgtggtcgccgtgttcgttcagggcccagcctggcagttcaaaggttggccatggctactcccagatggcagcccggttgacatatttgcaaaaattaaagcgtttcatctgaagtatgatgaagtcagactggatccgaatgtgcaaaagtgggatgtgaccgtcttagagctatcttaccacaagcgacacctcgatagacccgtcttcttgcgattctgggaaacccttgataggtatatggtcaaacataaatcccacctgcgtttttag

SEQ ID NO: 27985 - DNA, 951 bp, Artificial Sequence
  Description of Artificial Sequence: Synthetic coding sequence
atggccgacgtgctgtctgtactgaggcagtacaacatccagaagaaggaaatcgtggtgaaaggggacgaagtcattttcggtgagttttcgtggccaaaaaatgtaaagactaactatgtagtctgggggaccgggaaggagggacaacccagagagtactacactttagattcaattctgtttctcctcaacaacgtgcacctatcacaccctgtgtacgtccggagagctgctactgagaacatcccagtggtgcgcaggccggataggaaggaccttctgggctacctgaacggagaggccagcacatcagcttccatcgaccggtccgcacctctcgaaatcggcctgcagagatcgacacaggtgaagagggctgctgacgaagttttagccgaggctaaaaagccacgaattgaagacgaagagtgcgtcaggctcgacaaggaaaggctggccgctcggctggagggtcacaaagaaggcatcgtccagaccgagcaaattcggagtttaagtgaggccatgagcgtggagaaaattgccgctataaaagctaaaatcatggccaagaagaggagcacaatcaaaaccgacttggatgatgacatcaccgccctgaagcaacgctccttcgtggatgccgaagtggacgtgaccagggatattgtgagcagggaaagagtctggaggactcgcactactatcctgcagtctactgggaagaacttctccaaaaatatatttgccattctgcagtctgtgaaagcgagagaagaggggagggccccagagcagagacccgcacccaacgccgcacctgttgatcccacgctccgcactaaacaacctattccagctgcatataaccgctacgatcaggaacgcatcagcaacacacactatcataatagctgctcctaccacttgtttaacaatcacgcctag

SEQ ID NO: 27986 - DNA, 1317 bp, Artificial Sequence
  Description of Artificial Sequence: Synthetic coding sequence
atgggcggttgtgcgggatctcgaagaagattttctgactcagagggtgaggagaccgtgcctgagccacggctgccactgctggaccaccagggtgcccattggaagaacgctgtcgggttttggctgctgggactttgcaataatttttcctatgtagtgatgttaagcgccgctcatgatattctgtcacacaaaaggacttctggaaaccagagccacgtggatcctggccctacccccattcctcataatagctcctcaaggttcgactgtaacagcgtcagtactgccgctgtgctgctcgccgacatcctccccacacttgttattaaacttctggcccctctagggctgcacctgttgccttattctcctcgcgttctcgtatccggaatctgcgccgcaggatccttcgtgttggttgccttcagtcacagtgtggggacttctctgtgcggagtggtatttgcaagcatatcttcgggtttgggggaggtgacgttccttagcctgacagccttttatccacgcgcagtcatttcatggtggagttccggcacaggcggagctgggctgcttggggctctgtcctaccttggattgacccaagccggacttagcccccagcagactcttctttccatgcttggaatcccagctctcctgctggctagctactttctactattaactagccccgaagcgcaggatcccggaggagaagaggaggctgaatctgccgctaggcagccactgatccggaccgaggctcctgagagcaaacccggatcttctagctccctgtctctgagggagcgctggactgttttcaaggggcttctgtggtacattgtgcccctcgtagtggtttacttcgccgagtactttattaatcagggcctgtttgaattgctcttcttctggaacaccagtctgagccacgctcagcagtataggtggtaccagatgctgtatcaggccggtgtctttgccagcaggtccagtctgcgctgctgccgcatacggttcacatgggccctggcactcctacagtgcctgaatcttgtctttctcctggccgatgtgtggtttggcttcctgccgagtatctatctcgtatttctcatcatcctctacgaggggctgctagggggagccgcatatgtaaacaccttccacaacatcgcccttgaaacctcagacgagcaccgagagttcgctatggccgcaacctgcatatcagataccctcgggatctctctgtcgggactcctcgccttgcccttgcatgacttcttatgtcagctgagttag

SEQ ID NO: 27987 - DNA, 504 bp, Artificial Sequence
  Description of Artificial Sequence: Synthetic coding sequence
atgggcggttgcgcgggtagcaggagacgattttcggactcagaaggcgaggagacagtccctgagcccagactcccactgctcgaccaccaaggtgctcactggaagaacgccgtaggcttctggttgttgggattgtgcaataatttcagttatgtggtgatgctcagtgcagcacatgacatactaagccataagcggacttccggcaatcaatcccatccaccagggtctcgccagtgggacctttgttgttggaaacttaggcccggatgcctcttctctttctgcggtgaccaacctgtgtgttattttctgcttttaaccagccccgaggcacaggatccgggaggcgaagaggaagcggagtctgccgcacgtcagccactgattcgcactgaagctcccgaatcaaagccgggaagttcatccagtctcagcctgagggaacggtggactgtttttaagggtctgctctggtacatcgttcccctagtagtgtag

SEQ ID NO: 27988 - DNA, 1266 bp, Artificial Sequence
  Description of Artificial Sequence: Synthetic coding sequence
atgggcggttgcgccggttcaagacgtcgcttcagcgactccgagggtgaggagaccgtgcctgagcccagattaccgttgttggaccaccagggagcacattggaagaacgctgtcggcttctggcttctggggctttgcaataacttttcatatgtggtgatgctgtcagcagcacacgacatcttgtctcataaaaggactagcggcaatcagtctcacgtagatccaggacccacccccattccacacaattcgtccagcaggttcgactgcaattccgtctcaacagcagcggtgctgctcgcggatatcctcccaaccttagtgatcaagttgctggcccctctggggctccacctcctgccttactcaccacgggtcctggtttctggcatatgcgcggcaggctccttcgttctcgtcgccttcagtcattccgtcggaacctccctttgcggagtggtcttcgcttctatcagctccggcttgggtgaggttacttttctaagtctcacagccttctacccgagggctgtgataagctggtggtcctcaggaacagggggagccggactcctcggagcactttcatacctgggattgacgcaggccggactaagtcctcagcagaccttactgagcatgctcggcattcctgccctgctattagcttcatatttcttgctgctcaccagccccgaggcacaagacccaggaggagaagaagaggctgagagcgccgcacggcagccactcatccgcaccgaagcgcctgagtccaaacccggtagcagcagttctcttagcctccgggaacgatggacggtctttaaagtgaggatgatggctggttttgaacttctgtttttttggaacacttctctgtctcatgctcaacagtaccgatggtatcagatgctctatcaggccggagtgtttgcatcccgttctagtctgcgctgctgccggattagatttacttgggccctcgcactccttcagtgtcttaatctggtgtttctgttagcggacgtttggttcgggttccttccttccatctacctcgtcttcctcatcatcctgtacgagggcctcctgggtggtgctgcctacgtgaatacctttcacaacatcgccctggagacttcagacgagcacagggaattcgcaatggctgctacgtgtatctctgacaccctgggaatttccctgtcaggcctcctggcattgcccttgcatgattttctatgccaactttcttag

SEQ ID NO: 27989 - DNA, 1173 bp, Artificial Sequence
  Description of Artificial Sequence: Synthetic coding sequence
atgggcggatgtgccggaagtcggaggaggttctcagacagtgagggcgaggagactgtccctgagcctcgcctgcctcttctggatcaccagggagcacactggaaaaatgcggtcggcttctggctcttaggtctttgtaacaacttctcctacgttgtaatgctcagcgctgcacacgacattttgagccataagcggacctccggtaatcagtcacacgttgaccccggacccactcccataccacataattctagttcccggttcgattgcaattctgtgtctactgcagctgtcctgttggctgacatcctacccactctggtcatcaagctgctggctcctttggggctgcatttgctgccttatagccctcgggtattggtgtctggcatatgtgcagcaggcagtttcgtattggttgcgtttagccactcggtgggaacctccctgtgcggggtggttttcgcctcaattagttccggcctgggagaggtgaccttcttgtccttaacggctttctaccctagttactttctcctgcttaccagccccgaagcacaagatcctggaggagaggaggaggctgaatcagctgccagacagccattaatcagaaccgaagcccctgagagcaagcccggatcgagttcatcactcagcctacgcgaaaggtggacagtctttaaaggcctgctctggtacatcgtgccgcttgtggtggtgtacttcgctgaatactttatcaaccagggactgttcgaactacttttcttttggaacacctcgttgtcccacgcgcagcagtaccgctggtatcaaatgctctatcaggcgggagtgtttgcaagtaggagctctctccgctgttgtcgcatccggtttacgtgggccttggcattactgcaatgcctaaatctggtattcctcttggccgatgtttggtttggcttccttcccagcatttacctcgtattcttaattatactgtacgaaggccttttgggtggagccgcttatgtgaacaccttccataatattgctctcgaaacttccgacgaacacagggagttcgccatggcagccacatgtatcagtgacacgctgggcatctccctgagtggcttattagccctgcctttacatgatttcctgtgccagttaagctag

SEQ ID NO: 27990 - DNA, 762 bp, Artificial Sequence
  Description of Artificial Sequence: Synthetic coding sequence
atgggcggatgcgccggtagccggaggagattctccgactccgaaggcgaggaaactgtgccggagcctcggcttcccctactagaccaccagggcgctcattggaagaacgccgtcggcttttggttgttaggcctatgtaataatttcagttacgtggtaatgcttagtgccgctcacgatatactctcacataagcgcacctctggcaaccagtcccatgtcgacccaggccctacacctattcctcacaactctagcagtcgctttgactgcaacagtgtgtccaccgcagctgtccttcttgctgacatcctacccaccctggtcattaaactgctcgcgcctctgggtttacatctattgccatacagtccaagagttctcgtgagcggaatatgcgccgctgggtcctttgtccttgtggccttctcacatagcgtgggcactagtctttgtggctcctcttcaagccttagtctcagggagcgctggacagtgttcaagggactgctgtggtacatcgtcccattagtcgtcgtctacttcgcggaatattttattaaccagggtctgtttgagcttctttttttttggaacacctctctgtcccacgctcagcagtacaggtggtaccagatgctttaccaagcaggagtgtttgcaagccgctcctcacttagatgctgtaggataagattcacatgggcacttgccctcctccagatggaaagccgctctgtcgctcaggctggtatgtag

SEQ ID NO: 27991 - DNA, 1020 bp, Artificial Sequence
  Description of Artificial Sequence: Synthetic coding sequence
atggggggatgcgccggaagtagaaggcgattcagtgatagcgaaggtgaagagacagtgccagagcctcggctaccccttttggaccaccagggagcgcactggaagaacgcagtgggattttggctgctggggctgtgtaacaacttctcgtacgtagttatgcttagcgccgcacatgatattcttagccacaaaaggacgtctgggaaccagtctcacgttgatcctggtcctactccgattcctcacaactcatcttcacgcttcgactgtaattctgtgtcaactgccccacctggatccaggcagtgggacctgtgctgttggaagctcagacctggatgcttgttcagcttttgcggggatcaaccagtctgctatttcctgctacttactagccctgaggcccaagatcctggcggagaggaggaggcagagagtgccgcaagacaacccctgatcaggactgaggccccagagtccaaacccggtagctccagttccctttcattaagagagcgttggacggtattcaaaggcctgctctggtatatagtgccactggttgtggtatattttgccgaatactttatcaaccaagggctgtttgagctgctgtttttctggaatacatcgctgtcgcacgcgcagcaatacaggtggtatcagatgttgtatcaggccggagtgtttgcgagcagaagttcgcttcgatgctgcaggatccgcttcacttgggccctggcattgctgcaatgcttgaacctggtatttctcttagccgacgtgtggtttggttttctgccctcgatatacctggtcttccttataatcctgtatgagggactcctgggaggtgccgcttacgttaacactttccacaacatcgcgcttgagacaagtgacgagcaccgggaattcgctatggctgcaacctgcattagcgacacattgggaataagtttatccgggctgctcgccttaccactgcatgatttcctttgccaattatcctag

SEQ ID NO: 27992 - DNA, 1155 bp, Artificial Sequence
  Description of Artificial Sequence: Synthetic coding sequence
atgctctctgcagcccacgacatcctgagtcataaacggacgagcggcaatcagtcccatgtggacccgggtccgaccccaatccctcacaattccagcagccgatttgactgtaacagtgtgagtacagctgctgtgcttctggctgacatcctgcccactctggttataaagctgctggctcctttgggactgcaccttctgccttactctccaagggttctagtctcaggtatctgcgctgctgggtcatttgtgcttgtggcgttttctcatagtgttggtacctccctctgtggagttgtgtttgccagcatctcctccgggttaggtgaggtgacatttttaagtctgactgcgttttatcctcgggctgtgatttcttggtggtcatcagggaccgggggtgctgggttgctgggggcattatcctatttaggcctcacccaggctggcctgtctcctcagcaaacactgttaagcatgctcggtatccccgctttgctgttagcatcatactttttactgcttactagtcctgaagctcaggaccccggaggggaggaagaggccgaatctgcagctcgccagcccctgataagaaccgaggcacccgaatctaagcctggttcttcctcctctctttccctaagagagaggtggaccgtatttaagggtctgctctggtacatcgtgcccctcgtggtcgtttactttgccgaatattttataaaccaagggctgtttgagctcctgtttttctggaacacttctctcagccacgcacagcagtatcgctggtatcagatgctctaccaagcgggagtgttcgctagccgctcatccctgagatgctgtcggatacgcttcacttgggcactggccttacttcaatgtttgaatctggtgttcctgctggccgacgtttggttcggattcctccctagtatctatctcgtattccttattatactgtacgagggactcctcggcggagcagcctacgtgaatacctttcacaatattgccttggagacttctgatgagcacagggaattcgcaatggcagcaacgtgcatctcagacacgctgggcatttccttatcagggctgctggccctgcctcttcacgacttcctgtgtcagctcagttag

SEQ ID NO: 27993 - DNA, 1317 bp, Artificial Sequence
  Description of Artificial Sequence: Synthetic coding sequence
atggggggatgtgccggatctaggcgtcggttctctgattcagagggcgaagaaacggtaccagagcccagactgccacttcttgaccatcagggggctcactggaaaaacgcggtgggcttttggctgcttgggctgtgcaataacttcagttacgttgtaatgctgagcgcagcacacgacattctgagtcataagcggacatctggcaaccagtctcatgtggatcccggacctactccaatcccgcataatagcagctcgcggtttgactgtaactccgtgtccacagccgcagtcctgctggcagatattctgcccacactcgtgatcaagctgttggcccctctgggactgcacctcttgccctattcacctagggtgctggtgagtggcatctgtgctgctggatcctttgtcttggtagctttctcccattccgtcggaacgagtctgtgtggcgtggtgtttgcctctatatccagcggcttaggtgaggtgactttcctgtctttgacagcgttttacccacgcgctgtcatctcatggtggtctagcggtacaggaggggctggcttgctgggggcactttcttacctcggccttactcaggctggcctgagtcctcaacagacccttctcagtatgctgggaattcccgctctgctgctggcctcatatttcctcctgcttaccagtccagaggctcaagaccccggaggagaagaggaggcggagtccgccgcaagacaaccactcatccggacggaggctcccgagtcaaagcccggttcatcttcgtccctgtccctcagagagagatggactgtgtttaaaggcctcctgtggtacattgttccgctcgtcgtggtgtattttgcagagtattttatcaaccagggcctcttcgaattgctgttcttctggaatacgtctctttcacacgcccagcagtatagatggtatcagatgttgtaccaggctggagtgtttgcctcacgatcatccttacggtgctgtcgcatccggtttacctgggctctggctctcctgcagtgccttaatctggtttttctcctagccgacgtgtggttcggtttcctaccgtccatctacctggtgtttctgatcattctgtatgagggtcttctgggcggagctgcctacgtcaataccttccacaacattgccctggaaacaagcgacgaacacagagaattcgcgatggccgcaacctgtatttctgataccctggggatctcactgtcaggacttcttgccctaccgttacatgatttcctctgccagctgagctag

SEQ ID NO: 27994 - DNA, 1317 bp, Artificial Sequence
  Description of Artificial Sequence: Synthetic coding sequence
atgggcggatgcgccggtagccggcgaaggttttccgactccgagggggaggagacagtccccgaaccgagactacctctgctggatcaccagggggctcattggaaaaatgcagtgggattttggttgctcgggctatgtaataactttagctacgtggtaatgctttcagctgcccatgacattctgtcgcataaaagaacctcagggaatcagtcacatgttgatcctggccctacaccaatacctcataacagctcctcccggtttgattgtaatagtgtgtctactgccgctgtactcctggcagatattctccccactctagttattaagctgctcgctccgttgggactccacttgctgccatactcccctcgcgtacttgtgagtgggatctgcgctgcaggctcttttgttctggtggcattctcccactccgtgggaacgtcactgtgtggcgtggtttttgcatcaatcagttccgggctgggcgaagtgaccttcttgtctctgaccgccttttaccctcgagcagtcatctcatggtggagttcaggtactggtggtgcaggacttctcggggctctgtcctacctagggttaacacaagcgggtctgtcacctcagcagacattgctgtccatgctcggaattccagctctgctgctcgcttcatatttcctgttgttgacaagtccagaggctcaggacccaggcggtgaggaggaagctgagtccgccgcacgccagccacttatccgcacagaggctcctgaaagcaagcctggaagcagcagtagcttgtccctgagggagcggtggacagttttcaaagggcttctctggtatatcgtgccattggtggtggtgtatttcgccgaatacttcattaaccaaggcctgtttgaacttctgttcttttggaacactagtctttctcacgcacagcagtatagatggtaccaaatgctataccaggccggtgttttcgccagcagatcatcattacgctgttgcaggattaggttcacctgggccctagccctactgcagtgtttgaaccttgtgttcctactcgccgatgtttggttcggattcctgccatctatttacctcgtgtttctaataatcctgtatgagggactgttgggaggcgctgcctatgtcaatacattccataacattgcactagagacgtcggacgagcaccgtgagtttgcgatggccgctacgtgcatctccgatactcttggcataagtttgtccgggttgctcgcactgccgctccacgacttcctgtgtcaattgtcttag

SEQ ID NO: 27995 - DNA, 1017 bp, Artificial Sequence
  Description of Artificial Sequence: Synthetic coding sequence
atgtggacgcaagctcagagacgatcacctacaacggcccaccacgatcttaccgccactttgtccctgagactgccacgggtgctggtgagtgggatctgcgctgccggatcctttgtgctggtggcttttagtcatagtgtcggcacatctctctgtggggtcgtgttcgcgtctatcagctctggattaggcgaagtgacttttctcagcctcaccgccttttaccccagagcggtcatcagttggtggagcagcggaactggaggcgcaggccttctgggggctctttcttaccttggattaactcaagcaggattgtcccctcagcaaaccctactgtcgatgctggggattcctgccctactcctcgcgtcatactttctgctgctgacgagccctgaagctcaggaccccggaggggaggaggaggctgagtccgccgcacgacagcctcttattcggactgaggcccctgaatcgaagccgggaagttcgtcaagcctgagtctgagggaaaggtggacagtgtttaagggcttactctggtacatcgtgccactagtagtggtttactttgcagagtatttcattaatcagggcctgttcgaattgctgtttttttggaatacttccctgagtcatgctcaacagtacaggtggtaccaaatgctctatcaggccggagtgttcgcctcgagatctagtctgcggtgctgtaggatacggttcacgtgggctctggctctgttgcagtgccttaacctggttttcctgctggcggatgtctggtttgggttcctcccaagtatatatctcgtgtttctcattattctttacgagggattgctggggggagccgcttatgtcaacacctttcataatattgcactagaaacaagtgatgaacaccgagagttcgctatggcagctacgtgtatctccgatacgctcggcatatccctgtccggcctgcttgccctgccacttcacgatttcctgtgccagctgagctag

SEQ ID NO: 27996 - DNA, 1083 bp, Artificial Sequence
  Description of Artificial Sequence: Synthetic coding sequence
atgttatctgctgcacacgacatactttctcacaaacgaacttctgggaaccaaagccacgccgtcctgttggctgacatcttacctactttagtcattaagcttttggcacctcttggcctccacttgttaccatattcaccaagagtgctcgtctcaggcatttgcgccgcaggcagctttgtgctcgtggcattttcccactcagtgggcacctccttgtgcggcgtcgttttcgcatccatttcctcaggcctgggcgaggtcacctttctatccctgaccgccttttaccctagggcagttattagctggtggtcgagtgggactggcggagcaggactgcttggcgcactgtcctatcttgggttaacacaggccggtctgtcaccccagcagactttgctgagcatgctcggaattccagccctgctgttggcatcctattttctgctacttacatcccctgaggcacaggacccgggaggcgaagaggaagctgagtccgctgcccgtcaaccgctgatccgcacggaggcacctgagtcgaaacccggaagcagctcctcgcttagtttgagggagcgatggaccgtgttcaaaggcctcctatggtacatagtcccgttggtggtggtctacttcgctgagtacttcattaatcaaggattatttgaactcctgtttttctggaacacatcactgtcccacgctcaacagtatagatggtatcagatgctgtaccaggccggagtatttgcctcccgctcctcactgcgctgttgccgcattcggtttacatgggccttggctctgctgcaatgtctgaacctggtgtttttgttggccgatgtatggtttggcttcctgccctccatctatctagtttttctaatcatcttatacgaaggtttgctgggaggcgcagcttatgtaaatacttttcacaatatcgcgctggaaaccagtgacgagcaccgggaattcgcaatggctgccacatgtatcagtgacacattgggtattagtctgtcaggcctcttggcacttccactgcacgatttcctgtgtcagttatcttag

SEQ ID NO: 27997 - DNA, 1299 bp, Artificial Sequence
  Description of Artificial Sequence: Synthetic coding sequence
atggccgtccctttcgtggaggactgggacttggtgcagactctgggtgagggggcttacggagaagtacagctggcagtaaaccgcgttactgaggaagctgttgcagtgaagatagtcgacatgaaaagggccgtggactgtcctgaaaatattaaaaaggaaatctgcattaataagatgctcaaccatgagaacgtagtaaagttctacggacataggagagaggggaacatccagtatctgttcctggaatactgctctggaggggagctgtttgatagaatcgagcccgatatcggtatgcctgagccggatgctcagagattctttcaccaactaatggccggagttgtctacttacatgggataggcatcacgcatcgggacattaagcctgagaacctcctgctggacgaacgcgataatctgaaaatatcagactttgggctcgcaacagtttttagatacaacaacagagagcgcctattgaacaaaatgtgcgggacactcccgtacgttgccccagagctgcttaagagacgtgagttccacgcagaaccagttgacgtttggtcctgcggcattgttctcactgccatgcttgccggagaactgccatgggaccagccttccgacagttgccaggaatactccgactggaaagaaaagaagacatatttgaacccatggaaaaagatagacagtgcgcctctggccctgctgcacaagatactggtggaaaacccatccgctcgcatcactattcccgacatcaagaaagatcgatggtacaataaaccgttaaaaaaaggcgctaaaagaccaagagtaacttcagggggagtgtcagagtcgccatctggcttcagcaaacacatccagagcaaccttgacttcagtccagtaaacagtgctagctctgaagagaacgtgaagtattcaagctcccagcctgagccaagaaccggactcagcctgtgggacacatccccgagctatatcgataaactggtgcagggtatttcgttctcccagcccacatgtcccgaccacatgctcctaaattcacagctcttggggacccctgggagctcccaagtgacgattagtacaacagacagacgcaacaacaaacttatctttaaggtaaatttactggagatggacgataagatccttgttgacttccgcctgtcgaagggagacggtttggaatttaagcgtcacttcctgaaaataaaaggtaaattaatcgatattgtcagcagccaaaagatctggctgcccgcaacttag

SEQ ID NO: 27998 - DNA, 1431 bp, Artificial Sequence
  Description of Artificial Sequence: Synthetic coding sequence
atggccgtcccattcgtggaggattgggatcttgtccagacgctgggcgaaggagcatacggagaagtccagttggctgtgaacagggttaccgaggaggcagttgctgttaaaatcgtcgacatgaaacgagcagtagattgtcctgagaatataaaaaaggagatatgcatcaataaaatgttgaatcacgagaacgtagtgaaattttatggacacagaagagagggcaatatccagtatctttttctcgaatactgctcaggcggtgaacttttcgataggattgagcctgatatcggaatgccagagcctgatgctcagcgtttctttcatcagcttatggctggggttgtttaccttcacggcattggaattacacatcgggacatcaagcccgaaaatctgcttctggacgaaagggacaacctcaagattagtgacttcggcctggctacagtgttccgctacaataatcgcgaaagacttctgaacaaaatgtgtgggaccctcccttacgtggcccctgagcttctgaagaggagggagttccacgcagaaccagtagacgtgtggtcctgtggaatagtgctcaccgccatgcttgcgggtgaattaccctgggatcagccttccgattcatgtcaggagtattccgactggaaagagaaaaaaacgtatctgaatccctggaagaaaatcgactctgctccactcgccctccttcacaagatactagtggaaaatccttctgctcggatcacaatacccgacatcaaaaaagacaggtggtacaataagccactgaagaaaggtgctaagcgccctcgcgttacctccggcggagtgtcagaaagtcctagcggatttagcaaacacatccagagtaacctagacttctcgccggtaaatagcgcttcctcagaagagaatgtcaagtacagcagctcccaaccagagccgcgtactggactgtcgttatgggatacctctccttcctatatcgataagctggtacaaggcatcagtttctcgcagcctacatgtcctgatcacatgttgttgaactcgcagttactgggaacccccggtagttcacaaaacccgtggcagcggctggttaagcggatgactaggtttttcactaagttggacgcagataaatcataccaatgccttaaagaaacttgcgagaaactgggataccaatggaagaaatcatgtatgaaccaggttacgatctcaacaaccgacaggcgcaacaataaactgattttcaaggtgaatctgctagaaatggacgacaaaatcctcgtcgacttccgcctctccaagggcgacggactggagtttaagcgccacttcctcaagatcaaaggcaagctcatcgacattgtgtcttctcagaagatttggttgccagctacttag

SEQ ID NO: 27999 - DNA, 1431 bp, Artificial Sequence
  Description of Artificial Sequence: Synthetic coding sequence
atggcggtgccctttgtggaggattgggatctggtgcagaccctaggagaaggcgcttatggcgaggttcagctggccgtgaacagagtaacggaggaggcggttgccgtgaaaattgtggacatgaaacgtgccgttgactgcccggaaaatatcaaaaaagagatctgcatcaacaaaatgttaaatcatgagaacgttgttaagttctatggccatcgtcgcgagggcaacatccagtacctgtttctggaatactgttccggaggagaactgtttgatagaatcgagccagatataggcatgccggagccagacgcccagagatttttccaccaactaatggcgggagtcgtgtacttgcatggcatcggaatcacacacagagacataaaaccagagaacctgctgttggatgagagagataatctcaagatctcggatttcggcctcgccactgttttcaggtataacaaccgcgagaggctccttaacaaaatgtgcgggactctcccatatgtggctcccgaactcctcaaaaggagagagttccacgccgaacctgtagatgtttggagctgtggaatcgtgttgactgccatgcttgccggagagctgccgtgggatcagccatcagactcctgccaggagtattcggactggaaagaaaagaagacgtacctgaacccatggaaaaaaatagattctgctccactagcccttctgcacaaaattctagtggagaacccttcagctaggatcacaattcctgacatcaagaaggatagatggtataacaagccgttaaaaaagggtgcaaaacgacctagggtcacaagtggcggagtgagtgaatctcctagtggattttctaaacatatacagtctaacctggatttttcccccgtcaactccgcctccagtgaagaaaacgtgaagtacagttcaagtcagcccgagcccagaacgggcctcagtttatgggacacatcaccttcttatatcgataaattggtccagggaatatcattttctcaaccgacctgccctgaccacatgctattgaacagccaactgcttgggacaccgggaagcagtcaaaacccatggcagagactcgtcaagaggatgacaaggttctttacaaagctggatgcagacaagtcatatcagtgcctcaaggaaacctgcgaaaaactaggatatcaatggaaaaagtcttgtatgaatcaagtaaccatttctacaactgatcgcaggaataacaaattgatctttaaagttaatttgctggagatggatgataaaattcttgttgatttccgtttgtccaagggcgacggcctcgaattcaagcgccacttcttaaagataaagggcaagcttattgacatcgtgtcgtctcaaaagatttggttgcccgcaacttag

SEQ ID NO: 28000 - DNA, 1431 bp, Artificial Sequence
  Description of Artificial Sequence: Synthetic coding sequence
atggccgtgccttttgtggaggattgggacctggttcaaacactaggagagggcgcatatggtgaggtgcaactggcggtaaaccgggtgacagaagaggccgtggcggtgaagatagtggatatgaagcgcgcagtggactgccctgagaatattaagaaagagatctgtattaacaagatgctgaatcacgaaaatgtggttaagttctacggtcacagaagagagggtaatattcaatatctattcctggagtactgttcgggaggagagctgttcgacagaattgagccggacatcggtatgcctgaacctgacgctcaaaggttcttccatcagttgatggcgggtgtcgtttaccttcacgggattggcataacccaccgagacatcaagcccgaaaatctgctcctggatgaacgagataatctcaagatatccgacttcggcttggccactgtttttagatataacaacagagagagactcctgaacaaaatgtgtggcacactcccttatgttgcccctgagctgctgaagcggcgtgagttccacgcagaacccgtggacgtgtggtcttgcggaatcgttttgacggccatgctcgccggtgagctcccctgggatcaaccttccgacagttgccaggagtactctgactggaaggaaaaaaagacttacctgaatccttggaaaaaaattgactccgctcccttggctctgctgcataagatcttagttgagaacccatcagcgcgaatcactatccccgatatcaaaaaggataggtggtacaacaaacctctgaagaaaggagctaagaggccacgcgttacttccggcggagtatcggagtcgccctcagggttttctaaacacatccagagcaacctagacttcagtcctgttaattctgcttcaagcgaggaaaacgtaaagtattcatcctctcagccagagccgagaaccggactgtctttatgggacacctccccatcttacatcgacaaactggtacaggggatctctttcagccagcctacatgtcctgatcacatgctactgaacagtcagctgttgggcacacctgggtcctctcagaatccctggcaaaggctggttaaaagaatgactaggttcttcaccaaattggatgctgacaaatcctaccagtgtcttaaggaaacttgtgaaaaactggggtaccaatggaaaaagtcatgcatgaatcaggtgacgatatctaccacagaccgccgaaataataagctgatattcaaagtcaatttactggagatggatgataagatcctcgtcgacttccggttgagcaaaggagacggactggagttcaaacggcatttcttgaaaatcaagggcaaactgattgatatagtgagctcccaaaaaatttggctccccgctacatag

SEQ ID NO: 28001 - DNA, 402 bp, Artificial Sequence
  Description of Artificial Sequence: Synthetic coding sequence
atggccgtgccatttgtggaggattgggatctggtgcagaccctgggcgagggggcatatggagaagtgcagttggcagtgaatagggtgacggaggaggcagtagctgtgaagatcgtcgacatgaagcgagctgtggactgccctgagaatataaagaaggagatctgtattaacaagatgctgaatcacgagaacgtcgtgaaattttacggccatagaagggaaggcaatatccagtacctgtttctggaatactgttccgggggagagcttttcgatcgtatagagcccgatattgggatgcctgagccggatgctcagcgctttttccaccaactcatggcgggtgtggtgtatctgcacggcatcggaataacccatagggacatcaaaccatag

SEQ ID NO: 28002 - DNA, 513 bp, Artificial Sequence
  Description of Artificial Sequence: Synthetic coding sequence
atggccgtcccttttgtggaggactgggaccttgtacagacactcggagagggtgcctatggggaggtgcagttggccgtaaaccgcgttactgaagaagccgtggccgtgaaaatagtagacatgaagagggcagtcgattgcccagagaatattaaaaaggagatctgcattaataaaatgctgaatcacgagaacgtcgtgaaattttatggacaccggagagaaggcaatattcagtacctgttcctggaatattgctcaggcggagagctgttcgatcgcatcgagcccgatattggaatgccagaacctgatgcccagaggttttttcatcaactgatggcaggggtggtctacttacacggaatcggaataacccacagggacataaaacccgaaaacttactactggacgagcgcgacaaccttaaaatatccgacttcgggctggcaacagtgttccgatataataatcgggagcggctcctgaataagatgtgtggaacttag

SEQ ID NO: 28003 - DNA, 615 bp, Artificial Sequence
  Description of Artificial Sequence: Synthetic coding sequence
atggcagtgccttttgtagaagactgggacttagtgcaaactctgggcgagggtgcctatggagaggtacaattggccgttaaccgagtgacggaggaggctgtggcagtcaaaatcgtggatatgaagagggccgtggactgtcccgagaacattaagaaggagatctgcattaacaagatgctgaaccatgaaaacgtagtgaaattctatggtcacagaagggagggtaacatccaatatctattcctggagtactgttcgggaggggagcttttcgacagaatcgagcccgacattggcatgcctgagccagatgcccagaggttctttcatcaacttatggccggagtggtgtacctgcatgggattgggatcactcatagggacattaagccagaaaatctgctgttggatgaaagagacaatcttaaaatcagtgacttcgggctggcaactgtgtttagatataataaccgtgagagattgctcaacaagatgtgcggaaccctgccttatgtggcaccggagctgcttaagaggcgcgaattccatgctgagcctgtggatgtctggagctgcggaatcgtactgaccgcgatgctggcgggttag

SEQ ID NO: 28004 - DNA, 129 bp, Artificial Sequence
  Description of Artificial Sequence: Synthetic coding sequence
atggcggttcccttcgttgaggactgggatctagttcagacgctgggagaaggggcttacggcgaggtacagctggcagtgaaccgcgtcacggaagaggccgtagccgtaaaaattgttgacatgtag

SEQ ID NO: 28005 - DNA, 1431 bp, Artificial Sequence
  Description of Artificial Sequence: Synthetic coding sequence
atggccgtcccttttgtggaagactgggatctagtccagaccctgggtgaaggcgcatacggtgaggtgcagctcgcggtcaaccgggtgactgaagaggccgtcgcggtcaaaattgtagacatgaagagggctgttgactgccccgaaaatattaagaaagagatttgtatcaataaaatgttgaatcacgaaaacgttgttaagttctatgggcatcggagggagggcaatattcagtatctcttcctcgagtactgttctggtggggagttattcgatcgcattgaacctgatattgggatgcctgagcctgatgctcagcgttttttccaccagttgatggccggagtcgtctatcttcatggcataggcatcacacaccgggatataaaacccgagaacttgctgttagatgagcgagataacctgaagatctctgacttcgggctggctacagtctttcgctataataaccgcgagaggctgctgaacaaaatgtgcgggaccctcccatacgtagctcctgagttgttgaagcggagagagtttcacgccgaaccagtggacgtgtggagctgtgggattgtgcttacagccatgctggccggtgaactcccgtgggatcagccaagcgacagctgtcaggagtattccgactggaaagagaaaaagacctacctgaatccgtggaaaaaaatcgatagtgcgccactggccctcctccacaaaattctcgtcgagaatcccagcgctcgtataaccatcccagacattaagaaggatcggtggtacaacaagcccctcaagaaaggggcaaaaaggccacgcgtcaccagcggcggtgtgtccgagtctccctctggtttttcgaagcacatccagtcgaatctggatttctccccggttaactctgcctcttccgaagagaacgtaaaatatagttcaagccagcccgagccgagaacaggcctaagcctttgggacacctccccttcctacattgacaagctcgtgcagggaatttcttttagccagccaacatgccctgatcatatgttattgaacagccagttgcttgggacgcccggatcaagccagaatccctggcagcgcctggtgaaacgcatgaccagatttttcactaagttagacgccgacaaatcctatcagtgtttaaaggagacctgtgaaaaactgggctatcagtggaagaagtcctgtatgaatcaggtgaccatctcaactaccgatcgcaggaacaacaagctgatttttaaagtgaatctgctcgaaatggacgacaagatcctggtagatttcaggctgtcaaaaggcgacggcctggagtttaaaagacactttctcaagatcaaagggaaactgatcgatattgtgtctagccagaagatttggttacctgcaacgtag

SEQ ID NO: 28006 - DNA, 384 bp, Artificial Sequence
  Description of Artificial Sequence: Synthetic coding sequence
atggctgttcctttcgtggaggattgggacctggtgcagactctgggcgagggggcatacggagaggttcaactggccgtgaatcgtgttaccgaggaagctgtggccgtgaaaattgtggacatgaagagggctgttgactgcccagagaacatcaagaaagagatatgcatcaacaaaatgctgaatcatgaaaacgtcgtcaagttttacgggcataggagggagggcaatatccagtacctgttcctcgaatactgcagcgggggagagctttttgaccgcattgaaccagacatcggtatgccggagcccgatgcccagagattctttcatcaactgatggccggtgtggtgtacctgcacggtataggtatcacttag

SEQ ID NO: 28007 - DNA, 1329 bp, Artificial Sequence
  Description of Artificial Sequence: Synthetic coding sequence
atggctgtacccttcgtcgaagactgggatttagtgcaaactctgggagagggcgcttacggggaggtacagttggctgtgaaccgggtgacagaagaggccgtggctgtcaagatcgtcgacatgaagagggccgtggattgtcctgaaaacattaaaaaggagatttgtattaacaagatgttaaatcatgaaaacgtcgtgaagttctacgggcaccgcagggagggaaatatccagtaccttttcctggaatactgcagcggcggtgagctgttcgatcgcattgaaccagatatcggaatgcctgagccagatgctcagagatttttccatcagttaatggcgggagtggtttacctgcatggaattggtattacccatcgggacatcaagcctgaaaatctgcttctagatgagcgggataatttaaagattagcgattttgggctcgctaccgtcttccgctataacaaccgggaacgcctgctcaataaaatgtgtggcacactgccatatgtggcccctgagttactcaagagacgggaattccatgcagagcctgttgacgtctggagttgcgggatcgtgctgactgccatgcttgcaggcgagctgccctgggaccagccatctgatagttgccaggagtactccgactggaaggaaaagaaaacgtaccttaatccctggaaaaaaattgatagcgccccactggcactccttcataaaattttggtggagaacccctccgcacggattacgatcccagacatcaaaaaagataggtggtataataaacctctaaagaaaggggcaaagcgccctcgagtgacgtctggcggagtaagtgaaagtccatccggcttcagcaagcacattcaatcgaacttggacttttctcccgttaacagcgcaagctccgaagagaatgtaaaatactcttcatcccagcccgagcctcggacaggtcttagcctttgggatacgtctccatcctatattgacaaactcgtccagggcatttcatttagccaaccaacgtgtcctgaccatatgttgctaaacagccagctgctcgggacaccaggaagctctcaaaatccatggcagcgcttggtcaaacgaatgacaaggttttttaccaagctggatgcagacaagtcctaccagtgcctcaaagagacctgtgaaaagctcggctaccaatggaagaaaagctgtatgaaccaaggtgatggcctggagttcaagaggcacttcctgaaaattaaaggcaagttgatcgacatagtgagcagccaaaagatctggctgcctgctacctag

SEQ ID NO: 28008 - DNA, 1632 bp, Artificial Sequence
  Description of Artificial Sequence: Synthetic coding sequence
atgagccgcgaatcagatgttgaagcacaacaatcccacggcagctctgcatgcagccagccacacggctcagtgacccagagtcaggggtccagcagtcagtctcagggtatctcgtcctccagcacaagtactatgcccaacagctcccagagtagtcactcttcgtcagggactctgtcatcgctggagacagtgtctacgcaggagctttattcaattccagaagaccaggaacctgaagatcaagaacccgaggaaccgacccctgctccttgggcacgtctgtgggcgttgcaggatgggtttgcgaacctcgaatgtgtaaacgacaactactggttcgggagggacaaaagttgtgaatattgtttcgacgaacctctgctgaagcgtacggataaatacagaacctacagcaagaagcattttcggatttttcgcgaagtggggccaaagaactcctatatcgcatacatcgaagatcatagtggcaacggcacttttgttaacactgaactagttggcaaagggaaacgcaggcctctaaataacaattccgagatcgccctttctctgtctaggaacaaagtctttgtcttctttgatctaaccgtggacgatcagtcagtgtacccgaaggctctgcgggatgagtacatcatgagcaagactctgggctcaggtgcttgtggggaggtaaagctggccttcgaaaggaaaacttgcaagaaggtggccatcaaaataatctcgaagagaaagtttgccataggaagcgctagagaggcggacccggctctaaacgtggaaaccgagattgagatcctgaagaaactcaatcacccttgcatcatcaaaattaagaatttcttcgacgctgaggattactacattgtgctcgaacttatggaaggtggcgagttattcgacaaggtggtcggaaacaagagactgaaggaagccacttgcaagctgtatttttaccagatgctgctggcagtgcagtatttgcatgagaatgggattattcatcgggacttgaagcctgagaatgtgctactcagctctcaggaagaggattgcctgatcaaaattaccgatttcggacactctaagatccttggggaaacctccctgatgcggaccctgtgtggcacaccaacatatctggcgccagaggttctggttagcgtgggcactgccggttataaccgggctgttgactgctggtccctgggggtaatcctgttcatctgcctgtcgggctacccccctttcagcgaacacagaacccaagtctcactcaaggatcagattacatcagggaagtacaattttattcccgaagtctgggccgaggtctctgagaaagcattagacctggttaagaagctcctggtggtggatcctaaagctaggttcaccaccgaagaagccctgaggcacccatggctacaagacgaggacatgaagaggaagtttcaggacttgctgagcgaggagaacgagagcaccgccttgcctcaggtactggcccagccttctacttcccggaaacgccctcgtgagggcgaggcggagggtgcagaaactactaaacgacctgctgtctgcgcagcagtgctctag

SEQ ID NO: 28009 - DNA, 1545 bp, Artificial Sequence
  Description of Artificial Sequence: Synthetic coding sequence
atgtcacgggaaagtgatgtcgaggctcagcaatcccatggttcctcagcttgcagtcaaccccatggaagtgtgacacaaagtcaagggagtagctctcagagccagggcatctctagtagctctaccagtactatgcctaattcatctcagagtagccacagcagcagcggcaccctatccagcctcgagactgtctctacacaagaattatactcaatccctgaagaccaggagccagaagaccaggagcctgaggaaccaacacccgctccctgggccagactgtgggccctgcaagatggctttgccaacctggagtgcgtgaatgataattactggttcgggcgagacaaatcctgcgaatactgttttgacgagccactcctgaagagaaccgacaagtaccgtacctatagcaagaagcatttccgcattttccgtgaggtcggacccaaaaattcctacattgcatacatcgaggaccattctggtaatggcaccttcgttaataccgagcttgtgggaaagggaaagcgacgcccactgaacaataactctgagattgctctgtccctgagcagaaacaaggtgtttgtgtttttcgacctgaccgttgacgaccagtccgtataccctaaggccctcagagacgaatacatcatgagtaagactttgggtagtggcgcatgcggagaagtaaaactcgcctttgagcggaagacctgtaagaaggtagcgataaagatcatcagcaaacgcaaattcgcgatcggctccgccagagaagctgatcccgctcttaacgttgagacggaaatcgagatcctgaaaaaactcaatcacccatgcattatcaaaatcaagaattttttcgatgctgaggattattatattgtgctggaattaatggaggggggtgaactgttcgacaaagtagttgggaacaagagattgaaggaggcaacttgtaagctgtacttctaccagatgctattagcagtgcagataacagactttggccactctaaaattttgggcgagaccagtctgatgcgcacactctgtgggactccaacctatttggctcccgaggtcctggtgtccgtagggaccgccggatacaacagggcagtggattgctggagcctgggcgtgatcctttttatctgtctgtccggttaccctcccttcagtgagcaccgtacacaagtctcactcaaggatcagatcacatccgggaaatataactttataccagaagtgtgggctgaagttagcgagaaggcgctagacttagtgaaaaaactcttagtggtggatcctaaagcgagattcaccaccgaagaggccctccgccacccatggctgcaggacgaagacatgaagcgcaaatttcaggatctgctgtccgaagaaaatgagtctacggcactgccacaggtcttggcgcagcctagcacctcccgtaagagaccaagagagggcgaggctgaaggagccgaaactacaaaaaggcccgctgtgtgcgctgccgtgctatag

SEQ ID NO: 28010 - DNA, 681 bp, Artificial Sequence
  Description of Artificial Sequence: Synthetic coding sequence
atgtcccgagaatcagacgttgaggcccaacagtcccacggctcatcggcctgtagtcaaccacacggtagtgtgactcagtctcagggaagctccagccagtcccaaggcatcagcagcagtagcacaagtacaatgccaaacagcagccagtcctctcatagcagcagcggaacgctctcatccctcgaaacagtgagtactcaggagctttatagcattccacccgaagtcctggttagtgtgggaaccgctggatacaatcgagccgttgattgctggtccctcggggtgatactgtttatatgccttagcggatatccgccattcagtgagcatcggacgcaggtgtctcttaaggaccagataacaagcggcaagtataattttatccccgaagtgtgggctgaggtgagtgaaaaagctctcgatctggtgaaaaagctcctggtggttgatcctaaagcgaggttcacaacggaggaagcgctgcggcacccttggctgcaagatgaggacatgaaaaggaaattccaggatctactttcagaagagaatgaatctacagcccttccccaggtgctggcgcagccatctacgtctcgaaagcggccaagggagggcgaagccgagggagcagaaacaactaaacgaccggcagtgtgcgccgctgtgctttag

SEQ ID NO: 28011 - DNA, 492 bp, Artificial Sequence
  Description of Artificial Sequence: Synthetic coding sequence
atgagtcgggagagcgacgtggaagctcagcagtctcatgggagttcagcctgttcacagcctcacggcagcgtaactcagagccagggcagcagctcccagtcccaaggtatatcaagctcctcaacctctacaatgccaaattctagccagtcttcccatagtagctcaggaaccctatctagcctagagacagtctcaacccaggaactgtacagtattcccgaagatcaagagcctgaagaccaagagcccgaggagcctactccagctccctgggctcgcctctgggcactgcaggacgggttcgctaatttgggagacgaggacatgaaacggaaattccaggacctgctgagtgaggagaacgaatctaccgccctgccccaggttctggcccagccttccacctcaaggaaacgtccccgagagggtgaggcggagggagccgagaccacgaagcgacccgctgtatgcgcagccgtactctag

SEQ ID NO: 28012 - DNA, 870 bp, Artificial Sequence
  Description of Artificial Sequence: Synthetic coding sequence
atgtcacgtgagagcgacgtcgaggcgcagcagagccatggttcaagtgcatgcagtcagccccacggatctgtgactcaaagccagggatcatcatcccagagccaaggcatttctagcagttccactagtacaatgccaaatagctctcagtcctcccattccagctctggcaccctcagtagcctcgagaccgtgagcacccaggagctgtattcaatccctgaagatcaggagcccgaggaccaggaaccagaggaacctacaccagctccttgggcacggctctgggccctgcaggacggtttcgccaacctggagtgcgttaacgacaactactggtttgggagagacaaaagctgcgagtactgtttcgacgagccattgctgaaaaggaccgataaatatcgcacctactccaaaaaacacttccggatcttccgcgaggtcggtcctaagaattcgtatatcgcatatatcgaagatcattctggcaacggtactttcgtgaacaccgagctggtagggaagggcaagaggagacctttgaataataactcggagatagccctctctctgtcccgcaataaagtattcgtcttcttcgatcttactgttgacgaccagtccgtttaccctaaggccttaagggatgagtatatcatgagcaagactcttggtagcggtgcttgcggggaggtgaagctggctttcgaaaggaagacctgcaaaaaggttgcaataaaaatcatctcaaaacggaagtttgccattggcagcgcccgagaggctgaccctgccttgaacgtggagacagagatcgagatcttgaagaagttaaatcacgatggcagagggagggctgtttag

SEQ ID NO: 28013 - DNA, 1359 bp, Artificial Sequence
  Description of Artificial Sequence: Synthetic coding sequence
atgtcccgggagtccgacgttgaagcacaacagtcccatggctcttccgcctgctcacagccacacgggagcgtgacccagtctcagggatccagctcacagagtcaggggatatcctcttcaagcacttcaaccatgcccaattcgtctcagtcttcccacagtagcagcgggacacttagtagcctcgagaccgtgagtacacaggagctctattctatccctgaagaccaagagccggaggaccaggaacccgaggagccaacccccgctccgtgggctcgcctgtgggcactgcaagacggatttgctaacttagtattcgtgttcttcgatctcacagtggatgatcagagcgtgtaccctaaggccttgagagatgaatatataatgagcaagactttgggtagcggcgcatgtggagaggtgaaattggctttcgagcgcaaaacctgtaagaaagtggcaatcaaaatcatatctaaaagaaaatttgctattggcagcgccagagaggcagatcctgctctgaatgtcgagactgaaattgaaatccttaagaaactgaaccacccatgtattatcaagataaagaactttttcgatgccgaggactattacattgtcttagagcttatggaaggtggcgagttgttcgacaaagtggtgggtaataaacggctgaaggaagccacttgtaagctgtacttctaccagatgctgcttgctgtgcagtaccttcatgagaatggaattatacacagggacctaaagcctgaaaacgtcctgctgagttctcaggaagaggactgcctgataaaaatcactgacttcggacactcaaaaatcctcggggaaacgtctctcatgaggaccctgtgcgggactccaacctacctagcccctgaagtgttggtcagcgtgggaacagcaggatacaaccgagccgtggattgctggtcccttggcgtcattctgttcatttgtctgtctggttatcccccattttctgagcaccgaacccaagtttcactaaaagatcaaatcactagcggcaagtacaattttatcccggaggtgtgggccgaagtgagtgagaaggctctcgatctggtgaaaaaacttttagtcgttgaccccaaagctcggtttaccacggaagaagctttacgacacccgtggctgcaggacgaggatatgaagaggaaatttcaagatctgcttagcgaagagaatgaatccaccgcccttcctcaggtcttggctcaaccctccacatcccgaaagaggcccagggagggtgaggcagaaggtgccgagacaaccaagcgtccagccgtctgtgctgcagtgctctag

SEQ ID NO: 28014 - DNA, 1761 bp, Artificial Sequence
  Description of Artificial Sequence: Synthetic coding sequence
atgagtagggagtctgatgtcgaggcgcaacagagtcacgggagctcggcctgctctcagccacatggatccgtaacccagtcccagggcagctcttcccagagtcagggtatctcaagctcctctacttcgactatgccaaacagctcacagagcagtcattcatcaagcggaaccttgtcttccctcgagaccgtctccacccaggaactgtactccatccccgaggaccaggagcccgaggaccaggagccggaggagcccaccccagctccttgggctaggctttgggcgctgcaagacggctttgccaacctggagaccgagtccggccacgtaacccagagtgatctggaattgctgttgtcctccgatcccccagcgagtgcaagccagtccgctgggatcagaggtgtccgccaccaccctcgtccagtctgtagcctcaagtgtgtaaatgataattactggtttggccgagacaaaagctgtgaatactgtttcgatgagccactgcttaagcgaactgacaagtaccgcacctattccaagaaacacttcagaatctttagagaagttgggccaaaaaattcctacatcgcctatatcgaagatcactccgggaacggcactttcgtgaataccgaactggttgggaaggggaaacgcaggcctctcaataataactccgaaatcgccctgagcctctcacggaacaaggtgttcgtttttttcgatctgacagtggatgaccagagtgtctacccaaaggcccttagggacgagtatatcatgagtaagaccctgggttcgggcgcttgtggggaggttaagcttgccttcgagcggaaaacttgcaagaaggtagccatcaagatcatctcaaagcggaaattcgctattggcagcgcaagagaggctgatcctgcgctgaacgtggaaacggagatagagatcctgaagaagctgaaccatccttgtatcatcaaaattaagaattttttcgatgcagaagactactacatcgttctggagcttatggagggaggggaactgttcgacaaggtcgttggaaacaaacgcctcaaggaggcaacctgtaaattgtacttttaccagatgttacttgcagttcagtatctgcatgaaaatgggattatccatcgcgaccttaaaccggagaatgtgctcttgtcttcccaggaggaggactgcctgatcaaaatcactgacttcggacattcaaaaattcttggcgagacgtccctgatgcgaacattatgcggcaccccgacatatttggccccagaagtcctggtttcagtgggtactgctggctataaccgcgctgtagactgttggagtctgggtgtgatactgttcatctgcctttccggctaccctcctttttccgagcaccgcacccaggtaagcctcaaggaccaaataaccagcggaaaatataacttcataccagaggtgtgggccgaagtgtcagaaaaggctctcgaccttgtgaagaagctgctggtggtggaccccaaggccaggttcaccacagaagaggctctcagacacccgtggctgcaggatgaagatatgaagaggaagtttcaggacctacttagcgaagagaatgagagcacggctctgccccaggtcctcgcgcagccctccacaagccgaaagcgcccaagagagggcgaagccgaaggagcagagactacaaagcgtcctgccgtttgtgccgcagtgctgtag

SEQ ID NO: 28015 - DNA, 1545 bp, Artificial Sequence
  Description of Artificial Sequence: Synthetic coding sequence
atgtctagggaaagcgacgttgaggctcagcagtcacacggctcctccgcctgcagtcagccccacggttccgttacgcagagccagggcagctccagccagtcacagggcatttcaagcagcagtacttcgactatgcccaactcaagtcaaagctcccacagctcgtccggaacattaagtagtctcgagaccgtctccacgcaagagttgtactcaatccccgaagaccaggagcctgaagatcaggagcccgaggagcccacccctgctccctgggcaaggctctgggcattgcaagacggctttgccaacctggaatgcgtcaacgacaattattggtttggacgagacaagtcctgcgaatactgtttcgatgaaccgctcttgaagcgcaccgacaaataccgcacttactccaaaaaacattttagaatttttcgcgaagtcggacctaaaaatagttacatcgcctacatagaggaccacagtgggaacgggaccttcgtgaatactgagctggtggggaagggcaaacgccgaccactgaataataatagcgagattgcactctcgctgtcacgcaataaggtcttcgtattcttcgacttaactgtggatgaccagagcgtatatccaaaggccttgcgtgacgagtacattatgagcaagacacttgggtccggcgcttgtggcgaggtgaaactcgccttcgagcggaagacttgtaagaaggttgccattaagattatttctaagaggaaattcgctatcgggtctgctagagaggctgatccagctttgaacgtcgaaactgaaatagagatcctaaaaaaattgaaccacccatgcatcattaaaattaagaattttttcgacgcagaggactattacatagtgctggaacttatggaaggtggagagttatttgataaggtggtcggcaacaagcgtctgaaggaggccacctgcaagctgtatttttaccaaatgctgttggccgtgcaaatcacagatttcggtcactccaaaattctgggcgaaactagcctgatgaggaccctctgtggcacccccacctacctggcgccagaagtgctggttagtgtaggcaccgcaggatacaatcgcgctgtggactgctggtccctcggagttattctgttcatatgcctttccggctaccccccattttcagaacatcggacccaggtcagtctcaaggaccagatcacgagtggaaaatacaacttcatcccagaagtttgggcagaggtgtccgaaaaagcactcgatctggtgaaaaagctgctcgtggttgacccaaaggccaggttcactactgaagaggcgctcaggcacccctggctgcaagacgaagacatgaaaaggaaattccaggacttgctatccgaggaaaatgaatcaacagccttaccacaggtccttgctcagccatccacatcacgcaagcgcccacgggaaggtgaggcagaaggggctgagacaaccaagagacctgctgtgtgcgcagcggtattgtag

SEQ ID NO: 28016 - DNA, 1359 bp, Artificial Sequence
  Description of Artificial Sequence: Synthetic coding sequence
atgtctcgggagtccgacgtggaagctcagcagtcgcacggttccagcgcctgttcccaaccacacggaagcgtcactcagtctcaggggtccagcagccaatcccagggtattagttcttcttccacatccactatgccaaatagttctcagagctcccattcttcatcaggcacactgtcttcccttgaaacggtgtcaacacaagagttatattccattcccgaggaccaggagcccgaagaccaggaacccgaagaaccaaccccagccccttgggcaagactgtgggcgttgcaggatggcttcgccaatttagtctttgttttcttcgatctgacagttgacgaccagtctgtgtatccgaaagcactcagagatgaatacattatgtccaaaacactgggcagtggggcatgtggcgaggtaaaactcgcctttgaaagaaagacatgcaagaaggtagcaataaaaatcatctcaaagagaaagttcgctatcggtagcgcgagggaggccgaccccgcacttaatgtggaaacggagatcgaaatcctgaaaaaactgaatcacccgtgtatcattaagataaagaatttctttgacgctgaagattactatatcgtcttagagctgatggaggggggtgaactgttcgacaaggtcgtcggcaataagcgactgaaagaagcgacttgcaagctttatttctaccaaatgttacttgctgtgcaatacctgcatgagaatggaattattcacagagacctgaaaccagaaaatgtgctgctctccagccaagaggaagactgtctgatcaaaatcaccgacttcggtcactccaagatactgggagaaactagcctgatgcgcacgctttgcgggacacctacctaccttgctccagaggtgctagtctccgtgggtactgcaggctacaatagagctgtggactgctggagcctgggagtgatactcttcatctgccttagcggttatccaccgttctcagagcataggacccaggtgtcactgaaagatcagatcactagtggaaaatacaatttcatccctgaagtctgggccgaagtgtcggaaaaagccctagacctggttaaaaagctgctggtggtggaccctaaggcccgttttactacggaggaagccctccggcatccctggcttcaagatgaggatatgaagaggaaattccaggacctgttgagtgaggaaaatgaatcaacagctttaccgcaggtcctggcacagccttcaaccagcagaaagagaccacgagaaggcgaagcagaaggtgctgaaacaaccaaacgacccgctgtttgcgctgccgtgctgtag

SEQ ID NO: 28017 - DNA, 1632 bp, Artificial Sequence
  Description of Artificial Sequence: Synthetic coding sequence
atgtcacgggaatctgacgtggaagcacagcagtcacacggttcctcagcgtgcagtcaaccacacggaagcgtgactcagtcacagggatccagcagtcagtcacaagggatatcctcctctagcacaagcaccatgccgaacagtagccagtcttcacattcatcttcaggcaccctgagctccctggaaacagtttctacacaggagctgtatagcatccccgaagatcaagaaccagaagaccaggagcctgaggaaccaactccggctccctgggcccgtctgtgggccctgcaggatggcttcgcaaacctggaatgcgtcaacgataattactggtttgggcgtgacaaaagctgcgaatactgcttcgacgagccactgcttaagcgaactgacaaatataggacatatagtaaaaagcactttcggatctttagagaagtcggacccaaaaactcctacattgcctatatcgaggaccacagtggaaacggaaccttcgtaaatacggagctcgtgggaaagggtaagcggaggcctctgaacaataacagcgaaatagccctctcactttctcgtaataaagtttttgttttttttgatctgacagtggacgatcagagcgtttatcccaaagcattgcgagacgagtacattatgtcgaaaactctcggctctggggcatgcggggaagtgaagctagcatttgaacgaaaaacctgtaaaaaagtggctattaaaatcatatctaaacgaaagtttgctattgggtccgcgcgagaggctgatcctgcattaaacgtcgaaaccgaaatagaaattctgaaaaagttaaatcatccatgcatcattaaaatcaagaatttcttcgatgcggaggattactatatcgttctagaattgatggagggcggagagttatttgacaaagtggtaggtaacaagcggctgaaggaggcaacatgcaagctttatttctaccagatgctcttagcggtccaatacttacatgagaatggcatcattcatagagacctcaaaccagagaatgtcctgctgagttcccaggaggaagattgtctcattaaaattaccgactttgggcacagcaaaatactgggcgagacatccttgatgcgtactctctgcgggactcctacttatcttgcccctgaagtgctggtgtctgtgggcacggccggttacaaccgtgccgtcgactgctggagcttgggcgttatcttgttcatttgtctttctggttacccgccattctcagagcaccgaacacaagtcagcctgaaggatcagatcacatcaggcaagtataattttataccggaggtttgggccgaggttagcgagaaggccctagatcttgttaaaaaactccttgtggttgatccaaaagctagattcacaaccgaggaggccctgcgtcatccatggctgcaagatgaagacatgaagcggaagttccaggatctgctttcagaggagaacgaatcaactgcactaccccaggtactggcacagcctagcacatcccgcaagcgaccacgcgaaggagaagccgagggagccgaaacaaccaaacgccctgctgtgtgtgcagctgtgctgtag

SEQ ID NO: 28018 - DNA, 1632 bp, Artificial Sequence
  Description of Artificial Sequence: Synthetic coding sequence
atgagcagggagagtgatgtagaggctcagcagagccacggatcttccgcttgcagtcaaccgcatggctctgtgactcagagtcaaggcagttctagtcagtcgcagggcatctctagtagttccactagcactatgcccaattccagtcaatcgtcccactctagttcaggaaccctctccagtctggagaccgtatccacacaggagttgtactcaatcccggaggaccaagagccagaggatcaggagccagaggaaccaacaccggctccgtgggccaggctttgggcgctccaggacggtttcgccaacctggagtgcgtgaatgataattactggtttggtagggacaaaagttgtgagtactgcttcgacgaaccactgctcaagagaacagacaagtatcggacctactccaaaaaacactttaggatcttccgggaggtgggtccaaagaattcttacatcgcttatattgaggatcactctgggaatgggactttcgtgaacacagaactggtgggcaaaggaaagcgcaggccactgaataataatagcgagatcgcactgtctctgtcaagaaacaaggtgtttgtttttttcgacttgaccgtggatgaccagagcgtatatcctaaagctctcagagatgaatacataatgtctaagacgttgggcagcggagcctgtggagaggtgaaactggcattcgaacgcaaaacttgtaaaaaagtggccattaaaatcattagcaaaaggaaattcgcaattggcagcgccagagaggcagacccagcacttaatgttgagaccgagatcgagattttaaagaagctcaatcatccttgcattattaagattaaaaatttctttgatgccgaagactattatatcgtactggaactgatggagggcggagagcttttcgacaaggtggttggaaacaaaaggttaaaagaagccacctgtaagttgtatttctatcagatgctgctggccgttcagtatttacatgagaatggcatcatacaccgggacctgaaacctgagaacgttttattgtcctcccaagaagaagattgtctcatcaagattacagattttggccatagcaaaatattgggcgagacctccctcatgcgaactttatgcggaacccctacctatctggcacctgaagtactggtgtcagtgggcacagctgggtataacagggcagtagattgttggagcttaggggttatcctgtttatctgccttagcgggtatcctcctttttcagaacatcgtacccaggtgtcactcaaggatcagatcacatctggcaagtacaacttcattcctgaagtgtgggcagaggtcagtgagaaagccttggatctggtgaagaagctgctagtcgttgatccaaaagcccgtttcacgacagaagaagccctgcgacacccgtggctgcaggacgaagatatgaagcggaaattccaggatctgctgagcgaagagaacgaaagcaccgctttgccccaagtcctggctcagccatcaacatccaggaagcgtcctcgagagggcgaggccgagggcgcagagaccaccaaacgaccagccgtctgtgctgccgtcctgtag

SEQ ID NO: 28019 - DNA, 969 bp, Artificial Sequence
  Description of Artificial Sequence: Synthetic coding sequence
atgtctaagacgctgggaagcggcgcttgtggcgaggttaaactagcctttgagcggaaaacatgtaaaaaggtggctatcaaaattatcagcaagaggaaattcgcgattggatcagccagagaggcagaccctgccttgaatgttgagacagaaatcgaaattctgaagaagttgaatcatccgtgcattattaagattaagaatttcttcgacgcagaggattattatatagtgctggaacttatggaaggcggagaactgttcgacaaagtggtgggcaataagagactgaaagaagccacctgtaaactctatttttaccagatgttactagccgtgcagtatttgcatgaaaacggcattattcaccgtgacctcaagcctgaaaacgtgttgttgtcctcacaggaagaggattgtctgatcaaaattactgactttggacatagtaagattctcggtgaaacatctctgatgcgaaccctgtgcgggactcccacatacctggcaccggaggtcctggtcagcgtaggaacagccggatacaatagagccgtagactgttggagtcttggcgtgatcctctttatctgcctgtccggctacccaccgttctcggaacacagaactcaggtgtcactcaaggatcagataacatctggcaagtacaacttcattcccgaagtctgggcagaggtgtctgagaaggccttggacttggtaaagaaattgctggtggtggatcccaaggctaggttcaccactgaggaggccctccgtcacccgtggctgcaggacgaggatatgaagaggaagttccaagatctgcttagtgaggagaacgagtcgaccgctttaccacaggttctggcccagccctctactagccgaaagcgtccgagagaaggggaagccgagggagctgagaccacgaagcggccagccgtctgtgcggctgttctgtag

SEQ ID NO: 28020 - DNA, 624 bp, Artificial Sequence
  Description of Artificial Sequence: Synthetic coding sequence
atgagcagagagagtgacgttgaagctcaacagtctcacggcagctctgcatgtagccagccacacggatccgtgactcagtcacagggatcaagctctcaatctcagggaataagttcttcttcaacatcgaccatgcctaattcatcgcagagctctcactcctcctctggtactctgagcagtcttgaaacagtctcgacgcaagagctgtatagtattccagaggaccaggaacctgaagaccaagagccagaagagccgacacctgccccatgggccagactgtgggcattgcaggatggctttgcaaatttagagtgtgtgaatgataactactggttcggcagagataaatcttgcgagtactgctttgatgagccactcctcaaacgcactgacaaatatagaacctactccaagaagcattttcgcattttcagggaggttgggccaaagaatagttatatcgcttatatagaagaccactccggaaacggtacctttgtgaatacagagctggtgggcaagggcaagagacgcccacttaacaacaacagcgagatcgctttgtccctcagccgcaacaaagagaagatccttaaaatttattctctctcatag

SEQ ID NO: 28021 - DNA, 294 bp, Artificial Sequence
  Description of Artificial Sequence: Synthetic coding sequence
atgaaggtatcagcagccctgttgtggctccttttgatagctgctgctttttctccacagggactcgcaggtcctgcctcagtcccaaccacttgctgcttcaatctcgccaacagaaagattccattgcagaggctggagtcatatcggaggatcacatccggcaagtgtcctcagaaagcagtgatttttaagaccaagctggcaaaagatatttgtgcagaccccaaaaagaagtgggtgcaggactctatgaaatatttggaccagaaaagcccaacacctaaaccgtag

SEQ ID NO: 28022 - DNA, 1692 bp, Artificial Sequence
  Description of Artificial Sequence: Synthetic coding sequence
atgtcaaggatcggaggcgctggccttcctgcagcagcacttaccgggccaggacggtttcggatggcgagagaggaaccagcacctgctgctctggccgctgccggtcagccgggtgggggaaggggaggcgaaagagccctgcaaggaccaggcgtcgccagaaggggcagaccatccctttctagggctaagctgcacggcctaagacacatgtgtgcaggcaggaccgcagcgggtgggtccttccaacgcagagcgctctgggtcctggccttctgcacttccttcggcctgcttctaagctggagcagcaatcggctcctctattggctctcatttccgagtcacaccagagtgcacagggaatggtcccgacagctccccttccccgcagtcacggtgtgtaacaataatcctctgcgctttccacgcctgagtaagggtgacttatattatgcagggcattggcttggcctgcttctgcccaaccgcaccgctagacctctggtcagcgagctcctgcgcggagatgaacctcgtcgtcagtggtttcgcaagctagctgacttccgcctgtttctcccgcctcgtcactttgaaggcatcagcgctgcgtttatggataggctggggcaccaactggaagacatgcttctgtcctgtaagtataggggggagctctgtggccctcacaatttttcaagtgtgttcactaagtacggcaagtgttatatgttcaattccggcgaggacgggaaacccctactgactacagtgaaaggtgggaccggtaatggcctcgagattatgcttgatatccaacaagatgagtacctgcctatatggggcgaaacagaagaaaccactttcgaagctggagtgaaagtgcagatccactctcagtcagagccacccttcatccaggagctgggctttggcgtcgctcccggattccagacttttgtagctactcaggagcagagactgacgtaccttccccctccatggggtgaatgtcgtagcagcgagatgggtctagacttcttccccgtctatagcatcaccgcctgccggatcgactgtgaaacccgctatatcgtggaaaattgtaactgcaggatggtccacatgccaggggacgcgcctttctgcactcccgaacagcacaaagaatgcgccgagcccgctctcggcttactggcggagaaggactcaaactattgcctgtgcagaaccccctgtaatctcactcgctataataaagagcttagtatggttaagattccctccaagacgagcgctaaatacctggaaaaaaaattcaacaagtctgagaaatacatatccgaaaatattctggtgttggacatctttttcgaagcacttaactacgagactatagaacaaaagaaggcttacgaggtagccgcattgctgggcgatataggtgggcagatgggactcttcattggggcatcaatattgaccattctggaactcttcgactatatctacgagctgattaaggaaaagctgctcgatctgctcggaaaggaagaagacgagggttctcacgacgaaaacgtctctacttgcgacaccatgccaaaccatagcgagacgattagtcacaccgtgaatgttcctcttcagacaactcttggcactcttgaggaaattgcatgctag

SEQ ID NO: 28023 - DNA, 2328 bp, Artificial Sequence
  Description of Artificial Sequence: Synthetic coding sequence
atggtgggaccggaggacgcaggcgcatgcagcggcagaaaccccaagttattaccagtgcctgcacccgacccagtcggacaggatcgaaaggttatccgcgcaactggaggctttgggggtggggtcggggctgttgaacccccagaagaggccgacgaggaggaggaagccgacgaggaggaagaaactccccctcgacaactgctgcaaaggtacctagctgcagccggagaacagttggagccaggtttatgctattgccctctccctgcaggacaggcaggcgctccacctccaagcgccgctccaaggtccgacgcatgcttattgggtagcggtagcaaacatcggggtgctgaagtcgccgacggcagggcacccaggcatgagggcatgacaaatggggatagcgggttcctcccaggcagagattgccgagatctggaagaggcaaggggtttagctcgagctggtggccgtgaatcgcggagacggaggccttatggacgcctccgcctggaaggccctggggatgaggatgccgatggtgccggttctccttcagattgggcttctcctctcgaagatccactcaggagctgttgtctggtggcagctgacgcccaggagcctgagggagcaggctccgacagcggtgacagccctgcctcaagttgttcttcgagtgaagactccgagcagaggggtgtaggcgcaggtgggcctgaggaaggcgctccccctgcaaccagcgctgaaaggaccaacggcggtgccgagccccgactcggcttttctgatatccatttcaacagtaggaatactttccaggtgtcccggggacaatcagccagggaccatctgcctccagcagggccacctgtcccgttaccagccgcagagcaagggccagctggcgctagcgccagggctaggcgctcgggcggattcgcagacttctttaccaggaatctgtttccgaaaagaacaaaagagcttaagagcgtggtccatagtgccccagggtggaaactgttcggtaaagtcccccctagggagaatctccagaagacgtccaagatcatacagcaggagtacgaggctagaacaggaaggacttgcaaacccccaccgcagagctcacgaaggaagaactttgaattcgaacctctgtccaccaccgccctgatcctggaggacagacctagtaatttgcccgctaagtccgttgaagaggccctgaggcacagacaagaatacgatgagatggttgcagaggccaaaaaaagagaaatcaaagaggcgcacaagcgcaaaaggatcatgaaggaaaggttcaaacaggaggagaatatcgcgtccgccatggtgatctggatcaatgagattctgcccaactgggaagtcatgagatcaacacggagagtgagagagctgtggtggcaaggcctccccccttctgtgaggggaaaagtgtggtccctagccgtgggcaatgagcttaatatcacccctgaactctacgaaatcttcctgagccgcgcaaaagagcgatggaagtccttttcggagaccagtagcgagaacgatacagaaggcgtgagcgtagccgatcgagaggcctcgctggaacttattaagttagacatcagtaggacatttccaagtctatacatctttcaaaagggtggtccctaccacgacgtcttgcattctattctaggcgcatacacctgctacaggcctgatgttggatatgttcaggggatgtcgttcattgccgctgtattgatactcaacctggaagaagcagatgctttcatcgcgtttgctaatctactgaataagccttgccaattggctttttttagagtggaccatagcatgatgttaaaatactttgccacatttgaagtgttctttgaagagaatctatctaagctgtttctgcactttaaatcatattcactcacaccggacatctacctgatcgactggattttcacactctacagcaagtcattaccgcttgatctggcatgtcgtgtgtgggatgtgttttgcagggacggggaagaattcctttttcggaccggcctgggtatcctccgtctgtatgaagatatcctgctccagatggatttcatccacattgctcagttcttaaccaagctgccagaagacatcacatctgagaagttgttctcgtgtatcgcggctattcagatgcaaaattccacaaagaagtggactcaggtgtttgctagcgttatgaaggatattaaggagggtgataagaattcatccccagcccttaagagctag

SEQ ID NO: 28024 - DNA, 276 bp, Artificial Sequence
  Description of Artificial Sequence: Synthetic coding sequence
atgaaggtgtctgccgcagcacttgcagttatcttgatcgccactgcgctctgtgctcccgcatcggccagcccatactcgagcgatacgaccccctgttgctttgcatacatagcacgccctcttccgagggctcacatcaaggaatacttctatacatcaggcaaatgtagcaaccccgctgtggtgtttgtgactaggaagaaccggcaagtttgcgccaatcccgagaaaaagtgggtccgcgagtatatcaattccctcgagatgagctag

SEQ ID NO: 28025 - DNA, 276 bp, Artificial Sequence
  Description of Artificial Sequence: Synthetic coding sequence
atgaaggtgtcagcagccgctcttgcggtcattctgatagcaaccgctctgtgtgctccagccagcgcctccccatatagcagcgacaccacgccctgttgtttcgcttatatcgcacggcctctcccaagagcccacattaaggagtacttctacacttctggaaagtgctcaaaccctgccgttgtctttgttacccgcaagaatcgccaagtctgtgccaaccctgaaaaaaaatgggtgagggaatacatcaatagtttggagatgtcctag

SEQ ID NO: 28026 - DNA, 300 bp, Artificial Sequence
  Description of Artificial Sequence: Synthetic coding sequence
atgaaggctagcgcagcattgttatgcctgctcctcaccgccgctgccttctcaccacaagggttggcccagcccgtgggaattaacacgagcaccacttgctgctatcggttcattaataagaagatccctaagcagcgtctcgaatcctaccgaagaacaacttctagccactgccctagggaagcagtcatctttaagacgaagcttgacaaggaaatctgtgccgatccaacacagaagtgggtgcaggacttcatgaaacacctcgataagaagacccagacccccaaattatag

SEQ ID NO: 28027 - DNA, 330 bp, Artificial Sequence
  Description of Artificial Sequence: Synthetic coding sequence
atgtggaaaccaatgcccagcccaagtaatatgaaggcaagcgcggctttgttgtgcctccttttgactgcagccgcatttagtcctcaaggtcttgcacagcccgtcggcatcaatacgtctacgacttgctgttatagattcatcaacaagaagattcccaagcaacgcctcgagtcctataggcgcaccacaagcagtcactgtcccagagaggcagtcatttttaagactaaacttgataaagaaatctgcgctgaccccacacaaaagtgggtgcaggactttatgaagcacttggataagaagacccagacacccaaactgtag

SEQ ID NO: 28028 - DNA, 276 bp, Artificial Sequence
  Description of Artificial Sequence: Synthetic coding sequence
atgtggaagcctatgccctctcccagtaatatgaaggctagcgctgccctcttgtgtctcttactgaccgcagctgctttctccccacaagggttagcgcagcccgaaagaccacgcacacatcctcagtggaccttcctcctggtcgtgagcctgcaacttggacttattctccagcttcccgctgcgaccgacctgtcgatacgcaaatccctctctcggggttggcgcgctaccgaggggccaccagtagcaaccgttccaggaaagctgtag

SEQ ID NO: 28029 - DNA, 174 bp, Artificial Sequence
  Description of Artificial Sequence: Synthetic coding sequence
atgtggaaaccgatgccttctccatcaaacatgaaggcctccgccgctctgctatgtctgctgctaaccgctgcagccttcagtccacagggcttggctcagcccgcatctcgccctaactggaccaggcgcagtgtgctgaccccccataggagcggctccaggacgttgtag

SEQ ID NO: 28030 - DNA, 297 bp, Artificial Sequence
  Description of Artificial Sequence: Synthetic coding sequence
atgaatcagaccgcaatcctgatctgctgcctcatcttcctgactttaagcggcattcagggagttccactgtctcgcaccgtgcgctgtacatgcatcagcatctccaatcagccagtcaaccctagaagtcttgagaaattagaaatcatccccgcttcccaattctgccccagggtcgaaatcattgcaactatgaagaaaaagggcgagaagagatgcctcaaccccgagtctaaggctatcaaaaaccttttaaaggcggtaagcaaggagcggagtaagcggtccccctag

SEQ ID NO: 28031 - DNA, 270 bp, Artificial Sequence
  Description of Artificial Sequence: Synthetic coding sequence
atgaatgctaaggtggtggtggttctcgtcctagtgctgactgccctttgtttgtctgacggcaaacccgtgtctctgtcctaccgctgcccatgcaggtttttcgagtcccacgttgctcgcgctaatgtgaagcacctcaagatcctaaacacccctaactgtgccctgcagattgttgcaagactgaagaataataatagacaggtgtgcatcgacccaaagctcaaatggatccaggagtatctggagaaggccctgaataaatag

SEQ ID NO: 28032 - DNA, 360 bp, Artificial Sequence
  Description of Artificial Sequence: Synthetic coding sequence
atgaacgctaaagtggttgtggtgctagtgttagttcttactgccctctgcctatcagatggcaagcccgtttctctctcctaccgatgtccttgccgcttctttgaaagccacgttgcaagagccaacgtgaagcacctgaaaatcctgaatactccgaattgcgctctgcaaattgtggcgaggctgaagaacaacaataggcaagtgtgcattgatcctaaacttaagtggattcaagaataccttgagaaggcgctgaacaagggccgtcgcgaagaaaaagtcggaaaaaaggagaagatcggtaagaaaaagcgacaaaagaaaagaaaggctgctcagaagagaaaaaattag

SEQ ID NO: 28033 - DNA, 282 bp, Artificial Sequence
  Description of Artificial Sequence: Synthetic coding sequence
atgaatgccaaagtggttgtggtcctggtgctggtgctgacggctctgtgtctctcagatggaaagcctgtttccttatcctacaggtgcccttgcagattttttgaaagtcacgtggctagggccaacgtcaaacacctgaaaatattaaatacccccaactgtgcattacaaatcgtggccaggctcaaaaataataataggcaagtgtgtatagaccccaagcttaaatggattcaggagtacctggagaaagccctgaataagcgctttaagatgtag

SEQ ID NO: 28034 - DNA, 423 bp, Artificial Sequence
  Description of Artificial Sequence: Synthetic coding sequence
atgaatgctaaggtcgttgtcgtgttggtactagtcctcacggccctgtgtctgagcgatggcaaacctgtcagcctgtcctaccggtgcccgtgtcggttctttgagagccatgttgcgagggccaacgtgaagcacctgaagattcttaatacacctaattgtgctctgcagatcgtggcaaggttaaagaacaataacagacaagtgtgcattgatcctaaactcaagtggattcaggagtatcttgaaaaagctctgaacaaccttatctctgcagcaccagctgggaagcgggtcattgcaggggcacgggctctgcacccaagccctccaagagcttgcccaactgcacgcgctctctgtgaaatccgtctgtggccgccacctgaatggagctggccctctccaggcgacgtttag

SEQ ID NO: 28035 - DNA, 273 bp, Artificial Sequence
  Description of Artificial Sequence: Synthetic coding sequence
atgaatgccaaggtggtggtggttttagtccttgtgctcacagctctgtgcctgagcgatggtaagcccgtcagtctgtcctaccgttgcccttgtcgcttcttcgagagtcacgtggcgagggccaacgtgaaacacttgaagatactgaatacaccgaactgtgccctccaaatagtagcacgcctaaaaaacaacaacagacaggtctgcatcgatcctaaactgaagtggatacaggaatatttggagaaggctctaaacaactgctag

SEQ ID NO: 28036 - DNA, 330 bp, Artificial Sequence
  Description of Artificial Sequence: Synthetic coding sequence
atgaaattcatcagtaccagtctcctgttgatgctgctcgtgagctccttgagccccgttcagggggtcttggaagtttactatacctccctgcgatgccgttgtgttcaggagagtagcgttttcattccaagacggttcatcgaccgcatccaaattctcccccgaggtaatggatgccctcgaaaagagatcattgtctggaaaaagaataaatcgattgtatgcgtcgatccgcaggcagagtggatccagcgcatgatggaggtgttacggaaacgatcgagctcgaccctgccggtgcctgtgtttaaaagaaagataccttag

SEQ ID NO: 28037 - DNA, 1560 bp, Artificial Sequence
  Description of Artificial Sequence: Synthetic coding sequence
atgtttctgttgccacttccagcagccggacgcgtcgtagtgaggcgccttgcagtgcgaagatttggatcccggagtctgtccaccgctgatatgacaaagggcctggtgctcggaatctactcaaaagaaaaggaggacgatgtccctcagttcaccagcgctggagagaactttgacaaacttctggccggtaagctgcgcgagaccttgaatatatctggtcctccactgaaagcaggcaagactcggacattctacggactacatcaggattttccgtccgtcgtgctggtgggccttggcaaaaaagcagctggcatcgatgagcaagagaattggcacgaggggaaagaaaacatccgcgctgctgttgccgcaggatgccgccaaatacaagatctggaattatcttctgtggaggtagatccctgcggcgatgctcaggccgctgccgagggtgcagttttgggcctgtacgagtatgatgatctcaaacaaaaaaaaaagatggccgtgagtgccaagctctatggatccggggatcaggaggcttggcaaaaaggcgtactgtttgccagcggacagaacctggctaggcagcttatggagacgcccgctaacgagatgacacctacaagattcgccgagataattgaaaaaaacctcaaatcggcctcttcaaagactgaggttcacattcggcctaagagttggatcgaggaacaggcaatggggtctttcctctcagtggccaaaggctctgacgagcccccagtgtttctggaaattcattacaagggaagtcctaacgccaatgaaccaccactggtgttcgtggggaaaggcattactttcgactccggaggcattagcattaaagcatccgccaacatggatctgatgagggcggacatgggtggtgctgctactatatgctcagccatcgtgagcgctgctaagctgaacctgcctatcaacataataggtcttgccccactatgcgaaaacatgccttccggaaaggccaacaagccaggggatgtcgtgagagccaagaatggaaagacaattcaggtcgacaacacagacgctgagggaagattgattttagctgacgcactgtgttacgcccatacattcaaccctaaggtaatactcaacgcagccactctgaccggcgctatggacgtagctttgggcagcggtgcgaccggggtcttcacaaattcctcctggctctggaacaagttgtttgaagccagtatcgaaaccggcgacagggtttggcgaatgcccttgttcgaacactacacacgccaggtcgtcgattgtcagttggctgacgttaacaacattggtaaatatagaagtgctggggcttgtaccgcggcagcatttcttaaggagtttgtcacacatcctaagtgggcccatctagatatcgcgggtgtaatgactaacaaggacgaagtgccctacctgcgcaagggtatgactggacggccaacgaggacccttattgaattcctgctgcgcttttcacaggataatgcgtag

SEQ ID NO: 28038 - DNA, 378 bp, Artificial Sequence
  Description of Artificial Sequence: Synthetic coding sequence
atgaagaagtcaggagtgctcttccttctgggcattatcctgttggttctcattggggttcaggggactcccgtggtgagaaaggggaggtgttcctgcatctctaccaatcaaggcaccattcacctacagtccttaaaagaccttaagcaattcgccccttcccccagttgtgaaaaaattgagatcatcgcaactttaaagaacggggtgcagacttgtctgaaccctgattccgccgatgtgaaggagttaatcaaaaagtgggagaagcaagtgtctcagaaaaagaagcaaaagaacggaaagaaacaccagaagaagaaagtcttgaaggtacgaaagtcacagcgtagtaggcagaagaaaactacatag

SEQ ID NO: 28039 - DNA, 1083 bp, Artificial Sequence
  Description of Artificial Sequence: Synthetic coding sequence
atggaggattttaacatggagtcagactcctttgaagacttttggaagggtgaggacctgtcaaactactcatactctagcactctcccaccattcctgttagacgctgccccttgcgaaccggaaagtcttgagatcaacaagtatttcgttgttattatctacgctctggtattcctgctctcactgcttggtaatagtcttgtgatgctggtaattctttatagccgcgtcgggagaagcgtcacggatgtgtatttactcaacctcgcattagctgacctcttgttcgcgctgaccttacccatctgggcagctagcaaagttaatggctggattttcggcactttcttatgcaaggtcgtgagcctgttaaaagaggtgaacttctactctggtattttgctgttagcttgcatttcagtggacaggtacctggcaatcgtgcacgctactaggactcttacacagaagaggtatctagtgaaatttatttgtcttagtatctggggactctcattgctactcgcgctgcccgtactgctgtttaggagaaccgtgtactcctcgaatgtgagtcctgcgtgctacgaagatatgggcaacaataccgctaattggcggatgttgctgcgcattctaccacagagctttgggttcatcgtaccactactgataatgttgttctgttacggatttaccctgcgaacactctttaaggcacatatgggtcagaaacatagagctatgcgcgtaatcttcgccgtcgtgctgattttcttgctctgctggttgccatataacttggtcctgctcgccgacactctcatgcgcacccaggttatacaagagacctgcgagagaaggaatcatatcgatcgcgctttggatgcaacagagatattgggcatcctgcacagttgcctcaaccccctgatttatgcttttattgggcaaaagttccggcatggtctgttgaagatcctggcgatccacggccttatctccaaggacagcctccccaaggacagtagaccctctttcgtgggatcaagttccggtcacacgtccactacactctag

SEQ ID NO: 28040 - DNA, 417 bp, Artificial Sequence
  Description of Artificial Sequence: Synthetic coding sequence
atggaggatttcaacatggaatctgattcctttgaggatttttggaagggggaagacttatctaattatagttatagtagcacattgccaccctttcttctggacgcagcaccctgcgaacctgagagcctcgagataaacaaatactttgttgtaatcatctacgcgctggtttttctgctgagtctgctggggaattcactagttatgcttgtgattttatactctcgcgtgggccgaagcgtgaccgatgtctatctcttaaatctggccctggccgaccttttattcgcactgacactgcccatctgggccgcttcaaaagtgaatggctggatattcggcacttttctgtgtaaagtggtctcactactcaaagaggtgaatttctattccggcatcctgctgctggcctag

SEQ ID NO: 28041 - DNA, 48 bp, Artificial Sequence
  Description of Artificial Sequence: Synthetic coding sequence
atggaagattttaacatggaaagcgacagctttgaggacttctggtag

SEQ ID NO: 28042 - DNA, 519 bp, Artificial Sequence
  Description of Artificial Sequence: Synthetic coding sequence
atggaagatttcaatatggagtcagattcattcgaagacttctggaagggcgaggacttaagtaactacagttattcatcgaccctccccccttttttgctagacgccgctccgtgtgaaccggaatcactggagatcaataaatattttgtagttattatttacgccttggtattcttactctctctgctgggtaactcactcgtgatgctcgtgattctgtactcccgcgtgggaaggtccgtcactgacgtgtacctgctcaatcttgccctcgccgatttattgttcgctctcaccttgcccatctgggcagcatctaaggtgaatgggtggattttcggaacattcctgtgtaaagtcgtgagcctgttaaaggaggtcaatttttacagcggcatcttgctgttggcctgcatttccgttgataggtacctcgctatcgttcacgccactagaacacttactcagaaacggtacctcgttaagtttatctgcttgagcatctggggcctgtag

SEQ ID NO: 28043 - DNA, 48 bp, Artificial Sequence
  Description of Artificial Sequence: Synthetic coding sequence
atggaagattttaacatggaaagcgattcatttgaggacttctggtag

SEQ ID NO: 28044 - DNA, 606 bp, Artificial Sequence
  Description of Artificial Sequence: Synthetic coding sequence
atggaggattttaatatggagagtgactccttcgaagacttctggaagggggaagatctctcaaattattcctactctagcacactgccaccattcctgcttgacgctgcaccttgcgaacctgaatccctggagatcaataaatatttcgtggttattatctacgccttggtctttttactcagtttactaggaaattctttggtgatgttagtgattctgtacagtagggtaggccgtagcgtcactgacgtgtacctcttaaacctggctctggccgacctgctgttcgcacttaccctgcctatctgggccgcatctaaagtgaatggctggattttcggtaccttcctgtgtaaggtcgtcagcctcctgaaagaagtgaatttctacagtggaatcttacttttggcctgcataagcgtggaccgctatctggcaatcgtgcatgctacccgcacgttgacccagaaaagatatttggtgaaattcatctgcctaagcatatggggactatcgttgcttctggctctgcctgtcctgcttttcaggagaacagtgtacagttccaatgttagccccgcttgctacgaggacatggggtag

SEQ ID NO: 28045 - DNA, 411 bp, Artificial Sequence
  Description of Artificial Sequence: Synthetic coding sequence
atggaggattttaacatggagtcagactcctttgaagatttttggaaaggcgaagacctcagcaactattcctatagcagtactttacctccttttcttctcgacgccgctccatgtgagccggagagccttgaaattaacaaatacttcgttgtgattatttacgcgcttgttttcctcctgagcctgctcgggaattccctggtgatgctggtgatcctgtactctagggttggcagatccgtcaccgatgtttatctgcttaacctggcattagcagacctgctttttgcgctaacactacctatctgggccgcatcaaaggtgaacggttggatcttcgggactttcctgtgtaaagtggtaagcctcctcaaagaggtaaatttctactccggaatattgttatag

SEQ ID NO: 28046 - DNA, 1059 bp, Artificial Sequence
  Description of Artificial Sequence: Synthetic coding sequence
atggaaggcatctctatatacaccagcgacaactatactgaagagatgggttctggcgactatgatagtatgaaagagccttgctttagagaagaaaatgctaacttcaacaagatcttcctgcctacaatctattcaattatttttctaacaggaattgtgggcaatggcctggtgatccttgtgatggggtatcaaaagaaattgcggtctatgactgacaaatatcgactgcacttgtcggtagccgaccttctttttgtcataacgctgcccttctgggctgtagacgcggtggctaactggtattttggaaactttctgtgtaaggccgtgcacgtcatctacacagttaatctctactctagtgtcctaatacttgcttttatctctcttgatagatacctagcaattgttcatgcgacaaattcccagaggcctagaaagctccttgccgagaaagttgtttacgtgggagtctggatccccgctcttctgttgacaatccctgatttcatctttgcgaatgtttccgaagcggatgatagatatatctgcgacagattttatcccaatgatctctgggtggtggtcttccagtttcagcacatcatggtcgggctaatcctgcctggcattgtcatactgtcttgctactgcatcatcattagcaagttaagtcactcaaaggggcatcaaaagagaaaagctttgaagactactgtgatccttatcctcgctttctttgcatgttggttaccatattacatcggaatctcaatcgactctttcattttgttggaaataattaagcaagggtgtgagtttgagaataccgtgcataaatggatttccataacggaggccctcgcattcttccactgctgtctgaatcccatactttatgcattcctcggagccaaatttaaaacatcagctcagcacgcgcttacttcagttagtagaggcagtagccttaagatactctcaaagggcaagcgcggtggccactcttctgtgtctacagaatctgaatccagctcattccattcatcttag

SEQ ID NO: 28047 - DNA, 1071 bp, Artificial Sequence
  Description of Artificial Sequence: Synthetic coding sequence
atgtccattccactgccattgctgcagatttatacaagtgacaattataccgaggagatgggcagtggcgattatgattccatgaaggagccctgttttagggaggagaacgctaacttcaacaaaattttcctgccaaccatatactctatcatcttccttaccggcatcgtggggaacggtctcgtgattctagtgatgggctatcagaaaaagctaaggtcgatgactgataaatatcgcctccacctgagcgttgccgatctgcttttcgttataacactgcccttttgggccgtcgacgccgtagcaaactggtactttggtaattttctctgcaaagccgtgcatgtcatttacacagtgaatctttattcgagcgtcctgatcttggcttttattagccttgaccggtatttggccattgttcacgcgacgaactctcagagaccaagaaagctgctggcagaaaaggtcgtgtatgtaggagtctggattcccgcactgctgctcaccattcctgatttcatttttgccaatgttagcgaggccgatgaccgatatatctgtgacaggttttaccccaacgatctgtgggtagtggtattccaatttcaacatattatggtcggactaatcctgcccggaatcgtgatcctttcctgttattgtattattatatccaagctgtctcactccaagggccaccagaaacgcaaggcgctgaaaactacggttatccttattctagcctttttcgcctgctggttgccttactatatcgggatatctattgattctttcatcttgctcgaaatcataaagcaggggtgcgagtttgagaatacggttcacaagtggatcagtataacagaggctctcgctttctttcactgctgcctcaaccccatactctacgcattcctcggtgctaagtttaagacatctgcccagcatgctcttacaagcgtgagtagggggtccagcctgaagattctgagtaagggtaagcgcggtgggcattcgagtgtgtccaccgagtctgaatcatctagctttcacagcagttag

SEQ ID NO: 28048 - DNA, 669 bp, Artificial Sequence
  Description of Artificial Sequence: Synthetic coding sequence
atgccttggcagaccggaaccctaggcacttcatacgctcgacagtccatgtcttctactcagtccacgtctaccgccgtgagttcatcatggatcccagccctgttactgaccatccccgacttcatattcgccaacgtgagcgaagccgacgataggtacatctgtgatcggttctatcctaacgacctgtgggttgtggtgttccagtttcaacacataatggtaggtcttatactgccaggcatcgtgatactctcctgttactgcataattatctccaagctgagtcattcaaaggggcaccagaagaggaaagccctgaagacgaccgttattctgatcttggctttttttgcatgttggctgccatattacatcggcatctcaatagacagttttatactgctcgaaattatcaaacagggatgcgagttcgagaacactgtgcataagtggattagtataactgaggccttggcgttttttcattgctgtctcaatcctattttatatgctttcttgggggctaagttcaaaacttctgcacagcacgccctgaccagtgtttccagaggcagctcattgaagatcctaagtaagggaaaacgcggaggacatagtagcgtgtccactgaatctgagtcatctagctttcacagctcttag

SEQ ID NO: 28049 - DNA, 2832 bp, Artificial Sequence
  Description of Artificial Sequence: Synthetic coding sequence
atgactcagcgcagcattgccggacctatatgcaacctcaagttcgtaaccctgctggtcgcgctgagcagcgagctgcccttccttggggcaggggtacaactgcaggataatggatacaacggccttttgattgcgattaaccctcaggttcccgagaaccagaacctaatttcaaatattaaagaaatgattactgaagcttcattctatctgttcaatgcaaccaagagacgtgttttctttaggaatatcaaaatcctgattcctgccacatggaaggctaacaataattccaagatcaagcaggagagctacgaaaaagcaaacgtgattgtgaccgattggtacggagcccacggggacgatccctacaccctgcagtatcgagggtgcggaaaggagggcaaatatatccatttcacccccaattttttgttgaacgacaacctgaccgccggttatgggagtcgcggaagagtgtttgtacatgaatgggcacatctgagatggggcgtcttcgacgagtataataatgataaacccttctacattaacggacagaatcaaatcaaagtcacacggtgcagtagcgacatcacaggcatctttgtttgcgagaagggtccatgccctcaggagaactgtatcatcagcaaactgttcaaagaaggttgtacctttatttacaatagtacacagaacgccacagccagcattatgtttatgcagagcttgtcatccgtagtggagttctgtaacgctagcactcacaaccaggaggcccctaaccttcagaaccagatgtgctccctcaggtccgcctgggacgtaatcacagatagtgcagatttccatcactccttccccatgaacggcacagaactacccccacccccaacctttagcttagtccaagcaggtgataaggtggtatgtttggtgctggatgtaagtagtaaaatggccgaggcagaccggctcctacagttgcaacaagccgctgagttctatctgatgcaaatcgtggagatacatacattcgtgggcattgcaagttttgactcgaagggagaaattagagcccagttgcaccagatcaactccaatgacgacagaaaactccttgtgagttacctccctaccaccgtttctgcaaaaacagatatcagtatttgttccggcctgaaaaagggtttcgaagttgtcgagaagctgaacggcaaggcatacggttcagtgatgattttggtgaccagtggggacgataagctcctggggaattgtttgccaacagtgttaagctccggcagtaccatccattctatcgcccttgggagcagtgccgcaccgaacctggaagaactcagtcggttaacggggggacttaagttttttgtgcctgacatttccaattcaaattccatgattgatgccttctctagaatcagctcaggaacaggggatatattccaacagcatatccaactggaaagcaccggcgagaacgtcaagccacaccaccagcttaaaaacaccgtaactgtcgataacactgtgggcaacgatactatgttcctggttacttggcaggcatcggggccacctgagattattctgttcgacccagatggacggaaatattacacgaacaatttcatcactaatctgacttttaggacggcctctctatggatccctggaaccgctaaaccaggacactggacatatactctgaacaatacgcatcattctctacaggctctgaaggtaactgtgacatccagagcatccaattctgccgtcccgcctgctacggtcgaagcattcgttgaacgagacagcttgcacttccctcacccagtgatgatttatgcaaatgttaagcaaggcttttaccctatcctaaacgccactgtcactgccaccgtcgaacctgagactggggacccagtcaccctgagattactggacgatggagcaggcgctgatgtcattaaaaacgacgggatctatagccgctattttttctcttttgcagccaacgggaggtactcactcaaggtgcatgtgaaccatagcccctccatctccactcctgcccacagcattccagggtcacacgcgatgtacgtgcctggctacactgccaacggcaatatccagatgaatgcaccacggaagtccgtgggcagaaacgaagaggagcgtaagtggggcttcagcagggtgtcttccggcggatcatttagcgtcctgggtgtccccgctggcccacaccccgatgtgttccctccttgtaaaataatagacctggaggcagttaaggtcgaggaagaactaactctgtcctggaccgcccctggagaggacttcgatcaaggacaggctacgagctacgagatccgcatgtctaagtcactccagaacatccaggatgattttaataatgcgatactggtaaacacttcaaagagaaacccccaacaagcaggaattcgcgagatctttaccttcagcccccagatctcaactaacggtccggaacaccaacccaacggcgaaacccacgagtcccaccgaatctatgtggccattagagccatggaccgcaattccctgcagtctgccgtgtcgaatatagctcaggcaccactgttcatcccgccaaattctgatcctgttccggcaagggattacctgatcctcaagggagtcctcactgcgatgggtcttattggcatcatatgcctcattatagtcgttacccatcataccctgtcgcgcaagaaaagggcagataagaaggagaacggcactaaactcttatag

SEQ ID NO: 28050 - DNA, 423 bp, Artificial Sequence
  Description of Artificial Sequence: Synthetic coding sequence
atgacacagcggagtattgcagggcctatttgcaacctaaagtttgtcactttgctggtggccctcagttccgaactgccttttctgggggctggagtgcaactgcaggacaacggatacaacggattattgattgccataaacccccaagtgccagaaaatcagaatcttattagcaacataaaggagatgatcacagaggcttcattttatttgttcaatgctaccaagcgcagggtcttctttaggaacattaaaattttaatcccagctacatggaaggcgaataataatagtaagattaaacaggaatcctacgagaaagccaatgtcattgttaccgattggtacggagcacacggggacgatcaaggcgtggaaaagcgggagaatacctttatttcacacctgatctcatattag

SEQ ID NO: 28051 - DNA, 1233 bp, Artificial Sequence
  Description of Artificial Sequence: Synthetic coding sequence
atgaacgacgaagattactcaaccatctacgatactatacaaaacgaacgcacctacgaggttccagatcagcccgaggagaatgaatccccacactatgacgatgtccacgagtatctgagacccgagaatgatctatacgccacacaactgaacactcatgagtacgacttcgtgagcgtctacacaatcaaaggcgaagagacttctctcgcctcagtacaaagtgaggaccggggatatttgctgcctgatgaaatctactccgagctccaagaggcccaccctggagagccacaggaagatcgcggtatctccatggaaggcttatatagtagcacacaggatcaacagctgtgcgcagcggagcttcaggagaacggatcagtgatgaaagaggatttaccatcacctagttcttttaccattcagcacagcaaggcttttagcacaaccaagtactcctgttacagcgatgctgagggcctggaagagaaggaaggggctcacatgaatccagaaatctacctgttcgttaaggccggaatcgatggtgaatccatcggtaactgcccattcagccagagattgttcatgatcttgtggttaaagggggtggtgtttaatgtgacgactgtggacctgaaacgcaagccagcagaccttcacaacctggccccaggtacacatcctccctttcttaccttcaatggcgacgtcaaaaccgatgtgaacaagattgaagaattcctggaagagactctcactcctgaaaaatacccaaagctggccgctaagcacagagaatctaatacagcgggtattgacatattttctaagttttctgcttatatcaagaacaccaaacaacaaaacaatgccgcattagaacggggacttacaaaggctctgaagaaattagacgattatctaaacacaccgctgcctgaagagatcgacgccaacacatgcggggaagacaaggggtctcggcgtaagtttctcgatggagatgagctgaccttagcagactgtaatctgcttccgaagcttcacgtggttaagattgtagctaagaagtaccgcaactacgatattcctgccgagatgaccggtctgtggcgatatctgaagaatgcctacgcccgtgatgagttcaccaacacatgcgccgcagactccgaaatcgaactggcttatgctgatgtggcaaagcggctgagcaggagctag

SEQ ID NO: 28052 - DNA, 756 bp, Artificial Sequence
  Description of Artificial Sequence: Synthetic coding sequence
atgactgactccgctactgccaatggtgatgatagggatcccgaaatcgagctatttgtgaaagctggtattgacggtgagtccattggcaattgccctttttcacaacgccttttcatgatcctgtggctgaaaggcgtcgtgtttaatgtgaccacagtggatttaaaaaggaagccagctgatctgcacaacttagcacccggaacgcatcctcccttcctaaccttcaatggcgatgtgaagaccgacgtcaacaaaattgaggaattcttagaggagacactcacacctgaaaagtatccaaagcttgcagcaaagcatcgggagagcaatacagcagggattgacatcttctctaagttttccgcctatataaagaacacaaaacagcaaaacaatgccgctctggagaggggcctgacaaaagcactcaaaaagctggacgattacctgaatacccccttgccagaggagattgatgcaaacacctgtggcgaggataagggatcacgacgaaagtttttggacggagatgagctaaccttggccgactgtaatcttcttccaaaactacatgttgtcaaaatcgtggccaagaagtacagaaactatgacataccagccgaaatgaccggcctctggcgttacctcaaaaacgcttacgcacgcgatgaattcaccaatacgtgtgccgctgactctgagatagagctggcatacgccgatgttgccaaaaggctctcccgaagctag

SEQ ID NO: 28053 - DNA, 618 bp, Artificial Sequence
  Description of Artificial Sequence: Synthetic coding sequence
atgacggactcggctacagccaatggggacgaccgcgaccctgagatcgaactgtttgtaaaagcagggatagatggcgaatcaatcggcaactgtccattctcccaaagacttttcatgattctttggctcaaaggcgtcgtgttcaacgtgactaccgttgatctcaagagaaagcccgctgacttgcacaacctcgctcccggaacacatcctccgtttcttaccttcaacggagatgtgaaaaccgacgtcaacaagattgaagagttcctcgaagaaactctgacccctgagaagtacccaaaactggcggctaaacaccgtgagtcaaacaccgctggtatagacattttctcaaaattcagcgcctacattaaaaatactaagcaacaaaacaacgcagctttggagcgcggactgaccaaggcgctcaaaaagcttgatgattatctaaatacccccctccctgaggagatcgacgcaaatacatgtggcgaggacaaagggtcccgtagaaagtttctcgacggggacgagctgacactcgcggattgcaatcttctcccaaaactccacgttgtgaaagagcaggtgccactcaaaggaatgatttag

SEQ ID NO: 28054 - DNA, 5822 bp, Artificial Sequence
  Description of Artificial Sequence: Synthetic coding sequence
atggccagtgggttaggatcacctagcccatgttccgcaggatccgaggaggaagatatggatgctctgctgaataactccctgcctccaccacatccggaaaacgaagaggatcccgaagaagacctctccgagacagagacccccaagctaaagaagaagaaaaaacccaaaaagcctagggacccgaaaattccgaagtctaagcggcagaagaaagagcgaatgctcctctgcaggcagctcggggattcatctggcgaaggtccggaattcgtcgaggaagaggaggaggtggccctacgtagtgattctgagggctctgattacacacccggaaaaaaaaagaagaaaaagttaggccctaagaaggaaaagaagtccaaaagcaagcgtaaggaagaggaggaggaagaggatgatgatgacgattcaaaagaaccaaagtcttctgctcagctactggaagactgggggatggaagatatcgaccacgtcttctctgaggaagactatcggaccttaacgaactataaggctttttctcagtttgtgcgcccactcattgcagccaagaaccctaagattgccgtttcaaaaatgatgatggtccttggtgccaagtggcgggagtttagtactaacaacccatttaaagggtcttctggggctagcgttgccgctgccgcagccgcagcggtggccgttgttgaatctatggtcacggccacagaagttgcaccccctccccctcccgtggaagtgccaataaggaaggccaagacaaaagagggaaagggaccaaatgcccgaagaaagccaaaaggaagtcctagggtcccagatgccaagaagccaaaacccaagaaggtcgcccctctgaaaataaaactcggcggatttggttccaagagaaagagaagttcctctgaagacgacgacctggacgtggaatccgacttcgatgatgcatcaatcaactcatattcagtctctgacgggagcacatccagatcaagtaggtcacgcaagaaactgaggacaaccaagaaaaagaaaaagggggaggaagaagtgaccgcggttgatggctacgagactgaccatcaggactattgcgaagtctgtcaacaaggaggtgaaattatattgtgtgacacgtgccctagagcataccatatggtttgcttggatcctgacatggagaaggcgcctgaagggaaatggtcttgcccacattgtgagaaggagggcatccagtgggaggctaaagaagacaactccgagggggaagaaatactagaggaggtgggcggagatcttgaggaggaggacgaccatcatatggaattttgtcgcgtttgcaaggatggtggcgaattgctgtgttgtgacacatgcccttcgtcataccacattcactgtctcaacccccctttaccagagattccaaatggagagtggctgtgccctaggtgcacttgcccagctctgaagggtaaggtgcagaagatccttatctggaagtggggccagccccctagccccaccccagtgccacgcccacccgacgccgatcccaatacaccatcgccgaagccccttgaaggccgaccagagagacaattttttgtaaagtggcaaggtatgtcttactggcactgcagctgggtttctgagctccagctagagttgcactgtcaggtcatgtttcgaaattatcagcgtaaaaacgatatggacgagcccccatccggagactttggtggcgatgaggagaagagcagaaagcgcaagaataaagacccaaagtttgctgaaatggaggagagattctaccgctatgggattaaaccggagtggatgatgattcacaggattctgaaccacagcgtggacaagaaaggacacgtgcactatcttatcaaatggcgcgatctgccttacgaccaagccagctgggaaagcgaggacgtcgagatccaggattatgacctgttcaagcaatcatattggaatcatcgagagttaatgcgcggtgaagaagggcgaccaggaaagaaactgaaaaaggtgaaactgcggaagttagaacgccctccagaaactccaacggtggatccgacagtgaagtatgaaaggcagcccgaatacctggacgctacaggcggaacactgcacccataccagatggagggacttaattggttgcgtttctcatgggctcagggcacagacacgattctggccgacgaaatggggttggggaagaccgtgcagacagccgtgtttctgtatagtctctacaaagagggccacagcaaaggccctttcctggtaagcgccccactcagtacaatcatcaactgggaaagagaattcgagatgtgggctcccgacatgtacgttgtgacctacgtaggcgataaggacagtcgcgcaatcatcagggagaacgaattttccttcgaagataacgcaattcggggtggcaagaaggccagcagaatgaagaaggaagcctccgttaaatttcatgttctactaacttcttacgaactgatcacaattgacatggctatcctcggaagcatcgattgggcctgtctaattgtggatgaggcccataggctgaaaaacaaccagtccaagtttttcagagtgcttaacggatattcactgcagcacaaactccttctgacaggcacccctcttcaaaataatctggaggagctgtttcatcttcttaacttcctaacacccgagagatttcataacctggaaggctttctggaagaatttgcagatatcgccaaggaggaccaaatcaagaagttgcacgacatgttaggtccccatatgctgcgtcgactcaaagccgatgtctttaaaaacatgccatcgaagaccgagctgattgtgagggtggagttaagcccgatgcagaaaaagtattataagtacattctgacgagaaatttcgaagcactgaatgctaggggtggaggaaaccaagtgtctctgctgaatgttgttatggacctaaaaaagtgctgcaaccacccctacctgttccccgtagctgccatggaggcccctaaaatgcctaacggcatgtacgatggaagcgctctcatccgcgctagtggaaaactgttgctcctgcagaaaatgttgaagaacttgaaggaaggtggacatcgcgttctgattttctcccagatgacgaagatgctggatctgcttgaggactttctcgaacatgagggttacaaatacgaacgtatcgatggaggtattactggtaacatgaggcaggaggctatcgacagatttaatgcacctggggcacagcaattctgcttcctgcttagcacccgcgcagggggactgggtatcaacctcgctacggctgacacagtgattatctatgacagtgattggaatcctcacaacgacatccaggcattcagtcgggcacatcggataggccagaataagaaggtgatgatctatagattcgtgacacgagcttcggttgaagagcggatcactcaggtggctaagaagaagatgatgctgacccacttggtggtcaggccagggcttgggtccaaaacaggcagtatgtccaagcaggaactggacgacatcctaaagtttgggactgaggaactgttcaaagatgaagctactgacgggggtggcgacaacaaggagggcgaagattcatccgtgatccactacgatgataaagcaatagagcgcctcttagacagaaatcaggacgagaccgaagatacggagctacaggggatgaatgaatatttaagctcattcaaagttgctcagtatgtagtgcgtgaggaagaaatgggagaagaagaggaggttgagagggagattatcaaacaagaggaaagtgttgatccagactactgggagaaactcctgagacatcactatgagcaacagcaggaagatcttgcacgtaatttgggcaagggtaaacgcattcgcaagcaagtgaattataacgatggctcacaggaggatagaggcgtttgtggtcgaccaagaccacctcctatgggaagatccactcgcgcagtgggcccagctcacttgccctccctgccccctgattggcaagatgatcagagcgacaatcagagcgattattcagtagcctctgaggaaggtgacgaagatttcgacgaaagaagtgaagctccccgacgaccgagccgcaaagggctgcgcaacgataaggacaaaccactgcctcctctactggctagagtcggagggaacatagaggtccttggttttaatgccaggcagcggaaggcttttcttaatgccattatgcgttatggtatgccgccacaggatgcttttacaacccaatggttagttcgcgacctaagaggaaaaagtgaaaaagaatttaaggcctatgtctctctctttatgcggcacctttgtgaaccgggagcagacggcgctgagaccttcgcggacggagttccgcgtgaaggcctgagcaggcagcatgtgcttactaggattggcgttatgtccctgatccgcaaaaaagtccaggagtttgagcacgtcaacggcagatggtcgatgcccgagctggctgaagtggaggagaacaagaagatgtcccagcccggtagccccagtccaaaaacccctaccccctcgactcccggtgatactcagcctaacaccccagccccagtcccaccagcagaggacgggataaagatagaggagaactccctgaaagaggaagagtcaatcgagggtgagaaagaagtgaaaagtactgctcctgaaacagctatcgagtgtacacaagcacccgctccagcctccgaggacgagaaagtggtggtggaacctccggagggggaggaaaaagtggagaaagccgaggtcaaagagagaaccgaggaaccaatggagaccgaaccaaaaggggcagccgatgttgaaaaggtcgaagagaaatccgcaatcgatctgacacctattgttgtggaggacaaagaagagaaaaaggaggaggaagagaagaaggaagtcatgcttcagaacggagaaactccaaaagatcttaatgatgaaaaacaaaaaaagaacattaaacaacggttcatgtttaacatagccgacggaggcttcacagaacttcacagtctgtggcagaacgaggaacgagcagcaacagtgacaaagaaaacttacgagatctggcatagaaggcatgactactggctgctggcaggtattatcaatcacggctacgccagatggcaggatattcaaaacgaccctcggtacgctatcctcaatgagcctttcaagggagaaatgaaccggggtaacttcttagaaatcaaaaacaagttcctcgcgaggcggtttaagcttctcgaacaggccctggtgatcgaggaacaactgcggagagccgcttatctgaatatgtctgaagatccgagccacccctcaatggctctcaacactcgctttgcagaagtcgagtgcttggcagaatctcaccagcatttgagtaaagaatctatggccggaaacaaaccagccaatgctgtcttgcataaggtgttgaagcaattggaagaactattatccgacatgaaggcagacgtgacacgcttgcctgcaaccatcgctaggatccccccagtcgccgtgcgactccaaatgtccgaaaggaatatcttgtcccgactggctaatcgagcccctgagcctacgccgcagcaggtcgcgcagcagcaata

SEQ ID NO: 28055 - DNA, 5738 bp, Artificial Sequence
  Description of Artificial Sequence: Synthetic coding sequence
atggcatcgggactgggtagtcccagcccctgcagcgccggatcagaagaggaggatatggatgccttgcttaataactctctccctcctcctcaccccgaaaatgaggaggatccagaagaggacctttccgaaacggagaccccaaagttaaaaaaaaagaagaagccaaaaaagccccgagacccaaagatcccgaaaagtaaacgacagaagaaagaacgaatgctgctgtgtcggcagttgggtgatagctcaggagagggacctgaattcgtcgaggaagaagaagaggttgccctccgctccgactcggagggctctgactatacacctggcaaaaagaaaaagaaaaagctggggcctaagaaagagaaaaaaagcaagtcaaagcgcaaggaggaagaagaagaggaggatgacgacgatgacagcaaagagcccaaatcctccgcgcagctgctcgaggattggggcatggaggacatcgatcatgtgttttccgaagaggattatcgcacgctaaccaattataaagcattctcacagttcgtccgcccactcattgctgccaaaaatcctaaaatcgctgtgtcaaagatgatgatggtcctgggcgcaaagtggagagagtttagcaccaacaatcctttcaaggggtcaagcggcgcttctgtggctgccgctgcagccgcagccgtcgcagtagtcgaatcaatggtgacagctaccgaagtggctccgccaccccctcccgttgaagttccgattaggaaagctaaaaccaaagaaggcaaaggccctaatgctagacggaagcccaaaggtagccccagagtacctgatgcaaagaagcctaagccaaaaaaggtcgcccctttgaaaattaagctggggggattcggctccaaacggaagcggtctagcagtgaagacgatgatctggacgtggagagcgacttcgatgatgcttcgataaactcctactccgtgtccgacggctcaacttcaagatccagccgcagccgtaagaagttgagaaccacaaaaaaaaagaaaaaaggcgaggaagaagtgacagctgtagacggatatgaaacagaccatcaagattattgtgaagtctgtcagcaggggggagagattatcctgtgcgatacatgccctcgggcttaccatatggtgtgcttggatcccgacatggagaaagcccctgaaggtaagtggtcttgcccacattgcgaaaaggaagggattcagtgggaagcaaaggaggacaattccgagggggaagagatcctggaagaggtaggcggagacctcgaagaggaagacgaccaccacatggagttctgccgcgtatgcaaagacggtggagaacttctttgctgcgacacatgcccttcatcctaccacattcactgcctcaacccgccacttcctgaaattcctaacggtgaatggttgtgtcctcggtgtacatgtccagcacttaaagggaaagtgcagaagatcctgatctggaaatggggccagcctccctctcccacacctgtcccaagacccccagatgccgaccctaatactcctagccccaagcccctcgagggcagacccgaaagacagttcttcgtgaagtggcaggggatgagctactggcattgttcctgggtgtcagagctccaactggagctgcactgccaggtgatgttcagaaattaccagaggaagaatgatatggatgaaccgccttccggggacttcggaggcgatgaggaaaaatctaggaagcgaaaaaataaagatccaaaatttgccgaaatggaagaacggttttatagatatgggatcaagcctgaatggatgatgatccaccggatcttgaaccactcggtggacaagaagggccatgtgcactaccttatcaaatggagggacctgccatatgatcaagcatcgtgggagtcggaggatgttgaaattcaggactacgatctattcaagcagtcatattggaatcatcgcgaactcatgaggggcgaggagggtcgtccgggaaaaaaactcaaaaaggtcaaacttcgtaaattggaacgcccaccagagacccccaccgtcgatccaacagtgaaatatgagaggcagcccgagtacctagacgctaccggcggaaccctccatccctatcagatggagggactaaactggctacgcttctcctgggcccaggggaccgatactatcttggcagacgagatgggactcgggaaaacggtgcagacagccgtctttctttatagtctgtataaagaaggccactcaaaaggaccgtttctggtaagcgctcctcttagtactataatcaattgggaaagagagttcgaaatgtgggccccagatatgtatgtggttacctatgtcggcgataaagactcgcgtgccatcatccgagagaatgaattctcatttgaggacaacgcaattagagggggtaagaaagcctcaaggatgaaaaaggaggcctctgtcaaatttcacgtcctcctgacaagctacgagttgatcactatcgacatggctattctcgggtccattgactgggcctgtctgatagtcgatgaggcccaccggctcaagaataaccagagtaagtttttcagagtgctgaacgggtattccctgcaacacaaactgctgttgactggaacgcccctgcagaataacttagaagagctcttccacctcttgaatttcctgaccccagaacggttccataacttggaggggttcctcgaagaatttgcagacattgctaaagaagaccagataaaaaagctccatgacatgttggggccacatatgctgcgcaggctgaaagccgacgttttcaaaaatatgccctctaaaacagaactgattgtgagagtcgagcttagccctatgcaaaagaagtactataagtacatactgacaaggaatttcgaggccctgaatgctcgtgggggaggtaaccaagtgtcactactgaacgttgttatggacctcaagaaatgctgcaatcacccatatttgttccccgtggcagccatggaagctccaaaaatgcctaacgggatgtacgacgggtcagctttgatccgtgcttctggcaagcttttgttgttacagaagatgcttaagaacttgaaggaaggagggcatagagtcctgattttctcgcagatgacaaaaatgctggatctcctggaggactttttggaacacgaaggttacaagtatgaaaggatcgatgggggaatcacaggaaatatgcggcaggaagccattgacagatttaacgctccaggtgcccagcagttctgttttctcctgagtactcgcgcaggtggcctaggcattaatctggccactgcagacaccgttatcatttacgactctgactggaatccccacaacgacattcaggccttctccagagcacatcgcatcggccagaataagaaggtgatgatttacagattcgtaacacgggcttctgtggaagagcggataacccaagtggctaagaagaaaatgatgctgacccacttagtggtgcgtccaggcctgggctcaaagacaggttccatgtctaaacaggagctcgacgatattcttaaattcggaacagaagagttgttcaaggacgaggcaactgatggagggggtgacaataaagaaggagaagattcttccgtcatacattacgacgacaaggccatagagaggctgttggatagaaatcaggatgagactgaggacacagagctgcaggggatgaacgagtacctgtcttcttttaaagtggcacagtacgttgtgcgcgaggaagagatgggtgaggaggaagaggttgagagggaaatcataaaacaggaagagtctgtggaccccgattactgggagaaactgttaaggcatcactatgagcagcagcaggaagatcttgctcgaaacttgggcaagggcaagcgcatacggaagcaggtaaactacaacgatgggtcgcaggaagatagggattggcaggacgatcagagcgacaaccagtcggactatagtgtggcttccgaggagggtgatgaagacttcgacgagagatccgaggccccacgacgcccatcacggaagggactgaggaatgataaggataaaccactgcctcctctgctggcaagagtgggaggaaatattgaggttctggggttcaacgccaggcagcggaaggcttttcttaacgctattatgaggtacggcatgcctcctcaggatgcatttacaactcagtggctagtcagagatcttcggggaaagagtgaaaaagaattcaaggcctacgtgagcttgtttatgaggcatctttgtgagcctggggcagacggggctgagacgtttgccgacggagtccctcgcgagggacttagccgacaacacgttctgactaggattggcgttatgtcccttatcagaaagaaggtgcaggagttcgagcacgttaatggacgctggtccatgccagaactggctgaggtagaagagaacaaaaaaatgtcccagcctggctctccgtccccgaaaacccccacacctagcaccccgggtgacacgcagcccaataccccagcccctgtgccccctgccgaggatggaattaagatcgaggagaacagcctgaaagaagaagagtcaattgagggggaaaaggaggttaagtccactgcgcctgagaccgctatcgaatgtacccaagcacccgctccagcttctgaggacgaaaaagtagtcgtggagcccccagagggggaggaaaaggtcgaaaaggccgaagtgaaagagcggacagaggagcctatggagaccgagcctaagggagccgctgatgtggagaaagtggaggagaagagtgctatagatttgacccctattgtggttgaggacaaggaggagaagaaggaagaagaagagaagaaggaggtaatgctgcagaatggcgaaaccccaaaggatcttaacgacgaaaaacagaaaaagaacattaaacaacgttttatgttcaacattgctgacggcggatttacagaactacatagcttatggcagaacgaagaaagagctgcgactgtgactaagaagacttacgaaatctggcaccgtaggcatgactattggttgctcgccggaattattaatcacggctacgcaagatggcaggacatccagaacgatcctcgctacgctattttgaatgagcccttcaagggcgaaatgaacagagggaatttcttggagattaaaaacaaattcctggcaaggcggtttaagctgctggaacaggccctggtgatcgaagagcagctacggcgtgcagcctaccttaatatgagcgaagacccttcacaccctagcatggctctaaatacgcggtttgcggaggtggagtgcctggccgagtcccatcagcaccttagcaaggagagtatggcagggaataagcccgcaaatgctgttctgcacaaagtcctgaaacagctcgaagaacttctgtcagatatgaaagcagacgtaacgcgtctaccagcaacaatagccagaatccctccagtggctgtgcggcttcagatgagcgagcgcaatatcctgagcagactcgccaatagggctcccgagccaacgcctcaacaggtagctcagcagcaata

SEQ ID NO: 28056 - DNA, 5660 bp, Artificial Sequence
  Description of Artificial Sequence: Synthetic coding sequence
atggacgcacttctgaacaatagtctaccacccccacatcctgagaatgaggaggaccccgaggaagacctcagcgaaaccgagacaccaaagctgaaaaaaaaaaagaagcctaaaaaacccagagacccaaagattccaaaatctaagcggcagaagaaagagctcggcgactcttcaggggaggggcctgagtttgtggaagaagaggaggaagtagctctacgaagtgattcggaggggtctgactatacgcccggtaagaagaagaagaagaagctggggccaaagaaggaaaaaaagagcaagtccaaacggaaagaggaagaagaggaggaggacgatgatgacgattcaaaggaacctaagtcctctgcacagctactggaggactggggcatggaggatatagaccatgttttctcagaggaggattaccgtacactgaccaattacaaggcattctctcagtttgtccggccacttatagcagccaaaaacccgaaaattgctgtgagcaagatgatgatggtcctgggggcaaagtggagggagtttagcaccaacaatcccttcaaagggtctagcggagcgagcgtagccgcagcagccgctgccgctgtcgccgtggtggagtccatggtgaccgctactgaggttgctccaccacccccacccgtggaggtccccatcaggaaagccaaaacaaaggaaggaaagggccctaatgctagacggaagccaaaggggtcccccagggtgcctgatgccaaaaaaccaaaacctaaaaaagtcgcccctcttaaaattaagctcggcggattcggatctaagaggaagagaagcagctccgaggacgacgacctggatgtcgagagtgattttgacgatgcctccatcaacagctattccgtgtctgatggcagcacgagtcgttcaagtaggtctaggaagaagctgcgaaccaccaaaaagaaaaagaagggtgaggaagaagtcaccgcagttgatgggtacgagaccgaccaccaggattactgtgaggtttgtcagcagggaggtgagatcattctctgcgatacctgtcctcgagcttaccatatggtgtgtctcgatcccgatatggagaaagcacccgagggaaagtggtcctgtcctcattgcgagaaggaaggaatccagtgggaagcaaaagaagataactccgagggtgaggagattctggaagaggtggggggtgacctggaggaggaggacgatcatcacatggagttctgcagggtttgtaaggacgggggagagctgttgtgctgtgacacctgcccttcttcctaccacatccattgcctgaatcctcctttgccagaaattccaaatggagaatggttgtgcccgaggtgtacatgcccagcgttgaagggtaaggttcaaaagatcctcatttggaaatggggacaaccaccctctcccacccccgtacccaggccgcctgatgcagacccaaacactccaagtccgaagcctctcgagggacgtcccgagcggcagttttttgtgaaatggcaggggatgtcttactggcactgttcttgggtctcagaacttcagctcgagctgcattgtcaggtcatgtttcgtaactatcaacgtaagaacgatatggacgagccaccctccggcgattttggcggagatgaagagaagtccagaaaacggaaaaataaggatccgaaatttgcagaaatggaggagcgtttttatcgctatgggatcaaacctgaatggatgatgattcacagaatcctgaaccattccgtggacaagaagggccatgtgcactatctcattaagtggagagatttgccatatgaccaggcctcttgggagtccgaagatgtggagatacaagattacgatctatttaaacagtcctactggaatcaccgggagctcatgaggggggaggaggggagaccaggaaagaagctgaagaaagtcaagttgagaaaattagagcgtccacccgagactccaacagttgaccctaccgtgaagtacgagcgccagcccgagtatcttgacgccaccggagggaccctccacccttaccagatggaaggactaaattggctgcggtttagttgggcacagggtactgatacgattctagcagatgaaatgggcttgggcaagactgtgcagactgctgttttcttatacagtctctacaaggagggtcactcaaaagggcctttccttgtgtcggccccactttcgaccatcataaattgggagagggagttcgaaatgtgggcccctgacatgtatgtggtgacttacgtgggcgataaagacagtagagctataattcgagagaatgagttttcctttgaagataatgctatcaggggaggaaagaaggcctctcgaatgaagaaagaggcaagtgtgaaatttcatgttttgctgaccagctacgagcttattacaatcgatatggctattttgggcagcattgattgggcttgtctgattgtggatgaggctcatcgtttgaagaacaaccagagcaaattttttcgggtgcttaatgggtatagccttcagcataaactgttacttaccgggacaccgctgcagaacaacttggaggagctgtttcatctgctgaactttctgacaccagagagattccataacttagaaggattcctggaagaattcgcagatattgccaaggaggatcagataaaaaaactccatgatatgctaggcccacacatgctgagaagactcaaggctgacgtgtttaagaacatgccatctaaaaccgagctgatcgtaagggttgaactgtcccccatgcaaaaaaaatactacaagtatattttgactagaaacttcgaggctctcaacgcacgcggaggtggaaaccaagtgagcttgctgaacgtggtgatggacctgaaaaaatgctgtaaccacccctatctgtttcccgtggccgcaatggaggccccaaagatgcctaacgggatgtacgacggctctgcgctcattcgcgcttcaggtaaacttctcctgttgcaaaagatgctcaaaaatctgaaggaaggaggccacagggtgctcatttttagccagatgactaagatgctggacctgctagaggattttttggaacacgaagggtataagtacgagcggatcgatggcggaattacagggaatatgagacaggaggcaatcgatcgctttaatgcgccaggcgctcagcagttttgtttccttctgtccactcgggcagggggactcggaattaacctcgccacagccgatacggtgatcatttatgacagcgactggaacccccataatgacatccaggctttctcccgggcacatcgtatcggacagaacaagaaggtgatgatctaccggttcgtgacgcgcgcatctgtggaagaacgaattacacaggttgctaaaaaaaaaatgatgctgactcatttagttgtgaggccaggtctaggaagtaagactggctccatgtcaaaacaggagttggatgacatactgaagttcggcacagaagaactgtttaaggatgaggctactgatgggggaggagacaacaaagagggcgaagatagttctgttatccattacgacgacaaagcaattgaaagactgctggacagaaaccaggatgagacggaggacaccgaactccagggaatgaacgaatatttgtcgagtttcaaagtagctcaatacgtggtgagggaggaggaaatgggggaggaagaggaggtcgagagggagataattaagcaggaggagagtgtggatcctgactattgggagaaactccttagacaccactacgaacagcaacaggaagatcttgcaaggaatctaggaaagggcaaaagaatccgcaagcaggtcaactacaatgacggctcccaggaagaccgcgactggcaggacgaccagtccgataaccagtcggattatagtgtagcttcagaggaaggggatgaggattttgacgagagaagcgaagcccctcggagaccttctaggaagggcctgcgtaatgataaggacaaacccctcccacctttgctagcacgggtcgggggtaacatcgaggtgctgggcttcaatgctcgacaaaggaaagccttcctgaatgccatcatgcggtacggaatgccacctcaggacgcattcacaacgcagtggcttgtcagggacctgcgaggtaaatcagaaaaggaattcaaagcctatgtgtcacttttcatgcggcatctgtgcgagcctggcgcagacggcgcagagacttttgctgatggtgttcccagggagggtctcagccgtcaacatgtcctgactcggatcggcgtgatgtcactcattagaaaaaaagtacaggagtttgagcatgtgaacggccgatggagcatgcccgaactggccgaggttgaagagaacaaaaaaatgtcccagcccggatctccttctccaaaaactcctacccctagcacacctggagatacccagccgaacaccccagcgccagtgcctccagcggaagacggaatcaagatcgaggagaatagtcttaaagaggaagagtctatcgaaggagagaaggaagtcaaaagtacagctcccgagaccgccatcgagtgcactcaggctcctgcccctgcgtccgaagacgagaaagtggtagtcgaaccaccagaaggagaagaaaaagttgaaaaggccgaagtcaaagaacggactgaggaacccatggagacggaacccaagggagcagcagatgtggaaaaggtggaagagaaatcggccattgatctgactccgattgtggtcgaggataaggaggagaagaaggaggaagaagagaagaaggaagtgatgctccagaatggggagacacccaaggatctgaacgacgaaaagcagaagaagaatatcaagcagcgctttatgtttaatattgctgatggtggctttaccgaactgcattccctgtggcagaacgaagaacgtgcggcaactgtcacaaaaaaaacctacgagatatggcatagaaggcatgactattggctgctagctggcatcatcaaccacggctatgcaagatggcaagacatacagaacgatcccagatacgccatcctgaacgaacctttcaaaggcgaaatgaataggggcaatttccttgaaattaaaaataaatttctcgcaagacgcttcaagcttctggaacaggcactggtcattgaagagcagctcaggcgcgctgcctacctcaacatgtctgaagacccctcccatccatccatggccctgaacacacggtttgcggaggtcgagtgtctcgcagaaagccaccagcacctgagcaaggagtctatggcagggaacaaaccagccaacgctgtgctgcataaagttcttaagcagttggaggaactgctgtcagatatgaaggctgacgtaacgagactcccagcaacaatcgcgaggatccctcccgttgccgtgagattgcagatgtcagaacgaaatatactgagccgcttggccaaccgcgcaccagaacccacaccccaacaagtggcgcaacagcaata

SEQ ID NO: 28057 - DNA, 5717 bp, Artificial Sequence
  Description of Artificial Sequence: Synthetic coding sequence
atggcgagtggcctggggagcccatccccctgcagtgccggtagcgaggaggaagatatggacgccctcctcaataattccctcccaccgccacaccctgagaacgaggaagaccccgaggaagatcttagtgagaccgaaacgcctaagctgaaaaaaaagaagaaacccaaaaagccaagagaccctaaaataccaaagtccaagaggcagaagaaggagttgggcgactcctcaggtgagggtcctgagttcgtagaggaagaagaggaggtggccctgaggtcagattctgaggggtccgactatacccccggaaaaaagaagaagaaaaagctcggccctaaaaaggaaaagaaatctaagtccaaacgtaaggaagaggaggaagaggaagatgacgacgatgatagcaaagagcccaaatccagcgcccagctgctggaggattgggggatggaagatatcgaccatgttttttcagaggaagattataggacactgactaattacaaggccttttcccagttcgtgagacctcttatcgccgctaaaaacccaaagatcgccgtgagtaagatgatgatggtgctgggggcaaagtggagggagttttctacaaacaacccattcaagggaagctctggggcttcagtagctgcagccgctgccgctgcagtggctgtggtcgagagcatggtgacggccacagaggtagccccaccccctcctcccgttgaagtgcctattcgcaaggccaaaacaaaggaaggaaagggaccaaacgccagacgcaagcctaaagggtccccaagggtgcccgacgcaaagaagccaaaacccaaaaaggtggccccattgaaaatcaagttaggaggatttggctccaagaggaagcggagttcctctgaggacgacgacctcgacgtcgagtccgactttgatgatgcctctattaatagctacagtgtttccgatgggtctacatccagaagctccaggtcacgtaagaagctgaggaccaccaagaagaagaagaagggggaggaggaggtgacagcagtggacggctacgaaacagatcaccaagactactgtgaagtgtgtcagcaagggggagaaataatcctttgcgacacttgtccacgcgcttatcacatggtctgtctcgaccccgacatggaaaaggctcctgagggaaaatggtcatgccctcattgcgagaaggagggcatacaatgggaggcaaaagaagacaattcagagggcgaggagattctggaagaggttgggggtgatttagaagaggaagacgaccatcatatggagttctgtagggtgtgcaaggatggaggggaactgctgtgctgcgacacctgcccctcatcataccatatccattgcctcaatcccccactccctgagatcccgaacggcgaatggctgtgcccgcgttgtacctgtccagcacttaagggtaaggtgcagaaaattttgatatggaagtgggggcagcctccgtccccaacacccgtgcctagacccccagatgccgacccaaataccccttctcctaagccacttgagggcaggcccgagcgccaattctttgtaaagtggcagggtatgtcttactggcattgctcgtgggtgtctgaactccagctcgagctccactgtcaggtaatgttccggaactaccagagaaagaatgatatggatgagcctccatctggcgacttcgggggtgatgaggaaaagagccgaaagaggaaaaataaggaccctaagtttgcggagatggaggagcgcttttatcggtatggtattaaacctgagtggatgatgatccacagaatccttaaccatagcgtcgataaaaaaggccacgttcattacctgattaagtggagagatttgccttacgatcaggcctcctgggaatctgaagatgtcgagatccaggattatgacctttttaaacagtcctattggaatcatagagaactgatgcgaggcgaagagggcaggcccggtaagaaactgaagaaggttaagctccgcaaattggaacgtccccctgagacaccgactgttgatccgacagtgaaatatgaaaggcagccagagtatttggatgccacaggcggaacactccatccttaccaaatggagggactgaactggctgagattttcgtgggcacaggggactgacaccatcttggcggacgagatgggactgggcaagactgttcaaaccgccgtcttcttatactccttgtacaaagagggtcatagtaagggacccttccttgtgtctgcccctctcagtaccattattaattgggaacgcgagttcgaaatgtgggccccagacatgtacgtggtcacttatgtgggcgataaggatagccgcgctattatccgcgaaaacgaatttagttttgaggataacgccattcggggaggaaaaaaggccagtaggatgaaaaaagaggcaagtgtgaagtttcacgtgctccttacatcatacgagttgattacaattgatatggctatcctcggtagcattgactgggcttgtctcatcgtcgacgaagcgcatcgcttaaaaaacaatcagtctaaattcttccgagtgctcaatggatacagtcttcaacacaaactcctgctcacaggaacgccactccagaacaacttggaggagctcttccatcttctgaatttcttgacacccgaaagattccataatctggaggggtttttagaggagttcgcagatatagcgaaggaggatcaaataaagaaactgcatgacatgctcggtcctcacatgttacggaggctcaaggctgacgttttcaagaacatgcctagtaaaaccgaacttatcgtgagagttgaacttagccctatgcagaagaagtattacaaatacattttgacacgcaacttcgaggcccttaatgcccgaggaggtggcaatcaggtttcgctgctgaatgtcgtgatggaccttaaaaagtgctgcaaccatccttatttgtttcccgtagccgctatggaagccccaaaaatgcctaatggcatgtatgacggatccgcgctgattcgcgcttccggtaagctactgctcctgcagaagatgctgaaaaacctcaaagagggcggtcaccgagtcctgatttttagtcagatgacaaaaatgctggacctgctcgaggatttccttgagcacgaaggttacaaatacgaaagaattgacgggggaataacaggtaacatgcggcaagaggccatcgaccgctttaacgctcccggtgcacagcagttttgttttctgctgtctacccgagctggagggttgggcattaacctagcgaccgccgacactgttatcatttacgactcggactggaacccacataatgacattcaggcattttccagagcccaccgcatcgggcaaaataagaaggtgatgatttatcgttttgttacacgcgcttctgtcgaggaaagaattacacaggtcgccaagaaaaagatgatgttaacccatctagtggtgcgtccaggccttggctccaaaactgggtcaatgtctaagcaggaactcgatgatatactgaaatttggtactgaagagctcttcaaagacgaagccaccgacggcggaggcgacaataaggaaggagaagactcttccgttatccactacgatgataaagcaattgagagactgctcgatagaaaccaggatgagacagaagatacagagctccagggcatgaatgagtatctgtcctcctttaaggtggcgcagtatgtagtgcgcgaggaggagatgggcgaggaagaagaggtggaacgggagatcatcaaacaggaagagtccgtggatcccgactattgggaaaaactccttcgacatcactacgagcagcagcaggaggatctcgccagaaatttgggtaagggaaaacgcatcaggaaacaggtgaactacaatgatggtagccaagaggatcgcgactggcaggatgaccagagtgacaatcagtcagattatagtgtcgcctctgaggaaggcgacgaggatttcgatgaaagaagcgaagcccctagaaggccgtcgaggaagggcctgaggaatgataaggacaaaccgctgccaccgcttctggcgcgtgtgggaggcaacatcgaggtgttagggtttaatgctagacagaggaaggccttcctgaacgctataatgaggtacggaatgccccctcaggacgcgttcaccactcagtggttggtaagggacttgcgcggaaaatcggagaaggagtttaaggcctatgtctcgttattcatgagacatttgtgtgagccgggtgccgatggtgccgagacgttcgccgacggtgtgccaagggaggggttgagccgtcagcacgtcctcacacggattggcgtcatgtccctgatacgcaaaaaggtacaggagttcgagcacgtcaacggcagatggtcaatgcctgagttagctgaggttgaagaaaataagaagatgtctcagccgggatccccgagccccaagacgcccactccgtcaacccctggcgatacacagcccaatactcccgctccagtcccgccagccgaggacggaattaagatcgaggaaaacagcctgaaggaggaggagtcgatcgaaggggagaaggaggtaaaaagcaccgcgcctgagactgctatcgaatgtactcaggccccagcgccagcctctgaggacgagaaagtggtggtggagcctcccgagggcgaggaaaaagtggagaaagcagaagttaaggagaggacagaggagccgatggagaccgaaccaaaaggagctgcagatgtggaaaaagttgaggagaagagtgccatcgacttgacaccaattgtggtcgaggataaggaggagaaaaaagaagaagaagagaagaaggaagtcatgctgcagaacggcgagacccctaaggatttgaatgatgagaagcagaaaaaaaatatcaaacagagatttatgtttaacattgccgacggtggtttcactgagcttcactctctgtggcagaacgaagagcgagccgcaacagtgacaaagaaaacctatgagatttggcatcggagacatgactactggcttcttgcaggaattatcaaccacggctatgcgagatggcaggacatccaaaacgatcccaggtatgctatcttgaatgagccattcaaaggggagatgaatcggggtaattttcttgagattaagaataagtttctggcaagaagatttaaattactggaacaagcactggttattgaggagcagcttcggagggccgcttatttaaatatgtcggaggacccatcccatcccagcatggcccttaacactcggttcgctgaagtggaatgcctcgcagagagccaccagcatttgtctaaggagtctatggcagggaacaagcctgccaacgcagtgctgcacaaagtcttgaaacagctggaagagttactgtccgacatgaaagcggatgtgacaagactcccagcaacgatagctcgaattccccctgtcgcagttcggttgcagatgtccgaaagaaatatccttagcagactggcaaacagagccccagaacctacgccacaacaggtcgcgcaacagcagta

SEQ ID NO: 28058 - DNA, 5813 bp, Artificial Sequence
  Description of Artificial Sequence: Synthetic coding sequence
atggcgtcgggactgggaagcccttcaccctgctccgctggatccgaggaagaagatatggacgctctgctcaacaatagcctgccccctcctcatcctgaggaccccgaagaagatctttccgagaccgagacgccgaaactcaagaagaaaaaaaagcccaagaagcccagggatccaaaaattccgaaatctaagcgccagaaaaaagaacgcatgctgctctgccggcagcttggggactcatctggggaaggacccgagttcgttgaggaagaggaagaagtggctctcagatctgactccgagggctctgattatactcccggtaagaagaagaagaagaagctgggccctaagaaagaaaaaaaatcaaaaagcaaacgaaaagaggaggaagaagaagaggacgacgacgatgattcaaaggagccaaaaagtagtgcacagctgttagaagactggggaatggaagacatcgaccacgttttctccgaggaggactacaggactctgacaaattataaggctttctctcaatttgtcaggcccttgatcgcagctaagaacccaaagattgctgtgagcaagatgatgatggttttaggcgctaagtggcgcgaattctcaaccaataacccttttaaggggtcatccggggcatccgtggctgctgcagctgctgctgctgtggcggtggtggagtccatggtcaccgcaacagaggtagcccctccccctcctccggtggaggtcccgatccgaaaagcaaagactaaagagggtaaaggcccaaacgctcggagaaagcccaagggatctcctcgcgtacccgacgcgaaaaagcctaaacccaagaaagtcgccccattaaaaatcaagctcggcggattcgggtctaagaggaagcgctccagcagtgaagatgatgatttagacgtagagagcgactttgacgatgccagcatcaactcgtactctgtgtccgacggcagcacctcgaggtcatctcgctctcgtaagaagttgcgcacaacgaagaaaaagaaaaagggggaagaagaggtcaccgctgtggatgggtacgagacggaccaccaggattattgcgaggtgtgccaacagggtggtgagattatcctgtgcgacacctgtccccgtgcctaccacatggtgtgtctcgatcctgacatggaaaaagccccagagggcaaatggtcatgtccacactgtgagaaggagggaatccaatgggaagcaaaggaagacaacagcgagggcgaagagatcctggaggaggttggtggggatctggaggaggaagacgatcaccatatggaattctgcagggtgtgtaaagatggaggagagctcctttgttgtgacacctgtcctagctcttaccatatacactgtctgaaccccccactacccgaaatacctaatggcgagtggctgtgcccgaggtgtacttgtcccgcactgaaaggaaaagtccagaaaatcctgatctggaaatggggccagcctccctctccaaccccagtacctcgccctcctgacgctgacccaaatacccctagccctaagcccctcgagggcaggcctgaaagacagttctttgtgaagtggcagggtatgagttattggcattgcagctgggtcagcgagttgcagctggagctgcattgtcaagttatgtttagaaactaccagcgcaaaaatgacatggatgagcctccgtccggagatttcggcggagatgaggagaaatcgcgcaaacggaagaacaaagaccctaaattcgccgaaatggaagaacgcttctaccggtatggtatcaagccagagtggatgatgatacaccggatcctgaaccactcagttgataaaaaaggccatgtacactacctgattaaatggagagatctgccctacgatcaggcctcatgggagtctgaggatgttgagattcaggattacgatctattcaagcagtcttattggaaccacagggaactcatgagaggcgaggagggacggcctggaaaaaaacttaagaaagtcaagctgcggaaattagagcggccacctgagacccccaccgttgatcccacagtgaaatacgaaagacagcccgaatatctcgacgctacagggggtactctccacccatatcagatggagggactgaactggctgcggttctcctgggcccaggggacagacactatactggccgatgaaatgggcttagggaagaccgtacaaaccgctgtgttcctctattctctgtacaaggaaggtcactcgaaagggcctttcctggtcagtgcccctctttccactattataaactgggaacgcgagtttgaaatgtgggcacccgacatgtacgtagtcacatacgttggagacaaagactcccgagcaattatccgggagaatgagttttcttttgaggataatgcaattagaggagggaagaaggcaagtaggatgaaaaaggaagcctcagtgaagttccacgtattgttgaccagctatgaattgatcaccatagacatggcgattctgggctcaatcgactgggcctgtctgatcgtcgacgaggcacacaggctgaagaacaatcagagtaaatttttccgggtgctcaacgggtacagtctgcaacataaactgttattgaccggcaccccgttacagaataatctggaagagctcttccaccttctgaattttcttacccccgaacgctttcacaatcttgaaggattcttagaagaatttgctgacatcgccaaagaagatcagatcaagaagttacacgatatgctaggacctcatatgctacggaggttaaaggcagacgtgttcaagaacatgccgagtaagactgaactgatcgtgcgggtcgagttgagccctatgcagaagaagtattacaagtatatactgactcggaacttcgaagcacttaacgccaggggcggtggaaatcaagtgtctctgctgaatgtggttatggatttaaagaagtgctgtaaccacccctatctgttcccagttgcggcaatggaggcccctaaaatgcctaacggaatgtatgatggaagcgcactgattcgagcctcagggaaactgttactcctgcagaagatgttaaaaaatcttaaagaggggggacatcgggtgctgatcttcagccagatgaccaagatgcttgacctactggaggattttctggagcacgaaggctacaagtacgagaggattgacggtggtatcacaggaaatatgcgccaggaggccatcgatcgattcaacgccccaggggctcagcagttctgctttctgctttccacacgcgcagggggacttgggatcaacctggctactgctgacaccgttattatttatgacagcgactggaatccacataatgacattcaggccttcagtcgggcacatcgaattggacagaataagaaagtgatgatttacaggttcgtcacccgagctagcgtggaagagaggataacacaagtggctaagaagaaaatgatgctgacccacctggtggtcaggcccggtttgggtagcaagactggcagtatgagcaaacaggaactggatgacattttgaagtttggcactgaagaactgttcaaggatgaagctactgatgggggaggcgacaataaagaaggcgaggacagctctgtcatccactatgacgacaaagccattgaacgtttgctggatcggaaccaggacgagactgaggatactgaattacaggggatgaacgagtatctgagctccttcaaagtcgcccaatacgtggtgcgagaggaggaaatgggtgaggaagaggaggttgagagggaaatcatcaagcaggaagagtccgttgacccagactactgggaaaagctgcttcggcatcactacgagcagcagcaggaggatttggctcggaatctgggaaagggcaagcgcatccgtaaacaggtaaattacaacgatggcagtcaggaagataggggcgtgtgcggcagaccgcgtccccctcctatggggaggtccacccgggctgttggtcctgcccatttgccctctctgccacccgactggcaggatgaccagtcagacaaccaaagtgattatagtgtagcgtccgaagagggcgacgaggattttgacgagcggagtgaagctcccaggcgacctagcaggaaaggcctgcgaaacgacaaggacaagccactgccacctctgctggcaagagtaggaggaaacatcgaagtgttgggatttaatgcacgtcaacgaaaagcttttctgaacgctattatgaggtacgggatgcccccacaggatgccttcactacgcagtggctggtgagagacctgcgcggaaagtccgagaaggagtttaaagcttatgtcagcctgtttatgcggcatctgtgcgagcccggtgcagacggggctgaaacttttgcagatggggtgccacgagaggggctttctaggcaacacgtgttgacaagaattggagtaatgtctctaatccgtaaaaaagtccaggagtttgagcatgtgaacggtcgttggtccatgccagaacttgcagaggtggaagagaacaaaaaaatgtcgcagcccggaagcccaagccccaaaaccccaacaccatctacgcccggagacacccagccaaacaccccggctcctgtgccaccagccgaggatggcattaaaatcgaagagaattcactcaaggaggaggaaagtatcgagggagaaaaggaagtaaaatccaccgcacccgagactgcaatcgagtgcactcaggctccagcgccagcttctgaagatgaaaaggtggtggttgaacctcccgaaggcgaagagaaggtggagaaagccgaggttaaagaaagaaccgaggaaccaatggaaaccgaacccaaaggcgcagctgatgtcgaaaaggttgaagagaagtccgccattgatctgactcctatagttgttgaggataaggaggagaaaaaagaggaagaggaaaagaaggaagtgatgctgcagaatggagaaacgcctaaagatctaaacgacgagaaacaaaagaagaatattaagcagaggtttatgttcaatattgcagatggcggatttacagaactgcactcactgtggcagaacgaggaacgggctgccaccgtcaccaaaaaaacatatgagatatggcatagacgccacgactactggttgctggctggtattatcaatcatggttacgctcgctggcaggatatacagaacgacccccgttacgccattctgaatgagccattcaaaggggagatgaaccgaggcaacttcctggagatcaaaaacaagttcctggccagacgctttaaactgctggagcaggcccttgtcatcgaggaacagttaagacgagcggcttatttgaacatgtcagaagacccgagtcacccttccatggctctgaataccagatttgcagaagtggagtgtctcgctgaatctcatcagcatctttccaaagagagcatggcaggtaacaagcccgctaacgccgtgttacacaaagtactgaaacagcttgaggaactgctctctgatatgaaggctgatgtcaccagactgccagccacaatcgctaggatccctcctgtggcagtgcgactgcagatgtccgagcggaacattctcagtcgcctggccaatcgggcacctgaaccgacaccacagcaggtcgcacagcaacaata

SEQ ID NO: 28059 - DNA, 1065 bp, Artificial Sequence
  Description of Artificial Sequence: Synthetic coding sequence
atggcctctgggttaggatctccaagtccatgcagcgcaggaagcgaagaggaggatatggatgctctgttaaataacagccttccgccaccccaccccgagaacgaggaagatcctgaggaggatctgtccgagaccgagactcccaagcttaagaaaaaaaagaagccaaaaaaacccagggatccgaaaattcctaagtctaagcgtcaaaagaaagaacgcatgttgttgtgtaggcaactgggagattcatccggggagggccctgagttcgtggaagaagaggaagaggtggcccttaggtctgactcagagggttctgactacaccccgggtaaaaaaaagaagaaaaaactggggccaaagaaagagaaaaagtcaaagtcgaagagaaaagaggaggaggaggaagaagacgatgacgatgacagcaaggagcccaaatctagcgcccagttactggaagactggggaatggaagacatcgaccacgtgttctcagaggaggactacaggacactaacaaactacaaggctttttcgcaatttgttaggccgctcattgccgcaaaaaaccccaagattgctgtttcaaagatgatgatggtactgggcgctaagtggcgcgagttcagtacgaataacccatttaagggatcaagcggcgcttcagtggccgctgccgctgcggctgccgtcgctgtggtggaaagcatggtaaccgctactgaagttgcacctcctccacccccagtggaggtacctatccgcaaggccaaaactaaagaaggaaaggggccaaatgctagacggaagccaaagggatcgccacgcgtgccggacgcgaagaaaccgaagcctaagaaggtagccccattaaaaattaaactgggaggctttggaagtaagaggaagcgttcttcaagcgaagacgatgacttggacgtcgagagcgacttcgacgatgccagcattaactcttattctgtgagcgatggaagcacgtcacgcagcagccgctctaggaaaaagcttcggaccacaaagaagaagaagaagtag

SEQ ID NO: 28060 - DNA, 1065 bp, Artificial Sequence
  Description of Artificial Sequence: Synthetic coding sequence
atggcttctggactgggatccccctctccttgctccgcaggcagcgaggaggaggacatggatgctctgttgaacaacagcttgccgcctccccaccccgaaaatgaagaagatccagaagaggacttgagcgaaaccgagacgccaaagctcaagaagaagaaaaaacccaagaagcctcgggacccgaagatccccaagtccaagaggcagaaaaaggagcgtatgctgctctgccggcagcttggggatagctcaggcgagggcccagagtttgtcgaagaagaagaggaggtggcgctcagaagtgactctgaggggtcggactataccccgggaaagaaaaaaaaaaaaaaactcgggccaaagaaggaaaagaaatctaagtctaaacggaaggaagaagaagaggaagaagatgatgatgatgactcaaaggaacccaagagctctgcccagctgcttgaagattgggggatggaagatatcgatcatgtattttccgaagaagattaccgtactctcacaaattataaagccttctcacagttcgttcggccactgatcgcggcaaaaaaccccaagatcgcagtctcaaagatgatgatggtgctgggcgctaaatggcgcgaattctccaccaacaatcctttcaagggatcatccggggcaagtgtggccgctgccgcagctgcagcagttgctgtagtcgagtcaatggttacagcaacagaagttgcgcctcccccaccccctgtcgaagtgccaatcaggaaagccaaaacgaaagaggggaagggcccaaacgcaaggagaaagcccaaagggagcccacgggtgccagacgccaaaaagcctaaaccaaaaaaagtcgcccctcttaagattaagttggggggtttcggctccaaacggaagaggtccagtagtgaggatgatgaccttgacgtggaaagcgatttcgatgacgcttcaataaattcttatagcgttagcgatgggagcacctcgaggtccagtcgcagcagaaagaaattgagaactacgaaaaaaaagaaaaaatag

SEQ ID NO: 28061 - DNA, 2562 bp, Artificial Sequence
  Description of Artificial Sequence: Synthetic coding sequence
atgtttctgccacacatgaatcacctgacattggagcagacttttttctcacaggttctccctaaaacagtcaaactcttcgacgacatgatgtacgagctgaccagccaggcgagaggattaagctcacagaacctggagatacaaaccactctgaggaacatcttgcaaacgatggtgcagctgctgggggcactgacaggatgcgtgcagcacatctgtgccactcaggaatctattatcctagaaaatatccagtccttgccttcttctgtgttacatatcataaagtccacttttgtgcactgcaagaattctgagtccgtgtattcaggctgtttacatctggtgtctgatcttttgcaagctctattcaaggaggcctattcactgcagaagcagcttatggagctgcttgacatggtgtgcatggaccctctggtggacgacaacgacgatatactgaacatggtgatcgtaatccattctttattggatatatgttctgtgatctctagcatggatcatgcattccacgccaatacgtggaaatttattatcaagcaatcattgaagcaccagagtatcatcaagtcccaacttaagcataaagatatcatcactagcctgtgcgaagacattctgttttccttccatagctgccttcagttggctgagcagatgactcagagcgatgcacaggacaacgccgattaccggctgttccagaaaactctgaaactgtgtcgcttctttgcgaactcactgctgcactatgctaaagagtttcttccttttctgagcgattcttgctgtaccctccatcagttgtacttgcagattcatagtaagtttcccccatccctgtatgcaacgcgtatttcaaaggcccatcaagaggaaattgctggagcatttctggtgacattagatccactcatttctcagctgttaacctttcagccatttatgcaggtggtgctcgattcgaaattagacctcccatgcgagcttcaattcccacagtgtctactcctagtcgtggtaatggataaattgccgagtcagcccaaagaagttcaaacactgtggtgcaccgactcccaagtaagcgaaacgacaactaggatctcattactcaaagccgtcttctactccttcgaacagtgtagtggtgagctgtccctaccagtgcatcttcagggactcaaatcaaaaggaaaggccgaggtggctgtcacactataccagcacgtttgcgtccacctgtgtaccttcatcacttcgtttcatcctagcctttttgccgagcttgacgcagctctgttgaacgctgttctcagtgcaaatatgattacaagcctcctcgccatggacgcctggtgcttcctcgcccgatacggcacagctgaactttgcgctcaccacgtgacgatcgtggcccacctcatcaagtcctgcccgggagagtgttatcagctgatcaacttgagcattttactgaagcgactgttcttcttcatggccccaccccaccagcttgaatttatacagaagttcagcccgaaagaggcagagaatctgcctttatggcagcacatcagtttccaggcactgccacctgagttacgcgaacagacggtgcacgaagttactactgtaggcacagcagaatgcaggaaatggctgtctcgcagtcggaccctgggagagcttgaatcactcaataccgtgctgagtgcccttctcgcggtctgtaactcagcaggagaagccctggatactgggaaacagacagctattatcgaggtcgtctcgcaactatgggccttcctgaatataaagcaggttgctgaccagccttacgtgcaacagacattttcactgctgctgcccctccttggttttttcattcagaccctagatccaaaactgatactgcaggctgtgacacttcagacttcactgttaaaactcgagctacccgactatgtccggctggctatgttggattttgtgagcagcctaggcaaactcttcattcctgaggccatacaagacaggatccttccaaatcttagctgtatgtttgcactccttctagccgacagaagttggttactggagcaacataccctggaggcttttacccaatttgcagagggaaccaatcacgaggagattgtgcctcagtgtttgtcgtcagaagagaccaaaaataaggtcgtcagctttctggagaaaactggttttgtagacgaaaccgaggccgcaaaagtcgagcgggtcaagcaggagaaaggaatcttctgggaaccgtttgcaaacgtcactgttgaagaggctaagagaagttctttacagccttacgccaaaagggcccgtcaggagttcccctgggaagaggaataccgctcagcattgcatacgatcgctggcgctttggaagcaaccgaatctcttctccagaaggggccagcacccgcttggctttcaatggagatggaggccctacaagaacgcatggataaactcaagcgatacattcatacactgggatag

SEQ ID NO: 28062 - DNA, 2562 bp, Artificial Sequence
  Description of Artificial Sequence: Synthetic coding sequence
atgtttctcccacatatgaaccatctcacactggagcaaacctttttttcacaggtcctgcctaaaaccgtcaagcttttcgacgatatgatgtacgaacttaccagccaggctcggggactctccagccagaatcttgagattcagacaaccctgcgcaacatactgcagactatggtccaactcctgggcgctcttacagggtgcgtgcagcacatctgtgcgactcaggagagcatcatccttgaaaacatccaatcactcccaagctcagttctgcatataatcaaaagtacatttgttcactgcaagaattcggaaagcgtgtactcaggctgcctgcatctggttagcgatcttctgcaggccttgttcaaggaagcttattccctgcaaaagcagctgatggagctgctggatatggtttgtatggatccgctggtagacgataacgatgatattctcaatatggtgatcgtgatacatagcctcttggacatctgttctgttatttcttccatggaccacgcatttcacgcaaatacctggaaatttattattaagcagtccctgaaacatcagtctatcatcaagagccaactgaaacataaagacatcataactagtctttgtgaggacattctcttttcgttccacagctgcctgcagctcgctgagcagatgacacagagcgacgctcaggacaacgcagattataggctattccagaaaactttaaagctgtgtcgcttttttgccaattccctactacactacgccaaggagtttcttccctttctgtcggatagctgctgcactttgcaccagttgtatctgcagatacactccaagtttccgccttcactttatgccaccaggatcagcaaagcccatcaggaggaaattgctggggcatttctagtgacattagacccactgatcagccagttgttaacattccagcctttcatgcaggtggtgcttgatagtaagctcgacctcccctgtgaacttcagttccctcaatgtctcctgctcgtggtggtaatggacaagctgccgagccagcctaaagaggtgcagactctgtggtgcacagattcacaggtgagcgaaaccaccacgcgcatcagtttacttaaggctgtgttctactcttttgagcagtgcagtggcgaattgtccctacctgtccacctgcaaggtcttaaaagtaagggtaaagcagaggtagccgtgacactgtaccaacacgtctgtgtccatctttgcactttcatcacaagctttcatccctcactgtttgccgagctggatgccgcactcttgaacgcggtcctatcagcaaacatgatcacaagcctgctggccatggacgcctggtgcttcttggcacgctacggcacggctgaactctgcgcccaccacgtcaccattgtcgcacatctgataaaaagctgcccaggggagtgctaccagctaattaacttatctatcctccttaaaagattgtttttcttcatggcgccacctcaccagctggaatttattcagaagtttagccccaaggaagctgagaacctcccactctggcagcacattagtttccaggccttacctccagaactccgtgaacagaccgtgcatgaggttacaactgtcgggacagcagagtgccggaagtggctgagtcgctctcgcacactgggagaacttgagagcctgaacacagttctgagcgccctcctcgctgtctgcaactcagctggcgaagctctagatacaggcaagcagacagccattattgaggttgttagtcagctgtgggcatttttgaatattaagcaagtagctgaccaaccatacgtgcagcaaactttttcgctcctgctgccgctgcttgggtttttcatccagaccctcgatccgaaactaattctgcaggctgttacgctgcagacctctcttttaaaacttgaattgcccgattatgtgcgactggcgatgctcgattttgtatcttcgctcggtaagctgttcataccggaggctatccaagataggatcctccccaacctgagctgtatgttcgctctgctactcgccgacagatcatggctgttagagcagcataccctcgaggcattcacccaattcgcggaaggcacgaatcatgaagagatcgtaccacaatgtctgagtagtgaagagaccaaaaacaaggtggtatcttttctggagaaaaccgggtttgtcgacgaaacggaagccgcaaaggttgagagggtcaagcaggagaaagggatcttttgggagccattcgccaacgtcacagtcgaagaggcaaagcggagctcgcttcagccttatgccaagagggccaggcaggagtttccttgggaggaagagtacagatctgccttacacaccatcgccggagccctcgaggctacggaaagtcttctccagaaggggcctgctcctgcttggttaagcatggagatggaggctcttcaagaaagaatggataagctgaagcgttacattcacactttggggtag

SEQ ID NO: 28063 - DNA, 993 bp, Artificial Sequence
  Description of Artificial Sequence: Synthetic coding sequence
atgatgtacgaactgacgtcacaggcacgaggactatcctctcaaaacctggagatccaaactaccctgcgcaatattctccagaccatggtacagctgctgggagctctgactggctgtgtgcagcacatctgtgcaacccaggagtcgattatcctggagaacatccagtctctgcccagcagcgtcctgcatatcattaaatctactttcgttcactgcaagaattcggaatccgtgtacagtggatgtctccatttagtgagtgacctgctacaagccctgtttaaagaggcgtactcactccagaagcaactgatggaattactggacatggtgtgtatggatccgctggtggatgacaatgacgatatactcaacatggtcatagtgattcactccctcctggatatctgtagcgtgatcagcagtatggatcatgcttttcatgcaaacacttggaaattcatcatcaaacagtccttgaaacaccagtccatcattaagtctcaacttaagcacaaggacattatcaccagcctgtgcgaggatatcctcttcagttttcatagctgcttgcaactggctgagcagatgacacagagcgacgctcaggacaatgccgactaccgcttattccaaaaaactctgaaactgtgccgcttctttgccaacagcctgctccactacgccaaggagtttttgccattcctctctgacagctgctgcaccctgcatcagctctatttgcagatccacagtaagtttccccctagcttatatgcaacgcggatatcaaaggcccaccaggaggagatcgcgggagcattcctggtgacgctggacccgttgataagccagcttctgacctttcaaccttttatgcaggtggtcctcgatagcaagctgggctacctttactcaaagcccttttcaactgtcctcagctccgtcctggtgaatagtctgtatctcttcatctaccgtgattag

SEQ ID NO: 28064 - DNA, 1047 bp, Artificial Sequence
  Description of Artificial Sequence: Synthetic coding sequence
atgtcccaggagggggctgtgccagcctcggcagttccattggaggagctgtccagctggcccgaggagctttgtaggcgcgagctgccatccgtcttaccacggttactgagtctttcacaacactctgactcgtggatcgagcacatccagatcctgaaaattattgtcgagatgttcctcccacatatgaaccatttgactttggagcaaacattctttagtcaggtgctgcctaagacagtgaagctgttcgacgatatgatgtacgagctgacctctcaggcccgaggtctcagttcacaaaacctggagattcagactacactgaggaatattctgcaaaccatggtccagctcctcggtgcccttacaggttgcgttcaacatatatgcgccacccaggaatctattatcctggagaatattcagtccctgccatcgtccgttctccacattataaagtccaccttcgtgcattgtaaaaacagcgaaagcgtctactccgggtgtcttcacttagtcagcgatctcctacaagcactctttaaagaagcttacagcctgcagaaacagttgatggaactcttggacatggtctgcatggaccctctagtcgacgacaatgatgacattttgaatatggtaatagtcatacactctctcctggacatttgctccgtgattagttcaatggaccacgcttttcatgctaacacttggaaatttatcatcaaacagtccctgaagcaccagtcgattataaagtcccagttgaaacacaaagacattattacctcactctgtgaggacattctcttctcgtttcacagctgcctgcagctggccgagcagatgacccagagcgacgcacaggataatgccgactatcgactgttccaaaagacattaaagctctgccgctttttcgcgaatagtctgctgcactacgccaaggaatttctgccatttctcagcgattcctgttgcactctccatcaactctacctgcagatccacagatggagcttcgctctcgctgtctag

SEQ ID NO: 28065 - DNA, 2100 bp, Artificial Sequence
  Description of Artificial Sequence: Synthetic coding sequence
atgttgaaactgtcaggcgaggggctgcgggattcttaccatagtcgcagggaccagatcgctttgaagaacctccagagtgatgtgaccgaagccaagagtgactttacaaaagaaacactagccagtcagaatacgaagatgatctcctccattgttatatcacagatgatcgatgagaataaaagccgggagaacagggcaagccttcctcttccctgtgctatcgcccaaagtcgtgcccatcatgcaaagcagagcctggcaaaccggagtggcgttaacatacaccgtgccttcgccctgttgcccggacgactgggcatcccagcgccatcagatgagagaggcccagaagccgagttgccacctaaggaagaaagaccttgtggagggcctcggagaggattcgcctctattactatcaccgccaggcgggtcggcccacccgcacgcgcactggtgtggggtactgcaggtgacagcctgtgtcccaagtgtagagcggaagatacactgtttcaagctcccccagcgctggccaacggtgctcatcctggcagacatcagaggagtttcgcctgtaccgagttttctcgcaactcaagcgtggtcaggttgaaggtgccagaagcccataccgggctttgcgagagacgcaagtactgggttacgcatgccgacgataaggaaacttctttttcacccgacactccactgagtggtaaaagtcctttggtgttcagctcttgcgtacatttaagggtgagtcagcaatgtcccgactccatttattacgtggataaaagccttagtgtaccaatcgagccaccacagatagcctcccccaaaatgcatcgctctgtcctatccctgaatttgaattgctcgtctcaccggctgactgctgatggggtggacggattggtcaacagagagcccattagcgaggcacttaagcaggaacttctggagggggatcaagatttagttgggcagcgttggaatccagggctgcaggagtcccacctgaaggaaacaccttcgcttcggcgagtccacctcgggaccggggcatgcccctggagtggctccttccccttagaaaacacggagctggccaacgttggtgctaaccaggttaccgtgagaaagggtgaaaaggaccatactacccactgtcacgcgagcgaccatgcaaaccagctgagcatccacatacccggatggtcctatagagccgtccacaccaaagtcttcagcggcagttccaagaggcagcaaggcgaagtgtgtatgactgtgtctgcaccccctgttgagcagaaacctacgagacactttctgccaataggcgatagtagcccatcagacgattgtctctcacgggacctctccgagccaacagagagacggcatcagtcctttttaaagcccagaatcctgtttcctggcttcctatgcccactgcaggatgtgtgtgcctcccttcaagaagacaatggcgtgcagatcgagagcaaatttcccaagggggactacacctgctgtgacttggtcgtcaagatcaaggaatgtaagaaatccgaggacccaaccacccctgagcccagccctgccgctccctccccggcaccccgtgatggcgctggtagcccagggttgtccgaagattgctcagaatctcagcaaacccccgctcgaagtctgaccttgcaggaagccctggaggtgcggaaaccacagtttatttcaagaagtcaggaacggctgaaaaaactggaacatatggtgcaacagcgcaaggcacagaggaaggaggatctccggcaaaagcagtcccttcttcccatacgtactagcaaaaagcagttcaccataccacaccccctatccgacaatctctttaagcctaaggagcggtgcatctcagagaaggaaatgcacatgaggagcaagcgcatctacgacaacctgccagaggtgaaaaagaaaaaagaggaacagcggaagcgagttattcttcagtcaaaccgcttgagggccgaagtgttcaagaaacagttgctggaccagctgctgcagcggaatgcagtgtag

SEQ ID NO: 28066 - DNA, 1959 bp, Artificial Sequence
  Description of Artificial Sequence: Synthetic coding sequence
atgattagcagtatagtgatctcccagatgatcgacgagaacaaatctcgagaaaacagagcctctctgccgctgccctgcgctattgcccagtcgcgtgcacatcacgccaaacagtccttagcaaatcggtccggcgtaaatatccatcgcgcatttgccctgttgcctgggcgtctcggaatacctgctcccagcgatgagcggggacctgaggcggaactccctccgaaggaggagcgaccatgtgggggacccagacggggtttcgcatcaataactattacagccaggcgggtgggcccaccagctcgtgccctggtgtggggcactgctggcgactcgttatgccccaaatgccgtgccgaagacaccctcttccaagcgcctcccgcattggctaacggggctcaccccggacgccaccagagatcattcgcatgcactgaatttagccgaaacagctccgtggttaggctgaaggtcccagaagcccacactggactgtgcgaacgtaggaaatactgggtgacccatgccgatgataaggaaacaagtttttcgcccgatacacctctgtcagggaagagccctcttgtgtttagctcatgcgttcacctaagggtcagtcagcaatgcccagactcaatctactatgttgataagagcctgtccgtgccaatcgaacctcctcagattgctagtcctaagatgcatcgtagcgtcctgagtctcaacctcaactgctccagccataggctgaccgctgacggggttgacggactggtaaatagggaacccatctcagaagcgcttaaacaggagctcttggaaggcgaccaggatctggtcgggcaaagatggaacccgggattgcaggaatcgcatctcaaagagactccatcattgcgtagagtccacctgggaacaggagcatgcccttggtctggatcctttcctctcgagaacacagagttggccaatgttggcgcaaatcaagttacagttcgtaagggagagaaagatcatactacccactgccacgcctccgatcacgctaaccagttgtctattcatatacctggctggtcttatagagccgtccacaccaaggtgttctccggatcctccaaaagacaacagggagaagtgtgcatgacagtgtcagccccacccgtcgaacagaaacctactcggcattttcttccaattggcgattccagcccgagcgacgactgcctgagccgggaccttagcgaaccaactgagcgcagacatcagagttttctcaagccacgcatcctatttccagggttcctatgtcctcttcaggatgtatgcgcttcacttcaggaggacaatggcgtccagatcgaatctaaatttcccaaaggggattacacatgttgtgatctcgtagtgaagatcaaagagtgtaaaaaatctgaagaccctactacccctgagcctagtccagccgctccctctcctgcccctagggatggggctggctctccaggcttgagcgaagactgttcagagagccaacagactcccgcacgtagccttactctacaagaagcgcttgaagtacgaaaaccgcagtttattagccgatcccaggaaaggctgaaaaaattggagcacatggttcaacagcggaaggcgcagcgaaaggaggatctgagacagaagcagtctttgctgcctatccgtacatctaagaaacagtttaccattccccaccctttatccgataatttgtttaagccaaaggaacgttgcatctcagaaaaagaaatgcacatgcggtcgaagcgaatttacgataacctcccggaggttaaaaagaagaaggaagagcaacgcaagagagtaattcttcagtccaatcgactgagagcagaagtgttcaagaaacagctgctcgatcagctcctgcaaaggaatgccgtatag

SEQ ID NO: 28067 - DNA, 1152 bp, Artificial Sequence
  Description of Artificial Sequence: Synthetic coding sequence
atgatttcatccattgtgatctctcagatgatcgatgagaataaatcccgggagaacagggctagcttgcccctcccttgtgccatcgctcagagtagagcacaccacgctaaacagagccttgccaacagatctggagttaacatccacagagcatttgccttgcttcctggcagactgggcattccagcacctagtgatgagcgtggcccagaagcggagctacccccaaaagaggagcgcccttgcggaggccctcgaagaggcttcgccagtataactatcacagccaggagagtgggaccgcctgcacgcgcattggtgtggggaacagctggagactctctttgccctaagtgccgcgcagaagacacccttttccaagctcctcctgccctagcgaatggagctcaccccggaagacatcagaggtcctttgcctgcacagagttctctagaaacagcagcgtggtaagactgaaggtgccagaagcccataccggcctgtgtgagaggcgcaaatactgggtgactcatgcagatgacaaggagaccagcttttctccagatacacccctatcaggtaaatcccctcttgtgttttcctcttgcgtccacttgcgggtgtcacaacagtgtcctgatagtatctactacgtcgataagagcctgtcagtacctattgaacctccacagatcgccagcccaaaaatgcaccgctccgtgctctcgctgaatttgaactgcagcagccacaggctgactgccgacggcgtagacggactggttaatcgggaacctattagcgaggccctaaaacaggagttgctcgaaggggaccaggacttggtgggacagaggtggaaccctgggctccaggagagtcatctgaaggagacgccatctctaaggcgagtccacttaggcactggggcttgtccatggagcggcagttttcctctggagaacaccgagctcgccaacgttggcgcaaatcaggtgaccgtccggaaaggcgagaaggaccacactactcattgtcacgcctcggatcacgctaaccagctctcgatccacattcctggctggagttatagagctgatctgctgcaagagggccaacacaagcaactatctatgttccagcgctag

SEQ ID NO: 28068 - DNA, 1152 bp, Artificial Sequence
  Description of Artificial Sequence: Synthetic coding sequence
atgatctcttccattgtcataagccaaatgatcgacgagaataagtccagggaaaatcgcgctagcctccccctaccgtgtgcaatcgcgcaatcacgggctcaccacgctaaacaatcactggccaatcggtccggagtgaacatccaccgcgctttcgctctgctgccaggacgcttaggaatccccgctccatcggatgagcgcggtccagaagcagaactgcctccaaaggaggaaagaccctgcggtggccctagaagaggatttgcctccatcacaatcaccgctcggcgtgtggggcctcctgcaagggcactggtgtgggggacggccggtgatagtttgtgccccaagtgtcgggctgaggacacactattccaagctcctccagccttggcaaacggtgcccaccccggaaggcaccaaaggagctttgcctgcacggagttctcccgcaacagctcggtggtgaggctaaaagtccccgaggcacatactggactgtgcgagaggcgcaagtattgggtcacccacgccgacgacaaggagacatctttttcaccagatactcccttgtccggtaagagcccgctggttttcagctcatgtgtgcacctgcgtgttagccagcaatgcccagacagcatctattacgtggacaaatccttatcggtgcccatcgaaccaccccaaatcgcaagcccgaagatgcatcgatcagtcctcagcctgaacctgaactgcagcagccatcggttgaccgccgacggcgtcgacggtctcgtgaacagggagcctatctccgaggccttgaagcaggagctactggaaggtgaccaggacctcgtggggcagaggtggaacccgggactccaggagtcccacctgaaggagactccctcacttagaagagtgcatcttgggactggggcatgcccctggagtgggtccttccctcttgaaaatacagagctggctaatgttggcgctaatcaagtgaccgtgcgaaaaggagagaaggaccacacgacacactgtcatgctagtgaccacgccaatcagttgagtatccatattcctgggtggtcatacagagcagatctgctacaggagggccagcataagcaactgagcatgttccaacgttag

SEQ ID NO: 28069 - DNA, 729 bp, Artificial Sequence
  Description of Artificial Sequence: Synthetic coding sequence
tagtggtccgggtccttcccactggagaacacggagctggctaacgtaggggctaaccaggtcactgttcggaaaggcgaaaaggaccacactacacactgtcatgccagtgatcacgctaatcagctaagtatacatattcctggctggagttaccgggcaggagattacacctgctgcgacttggtggttaagataaaagagtgcaaaaagagtgaggatccaactactcccgagcccagtccagcggcacctagcccagccccacgggacggggcaggatcacctggactatccgaggactgcagcgagagccagcagaccccggctagatcactgaccctccaggaggctttggaagtgcggaaaccacagttcatcagccgaagccaggaacggctgaagaagttggaacatatggtccaacagcggaaggctcagagaaaagaggatctccgccaaaaacagagcctgctgccaataagaacatccaagaaacagttcaccattccacatcctctgtctgataacctgttcaagccaaaagaaagatgcatcagtgagaaagaaatgcacatgcggagcaaacgcatctatgataacctgccagaagtgaaaaaaaaaaaggaggagcagaggaagcgggtcatcctgcagtccaataggctgcgggcagaagttttcaaaaagcaacttctcgaccagctgctgcagagaaatgcagtgtag

SEQ ID NO: 28070 - DNA, 1989 bp, Artificial Sequence
  Description of Artificial Sequence: Synthetic coding sequence
atgttaaaactgagcggggagggcctgagggactcttaccactcacggagggaccagattgcactgaagaatctccagagcgatgtcacagaagctaagtctgacttcactaaggaaaccctcgcctctcagaatacaaaaatgatcagctcaattgttatttctcagatgattgacgagaacaagagtcgggaaaacagggctagcctgcctttgccttgtgctattgcccagtctcgtgcgcaccacgcgaagcagtccctggcaaatcggagtggcgttaatatccatagggcatttgctctactgcctggcaggttggggattcctgctccatccgatgagagagggcctgaagctgagctgccccctaaggaggaacgtccctgtgggggaccccgtagagggttcgcctctattacaatcactgctagaagagtcggccctccagccagagcgttggtttggggtacggccggtgacagtttatgtcccaagtgccgagctgaagacacactgttccaagcccctccggcactcgctaacggcgctcaccccggacgccaccaaaggagcttcgcctgtacagagttcagtagaaattcttccgtcgttagactaaaggtgcctgaggcacacactggcctgtgtgagcgtaggaagtactgggtgactcatgcagatgacaaggagaccagcttttcccctgacacaccactcagtggcaaaagccctctggtgtttagcagctgtgttcacctgcgggtctctcagcagtgtccggactcgatctattacgtagataagtcactcagtgtaccaattgagccacctcagattgccagtcccaagatgcaccgctcagtcttgtccctaaacctgaactgcagctcccacagacttaccgctgacggagtggatggactagtcaatcgcgagcctatttccgaagctctgaagcaggaacttctggaaggcgaccaggacttagtaggtcaacgatggaaccctggactccaagaatctcatctgaaggagaccccttcattgcggagagtccatctgggcaccggcgcttgcccgtggagcggatcatttccattagagaatactgagctggccaacgtaggtgccaatcaggtgaccgttcggaagggcgagaaggatcacaccacccattgtcacgcttcagaccacgccaatcagctgtccatacacatccctggctggtcttaccgggctgtccacactaaggtgtttagcggcagctctaagcgccagcaaggcgaagtttgtatgactgtcagcgcgcctccagtagagcaaaagccaactaggcattttcttcctattggggattcctctccctctgacgattgcttatcccgtgatctgtctgaacctaccgaacgacggcaccagtcttttctgaagcctagaattctgttccctgggtttctgtgtccactccaggatgtgtgcgccagtcttcaggaggataacggagttcagattgaatccaaatttcccaaaggtgactacacatgttgcgacctcgttgtgaaaattaaggagtgtaagaagagcgaggatccaaccactccagaaccttcccccgctgctcccagcccagccccaagggacggtgccggatcccccggactcagcgaggactgctcagagtctcagcagacccccgcaaggtccttgacactgcaggaggccttagaggtgcggaaaccccagtttatctctcgctcacaggaacgattaaagaagctggagcacatggtgcagcaaaggaaagcccagcggaaggaagatctccggcagaagcagagtcttctccccatacgtacttctaagaagcagttcacaatcccacaccccctctccgataatctgtttaagcctaaagagagatgcattagtgaaaaggagatgcacatgcggtccaagagaatttacgacaatcttcctgaagtgtag

SEQ ID NO: 28071 - DNA, 1809 bp, Artificial Sequence
  Description of Artificial Sequence: Synthetic coding sequence
atgcttaaactttccggcgaaggtctcagagattcttaccattctaggcgtgaccaaattgcgctgaagaacttgcagagcgatgtaacagaggcgaaatctgactttaccaaagaaaccttagccagtcagaacacaaaaatgatttccagcatcgtgattagccaaatgattgatgagaataaatctagggagaaccgcgcaagcctgcctctgccttgcgccattgcccagtcgagagcgcaccatgcaaagcagtcactggcaaatcgctcaggtgtgaatatccacagagcatttgcgctcctgccagggagactgggcatccccgcaccgtccgacgaaaggggcccagaggcagagctcccgccaaaggaggagcgcccatgtggtggcccacgccgagggtttgcatctatcacgattaccgcgagacgggtcggccctccagctagggcactagtttggggtaccgccggagattccctgtgccccaaatgccgcgcagaggacacgcttttccaagcacctccagctcttgctaacggagcccatcctggtagacaccaacgaagctttgcctgcacggaattctctagaaattcttccgtcgtccggttaaaagttccagaagctcacacgggtctctgtgagcgacgaaagtactgggtgacacacgctgatgacaaggagacatctttctcccccgacacacccttgtcgggtaagagcccccttgtatttagttcctgcgttcacctcagagttagtcaacagtgtccagactcaatttattacgtggacaaaagtttgtctgtgccaatcgaacccccacagattgcgtcgcccaagatgcaccgttccgtcctatccctgaacctgaattgttcatcacatcgcctcactgctgatggggtagatggtctggtcaaccgtgagcctatcagtgaggcgctgaaacaggagctgctggagggggaccaagaccttgtcgggcagaggtggaatccgggactccaggagtctcacctgaaggagactcctagcttacggcgtgtccatctaggtaccggcgcttgtccatggagtgggtctttccccctggagaataccgaactggcaaatgtcggcgcaaatcaggtcacagttaggaaaggagaaaaagaccataccacccattgtcatgcatctgatcatgctaatcagttgagcatccatattcctggctggtcttacagggcaggggattacacttgttgtgacctggtggttaaaatcaaggagtgtaagaagtcggaagatcccaccacgcccgagccatcccccgcagccccaagtccagcgcctcgggatggtgccggaagcccaggcctttcagaagactgctcagaaagccagcagacacccgctcgctcgcttactctgcaggaggctctcgaggtccggaaacctcagttcatctctaggtcacaggaacggctgaagaagcttgagcatatggtgcaacaaagaaaagcgcaaaggaaggaagatctcaggcagaaacagtcgctcctgcccatccggacatcgaaaaaacaattcaccattccccatcccctcagcgacaacttatttaagcctaaagaaagatgcatttccgaaaaggaaatgcacatgaggagcaaacgcatctacgacaacttgcccgaagttaaaaaaaaaaaggaagaacagcgcaaaagagtcatcctgcaatctaacaggctgagagcggaggtctttaaaaagcaattgttggatcagttgcttcaacgcaacgctgtgtag

SEQ ID NO: 28072 - DNA, 2391 bp, Artificial Sequence
  Description of Artificial Sequence: Synthetic coding sequence
atgcagcacagtggaattcctactaagacgcatccgcagggttacgcggcaaggtacaccgagaccgccgtccaccggaccttccagattaagactttttccactgagctgaaaaaccacgttatggtgatggatttcgtcaagtccaactggttccctagccaacgaagggccaaagtttgtattattcacatgtgccagggactaaagaccgctgagcagacggccagccggtacgaaattcactcaaggctcttctcgtcacctaaggaccatagcgcttgggagcggaatgagagtctgagtaatgctggcttgagagattcctatcattctcggagagaccagatcgcacttaagaatctgcaaagcgatgtcacagaagcgaagagcgatttcaccaaagagactctcgcctctcagaacaccaaaatgatctcaagcatcgtgataagccaaatgatcgacgagaataagagccgtgaaaatcgggcttctttgcctttaccctgtgcgatcgctcagtccagagctcaccacgccaaacagagtctggctaaccgaagtggcgtcaacatccacagagcctttgcactgctgccaggtaggctcggtattccggcaccctctgacgaacggggaccggaggcagaactgcctcctaaagaggaacgtccttgtggcggacctaggagggggtttgctagcatcacaatcacagccaggcgggtcggccctccagcacgcgctttggtttggggcacagcaggggatagtctgtgtccaaagtgtcgggctgaagacacgctttttcaggcaccaccagccctagccaatggagctcacccaggccgacaccagagaagcttcgcctgcacggaattctcacggaacagctctgtggtgcgtttgaaagtgcccgaggcccacaccggcctatgtgagagaaggaagtactgggtgacccatgcagacgacaaggaaacctccttttctccagatacccccctatctgggaaaagtcctctggtgttttctagctgcgtccacttgagagtgagccaacagtgtccagatagcatctactacgttgataaatcacttagcgtgcccattgagcccccacagatagcctctccaaagatgcatcgatcagtgcttagcctcaacctcaattgttcttctcaccgactaacagcggacggcgtggacgggctcgtaaatcgcgaacccattagcgaagccctcaagcaagagctattggaaggggatcaagaccttgtcggtcagagatggaaccctggtctgcaggaatcccatctgaaagagaccccctctctgcgcagagtccaccttggcaccggggcatgcccatggagcggttccttccctctggaaaacacagagctcgctaatgtcggcgcaaaccaagtgaccgtgcggaaaggtgagaaggaccatacaacgcattgccatgcctcagatcatgcgaatcaattgtctattcacatacccggatggtcttaccgggctgtgcacaccaaagtattctcaggctcgagcaagagacagcagggcgaagtgtgcatgacagtgtctgccccacctgttgagcaaaagccaactcggcactttctgccaattggcgattcatctccatctgacgattgtctcagcagagatcttagcgagcctaccgaaagacgacaccaatccttccttaaacccaggatcctgtttcccggtttcctgtgccccctgcaggacgtgtgcgcatccctgcaggaagacaacggtgtccagatcgagtcaaaatttcctaaaggtgactacacctgctgcgatttggtggtaaagataaaggaatgcaagaaatccgaggatcctaccacccctgaaccgtccccagcagctcctagtccagcccctcgcgacggagccggaagtcccggtttgtctgaggactgtagcgaatcacaacagacgcctgcgcgaagcctgacattacaggaagctctcgaagtgcggaagcctcaattcatttcaaggtcccaggaaagactgaagaaactcgagcacatggttcagcaacgcaaggcacagcgtaaagaagacctcagacagaagcagagtctgttgcccatccggacaagcaagaagcaatttaccatccctcaccccctgtctgacaatctgtttaaaccaaaggagcggtgtataagtgaaaaggaaatgcatatgcgttctaaacgcatttatgataacttacccgaggtgaaaaaaaaaaaggaggaacagaggaagagagtgatcctgcagagtaaccgactgcgcgctgaggtgtttaagaagcagctactggatcagctgctgcagagaaatgctgtctag

SEQ ID NO: 28073 - DNA, 786 bp, Artificial Sequence
  Description of Artificial Sequence: Synthetic coding sequence
atgtctacaactacatgtcaagtcgttgccttcttgctctccatcctcggactggctggttgtattgccgctactggaatggacatgtggagtacccaagacttgtatgacaatccagtgacctcagtcttccagtacgaagggttgtggcggagctgcgtgaggcagagttctggcttcacagagtgccgtccctactttactatactggggctgccagctatgctgcaggcagtccgggcactgatgattgttggaatcgtgctgggggcaatcggcctacttgtttccatctttgctctaaagtgcatccggattggctccatggaagatagtgcgaaggccaacatgaccttgacctcaggtattatgttcattgtctccgggctgtgcgcaatcgctggagtgtcagtttttgcgaatatgctcgtcacgaacttttggatgtccaccgccaacatgtatactggcatggggggtatggtgcagacggtgcagacaaggtatacttttggtgccgcactattcgtagggtgggtcgccggaggcttaacactcattgggggagtgatgatgtgtatcgcttgccgaggactggcccctgaagagacaaattacaaagctgtcagctatcacgcctctggacacagcgttgcatataagccaggaggctttaaggccagtacaggatttggaagtaacacgaaaaataagaagatctacgacgggggtgccagaaccgaagacgaagtccaaagttacccatcaaaacacgactacgtgtag

SEQ ID NO: 28074 - DNA, 786 bp, Artificial Sequence
  Description of Artificial Sequence: Synthetic coding sequence
atggcagtgactgcatgtcaggggttgggtttcgttgtgtccctgatcggcatcgcgggaatcatcgctgccacctgcatggatcagtggtccactcaggacttatacaacaatcccgtcacagcagtcttcaactaccagggcctctggcgttcctgcgttagggagagctccggttttacagagtgcagagggtatttcacactgctagggctgccagcaatgttgcaggccgtgcgcgcactcatgatagtaggcattgtccttggtgctattgggctgcttgtctccatattcgcactcaagtgtattcggattggctcaatggaggactctgctaaggccaatatgacgttgacgtcaggcatcatgtttatcgtgagcgggctgtgtgcaattgctggcgtcagcgtttttgccaacatgctggtgacgaacttttggatgtctaccgctaacatgtacaccgggatgggaggtatggtgcaaaccgttcagacacgttacactttcggcgcagcactgttcgtaggctgggtggcgggtgggctaacccttatcggaggcgttatgatgtgtattgcttgtcgcggactagcaccagaggagacgaactataaagccgtgtcttaccatgcctccggacactctgttgcgtacaagcctggaggttttaaggcaagtacaggttttgggtcgaatactaaaaataagaagatctacgacggcggagctcgcaccgaggatgaggtgcagagttacccctctaaacatgattacgtgtag

SEQ ID NO: 28075 - DNA, 753 bp, Artificial Sequence
  Description of Artificial Sequence: Synthetic coding sequence
atgtccactaccacatgccaggtcgtggccttcctgctcagcattcttggcttggcagggtgcatcgccgcaacaggcatggatatgtggagcacacaggatctgtacgataatcccgtgacaagtgtatttcagtatgagggtttgtggcgaagctgcgtccggcagagctcaggatttacggagtgtaggccctattttactatcttgggactgcctgcaatgctccaagcagtgcgggctttgatgatcgtggcaatctttgcactgaagtgcattcgaattggctctatggaggatagtgctaaggcgaacatgacactcacaagcgggatcatgttcatagtgtccggtctgtgtgcgattgctggagtatctgttttcgccaacatgctggttacgaacttttggatgtctacagcaaacatgtacaccggcatggggggtatggtgcagactgtacagactaggtatacttttggagccgctctgttcgtaggctgggtcgctggtggactcacccttatcgggggagtcatgatgtgtatcgcatgtcggggattggcaccggaggaaaccaactataaagccgtcagttaccatgctagcgggcattcggttgcctataagccaggcggattcaaggctagtactggatttggctccaacacaaagaacaaaaagatctatgacggtggcgcaagaacggaggacgaagtccagagttaccctagcaaacacgattacgtctag

SEQ ID NO: 28076 - DNA, 3000 bp, Artificial Sequence
  Description of Artificial Sequence: Synthetic coding sequence
atgggaccggcaccactcccattgctgctgggactgtttttgccagcactgtggcgcagagccattactgaggccagagaggaagccaagccctaccccctgtttcccggtccattcccaggatcccttcagacagatcacaccccccttctctccctgcctcacgcctcggggtaccagccggctctcatgttctcccccacgcagcctggtagacctcataccggaaacgtggcaattcctcaggtgacatcagttgaaagcaagccactgccaccattggcgtttaaacacacagtagggcacatcattctgtcagagcacaagggagttaagtttaactgcagcatctctgttcccaatatatatcaggacactaccattagctggtggaaggacgggaaagaattactcggcgcacaccacgctatcacacaattttaccccgacgacgaggtaacagctattattgcctcattcagtatcacatccgtgcagagaagcgacaacggcagctatatctgtaagatgaagatcaacaacgaggagatcgtctctgatccaatctacattgaggtccagggcctgccccattttacaaagcaacctgaatctatgaatgttaccagaaatacagcattcaacctgacctgtcaggctgttggacctccagagcccgtgaatatcttctgggtgcagaattcctcccgcgttaatgaacagcccgaaaaatctccgtccgtgctgaccgtgcctggactgactgaaatggccgtctttagctgcgaggcacataatgataagggcctcaccgtatccaagggggtgcaaatcaacatcaaagctatcccgtcaccaccgactgaggtttccatacgcaacagcaccgctcactctatacttataagctgggttcccggttttgatgggtattcacctttccgtaattgtagcatacaggtgaaggaagctgaccccctatccaacggaagcgtgatgatcttcaacacttccgcactcccacatctgtaccagatcaagcagctccaagctctggccaattatagtattggtgtcagttgcatgaatgagataggctggtccgccgtcagcccgtggatcctggctagtaccaccgagggtgccccatctgtggcgccattgaatgtgacggtcttcctgaacgaatcaagtgacaacgttgatatacgctggatgaaaccacctaccaagcagcaggacggtgaactcgtggggtacagaatctcacatgtctggcagtctgctgggatttcaaaggagctgctggaggaggtggggcagaacggatcacgagcccgaatctcagtgcaggtgcataacgcgacctgcaccgtgagaatcgcagccgtaacacggggaggggtgggcccattttccgatcccgtcaagatttttattccagcccacggctgggtggactatgcacccagttcaactcctgctcctggcaacgccgaccccgtgttgatcatttttgggtgtttctgcggtttcatcctgatcggtctgatcctgtacattagcctggccattcgcaagagggtccaggaaactaagtttgggaatgcatttacagaggaggatagtgaactcgtggttaattacatcgcaaaaaaaagcttctgccggagagcaattgagctcacattacactccctgggtgtttcggaggagctccagaataagctggaagacgttgttattgacaggaacctcctcatactgggcaaaatcctgggggagggtgaattcggctctgtaatggaaggcaatttaaagcaggaggatggcacaagcttgaaagtcgcagtgaagacaatgaagcttgataactcctctcagcgagaaattgaagagttcctcagcgaagccgcttgcatgaaggatttttctcaccccaacgtgatccggctgctcggagtatgtattgaaatgtcaagtcaagggataccaaagccgatggttatcctgccctttatgaagtatggcgacctccacacctaccttctgtattcgcgacttgagacaggcccaaagcatatccctttgcaaaccctgctgaagttcatggtggacattgcgttggggatggagtacctgagcaatcgcaattttttacatcgcgatctagcagctcggaattgcatgttgcgagatgatatgacggtctgtgtcgccgattttgggctcagtaagaaaatttactcaggagattattacaggcaagggagaatcgccaagatgcccgtcaagtggatcgcgattgagtccctggccgatcgcgtgtacacctctaaatcagacgtttgggctttcggtgtgacaatgtgggagattgcaacgagaggtatgactccttaccccggagtccagaatcacgagatgtacgactacctgctgcatggacaccggctcaagcagccagaagactgcctcgacgagttgtacgagattatgtacagctgctggcgaaccgaccccctcgaccggcctaccttttctgtgctgcgactgcagctggaaaagttgctggagtctctcccagatgttcggaaccaggctgatgtcatctacgttaatactcagctgttagagagcagtgaagggcttgctcagggttccactttggcacctctggacctgaacatcgaccccgatagcattatcgcctcctgcacacccagggcagccatatctgtcgttacagccgaagtacacgactccaaacctcacgaaggtaggtatatcctaaacggaggttctgaagagtgggaagacctgacttcagcaccttcggcggcagtcacagcagaaaagaattctgtccttcccggagagagactggttcgtaacggggttagttggtcacattcttccatgctgcccctgggctcatctctaccagacgagctgctgtttgccgacgactctagcgaaggatcggaagttctgatgtag

SEQ ID NO: 28077 - DNA, 1671 bp, Artificial Sequence
  Description of Artificial Sequence: Synthetic coding sequence
atgaagccaccaacaaaacagcaagatggcgagctggtggggtacagaatttcgcacgtctggcaaagcgctgggatctccaaggaactcctagaggaggtagggcagaacggcagcagggccaggatctccgtgcaagtccacaatgccacttgtactgtcaggatcgccgctgttacccgcggaggggttggcccattctctgatcccgtcaagatcttcatacctgcacacggagaatcatacacacatgcccagattgccaggaatctgcataaagtgagaccggcatacatctcccttaccatatgtagcagcttgttacaggcatctgtgtctcacatattccagacgatgaccggcctcttagtctctaccaggcttgggagactgtgcccactgtttaactccggcgcttggcagaggcgatcctgcgcgcaccacttgtggctgctgctgtggatcttaatcggactgatcctatatatttctctggctatcagaaaaagagtccaggaaaccaagtttggcaatgcttttacggaggaggatagcgaactggttgtgaattacatcgcaaaaaaatctttttgtcgacgcgcaatagaattaacgctacactccctgggggtgtcggaagaactccagaataagctggaggatgtggtaattgataggaatcttctaatcttaggaaagattctcggtgagggagaatttggcagtgtgatggaggggaacctcaagcaggaggatggcacgtccctgaaggtcgccgttaagacaatgaagctggataactctagtcagagggagatagaggaattcctaagcgaggcggcttgtatgaaggacttctctcaccctaacgtgattaggctactcggaacttccgagaaatgtaggtgggttgccaagcgggctctgctgatctgttcagtccccaaggagaaaatcagcggcgtggataaaaactgcctacagatccacatccctctccagaccctccttaagtttatggtggatattgccctggggatggagtatctcagtaaccgcaatttccttcacagggatcttgctgcgcgaaactgtatgcttcgggatgatatgactgtttgcgtggcagatttcggacttagtaaaaaaatttactccggagattattaccgacaaggtaggatagcaaaaatgccagtcaaatggattgccattgagtcactggcggatcgcgtgtatacctctaagtcggacgtatgggctttcggcgtcaccatgtgggagatcgcaacccgcggtatgactccatatccaggcgtgcagaatcatgaaatgtacgactacctgctccacggccacaggttgaagcagcccactgcctggatgaactgtgatcaggttggaatgtgccggggagtggagccaaccgacacccccgctcaggaacccttccttatgtgggaaattgtctacgagtgtactctcgccggagagccaattcctgaccgcccaacattctccgttctgcgcttacaactggaaaagcttcttgaaagcctgcctgatgtgcgcaatcaggctgatgtgatctatgtaaatacccagctcctggagtcttctgaggggcttgcgctccatccttgctccacagggttggaacatcgcccatag

SEQ ID NO: 28078 - DNA, 2472 bp, Artificial Sequence
  Description of Artificial Sequence: Synthetic coding sequence
atgaagataaacaacgaagaaatagtttccgatcccatatacatcgaagttcagggccttcctcactttacaaagcagcccgagagcatgaacgtgacaagaaacaccgcattcaatctgacttgtcaagcagttggtccacctgaacctgttaatattttctgggtgcagaactcatccagagtgaacgaacaaccggaaaaaagtccaagtgtgctcactgtacctggattaacagagatggcagtctttagctgtgaggctcacaatgacaaagggttaacggtgagcaagggagtgcagatcaacataaaggcgattcccagtcctcccactgaggtgagcattcggaacagtaccgcgcacagtatccttatctcctgggtccctggttttgacggctattccccgttccggaactgttcaatacaggttaaagaggccgatcccctgagcaatggctcagtgatgattttcaacactagcgcgctgcctcacctgtatcaaatcaaacagttgcaggcccttgccaattattccataggcgtaagctgcatgaatgagattggatggtccgccgtaagtccgtggattctggctagtacgaccgagggggctccctctgtcgccccactcaatgtcactgtgtttctgaatgaatcatctgacaatgtggacattcgatggatgaaaccacccacaaaacagcaggatggggagcttgttggatacaggattagtcacgtgtggcagagcgcaggtatcagcaaggaactgctggaggaggtgggccaaaacgggagtcgggcacgtatatcggtccaagtgcataacgcaacatgtaccgtgagaattgccgctgtgacccggggtggcgtaggccctttcagcgaccccgtaaaaatctttatccccgctcatggctgggtcgattatgcgccaagttcgaccccagcgccaggcaatgctgaccccgttctgatcatattcggctgcttttgcggtttcatcctcataggattgattttgtacatcagtctggctattcgcaaaagggtgcaggaaaccaagtttggcaatgcgttcaccgaagaagatagtgaacttgtggtgaactatatagccaagaaaagcttttgtaggcgcgctatcgagctcaccctccacagcctcggagtgagcgaggagttacagaacaagctggaagacgttgtaatcgataggaatctcctgatcctgggcaagattctgggggagggcgaatttgggtctgttatggagggaaacctgaagcaggaggacggcacttcactaaaggtggccgtcaagaccatgaaactggataactcctcacagcgggagattgaggagttcttaagcgaagcagcttgcatgaaagacttttcccaccctaatgtcatacgtctgctgggcgtctgcatcgagatgtcctcccagggaattcccaaacccatggttatcctgcctttcatgaagtacggagacctccacacatatctgctgtactctaggctggaaactgggccaaagcacattccactgcagacattgctgaagttcatggtcgacattgctttagggatggagtacctaagcaaccggaactttttacatcgcgacctggctgcccgaaactgtatgctgagggatgacatgacagtgtgcgttgcagattttggactgtctaagaaaatttacagcggagactattatcgccagggacgcattgctaaaatgcctgtgaagtggattgcaatagaatcccttgccgatagggtatatacatccaaaagcgatgtctgggcgttcggtgtgactatgtgggaaatcgcgactagaggaatgactccgtatcctggggttcagaaccacgagatgtatgactacctgttgcatggacatagattaaagcagcccgaggattgtctggacgaactgtacgagattatgtactcatgctggagaacagacccactcgaccggcctacatttagtgtcctgcggttgcaactcgaaaaactgctcgaatctcttcccgacgtacggaatcaagcagatgtgatatacgtgaacacacagctcctggagtcgtccgaaggtcttgcacagggctccaccttggccccactcgatctgaacattgatccggacagtattatcgcttcttgtactcctagggccgcaatctctgtggtaaccgccgaagtgcacgatagtaaaccccacgagggcaggtacattttgaacggcggatctgaggaatgggaagatttgactagtgctccatccgccgcagttaccgctgagaagaactccgtgttacctggcgagcggctggttaggaatggcgtaagctggagccacagttccatgctccctctcggctcgagcctgcccgacgagctccttttcgcagacgattctagcgagggtagcgaagtgttaatgtag

SEQ ID NO: 28079 - DNA, 3000 bp, Artificial Sequence
  Description of Artificial Sequence: Synthetic coding sequence
atgggccctgccccattgccactattgctgggactcttcctgcccgcactgtggagaagagccatcaccgaggccagagaagaggccaagccttatcctctgttccccggtccatttcccggatcgcttcaaaccgaccacacacccttactttccctgccccatgccagtgggtaccagcctgccctgatgttttctccgactcagccaggcaggccccacactggcaacgtggcaatcccacaggttacctcagttgaatctaaacctcttcctccactggctttcaagcacactgtggggcacataattctctctgaacataagggtgtgaagttcaattgctctattagtgtacccaatatttaccaggacacgaccatcagctggtggaaagatggaaaggagctcctcggagcccatcacgctattacccaattctacccggatgatgaggtgacggccattattgctagtttctccattacaagtgttcagcggtccgataatggaagctatatatgcaaaatgaagattaataatgaggagatagtcagcgaccctatttatatagaagtgcagggcctcccacatttcactaaacaacctgaaagcatgaacgtgactcggaacaccgcctttaaccttacttgccaggcagtcgggcctcccgaaccagtgaatatcttttgggtccagaattctagtcgagtgaatgagcagcctgagaagagccctagcgttctgacagtgccgggattgacagagatggctgtctttagctgcgaagcgcataacgataagggccttacagtcagcaaaggggtccagataaacatcaaggccatcccaagtccgccaacagaagtgtccatacggaacagtacagcccattccattctgattagttgggtgccagggtttgatggctactctcccttcaggaactgctcaatccaggttaaggaggcagatcctctgagtaatggctcagttatgatctttaatacctccgctttgccccatctatatcagataaaacaactgcaggctctcgcaaattactcaattggggttagctgcatgaatgaaattgggtggtcggcagtcagcccatggatccttgcctcgactactgaaggtgcaccgagtgtcgcacccctgaacgtgaccgtgttcctgaatgagtcatccgacaatgtcgacattcggtggatgaagccgcctacaaaacagcaggacggagaattggtgggataccggatctcccacgtctggcagtcggccggtatctccaaggaactactggaggaggtgggccagaatggctcccgcgcacgcatcagtgtccaggtacacaatgctacttgtaccgttaggatcgccgctgttacgaggggaggcgttggccctttctcggatcccgttaaaatcttcattccagcccacggttgggtggactatgctcccagtagtacaccggcacctggcaacgccgatcctgtgctgattatttttggatgcttctgtgggtttatattaatcggcctgatcctgtacatctcattagcgatcagaaagcgcgtacaggagaccaaattcggcaatgcctttactgaggaggattctgagctggttgtcaattacatcgcgaagaagtcgttttgtcggcgagcaatcgaattgacactccacagcctgggagtgtctgaggagctgcaaaataagctggaagacgtcgtgattgacaggaatctactaattttgggaaaaatcctcggcgaaggggagtttgggtctgtaatggagggaaatctgaaacaggaagatggtacctccctgaaagttgcagtcaagacgatgaaactggacaactcgtcacagcgtgaaatcgaagagtttctgtcggaagccgcatgtatgaaagatttttcccaccccaacgtgattaggctgctcggagtttgcatagagatgtcctcacaaggcatccctaaaccaatggtgattcttccttttatgaagtatggggatctgcacacataccttttgtactcacggttggaaaccggacccaaacacatcccgttgcagaccctgctcaaattcatggtggatatcgcgcttggtatggaatacctgagtaaccggaattttctgcatagagatctcgccgcacgaaattgtatgctgcgagacgacatgacagtctgcgtcgccgactttggactgtctaagaaaatctattctggagattactatcggcagggaagaatagctaaaatgcccgttaagtggatcgccattgagtccctagctgatagggtttacaccagcaagtccgatgtgtgggcctttggagtgaccatgtgggaaattgcaacaaggggaatgaccccctatccaggtgtccagaaccatgaaatgtacgattatttgctacacggccatcgcttaaagcaacccgaggattgtctcgacgagctctatgaaatcatgtattcctgctggcgcactgatcccctagataggccaacctttagcgtactgaggcttcagctcgagaagcttctggagtctcttcccgacgtgcgaaatcaagcagacgtgatatatgttaacacccagctgctagaaagctccgagggcttggcccagggctccactctagccccactggacctgaacatagaccccgacagtattattgcttcctgcacacccagagctgctatctctgttgttaccgctgaggtgcacgactccaagccacacgaggggcgttatatcctgaacggcggatccgaagagtgggaagatctgacatccgccccatcagccgctgttaccgctgagaagaattcggtcctacccggagagcgcctggtgcgtaacggcgtgtcgtggagtcactcttctatgctcccactaggatcgtcactccctgacgaacttctgtttgcagacgacagctccgaaggctcggaggtgcttatgtag

SEQ ID NO: 28080 - DNA, 501 bp, Artificial Sequence
  Description of Artificial Sequence: Synthetic coding sequence
atggccagcggagtggccgtatccgacggagtgattaaggtgttcaacgacatgaaggtgcggaaatcctcaactccagaggaagtgaagaaaagaaaaaaggccgtgctgttttgcctgagtgaagacaaaaaaaacatcatcttagaagagggcaaggagatactggtgggagatgtgggccagaccgtcgacgatccttatgccactttcgtgaagatgctccccgacaaagattgtcggtatgctctgtacgatgcgacatatgagaccaaagagtccaagaaggaggacctcgtattcatattttgggcccctgaaagtgcccctctcaagagcaaaatgatctatgcctctagcaaggacgctatcaagaagaagttaacaggaattaagcacgaactgcaagctaactgctacgaggaggtgaaggatcggtgcaccttggccgaaaaactagggggaagcgccgtgataagcttggagggaaaaccactgtag

SEQ ID NO: 28081 - DNA, 501 bp, Artificial Sequence
  Description of Artificial Sequence: Synthetic coding sequence
atggccagtggtgttgccgtctccgacggcgttatcaaggtgtttaacgatatgaaggtgaggaaatccagtaccccagaggaggtaaaaaagcggaagaaagctgtacttttttgtctttcagaagacaagaaaaacattatcctggaggaagggaaggagatcctggttggggatgtgggccagaccgtcgacgacccctacgctaccttcgtgaagatgctacccgataaggactgtaggtatgctctctatgatgcgacctacgaaacaaaggagagtaaaaaagaagatttggtgtttattttttgggccccagagagtgctccactgaagtccaaaatgatttacgcctcctcgaaagacgccatcaaaaagaaactcacaggaataaagcatgagctgcaggctaattgctacgaggaggtgaaggataggtgcacactcgcagaaaagctcggcggtagtgcagtgatctcactcgaggggaaacccctatag

SEQ ID NO: 28082 - DNA, 276 bp, Artificial Sequence
  Description of Artificial Sequence: Synthetic coding sequence
atggcctccggggtggcggtgtccgacggcgtgattaaagtgttcaacgacatgaaagtgcgaaaaagcagcacccctgaggaagtgaaaaaacgaaagaaagcagtgcttttttgcttgtctgaggataagaaaaacatcatcctggaagagggcaaggaaattctcgtcggggacgtgggtcaaacggtcgacgatccctatgccaccttcgtgaaaatgttaccagataaggactgccggtacgccctatatgacgcgacctatgagacctag

SEQ ID NO: 28083 - DNA, 4101 bp, Artificial Sequence
  Description of Artificial Sequence: Synthetic coding sequence
atgctctccttcgtggacacacgaacgctgctgctgctcgccgttactctgtgtcttgcgacctgccaaagtttacaggaggagacagtccggaaaggtcccgctggcgatcgtggccctcgcggagagcgcggtcccccagggcctcccggtcgcgatggggaggatgggccaactggcccaccgggaccacctggacctccaggcccaccgggactcgggggaaactttgcggctcaatacgatggtaagggggtggggttaggccctgggccaatgggactgatggggccacggggtcctcccggagctgctggagcgccaggtccccagggctttcaggggccagctggggagccgggagagcctggtcagacaggcccagcaggagctcgaggccctgcaggcccacccggaaaggctggggaggatggacatcccggaaaacccggaaggcctggcgagagaggggtggttggaccccagggcgcaagaggattccctggaacccccggactgccgggattcaaaggtatccgtggacacaatggcctggacggattgaagggacagcccggagccccaggggtgaaaggggagcccggagctccgggagagaacggcaccccgggacaaaccggcgctaggggcctacctggtgagcgtgggagagtaggggcacctggtcccgcaggggcaagaggttcggatggctccgtgggcccagtgggccctgcaggccctattgggtctgctggtccccctggctttccaggagctcctggaccaaagggtgaaattggagctgtggggaatgccggacctgcaggacccgcaggcccaagaggggaggtggggctgcccggtctttccggtccagtgggaccaccaggtaatccaggcgcaaacggcctgaccggagcaaagggggcagcgggactcccaggggtcgcgggagctcccggtctgcctggacctcggggaattcccggacccgtcggggcagctggcgcaactggcgcacgcggactggtgggtgagccaggccctgcgggttccaaaggggaaagcggcaacaaaggcgagcctgggtcggctggaccacagggccctccagggccatccggggaagaggggaaacgtggacctaacggggaagctggctccgccggaccccctggtcccccaggcctgagaggtagccctggctctagggggctgcccggtgctgacggccgtgccggtgtcatgggacctcctggatctagaggcgcttctggacctgccggagtgagagggccaaatggcgacgcaggccgacccggagaacctggcctgatgggacccagggggctgccaggttcccccggaaacatcggaccagcagggaaggaagggccagtcggtctccccggaattgatgggcgacctgggcctattggccctgctggcgctaggggcgagcctgggaatattggcttcccaggcccaaagggccctaccggggatcccggaaagaacggcgataaagggcacgcagggcttgctggcgctcggggagcccctggacctgatgggaataatggagcacagggccctcctggacctcagggagtccagggcggaaagggcgagcagggaccccctggtcccccaggattccagggccttccagggccttccgggccagctggagaggtgggtaagcccggagagagaggccttcacggcgaatttgggctgccaggacctgccggacctcggggtgaacgcggaccccctggcgagagcggcgcagcgggacctacaggacctattgggtctcgagggcctagcggccctccaggacccgatgggaacaagggggagcctggagtcgtgggcgcagttggaactgcaggcccatccgggccatctggtctgcctggcgaacgcggtgcggcagggattcccggtggcaagggcgaaaagggcgagccaggcttgagaggcgagatcggaaatccgggaagggatggggctcgaggtgctccaggtgccgtaggagcccctgggccagccggtgccacaggagacaggggggaagcgggagctgcgggaccagctggccctgccggacctagaggatctcctggcgagcgcggagaggtgggtcctgccggtcccaatggttttgccggacccgcaggtgctgcgggtcaaccgggtgctaaaggagagaggggcgctaaggggccaaagggagagaatggtgtggtcgggcctacagggcctgttggagcagccggtcctgccggacccaatggcccaccaggccctgctgggtcgcgaggagatggcggtccccctggaatgacgggcttccctggggctgcgggtaggacggggcctccgggaccatccggcatttctgggcctcccggtcctccaggcccagcaggtaaggagggtctcagagggccacgaggcgaccaaggcccagtgggccgtacaggcgaggtgggcgctgtgggccctccgggtttcgcaggcgagaaaggaccgagtggagaggccggtacagccggacctcccggtacccccggaccacagggactgctgggtgcacctggaatcctaggcctccctgggtctcgtggagagagagggttgccaggcgttgcaggcgctgtaggagaacctggaccgttgggcattgctggccctccaggcgctagagggcctccaggagcggtgggctccccgggagtcaacggggcaccaggagaggccggtcgagacgggaacccaggtaatgacggcccacctggcagagacggccagcctggacacaagggcgagcgtggttaccctggcaatatcgggccagtgggcgctgcaggagcacccggacctcatggacccgttggcccagctggaaagcacgggaacaggggggagactgggccaagcgggcctgtcggtcccgcaggagctgtgggaccaagaggaccatcaggaccccaggggatcaggggggacaaaggcgagccaggcgaaaaaggacccaggggactacctggccttaagggtcacaatgggctgcaagggctccctgggatagccggacatcacggcgaccagggggcacctggttctgtgggtccagctgggccaaggggcccagccggtccttccgggcctgccggtaaagacgggcgtacgggccaccccggaacggtagggcctgcaggcatcagagggccacagggccaccaaggacctgctggtcccccaggaccgcctggccctcctggtcctccgggagtgagcgggggtgggtacgactttgggtatgacggtgacttctatcgggcagaccagccacggtcagctccatctctgcgccctaaggattatgaggtggatgctactctcaagtcactgaataaccagatagagaccctgctgacacccgaaggcagccgtaaaaatccagccaggacctgtcgggacttacggctttcacacccagaatggagcagcggctactattggatcgatccgaatcaaggatgtacaatggatgcaataaaagtctactgcgattttagcaccggcgagacttgtattcgagctcagccagagaatatccctgccaaaaattggtaccgtagcagcaaagacaaaaagcatgtatggctgggggagactattaacgctggaagtcagttcgagtacaacgtcgagggcgttacctccaaggagatggctactcagctggcttttatgagactgctggccaattacgcctcccagaacataacctatcattgtaaaaactccattgcgtatatggacgaggaaaccggcaatctcaaaaaagctgtgatcctacaaggctcaaacgacgtggagcttgtggccgaaggtaacagtcggtttacttacacagttctggtggatggctgcagcaaaaaaactaacgagtgggggaaaactataatcgaatacaaaactaataaaccttcccggctcccgttcctggacattgcacccctggatatcggaggcgctgaccaagaattttttgtggacattggcccagtctgtttcaagtag

SEQ ID NO: 28084 - DNA, 4104 bp, Artificial Sequence
  Description of Artificial Sequence: Synthetic coding sequence
atgctttctttcgtggacacccgtactctgttgctccttgccgtcaccctttgtctggccacctgtcagtgcacgcttgggggacagaccctgtctaaattcccaccttatctccatattgagcggagcgagcaaggacctcctggacccccaggccgtgatggagaagacggacctacaggacccccaggcccaccaggccctcccggaccccctggactgggcggaaatttcgccgcacagtatgacggcaagggcgtgggcctgggacctgggccaatggggctcatgggccctcgtggaccacctggggctgccggtgctcctggtccgcaggggttccagggcccagccggtgagcccggagagccaggtcagaccggcccagcaggagccaggggaccggcaggccctcccggtaaagcaggtgaggacggccacccagggaagcctggccgaccaggagagaggggggtggtggggcctcagggggcacggggattccctggaacaccgggactcccgggatttaaaggcattagaggacataatggactggacgggctgaagggccagcctggcgctccaggcgtaaaaggagagcctggcgctccgggtgagaatggcactcccggtcaaaccggggcaaggggacttcccggagagcgcggtagggtgggtgcgcctggaccagccggagccagaggctcagatggatcggtggggcctgtggggccagctggtcctatcggcagcgcaggacctccagggttccctggtgcaccgggaccaaagggagagataggggcagtggggaacgccggaccagccggacctgcaggtcctcggggtgaggtaggtctccccggactgtctggcccagtcggaccaccgggaaaccccggagcaaacggacttactggcgctaagggagcagccggactgccaggggtggctggagcccctggcctgcccggtcctcgcggtatccctggcccagtcggggcagcaggtgccaccggcgcaagaggcttggtgggggagcctggtcctgctggttccaagggcgaatctggaaataagggcgaaccagggagcgccggaccacaggggccacccggaccctccggcgaggaagggaagaggggccctaatggggaagccggttcggcagggccacccggaccaccgggtcttaggggttctcccggatcacggggattacccggagccgacggtagagccggtgtgatggggccaccaggtagtagaggcgcttcaggccctgccggtgtgcggggaccaaacggcgacgctggaaggccaggtgagccaggcctcatggggcctcgaggtctgcccggaagcccaggtaatattggtccggctggcaaagaggggcctgtgggcctccccggaatcgacggcaggccgggtccaattgggccagctggtgctcgcggtgaaccgggtaacattggcttccccggaccgaagggtcccacaggggatcccggaaagaatggcgataaaggtcacgcaggcttggctggtgctaggggcgctcccggtccagacgggaacaatggtgctcagggcccaccgggaccccagggtgtgcagggcggtaagggcgaacaagggccaccgggtcctccaggatttcagggactgccaggcccaagcggcccagcaggtgaggtcgggaaacctggcgagcggggactccacggagagtttggccttcctggccctgctgggccacgcggtgaaagaggcccaccgggtgagagcggtgctgctggaccaaccggtccaattgggtctcgcggtccaagcggtccacccggacccgatgggaacaaaggggaaccaggtgtggtgggggctgttgggaccgcaggcccatccggaccgtcaggcttacccggagagagaggggctgccggtattccaggcggtaagggtgagaagggtgaacccggactgcgcggtgaaatcggaaaccctggtcgcgacggcgcacgaggtgcgccaggcgctgtgggggctcctggacctgctggcgctaccggcgaccgcggagaggcaggcgctgccggacccgctggccctgccggtccacggggatctcccggagagcggggagaggttggacctgctggcccaaacggttttgccggacctgcaggggctgcgggtcaaccaggagcgaagggagagcggggagcgaaggggcctaagggagagaatggggtagtcggccctactggtcccgttggagccgctggacctgccggacctaacgggcctcccggtcccgctggcagtcgaggggacggcggacctcccggaatgaccgggtttcctggtgcagcaggccgaactggaccacctgggccaagtggaatctccgggccacctggacccccaggtcccgctggtaaggagggactgcgcggaccccgtggagatcagggccctgtcgggagaacgggagaggttggtgcggtgggaccaccgggtttcgccggtgagaaaggcccttccggcgaagccggaaccgctgggccacccggaactccagggcctcaggggctcctcggtgctcccggaatactgggtctcccaggctcgcgcggtgaacgcggtttgcccggtgtggctggcgctgtgggagaacccggtccactggggatcgcaggccctcccggagccaggggaccacccggtgcagtgggctcccctggagtgaatggtgccccaggcgaggctggcagggacggtaacccgggaaatgacgggccacctgggagggacggtcagcctgggcataagggcgagcgcggatacccaggaaatatcgggccagtcggggcagcaggagcccctggcccacatggaccagtggggccagcagggaagcatggaaatagaggcgagaccggcccttccggacccgtaggccctgctggggctgtgggacctagggggccatcaggtccccagggcattagaggcgataagggagagccaggtgaaaagggccctagagggcttcctgggctgaagggacataatggtctccagggattgccgggtatcgcagggcatcatggcgatcagggggctccgggtagcgttggcccagccggacctcggggacccgcaggaccatccggaccagcagggaaggatgggcgaaccggccatccaggtacagtcggaccagccggaattcgtggccctcaagggcatcagggacccgcaggaccccctgggccacccggtcccccaggtccccctggcgtgtcaggcggaggatacgacttcggctacgatggcgatttctaccgcgctgatcagcctcggtctgccccatctctccgacctaaagattatgaggttgacgcaacgctgaagtcgctgaacaaccaaattgagactttactcacccccgaaggcagccggaagaatcctgccaggacttgtagggacctacgccttagtcatccagagtggtcatcaggatactattggattgatccaaaccagggatgcaccatggacgcaatcaaggtgtattgcgatttttccaccggtgaaacctgtattcgagcccagccggaaaatatcccagccaaaaactggtaccgcagcagcaaggacaaaaagcacgtgtggctgggggaaacaattaatgctggcagccaatttgagtacaacgtcgagggagtgacatctaaagaaatggcaacccaactggcctttatgcgacttctggcaaattatgccagtcaaaatattacataccattgcaagaatagtattgcgtacatggacgaagaaacagggaatctgaagaaagcagtcattctccaagggagcaatgatgtggagctggtggctgagggtaatagcaggttcacttacactgtgctagttgatggctgttcaaagaaaacaaatgagtgggggaagacaattattgaatataaaacaaacaagccctctcgattaccatttctcgacattgccccacttgatatcggaggcgctgatcaggagttttttgtggatataggtccagtgtgtttcaagtag

SEQ ID NO: 28085 - DNA, 4401 bp, Artificial Sequence
  Description of Artificial Sequence: Synthetic coding sequence
atgatgagtttcgtacagaaaggctcatggcttctgttagcgctactccacccaactataatcctcgctcagcaagaggccgtggaaggcggttgctcccatctaggtcaaagttatgccgatagagatgtctggaagcctgaaccgtgtcagatttgcgtgtgtgattcaggctcagtgctgtgtgacgacataatctgtgacgaccaggaacttgactgccccaacccagaaattccttttggggagtgttgtgccgtgtgcccccagccccctaccgcccctactagaccaccaaatggacagggaccccagggaccaaagggcgaccctgggcctccaggcatccctggacgcaacggagatccaggcattccagggcaacccggtagccccggatctcctggccctcccggaatatgcgagagttgtcctaccggtcctcagaactattcaccccaatatgactcttacgatgtcaagagtggtgttgcggtaggtggattggccggatacccaggcccagccggtccccctggcccacctggaccacccggtacctcagggcacccaggcagcccaggctcacccggttaccagggccctcccggtgagccaggccaagccggaccatctggtccccctggccctccaggagcaataggccctagcggacctgctggaaaggacggtgagtctggacgcccaggacgcccaggcgaaagaggcttgccgggaccacccggaatcaaaggcccagcaggtatccctggattcccaggcatgaagggacacagagggttcgacggccgtaatggtgagaaaggtgagacaggagcccctgggctgaagggagaaaatggcctgccaggagagaacggcgcacccggacccatgggacccaggggggctcccggagagcgcggtaggccagggttgccaggcgctgcaggggctcgcggtaacgatggcgcacgaggctccgatgggcagccaggacctccgggtcccccaggtactgccggattccctggatcaccgggagctaaaggggaagttggccctgccggttctcccggatctaatggagctccaggacaaaggggcgaaccaggtcctcaggggcatgccggtgcacagggtcccccaggccctccaggaataaacgggagtcccggtggtaagggcgagatggggccagccggaatccctggggcacctgggctgatgggagcaaggggcccacccggacccgctggagccaatggggcaccaggcctcagaggcggtgccggtgagcccggaaagaatggcgctaagggggaacctggaccccgtggagaaagaggcgaggccggtatcccaggcgtgcctggcgctaaaggggaggacggaaaggacggctcccctggcgaaccaggggcaaatggtctgccaggagctgccggtgagagaggcgctcccggatttcgcggaccggcaggtcccaatggcatccctggcgaaaaggggcctgccggagagcgtggtgctcccggtccggcagggcctaggggtgccgctggtgaaccaggcagggacggtgtgcccggaggacctggaatgcggggtatgccgggaagccctgggggacctggcagcgatggcaagccaggccctccaggttctcaaggggaatcagggaggcccggaccccctgggccttctggccctagagggcaacccggagttatggggttcccaggcccaaagggtaacgatggagcgccaggcaagaacggcgagcgcggtggacccggtgggccagggcctcaaggtccccctgggaaaaacggcgaaaccgggcctcagggacctcccggacccaccggacctggcggagacaagggggacaccggaccaccaggccctcagggtttgcaaggcttgccaggcaccgggggacccccaggtgagaacggcaagcccggtgagccgggacccaagggagatgcaggagccccaggtgcgcctgggggaaaaggcgacgctggggctccaggggagcgaggcccaccaggcctcgccggtgctcccggtcttagaggaggcgctggtccccctggtccagagggcggtaaaggggctgccggaccacccggaccacccggagccgcagggacccccggtctccagggcatgcccggagagcggggtgggctggggtcgcccggacctaagggggacaagggagaaccgggaggtcctggggcagacggggttccaggcaaagacggacctagaggacccactgggccaatcggccctcccggacccgctgggcagcccggagacaaaggagagggaggagcaccaggcctccccggaattgctggacctcgcggatctccgggtgagcggggtgagacgggccctcccggtccagctggattccctggcgcacctggccaaaacggtgagccgggtgggaaaggcgaaagaggagcaccaggcgagaagggagagggtgggccaccaggtgtggctgggcctccgggtggatcaggtcctgccggtccacctggaccccagggcgttaagggggaacgaggatcacctggaggtcccggagctgcgggttttcctggagccaggggactacctgggcctccagggtcaaatggcaacccagggccacccggtccctctggctcccctggaaaagacggcccacctgggcctgcgggaaacaccggtgcccctggcagccctggcgtgagtggacctaaaggagatgccggacaacccggagaaaaaggcagtcctggggctcagggacctcctggagctcctggtcccctcggaatcgcaggtattaccggcgctagaggcttggcaggtccaccagggatgccgggtcctcgagggtctccaggccctcagggagtcaaaggcgaatcaggcaagcccggagctaacggtctctcgggggagagagggccacctggtcctcagggactccccggtcttgccggaacagccggagaaccagggagagacggaaacccaggctccgatggcttgccaggccgagacggaagcccgggaggcaaaggcgaccggggagagaatggctctcccggtgcccctggtgcacccggacatcctggaccgcctgggcctgtggggccagctggtaagtcaggcgaccggggagagagcggaccagctggtcctgcaggtgcccctggaccggcaggaagtcgtggggcacctgggccacaggggccacggggagacaagggagagaccggagaacggggagcagccggaatcaaaggtcaccgaggtttccctggcaacccaggagctcctggcagtccgggacctgccggacaacagggagccatcgggtcacccggtcccgctggtccgaggggccctgtcggtcctagcggccctccaggaaaggacggaacaagcggccaccccggaccaatcggtccgccagggccaaggggaaaccgtggcgagagaggcagcgaggggtccccaggccaccctgggcagccaggaccgcctggaccgccaggagcgccaggaccgtgttgtggtggcgtcggggcagctgccattgccggaatcgggggtgagaaggctggaggctttgccccatattatggcgacgaacccatggactttaaaattaataccgatgaaataatgacttccctgaagagcgtcaatggacagatagaaagccttattagtccagatggctctaggaagaaccctgctagaaactgccgcgatctaaagttctgccatccagagctgaagagtggagagtactgggtggacccaaaccagggctgcaagttggacgccattaaggttttttgcaacatggaaacaggcgagacttgtatttctgcaaaccctctgaacgtaccaagaaagcattggtggaccgactcgtcagcagagaagaagcacgtgtggtttggagaaagtatggacgggggatttcaattctcttacggaaacccagagctgccagaagacgtgctagacgtgcatctggcctttctccggttacttagctcgagagcaagtcagaatataacttaccactgcaagaattctatcgcttacatggaccaagcctcaggcaacgtgaagaaggcactgaaactgatggggtcaaatgaaggcgagttcaaagcagagggcaattcaaagtttacatacactgtgctggaggacgggtgcacaaaacacaccggtgagtggtccaagacggttttcgaatacaggacacgtaaggctgtgaggttacctatagtggatattgcgccatacgatatagggggacctgatcaggagttcggcgttgatgttggccctgtgtgttttctgtag

SEQ ID NO: 28086 - DNA, 3492 bp, Artificial Sequence
  Description of Artificial Sequence: Synthetic coding sequence
atgatgtccttcgtccaaaaagggagctggctgcttctggcactcctgcacccaactataatcctggcgcagcaggaggctgttgaagggggatgctcacacttaggacagtcatatgctgaccgggacgtatggaagcctgaaccatgccagatttgcgtgtgcgatagcggatccgtgctctgcgacgacattatatgcgatgatcaggagctggattgccccaacccagagatcccttttggcgagtgctgcgccgtgtgcccacagccacctactgctcccactcgcccacctaatgggcagggcccacaagggcctaaaggagatcccggacctccgggaattccagggagaaacggtgatcctggaatccctgggcagccaggatcacccggaagtcctgggccacccggtatctgcgagagttgtcccacagggcctcagaactattccccccaatacgatagttatgatgtgaaatcaggggtcgccgtgggtggcctggctggatacccaggccctgcagggccaccgggacccccaggtcctcctggtactagtggccacccaggcagtcctgggtcccctggctatcaagggccaccaggggaacctggacaggccggaccgtcagggcctccgggtccacctggagcaatcgggcctagcggccctgccggtaaggacggggagagtggcaggcctggcaggcctggtgagcggggtctgccaggcccacctgggatcaaggggcctgcaggaataccgggattcccagggatgaaagggcaccgcggtttcgatgggaggaatggagaaaaaggcgagaccggtgccccaggcctcaagggcgagaacggacttcccggtgaaaacggtgcacccggtccgatgggacccaggggtgcccctggagaacggggaagaccgggtcttccgggagctgctggtgcccgaggtaacgacggcgctcgaggaagcgatggacagccaggaccgccaggccctccgggaactgctggtttccccggatcccctggggcaaagggagaggtgggtccagcgggttcacctgggagcaacggcgcacccggacagcgcggtgagcctggaccacaggggcacgctggagcacaagggcctcccggaccgccaggtattaatggtagcccaggcggtaagggagaaatgggcccagccggaattccaggggctccaggcctcatgggagcgcgaggcccacccggacctgccggagcaaacggtgcccctgggctgcggggaggcgcaggcgaacctggcaaaaacggcgcaaagggcgaacccggacccaggggcgagcgaggagaagccggtattccaggggtacccggagccaagggtgaggatggcaaggacggtagccccggagagccaggagccaatggactccccggagcagcaggggagcggggagctcccggattccggggtcccgctggacccaacggaattccaggagaaaaaggccctgctggggagcgcggagccccaggacctgctgggcctagaggagcagccggtgagcctggcagagatggggttcctggtggtccgggaatgcgtggcatgccgggtagccctggaggcccaggcagtgacgggaagccaggcccacctggtagccaaggcgaatctggacgcccaggccctcccggaccgtctggtccacggggtcaacctggggttatgggatttcccggtccaaaaggcaacgacggggctccaggaaaaaacggggaaaggggaggcccaggcggacctgggcctcaggggccacctggtaaaaacggagagacaggccctcaggggccacctggcccaacaggacccggaggcgacaagggtgacacaggtcctcctggcccacagggtttgcagggcctacccggtactgggggtcctcctggagagaacggcaagcccggagagccaggtcccaagggagacgcaggcgctcctggggctccaggaggcaagggcgacgcaggggctcccggagagcggggaccccctgggctcgccggagctcctggattacgtggcggtgccggaccacccggaccagaaggaggtaagggcgctgccggtcccccaggtccgcctggagccgctggaacccctgggctccaagggatgccaggcgaaagaggaggcctgggaagccccggtccgaaaggcgacaagggagagcctggcggtcccggagccgatggcgtcccagggaaagatgggcctagaggacccacgggaccgattggaccgcctggcccagcaggacaacctggcgacaagggagaaggcggtgccccaggcctcccaggtattgctggcccacgtggatcccctggcgaaagaggtgaaaccggacctcccggacctgccggatttccaggcgcaccgggtcagaatggggagccgggagggaagggggagagaggggcaccgggagaaaaaggggaaggcggtcccccaggcctttttgggccacctggtaaggacggaaccagcgggcacccgggtcctatcggacctcccggaccacggggtaataggggagaacgtggctccgagggcagcccaggacatccaggtcaaccaggtccgcctggcccacctggtgccccaggcccatgttgcggtggggtgggcgcagcagctatcgccggaatcggtggggagaaagctggtggctttgccccttactacggggacgagcctatggacttcaagatcaatacggacgaaattatgactagcctgaaatctgtgaatgggcaaattgaatctttaataagccctgatggtagccgcaagaatccagcaagaaactgtcgggatctgaaattttgccatcccgaacttaagtccggcgagtactgggtagaccccaatcaggggtgcaagctcgacgctataaaagtgttttgtaatatggagaccggggagacctgcatttcagcgaatcctctgaacgtgcccagaaaacactggtggactgactcaagcgccgaaaagaagcacgtctggtttggagaatccatggacggcggatttcaatttagttatggaaatcctgaacttcccgaggatgttctcgacgtccacttggcctttctcaggcttctgtcttcacgggctagtcagaacatcacttatcactgcaagaattccatcgcttacatggatcaggccagcggcaatgtcaagaaggcattgaaactcatgggatcaaatgaaggtgagttcaaggccgaaggaaatagtaaattcacttatactgtactggaggacggttgtacaaagcacacaggagaatggtccaagactgtgttcgagtaccgaactcggaaagcggtgcggcttccgatcgtcgacatagctccctacgatatcggcggtccagatcaagagtttggcgtggatgtaggaccagtgtgcttcctgtag

SEQ ID NO: 28087 - DNA, 5139 bp, Artificial Sequence
  Description of Artificial Sequence: Synthetic coding sequence
atgggacgggaccagcgagccgtcgcagggccagccctgagacgatggcttttgttgggcaccgtgacggtcggctttctggcacaaagcgtgcttgccggtgtgaaaaaatttgacgttccgtgtgggggtcgtgattgcagtggcggatgtcagtgttacccggagaagggaggcagaggccagcccggaccagtgggacctcaggggtacaacggccctcccggactccagggcttcccgggactgcagggacgcaaaggggacaagggggaacggggagcccctggggttactgggcctaaaggagacgtcggtgctcggggagtgagtggatttcccggtgccgacgggatcccaggacaccccggacagggaggtccgagaggcaggccaggctatgatggatgtaacgggacacaaggtgacagcggacctcagggaccgcctggttccgaaggcttcacaggtcccccaggtccgcagggtccaaaaggccagaagggagaaccctatgctctcccaaaggaggaaagagaccggtaccgcggtgagccaggtgagcctggtttagtaggcttccaggggccaccagggcgaccaggacacgtggggcaaatgggaccagtgggcgcaccaggcagaccagggcctagcagtgatgaaagctttaaaaataagctcaagaacaaaggcctgaattattatactgtgaacagcatgcaaggagatgtgggacagcccggtcccaatggaataccttccgacactcttcaccccattatagcgccaacaggagtcaccttccaccctgatcagtacaaaggcccagtgggctggcgtggcagaccttgggtcgctggcatttcgctgaagggggaggagggtattatgggattcccaggcctccgaggctacccagggctctccggtgaaaaagggtctcccggtcagaaagggtcaagaggcctggatgggtaccaggggcctgatggaccacggggacctaagggcgaggccggtgatcctggtccacccggactgccagcctatagtccccacccctccctcgcaaagggagcgcgaggcgatcccggattcccgggtgcgcagggagaacctggatcacaaggcgagcccggagacccaggcctcccagggccacctggcctgtctattggagacggagatcagagaaggggattgcctggcgagatggggccaaagggctttattggggatcccggaatcccggcattgtatggtggaccacctggacctgatggtaagcggggtccgcctgggcctccaggcttgcccggacctccgggtcctgacggattcctgttcggtttaaaaggagccaaggggcgtgccggatttcccggattgcccggtagtccaggcgctagaggccctaaaggctggaaaggagatgccggtgagtgtagatgtaccgaaggggatgaggccattaagggtctcccagggctcccgggtccaaagggatttgccggaatcaatggcgagcccggacggaagggcgaccgcggagaccccggtcagcacgggctgcccggattcccagggttgaaaggcgttccaggtaacatcggcgctccgggacccaagggtgctaagggcgacagtagaacgataaccactaaaggcgaaaggggccagcctggcgtgccgggtgtgccagggatgaagggcgatgacggctctccgggacgtgatggattggatggattcccaggcttacctggaccccctggtgacgggattaagggcccacctggagacccagggtacccaggcataccaggaacgaaaggcactcccggagagatgggcccaccgggactggggcttccagggctcaaaggacagcgtggcttccctggggacgcaggcctccctggacccccaggattcttaggtcctccgggtccagctggaactccagggcagattgattgcgacacagatgtcaagcgtgccgttggcggagatagacaagaagcaatccaacctggatgtattggcggaccaaagggactgcccggtctacccggacctccaggccctacaggggcaaagggcttgcggggaataccaggctttgccggagccgacggaggtccaggccctagggggttgcccggtgacgctggcagagaagggttcccagggcctccgggtttcatcggtcctcggggaagcaagggagccgtcggtctgccagggccagatgggagccctggaccaatcgggttacctggccctgacgggcctcccggagaacgtggcctgcccggagaagtcttaggcgcacagcccggacctcgcggagacgccggagtaccgggtcagcctggtctgaaggggttacccggtgataggggccctcctggcttccgcggtagtcaagggatgcctggaatgccaggactgaaaggccagcctggtttgcctggcccatcagggcagccagggctgtatggccctcctggcctgcatggattccctggggcacctggacaggaagggccactgggtctccctggtatacccggtcgagagggtcttcccggagacagaggtgatcctggcgataccggtgcacccggaccggtcgggatgaagggtctgtccggagaccggggtgacgctggatttacaggcgaacaggggcatcctggctctccaggctttaagggcattgatggcatgccagggacccccggactgaagggagacaggggcagccccggtatggacgggtttcagggaatgcccggactgaaaggtcgaccgggatttcccggaagtaagggtgaggccggattcttcggaattcccggactcaagggcttggctggagaacctgggttcaaggggagcagaggtgacccaggacctccaggccctcccccagttattttgcctggcatgaaagacataaagggggagaaaggggatgagggcccaatgggtcttaaaggctatttgggggcaaagggcatccagggaatgccagggattccaggcctgtctggcatcccaggcctcccaggaaggcctgggcacattaagggcgtgaagggagacatcggagtccctggcattcccggactccctggctttcccggtgtggcgggtccccctggaatcaccgggttcccgggattcattggctcaaggggagacaagggcgcaccagggagagccggactgtatggcgaaattggcgctaccggcgattttggtgatataggcgacacaatcaatctgcctggccgtcctgggttgaaaggggagcgaggaacaactggcatcccaggcttgaaagggttttttggggaaaaggggacagagggggacattggcttcccaggcattacgggcgtgaccggcgtgcaaggaccacccggattgaagggacagacgggattcccaggtctgacaggcccacctggatcccagggggaactgggcaggatcggactcccaggcggaaagggggacgatgggtggcctggggctcccggtctccccggattcccgggtctgagaggaataaggggactccatggactccccggaacgaaaggattcccgggatctccaggttccgatatccacggcgaccccggatttcctggcccacccggtgaacgtggagaccctggggaagcgaacacccttcctggcccagttggcgtccctggacagaaaggagaccagggcgcaccaggggaacgaggcccacctggttcccctggcttgcaggggtttccaggcatcaccccacccagcaatatctccggcgcacccggagacaagggcgcaccgggaatctttgggcttaaggggtatagaggtccgccaggtcccccaggatccgcggctctgcctggctccaagggtgatactggcaatcccggagccccaggaacgcctggcacaaaaggctgggccggtgacagcggcccacaaggcagaccaggggtcttcggcttgccgggagaaaagggtccccgaggcgaacagggttttatggggaatactgggcctaccggggctgtcggagatcgcggaccgaagggtcctaaaggcgatcccggattccccggagcgcctggaactgtgggagctccgggtatcgcaggtattcctcagaagattgcagtccagccaggcaccgtcgggcctcaggggaggcgcggtcctcccggtgcacccggagaaatggggccacagggccctcctggcgagcccggtttccggggagccccaggcaaggccggtccccagggcaggggcggagtgagcgcagtgccagggtttagaggggacgagggtcccattggacaccaggggcctatcgggcaggagggagccccaggacgaccgggatctccagggctgccgggtatgcccggacgttcggtatcgattggctacctgcttgtaaagcacagtcagactgaccaggagcctatgtgtccagtaggcatgaataagttgtggtccgggtattctctgctctatttcgaggggcaggagaaggcccataatcaggatcttggcctcgcaggaagttgcctcgcacgtttctcaaccatgcctttcctctactgcaatccaggtgacgtctgctactacgctagccggaatgacaaaagttactggctgtctacaactgctcccctgcctatgatgcctgttgctgaggatgaaataaagccatatatctcgcggtgctctgtgtgtgaagcccctgctattgcaatcgcggtacactctcaagacgtgtccatccctcactgccccgctggctggagatctctgtggataggttactctttcctaatgcacaccgctgccggagatgaggggggaggccagtccctggtcagtcctggatcttgcctggaagacttccgggctactcccttcattgagtgcaatgggggtcgcggaacctgtcattattacgccaataagtattcgttctggctcaccactattccagagcaaagtttccaggggtctccaagtgccgacacattaaaggccggactgatccgcactcacatttcgcgttgtcaggtgtgcatgaagaatctgtag

SEQ ID NO: 28088 - DNA, 5138 bp, Artificial Sequence
  Description of Artificial Sequence: Synthetic coding sequence
atggggagggatcagagagctgtggcgggacccgctctgcggaggtggctcctgctcggaactgtcaccgtgggcttcctggcgcagagcgtgctcgctggcgtgaaaaaatttgacgtgccctgtggcggacgcgactgttccgggggttgtcaatgttacccagaaaaaggcggtcgcggacagccaggtccagtcggaccccagggatacaacggccctccgggactgcagggattcccaggtctgcaaggtcgcaagggagataaaggcgaacggggagctcctggcgttaccggccctaagggtgatgtcggggctcgcggagtctccgggtttccgggagccgacggtataccgggtcacccaggacagggcggtcctaggggacgcccaggctacgacggctgcaacgggacccagggtgattccgggccacagggcccacccggatcagagggatttaccggacctccgggtccacaggggcctaagggtcagaaaggagaaccttacgctctgccaaaagaggaacgggacagatacagaggtgagcccggagaacccggtctggtgggtttccagggcccaccgggaagacccggtcacgtaggacagatggggcctgtgggggcaccagggaggcctgggccacccggacctcccggtcctaagggccagcagggtaatcgaggcttgggattttacggcgtcaagggtgagaaaggcgatgtaggacagcctggcccaaacggaataccatccgacaccctgcatcccatcatagccccaacaggcgtcacatttcaccctgaccagtataagggagagaaaggctcagaaggggaacccggaattcgcggaattagtctgaagggagaggaaggaatcatggggtttcctggtctgagaggttatcctgggctatctggcgaaaaggggtctcctggtcagaagggcagccggggactcgacggctatcagggaccagacggcccaaggggaccgaagggagaggcgggtgatccagggccaccaggcctccctgcctattcgccccacccctcgctggccaaaggtgccaggggtgaccccggttttccgggagcacaaggggaacccggttcccaaggagagcctggggaccctgggctaccaggaccacctggcctgtccatcggcgacggcgatcagcgccgaggattgcccggtgagatgggtccaaagggattcattggcgatccaggcatccccgctctctatgggggtccaccagggccagatggaaaacggggaccccctggacctcccggacttcctgggccaccgggacctgacggattcctatttggactcaaaggtgcaaaaggaagagcaggattccccggactgcctggctctcccggtgcacgaggcccaaaaggttggaaaggcgatgccggagagtgccggtgcaccgaaggggatgaagcaattaagggcctccctggtttacctggaccaaaaggatttgcaggcattaatggagagccagggagaaagggggatcgcggagaccccggacagcacggattaccaggattccccggactgaagggtgtgcctggaaatatcggggcaccgggtcctaaaggggcaaagggagattctcggaccataaccaccaaaggagagcgtgggcagccaggggtgcctggagtgcctggcatgaagggagacgatggttcacctggccgtgatgggcttgacgggttccccggattgccaggccctcctggcgacgggatcaagggcccacccggagacccaggatatccgggtatacctggaactaagggtacacccggtgagatgggccctcctggtctggggcttccaggtctgaaagggcagcgaggattccccggagatgctggcctgcccggacctcctggattcctggggccacccggtcccgcaggaacacctggtcagatagactgtgacacagatgtcaagcgggcagtcggcggagaccgccaggaagcaattcagcccggttgcattggcggtcccaaggggttgcctggccttcctggaccacctggccctacaggcgcaaaaggcctccgcggaatccctggttttgctggtgccgatggcggacctggtcccagagggctgccaggagacgcagggagagaaggatttcctggcccaccaggcttcatcggacctcgcggatcgaagggtgctgtggggctccctggccctgatggctcccctggcccaatagggctgcccggtcctgacggcccacctggcgagagagggctcccgggagaagtgctcggagcacagcccggtccccgaggtgacgcaggcgtgccagggcaacccggtctcaaagggctgcctggagacagggggcctcccggatttagaggcagccaagggatgcccggtatgcccggtctgaagggacagcccggtctccctggacctagcggacagcctggcctctatggaccgccagggctccacgggttcccaggcgcacctggccaagaagggcctctgggactccccggtatcccgggacgagagggacttccaggcgaccggggagatccgggagacaccggtgcgcctggcccagtcgggatgaagggactgtctggggaccgaggagacgcaggtttcaccggagagcaggggcatcccggatcaccaggttttaaagggattgatggaatgcccggaacaccagggctgaaaggggacagaggctcccccggaatggacggatttcagggcatgcccggactgaagggacgcccagggttccctggatctaaaggagaggccggattcttcggtataccaggccttaagggcctggccggagaaccgggattcaaggggagccgaggcgatcctggccctcccggaccccctccagtgattctccccggaatgaaggatataaagggcgagaaaggcgatgagggacccatgggcctgaagggctacctgggggctaaggggatccagggcatgcccggaatccctggactgtccggaattcctggactccccggtaggccaggccatattaagggggtgaaaggggacattggagtacccggaattcccggtctcccaggattcccgggtgtagccggacccccaggaatcaccggctttcccggtttcatcggctcccggggtgataagggggctcccggaagagctgggctgtatggagaaataggcgctaccggcgatttcggcgatattggcgacaccatcaatctgccgggaaggccaggcctgaagggcgagagaggcacgacagggatcccgggactgaagggctttttcggagagaaagggaccgaaggagacattgggttcccagggattacgggtgtgacaggcgttcaagggcctccaggcctcaagggtcaaaccgggtttcctggactgactggtccccctggttcccagggtgaattgggcagaattggcctgccagggggtaagggcgacgatgggtggcctggtgcccctgggctgccaggcttccccggactgcgcggaatccggggactgcacggcttgcctggcaccaagggattccctggcagccctggttcagatatccatggcgatcctgggtttcccggaccaccaggagaaaggggggacccaggtgaggctaacactctacctgggccagtgggcgtgcctggacaaaagggggatcagggggctcctggcgaacgcggtccacccggatccccaggtttacagggcttccccggtataacacctccctccaatataagcggagcaccaggcgataaaggcgctcccggaatttttggactcaaggggtatagaggaccacctggcccacccggaagcgctgcgctccccggatctaagggggataccggcaaccccggtgctcctggtacgcccggaactaaagggtgggccggagactccggccctcagggcagaccaggtgtctttgggttaccaggtgagaagggacctaggggcgagcaagggttcatggggaatacagggccaacgggagccgttggagatcgtggacctaaaggacctaagggagaccctgggttccccggagctcctgggaccgtaggtgcccctggaatagccggtattccgcagaaaattgcagtgcagcccggaaccgtaggacctcaaggtaggcgaggccctcccggtgcacctggtgagatgggacctcaggggccacctggcgaacccggttttcgaggggctcctggcaaagctggtccgcagggcagaggaggcgtgtcggcagtccctggattcagaggcgacgaggggccaataggccatcaggggcctattggacaggagggggctcctggcaggccagggtcaccgggtcttcctgggatgcctgggagaagcgtgtcaatcggctacctcctcgttaaacattctcagaccgatcaggaaccgatgtgccccgtcggtatgaacaagctttggagcggttattcccttttgtatttcgaggggcaagagaaggcacataaccaggacttaggcctggccggatcctgcttagcgagattttccacaatgccctttttgtactgtaaccctggcgacgtctgttattatgcctctcggaacgataagtcctattggctgtcgactaccgcgccactaccaatgatgcctgtggcagaggatgaaatcaagccctacatttcacgctgctcagtgtgcgaggccccagctatcgccatcgccgtacactcacaggacgtatctattcctcactgcccagccggttggcgaagcctctggatagggtatagttttctgatgcatacagccgctggggatgaagggggaggccaaagcttggtgagcccaggatcttgcttggaggacttccgagcaactcctttcattgagtgtaacggcggaagaggaacatgtcactactacgcaaacaagtatagcttctggcttaccaccatcccagagcagagctttcaagggagcccctcggccgacacgctcaaggccggtctaatccggacgcacatttcacgttgtcaggtctgtatgaagaacctcta

SEQ ID NO: 28089 - DNA, 318 bp, Artificial Sequence
  Description of Artificial Sequence: Synthetic coding sequence
atgggacgggaccagcgagccgtggcaggacccgctctgcgaaggtggctgctgctgggtacagtgacagtcggatttttggcccaatctgtgctggccggagtcaaaaagtttgacgtaccctgtggaggacgcgactgttccggcggatgccaatgctatccagaaaagggcggtcgagggcagccagggcctgttggccctcagggctacaatggtcccccaggactgcaaggtttccctggactgcagggtcgcaaaggcgataaaggggagagaggagcacctggcgtcacagggccaaaaggagacgtttag

SEQ ID NO: 28090 - DNA, 4497 bp, Artificial Sequence
  Description of Artificial Sequence: Synthetic coding sequence
atgagcgctcgaaccgctccaagaccccaagtactgctccttccactccttctggtgctgctcgccgctgccccagctgcgagtaaagggtgtgtgtgcaaggacaaaggtcagtgcttttgtgatggggctaagggcgaaaagggagaaaagggttttcccggaccgcctggctctcccggtcaaaagggttttaccgggcctgagggcctacctggaccacagggcccaaagtccttccgcgcaattccttcctactcaggaggaaaatcacttcaaggtatctctggcctccctggtttctcaggaagtccagggcttcccggtacaccaggaaataccggaccttatggactggtcggcgtgccgggatgttctggtagtaagggcgagcagggctttcctgggctaccaggcaccctgggctaccctgggattccagggattcacaatctgaagattttcaaaggggctcccgcaaaagaggaggacatcgagctggatgccaaaggcgaccctgggctccctggcgcaccaggcccacagggcctgccgggaccacctgggttccccggtcctgtggggcctccaggccctcccggtttctttgggtttccgggtgcaatggggcctcggggacctaagagcttcgtgctaagttcaaggatatcgaccaagggggaaaaaggtgttaaaggactcaccgggcctccaggcccaccgggtacagtgattgttactctgactggacctgacaataggacggacctaaagggggaaaagggtgacaagggtgccatgggtgagcccggtccccctggcccaagtggccttccgggtgagtcatacggtagtgaaaagggggctcctggagatcctggtctgcaaggtaagcccggaaaggacggcgttccagggttcccaggctctgaaggcgtcaagggaaataggggatttccagggcttatgggtgaggatggaatcaaagaggagaaacgtgatgttgccatcgtctccttttctagcaaaactgaatattacgacacttatcaagaaaagggggacgagggcacgcccggacctccaggccctaggggggctcgaggccctcagggcaagaacaagttccgttgcatcccagggagccagggtagctctaggccaggcctaaggggagcgccaggctggcctgggttgaaaggtagtaagggggagagaggcagaccgggaaaggatgcaatgggcacccccggaagcccgggatgcgccggttcccccggtttgcccggaagtcccggaccacccggtcctcctggagatattgttttccgtaaggggcctcccggtgatcatggcctgcctggatatctgggcagtcccggtattccaggagttgatgggcctaagggcgaacctggactactgtgtacccagtgcccctacatcccaggtccccctggcttgccaggcttacccggtctgcatggtgttaagggtatccccggacgtcagggtgccgcaggcctgaagggctcacccggatctccgggtaataccggcctgccagggttccccggattcccaggcgcacagggggaccctgggctgaagggtgaaaagggagaaacgctccagcccgaaggacaggtaggggtgcccggagaccctggacttcgaggccaaccaggcaggaagggtctcgatgggatcccaggaactcccggtgtgaaaggtctgcctgggcctaaaggagaacttgccttgtctggagaaaagggtgaccaagggcctccgggagaccccggttctcctggatcacctggtccagctgggcctgccggaccccctggatatggcccacagggagagccaggtctgcaggggactcaaggagtgccaggggctcccggacctcccggtgaggcaggaccaaggggagagttatccgtgtccaccccagtgcccggtcccccagggccacctggcccacccggacatcctggacctcagggcccacccggtatcccaggatccctcggtaagtgcggggaccctgggctgcccggtcctgatggcgagcccggtattccgggaattggatttccaggccctccgggtcccaagggtgaccaggggttccctggaactaagggatccttgggctgtcctggaaaaatgggggagccaggattacccggaaaaccaggactgccgggagcaaaaggtgagccagccgtggcaatgcccggaggcccaggcacgcccggattcccaggtgaaagaggcaattctggtgaacacggcgagataggcttgccagggctgcccggtttaccaggcactcccggaaatgaagggttggacggccctaggggagacccaggccagccaggtcctccaggcgagcagggtccacctggccgatgcatcgagggacccagaggtgcccagggcctgccgggattaaacggcctgaaagggcaacaggggaggcgaggaaaaactggacccaagggggatcccggtattccaggactggacaggtccggattcccaggagaaactggtagccccggtatccctggacaccagggcgaaatgggacccctcggccagcgtggttatcctggcaatcctggaatcctgggacctcccggtgaagacggagtaatcggaatgatgggcttccctggcgcaatcgggccacctggacccccaggcaacccaggcacccccggacaaagaggctctccgggaatccccggagttaaagggcaacgcggaacacccggtgccaaaggggagcagggcgacaagggaaatcctggtcccagtgagatttcacatgtgatcggagacaaaggggaacccggtctgaaggggtttgcgggaaacccgggagaaaagggcaataggggcgtacctggcatgcctggtctgaagggactgaagggtctgccaggaccagcaggcccacctggcccacgcggagacctggggtctactgggaaccccggtgagccgggtttgagaggaatcccaggaagtatgggtaacatgggaatgccaggctctaaggggaagcggggtacattaggtttccccggacgggctggacgccctgggctgcctggcatccacggtctgcaaggagataagggggagccgggttattcagaggggactagacctggtccccctggacctacgggtgatcccggactgccgggtgacatgggcaagaaaggggaaatgggtcagcctggaccacctgggcacctgggtccggctggtcccgaaggagcgccaggttccccgggaagcccaggtctgcccggaaaacctggaccccacggagacctagggtttaaagggatcaagggtctacttggtccaccaggcatcaggggacctccgggactgcccggattcccaggttcacccggacccatgggcatccggggtgatcagggccgtgatggcatccccggacctgcaggcgaaaagggtgaaactggcctgctaagagcccctcccggtccccgaggcaatcccggagctcaaggagctaagggcgatcgtggagcaccaggttttccagggctcccgggtagaaaaggagccatgggagacgctggcccacgtggcccaaccggaattgagggcttccccggtccgcctggactcccaggtgccattattcctggtcagaccggaaatcggggaccaccaggatcaagaggttccccaggggctcccggtccacctgggccacccggatcccacgtgattggaataaagggtgacaaggggagcatggggcatccgggaccgaagggccctcccggaacagccggtgacatgggaccacccggacgcctgggtgcaccaggcacccctgggctcccaggacctcggggtgacccgggattccagggcttccccggagttaagggcgaaaaaggcaaccccggtttccttggctcaatcggtccccctggacctattgggccaaagggacctcctggagtgcgcggagatcctggcacgctcaaaatcatatctctgcctgggtcgcctggcccacctggtactcccggagaaccgggaatgcagggggagccagggccacctgggcctccaggcaacctggggccatgtggtcccaggggtaaacccggtaaagacgggaaaccaggcacacctggccctgccggagaaaaaggtaataagggttccaaaggggaacctggcccagcaggaagcgacgggttgcctggcctgaagggtaagcgaggagactcaggcagtcccgctacgtggactacaagggggtttgtgtttacacggcattctcagacaactgccattccctcatgtcccgaagggactgtacccctatattccggattcagttttttattcgtacagggcaatcaacgggcacacgggcaggatctcgatgctttattcgtaaaagttttgaggagtccctag

SEQ ID NO: 28091 - DNA, 4913 bp, Artificial Sequence
  Description of Artificial Sequence: Synthetic coding sequence
atgtccgccagaaccgcccctcggcctcaagtattattgctaccccttctgcttgttttactcgcagccgctccggctgcttcaaaaggctgcgtgtgtaaggataagggacagtgtttctgcgacggtgccaagggcgaaaagggagaaaaaggattccccggtccaccaggttcgcctggccagaagggattcaccgggcctgagggtttgcctggtccccagggccctaagtctttccgcgctatccccagttactccgggggaaagtccttgcaaggtatttcagggcttccgggtttttcagggagtccaggcctaccaggaactccagggaacaccggtccctacggcctagtgggagttccgggttgctccggctctaagggggaacagggctttccaggcctcccaggcaccttagggtatccgggtatcccgggtatccacaatctgaagatatttaagggagctcctgccaaggaagaggatattgagctcgacgcaaagggagacccaggcctgcccggtgcaccagggcctcagggcttgcctggaccgccaggcttccccggaccggtgggccctccaggacctccaggcttctttgggttccctggtgctatgggacccaggggaccgaagtcctttgtcctttctagccggattagtaccaagggcgaaaagggcgtgaagggattaaccggccctcccggaccgccaggaacagtgatagttacacttactgggcctgacaatcggactgaccttaaaggggaaaagggcgataagggagccatgggtgagccaggccctccagggccttccgggctcccgggagaatcgtatggaagtgaaaaaggggctcctggggatccagggctccagggtaagcccggaaaagacggcgttcccggttttccaggatctgaaggcgtgaaaggcaatcgagggttcccagggttgatgggcgaggacggtatcaaagaagagaaacgagacgtcgctatagtctcgttttcgagtaaaacagagtactacgatacctatcaggagaaaggcgatgaggggaccccaggcccacccggtcctagaggggcacgaggccctcagggtaagaataaattcaggtgtatcccgggtagtcagggttcttcccgaccaggactcaggggggcacccggatggccgggactgaaaggatcaaaaggtgagagagggcgacccggtaaggatgcaatggggaccccaggcagcccgggttgcgccggtagtccgggtctgccagggtcccctggccctcctggtcctcctggtgatattgtgttcagaaaaggcccacccggtgaccacgggctgccagggtaccttggatcccccggtatccctggagtagacggtccaaagggggaacccggtctgctttgtacacaatgcccctatattcctggccctccgggtctgcccggactacctgggctgcatggggtcaagggcatccccggtagacagggggcagccggtttgaaaggtagccccggatcccctggcaacacaggactgcccggtttccccggattccccggtgcccagggcgacccgggtctgaaaggagaaaaaggggagacactgcagcccgagggacaggtgggtgtacccggagatccagggctgcgaggccagccaggtaggaaaggccttgatggaattccgggaaccccgggagtaaagggactgcccggacctaaaggcgagctggctctgtctggagaaaaaggcgatcaagggcctccgggtgaccccggtagtccgggtagccccggtccagcgggtccggcaggacctcctgggtacggccctcaaggagagcctggtctgcaggggacccaaggcgtccccggagccccaggaccccctggagaggctggcccaaggggtgaactgtccgttagcactcccgtgcccggtccacctggtcctcctgggcctcctggccacccaggtccacagggaccacccggaatccctggatctttaggcaagtgtggggaccccggacttcccggtcctgacggggagcctggcatccctggaataggatttccgggacctcccggtccaaaaggcgatcagggattcccgggtacgaaaggcagcctgggatgtccaggtaagatgggagaaccaggtctccccggaaagcctggcctccctggggctaagggggaacccgctgtggcaatgccaggagggccaggcactcctggctttcctggtgaacgaggcaattctggcgaacacggggaaatagggttaccaggcctgccaggccttcctgggacacccggaaacgagggattggacggacctagaggtgacccaggtcagccaggtccccctggagaacaaggcccacccggacggtgcattgagggaccgcgaggggcacagggcttgccgggtctcaatggcctgaaaggccagcagggacggagaggcaagactggtccaaaaggcgatccaggtatcccaggcctggacagatcaggatttccgggtgagaccgggtcaccaggcatccctggacaccagggagagatggggccactggggcagcgagggtatccaggtaatcctggcatcttaggaccccctggcgaggacggagtgattgggatgatgggcttcccaggagcaatcggtcctccaggcccacctggtaatccgggtacccctggccaacggggaagtccaggcattccaggtgtgaagggacagaggggcacgcccggtgccaagggcgagcagggagataaaggcaatccaggcccttccgagatttcccacgttatcggagataagggtgagccagggctgaaagggtttgccggtaatccaggagaaaaagggaataggggggtcccaggtatgcccggtctaaaaggcctgaaagggttgcctggtcccgcaggccctcctgggcctagaggagacctcgggagtacaggaaatcccggagagccaggtctgagaggcatccctggatctatgggaaatatggggatgcccggttcgaaaggcaagaggggcacattgggattccctggtagggctggcaggcccggtctgcctggcatccatggcctacagggagacaagggggaacccggatattctgagggtacaagaccgggaccccctggcccaactggagacccgggattaccaggcgacatgggcaaaaaaggcgaaatgggccaacccggaccaccaggccacctgggaccagccggaccagagggtgcacccggttccccaggtagcccaggattgccaggcaaacccggtccccacggtgacctggggtttaaggggataaagggcttgctaggccctccagggattaggggcccaccgggtttacctggatttcctgggagccccggtcctatggggatacggggagaccagggacgggatggcattcctggcccagcgggagaaaaaggcgagactgggttgctcagggcacccccaggcccacggggaaaccccggagcccagggggctaagggagatcgaggagcgccagggttcccagggctgccgggtcgcaagggagccatgggtgacgctggccctaggggcccaaccggcatagaaggatttccaggtccacccggattgcctggggcaattatccccggacaaaccgggaaccggggacccccaggaagtcggggttctccaggtgcccctggcccacctggccctcctggaagccacgtgatcggcataaagggggacaaggggtccatgggccatcctgggccaaagggccctcccggtaccgcaggggacatggggccacccggacgcctgggagcgccaggcacaccgggactgcccggacctcgaggtgaccccggtttccaaggctttcccggagtgaagggggaaaagggaaatccaggcttccttggctctataggacctcccggaccaatagggccaaagggccctcctggggttcggggtgatcccggaacccttaagatcatatccctgccaggctcccccggacccccaggcactcccggagagcctgggatgcagggggagccgggacctccagggccaccgggaaacctgggcccatgcggaccccgaggtaagccaggcaaggacggcaaacctggaacaccgggaccagccggtgaaaaaggaaataaggggagcaagggtgagccaggccctgccggatcagatggtctaccaggactcaaaggtaagcggggtgatagtggttccccagcaacatggaccacaagaggttttgtgttcaccaggcatagtcagacaactgccattccatcttgtccagagggaacagttccattgtatagtggtttctccttcctgtttgtgcagggaaatcagagagctcatgggcaagatctgggaacgttggggtcatgtctgcagagattcaccactatgccctttctgttttgtaatgttaacgatgtttgcaacttcgcaagccgcaatgattacagctattggctaagcacccctgccttgatgccgatgaatatggcccctatcacagggagagcactggagccctacatatctcgatgtacagtgtgtgagggacctgctatcgccattgctgtccactcacagaccaccgatattccaccatgcccgcacgggtggatcagcctttggaagggttttagtttcattatgaaggcttatagcataaattgcgagtcctgggggatcaggaagaataacaagtcactgagcggcgtccacgaggagaagaccctgaagttgaaaaagaccgcagagctgctattcttcattctcaaaaacaaagttatgactgaacacgctgttattta

SEQ ID NO: 28092 - DNA, 4485 bp, Artificial Sequence
  Description of Artificial Sequence: Synthetic coding sequence
atgagcgccagaactgcaccaagaccacaggtgctcctcctccctctgctgttggtcctcctggctgcagcgccagctgcttcaaagggctgtgtgtgcaaggataaggggcaatgcttctgtgatggggcaaagggtgagaagggagagaaaggatttccaggccctcctggcagtcccggtcagaaaggttttaccgggcctgaaggtctgccgggacctcagggcccaaagagtttcagagctattccaagctattctgggggaaagagtctgcagggaatatcaggactcccagggtttagcggctcaccaggactgcctgggacaccaggaaacactggcccatacggactggtgggtgtgcctgggtgctcagggagtaagggggaacagggctttcctgggctaccagggacgttgggataccccggtatcccaggaatccacaacttaaagattttcaagggcgcacctgctaaggaggaagatatagagctggatgctaagggggaccccggactccccggagcccctggtcctcagggtttgcccggacccccaggattcccaggacccgtaggcccacccggtcccccaggattttttggattccctggagccatggggcctagggggccaaaatcttttgtgctgagctctagaatctccactaagggagaaaaaggcgtcaaaggactcactggcccacctggtcccccaggcaccgtcatcgtcaccctcaccggaccagacaaccgaacggacttaaagggggaaaaaggtgacaagggcgctatgggggagcccggtccccctgggcctagcgggttgccaggcgaaagttacggctctgagaagggggcaccaggagatccaggtcttcagggaaagcccggaaaggatggtgtccctggctttcccggttccgaaggagtcaaaggcaaccggggttttcctggcctgatgggagaggacgggatcaaggaggagaagagagacgtggctatcgtgagcttcagttccaaaacagagtattatgacacctaccaagaaaaaggtgacgagggaactcctggcccaccgggacctaggggagcccgtggccctcagggaaaaaataaattccgatgcatccccggatcgcaaggctcttctcgccctgggctgaggggtgcacccggatggcccggactaaagggaagcaaaggggagagaggcagacccggaaaggatgcaatgggaactcccggttccccaggttgcgctggttcccccggattaccaggcagccccggacctcctgggcctccgggagatatcgtatttcggaagggtcctccaggtgaccacggcctgccaggctaccttggatctcctggaatacccggagtggatggccctaagggagaacccggtttactgtgcacgcagtgtccatatattcctggaccgccaggactcccgggactgcccggactgcacggcgtgaaggggatcccagggaggcagggggctgccggattgaagggcagccctggctcaccaggcaacacaggactgcccggattcccaggatttccgggagctcagggagatcccggtctcaagggcgagaaaggtgaaactctgcaacccgagggccaggtgggtgtccccggagacccgggattaagggggcagcctgggaggaaaggattagatggaattccgggtactcctggcgtgaaaggacttccagggcctaaaggcgagctcgccctgagcggcgagaagggggatcagggccctcctggcgatccagggtctcccggatctcctggacccgcaggcccagcaggcccacctggatatggcccacaaggagagcctggcttacaaggaacccaaggcgttcctggcgcaccaggccctccaggtgaagccggtcctcggggagaattgagcgtatcaactccagtgcccggaccccctggaccaccgggaccaccaggacatccaggacctcagggaccccctggcattcctggtagtctgggcaagtgcggtgatccaggcttgccaggcccagatggagaaccagggattcctgggatagggtttcctggtcctcctggtccaaagggagaccagggcttcccaggcacgaagggaagtctaggatgccctggaaagatgggagagccaggactgccgggaaaacccggtctccctggcgcaaagggagagcctgcagtggccatgcccggagggcctgggacgcccggatttcccggagagaggggtaacagcggggaacacggcgagatcggcctccccggtttacctggccttccaggaacacctggcaatgaaggacttgatggtcctagaggcgacccaggccagcccggaccgccaggcgaacaaggaccgccagggaggtgcatagaggggcctcgtggtgcccaaggcttgcccggactcaatgggctcaagggccagcaaggcagaagaggaaagactgggccaaaaggggaccccggaatcccaggcctggacaggagcggattccccggagagactgggagcccagggatccctggccaccagggggagatgggccctctggggcaacggggatatccaggaaatcccggaatcttagggcctcctggagaggacggagtgattgggatgatgggctttccaggggcaattggccctcctggaccccctggcaaccccggtaccccaggacagcggggatcgccaggtatccccggagtcaaaggccagcgcggtacgcctggtgcgaagggggaacagggtgataagggcaacccgggaccttcagagatcagccatgttattggcgacaagggcgagccaggtctgaagggttttgcgggaaatccaggggagaagggtaataggggagtccccggaatgccagggttgaaaggactgaaaggcctgcccggacccgctggaccacccggtccacgaggcgacctagggagcacaggcaaccccggagagcccggtctccgcggtatccccggaagcatggggaacatgggaatgcccggaagtaagggcaagcggggaactctcggatttcccggacgagctgggcgtccagggctaccaggcatccatggtttacaaggcgacaagggcgagcctggttattctgaggggacacgcccaggtcctcctggcccaaccggcgatccgggactgcccggagatatgggtaagaagggagaaatggggcagcccggaccccctgggcatctggggcctgctggaccagagggtgcgccagggagccccggttcaccgggtctccccggtaaacccggtccacacggggaccttggcttcaaggggattaaggggctattgggcccacccggaataaggggtcctccagggctgccagggtttccagggtccccaggtcccatgggtatccggggagaccaggggagagacggcatccccggtcctgccggagagaaaggagaaactgggttactgagagcgccacccggtcctcggggaaatccaggggcacaaggggctaaaggggacaggggggctccagggtttcccggattgccagggcgaaagggggctatgggggacgcaggcccacgcggtcctactggaatcgaaggcttccctggtcctccagggttacctggtgcaatcattccaggccagacgggaaaccgcggtcctcctgggtctcgtggatccccgggagcacccggtccgccagggcctcctggcagccacgtgatcgggattaaaggagataagggatcaatgggccacccaggcccaaagggacctccaggcaccgctggcgacatgggcccacctggacggctgggcgcacctggtactcctggtcttccaggacccagaggggatccaggcttccaggggttcccaggtgtgaaaggcgagaagggcaatcccggattcctaggaagtatcggccctccgggacccatcggacccaagggccctcctggcgtgcgcggtgaccctggtaccttaaagatcatcagtctcccaggcagcccagggccacccggaactccgggagagccaggaatgcagggggaaccaggaccccctggtcccccagggaatctgggaccctgcggtccccgtggcaaaccaggtaaggacggcaaacccggaactcctggccctgcaggggagaagggtaataaaggcagtaaaggggagcccggacctgcaggtagtgatggccttccaggcttgaaaggcaagcgtggcgattcggggagcccagccacatggaccacacggggttttgtctttacaagacacagtcaaaccaccgcaattccaagctgtcccgaaggtaccgtcccgttatacagcgggttcagctttctttttgtccaagggaaccagcgggctcatggccaggaccttgagtctcttttccaccagctttag

SEQ ID NO: 28093 - DNA, 4275 bp, Artificial Sequence
  Description of Artificial Sequence: Synthetic coding sequence
atgtctgccagaactgctcctaggccacaggtgctgttgctgcccttactgctagttttgcttgctgccgctccagcagcctctaaggggtgcgtttgcaaggacaagggccagtgtttctgcgatggagctaaaggcgaaaaaggagagaaagggttccctgggccaccagggtctccaggccaaaagggcttcactggccctgaaggattgccgggaccccagggccctaagagcttccgcgctattccctcgtattctggcggtaaatcactgcaggggatatctgggctccccggattcagcggttcccccggactgccagggactcccggtaatacaggaccatatggcctcgtcggcgtccctggatgttccggatccaaaggtgagcagggtttccccggtctcccgggaacattagggtaccctgggatacctggcatccataacttgaaaattttcaaaggggctccagcaaaagaagaggacatcgaattagacgcgaagggggacccagggttacctggggctcctggcccacagggcttaccgggaccacctggtttcccagggccagtagggccacccggaccacctggcttcttcgggttccctggcgctatgggtccgaggggcccaaagtcgttcgtgctgtcaagcaggatctctacaaaaggggaaaaaggggtcaaaggattgactggcccacccggtcccccaggtacagtaattgtgacgctcacaggcccagataacaggaccgatctgaagggcgagaaaggcgacaaaggcgctatgggtgagcccggaccaccagggccaagcgggctaccaggagaaagttatgggtccgagaaaggggctcccggtgatcccggactccagggcaagcccggtaaggacggcgtgcccggatttccgggatcggagggcgttaagggtaacagaggattccccggactgatgggcgaggatggaatcaaggaagagaagcgagacgtcgcaatcgtcagcttctcgtcaaaaaccgaatattatgatacctaccaagagaagggtgacgagggtactcctggcccacccggtccaaggggtgccaggggcccacagggaaagaataaatttcgctgtatccctggctcacagggttcgtcccgtcctggcctgcggggtgcacccggttggcctggacttaagggttctaaaggagagaggggtcggccaggcaaagacgcaatgggcacgcctggaagcccaggatgcgcaggaagtcctggactgcccggttctccaggccctccaggaccaccaggagatatcgtgttccggaaggggcctcctggggaccatggactgcccggatacttgggtagtcctgggattccgggagtcgatggcccaaaaggggagccaggcctcctgtgcacacaatgcccttatattcctggcccacccggtctccccggtctgcctgggctgcatggcgtcaagggcatccccggtaggcagggagctgcaggactgaagggatcgcctgggtctcctgggaatactggcctacctggcttccctggattccccggagctcagggggaccctgggctcaaaggtgagaaaggggagacacttcaacccgagggacaggtgggggtccccggtgatcccggactccgtgggcagcctggacggaagggcttggacggcatccctgggactccgggagtgaaggggctgccgggacctaagggcgagctggcgctctccggtgagaagggagatcaaggaccgcctggcgatcctggctctccagggtccccgggacctgctggaccagcaggacctccgggttatgggcctcagggagagcctggcctgcaggggactcagggagtgcccggtgcccctggtccacccggagaggcaggcccacggggagagctatctgtttctacccctgtgccgggacctccgggtccacctggccctccaggccacccaggccctcagggccctccaggtattcccggaagtctagggaagtgcggcgacccgggattgccaggccctgatggagaaccaggaatccccggaattggcttccctggccctccgggtccaaaaggagaccaaggttttccaggcactaaaggttcactgggatgtcccggtaagatgggggaacccggtttgcccggtaagccaggtcttccgggagcgaagggagagcccgctgtggccatgcccggaggccctggcaccccaggctttccaggagagagaggcaacagtggagaacacggagaaatcggcctgcctggccttcctgggttacctggtacccctggaaacgaaggtttggacgggcctcgtggtgaccccggacagcctgggccacccggagaacagggccctccgggtcggtgtatcgaaggaccacggggagctcaaggcctgcccggtttaaacgggcttaaaggccagcagggaagaagggggaaaaccggtcccaagggagaccccggaatccctggcctcgacagaagcgggtttcccggtgaaactggctctcctgggatcccaggccaccagggcgagatggggccactgggacaacggggatatcccggtaaccccggtattctggggccaccaggtgaagatggcgtcatcggcatgatgggtttcccaggagctatcggcccacctgggccaccaggcaacccaggaacccccggtcagcggggtagcccaggaatccctggcgtcaaaggtcaacgcggtacacccggagcgaaaggggaacagggagacaaaggaaaccctgggccttctgagatttctcacgtcatcggagacaaaggcgagccaggcctcaagggatttgctggcaacccaggagagaaaggcaacagaggggtccccggaatgccgggacttaaaggactgaaagggctgcccggtccagccggaccaccagggccacgcggagacctcggctctacgggaaacccgggtgagccaggactccgaggcatccctggttccatgggaaatatggggatgccaggcagcaaggggaagcggggaacacttggattccccggtcgggctggtcgcccaggccttcccggtattcacgggctgcagggcgacaagggagaacccggatatagtgagggcacccgcccagggcctcccggacctacaggagaccccggtctgcccggagacatgggcaaaaaaggagaaatggggcagcctggcccacccggacatctggggcctgcaggccctgaaggggctcccggaagcccaggttcccccggattgcctggcaagccaggtcctcacggggatcttggatttaaagggattaaaggcctccttgggccaccgggaatcaggggaccaccaggtttgcccggatttccgggtagccccggacctatgggtattcggggtgatcaaggcagagatgggattccgggacctgccggagaaaagggggagactggccttcttagagccccacctgggcctcgagggaatcccggagcccaaggggctaaaggcgaccggggtgcgcctggcttccctgggctaccaggccgaaaaggtgcaatgggggacgcagggcctcgcggtccaaccggtatcgaaggattccctggcccacccggactgcccggagccatcattccaggccagacggggaataggggacctccgggttctagaggatcccctggagctcctggtccacccggacccccaggttctcacgtgattggaattaaaggagataaggggtctatgggacatcctgggccaaaagggcctccgggaacggctggggacatgggtccccctggccgactcggtgcccctggtacacccggtttgcctggacctagaggagacccaggatttcaaggcttcccaggtgtcaagggcgagaaaggaaatcctggatttctaggctcaatcggacctcctggacccatcggcccaaaagggcctcctggagtgcggggagaccccggaactctcaagattatatccttacctggaagtccgggacccccaggtacccctggggaacccggtatgcagggggaaccaggtcctccgggtccccctggaaacctaggaccttgtggccctagaggaaagcctggaaaggacggcaagccagggacccctggtcccgctggagaaaaaggcaacaaaggaagcaagggtgagcctgaatctctgtttcatcagctatag

SEQ ID NO: 28094 - DNA, 5012 bp, Artificial Sequence
  Description of Artificial Sequence: Synthetic coding sequence
atgagtgccagaactgccccacgtccccaagttctgcttcttcctctacttctcgtgctgctcgcggcagcgccagccgcttccaaaggatgcgtgtgcaaggataaggggcagtgcttttgtgacggtgccaaaggtgaaaagggagaaaagggattccccggtccgcctggcagtcccggtcagaaagggtttacgggacccgaaggccttcctggaccacaagggccaaagggttttccaggtctacctggcctgactggctcgaagggtgtaagaggtatctccggattacctgggttctccgggtccccaggcctcccaggaacacccggaaataccggtccctacgggctggtcggcgttccgggttgttctgggtcaaagggggagcaaggcttcccagggcttcccggtaccctggggtacccagggatcccgggtgcagcaggcctgaaaggacagaagggagccccagccaaggaagaggacattgaacttgacgctaagggggacccaggccttcctggagccccaggccctcaggggctgcccggacccccaggcttccccggaccagtgggtcccccagggccacccggatttttcggatttccaggtgctatgggaccacggggtcctaaagggcacatgggcgaacgggtgattggtcacaagggagaacggggagttaaaggactgaccgggccacccggaccgcctggcacagtcatcgtgacactgacaggccctgacaatcgcaccgatttaaagggagaaaaaggcgacaagggagctatgggagaacctggacccccaggcccatccggactccccggagaatcttacggaagtgaaaagggcgctccaggtgatcccggtctgcagggaaaacccggaaaggacggagttccagggttcccgggttccgagggggtcaagggaaatcggggatttccagggttgatgggagaggacgggattaaagggcagaagggagacattgggccaccgggattccgcggacctactgaatactatgacacctatcaggagaagggagacgagggaactccagggccaccaggaccacgcggtgcacgcggtccacagggcccttctggacccccaggagttcctggatcaccaggatcaagtaggcccggactgcgcggagccccagggtggccagggttaaagggatcaaagggggaacgcggtaggccgggtaaagatgccatgggcacaccaggcagccctggttgtgcgggatcccctggactcccaggatcacccggaccccctggccctcctggggatattgtctttcggaaagggcctccgggtgaccatgggctcccgggatatctaggctcgcctggtatccctggcgttgatgggccaaaaggggagcccggtctgctttgcacccaatgcccctatataccaggtcctcccggactccccggattacccggactgcacggtgttaagggaattcccggtaggcagggcgcagccggtctgaagggttcacctggttctcctggcaatacaggcctccccggattcccgggttttccgggtgctcagggggatccaggcctgaagggagagaagggtgagaccctccaacctgaagggcaagtgggcgtaccaggcgatccagggctgaggggtcaaccaggacgcaaaggtcttgacggcatcccaggaacgccaggggtcaagggtctcccagggcctaagggcgaattagccctttccggagagaagggggatcaggggccaccaggagaccctgggagtccaggctcacctggacccgctgggccagccggacccccaggatacggcccacaaggcgagcccggattacagggaactcagggggtgcctggggctccaggccctcccggagaggcaggacccagaggggaattatctgtgtcaactcctgttcctgggccacccggacctcctgggccaccaggtcacccgggaccgcagggaccacccggaattcctgggagtcttggaaagtgcggggaccccggactccccggtccagatggcgaacctgggatccccggtataggattccctgggcctcccggtcccaaaggggatcaggggttccctggcaccaagggctccctagggtgtccaggcaaaatgggagaacccggactgcctggtaagcctggccttcccggtgccaagggagagcccgcagtcgccatgcccggtggcccagggacacctggcttcccgggtgaacgcggaaatagtggcgagcatggtgagatcggcctgcccggattgcccggtctccctggtactccgggaaatgaggggcttgatggaccgagaggtgatcccggtcagccaggacctcctggcgagcaaggcccacctggcaggtgcatcgaaggccctaggggcgctcagggcttgccgggtctgaatgggctgaaaggacagcagggaagaagaggcaagacaggaccaaaaggtgacccaggcatccccggtctcgatcggtccggctttcccggtgagactggtagccctgggatcccgggtcaccagggggagatgggcccactagggcagaggggatatcctggcaatccgggtatcctgggaccccctggggaagatggagtgattgggatgatgggttttcccggagccattggccctcccggaccccctggtaatccaggcacccctggacaacggggttccccgggaatccccggagtcaaagggcagcgcggaacacctggcgctaagggcgaacagggggacaagggaaatcctggtcctagcgagatttcccacgtcattggggacaagggtgaacccggactgaaaggctttgcaggcaatcctggagaaaagggaaatcgcggagtgccgggaatgcctggcctgaaaggcctgaagggcctgcctggtcctgccggaccgcctggaccaaggggggatctgggaagtacaggaaatcctggggagcctggcctcagagggataccaggctctatgggtaatatgggaatgccaggctcaaagggaaagagggggacactcggctttcctgggcgagcaggtaggcctggactgcctgggattcacggactgcagggcgacaagggggaacctggatactcagagggcacccgacctggtccaccagggcctacaggtgatccgggtttgcctggcgatatgggcaagaaaggagaaatggggcagcctgggccaccagggcatcttgggcctgcgggtcccgagggcgctcccggaagtcctggctcaccgggtctgcctggcaagcccggtccccacggggatctgggtttcaagggcattaagggactgctgggcccaccaggtatcaggggtccccctggcctgccgggattcccgggatctcccggtcctatgggcataagaggagatcagggcagggatggaattcctggacctgctggagaaaagggggagaccggcctcctgagggcacctcctggtcccaggggaaaccccggagcccagggggcaaagggggaccgaggagctccaggtttcccaggactgcccggtagaaagggtgctatgggagatgcaggcccaaggggtccaactggcattgaggggttccccggtcccccaggtctgcccggtgcaatcattccaggtcagacggggaaccggggacccccaggatcgcggggatccccaggcgcacccggtcctccgggtccaccgggttcccacgtaatcggcattaagggagacaaaggaagcatgggccaccccggtcccaaagggcctccgggaacagcaggcgacatgggccctcctgggagactaggggctccaggaacacctgggttgcctggtcccagaggtgaccccggattccaggggtttcccggagtgaaaggtgagaaaggcaatccaggctttttgggctctattggcccaccaggtccaataggcccaaagggcccaccaggcgtgaggggagatccaggaaccttaaaaatcatttccttgcctggttcccctggccctcccggtacccctggcgagcctggaatgcaaggtgaacccggaccgcctggtccccctgggaatctaggaccatgcggtccacgcggtaagccgggtaaggatgggaaaccaggtactcctggtccggcaggagaaaagggaaataaaggctcaaaaggggagcctgggccagccggaagcgatggtctcccaggactgaaaggtaaaaggggtgacagcggaagtcctgctacatggaccacacgcggatttgtctttactagacacagtcagactactgcaattcctagttgcccagaggggactgtccctctttacagtggcttctcatttcttttcgtgcaaggcaatcagagggcccacgggcaggacctgggcactctgggatcctgtctgcaaaggtttacaactatgccatttctcttctgtaatgtcaacgatgtctgtaacttcgcaagtcgtaacgactatagctattggctatcgactcctgccctgatgcctatgaacatggctcccataacagggagggctttggagccctatatcagtcgttgtactgtgtgtgagggccctgctatcgctatagccgtccatagccagactaccgatattcccccttgcccccacggttggataagcctttggaaggggttttctttcatcatgttcactagtgctggctcagagggcaccgggcaggccctggcttcacccggttcttgtctggaggagttccgggcttccccgtttttggagtgccacggtaggggcacctgcaactactattcgaatagctattctttctggctggcctccctaaaccccgagaggatgttcaggaaacctatcccatccaccgtaaaagccggtgagctggagaagattatttcccggtgccaggtatgcatgaaaaagcggcatta

SEQ ID NO: 28095 - DNA, 4500 bp, Artificial Sequence
  Description of Artificial Sequence: Synthetic coding sequence
atgatggcaaactgggccgaggcccgaccactgttgattctaatagtgttacttgggcaatttgtctctattaaggcccaggaggaagatgaagatgagggctacggagaggagatcgcatgcacccagaacggccagatgtatctgaatagggatatttggaaacctgctccctgccaaatttgcgtctgtgataacggcgcaatactatgtgataaaatcgagtgtcaagacgtgctcgactgtgccgaccccgtgacgcctcccggagagtgctgccctgtctgttctcagactcctgggggtgggaacaccaatttcggaagaggcaggaaaggtcagaaaggggaaccaggcttggtgccggtggtgaccgggatccgcggaagacccggacccgctggcccacctggctcacaagggccaaggggggagaggggaccaaagggtcgcccaggtcctagaggtccccagggtattgacggtgagcccggagtcccagggcagcctggagcacccggacccccagggcatccctcgcacccgggtcctgatggtctgtctcggcctttttcggcccagatggctggcttagacgaaaagtctggattgggatcacaggtgggattgatgcccggaagcgtgggacctgtcggaccaaggggacctcagggcttgcaggggcagcagggcggagcgggtcccacagggccaccaggagagccaggggatccgggtcccatgggccctatcggcagccgtggacccgaggggccaccgggaaagcctggagaagatggggagccagggagaaacggcaatcctggcgaggttggattcgcaggcagtccgggtgcgagaggattccctggcgctcctggactgcctggattaaaaggccacagaggtcacaaggggctggagggccctaaaggcgaagtgggcgcaccaggatctaaaggtgaggcagggccaactggccctatgggcgcaatgggcccattggggccaagaggtatgcctggcgagaggggcagactcggtccacagggggcaccgggtcaacgcggtgcccacgggatgcctggaaagccaggccctatgggccctctggggatccctgggtccagtggctttcctggaaaccccggaatgaaaggcgaggctggccctacaggggcacggggacctgagggacctcaggggcagagaggtgaaacaggaccaccaggtccagtcggatccccaggtctgcccggtgccattggcactgacggaacgccgggagctaaaggccctactgggtctcccggaacctcaggccctccaggcagcgcaggacctcctggctcgccgggaccacagggctctacaggaccgcaggggatcagaggtcagcctggtgatcccggtgtacccggattcaagggggaggctggcccaaagggagagccaggtcctcacggtatacaggggccaattggccctcctggggaggagggaaagcgcggacccagaggcgatcccggtaccgtgggcccaccaggccctgtcggggagcgtggcgcacctggcaaccgaggattccccggaagcgacgggctccccggtcccaaaggagctcaaggggaaagggggcctgttggctcctccgggcctaaggggtctcagggcgatcctgggcgacccggtgagcccggtcttccaggtgcccgtggcttaacggggaacccaggggtccaagggcctgaaggaaagctagggccactaggcgcaccaggcgaggacggacggcctggacccccaggctctatcggaatccggggacagcctgggtctatgggattacctggtcctaaaggtagttctggcgatcccggtaagcccggagaggcaggaaatgccggtgttccaggacagaggggcgcacctgggaaagacggggaggtcgggccaagtgggccagtaggcccacccggactcgctggcgagcgcggtgaacagggccctcctgggcctactggctttcagggcctgcctggaccgcctggcccaccaggcgaggggggtaagcctggcgatcagggagtgcccggtgatcccggtgcggtcggcccattaggacccagaggcgaaagagggaacccaggtgagcgaggagagcccggtattacggggctgcctggtgagaaaggaatggctgggggacacgggccagacggtccaaaaggttcacccggaccctctgggacccccggtgatactggcccaccgggtcttcagggcatgccgggagaacggggaattgccggaactcccggacccaagggtgatcggggtggtattggagagaaaggcgcagaggggaccgctggcaatgatggggcaagagggctgcccggtcccctcggaccgccagggcctgcaggccctacaggggagaagggcgagcccggtcctaggggcctggtaggaccccctggctccagagggaaccctgggtctcgaggtgagaacggacccaccggcgcagtcgggttcgctggtcctcagggtccagacggacaaccaggagtgaagggtgaacctggcgaaccaggacagaagggcgacgcgggatctccaggcccacagggattggcagggagtcctggcccacacggaccaaatggtgtgcctggtcttaagggagggagaggcacacagggacctccaggggctactggattccctgggtccgccggtcgtgtggggcctcctggcccagccggtgcacctggccctgctgggcctcttggcgagcccggaaaggaggggccacccggtctcagaggcgaccccggatcgcacgggcgtgtgggcgaccggggacctgccggtcccccaggaggccctggcgacaagggggaccccggagaggacggccagcctggacccgatgggccaccagggccagctgggactactggacaaaggggaatcgtcggtatgcctggacagagaggcgagaggggcatgcccggtctaccaggacccgctgggacgcctggaaaggtgggccctaccggagccaccggcgataaaggtcctccaggacctgtcgggcctcccggaagcaacggtcccgtaggagaaccgggaccagagggcccagccggaaatgacggcacccccggtcgggacggcgcagtcggcgagaggggggaccgtggggatcctggtccagccggacttcctggctcacagggtgcccctggaacacccggtccagtcggcgctcctggggatgcgggacagcgaggagaccccggtagtcggggtcctattggtcccccagggcgagccggtaagagaggcttacccggaccgcaaggcccacggggagacaaaggcgatcacggggaccgcggagacagggggcaaaaggggcacaggggctttacagggctgcagggactccctggccctcccggtcccaacggggagcaaggatctgcgggtatccctgggccttttggcccacgcggaccacctggcccagtcggcccaagcgggaaggaaggtaatcccggtccgctcgggcctatcggccctccaggcgtgcgtggctctgtaggtgaagccggacccgagggcccacccggagagcccggaccacccggtcccccaggacccccaggccacctgactgcagcccttggggacatcatggggcattatgacgagtccatgcctgatcctttgcctgaatttactgaggatcaggcggctccagacgataagaataagactgacccaggagtgcacgcaactctgaaatctctctcatcccagatagaaaccatgagaagccccgatggcagcaaaaaacaccccgctagaacgtgtgatgacctcaagttatgccatagcgccaagcagagtggtgaatactggattgatcctaatcaaggttccgtcgaggatgcaattaaggtctattgcaatatggaaactggagagacctgcattagcgcgaatccttcctccgtgccaaggaagacctggtgggcttcaaagagcccagacaataagccggtctggtatggcctcgacatgaatcgagggagtcaatttgcatacggtgaccaccaatcgccaaatactgccataacacagatgacatttctgcggctgctttcgaaggaagccagccagaatattacttatatctgtaagaattccgttggatatatggatgaccaggcaaagaatctaaagaaggccgtcgtcctgaagggggcaaacgaccttgacattaaggctgaagggaatattcgatttcggtacatcgttcttcaggatacttgtagcaagaggaacggaaacgtcgggaagacagtctttgaataccgtacacagaacgtcgcacggctcccgattatagatctggcaccagtagacgtcggcggaactgaccaagaatttggcgtggaaattggtcccgtatgcttcgtgtag

SEQ ID NO: 28096 - DNA, 3420 bp, Artificial Sequence
  Description of Artificial Sequence: Synthetic coding sequence
ctgcctggccgtaggcaccgactgggaccacctggatctcagggccctagaggggagcggggacccaaggggaggcctggtcccagagggccacaaggcatcgacggcgaaccgggtgtgcccggacagcccggagctcctgggggtgctggtccgacaggtccacccggagaacctggcgaccccggaccaatggggccaatcggctcacggggaccagaaggaccgccaggcaaacccggagaggacggtgagcccggaagaaatggtaaccccggtgaagtgggctttgcagggagtcccggtgcaaggggattcccaggggctcctggcctgcccggtttgaaagggcacagaggacacaaaggactggaaggacctaagggtgaagtgggggcaccaggttccaagggggaggccggtccgactggcccacgcggtgacccgggtacagttggcccacccggtccggtgggagaaagaggagcaccaggtaaccgcggatttcctgggtctgacgggcttcccggacccaagggtgctcagggcgagagggggccagttggctcctccggccctaaaggcagtcaaggggatcctgggagaccaggcgagcccggtctcccaggagccagaggtttgacaggtaacccaggcgtgcagggtcctgaaggcaagctgggacctttgggagcccctggagaggacggcagacccggtccacccggaagtatcgggattcggggacagccagggtctatgggactgccaggccctaagggctcttccggggaccccggaaagcccggtgaggccggtaacgccggagtgcctgggcagcgcggagcgccaggtaaagacggagaggtgggcccatctggtcccgtgggccctccaggccttgcgggagagagaggcgagcaagggccacctgggccaaccggctttcaaggtctgccaggcccacctggaccgccaggagagggaggcaagcccggtgaccaaggagtgcctggcgatccaggagccgtgggcccactcggcccacgcggtgaaagaggaaaccccggagaacggggagaacccggtataaccggtctccccggagaaaaggggatggcaggcggtcacggtccggacggtccgaaaggatctcctgggccatctggtacccctggtgacaccggccctccaggtctacaaggaatgcccggagaaagaggcatcgcaggtacaccaggccctaaaggcgaccgcggtggcattggggagaaaggcgctgaaggcactgcgggtaacgatggcgcacggggactgccgggaccattggggcctcccggtcctgcgggtcctaccggcgaaaaaggggaacccggacctcgtggcctcgtcggacctcccggttctcgaggcaatccaggaagtcgaggagagaacggcccaacaggggctgtcggatttgctgggccacaaggccctgatggacagcctggggttaagggagaacccggagagccaggtcagaagggtgacgctggctcccctggccctcagggtcttgctggcagtccagggcctcatggccctaatggtgtcccgggactgaagggcggtaggggtacccaaggccctcccggtgcaactggatttcccggtagcgctgggagggtggggccaccaggccctgctggggctccaggccctgctgggcctctgggcgaacctggaaaggagggaccaccaggactgagaggggacccgggaagtcacgggagagtcggcgacaggggcccagcgggaccacctggcggacctggggacaaaggcgatcctggggaggacggccagccagggcctgacggacctcctggacccgcaggaaccactgggcaacgcggtattgtgggcatgcctggtcagagaggggagaggggtatgcccggacttcctgggcctgcgggaaccccaggaaaagtagggccaaccggtgcaaccggagacaagggacctccaggtcctgtgggaccaccagggagcaatggccctgtgggggagccagggcctgaggggcctgccggtaatgatggtactcctgggcgtgacggcgctgtaggcgaacgaggagatagaggtgaccccggacctgccggtcttccgggatcccagggcgctcccggaacccctggacctgttggggcaccgggagacgcaggccaacgaggggatcctgggagtagaggacctatcggacccccagggagggccggtaagaggggcctcccaggaccgcagggacccaggggggacaaaggggaccatggggatcggggagataggggacagaagggacacagaggcttcactgggcttcaggggcttcctgggcctccgggtccgaatggtgagcagggttctgccggtatcccaggccctttcggaccccgagggccacctgggccagtgggaccttcaggaaaggaaggcaatcccggtccccttggaccaatcggccctccgggagtgagaggatctgtgggtgaggcaggccctgaagggcctcccggtgagcctggaccgcctggccctccaggacccccagggcatctaacggctgccctgggggacatcatggggcattacgatgagtctatgcctgacccactgccagaattcaccgaggaccaggctgcccctgacgataagaataaaaccgaccctggcgtgcacgctactctgaagtccctgagctcacagattgagacaatgaggtcacctgatggctcaaagaagcaccccgctcgcacttgtgatgacctgaagctgtgtcacagtgctaagcaatccggagaatattggattgatccaaatcagggcagtgtggaagacgccataaaggtgtactgcaacatggaaacaggggaaacctgcatctccgctaacccatcgtccgtaccaaggaagacctggtgggcttccaagtcacctgacaataaacccgtctggtatgggctggacatgaatcggggtagccagttcgcatatggagaccaccaatcacccaatacagccattacccagatgacattcttgagactgctcagtaaggaagcatcacagaatatcacctatatatgtaaaaatagcgtgggttatatggatgaccaagccaagaacctgaagaaagccgttgtactcaagggcgctaacgatctggacattaaggccgagggcaacatcaggtttaggtacatcgttttgcaggatacatgttccaaacggaacggcaatgtcggcaagaccgtctttgagtaccgtacccaaaacgtcgctcggcttccgatcattgatctggccccagtagatgttggaggtactgaccaggaattcggggtggaaatcggccctgtctgcttcgtttag

SEQ ID NO: 28097 - DNA, 5304 bp, Artificial Sequence
  Description of Artificial Sequence: Synthetic coding sequence
atggaaccttggagcagtagatggaagaccaagaggtggttgtgggatttcactgtaacaacactcgcgttgaccttcctctttcaggccagggaagtgagaggagcagctcccgtcgatgttctgaaagccttggacttccacaacagccctgaaggcattagcaagactaccggtttctgcacgaaccggaagaactccaagggctcggacaccgcttaccgcgtatctaagcaagcacagctctctgctcccacgaaacagttgttcccgggagggacattcccagaggatttttctatactattcactgtcaaaccaaagaaggggatccaatcctttctcctgtcaatctataacgagcacgggatccagcagataggagtcgaagtgggtcggagtcctgtgttcctgttcgaggaccacacaggtaagcccgctcctgaggactaccctctgttcagaactgtaaatatcgctgatgggaaatggcaccgcgttgccatctccgtggaaaagaagacagttaccatgatcgtggattgtaagaagaaaactacaaaacccctcgaccggtctgaacgagctatcgttgacactaacgggattaccgtgtttgggacaaggatcctcgatgaagaagtgttcgagggcgacattcagcaattcctgattaccggagacccaaaagccgcttatgattattgtgagcactattcgcccgactgtgacagtagtgcgcctaaggccgctcaggcccaggagcctcagatcgatgaggccaatatcgtggatgacttccaggaatataactatggcaccatggagagctatcagacggaagcgccacgccatgtcagcgggacaaatgagccgaaccctgtcgaggagatctttacagaggagtatttgacgggtgaagattacgattcccagcgaaagaactccgaagatactctctatgagaacaaagagattgatggccgtgatagtgacctcctggtcgatggtgatctgggagagtatgatttttatgagtataaagagtacgaagataagcccacaagcccacctaatgaagagtttggacccggtgtgcctgccgaaaccgatataactgagacatctatcaacggacacggggcatatggggagaaaggacagaagggcgaaccagccgtggtggaacctggcatgctggtagagggaccgcctggtcctgccggtccagcaggcattatgggtccccctggcctgcaggggcctaccggacctccaggtgatccaggcgaccgaggccctcccggacgtcccggactgcccggagctgacggcctccccggaccccctggcaccatgctcatgttgccattccgctacggcggtgatggttctaaaggtcctactataagcgcgcaggaggcccaggcccaggctatcctccagcaagctcggatagccctccggggacccccaggacccatggggttgacagggcgaccgggacccgtaggtggcccaggctcctcaggtgcaaagggtgaaagcggcgatcctgggccacagggccctaggggcgtgcagggccctcctgggccaactgggaaaccaggtaagcgtggacggccaggtgcagatggcggaaggggaatgcccggagagcctggtgctaaaggggacaggggcttcgatggcctcccaggccttcctggtgataaggggcataggggtgaaaggggtccccagggccctccaggtcctcccggtgatgacggtatgcgaggggaagacggagagatcggaccacggggactgccgggagaagccggaccaagaggcctgttgggccctcggggaacaccaggcgctccaggccagcccggtatggcaggcgtcgatggccctcccggtccgaagggaaatatgggtccccagggggagcctggtccacccggacaacagggcaaccctggaccccagggactcccaggtccccaggggcctatcggtccacccggagaaaaaggtccacaaggcaagcctggccttgctggacttccgggagctgacgggccaccaggccacccaggtaaggaaggccagtccggagaaaagggggctctcggccctcccggtcctcaaggacccattggctatccagggccacgcggagtgaaaggcgcagacggagtgcgcggtctgaagggcagtaagggagaaaagggtgaggatgggttcccgggattcaaaggggatatgggacttaaaggcgaccgtggcgaagtgggccaaattggtccacgtggcgaggatggccctgaaggacctaagggtcgcgctggacccacaggggatcctggccctagcggccaggccggagagaaaggcaagctgggggtacctggcctacctggttatccgggtcggcagggcccaaaaggaagcactgggtttccaggatttccaggagccaacggtgaaaaaggtgccagaggggttgcaggaaaacccggacccagggggcagcgcggacctaccgggcctagagggtcccgcggagccagagggccaaccggaaagcccggtccaaaaggcaccagcggtggggacggcccaccaggtccacctggcgaaagaggtccacaagggccacaaggacccgtaggcttccctggccctaaagggcctcccggaccaccgggaaaagacggcctgcccggacacccaggacaacgtggtgagaccggatttcaagggaagaccggaccaccgggtccagggggagtggtaggccctcaggggcctactggcgaaacaggccctataggggagcggggacatccgggtccaccgggacctccaggtgagcagggcctccccggtgccgctggcaaggaaggggctaagggcgaccccggtccacagggcatttcagggaaagatgggccagccggtctgcggggatttccaggagagcgcggactacccggagcacagggcgctccaggactgaagggcggtgaggggcctcagggtccgcctggccctgtcggcagccctggggagagaggtagcgctggcacagctggcccaatcggcctgcctggcagacccggacctcaggggcctccaggccctgctggagaaaagggggcacctggcgagaagggacctcagggaccggcaggaagggacggggttcagggtccagtgggcctgccaggaccagctggtcccgctgggagccccggtgaggatggggacaaaggtgaaataggcgaaccaggccagaagggcagtaagggtgataagggcgaaaatgggcctccaggtccaccgggacttcaggggccagttggggctccaggcattgctgggggagacggagaacccggaccgaggggacagcagggcatgtttggccagaaaggggacgaaggagcaaggggctttcctgggccacccggaccaattggcctgcaggggctcccaggtccgcctggcgaaaagggagagaacggcgacgtgggccctatgggcccaccaggcccacccggacccaggggacctcagggacccaatggggctgatggtccacaagggcctcccggaagcgttggcagtgtgggaggcgtcggggagaagggcgagccaggtgaggccggaaaccctggcccacccggagaagccggtgtaggcggacctaagggagaacgtggcgagaaaggggaagctggacctccaggcgcagccggaccacctggcgcaaagggaccacccggtgacgatggccctaagggaaacccaggcccagtgggctttccaggagatcccggtcctccaggggaacccggacccgctggccaggacggggtaggaggagacaaaggcgaggacggcgatcccggtcagcctgggccaccgggaccttcaggagaggccggacctcccggtccacccggaaagcgcggaccccctggcgcagctggagccgagggccgacaaggtgagaagggagccaagggagaagctggagctgaggggcctcccggaaaaaccggacctgtgggaccacagggcccagctggaaagccaggcccagaaggcctccgcggtatcccaggtcccgtgggtgagcaggggcttcctggggctgctgggcaggatggaccacctggcccaatgggcccaccagggctgccgggacttaaaggggaccctggatctaaaggggagaaaggccatcccggtctcataggcctcataggacccccaggagaacagggcgagaagggcgatcgtgggctgcctggaacacaggggtcccccggagcgaagggagatgggggaattcctgggcctgcgggtcccctgggcccaccgggacctcccggactacctggccctcagggcccaaaagggaacaaagggtctactgggccagccggacaaaaaggtgacagtgggctgcccggaccacctggatcccctggccctcctggagaagtgatccagccgctcccaatcctcagctcaaaaaagacccgtagacacaccgagggtatgcaggcggacgctgacgataatatcctagactactctgacggcatggaagaaatcttcggcagcctgaactccctgaaacaggacattgaacacatgaaattccccatgggcacacagaccaatcccgctcggacctgcaaggacctccaactaagccaccccgatttccccgacggagaatactggatcgacccaaatcagggttgcagtggagatagctttaaagtgtattgtaactttacgtccggcggtgagacatgcatttaccctgataaaaagtctgagggagtgcgaatctccagttggcccaaagagaagccgggatcatggttctccgaatttaaacggggaaaattattgtcgtacctggacgtggagggaaattctataaatatggtccagatgaccttcttaaagctgttgacagcgtccgccaggcaaaactttacctatcattgtcaccagtcagcagcatggtacgacgtgtcttcgggaagctatgataaagccctacgatttcttggttccaatgatgaagagatgtcctacgataacaatccatttataaaaaccctctacgatggatgcgcatccagaaagggatacgagaaaaccgtgatcgagattaacaccccaaaaatcgatcaggtgcccattgtcgatgtgatgatcaatgactttggggaccagaatcaaaagtttggctttgaggtgggacccgtatgttttctaggctaa

SEQ ID NO: 28098 - DNA, 5456 bp, Artificial Sequence
  Description of Artificial Sequence: Synthetic coding sequence
atggagccttggtcatcacgttggaagacaaagagatggctgtgggattttactgtgacaacactggcacttacatttctgtttcaggccagggaggttaggggcgctgcgccagtggacgtcttaaaagctctcgattttcataattcccctgaaggaataagcaagaccacgggcttttgtaccaaccggaagaacagcaaagggtccgatactgcttacagggtcagcaaacaggcccaactgagtgctcccaccaaacaactcttcccaggtggcaccttccctgaagatttcagtatcctgttcaccgtgaaacctaagaaggggatccaatcgttcctgctgagcatttacaatgagcacggtatccagcagatcggagttgaggtaggacgctcgcctgtgtttctttttgaggaccatactggcaagccagctcctgaggattatccactatttcgcacggtcaatattgccgacggcaagtggcaccgggtggcgatctcagtcgagaaaaagacagttaccatgattgttgattgcaaaaaaaagactaccaaacctttagataggagtgagcgcgcaattgtggacacaaatggcattactgttttcgggactcgaatcctggatgaagaggtgttcgaaggtgacattcagcagtttctaatcaccggcgaccccaaggccgcatatgactactgtgagcactattcaccagattgcgactcttctgccccaaaagccgctcaggcccaggagccgcagatcgatgagaaaaagaaatccaactttaaaaagaagatgagaaccgtcgccaccaaatccaaagaaaagtccaaaaagttcacgccacctaagtcagaaaaattttcctcaaaaaaaaagaaaagctaccaggcctctgctaaagccaagttaggagtgaaggcaaacattgtagacgattttcaggagtataactatggtactatggagtcttaccagacagaggccccaagacatgtgtcaggaacaaatgagccaaacccggtggaagagatattcaccgaggagtatttgaccggcgaagactatgattcacagcgcaagaattcggaggatactctctacgagaataaagaaatcgacggaagggactcagatctgcttgtagatggcgatctgggcgaatatgacttctatgaatataaggaatacgaggacaaacctactagcccacccaatgaggaattcggacctggcgtgccagccgagaccgacattaccgagacaagtatcaatggccatggggcatatggcgagaaaggccagaagggcgagcccgctgtggtagagcctgggatgctcgtcgagggtccaccagggccagcaggaccagctggcattatgggaccacccggactgcaggggccaacgggcccacctggcgatcctggcgaccgagggccacctggcagaccgggattacccggtgctgatggcctccctggaccaccgggtacgatgcttatgctgccctttcggtatggcggagacggatcgaaaggccctacgatttccgcgcaggaagcacaggctcaggcgattctgcagcaggcgaggatcgcactccgaggaccacccggaccgatggggctgaccggacgacctggcccagtcggaggtcccggttcatcgggcgctaaaggagaaagcggagacccgggaccacaagggcctaggggagtgcaagggccacctggccctactgggaaacccggaaagagagggagaccgggagcagatggcggtaggggcatgcccggtgagccgggagcaaagggcgacagggggttcgacggtctgcccggactccctggcgacaaggggcacagaggtgaaagagggccacagggtccgccaggaccacccggtgatgacggcatgagaggggaagatggtgaaattgggcctaggggcttgcctggggaagccggaccacgtggactgctcggaccaaggggcactcctggagcaccaggacaaccgggtatggcaggagtggatggaccaccaggacccaaaggcaacatgggtccgcagggagaaccgggacctccgggtcaacagggtaaccctggcccacagggcttgcccggaccacagggccctataggccctcctggcgaaaaaggacctcagggcaaaccgggattggcaggcctacccggtgccgacggccctcccggacatcctggtaaagaggggcagagcggggagaagggggcactcggccctccaggccctcaggggccaatcggataccccggtccacggggagtgaagggggctgacggggtgagggggctaaagggcagcaagggtgagaaaggggaggacggattcccaggttttaaaggcgatatgggtctcaagggcgaccgaggagaggtcggtcagatcggccctaggggggaggacgggccagagggtccaaaaggcagagctggacctaccggtgatccgggtccttcagggcaggcaggggagaaaggaaagttgggcgtcccaggactgcccggttaccccggaagacagggtccaaagggttccaccggattcccaggatttcccggagccaatggggagaaaggcgctcgcggagtggctgggaaacctgggccaagagggcaacgcggtcctaccggtcctcgcggatcacgtggcgctaggggcccaacaggcaagcctggacctaaaggtacgagcggcggagatgggccacctggcccaccaggcgagcggggtccccagggcccacagggccctgttggattcccaggacccaagggacctcctggacctcctggtaaggatggattgccgggacatccgggacagcgcggagaaaccgggttccagggaaagactggcccacctgggccaggtggcgtggtggggcctcagggaccaaccggcgaaacagggccaatcggcgaaagaggccacccgggacccccaggccctcctggggagcaagggctccctggagcagccggtaaagagggagctaagggagaccctggccctcaggggatttctggaaaggatgggccagctgggctgcgcggattccctggcgaacgtggcttgcctggagctcagggcgctccgggacttaaaggcggtgaaggaccacagggtccccctggcccagtcggatctcccggagaacgtgggagtgccggaactgccggtcccattggactgcccggtcgacctggaccgcagggtcctcccggtcccgctggggagaaaggggcaccgggagagaagggcccacagggtcccgctggacgcgatggagttcagggtcccgtgggcttgccaggacccgctggacccgctggttctccaggcgaagacggagacaaaggcgagataggtgaaccaggccagaaggggtcaaagggtgacaaaggagagaatgggccacccggacccccaggacttcaggggccagtcggggcacccggaatcgcaggcggagacggagaacctggcccaagaggccagcaaggcatgttcggtcagaagggggatgagggagcgagaggttttcccggtccaccagggcctatcgggctccagggcttgcctgggcctccaggagagaagggggagaatggagacgtcggtcctatggggccacccggtcccccaggtccaaggggccctcagggacctaacggggcagatggcccacaggggcctccaggtagtgtcgggtcagtgggtggagtgggggaaaagggtgagcctggcgaagccggtaatcctggtcccccaggtgaggccggagtgggtgggccaaagggagaacgcggagagaaaggggaggcgggtccacccggtgccgctggccctccaggcgcaaagggacctcccggagacgatggcccaaaagggaatcctgggccagtgggctttcccggagaccctggaccacctggcgagcccggaccggcaggccaggatggggtgggcggtgataagggagaagatggagacccaggccagccgggtcccccagggccatccggagaggccggtcctcccggaccccctggaaaacgagggccacctggcgctgccggagccgaagggcgacagggcgaaaaaggggctaaaggggaagctggagcagagggcccacctgggaagaccggaccagtgggacctcagggtcccgctggcaaacccggacccgaaggcctaagggggatccccggaccggtcggcgagcaggggttgcccggagcagcagggcaggacggcccacctgggccaatgggaccaccaggcctaccaggccttaaaggagaccccggaagcaagggggaaaaaggccaccccggacttataggtctgataggcccaccaggggaacagggcgagaagggagatagggggctccctggcacacagggttccccaggagctaagggggacggcggtattcccggaccagcaggccctcttggtccccctggacctccagggctgccgggtccgcagggccctaaaggaaataaagggagtaccggacctgcgggtcaaaaaggcgactctggcctcccaggccctcccggaagtccgggaccacccggagaggtcattcagcccctgcccatcctgtcatccaagaagaccaggagacacaccgaaggaatgcaggcagatgccgatgataatatactggactatagtgatggaatggaggagattttcgggtcactgaacagtctcaagcaagacattgagcatatgaagtttccaatgggcacccagaccaatcccgcaagaacatgtaaagacttgcaattgtcacaccccgatttccccgacggggagtactggattgatccaaatcaagggtgctctggtgactcattcaaagtttactgcaatttcacgtctgggggagagacatgcatctacccagataagaagtccgaaggtgttcgcatctcaagttggccaaaagaaaaaccaggaagctggttctctgaatttaagcggggaaagctcttaagctatctggatgttgagggtaattcaatcaatatggtgcagatgacttttcttaagttactgactgcctctgccagacagaactttacttatcactgtcatcagtccgccgcttggtacgatgtctcatccggctcttacgataaagctttacggttccttggctccaatgatgaagagatgtcctatgataataatcccttcatcaagaccctctacgacggctgtgcgtctaggaagggatatgagaagactgtcattgaaatcaacacacctaaaatcgaccaggtgcccattgtggacgtgatgattaacgatttcggggatcaaaatcagaagtttggttttgaagttggcccagtgtgctttctcggata

SEQ ID NO: 28099 - DNA, 3081 bp, Artificial Sequence
  Description of Artificial Sequence: Synthetic coding sequence
atggtctctgaagtaagcagagacttaaaggttaagcgtgagaagctggtgaaactggcccaggagggcaaaatggctcttaaggaccccaaggtggagcaagctcaactggaaactcaggttctacaagtgaagcaggaaaagagggaaaacctagagtttcaagactaccaagatattcaagaagataaggtgcagcgcatcagtgatgtcataggatctaccgggtttcccggttttcctggggctaatggtgagaaaggagccagaggggtggcagggaagcccggaccacggggacagaggggacctacgggcccacgcggaagccgcggagctaggggtccaactggcaagcccggaccgaaagggacaagcggtggggacggccctcctggcccaccaggcgagaggggaccccagggtcctcaggggccagtagggttccccggaccaaaaggtccgccaggccctcccggaaaggacggacttccaggacaccccggtcagagaggcgagactgggtttcaggggaaaaccgggccacccggacctggcggagttgtagggcctcagggcccaacaggtgaaaccggcccaatcggagagcggggacatccaggccctcctggacctcctggggaacaggggctgccaggggcagctggtaaagagggggctaaaggcgatccagggcctcaaggcataagcggcaaggacggcccagccggactgagaggcttcccaggggagcgcggactccccggtgcgcaaggagcccctggactgaaaggcggtgaggggccacagggccctcccggaccagtgggctcccctggggaacggggatcagccggaactgcaggtccgatcgggttgcccggacggccaggaccccagggcccacccggaccagcaggcgaaaaaggagccccaggggagaagggaccccaggggcctgcgggaagggatggcgtgcagggcccagtcggtctcccaggtccagcagggcctgcaggatccccaggtgaggacggggacaagggcgagattggagagcctggtcaaaaggggagtaagggagacaaaggcgagaacgggccacccggtccccctggcttacaggggccagtgggggcacccggtattgctggtggagatggggagccaggccctagagggcagcagggaatgttcggccagaaaggtgatgaaggggctaggggctttcctggaccgcctggacccatcggacttcaaggcctgccagggccaccaggggaaaagggtgagaatggggacgtgggcccaatggggcctcctggaccgcctgggccaaggggtccgcaaggtccaaacggtgcggatggacctcaagggcctcctggctcagtgggctcagtgggaggagttggggaaaagggcgagcccggagaggcagggaatcctggccctccaggagaagcaggagttgggggaccaaaaggtgagaggggcgaaaagggggaagcgggtccccctggcgctgccggaccgcctggagcgaaggggccaccgggtgacgacggccctaagggaaacccagggcctgttgggtttcccggagatcccggaccacccggtgagccgggacctgcgggacaggatggcgtcggcggtgacaagggtgaggatggcgaccctggacaaccgggacctcccggaccttctggcgaggccggtccaccaggtcctccagggaagcgcggtccgcctggcgctgctggcgctgaaggcagacagggagaaaaaggcgcaaaaggtgaagcgggagccgaggggcctcctggaaaaacagggcctgtcggccctcagggccctgcgggaaaacctggtccagaggggttgaggggtattccaggaccagtgggagagcagggcttacccggagccgcaggacaggacggtcctcccggacctatgggtccacctggcctgccagggctaaaaggcgaccccggaagcaagggggagaagggacacccaggactgatcgggcttatcggcccaccgggtgagcagggtgagaagggcgaccggggtctccccggaacacagggctcgccaggggcaaagggcgatggcggaattccaggccctgctgggcctctcggcccacccggacctccaggattgcccggaccacagggacctaagggtaataaggggtctacagggccagcgggacagaagggcgatagtgggttacccggaccacctggctccccaggacccccaggagaggtgatacagccccttcctattttaagcagcaaaaagacaaggcgccacacagaaggaatgcaggctgacgccgatgacaacatcctagattatagtgacgggatggaagagatttttgggtccctgaactccttgaaacaagatattgagcacatgaagtttcccatgggaacccagacgaaccccgctaggacttgcaaggacctccagctcagccatccggatttcccagatggggagtactggattgatcccaaccaggggtgctccggcgactcatttaaggtatattgtaactttaccagcggcggtgagacctgtatttatccagacaagaaaagcgaaggcgtgcgtatttccagctggccaaaagagaaacccggatcatggtttagtgagttcaagcgcggtaaattactctcatatctggatgtagagggaaattccatcaacatggttcaaatgacctttctgaaattactgaccgccagcgctcgccagaatttcacatatcattgccaccagagcgctgcttggtacgatgtgagttccggctcttacgataaagcactgcgcttcctgggatcaaatgatgaggaaatgagttatgataacaacccatttatcaagactctgtatgacggttgcgcctcccgaaaaggctacgagaagacggttattgagatcaacactcctaaaattgaccaagtgcctattgtggacgttatgatcaacgattttggcgatcagaatcaaaagtttggctttgaggtgggtcctgtctgctttttgggttag

SEQ ID NO: 28100 - DNA, 5421 bp, Artificial Sequence
  Description of Artificial Sequence: Synthetic coding sequence
atggagccatggagcagtaggtggaagacgaagcgctggctctgggacttcactgtcacaaccctggcactgacatttctgtttcaggcacgagaggttcggggagctgccccagttgatgtgctgaaagctctggattttcacaattcacctgaaggtattagtaaaacgacagggttttgtacaaaccggaagaacagcaagggctcagatacagcttaccgagtctctaaacaagcccagctgtccgctcccaccaagcagttatttccaggaggtactttccctgaggattttagcattctcttcaccgtgaagcctaagaaagggatccaatcttttttactgtctatttacaacgagcacggcattcaacaaattggagtcgaggttggcagaagccccgtgttcctcttcgaggaccacaccgggaagcctgctccagaggactaccctcttttccggaccgtgaatattgctgatggcaaatggcatagagtagcaatctccgtcgaaaaaaaaaccgtaacaatgatcgttgattgcaaaaaaaagacaacgaaacctttggatcgtagcgaaagggcgattgtggacaccaacggtatcactgtgtttggcacacggattttggacgaagaggtctttgaaggagacattcagcaattcctgatcacgggagaccctaaggcagcgtacgattactgtgaacactactcgcccgattgcgattctagcgctcctaaggccgcacaagctcaggaacctcagattgacgaatatgcccctgaagatatcattgaatacgactatgaatatggggaagctgaatacaaggaagccgagtccgtgaccgaaggtccaacagttactgaagagacgattgcacagacagaagccaatatcgtggatgattttcaggagtacaattacggaaccatggaatcctaccagacagaggcaccacggcatgtctctgggaccaacgagcctaatcccgtggaagagatcttcacagaggaatacctgacgggggaggactatgatagccagcggaaaaactcagaggacactctgtacgaaaataaggagatcgacggacgggatagcgatctgttagtggatggggatctcggggaatacgacttttatgagtataaagagtatgaagataagcccaccagccctccgaacgaagaattcggccctggggtgcccgctgagaccgatattactgagacatccatcaatggacacggcgcttacggggaaaaggggcagaagggagaaccagctgtggtggagcccggaatgcttgtggaaggtccccctggccctgccggtccggcaggaataatgggccctcctggcctccagggacccaccggccctcctggtgaccccggagacagaggaccacccggacgtcccggactgccaggggctgatgggctgcctggacctcccggtaccatgctgatgttgcccttcaggtacggaggggacggctcaaagggcccaacgatctcggcccaggaggcccaagcccaggctatcctccagcaggcaagaatcgctctcaggggaccacctggtcccatgggacttacagggcgtccaggccctgttggaggcccaggatcatccggtgccaagggcgaaagcggggatcccggtcctcagggcccaagaggcgtacaggggccaccgggaccaacgggcaagcccggaaagcggggtcggccaggagccgacgggggtcgcggaatgccgggagagcccggagcaaagggggatcggggattcgatggcctgccagggctgcctggcgacaagggccacagaggagagcgaggccctcagggaccccctggtcccccaggagacgatggcatgcgcggtgaagatggcgagatcggccctaggggcctgcccggagaggccggtcctcgcggtctgctgggcccacggggaaccccaggggcacctggtcagcccggaatggccggtgttgatggacccccaggacctaaaggaaacatggggccacagggggaaccaggccctccaggccagcaaggtaatcccggaccgcagggcctacctgggcctcaagggcctataggcccacccggtgagaaaggcccacagggaaagcccggtctcgctggactgccaggggctgacggaccacctgggcatccgggtaaggaaggacagtcgggggaaaagggagcactagggccaccagggcctcagggtccgatcggttacccaggccctaggggggtgaagggcgcagatggcgtaaggggcctcaagggcagcaagggagagaagggcgaggacggattccccggatttaagggtgacatgggcttgaagggagatagaggtgaggtggggcagattggccctaggggcgaagacggaccagaggggccaaagggtcgggctggaccaaccggtgaccctggaccatctggccaggccggagaaaaggggaaactcggagtacccggtcttccaggctaccctggcaggcaaggcccaaaaggcagtaccgggtttccagggtttccaggcgcaaacggggaaaaaggagctcgaggcgttgcaggtaagcccggtccgagaggacagcggggacctaccgggccaagaggcagcagaggagcccgtggaccgacgggaaaaccaggcccaaaaggcacaagtgggggagatgggcctccagggccacctggagagcggggaccgcagggcccacagggtccagtcgggttccctgggccaaaaggacctcctggccctcctggcaaagacggactacctggccaccctggtcagagaggagagacaggctttcaaggcaaaacaggcccacctgggccaggcggtgtagtcggcccacaaggtccaaccggcgagaccggacctataggggagaggggccacccgggacccccaggccctcccggagaacagggactgcctggcgctgccggaaaggagggagcaaaaggggacccgggacctcaggggatatctggcaaggatggcccagccggtctgcgtggctttcccggagagcggggtctgcctggcgctcagggtgcacccggactgaagggtggtgaaggaccccaggggcctcccggacccgtaggatcacccggagagcggggatctgccggaacggccggtcccattggattgcctgggagacctgggcctcagggccctccaggtcccgctggcgaaaaaggcgctccaggcgaaaaaggtccacagggcccagccggtcgggatggcgtccagggaccggtgggcctgcccggaccggcaggcccagcaggctctcccggagaagatggggacaaaggcgagatcggtgagcccggacaaaaagggagcaaaggtgacaaaggtgaaaatgggccacctggacctcccggactgcaaggaccagttggagcacccggaattgctgggggagacggagaacctgggcctcgaggccagcagggtatgtttgggcagaagggtgatgagggggcacgcggtttccctgggccacccggacctatcggcctccagggtttgcctggccctcccggtgagaagggcgagaatggcgacgttgggcctatgggccctcccggacccccaggaccaagaggtccacaggggccaaacggcgcagatggaccacaagggcctcccggatccgttggctctgtgggcggagttggcgaaaaaggcgaacccggtgaagcaggcaatcctgggccacccggagaggcaggagtgggaggcccaaaaggtgagcgaggcgaaaagggggaagccggacctccaggcgcagcgggaccgcctggcgcaaaggggccaccaggggacgacggacccaagggaaacccaggcccagtcggctttcccggagatccaggccctcccggtgagccgggacctgcagggcaggatggcgtcggcggagacaaaggcgaagatggagatcctggccagcccggacctccaggaccctctggcgaggccggtcctcctggccctcccggaaaaagaggaccacccggagcggctggagccgaaggccgtcaaggagaaaagggcgcaaaaggcgaggctggagccgagggacctccagggaagactggccctgtcggccctcaggggccagctggtaaacctggccctgagggcttgaggggcattcctgggccagtgggtgagcaaggtctgcctggggctgcaggccaagatggacctccagggccaatgggccctccgggactgcctggtctcaagggagatcccggaagcaagggagagaaggggcaccccggtttgattggactgattgggcctccaggagagcagggcgaaaagggagacagaggactgcctggcacacaagggagccctggcgcaaagggcgatggaggtattcccggaccagcagggcctttaggacccccaggccctcccggactgccgggacctcagggccctaagggcaataagggatctaccggaccagccggacagaagggcgactcggggcttccgggtcccccaggtagcccgggaccccctggcgaggtgatacagccactgcccatactaagctcgaaaaagacccgtagacacacagaaggcatgcaggccgatgccgacgataacattctggactattccgacggaatggaagaaatcttcggctcacttaactctctgaagcaggatatcgaacatatgaagtttcccatggggacacagactaaccccgctagaacctgcaaggacctgcagttgagtcaccctgatttccctgacggagagtattggattgaccccaaccagggttgttccggagactcattcaaggtgtactgcaacttcacctccgggggagagacctgcatttatcccgataagaaatcagagggggtccggatatcctcttggcccaaggaaaagcccggtagctggttttctgaatttaaaagggggaagctcttgagttatctggatgtggagggcaactccattaacatggtccagatgacattcctgaaactcttgacggcctcagccagacagaattttacctaccactgtcaccagtcagccgcttggtacgacgtcagttctggtagctacgataaagccctgagattcctgggtagcaatgacgaagaaatgagttacgataataatccctttattaaaactctttatgatgggtgcgcttctaggaagggttacgagaaaacggtgatcgagatcaacacccccaagatcgaccaagtccctatagttgacgtgatgattaacgacttcggagatcagaatcaaaaatttggtttcgaggtcggacctgtttgtttcttaggatac

SEQ ID NO: 28101 - DNA, 5073 bp, Artificial Sequence
  Description of Artificial Sequence: Synthetic coding sequence
atggaaccatggtcgagtcgctggaagaccaaaaggtggctctgggacttcaccgtgaccacactggctctgactttcctgtttcaggctcgagaagttcgaggcgcagctcccgtggacgttctaaaagccttagactttcataatagcccagaaggcatctcgaaaaccacaggattttgtacaaatagaaagaacagcaaggggagcgacacagcttatcgtgtttctaagcaggctcagctgagcgcacccacaaaacagttgtttccgggaggaaccttccctgaagacttcagcatattattcacagtcaagcccaagaagggaatccagtctttcctgctctctatctataatgaacacgggatccagcagattggtgtggaggtaggaagatctcctgtatttctctttgaggatcacacaggtaaacccgctcctgaggattacccgctctttcgaactgtaaacattgccgacgggaaatggcatcgggttgcaatcagcgttgaaaagaagacagtgacaatgatcgtggattgtaaaaaaaagacaactaaacccctggatcggagcgaacgggctatagtggatacaaatggcatcaccgttttcggcaccaggattctggacgaagaggtgttcgaaggggacatccagcagttcctaatcacaggtgaccctaaagccgcatacgattattgcgagcattattcaccagattgcgattcatctgctcccaaggctgcccaggcccaggaacctcagatagatgagtatgccccagaggacatcatagaatacgattatgagtatggagaggctgaatataaggaagccgagagcgtgaccgagggaccaaccgtcacggaagagactatcgcacaaaccgaaatcaatggccatggtgcttacggcgaaaaggggcagaagggcgagccagccgttgtcgaacccggaatgttggttgaggggcctcctggccctgctggaccagccggaatcatgggtccaccaggtttacagggcccaactggaccacccggagatcctggagatcggggtcctcccggaaggcctggactccctggcgcagatgggctgccaggtccgcctggtactatgctgatgctaccatttcggtacggcggtgacgggagcaagggccctactatatcagcgcaagaagcccaagcacaggcgatcctgcagcaagctcgcatcgccctccggggaccacctggcccaatgggcctcaccggacgccctgggcctgttggcggtcccggtagtagtggcgctaagggagagtcaggcgaccctgggcctcaggggccaaggggagtgcaggggcctcctggacccactggtaagcctggtaaacgcggaagacccggagccgatggaggacggggaatgccaggcgagccgggtgctaagggggaccggggatttgacggtctaccaggcctccctggggataaagggcatcggggagagcgcggacctcaggggccacccggaccccctggggatgatggcatgcgcggtgaagacggcgagatcggaccgcgaggcctgcctggcgaagcagggcctcgcggactgctcggaccccgtggaacacccggtgcccctggtcagcctgggatggccggagtcgatggaccacctgggcctaaaggaaacatggggcctcaaggagagcccggacctcccggacagcagggaaatccagggccacaagggttgcccggaccacagggcccaataggccctccaggagagaaagggcctcagggcaaaccgggattggcgggtttaccaggcgcagacgggccacctgggcatcccggaaaggagggccaatctggggaaaaaggagctctgggccctcccggtcctcaggggccaatcggttatcctggcccacggggtgtcaagggcgctgatggagttcggggactcaaaggctcaaagggagaaaagggggaggacggcttccctggcttcaagggtgacatgggtctgaaaggcgataggggcgaggtggggcagataggcccaagaggggaggacgggccagaaggcccaaagggcagggcaggaccaactggcgatcccggaccctccgggcaggcgggtgagaaaggcaaactcggtgtccccggactaccaggctaccccggaagacagggacctaaaggttctaccggtttccccggattcccaggcgctaatggagaaaagggcgctcgtggcgtcgccggtaagcctggtccacgaggccagagaggccctactggacctcgcggtagcagaggagctcggggtcctacaggaaagcccggtcctaagggaacttccggaggggacggacctcccggtccacccggagagcgcggtccccagggaccgcagggcccagtcgggttcccaggtcctaagggaccccctgggccaccaggcaaagacggactgccaggacaccccggtcaacggggtgagacgggttttcaggggaagaccgggccacctggacctggtggggtggtcgggccacagggtcccacaggtgagacagggcctataggagagcggggacacccaggaccccctggccctccgggagagcaaggtctgcctggagcggctgggaaggagggcgcaaaaggcgacccagggcctcagggaatctccggaaaggacggccctgcgggactgcggggatttcctggcgagaggggcctacctggggctcagggcgctccaggtctgaaagggggagaaggaccacaagggccacccggtcctgttggttcgccaggggagagggggtcagccggaactgctggtcctataggactcccagggagacctgggccacagggccctcctggacctgcgggagagaaaggcgctcccggagagaaaggcccacagggtcctgcgggtagggacggggtacaagggccagtaggcctgcccggacctgcaggaccggctggtagccctggggaagacggggacaagggggagattggtgagccagggcagaaaggttctaagggcgataagggagagaatggccctccaggcccacctggactgcaaggccctgtaggtgctcccggtatcgccggaggagacggtgaacccggtccccgtggtcagcaggggatgttcgggcagaaaggcgatgagggcgctagaggttttccaggcccacccggacctatcggtttacagggccttcccggaccgcctggagagaagggagagaatggcgatgtgggcccaatgggtcctccagggccaccgggtccaagaggtccgcaaggcccaaatggggctgatggaccacaaggcccacctggatcggtgggctccgtaggaggtgtaggtgaaaagggggagccaggggaagccggaaaccctggacctcctggcgaagccggagttggaggcccaaagggagaacggggagaaaagggggaagcagggccacctggagccgctggccctcccggagccaaaggccctcccggagacgatggtcctaagggcaaccccggaccagtagggttccccggagatccaggccctcccggtgagcctgggcctgcgggacaggacggagtaggcggtgacaaaggcgaggatggtgatcccggacagccgggtccacccggtccttctggggaggcgggaccaccagggcctcccggaaagaggggccctcctggtgccgcaggcgctgagggcaggcagggcgagaaaggggcaaaaggtgaggccggagcagaggggcctcctgggaagacgggccctgtgggaccacaaggacccgctggcaaacccggtcctgagggcctacgaggaattcctgggcctgtcggggaacagggtctgccaggagccgctggccaggatggccctcccggtcctatgggccctccaggtttaccaggcctcaagggcgaccccggatctaaaggagaaaaaggccatccgggactgattgggctgattggcccacccggtgagcagggagagaagggagaccgcggtttgcctggcacgcagggcagtccaggagctaagggggatggcggtatccccggtccggcagggcctttggggcctcctggtccccctggactgcctgggccacaaggacctaaagggaacaaggggtccacaggtcccgcaggtcagaaaggtgacagcggcctgcccggaccccctgggtcccctggcccacccggagaggtgatacaacctctacccatactaagctctaaaaaaacaagaaggcacactgaggggatgcaggctgatgccgacgacaacatactcgactactctgatgggatggaggaaatctttggcagcctcaattcactcaagcaggacatcgagcatatgaaattccccatgggaactcagacgaaccccgctcgtacctgcaaagacttgcagctgagccaccctgatttccctgacggagagtattggattgaccctaatcaggggtgctctggagactcgttcaaagtgtattgcaatttcacaagcggaggagagacctgcatctacccagataaaaagagcgaaggagtgagaattagcagctggccaaaagagaagcctgggagctggttctcagagtttaaacgtggaaaattgctctcatacctggacgtcgaagggaactctattaatatggtacagatgaccttcctcaagctcctgacagccagcgctcgccaaaacttcacctaccactgtcatcagtctgccgcatggtacgatgtgagctccggatcctacgataaggccctgagatttttgggtagcaatgatgaagaaatgtcttatgacaataacccattcattaagacactctacgacggctgtgcctcccgcaagggatatgaaaagacggtcatcgaaataaacacaccaaaaattgatcaggtccccatagtggatgtgatgatcaacgacttcggcgaccagaatcagaaatttgggttcgaggtgggacctgtgtgtttcctgggctag

SEQ ID NO: 28102 - DNA, 4560 bp, Artificial Sequence
  Description of Artificial Sequence: Synthetic coding sequence
atggcaccctatccctgcggatgtcacatcctgcttctgcttttttgctgcctcgcagccgcacgcgctaacttgcttaatttgaactggctgtggttcaacaacgaggacacatcacacgcagcaacgacaatccccgagccacaggggcctctccccgtgcagcctaccgccgatacaactacacacgtaacgccacgcaatgggagtaccgagccagccacagctcctggatcccctgagcctccatctgagctactcgaggacggccaggatacccccacttccgcagagtcacctgacgcgcctgaagagaacatcgccggagtcggagcagagattctcaatgttgcgaagggcattagatcatttgtccagctttggaacgataccgtgccaaccgaatccctggcacgggcagaaaccctggttcttgaaactccagtggggcctctggccctggctggaccttcatcgacaccccaggaaaatggtaccacactgtggccatctagagggattccgtctagcccaggggctcacacgacagaagccggtactctccctgcccctacgcccagtcccccatcccttggccgtccctgggcccctctcaccgggccaagcgtcccgccaccctcgtcagagcggatcagtgaggaagtgggcctgttgcagctgcttggagaccctccccctcagcaggtgacacagacagacgatcctgacgtcggcctagcatatgtcttcgggccagatgcaaacagcggtcaggtggcacggtatcacttccctagcttattttttagagacttttccttgctctttcacatccggcctgcaactgaaggcccaggagtactttttgcaattacggactccgcccaagctatggtgctgctgggcgtaaaactgagcggcgtccaggatgggcaccaggacatttcactgctgtacacggagccaggagctgggcaaactcataccgcagcctcatttcgcctgcccgcatttgtgggccaatggactcatctcgccctctctgtagctggcggattcgttgccctctatgtagattgtgaggagtttcaaagaatgcccctggcgagatcatcaaggggcctggagctggaaccaggcgcaggactctttgtggcccaagcgggaggcgctgatcccgataaatttcagggagtcatcgccgagctgaaggtgcgtcgggaccctcaagtatcaccgatgcattgtctggacgaagaaggtgatgactcagatggagcttctggcgacagtggctccggactgggtgacgcacgggagctgctgagggaggaaaccggggctgccctcaaaccaaggttgcctgccccacctcccgtgacgacgccacctttggcagggggaagtagtacagaggactcacggtcagaagaagttgaagagcaaaccacggtggctagtctgggcgctcagactctcccagggagcgatagtgtgagcacgtgggatggaagcgtgcgcacgccaggcggaagagtcaaagagggcggacttaagggtcaaaaaggagaacccggagttccaggccctcccggtcgagccggaccacctggatctccgtgccttcccggaccccctggtctgccctgtcctgtctctcccttgggccctgcgggacccgcattgcagaccgtccccggaccacaggggcctcctgggcctccgggaagagacggcacgcctgggcgtgatggagagcccggagatcccggagaagacggcaagcctggcgacaccggccctcagggtttccccggaacacctggcgatgttgggcctaaaggcgacaagggggatccgggtgttggagaacgaggacccccaggccctcagggaccaccgggaccgcctggaccgtcatttaggcatgataaactcacctttattgacatggaaggctctgggttcggaggagacctggaggctctgaggggaccaaggggcttcccagggcctcccggaccgccaggagtgcctggcctgccaggagagcctggcagattcggggtgaactcctcagacgtacccggtcccgctgggttgcccggagtcccgggtcgcgaaggaccacctgggttcccgggactgccaggaccacccggtcccccaggcagagagggcccaccaggacggactgggcagaagggaagcctgggcgaggccggtgctccagggcacaaggggagcaagggcgctccgggacctgccggtgcccgtggggaatcgggactggccggtgctcccggaccagccggacccccagggcctcccggaccacccggtccgcctggtcctgggctcccagctggattcgacgatatggaggggtcgggcggaccgttctggtcgacagctagatctgccgatggtccacaggggcctcccggtttgccaggtttgaagggcgatccgggagtgcctggtctgccaggcgctaagggagaggttggggctgacggcgtgcccggttttcctgggctcccaggccgagagggtatcgcaggaccacaagggcctaaaggcgataggggcagcagaggggagaaaggagatccaggcaaagatggagtcggccagcccggtctgcctggaccccctggccctcccggtccggtagtgtacgtctccgagcaggatggcagcgtgttgagtgttcccggacctgaagggaggccaggattcgctggcttccccggtccagctgggccaaaaggcaacctggggagcaaaggggagaggggctctccaggaccaaaaggtgagaaaggcgaacccggatccattttttctcccgatggcggtgcgctaggccctgctcaaaaaggtgctaaaggagaacccggatttaggggccctcccggaccctacggcagacccggatataagggggagataggcttccctggcagacccggtaggcccggaatgaatggtttaaaaggtgagaagggggaacctggcgacgcttcgctcggctttggaatgcgtggcatgcctggcccacctggtcctcctgggccaccaggacctccgggtactccggtgtatgacagtaacgtctttgcagagtcatcccggcctgggccacctggactcccgggtaaccagggacctcctgggccaaagggagccaagggcgaagtcgggcctcctgggcctccgggtcagttcccattcgacttcttgcagctggaagcagagatgaaaggcgagaagggggatagaggcgacgctggccagaagggggagagaggtgagccaggtggcggaggcttttttggctcaagcctccctggaccaccaggcccacctggcccacccggacctcgcggatatccagggatccctgggcctaagggagaaagcattcgcggtcagcctgggccaccaggcccacaaggaccccctggcattggttacgaaggcaggcagggccctccagggcctcccggtccacctgggccaccatctttcccaggaccccatagacagaccatatccgtgcccggaccccctgggccaccgggaccgccagggcctccagggaccatgggcgcttcgtccggcgtcaggttatgggccacacgtcaagcaatgctaggtcaagtgcatgaggtgccagagggatggttaatttttgtcgccgagcaagaggaactatatgttagagttcagaatggctttcggaaggtgcagcttgaggccagaacacctttaccaagagggacagacaatgaggtggccgcactccaaccccctgtggtgcagttacatgactcaaatccatatcctcggagggagcaccctcatcccacagccagaccatggcgtgccgacgacatcctcgcatcgcctccgcgactgcctgaacctcagccttaccctggagcccctcaccacagcagttatgtgcatctgaggcctgcaagacctaccagtccccctgcgcatagtcatcgtgatttccaacccgtcctgcaccttgttgcattaaattctcctctgtcaggaggtatgagagggattcgcggagccgattttcagtgctttcagcaggcccgagccgttggattagctgggacctttagggccttcctgagctccagactgcaagatctgtattccatcgtacggcgagctgaccgcgcagcagtgcccatagtcaacctgaaagacgagctgctgttcccttcctgggaggctttgttttctggttcagaggggcctctgaagccgggtgctcgaattttctccttcgatggcaaagacgtgcttcggcatccaacttggccccagaagtcggtgtggcacggtagcgaccccaacgggagacgtctgacagagagctattgcgagacatggcgcaccgaggcaccatctgccacagggcaagccagtagcctccttggcggacgcctgctgggccaatctgctgctagctgtcatcatgcttatatcgtcctgtgcatcgagaactccttcatgaccgcaagtaagtag

SEQ ID NO: 28103 - DNA, 5264 bp, Artificial Sequence
  Description of Artificial Sequence: Synthetic coding sequence
atggctccctatccctgtggctgccatatcttactgctgttgttctgttgtttagctgctgcccgagctaacctcctgaatttgaactggctgtggttcaataatgaggacacatcacatgccgctaccaccattcccgaacctcagggacccctaccagttcagccaactgcagacacaaccactcacgtaactccgagaaacggctcaacggaacctgctaccgctccaggcagtccagagccaccttctgagcttctcgaggacgggcaggacacgcccacttcggcagaatctcctgacgcccctgaggagaacattgccggagtgggagccgagattctgaatgtcgcgaagggaattagatcctttgtccagctttggaacgacacagttcccacagaaagccttgccagggctgaaaccctagtgttggagacacctgttggacctttagccctagctggcccaagctccacgcctcaggaaaatggcaccaccctctggccatcccgcggaatcccttcaagccccggagcacatacgacagaagccggtaccctgcccgcacccactcctagtcctccctcattgggaagaccttgggccccactcactgggccaagcgtgccacccccatcttccggcagggccagtctttcgtcgctactcggcggtgccccaccatggggaagcctgcaggaccccgactcgcagggcttaagccctgcagccgcagctcccagtcagcagctgcaacggccagacgtgcggctgcggacacccctacttcacccactcgtgatggggagtctgggtaaacacgccgctcccagcgcatttagcagtggacttccaggcgctctttcccaggtcgcggtcactaccctgacacgagactcaggtgcttgggtttcccatgtcgccaactcagtgggcccaggactcgctaataacagcgcactcctcggggcagacccggaggccccagcgggacgctgtctgcccttaccccctagtcttccagtctgcggccatctcggaattagccggttttggctgcccaaccacctacatcatgagagtggcgagcaggttagagctggcgctcgagcatggggaggtctgctccaaactcactgtcacccctttctggcctggttcttttgcttgttactagtccccccttgtggaagcgtcccccctcccgcacctcccccttgttgtcagttctgcgaggcactccaggacgcttgttggagccgcctgggaggaggtaggttacctgttgcgtgcgcgtcactccctactcaggaagatgggtactgcgtcttaattgggccagccgctgagcggatttcagaagaggttggcctactgcagctactgggggatccccctccccagcaggtgacacagaccgacgatcccgatgtgggccttgcttatgtgttcggccctgacgctaatagcggccaagtggcgagatatcattttccctccctgttcttccgtgactttagcctcctcttccacatccggccagctacagaagggccaggtgttttgttcgccattaccgacagtgcccaagctatggtcctgctgggtgtaaagttgagcggcgtgcaagacggccatcaggacattagcctcctgtacaccgagcccggtgctggccaaacacataccgctgcatccttcagactaccggcattcgtcggccagtggacgcatctggccctttcggttgctggaggttttgtggcactgtacgtagactgcgaggaatttcagcgcatgcccctcgcacgtagcagccggggactggagctggaacctggagccggactttttgtggcccaggcaggcggagccgaccccgacaagttccagggagtgatcgcggagctgaaagtgagaagggatccccaggtctctcctatgcactgcctggatgaggagggggatgattctgacggagcttccggagactctggctcaggtctgggcgacgctcgggagctgcttcgggaagagacgggtgctgccctgaaacctagactgccagcccctccacctgtgacaactcctcctctggctggcggaagtagtactgaagactcaagatcggaagaagtggaggagcaaacaaccgttgcgtccctgggcgctcagacgttacccggatcggatagcgtgtctacatgggacggctcagttagaacacctggcggacgggtcaaggaggggggtctgaaaggccagaagggagaacccggagttccagggccacccggtcgggctggtcctcctggcagtccgtgccttccaggccctcccggtctcccctgtcccgtgtcaccactaggccctgccggaccagctctccagaccgtgcccggtccccagggcccacctggcccacccggacgggatggcactcccggtcgcgacggagaacccggagacccgggagaggacggaaaaccaggcgatacagggccacagggattccctgggacccccggagatgtgggtccgaagggcgataaaggagatccaggtgtcggggagcggggtcctccgggtccacagggcccacccggaccccctgggccaagtttccgtcacgacaaacttacctttattgacatggaagggtctggtttcggaggtgacctcgaggccctgcggggtccccgaggcttccctgggcctccgggaccccctggtgtgccagggctgccaggggagcccggacggttcggcgttaactctagtgacgtgcccggacccgctgggctgccaggggtgcccggtagggaagggccacccggtttcccgggactccctggtccacccggaccccctgggagagaggggcctccgggtcggaccggccagaagggctcacttggcgaagcaggagcaccgggacacaagggttctaaaggagcaccagggcctgccggagcaagaggagagagcggcctggccggagctccaggtccggcaggaccacccggtccccctgggccaccgggtcctcccggacccggattaccggcagggtttgacgatatggagggcagtggcggtcccttctggagcaccgctcgctccgcggatggacctcaaggacctccaggcctccccggacttaaaggagacccaggcgttcccggactgccaggcgctaagggcgaagtcggtgctgacggagtgccagggtttccaggactcccaggccgtgaggggatcgcagggcctcagggacccaaaggcgacagaggttcgcgaggggagaagggggatccgggaaaagacggcgtggggcagccaggactccccggaccccctggccctccagggccagtcgtgtacgtttccgagcaagatggctccgtgctgtcagtgccaggacccgagggacgccctggatttgccggttttcctggccctgccggacccaaaggaaacctgggttccaaaggcgaacgcggatcccctgggccaaaaggggagaagggggagcctgggtcgatcttcagtccagatggcggtgcactgggacccgcacagaagggagcaaagggggagcccggattccggggtccacctggtccgtatggacgtcctgggtataaaggtgagatagggttccccggtcgccctgggcgaccaggcatgaacggactcaaaggcgaaaagggcgagccgggtgacgccagcctgggctttggaatgcgaggcatgcctggccctcccggtccgcctgggccacctggaccaccaggcacccccgtctacgattccaatgtcttcgccgagtcctctcgacctggtcccccaggactgcctggaaaccaggggcctccagggccaaagggcgcaaagggcgaagtcggacccccaggaccacccggacagtttcccttcgatttcctgcagttggaggccgaaatgaaaggcgagaaaggcgaccgtggagacgccggtcagaaaggagagcgcggagaacccggtgggggaggctttttcggatcttctctcccagggccacccggacctcccggaccgcctggccctagggggtacccaggaattccaggccctaaaggcgaatcaattcggggacagccagggcctcccggtcctcaagggcctcctggcattgggtacgaaggcagacagggaccccctggtcccccaggaccacctggacctccctccttccccggtcctcatcgtcagactatttctgttccaggccctccaggccctccagggccacccggtcccccaggcacaatgggagcttcatctggggtgcgcctgtgggccaccaggcaggcgatgctggggcaggtacatgaagtcccagaaggatggctgatcttcgtggcggagcaggaggagctctacgtcagggtccagaacggattcaggaaggtccagctcgaggccagaacccctttgcccagggggacagataacgaggtggccgctctgcagcctccagttgtgcagctgcatgacagcaacccctatccgagaagggagcacccccacccaaccgctcgtccctggcgggcagatgacatcttggcctcgccccctaggcttcccgagccacagccctatcccggagcaccacatcattccagttatgtccatctccgtcctgctcgtcccacttctccacccgctcattctcaccgagattttcaacccgtgttgcacctcgtcgctctaaactccccactcagtggcggtatgcgaggcattcggggagcagattttcagtgctttcaacaagcccgagccgtcggccttgcaggtacttttcgggctttcctatcaagcaggctccaggatctatattctatcgtacgaagagcagatagggctgcagtgcccattgtcaatctgaaagacgagctactgttcccatcctgggaggctctcttctctggttccgaagggcctttgaaaccaggggctcgcatattcagcttcgacgggaaggatgttctcagacatccaacttggcctcagaaaagcgtttggcacggaagtgaccctaacgggcgtcgcttgacagaatcctattgcgagacctggcggaccgaggcgccatcagcgactggccaggcatcaagtctgcttgggggtagattgctgggacagagtgccgctagctgccaccatgcatatatcgtgctctgcatcgaaaactcttttatgactgccagcaagta

SEQ ID NO: 28104 - DNA, 4020 bp, Artificial Sequence
  Description of Artificial Sequence: Synthetic coding sequence
atggcacctcgttgtccctggccttggcctagacgtcggagattattggatgtgctggccccactcgttctcctgctcggcgtccgggctgcctccgccgaacccgagcggatttccgaggaagtgggactcttacagcttctcggagatccacccccacagcaggtgacccagacagacgaccctgacgtaggacttgcctatgtcttcggcccagatgcaaactcaggtcaagtggccaggtatcacttcccaagcttgttttttagggacttcagccttctcttccacatcagacccgctaccgagggccctggcgtcctcttcgctataacagattctgcgcaagcaatggtcttactcggggtgaaattaagtggagtgcaggatggacatcaagatatatcgctgctgtatacagaacctggagcaggccaaacacatacggctgccagtttcagacttcctgccttcgtgggacagtggacacatctggccctgtccgtggcgggtggtttcgtggcgctgtacgtggattgcgaggagttccaaagaatgccactcgcgcgtagctctagaggcctggaattggagccaggagctggtctcttcgtagcacaggcaggaggcgcagaccccgacaaatttcagggggtcatagctgaactcaaagtccggagggacccacaggtatcccctatgcactgcttagacgaagagggggacgactcggacggcgcttccggagactccggctctggtctcggagacgcccgagaacttttaagggaagaaaccggagccgcactgaagccacgactgccagcaccaccgccagtgactactccacccctggcgggaggctcgagcacagaagactccaggagcgaggaagtggaggagcaaaccaccgtggctagtctgggagcacagaccctgcccggttcagacagcgttagtacgtgggacggctccgtaagaacacctggcggtcgagtcaaagagggtgggctgaaaggtcaaaagggcgaacccggagtgcccggaccccctggccgagctggccctcctgggtcgccgtgcctcccaggaccaccgggacttccctgccctgtctctccattggggcctgcgggtcctgcgttgcaaaccgtgccaggcccacaaggaccaccgggtccccctggacgggacggcacacctgggagagatggcgaaccaggtgatcccggagaggacgggaagccaggggataccggccctcaggggttccccggtacccctggggacgtaggtcctaagggtgacaagggcgatccgggagtcggggagcgagggcctcccggtccccagggacctcctggcccacctggtccatcattcaggcacgataaactcacttttatcgatatggaaggatccggatttggaggcgacctggaggctctccggggaccgagaggcttccctggcccacctggaccccctggcgtgccagggcttcccggagagcccggaagatttggggtcaatagtagtgacgtgccgggtcccgcagggcttcccggagttccaggtagggaggggccacccggtttcccgggacttcccggaccacctggcccaccagggcgtgagggccctcctggcagaacgggtcagaagggcagcctgggagaagccggtgctcctggacacaaggggtccaaaggtgctcccggacctgctggcgcacggggtgagtccggccttgcaggggctccaggtcctgcgggtcccccaggcccacccggacctccgggtcctccgggtccagggcttcccgctggattcgacgacatggaggggtccgggggacctttttggagcactgcccgttccgcggatggccctcaagggcctcccggtttaccagggctgaagggggaccccggagttccaggcctacccggagccaagggtgaagtcggggcagatggcgttccgggtttccccggtctcccgggacgggagggaattgccggaccgcaagggcctaagggcgatagggggagccggggagaaaagggggatcctggcaaagatggcgtcgggcagcccggactgcccggtccccctgggcctccaggtcccgttgtatatgtttcagagcaggacgggagcgtgctgagtgttccgggacctgaagggaggccaggctttgctggatttcccggaccggcaggccctaaaggcaatcttggcagcaaaggggagagaggttcgccgggacccaaaggggagaaaggagaaccaggatctattttttcccccgatggcggagccctgggcccagctcagaaaggcgcaaaaggggaacctggcttcaggggcccacctggtccctacggccgaccagggtacaagggggagatcggattcccaggccgtcctggcagaccaggtatgaacggtctaaaaggggaaaagggggagccaggtgacgccagcctggggtttggaatgaggggcatgcccggtccccctggccctcctggcccacctggtcctcccggaacacctgtatacgatagcaacgtattcgcagagagcagcagacctggcccacctggattgcctggcaaccagggacctccagggcctaagggcgcaaagggagaggtggggcctcccggacctcctggccagttccctttcgacttccttcaactcgaggccgagatgaaaggcgagaaaggcgatcgcggtgacgccggacaaaaaggggagagaggtgaacctggaggtggaggatttttcggctcatctctgccaggccctcctggtccaccaggaccacctggcccaagggggtatccagggattcctggacccaaaggcgagtccattagaggacagcctggcccaccaggcccacagggcccacctggcatcgggtatgagggcaggcaggggccacctgggccacccggtccccctggaccaccttccttccctggcccacacaggcaaacgatatccgtgccaggccctccgggtcctcccggtcccccaggtccccctgggaccatgggcgcaagcagcggcgtgcgactgtgggccacgagacaagccatgctcggacaagttcacgaagtcccggagggctggctgatctttgtggcggaacaagaggaactgtatgtccgcgtgcagaatggatttcgtaaggttcagttagaggctagaaccccactcccgcgaggaacagataatgaagtggccgctcttcagcctcctgtggtccaactccatgactcgaacccctatcccagaagagagcatcctcatcctaccgccaggccgtggagagccgacgacatactcgcctcccctccgaggctgccggaacctcaaccctaccctggcgctccccaccactcctcctacgtacacctcaggccggcacgtcctacatcccctccggcacactcccaccgcgacttccaaccagttctgcatctcgtggccctgaacagccccctcagtgggggaatgcgcggtattcggggtgcagattttcagtgcttccaacaagccagggcggttggactggcgggaacatttcgtgcttttttatccagcaggctccaggatctgtactctatagttcgcagagctgaccgggcagcagtgcccatcgtgaatctgaaggatgagctcctcttcccctcctgggaggctctgttcagcgggtcagaggggcctttaaagcctggggcacggattttcagctttgacggtaaggacgtgctgagacaccctacgtggccgcagaagtccgtgtggcatgggagcgatcccaatggccgaagactgacagagagctactgcgagacctggcggacagaagccccatcagcaactggccaagccagctcactcttgggcggtaggctgcttggacagagcgccgctagttgtcatcacgcgtacatagtgctgtgcatagagaatagcttcatgacagctagcaagtag

SEQ ID NO: 28105 - DNA, 4020 bp, Artificial Sequence
  Description of Artificial Sequence: Synthetic coding sequence
atggcacctaggtgcccttggccttggcccaggagacgcagactgctcgatgtcctcgcacccctggtcttgctccttggggtacgggcagcttctgctgaaccagagagaattagtgaggaagtgggactgctccagcttcttggagacccgccaccacagcaggtaacccagaccgatgatcctgacgtgggtctggcttacgtcttcggcccagacgctaattcagggcaggtggcaaggtatcatttcccctccctgttttttcgggatttttcccttctgtttcatatcaggccagccaccgaaggccctggcgttctgttcgcaatcaccgatagcgcacaagctatggtgctgcttggcgtgaaactcagtggagtccaagacggccaccaggacattagtcttttatacacagaacccggagccggacagacacacaccgctgcctcttttaggctcccggctttcgttggccaatggacccacctggcactgtctgtggccggaggcttcgtggcactttacgtcgattgtgaggaattccagcggatgcccctggccaggtctagtaggggccttgaactggagcccggtgcgggactctttgtcgcacaggctgggggagcagatccggacaaattccagggcgtgattgctgagttgaaggtgcgtcgtgatcctcaggtgtcaccaatgcattgcttggacgaagagggcgacgactcagacggggctagcggagactccggctctggtctgggcgatgccagggagctgctccgggaggaaactggcgctgctctgaaaccgaggcttcccgctcctccccctgttacgacaccccctctagctggaggttctagcaccgaggactcccgcagcgaagaggtagaagaacagacaaccgtggccagtttgggagcccaaacacttcccggatctgactccgtctcaacctgggacggatccgtaagaactccgggtggcagagtaaaggaaggcggattgaaaggccagaagggtgaacctggagtgcctggaccgccagggcgtgctggccctcctggttccccctgtctaccaggtccacccggtctgccgtgtcctgttagccctttgggaccagccggaccagccctgcagaccgtccctggaccccagggtccgccagggcctcccggacgggacggcactcccggtagggacggggagccggtgagtccccatgtgccgccatcaccaggtgacactggaccacaggggttcccgggaacaccgggagacgtgggcccaaaaggtgataagggagatccaggagtcggagaacgcggacctcccggtccacagggtccgccaggtcctcctggaccttcattcaggcacgacaagctaacttttatcgacatggaggggagtgggtttggaggcgatctggaagcccttcgtggcccacgcggttttccaggacctccgggacccccaggcgtacctgggctgcctggcgagccaggacgcttcggcgtgaacagctcagatgtccccggtccagccggtctgccaggggtcccaggcagggagggtccccctggatttcctggtctgccaggacccccagggcctcccggacgggaaggccctcccggtaggacaggtcaaaaaggctctctacagggagcgggtgctcctggcgtgcaggggtcaaaaggggctccgggacccgctggcgcaagaggggaaagtggactagccggagctcctggtcctgctgggccacctggtccacccggacccccaggacctcccggaccaggactccccgcaggcttcgatgacatggagggcagcgggggtcctttttggagtactgccagatctgccgatggaccccaggaaccacccgcactccacgggattggaggcgaccctggtgttcccggtttaccgggagctaagggagaggtgggcgctgacggcgtccctggtttcccagggctacctggtcgcgaaggtatagccggacctcaggggccaaaaggtgaccggggaagtagaggcgagaagggagatcccggtaaggacggcgtgggccagccaggattgcctggacctcccggtcctcccggaccagtggtctacgtgagcgagcaggatggctcagtcctcagcgtcccgggtccagaggggagaccgggatttgccggttttcccggacctgctgggccaaagggtaacctgggctcaaaaggagagcgcggttccccaggacccaaaggtgaaaaaggggagcctggaagtatcttctcgccagatggcggagccctgggaccagcacagaaaggcgctaagggcgaacctgggttcagagggcctcccggaccctacggtcgacctggttataagggcgagatcggctttcctggacggccaggaagacctgggatgaacgggttgaagggagaaaaaggcgaacctggggacgctagtctaggctttggaatgcgagggatgcccggaccaccaggccctcctggccctccaggacccccaggtacaccggtctacgactcaaacgtgtttgctgaaagctcccgacccggacctcctggtctgcccggaaatcaaggccctcctgggccaaagggtgcaaagggcgaagtgggcccacctggccctccagggcagttcccttttgatttcttacaacttgaagctgagatgaaaggcgaaaaaggtgacagaggcgatgctgggcagaagggcgaacggggagagcccggaggcggaggcttctttgggagctctctcccgggacccccaggaccccctggaccaccgggacctcgcggttatcctgggatccccggaccgaagggcgagagtataagaggccagcctggcccacccggacctcaggggcctccagggatcggatacgaaggacggcagggccctccgggtcctcctgggcctcctggaccaccttcttttcctgggcctcatcgccagacaatcagtgtgccaggtccccctggaccccctggacctccagggccaccgggaactatgggcgcaagtagcggcgtacgcctctgggcaacccggcaggcaatgcttggtcaagtgcatgaggtccctgagggctggctgatctttgtggccgagcaggaagaactgtatgtcagagtccagaacgggtttaggaaagtgcaattagaggccagaaccccactacctagaggtacagataacgaggtcgcggctctacagcccccagtcgtccagctccatgattcgaacccctatccgaggcgagagcatccccaccccacagccaggccttggcgggcagacgatatcctcgcctccccacccaggttacccgaacctcagccttatcctggcgcaccccatcacagttcctatgtgcacttacgcccagcacggcctacatctccccctgcgcacagccatcgcgactttcagcccgtgctccacctggtggcactgaacagtcctctcagcggcggaatgagggggattcggggagccgatttccaatgctttcagcaggccagggctgtgggtctagccggaacattccgcgcattcctctcatcaaggctgcaagacctgtacagcattgtaagacgagcggaccgggctgccgtgccaatcgtgaatctcaaagatgagctgttgtttccatcgtgggaggcactgttctctggtagtgagggcccactgaaacccggagcacgaattttctcctttgacggaaaagatgtgcttagacatcctacatggcctcaaaagagtgtttggcacggatccgatccaaacggacggcgacttacggagtcttactgtgagacgtggcgcacagaggcaccatctgccactggccaggcaagctcactgctagggggtcggctcctcggccaatctgcggcttcctgccatcacgcctatatagtgctttgcatcgagaacagcttcatgaccgccagcaagtag

SEQ ID NO: 28106 - DNA, 5264 bp, Artificial Sequence
  Description of Artificial Sequence: Synthetic coding sequence
atggctccttatccgtgtggttgtcacattctgcttctactgttctgctgcctggcggctgccagagccaacttgttgaacctcaattggctgtggtttaacaatgaagatacctctcatgctgcaacaactattcccgaacctcaaggccctcttccggtccagccgactgccgataccaccacacatgtgacccccagaaacggcagcacagaacctgcaacagcaccaggtagcccagaaccgccaagtgagctgctcgaagacggacaagacaccccgacgtcggcagagtctcccgacgcccctgaagagaacatagccggagtgggcgcagagattctgaatgtggccaaggggattcgcagtttcgtgcagctgtggaatgacacagtgcccacagaatccctcgctcgggctgagaccctggtgctagagacccccgttggaccactggctctagccggtccgtcatcaacacctcaagaaaatggtacaacgctctggccatcccgaggtataccctccagtccaggcgctcacacgaccgaagctgggactctgccagcccctactccttctcccccaagcctgggtcggccatgggcacctctcaccggcccaagcgtgcccccaccctcttctggcagagcctcattgtcatccctgcttggcggtgcgccaccctggggctcactccaggatcctgactcacagggtctgagcccagcagcagccgctccgagccagcagctccagcgcccagatgtgcgactccgcacccctttacttcacccccttgtcatggggtcccttggcaagcatgcggctcctagtgcatttagctccggacttccaggagcacttagccaggtggctgttacaactctgacacgtgacagtggcgcttgggtgagccacgtggccaatagtgtggggcctggactcgccaataactccgcactgctgggggcagatcccgaagctccagctgggagatgtctgccactgccccctagtctgcccgtatgtggtcaccttggtatctcaaggttttggctgcccaaccatctgcatcacgaaagcggagagcaggttcgcgctggagccagggcctgggggggtttactacagacccactgccacccgttcttagcttggtttttctgtctgctgctggtgccaccgtgcggatcagtaccacccccagcccctccgccttgctgccagttctgcgaggctttgcaggacgcttgctggagccgcctcgggggtggaaggctgcctgtggcttgtgctagtcttccaactcaggaggatggatactgtgttctgattggacccgctgctgagaggatcagtgaggaagtgggattattacaattgctcggcgacccgcctcctcagcaggtgacccagaccgatgatcctgatgttggcctggcgtacgtgttcggcccagatgccaattctgggcaggttgcaaggtaccatttcccgtcactcttcttcagggattttagcctgctatttcatatcagacccgctactgaaggacccggagttttgtttgcgataacagattccgcgcaagcaatggttctgctgggtgtgaagctgtctggggtgcaggatgggcaccaggacatctcactgctttatactgaacccggagctggccagacccacaccgccgcttcctttagattacctgcttttgtgggacagtggacccatctcgcgttaagcgtggccggtggcttcgtcgcactttatgttgattgtgaagagtttcaacgcatgcctcttgctcgctcatcgcggggattggaacttgagccaggcgcaggcttatttgtagctcaggcgggaggggctgatcctgataaatttcagggcgtgattgctgagctcaaagttaggagagatccccaagtgtcacccatgcattgcctcgacgaggaaggtgacgactctgacggtgcctctggcgactctggtagtggactgggcgatgcacgagaactcctgcgtgaagagacaggcgctgccctgaagcctcgcctgcccgctccaccaccagtgacaacgccgccactggccggaggatctagcacggaagatagcaggagtgaggaggtcgaagagcagactacggttgcaagcttgggtgcacagactctgcccggaagtgacagcgtgagcacttgggatggatccgtccgtaccccaggaggtcgcgtcaaggagggcggtctcaagggccagaaaggagagccaggtgtgccaggaccacctggacgagccggaccaccaggtagcccttgcctacccggaccacctggactcccttgccccgttagtcccttggggcctgccggacctgccctgcagaccgttcctggacctcaaggccctcccggtcccccagggagggatgggaccccaggccgtgatggcgagcctgtctctccgcatgtgccgccttcaccaggggataccggtccacaagggttccccggaacacctggcgatgtggggcctaagggggataagggggacccaggcgtcggcgaacgagggccacctggcccacagggcccaccgggaccgcctggcccttccttcagacacgacaagctcacctttattgatatggaaggttctggctttggaggtgatctagaggcactcaggggaccaaggggattccccggaccaccgggacctcccggagtccctgggcttccgggtgaacccggacgattcggagtcaatagtagtgatgttccaggtcctgccggtcttcccggagtcccaggacgcgaagggccacctggttttccgggtttgcccggacctccaggaccaccaggaagggaaggccctcccggacgtacagggcaaaagggatctctccaaggagccggagctccaggagtgcaaggaagtaaaggcgctccgggtcctgccggtgctaggggagagtccggcctggccggagcaccaggccctgctggtccacctggcccaccagggccaccaggccctccaggtcctggactccccgcagggttcgacgacatggaggggagcggcggaccattttggagcaccgcacgttcggcagatgggccacagggcccacccggtctgccagggcttaagggcgatcccggagtacccggactcccgggagctaagggcgaggtaggcgcagacggagtcccgggattcccaggtctaccaggcagggagggaattgccggtcctcagggtccaaaaggcgataggggcagccgcggtgagaagggagacccaggaaaagatggcgttgggcagcccggactgcccggaccacctggcccaccagggcctgtcgtgtacgtgagtgagcaggatggcagcgtcctgtccgtcccaggacccgagggcagaccaggattcgctgggttccctggcccagcaggccctaagggcaatctgggaagcaagggggaacgtggatcacccggtcctaagggtgagaagggtgaaccaggaagtattttcagccccgacggcggtgctttaggacctgcccaaaagggagcgaagggggagcccggttttcgtggccctcccggaccctacggacggcctggatacaagggagagattggcttcccaggtcgccctggtcgccctggcatgaacgggctcaagggagaaaagggggaacctggtgatgcctcgctggggttcggtatgcgcggaatgcctggaccacccggacctccgggaccgcctggcccacccggaacgcctgtgtacgacagcaacgtgttcgccgagtcttccaggcctggtccacccggtttgccaggtaatcaaggaccccctggtcccaaaggcgcaaagggtgaagttggcccacccggaccaccaggacagtttccatttgacttcctccagctggaggccgagatgaagggggagaagggcgatcggggagacgctggacagaagggggagcgtggggagccaggcggtggtggctttttcggcagtagtctgcccggaccccctgggcctccaggccctcctgggcctagaggctacccaggaattccaggtcctaagggagaaagcatccgtgggcagccaggccctcccggtccacaaggaccccctggtatagggtatgaaggaaggcagggccctccgggacctccaggtcccccaggaccgccttcattcccgggaccacacaggcagacgatttcagtgccagggccaccaggccctccaggcccacctgggcctccaggcactatgggcgctagctccggagtcaggttgtgggctaccaggcaggctatgttggggcaagtacatgaagtgcccgaaggctggcttatcttcgttgccgagcaagaggagctgtacgtgcgggtgcagaatggcttcaggaaggtgcagcttgaggcccgtaccccgctcccccgtggcaccgacaatgaagtagctgccctgcagccacccgtggtccaactccacgattctaacccctatcctagaagggaacaccctcaccccaccgccagaccgtggagagcagacgatatcctcgcatccccccctagacttcctgagccgcagccgtaccctggcgcacctcatcactcttcttacgtgcacttgagacctgccagaccaacatccccgcctgcacattcccacagagactttcagccagtacttcacctcgtagcccttaattctcccctgagcggcggtatgcgtggcatacgcggagccgactttcagtgcttccaacaggcccgagcagtgggactcgcaggcacttttagggcatttttgtcaagcagacttcaggacctgtactccatcgtgaggcgggcagaccgtgccgctgttcctattgtgaacctcaaggatgaactactcttcccaagttgggaggcactgttctccgggtcagaggggcctctgaagcccggagccaggattttcagctttgacgggaaggacgttctccgacaccccacctggcctcagaagtctgtgtggcacgggagtgatcccaatggacgcagactgacggagagttattgcgaaacgtggaggacagaagcaccttcggccacggggcaggcaagtagccttctcggtgggagattgctgggccaatcagctgcaagttgccatcatgcttacatcgtcctgtgtattgaaaacagtttcatgacagcttccaaata

SEQ ID NO: 28107 - DNA, 1623 bp, Artificial Sequence
  Description of Artificial Sequence: Synthetic coding sequence
atgggtcccggtgagcgtgccggtggcggtggggacgctggcaagggcaatgcagctggcggagggggaggtggacgcagcgccacaaccgcaggctccagggctgttagcgccttatgtctcctcctatccgtcggctccgccgctgcatgcctgctgttaggagttcaggcagccgcactgcagggacgggtggccgcacttgaagaagaacgcgaactcctgcgcagggcaggacctccaggagcgctcgacgcatgggccgagccacatctcgaacgccttctgcgagagaagctggacgggctggcaaagataaggaccgcccgtgaagctccgagcgaatgtgtctgtcctccaggtcctcctggtcgcaggggaaagccagggagaagaggcgaccctgggccaccagggcagagcggccgagacggttacccaggaccactgggcttggacggtaagcctggtctgcccggtccaaagggggaaaaaggggctcccggtgacttcggacccaggggcgatcagggacaggacggagccgcaggcccaccaggtccccctggacccccaggagcccgagggccacccggagacaccggtaaggacggacctaggggggctcagggaccagcgggaccgaagggagagcccggacaggatggagagatgggcccaaagggtccgccagggccaaaaggagagccaggcgtgccaggcaaaaaaggcgatgatgggacccccagtcagcccggaccaccaggcccaaaaggggagcctgggtcaatgggtcccaggggtgaaaacggagtggacggcgctccagggccaaaaggtgagcccggacatcggggaactgatggagccgcaggtccgaggggcgctccaggtttaaaaggtgagcaaggggatacagtggttatcgactatgatggaaggattcttgacgcgctcaaagggccaccaggtccccagggaccaccagggcctcccggtatcccaggggcaaaaggtgagctgggactccctggagctcctggaatcgatggcgagaagggccctaaaggacagaagggcgaccctggagagcccggacctgctggactcaaaggcgaggcgggagagatgggtctgtccggcctgcctggggcagacgggctcaagggtgaaaaaggcgagtcagcatcagactccctgcaggaatcactggctcagttaatcgttgaacctggtcccccaggccctcccggtccgcctggccctatgggtcttcagggaattcaggggccaaagggcctggacggggctaaaggtgaaaaaggggcaagcggtgaacgcggtcctagtggactcccaggtcccgtcggccctcccggtctgattggactcccagggactaaaggagagaagggtcggcctggggaaccgggtctcgacgggtttccgggacccagaggggaaaagggcgacagatcggagcgcggagagaagggcgagaggggcgtgccagggaggaagggtgtgaaggggcaaaaaggcgaacccggtccccctggcttggatcagccctgccccgtgggtccagatggtttgcccgtccctggttgttggcacaagtag

SEQ ID NO: 28108 - DNA, 930 bp, Artificial Sequence
  Description of Artificial Sequence: Synthetic coding sequence
atggagtcacgttccggaattcaggctggtgtgagatgtcgggaccttgggagcctgcaaccacctccccttgcgcttaagcagtttagtagtttgtccctcccatcatcttgggactatcgaagactcccacctcggtgcggctttctattcgaagtatcagagacaacaaatcctccagctgggaccaattcccggcacacgctcaccgtgaagctcgatggactggccaagattaggacagctcgggaggcaccttccgagtgtgtgtgtcctcccggacctcccggaagacggggtaagccgggtagacgcggtgaccccggaccccctggccctctgggtctggacggaaagcctggactgccagggccaaaaggagaaaagggcgctcccggagactttggaccgaggggggatcaaggccaggatggagccgctggcccacctggaccgccaggaccacccggtgctcgagggccaccaggagacaccgggaaagacggacccagaggcgcacaaggacccgcagggcctaagggcgagcctggccaggatggagagatggggcctaagggaccccctggaccaaaaggagaacctggagtacccggaaaaaagggggatgatggtacaccttcacagcctggcccaccgggtcccaagggcgagccaggcagcatgggcccacgcggagaaaacggcgtggacggcgcaccaggccctaagggagagcctgggcatcgagggacagacggggctgcaggaccaagaggcgacgtacgagatcccggactgggatcggtttctagctgttcacagcgccttgccagcagttcaaagaagaacggatccgagcccccacctggatgtgctggctgtccaaggccacaaggtagggcaggcagacacagtggagacagactgtag

SEQ ID NO: 28109 - DNA, 1665 bp, Artificial Sequence
  Description of Artificial Sequence: Synthetic coding sequence
atgactgcccctggagcagcaggacgttgcccccctacaacatggctgggatctcttctacttttggtctgcctgctagcgtctagatctatcacagaggaagtgtcggagtattgttcacatatgattggctccggccacctccagagtttgcagagattaatagattcacaaatggaaacaagctgccagattaccttcgagttcgtcgatcaggaacagctcaaggacccggtctgctatctcaaaaaagcatttcttctagtgcaggatataatggaggataccatgcgcttccgcgacaacacacctaatgctattgccatcgttcagcttcaggagctctccttgcggctgaagagctgtttcaccaaagactatgaggagcacgacaaggcatgcgtaagaacattctacgaaactccacttcagttgctcgagaaggtgaagaatgtgtttaacgaaacgaagaatctcctggataaggattggaacattttctcaaagaactgcaacaattccttcgccgaatgctctagccaggatgtggttacaaagcctgattgcaactgcctctaccctaaggcaatcccatcctccgatcccgcttccgtgtcaccccaccagcctctggccccatcgatggctccagttgctggtctaacatgggaagattccgaggggaccgagggcagtagcctcctgcctggagagcagcctctgcacacagtcgaccccggaagtgcaaaacagcggcctccccgtagcacatgtcagtcattcgaacctcccgagacccccgtggtgaaagatagcacaattggcggtagcccccagccacggccttcagtgggagcctttaatcccggtatggaggatattctcgatagcgctatgggcacaaattgggtccctgaagaagcttccggcgaggctagtgagatcccggtgccacaggggaccgaattatccccgtcccgccctggaggagggtcaatgcaaaccgagccagcaagaccatctaactttctgagtgcttctagtccactgccagcgtctgccaaaggtcagcagcctgctgacgtgacaggcactgcactcccaagggtaggtccagtgagacccactggccaggactggaatcacactcctcagaaaactgaccacccctcagcgctgctgagagaccctcccgagcctggtagccctcgaatctcttcccttagacctcaaggcctgtccaacccgagcaccttgtctgctcagccccagctctctcgatctcacagctcgggcagtgtattgccactgggagagctggagggtcgacgttccacccgggatcggagatcaccggcagaaccggaagggggacccgctagcgaaggcgcagccagacctctgcctaggtttaattctgtgccgctgacagacactggacacgagagacagtctgaggggagtttctcaccccagctccaggagtcagtgttccacctactcgtgccctcagtgattttagtattactggcagtcgggggtttgctcttttaccgatggaggcgtcgaagccaccaggagccacagagggcggactcccccctcgagcagcctgagggtagccccttgacccaggatgaccgacaagttgaactgcccgtctag

SEQ ID NO: 28110 - DNA, 1317 bp, Artificial Sequence
  Description of Artificial Sequence: Synthetic coding sequence
atgactgctccgggagctgctgggaggtgtcctcccacaacatggttaggatcgctgctactgcttgtctgcctacttgctagcagaagtattactgaggaggtatccgagtactgctctcacatgatcggaagcggacatctgcaatccctacaacgcctcatagattcccagatggaaacatcatgtcagataaccttcgagtttgtggatcaagagcagttgaaagatcctgtgtgctatctcaagaaggcattcctcctggtacaggacataatggaagacacgatgcgattccgagacaacacaccgaatgctattgcaattgttcaactccaagagctatccctgcgcctgaaatcctgctttactaaagattatgaggagcacgacaaggcctgcgttcgcacgttctatgagacacctctgcagttgttggaaaaggtgaagaatgtttttaacgaaacaaagaaccttctggataaggactggaacatcttctcaaaaaattgcaacaactcctttgcagagtgttcctctcaggacgtagtcacaaaaccggattgcaattgcctgtacccaaaggctattcctagctcggatcctgcctcggtgtccccgcaccagcccctcgcgccatcaatggccccagtggctggactcacctgggaggacagcgaaggcaccgaaggcagctcgcttttacccggagagcagccccttcatactgttgatcccggtagtgccaaacagcgccctccccgaagtacgtgtcagagttttgagccgccagaaactcccgtagtgaaggatagtacaattggtggctcacctcagcccagaccgtccgtgggcgcatttaatcctggaatggaagacattctcgacagcgctatgggaactaattgggttccagaggaggcatctggggaggctagtgagatccctgtgccgcagggtacggaactcagtccttcgaggccgggaggcggatccatgcaaacagagccagcacgcccatcaaattttctttctgcctcatcacccctcccggcttccgccaagggtcagcagcccgctgacgtgactggacacgaacgccagagcgagggctcattctcgccccagctgcaggaatccgtgttccacctcctggtccctagtgtgatcctggtcttgttggccgtggggggtctactgttttatcgctggaggaggcggtcgcatcaagagccccagagagccgattctcctttagaacagcctgaggggtctccgttaacacaggatgatcggcaggtagaactacccgtttag

SEQ ID NO: 28111 - DNA, 360 bp, Artificial Sequence
  Description of Artificial Sequence: Synthetic coding sequence
atgacggctccaggggcagctgggaggtgcccccctaccacttggctcggctctctgctcctgctggtgtgcctattagcaagcaggtcgataactgaagaagtgtcggaatattgctctcatatgatcgggtccgggcacctgcagtctttgcagaggctcattgactcgcagatggagacctcctgccagatcacgttcgaatttgtggatcaggaacaactgaaggatcccgtttgctatcttaagaaggccttcctgttagtgcaagatatcatggaagacactatgagattccgggataataccccgaacgccattgcaatcgtccagctccaggaactgtccctaaggttatag

SEQ ID NO: 28112 - DNA, 1317 bp, Artificial Sequence
  Description of Artificial Sequence: Synthetic coding sequence
atgactgctccaggagccgcaggtcggtgtcctcctacgacctggcttgggagtcttcttttgttggtgtgtctactcgccagccgatccattactgaggaggtgagtgagtattgctcccatatgatcgggtccggacatttacaaagcctgcaacggctcatcgactcacaaatggaaacaagctgtcaaataacatttgaatttgtcgaccaggagcagcttaaagacccggtgtgttatcttaagaaagcattcctgctcgtccaggatatcatggaggatacgatgaggttccgtgacaacacccctaacgccatagctatcgttcagctgcaagaactgagccttcgcctaaagtcttgttttaccaaggactatgaagagcacgacaaggcctgtgttcgcacattttacgagacacccctgcaactgttagagaaggtgaaaaatgtgtttaacgagacaaagaatctccttgataaggactggaacatcttcagtaaaaattgtaacaattcctttgccgagtgttcgagccaggacgttgtgacaaagccagactgcaactgcctgtacccaaaagctataccatcaagcgatcccgcatccgtgagtccccatcaacctctggcgccatccatggccccagtcgctggcctgacatgggaggactccgaagggaccgaaggatcatccctccttccaggggagcagcctctgcacaccgtcgatcctggcagcgccaaacagcgtcctccacgctcaacctgccagagtttcgagcccccagaaacccccgtcgtgaaagatagcactatcgggggaagcccacagccgagaccctctgtgggcgcattcaatcccggtatggaagatatcctggacagtgcaatggggaccaactgggtaccagaagaagcttctggcgaggcaagcgaaatcccagtgccccagggcaccgaactgtcacctagtagacctggcggaggcagtatgcagacggaaccagccaggccgagtaactttcttagtgcctcatcacccctgcctgcaagcgccaaaggacaacagccagccgacgttaccggtcatgagcggcagtccgaaggatcattcagccctcagctgcaggaaagtgtgttccatctgctcgtcccttctgtcattctggtgttactggccgtgggtgggcttcttttctaccgatggcgcaggcggtcccaccaggaaccccagcgagcagacagtcccctggaacagccagaaggctctccactgacacaggatgatagacaggtggagctcccggtctag

SEQ ID NO: 28113 - DNA, 1665 bp, Artificial Sequence
  Description of Artificial Sequence: Synthetic coding sequence
atgaccgctccaggcgcagccggtaggtgtcccccaactacctggcttggctccttattactgctggtttgccttttggcaagccggtcaatcaccgaggaggtaagcgagtattgttcccatatgatagggagtggacacctgcagagcctgcagaggctgatagacagccagatggaaacctcctgccagattacattcgaatttgtggaccaggagcagctcaaagacccagtctgttacttgaaaaaggcgtttcttctcgtgcaggacatcatggaggacacaatgcgcttcagagataatacgcctaatgctattgccatcgtgcagctgcaggagctttcgctcagactgaagtcttgtttcacgaaagattatgaggagcatgacaaggcttgcgtcaggaccttctacgaaactcctttgcagctgttggaaaaggtgaagaatgtgtttaacgagactaaaaatctgctagacaaggattggaacattttctctaagaattgcaacaatagcttcgccgaatgcagctctcaggacgtggtcaccaagccggattgtaactgtctgtacccaaaggcaattccatcatctgatcccgcttccgtgagcccgcatcaacctttagcacccagcatggcacccgttgcaggcctgacatgggaagactcagagggcacagaaggctcatcactgctaccaggcgaacaaccactccacactgtggatcccggttcggcgaagcaacggccacctcggagtacgtgccagtcctttgagcccccagagacccctgtggttaaagatagcacaatcggcggaagcccacagccaaggccctctgttggagccttcaatccaggcatggaagatatcttggatagcgctatgggaacgaattgggtacccgaggaggcgtcaggggaggcctcagaaatcccagtgccccagggaacagaactgagcccatcaagaccaggaggcggtagcatgcaaacagaaccagcccgacctagcaacttcttgagtgcatcctcacctctgccggcatccgcaaagggccaacagcctgctgatgtgactgggaccgccttacccagagtggggcctgtgcgcccaactgggcaggattggaaccatacccctcaaaaaacggatcaccctagtgcactcttgcgcgaccctccagagcccggatccccacgtatttcgagtctgcgcccacagggactctccaatccttccaccctgagtgcccagccccagctatcaaggagccatagcagcggcagcgttctcccactgggggagctagagggccgacggtctacgcgggacaggagaagtccagccgagccggagggcggacccgcatcggaaggtgctgctcgcccactgccccgttttaatagcgtgccgctgacggacaccggtcatgaaaggcaaagcgaaggatcttttagcccacagctccaagagtctgtgttccacttactggtgcccagtgtcattctggtgcttctagccgtcggaggcctcctgttctaccgctggagacgacggtctcatcaggagcctcagcgagctgatagccccctagagcagcctgaaggcagccccttgactcaggatgaccggcaggttgaactgccagtgtag

SEQ ID NO: 28114 - DNA, 771 bp, Artificial Sequence
  Description of Artificial Sequence: Synthetic coding sequence
atgacggcacctggcgctgcagggaggtgtcctcctacaacttggttagggtcacttctgcttctggtctgcctgctcgcttctcgcagcataaccgaagaagttagcgagtactgttcccacatgataggaagtggacacttacagagcctgcaaagactgattgacagtcagatggaaacttcctgtcaaatcacattcgaattcgttgaccaagaacagctgaaggatccagtgtgctacctgaagaaggcctttttactggtgcaggacataatggaggacaccatgcgattccgagataatacccccaacgccatcgctattgtgcagttgcaagaactgtcactcaggcttaagagctgctttacgaaggactatgaagaacacgataaagcctgcgtgaggactttttatgagacacctcttcagctgcttgagaaagtcaagaatgttttcaatgagacgaagaaccttcttgataaggattggaatattttctccaagaactgcaataacagctttgccgagtgttcaagccaaggccatgagagacaatcagaaggcagctttagcccacagttgcaggaaagtgtctttcaccttctggtgccgagcgtgatcttagtgttgttggcagtggggggactcttgttttataggtggcgccgacgcagccatcaggagcctcaacgagctgattcccctctggagcagcccgagggttcccccttgacacaggacgaccgccaagtggagctgcccgtatag

SEQ ID NO: 28115 - DNA, 828 bp, Artificial Sequence
  Description of Artificial Sequence: Synthetic coding sequence
ggaagccccggtatggcaggagcactgtgcgccggtcacattgccggtctttacggagaccggggtttggttccctcgactcgcagagaggagcgaggcggacgcaaaacgtggcaaactggtgcagctcgccctcaagggggagctcggggagctggaggaccctggcaccccgatagacaccccaggccgaaggagacccgtggaaatctggggccactggaaacgccggctcgctgggcaacgcagggacccgctgctcctagcgaaccaattcccggaatcaaggggaccaaggggagtcccggaaacatcaaggaccagccgagacccgcattctcagccattcgcaggaaccctaacggaggacagcggggacattcgactcgatcctcccccacccgcaagaatcgtacgagaactacaccggcagattccagcgccctttatccagccacaacaacttcacccagccgctgttgtccaagtggtaagtcagcctgtccatcaagtcccccacagggcgctaggtcagatgctccctgggcaagcgtcaccccccctacccggggttcttcacgatggtgtcagggagcctggtgtttctcctgtagccgagtgactagatcaggcctgaagaaaacaccaaaaagggtaacattcaccagggcccttcgcccaacagctagttcggctgcctcatcaagtagccacctccctgagccaggcaaagacccactaccacatcctccactttggctgccgtgttccgcctgcaaaatgggagctctcctattacagctactgaagggaggcggatggctctag

SEQ ID NO: 28116 - DNA, 738 bp, Artificial Sequence
  Description of Artificial Sequence: Synthetic coding sequence
atggaaggcccaagggggtggctggtgctgtgtgtgcttgctatatcacttgccagtatggttacagaggacctctgtcgcgctcccgatggcaaaaaaggggaggcgggtcgccctggcaggcgcggacgccctggattgaaaggagaacagggcgaacccggtgccccaggcatccggaccggaatccaaggactcaagggtgatcaaggtgagcccggtccgtccgggaacccgggaaaggtgggttaccccggaccaagcggacctctgggtgctcgtggcatcccagggattaaggggaccaaaggctccccgggtaacattaaagatcagcctagacctgccttttccgcaattcgtcgaaaccctccaatgggtgggaatgtggtaatattcgacacagtgatcactaatcaggaggagccttatcaaaaccactctgggaggtttgtgtgcaccgtgccagggtactactattttacctttcaggtcctgagccagtgggagatatgcctgtcgatcgtgagttcctctcgtgggcaggtaagacggagcctgggtttttgtgacaccacaaataagggactgtttcaagtggtttccgggggtatggtgttgcaactgcagcagggagaccaggtgtgggtggaaaaggatcccaaaaagggtcacatctaccagggaagcgaggcagattcagtgttctccggattcttgattttccccagtgcttag

SEQ ID NO: 28117 - DNA, 738 bp, Artificial Sequence
  Description of Artificial Sequence: Synthetic coding sequence
atggaaggcccaaggggttggctagtgttatgcgttctggcgatttctctggccagtatggttaccgaagatctgtgtcgcgctcctgacggtaaaaaaggagaagccggaagacccggacgccgaggcagacccggattgaaaggcgaacaaggcgagccaggcgcacctgggattcggacgggcatacagggactcaaaggagaccaaggcgaacccggacctagtggaaaccccggaaaagtaggctatcctgggcctagcggccctttgggcgcaagaggcattcccggaataaagggcaccaaaggctctcctggtaatatcaaagaccaacccaggcccgctttttccgcgattcggaggaacccacctatggggggtaatgtggttatcttcgatacagtgatcactaatcaagaggagccatatcagaatcactcaggtcgctttgtgtgcacagtgccaggatattactacttcaccttccaggtgcttagccagtgggaaatctgtctcagcatcgtgtcctccagcagaggacaggtgcgacggagcctggggttctgtgacacgaccaataaagggctgttccaagtggtgagcggcggaatggtcctgcagttacaacagggcgaccaagtttgggtagagaaagatccgaagaaagggcacatctaccaaggaagtgaagctgattctgttttttctggtttccttatctttccctccgcttag

SEQ ID NO: 28118 - DNA, 666 bp, Artificial Sequence
  Description of Artificial Sequence: Synthetic coding sequence
atggagggaccccgtggatggttggttttgtgtgtgttagcaatctctcttgcaagcatggttacagaagatctgtgccgagcccctgacggtaagaaaggagaggcaggaaggccaggtcgcagggggagaccagggttgaagggagaacaaggggagccaggagctcccggaataaggaccgggattcagggcctgaaaggagaccaaggggaaccagggccatctggaaacccaggtaaggtcggatatcccggacccagcggcccattgggggcacggggtattcctggaatcaagggaactaaaggcagcccgggtaacatcaaggatcagccaagacctgccttcagcgccattcgcaggaatccacctatgggaggcaatgtggtgattttcgacacagtcattacaaaccaggaagagccgtaccaaaaccattccgggaggtttgtgtgcaccgtccctgggtattattacttcacttttcaagtgctgtctcaatgggaaatctgcctctccatcgtgagctcttctcggggtcaggtgagaagaagcctgggattctgtgacaccaccaataagggcctcttccaggtagtttcaggtgggatggtcctccagctgcaacaaggggatcaggtatgggttgaaaaggacccctag

SEQ ID NO: 28119 - DNA, 1050 bp, Artificial Sequence
  Description of Artificial Sequence: Synthetic coding sequence
atgacagcagcttctatggggccagtgcgagttgcttttgtggtcctactcgccctctgtagtaggcccgctgtggggcagaactgcagtgggccttgtaggtgccccgatgaacccgcaccacgctgcccagccggtgtgagtttagtactcgatgggtgcgggtgctgccgggtttgtgcgaaacagctgggggaactgtgcacggagcgagacccatgcgatccccacaaaggacttttctgccacttcggctctcctgctaatcgaaagattggcgtgtgtacggccaaggacggagccccatgtatattcggcggaacagtgtaccggtctggagaatcatttcaatcatcttgtaaatatcagtgtacatgccttgatggtgccgtgggttgtatgccattgtgtagtatggatgtccgcctgccgtccccagactgtcctttccctaggcgcgtgaaacttcctgggaaatgttgcgaggagtgggtgtgcgatgagcctaaggatcaaactgtggtggggcctgcactggccgcatacagactggaagacacctttgggcctgaccctaccatgatcagagccaactgtttagttcagacaactgaatggagcgcctgttccaagacatgcggaatgggcattagtactagggtgaccaacgacaatgcttcctgccggttagaaaaacagtccagactgtgtatggtcagaccgtgcgaagccgatctagaggaaaacattaagaaaggcaagaaatgtatccgtaccccgaagatcagcaaaccaatcaagtttgaactgtccggatgtacttcaatgaaaacatatagggccaaattctgtggcgtatgcacagatgggaggtgttgcaccccccacaggaccaccaccctgcccgtcgagtttaagtgtcctgacggcgaggtgatgaagaagaacatgatgttcattaaaacatgtgcctgtcactacaactgtccaggggataatgacatttttgaaagcctgtattatagaaagatgtatggcgatatggcctag

SEQ ID NO: 28120 - DNA, 2238 bp, Artificial Sequence
  Description of Artificial Sequence: Synthetic coding sequence
atggaacgtccaccgggtctgagaccgggtgccggtggcccttgggaaatgcgggaacggctgggcaccggcggattcggcaacgtctgtttataccagcatcgcgaacttgatctgaaaatcgccattaaatcatgtcgcctggaactttccacaaaaaatcgcgaacgttggtgccatgaaatccaaatcatgaagaaattgaatcacgcaaacgtcgtcaaggcctgtgatgtgcccgaggagctgaacatacttatccatgatgtccctctgttagctatggagtattgcagcgggggagaccttaggaaactgctcaataaacccgagaattgttgtggcttgaaagaatcccaaattctgtctttactgagtgacatcggctcaggcattcgatatcttcatgagaacaagatcatacacagagacctcaaaccagagaatatcgtcctgcaggatgttggagggaagatcatccacaagattatcgacctaggctacgctaaagatgtggatcagggctctctttgcacctccttcgtgggaaccctgcaatatcttgcacctgagctgtttgagaacaagccatacaccgccactgtggattactggtctttcggtacaatggtgtttgaatgtattgcaggctacagaccctttctccaccacctgcagccctttacctggcatgagaaaattaagaagaaggatcccaagtgtatatttgcttgtgaagaaatgtccggtgaagtgagattttcgtcccacctgccacaacctaactctctttgctcgctggtggtggagccaatggagaattggctgcagttaatgctgaactgggatcctcagcagaggggaggccctgtggatctcactcttaaacagcctcggtgctttgtgctcatggaccatatcttaaatcttaaaattgtgcacatcttaaacatgacaagcgccaagattatttcattcttactgccaccggatgaaagcctgcattctttgcagtctcggatcgagagggagaccggaatcaatactggaagtcaggagctgctgtccgaaactggtatctctctggacccaaggaagccagcatcccaatgcgttttagatggcgttagaggatgcgactcctacatggtttacttgtttgacaagagcaagaccgtctatgaaggcccattcgcgtctaggtcccttagcgactgcgttaactacatcgtgcaggactcgaaaatccagttgccaataattcagctgcgcaaggtatgggctgaggccgtccattacgtgtctggcttgaaggaggactactctcggctgttccagggtcagagggccgctatgttgagcttgctgcgatacaatgccaacctgacaaaaatgaaaaatactctgattagcgcctcccaacagctgaaagctaagcttgagttttttcacaaatccatccagctcgacctcgagcggtattctgagcagatgacctacggtatatcaagcgagaaaatgctgaaagcctggaaagagatggaggagaaggccatccattacgctgaagttggtgtaattggctatttggaagaccagatcatgagtctccatgccgagatcatggagctacagaagtcaccgtatggccgtagacagggagatttgatggagtcactggagcagagggccattgacttatacaaacagctgaaacacaggccttctgatcactcatattcagactctacggagatggtcaaaattattgtgcacactgtgcagtctcaggaccgcgtgctaaaggaattgttcgggcacctgtcaaagctcctggggtgtaaacagaaaataattgacctactgcctaaggtagaggtggcattgtcgaacatcaaggaggctgataataccgtgatgttcatgcagggtaagcggcaaaaagagatttggcatctactaaaaattgcatgcacccagtcatccgccaggagcctcgttggtagctcactcgagggagcagtcactccccaaactagtgcgtggctgccaccaacatccgcagaacatgaccattccctgtcatgcgtagtcactccacaggatggggaaacgtccgcccagatgatcgaggagaatttaaattgtttgggccacctgtctacgatcatccatgaagcgaacgaggagcaaggaaatagtatgatgaacttggattggagctggctgactgagtag

SEQ ID NO: 28121 - DNA, 1653 bp, Artificial Sequence
  Description of Artificial Sequence: Synthetic coding sequence
atgtggaaagcgagcgctggtcacgccgtctctatcgcccaagatgatgcaggagctgacgattgggaaacagatccagacttcgtgaacgacgtgtcggagaaggaacagcgctggggagccaagacagttcaaggctcgggacatcaggaacatatcaatatccacaagctccgagaaaacgtctttcaggagcaccagaccctgaaggaaaaggagctggagacaggacccaaagcctctcatggttatggcggaaagtttggggtggagcaggacagaatggacaaatctgctgtgggccacgagtaccagtccaaactttcaaagcattgttcccaagtcgatagcgttaggggatttggcggtaaattcggagtgcaaatggatcgcgtcgaccagtccgctgtcgggttcgagtatcagggaaagaccgaaaagcatgctagtcaaaaagattactctagtggatttgggggaaagtacggtgtccaggccgaccgggtggataagtccgctgttggcttcgattaccagggtaaaaccgagaagcacgaatcacagagagattacagtaagggttttggaggaaagtatggcatcgataaggacaaggtagataagtcagcagtaggcttcgagtatcagggcaaaacggagaagcatgagagccagaaggactatgtcaagggctttgggggtaaattcggagttcagactgacagacaggataaatgtgctctcggctgggaccatcaggagaagctccaactgcacgagtcccaaaaagactacaagacagggtttggcggtaaatttggagttcagtcagagagacaagatagcgcagccgtcggattcgactacaaggagaaactggctaaacatgagagccaacaggattactcaaaggggttcgggggaaagtatggcgtgcagaaagaccgaatggacaagaatgcgtcaaccttcgaggacgtcacacaggtgagcagtgcttatcagaaaactgttcctgtggaggcggttacaagtaaaacttccaacatccgtgccaacttcgaaaacttagctaaagaaaaagagcaggaggacagaaggaaggcggaagcggagcgagcccagcgcatggccaaagaaaggcaggagcaagaggaggccaggagaaagctggaagagcaagctcgagccaaaactcaaactcctcctgtgtccccggcaccacagccaacagaggagaggctaccctcctccccagtttatgaggacgccgctagctttaaggcagaactcagctacagaggtcctgtgagcgggacggagcccgaaccagtctacagcatggaagccgctgactaccgggaagcaagcagtcagcagggactggcttacgccaccgaggccgtttatgaaagcgcagaggcccctgggcattacccagccgaagattcaacctatgatgagtacgaaaacgatctggggattaccgccgtggccctctatgactaccaggccgcaggtgatgacgagattagcttcgatccagacgacattatcaccaatatcgaaatgattgacgacggttggtggcggggagtgtgtaagggcaggtacgggctgttccctgcgaattatgtggagctgcgccagtag

SEQ ID NO: 28122 - DNA, 1542 bp, Artificial Sequence
  Description of Artificial Sequence: Synthetic coding sequence
atgtggaaagcctccgctggccatgcagtgtccatcgcgcaagacgatgcaggtgccgacgactgggagacagatcccgacttcgttaacgacgtgtccgagaaggaacagcggtggggtgcaaaaactgtgcagggaagcggccatcaggaacatataaacattcataaactgcgggaaaacgtttttcaggagcaccagaccctcaaagaaaaagagctggagactgggcctaaggcatcccatgggtacgggggaaaatttggagttgagcaggatcgaatggacaagagcgcagtcgggcatgaatatcaaagcaaactctcaaaacattgctcacaggtcgacagcgtgagagggttcggagggaaattcggcgttcaaatggaccgggtggatcaatccgccgtgggtttcgaataccagggtaagacggaaaagcatgcaagtcagaaggattattctagtggcttcgggggtaagtatggtgtccaagccgaccgggtggacaaaagcgctgtgggtttcgattaccagggaaaaacagagaaacacgaaagtcagcgtgactattccaaaggctttggtggcaagtatggcatcgacaaagacaaagttgacaaaagcgcagtcggcttcgagtaccagggaaaaaccgaaaaacatgaatcccagaaggattatgtgaaaggttttgggggaaagttcggagtccaaactgacagacaagacaaatgtgcattaggatgggaccaccaggaaaagctccagctccacgagagtcagaaagactacagtaaaggctttggaggcaaatacggagtacaaaaggatagaatggataagaatgcgtccacgtttgaggacgtgacccaggtctcttccgcctaccagaagactgttcctgtcgaggccgttacaagcaagaccagcaacattcgggctaacttcgagaatctggcaaaggaaaaggaacaggaagatagacggaaagcagaagccgagcgcgctcagcgaatggcgaaagagcgccaggagcaggaagaagcgcgaaggaagcttgaagagcaggctcgggctaaaacacagacccctcccgtgtccccagctccacagccaactgaggagcggctaccttcttcacccgtgtatgaggatgccgcatcttttaaggctgaattaagctatcggggacctgtttccggaaccgaaccagagcccgtgtactccatggaggcagccgactatcgcgaggctagcagccagcaggggctggcgtatgctacagaagccgtatatgagtcagcagaggctcccggtcactaccctgccgaagacagtacctatgacgagtacgagaacgatctgggcattaccgccgtcgcactctacgactaccaggccgctggagatgatgaaattagttttgaccctgatgatatcataaccaacatagaaatgattgatgacggctggtggcgcggtgtgtgcaaaggtcgctatggtctctttccagcgaactatgttgaactgaggcagtag

SEQ ID NO: 28123 - DNA, 1905 bp, Artificial Sequence
  Description of Artificial Sequence: Synthetic coding sequence
atgtggaaagcgtctgctggacacgctgtctccattgcgcaggacgacgctggcgctgatgattgggaaactgatccggacttcgtgaacgatgtcagtgaaaaggagcagcggtggggcgctaagactgttcagggttcagggcaccaagagcacatcaatattcataagcttcgggaaaacgtctttcaagagcatcagactctgaaggagaaggagctagaaacgggcccaaaagccagccatggatatggtggcaaatttggcgtagagcaggatagaatggataaaagtgcagttgggcacgagtatcagtccaagttgagcaaacattgtagccaggtggactcagtacgcggattcggcggaaagttcggcgtgcagatggaccgtgttgaccagtcagccgtggggttcgagtatcaggggaaaaccgagaagcatgccagtcagaaggattactcgtccgggtttggagggaagtatggtgttcaggctgatcgggtggacaaatctgctgtgggctttgattatcaaggcaaaacggagaagcatgagtcccaacgggactacagtaagggcttcggcggtaaatatggtattgataaggataaagtggacaaatccgccgtggggtttgagtaccagggaaagactgagaagcacgagagccagaaagattacgtgaagggcttcggcggtaagtttggagtccaaaccgatcgacaagataagtgtgcattgggctgggatcaccaagaaaaactccaactgcacgagtctcagaaggattatagcaagggatttgggggtaagtatggtgttcaaaaggatcgcatggacaagaacgcgagtacgttcgaggacgttactcaggtctcttcggcctaccagaaaacagtgccagtcgaggccgtcacgtcaaaaacctctaatattcgagctaacttcgagaatctggctaaagagaaggaacaggaagatagacgcaaggccgaggcggagagagctcagagaatggccaaagagcggcaggagcaggaggaggcccgaaggaagctagaagagcaagctagggcaaagacacagactccaccagtatccccagccccacagcctacagaggaacgacttccgagttcaccagtttatgaagacgccgcatcattcaaggccgagctatcctacagaggacctgtatcaggcacagaacccgaacccgtgtattctatggaggctgcagattacagagaagctagttctcagcagggacttgcttatgccactgaggctgtctacgagagcgccgaagctcccggacactatcctgccgaagacagtacctatgatgagtatgaaaacgatctggggattactgctgttgccctgtatgattaccaagcggcaggggatgacgagatcagtttcgacccggatgacataattactaacatagagatgatcgacgacggctggtggcgaggggtgtgtaagggaaggtttcgtgaactcgcctttagttgtgtcagggttgctctggtgcccatcaagtgttctagagatctgccaggacaggccaggggattgagaagcgccttatggcgggtgggtagaaaggactgtcctagacggggagcgtcctcgcgagtatccctcttaggcagaagaggtttgggtctcatggaggtgaatcccgagctgagccaccctgagcacaggtcctgccacgtcaggtgggagatctgtctgtgtcataccgtcacagcccgtagaattcgcaaactaatttccttccttagatcgagggaggccggacccgttccttcttgctcacaagtaggaggggtctcattccagaaggtcacctggaagtgtctaggcacgtgggttcctgagtgtccgtag

SEQ ID NO: 28124 - DNA, 945 bp, Artificial Sequence
  Description of Artificial Sequence: Synthetic coding sequence
atggataaaaacgcctccacattcgaggacgtgactcaggtgagcagcgcatatcagaaaacagtgcctgtggaggcagtgaccagtaaaacatcaaatatccgagccaactttgaaaatttggccaaggaaaaagagcaggaagataggaggaaggcggaggccgaaagagcccagcgaatggcaaaagagcgccaggaacaggaggaagcccgaagaaaactcgaggagcaggctcgagccaagacccagacaccccctgtgagtcccgctcctcaacctaccgaggaacgcttacccagctcaccagtgtacgaggatgctgcttcttttaaggcagagctaagttatcgtggtccagtgagcgggacagaacccgaaccagtctacagcatggaagccgcagactaccgggaagccagctcacagcagggactggcctacgctacagaggcggtttatgaatccgcggaggcacccggtcattacccggctgaagacagtacctacgacgaatacgagaatgatctcggcatcaccgccgtagctctctatgattaccaggccgcaggtgacgatgaaatctcttttgatcccgatgatattattaccaacatagaaatgattgacgacggttggtggagaggtgtgtgcaagggcaggttccgagaactggcgttttcatgtgtgcgtgtcgcattggtccccattaagtgctcccgagatcttcccggacaagctcgtgggctccggtcagcactttggagggtcggaagaaaagactgtcctagacggggagcttcctccagggtgtccctcctcgggaggcggggtctgggcttgatggaggtgaaccccgagctttcccacccggagcatagaagctgccacgtgagatgggaaatttgcctctgtcacacagtgactgccagaaggattcgatag

SEQ ID NO: 28125 - DNA, 1761 bp, Artificial Sequence
  Description of Artificial Sequence: Synthetic coding sequence
atgggcgttaacgctgtgcactggtttcgtaaagggctgcgcctgcacgataatccagctttgaaagaatgtatacagggagctgacactatcaggtgcgtgtacattcttgatccttggtttgccggatcctctaacgtggggatcaaccgatggcggtttctccttcagtgtcttgaggacctggacgcaaacctgaggaaactgaactctcgactctttgtcatacgaggtcaacctgctgatgttttcccccgactcttcaaagaatggaacatcactaagctgtctattgaatacgattcagaaccctttggaaaggagcgcgatgcggcaatcaagaagcttgctaccgaggccggtgtcgaagtgatagttagaataagccataccttgtacgacctcgataagatcatcgaactgaatggcggacagccacccttgacctataaaaggtttcagaccctgatttccaagatggagcccctcgaaatacctgtcgagactatcacatccgaagtgatcgaaaaatgtactacgcctctgtcggatgatcacgatgaaaagtacggggtgccttcccttgaggaactgggctttgatacagacggactgtcatccgcagtctggccaggcggagaaaccgaggccctcaccaggctggagcgacatttggaacggaaggcatgggtggcaaattttgagcgtcccagaatgaatgccaacagtcttctggcctccccaacaggtttatctccatatcttcggtttggctgtctgagctgtaggctgttctattttaagctgacggatctgtacaaaaaagtgaagaagaattcttccccacctctgagtctctacggacagctcctttggcgtgaatttttttacacagcagcaacaaataatcctcgttttgacaaaatggaaggcaatccaatttgtgtgcagataccctgggacaagaatcctgaagctctggccaaatgggcggagggtcgtactggcttcccctggattgatgccattatgacacaactgcgtcaagagggctggatccaccacctggcccgacacgcagtcgcttgttttttgacacggggtgatttgtggatttcctgggaggagggtatgaaagtttttgaggagttactgctggacgcggattggagcattaatgcaggatcctggatgtggttgtcatgcagctctttctttcaacagttcttccactgctactgtcctgtgggtttcggccgtagaacagatccaaatggagattacatccgcaggtacctgcccgtcttgcgcggattccctgcgaaatacatatatgatccctggaacgccccagaagggatccaaaaagtcgccaagtgcctgatcggagtgaactacccaaagcccatggtgaaccatgccgaggcttcccggctcaacatcgagcggatgaaacagatttatcagcagttgtccaggtatcgtgggctgggccttctggccagcgtaccaagcaaccctaacggaaatgggggtttcatggggtatagcgcagagaatattcctggatgttctagctcgggctcgtgcagtcaggggtcaggcattctccactacgcacacggagattcacaacaaacgcatctccttaaacagggacggtcgtctatgggtacaggcctgtctggtggaaaacggcctagccaggaagaggacacacagagcattggcccaaaagtgcagcggcagtccaccaactag

SEQ ID NO: 28126 - DNA, 582 bp, Artificial Sequence
  Description of Artificial Sequence: Synthetic coding sequence
atgctcgaagtgggctgcgggtgtttagtagtcccgttctttaacttctttcattgctactgcccagtaggctttggcagaaggacagatccaaacggagattatatccgcaggtatctcccagtcttaaggggcttcccggcaaagtacatctatgatccttggaacgcccctgaaggcatccagaaagtggccaaatgcttgattggcgtcaactaccccaaacccatggtgaaccacgcagaggcatctaggcttaacattgaacgtatgaagcagatctaccagcagctctcaagataccgcggactcggactgttggcctccgtgccttctaatcccaacggaaatggaggatttatggggtactctgccgaaaacattccaggctgtagcagtagcggctcttgtagtcagggatctgggattctgcattatgctcacggcgacagccagcaaacccacctcctaaaacagggacggtcatctatgggcactggactgtcgggcggtaagagacctagccaggaggaggatacacagtccatagggccaaaggtccaacggcaatccacaaattag

SEQ ID NO: 28127 - DNA, 1323 bp, Artificial Sequence
  Description of Artificial Sequence: Synthetic coding sequence
atgggaagctctcatcttttaaacaagggcctgccactcggggtgaggcccccaataatgaacggcccattgcacccacgaccactggtggccctgctggacggcagagactgtacagtggagatgcccattctgaaagacgtcgctactgtggcattctgcgacgcgcaatctacgcaagagattcacgagaaagtcctaaatgaagctgtcggcgctttgatgtatcacaccatcaccttgactcgtgaggatttggaaaaattcaaagcgctgcgtatcattgtccgcatcggtagcggttttgataatatcgatattaaatctgcgggtgacttaggcatagctgtttgtaacgtacccgctgcttcagtcgaagagacggctgacagtacactctgccatattctcaatctgtacaggcgcgctacctggcttcaccaggccctccgagaaggcacccgggtgcagagcgttgagcagatcagagaagtggctagcggtgctgctaggatccggggtgaaacactcggcatcatcggactaggtcgcgtgggccaggcggtggccctgcgggctaaagcctttggctttaacgttttattttacgatccctacttgtctgacggcgtggagagagcgcttggcctccagcgcgtgagcacgcttcaagatctactgtttcactctgactgcgtgactttgcactgcggcctgaatgaacacaaccaccacttgatcaatgattttaccgtgaagcagatgcggcaaggagcttttctcgtcaacactgccagaggaggcctcgtggatgagaaggccttagctcaagccctaaaggagggtcgcatccggggagctgctctggacgttcatgagtccgagcctttttccttttctcaggggcctctcaaagatgccccaaatctgatctgcactccccacgccgcatggtactccgagcaggccagtatcgaaatgcgcgaagaagcagctcgtgaaattagacgagcaatcaccggtagaattcccgatagccttaagaattgtgtaaataaagaccacctcaccgctgcaacccattgggcatctatggaccccgctgtggttcacccagagttgaacggtgcggcataccggtatccccctggggtggtgggcgtcgctccaaccggcattcctgccgcagtggaggggatagtgcctagcgcgatgtctctgtcccacggcctgcccccagtggcccaccctccccacgcccctagccccggacaaacagttaaaccagaggcagacagggaccacgctagtgaccaattatag

SEQ ID NO: 28128 - DNA, 1290 bp, Artificial Sequence
  Description of Artificial Sequence: Synthetic coding sequence
atgagcggggtgaggccccctatcatgaacggccctttgcatccgagaccactggtagcactgctggatggcagggactgtaccgtcgagatgccaattttaaaggatgtggccacagttgccttctgcgatgctcagagtacgcaagagatacatgagaaggtgttgaatgaagccgtcggcgcactgatgtaccataccattacactcacaagggaagatctggagaaattcaaggccttacgaatcattgtgcggatcggttcagggtttgataatattgatattaaatcagctggggacttaggtattgccgtctgtaatgtacctgccgcttccgtggaagagaccgccgattctactttgtgccacatactgaacttatacagaagggctacctggctccaccaggcactgcgcgagggaaccagagttcagagcgttgaacagatacgggaggtggctagcggtgctgcccgtatcagaggagagaccctggggattatcggacttggccgtgttggccaggcagttgcactacgcgctaaggcctttgggtttaacgtccttttttacgacccgtatctgtctgacggcgtcgagagagctctcggcctgcagagagtatcaactctacaagaccttcttttccattcggattgcgtcacactgcactgcggacttaatgagcacaatcaccacctgatcaatgacttcacagtgaagcaaatgcgccaaggggcttttttagttaacactgcgagaggcggacttgtcgatgagaaggcgctcgctcaagctctgaaagaaggaagaatcaggggggctgcattggacgtgcacgagtctgagccattttcgttcagtcagggacctttaaaggacgcgccaaatctgatttgcactcctcacgcagcatggtattcagagcaggcctcaattgagatgcgtgaggaggctgccagggagattcgacgcgctatcaccgggaggattcctgattcccttaagaactgtgttaacaaagaccacttgaccgccgcaacacattgggcgtccatggatcctgccgtggtccatcctgagttgaatggagcagcgtaccgttatccgcctggggttgtcggcgtagctcctactggtatcccggcagccgtcgaaggtatcgtgccatcagctatgagcctgtcccacggactacccccagtggcacatccaccacacgcaccaagccccggtcaaacagtgaagccggaggccgatagggaccatgcttccgaccaactctag

SEQ ID NO: 28129 - DNA, 438 bp, Artificial Sequence
  Description of Artificial Sequence: Synthetic coding sequence
atgagcggagtgcgcccaccaatcatgaatgggcctctgcatcctcgtcctctggttgcactactggatggcagggactgcaccgtagaaatgcccattctgaaagatgtcgcaactgtggcgttttgtgacgcacagagtacacaggagatccatgagaaggtgttaaatgaagcggttggcgcattgatgtaccacacaatcacgctgacgcgcgaagacctcgagaaattcaaagctctcagaattattgtgcgcattggcagtggctttgataatattgacatcaaaagcgccggagacctgggaatcgctgtctgcaacgtgccagccgcaagtgtggaggaaacagcagactccacactttgtcacattctcaacctctacagacgcgctacttggctccaccaggcccttcgggagggaactcgtgtttag

SEQ ID NO: 28130 - DNA, 516 bp, Artificial Sequence
  Description of Artificial Sequence: Synthetic coding sequence
atgtccggagtgcgtcccccaattatgaacggccctctgcatcccagaccgctggtggcgcttcttgatggcagggactgtacagtggagatgccaattttgaaggatgtagcaacagtggccttttgcgacgcccagtctactcaggaaatacacgaaaaagttctcaacgaagccgtcggggctttgatgtatcatacaataacactgacgcgtgaagacttggagaagttcaaagctctgcgaatcatagtccgcatcggcagcggcttcgacaacattgacatcaagtcagccggagacctggggattgcggtgtgtaacgtcccagccgcatctgtcgaggagacagcagactctactctgtgtcacattctgaatctgtatcgcagagccacctggttgcatcaggctcttcgggaggggactagggtgcagtccgtggagcagattcgggaagttgcttcaggcgcagcgagaatacggggagagactctgggcattatcggcttatag

SEQ ID NO: 28131 - DNA, 2958 bp, Artificial Sequence
  Description of Artificial Sequence: Synthetic coding sequence
atgcccgtgccttccaggcatatcaacatcggtcgcagtcagagctgggacgccgcagggtggtacgaaggtccttgggagaatgctgagtccctgcggccactgggccgtagatcatctctcacttatgggactgcagaaggcacctggtttgagccaaaccatcggccacaggatgcagccctaccagttgccgctgagccatacctgtacagggaagccgtgtacaactcagttgcagccaggaaaggctctacccccgactttacattttacgactctcggcaggccgtgatgagtggtcggtcacctctgctgcctcgagagtattattctgacccctcgggtgccgctcgagtccctaaggagcccccactgtatcgagatcctggcgtgtcaagacctgtaccttcctatggggtcttagggagcagaacatcatgggacccgatgcagggtagatccccggctctgcaggacgccggtcacttatatcgtgacccaggtggaaaaatgattccgcagggcagacagacccagagcagggcagcctcaccgggaaggtacggtcgtgagcagcccgacacccggtatggagccgaggtgcccgcttatccacttagccaggtgttctcagacataagtgagaggccgatcgaccccgctccagctaggcaggttgcacccacctgtctggtggtggacccaagcagcgcagctgcccctgagggttcaacgggtgtcgcacccggtgccttgaacaggggttatggtccggctcgagaatccatccctagtaagatggcgtacgaaacgtacgaagctgatcttagtacatttcaagggccagggggtaagaggacagtcttgcctgagtttctggctttcctaagggccgaggggttagcagaggcaactttaggagcacttcttcagcaaggcttcgacagcccagccgtcctggctaccttggaggatgcggacataaaaagtgtggctccgaatcttggccaggccagagtgctctccagacttgcaaacagttgtcgcacagaaatgcagctacgacggcaggacaggggcggtcctttacccagagcgcgtagctcctcattctcacaccgcagcgagttgcttcatggggatctggcttctctaggagcggcagcaccacttcaaactgcttctccgagagccggagaccccgctcggcgaccttcttccgccccaagccaacatctcctggagaccgccgcaacatattccgctcctggggtcgggacacacgcccctcatttcccatcaaattccggctactcgtctcccaccccatgcgctcttactgcgcgtctatcaccaacctatccgctgcaggccggagtggccctgaccaatcctggaccctctaacccactgcatccaggcccaaggaccgcctactctacagcatacactgtgccgatggagctcctaaaacgcgaacggaacgtagccgctagcccactgccctccccacacggttcgcctcaggtcctgcgtaagcctggggcaccgctcggccctagcaccctgccccctgcatcccaatctctgcacaccccccattcaccatatcaaaaggtggcaaggagaacaggggctcccatcattgttagtacaatgttggctcctgagccctccatcaggccccagatcatgaacgggcctctccacccgagaccactcgtggctcttctggacggtcgggattgtactgtggagatgcctattttaaaggaccttgccacggtggcgttctgtgatgcccagtctacccaggagatacacgaaaaggttctgaacgaagccgtaggggctatgatgtaccatacaatcaccctgaccagggaggatctggaaaagttcaaggcccttagagtaatcgttagaattggctcgggctacgacaacgtcgacataaaagcagctggcgaattggggatcgctgtgtgcaacatcccgtctgccgctgtcgaggaaaccgcggacagtaccatatgtcacatccttaacttataccgacggaacacgtggctctatcaagcacttagagagggtactcgggtgcaatccgtcgagcagatccgagaggtagcctccggggcagccaggattcggggagaaactctgggactgatagggtttggacgaaccggacaagctgtcgctgtccgggcaaaggcctttggcttcagcgtcatcttctacgatccttatctacaagatggtatcgaacggtccctcggggtacaaagagtctatactttgcaagatctgctttaccagtctgattgcgtcagccttcattgtaacctgaatgaacataatcaccacctcattaatgacttcactattaaacagatgaggcaaggcgcatttctggtgaacgccgcacgaggtgggttggttgacgaaaaagcgctcgcccaggcccttaaggaaggaagaattcgcggagctgctcttgacgtgcatgagagcgaaccatttagtttcgcgcagggccctttgaaggacgcccctaaccttatctgtaccccacacacggcatggtactctgagcaggcatctctggagatgagagaggctgccgcaacagaaattagaagagccatcaccggacggatcccagaatctttgaggaattgcgtgaacaaagagttttttgtcacttctgcaccttggtcagtgatcgaccaacaagcgatccatcctgagttaaacggagctacgtatcggtacccacctggtatagtcggagtggctccgggaggcctgccagctgccatggaagggattatcccgggaggaattccagtgactcacaatctgcctaccgtggcccacccgtctcaggctccatctccaaatcagcccacgaagcacggagataatcgggagcatccaaatgaacaatag

SEQ ID NO: 28132 - DNA, 1338 bp, Artificial Sequence
  Description of Artificial Sequence: Synthetic coding sequence
atggccttagtagataaacataaagttaaaagacaaaggctggaccgcatctgtgagggtataagaccacaaattatgaacggaccacttcatcctagacctctggtggcactgctggatgggagagactgtaccgtggagatgcctatcttaaaggacctggccacagtcgcattctgtgatgctcagtctactcaggagatccatgaaaaagttctaaatgaggctgtaggtgccatgatgtaccatacaatcaccctgacacgggaggatcttgagaaattcaaagctctccgggtgatcgtccgaataggttcagggtacgataatgtggacatcaaggccgcaggggagctgggaatcgccgtgtgcaacattccatctgctgcagtggaagaaaccgctgacagcaccatttgccacatcctgaacctctaccgaaggaatacttggctctatcaagctctccgggaaggcactagagtgcagagcgtcgaacagatccgggaagtcgccagcggagcagccaggatccggggagagacactcggactcatcggcttcggtcggactggtcaggcagtggccgtgcgagccaaggcttttggcttctccgtgatattctacgacccgtatctccaagatggtattgaacggagcctcggagttcagagggtgtatacacttcaagatctcctctaccagtctgactgtgtgtcgctccactgcaatttgaacgagcacaatcaccacctgataaacgactttaccatcaagcagatgcgtcagggcgcattcttagtaaatgccgctcgcggaggactggtggatgagaaagccctggcccaggccctcaaagagggaaggattcgaggagcagctctcgacgtgcacgaatccgagccattttctttcgctcagggacccctgaaagatgcaccgaacctgatttgtactccccacaccgcctggtattccgaacaggcatctttggagatgcgggaagctgccgctactgagataaggcgggcaatcaccgggagaatccctgagagcttgaggaactgtgtgaataaggaattcttcgtgaccagtgctccctggtctgtcattgaccagcaggccatacatcctgaactgaacggagcgacgtaccggtaccctcctggaattgtgggggtggcacctggaggtctaccagccgcaatggaaggaattattccaggaggtattcccgtgacacacaacctgcctacagtggcccacccaagtcaggctccgtcccctaatcagccgactaagcatggcgacaaccgtgaacacccgaatgagcaatag

SEQ ID NO: 28133 - DNA, 1338 bp, Artificial Sequence
  Description of Artificial Sequence: Synthetic coding sequence
atggctctcgtcgataagcacaaagtgaaaaggcaacgtttagaccgcatctgtgagggaatcagaccccagatcatgaacgggcctttgcacccacgccctctcgtggccctgctggacggacgtgactgcacagtagagatgcccattctcaaagatctagccaccgtagctttctgcgacgcccaatcgactcaagagattcacgagaaggttttaaatgaggcggtaggagcaatgatgtatcatacaatcacactgacgagagaagacctcgagaaatttaaagcgctacgtgtcattgttcgaatcggcagcgggtacgacaacgtcgacataaaggcggcaggcgagctcggaatcgccgtctgtaacatccccagcgcagctgttgaggaaaccgcagattccacaatctgccacattctaaatctgtatcgtcggaacacttggctttaccaagctttgagagaagggaccagagtgcagtcagtggagcagatcagggaggtggccagcggcgcagctagaattcgaggagaaaccctcgggctgattgggttcggcagaacgggacaagctgttgccgtacgtgccaaagcttttggttttagtgtgatcttttatgacccctacctgcaggatggcatcgaaaggagcctgggtgtgcaaagggtctatactctccaagacttactctaccagtctgattgcgtgtccctgcattgcaacctcaacgaacataaccaccatctcattaatgattttactattaagcaaatgcgccaaggtgccttccttgtcaacgcagccagaggaggtctggtggatgagaaagctctggcacaagcattaaaggagggcagaattcggggagctgctttggatgtgcacgaaagcgagcccttctctttcgcacaggggcctttgaaggacgccccaaatttgatttgtaccccacataccgcctggtattcagagcaggctagtcttgagatgcgggaggccgctgctacggaaatcaggcgcgctatcactggcaggattcccgagtctcttaggaactgtgtcaataaggagttcttcgttaccagtgctccctggtctgtcatcgatcagcaagccattcatccggagttaaatggagccacgtatcggtatcctcccggtattgttggtgtggcccctggcggactgccagccgctatggaggggattatccctggcggaattcctgtgacccataatctcccaactgtggcccacccgagccaggccccatctccaaatcagcctaccaagcacggagacaacagagaacaccctaatgagcagtag

SEQ ID NO: 28134 - DNA, 1338 bp, Artificial Sequence
  Description of Artificial Sequence: Synthetic coding sequence
atggccttagtcgataaacacaaagtcaaacgccagaggctggacaggatctgtgaagggattcgacctcagattatgaatgggccactacatcctcggccattagtggctctgctcgatggccgagactgtacagttgaaatgcccatcctcaaagacctggctactgtcgcattttgcgatgcgcagtccacccaggaaatccatgagaaggtcctgaatgaagccgtcggtgccatgatgtaccacacaatcacattaacaagggaggacctcgaaaagttcaaggccctccgcgtaattgtcaggatcggatccggctatgataacgtcgacattaaggccgcaggcgaactcggcatcgctgtttgcaacatccctagtgcagccgtggaggaaactgctgattctaccatttgccatatacttaatttgtaccgcagaaacacttggctataccaggcccttcgcgagggtacgagggtacagtcagtggagcaaatcagagaggtggcaagtggagccgcacgcatcaggggcgagaccctcggcctaattggatttggcagaacaggccaggccgtggctgtgcgggctaaggcgttcggcttctcggtgattttctacgatccctatctccaggatggcattgaacgcagccttggcgtgcagcgagtatatacgctgcaggatctgctataccagtccgactgcgtttccctccactgcaatttgaatgaacacaaccaccacctgattaatgactttacaattaagcaaatgcgacaaggggcatttctcgtgaacgccgcaagggggggtttagtggatgagaaagcactggcacaagcgctgaaggagggcagaatccggggagccgctctagatgtgcatgaatccgagcctttctccttcgcacagggacccttgaaagacgctcccaacctgatttgtacacctcacaccgcatggtactcagaacaagcttctctcgaaatgcgggaggctgccgctacagaaatcagacgcgctatcacaggcaggatccctgaatcgctacggaattgtgttaataaagagttcttcgtgacttccgcaccatggtctgtgatcgatcagcaggctattcaccctgagctgaacggagcaacatatcggtatccccctggcatcgtgggagtggcccctggcggactcccagcggctatggagggcattattccagggggtatacccgtcactcacaatctaccaacggtggctcatccaagtcaggctccttctcctaaccagccaaccaagcacggcgacaacagggagcacccaaatgaacaatag

SEQ ID NO: 28135 - DNA, 12 bp, Artificial Sequence
  Description of Artificial Sequence: Synthetic coding sequence
atggccctttag

SEQ ID NO: 28136 - DNA, 1338 bp, Artificial Sequence
  Description of Artificial Sequence: Synthetic coding sequence
atggctttagtagacaaacacaaagttaagcggcagcggcttgatcgcatctgtgaagggatacgccctcaaataatgaatgggccactccatcccaggccactggtggctctgctggacgggagagactgcaccgtggaaatgcccattctgaaagatttagctaccgtagccttttgcgacgcgcagtccacacaagaaatccacgagaaggtgctcaacgaagctgtgggggcaatgatgtatcacactattaccctgactcgcgaggatctggaaaagttcaaggctctccgtgttattgtgaggattggttccggatacgataatgtggacataaaagccgctggtgaattgggcattgccgtttgcaacatcccctcagccgcagtagaagagactgccgatagcaccatatgtcatatcttgaatctgtataggaggaacacttggctgtatcaggctctgcgggagggtacaagggtccagagcgtggagcagattagggaggttgcaagtggcgcagcacgaataagaggcgagacacttggtctcataggattcggaaggacaggccaggctgtggcggtccgggcaaaggcttttgggttttctgtcattttttatgacccctacctgcaagacggtatcgagcgctctctgggagtgcagcgagtctataccctgcaggatctcctttaccagagtgactgcgtgtcactccactgtaacttaaatgagcacaaccaccatctgattaatgatttcacgattaaacagatgcgtcaaggcgcattcctggttaatgccgctagaggcggtttggtggatgaaaaagccctggcacaggcgctgaaggagggcagaattcggggagcagcactggatgtgcacgaaagcgaaccattcagctttgctcagggacccctcaaggacgcccctaatcttatttgcaccccgcatacagcctggtactctgagcaggcctcattggaaatgcgcgaggcggcagccaccgagattaggagagcgattaccggtaggatccctgaatcgctgaggaattgtgtgaataaagagttcttcgtgacctcagccccatggtccgtgattgatcagcaggccattcaccctgaactgaatggcgcaacttacagatatcctccaggaattgtgggtgtcgctccaggcggactgcccgcagctatggaaggaatcattccaggcggtatacccgtaacccataaccttccaactgtcgctcatccatctcaggcccctagtcccaatcagcccacgaaacatggcgataaccgtgaacatcccaatgaacagtag

SEQ ID NO: 28137 - DNA, 2331 bp, Artificial Sequence
  Description of Artificial Sequence: Synthetic coding sequence
atgtcctctacacgatcccagaacccacacggcctgaaacaaatcggcctggatcagatttgggacgacctgcgcgctggcattcaacaggtgtatactagacagagcatggctaaaagccgctacatggagctatacactcatgtctacaattattgcacaagcgtccaccagtctaatcaggcgcgtggggcaggggtcccgccatccaaatctaagaaaggtcagaccccagggggagcgcagtttgtagggctcgagctgtacaaacggctgaaggaattcctgaaaaactacctaacgaatctattaaaagatggagaggatctgatggacgaatcagtgctgaagttctatacccagcagtgggaagactataggttctcctccaaagtgcttaatgggatctgtgcctacctgaaccgtcactgggtgcggcgagaatgcgacgaagggagaaaaggaatttatgaaatatacagcttggccctcgtgacctggagggattgcctgttccgacccctcaacaaacaggtgactaatgccgtgctgaagctgatcgaaaaagagcgcaacggggagacaatcaacacgcgcctgatttcaggagttgtgcagtcttacgtggaactcggcctgaacgaagacgacgcctttgcaaagggccctacgcttactgtttataaagagtcatttgagagccagtttctggccgacaccgaacgtttctacacccgtgagagtaccgagttcttgcagcagaatcccgtcacagagtacatgaagaaggccgaggctagacttctcgaagagcagaggcgtgtccaggtttaccttcacgagtctactcaagacgagcttgccaggaaatgcgagcaagtattgatcgaaaaacatctcgagatctttcataccgagttccagaaccttcttgatgctgataaaaatgaggacctgggccgtatgtacaacctggtgtcccggatccaagatggcctcggtgagcttaaaaagctgctggagacgcacattcacaatcaagggctggccgctatcgagaagtgtggcgaggccgcattgaatgatcccaaaatgtacgtgcagactgttttggacgtccacaagaaatacaatgccctggtgatgtcggcttttaataacgacgctggcttcgtcgcggcattagataaagcctgcggcaggtttattaataacaacgctgtcacgaaaatggcccagtcttcttcaaagagccctgagttactggctagatactgtgatagccttcttaaaaaaagctcgaagaaccccgaagaggcggaactggaggatacactcaaccaggtgatggtggtgttcaaatacattgaagacaaagatgttttccagaagttctacgccaaaatgttagccaagcgactcgtacatcagaactcagcaagcgatgacgcggaggcatctatgatcagcaagctgaaacaggcctgcggttttgagtacaccagcaaactgcagcggatgttccaagatatcggtgtcagtaaggatctgaatgaacaattcaaaaaacaccttacgaatagcgagcctctggatttggacttttccatccaggtgctcagcagcgggtcttggcctttccagcaaagctgtacgtttgcactgcctagtgaactcgagcgtagctatcagcgttttaccgctttttatgcctcaaggcactctggtcgtaaactcacatggctatatcagctgagcaagggcgagcttgtgacaaattgtttcaagaataggtatacacttcaggcctcaacctttcagatggccatactactccaatataacaccgaggatgcttacacggtccagcagttgacagactccacgcagataaagatggacatactggctcaggtactacaaatcctgctcaagagcaagctgctggttctcgaggacgagaacgctaatgtggatgaggtagagctgaaacccgacacacttattaagttatacttaggttacaaaaataaaaagctacgcgttaacataaatgttcctatgaagaccgaacagaagcaggagcaggagaccactcacaaaaacatcgaggaggacagaaagctccttatccaggctgccatcgttagaattatgaagatgagaaaggtcttaaagcatcagcagcttctaggagaggtgctgactcaactgagctctcgctttaagccccgagtgcctgtaatcaagaagtgtattgacatccttatcgaaaaggagtacctggaaagggtggacggcgagaaggatacctacagctaccttgcatag

SEQ ID NO: 28138 - DNA, 2331 bp, Artificial Sequence
  Description of Artificial Sequence: Synthetic coding sequence
atgtcttccactcgcagtcagaatcctcatggcctgaaacagatcggactagatcagatttgggatgaccttcgggctggcatacagcaggtgtataccaggcagtccatggcgaaaagccggtacatggaattgtacacccacgtctataattactgtacttcagtgcatcagtctaaccaggcacggggtgccggagtgccgccttccaagtcaaaaaaggggcagacacccggaggcgcacagttcgtgggcttggagctttacaagcgcctcaaagaattcttgaaaaattatttgacaaacctcctgaaagatggtgaggacctgatggatgagagtgtgctaaagttctacacgcaacaatgggaagattaccgcttctcttcgaaggtgctgaacggaatttgtgcatatctaaatcggcattgggttcgtagagagtgtgatgaggggagaaaaggaatttacgaaatctatagcctggcactggtaacatggcgagactgtctgtttaggccgttaaacaagcaagtgaccaatgcagtgctgaagctcattgagaaagaacgtaatggcgaaacaatcaacacacgactgatctccggcgttgtccagtcttatgtggagctcggccttaacgaagatgacgcctttgccaagggccctactttgaccgtttacaaagaaagcttcgaatcacagtttctcgccgatactgaacggttctacacccgagaatctactgagttcctccaacagaatcccgtgaccgagtacatgaaaaaggctgaagcaaggttacttgaagaacagcgacgcgttcaagtgtatttacacgagtcaacccaggacgagctggcacgtaagtgcgagcaggtccttattgagaaacatctcgaaatctttcatacagagtttcagaaccttctggatgcagataaaaacgaggatctcggccgaatgtataatctcgtctcgcggattcaggatggactgggcgagctgaagaaattgctagagacgcatatccataatcagggtctcgcggctatcgagaagtgcggtgaagcggcacttaatgaccctaagatgtacgtccagacggttctcgacgtgcataagaagtataatgccctggttatgtctgcatttaacaatgatgctggcttcgttgctgccttggacaaagcctgcgggcgttttattaacaataacgctgttacaaagatggcgcagtcttccagcaagagcccagagctccttgcacggtactgtgacagcttactgaagaagagcagtaagaatcccgaggaggctgagctcgaagacacccttaatcaggtgatggtcgtctttaagtatatagaggataaagatgttttccagaaattttacgctaagatgctggcgaagcgcttagtccatcaaaatagtgccagcgatgacgccgaagcatccatgatctcaaagctgaagcaggcttgtggcttcgaatatacatccaagctgcagagaatgtttcaggacataggagtgagcaaagacttgaacgagcaatttaaaaaacatctcaccaattctgaaccgttggaccttgatttctcaatccaagtgctgagcagcgggtcctggccttttcaacagagttgcacctttgcattgccgagtgaacttgagaggagctatcagcgttttactgccttctacgcatccaggcatagcgggagaaaacttacatggttataccagctttcaaagggagagctggtgaccaactgcttcaagaacaggtatacgctgcaagcgagtaccttccaaatggcaatcctgttacaatacaataccgaggatgcttatacagtgcagcaactgacagactctacacagatcaaaatggacatcctggcccaggtgctgcaaatcctactgaaaagtaagctgctggtgttagaagatgagaatgccaacgtcgatgaggtcgaactaaaaccagatacattgattaaactctacctcggatataagaataaaaagctccgggtgaatattaatgtacctatgaagaccgagcagaaacaggagcaggagactacacataagaatattgaggaggatagaaagcttctgatacaggcagcaatagtcaggatcatgaagatgagaaaggtgctgaagcaccagcagctgctgggagaagtgctgacacaactctcatccagattcaaaccacgggtgccagtcatcaaaaagtgtatagacattttgatcgagaaagagtacctagagagggtggacggcgagaaggacacctactcctacttagcatag

SEQ ID NO: 28139 - DNA, 2112 bp, Artificial Sequence
  Description of Artificial Sequence: Synthetic coding sequence
atgagctccacccggtctcagaatccccatggacttaagcagattgggctcgatcagatctgggatgatttacgggcagggatccagcaggtgtatacccggcagtcaatggccaaatccaggtatatggagttgtatacacagcagtgggaagattaccgcttctcatcaaaagtcttgaatggcatctgcgcttacctcaaccgccactgggtcaggcgcgaatgcgacgaggggaggaagggcatctatgaaatctatagcctcgcattggtcacatggagagactgtttgtttaggcctctaaataagcaagtgaccaatgctgtgctgaagcttatagagaaggaacggaacggagagactatcaatacaaggcttatatctggggtcgtgcagagctacgttgaactgggtctgaacgaggatgatgcttttgccaaaggtcccacacttacagtgtataaagagagcttcgagtctcagttcttggccgacaccgagagattctacacgagggagtctactgagttccttcaacagaatccagttaccgagtacatgaagaaagctgaagctagactgcttgaggagcaacgccgagtgcaagtttaccttcacgagtctacgcaagacgaactggcccgtaagtgtgaacaagtcttaatagaaaagcatttggagatatttcacactgagttccagaacttactggatgccgacaagaacgaagatctcggccgaatgtacaatttggtgtcaagaatccaagatgggctcggagaacttaagaaacttttggagacccacatccacaatcagggcttagctgccatcgagaaatgcggggaggccgctcttaatgaccctaaaatgtacgtccaaaccgtccttgatgttcacaagaagtataatgctttggtcatgtctgcctttaataatgacgcagggtttgtggcagcccttgataaggcatgcggcaggtttatcaacaacaatgcggtgaccaagatggcccaatccagctccaagtctcccgaattgctggccagatattgcgacagccttcttaaaaaaagcagtaagaatcctgaggaagcagaactagaggacaccctgaatcaagttatggtcgtgttcaaatacattgaagacaaggatgtcttccaaaaattctatgcaaagatgttggctaagcgcctggtgcatcagaacagcgccagcgacgacgctgaagcatccatgatctccaagttaaagcaggcttgcggctttgaatatacaagtaagcttcagcgcatgttccaagatatcggcgtatctaaggatctgaatgagcaattcaaaaagcacttgaccaatagtgaacccctggatctggatttctccatccaggtgctcagttcagggtcgtggcccttccagcagtcttgtaccttcgctttgccatcagaattggaaaggtcatatcagaggttcaccgcattttacgcttctcggcacagtggaagaaaattgacatggctgtaccaactgagcaagggagagttagtcactaactgtttcaagaaccgttacacactgcaagcttccacatttcagatggctattttattacaatataacacagaggacgcgtataccgtgcagcagctcactgattcaacccagatcaaaatggatattcttgcccaggtgctgcagatcctcctgaaatctaagctgctcgtgctggaggacgagaacgcaaatgtggacgaggtcgagctcaaacctgatacactgataaaactgtatcttggctacaaaaataagaagttgcgcgtgaatatcaatgtacccatgaaaaccgaacaaaaacaggagcaggagactactcataaaaacatagaggaggatcggaagcttctcattcaagccgcaatcgtgcggatcatgaagatgcgaaaagtgttgaaacaccaacagctgctgggagaggttcttactcaacttagttccaggttcaagcctcgcgtgccagtcataaaaaaatgcattgatatcctgattgaaaaggaatacctagaaagggtggatggggagaaggacacatattcttacttggcttag

SEQ ID NO: 28140 - DNA, 1824 bp, Artificial Sequence
  Description of Artificial Sequence: Synthetic coding sequence
atggaactctacacccacgtgtacaactactgtacatcagtacatcagagcaatcaagcccgtggcgcaggggtccccccatctaaatcgaagaaggggcagacacctggcggagctcagttcgtgggcctcgaactttataagcgcctgaaggagttcttgaagaattatctaaccaatttactgaaggacggggaagacctcatggatgagtcagtgctgaagttttatacgcaacaatgggaagactaccggttttcatctaaagtgttaaacggaatttgtgcttacctgaatcgacattgggtgcgcagagagtgcgatgaggggaggaagggaatttatgaaatttactctttagccttggtgacctggcgcgactgcttgttccggcctctcaacaaacaggtcacaaacgcggtactgaagctgatagagaaagaacggaacggagagactatcaacacccgtctgatctctggggtggttcagtcctatgtcgaactgggactgaatgaagatgacgccttcgcgaaaggacccactctgaccgtttataaagaaagctttgagtcccagttccttgccgacacagagaggttctacacgcgggagagcacggagttcctccagcagaatcccgtgaccgagtacatgaagaaggcagaagcccgtctgttggaggagcaaaggcgggtccaggtctacttacatgaatccacccaggatgagctggctaggaagtgcgaacaggtcctcattgagaagcatctagaaatattccacaccgagtttcagaatctactggatgccgacaagaacgaggacctgggccgtatgtataatctcgtatctagaattcaggacggactgggagaactgaagaaactgcttgaaacacacatccataaccagggactcgctgccatcgaaaagtgcggggaggcagctttgaacgatcctaagatgtacgtccagacggtccttgacgttcacaaaaagtacaacgcattagtgatgtccgcctttaataatgacgctgggttcgtcgcagctctggataaagcatgcggcaggtttattaataacaacgccgtgaccaagatggcccagtccagtagcaagagccctgagctgctggcacgatactgcgactctctcttgaaaaagagctctaagaaccccgaggaagctgagttggaggatactctgaatcaggtgatggtggtgtttaaatacatcgaggacaaggacgtgttccagaagttctacgctaaaatgctggcaaagagactcgtgcatcagaactctgcatctgatgacgccgaagccagcatgattagtaagcttaaacaagcttgtggattcgagtatacttcaaaactccaacgtatgtttcaggacatcggtgttagcaaggatctcaatgaacagtttaagaagcatctgacaaactccgagccactggatcttgatttctccatccaggtgcttagcagtggtagctggcctttccagcagagttgtacatttgcattaccgagcgagctcgaacgttcctatcagcgcttcacggcattttatgcttcccgtcactctggtcgcaagcttacttggctgtatcaattgagtaaaggtgaattggtgacaaactgcttcaagaaccggtatacactccaggcatccacattccaaatggctatattacttcaatacaacacagaagacgcctacaccgtgcaacagctgaccgattctacgcagatcaaaatggatattctggcgcaggtcctgcagatcttgctcaaatctaagctgttgtag

SEQ ID NO: 28141 - DNA, 2121 bp, Artificial Sequence
  Description of Artificial Sequence: Synthetic coding sequence
atgagtctaaagccccgagtagtcgacttcgatgaaacttggaataaactcctgacaacaatcaaagccgtggtgatgctggaatatgtcgagcgggctacttggaatgacagattcagtgacatttacgccttatgcgtcgcatatcccgaacctctgggtgagagactgtatacagaaactaaaatcttccttgaaaaccatgtcaggcatcttcacaaacgagttttggagtctgaagaacaggtgcttgttatgtatcatcggtactgggaagagtactccaaaggcgctgattacatggactgcctatacaggtacttaaacactcagtttataaagaaaaacaaactcactgaggccgatctgcagtacggctatggcggagtggatatgaatgagcctctgatggagataggggagctcgcattagatatgtggcgtaagctcatggtcgaaccattacaggctatcttgatccggatgctcctgagagagattaagaacgatcgcggtggcgaggacccaaatcaaaaagtgattcacggagtcattaactcttttgtgcacgtagaacaatacaagaagaagttccccctgaaattctaccaggaaatcttcgaatcaccctttctgactgagacaggcgagtactataaacaggaagccagtaatcttctgcaggaaagcaactgcagtcagtacatggagaaagtacttggcagattgaaagacgaggaaatcaggtgccggaagtatcttcatccctcatcttacacgaaagttattcacgaatgccagcagaggatggtagccgatcacctgcagttcctccacgcagaatgccataatataattagacaagagaagaaaaacgatatggccaatatgtacgttctattgcgtgcagtttccaccggactcccccacatgattcaagagctccagaaccacatccacgatgaggggctgagagccaccagtaacttgacccaagaaaatatgccaactcttttcgtggagagcgtacttgaagtacatgggaaattcgtgcaattaatcaatacggtactgaatggagatcagcacttcatgtctgctttagataaggctctgacctccgtggtcaattaccgcgagcccaaatccgtctgtaaggcacctgaactgctggcaaaatattgtgacaacctgctcaagaaatcggctaagggaatgacagagaatgaagtagaggatagattaacgtctttcatcaccgtatttaagtacatagatgataaagacgtgttccagaaattttatgcaagaatgcttgccaaacggctaatccatggcctctcaatgagtatggatagtgaggaagccatgattaacaagcttaaacaagcatgtggatatgagtttacatcaaagcttcatcgtatgtacactgacatgtccgttagtgccgatctcaacaacaaatttaacaatttcatcaaaaaccaggatacagtgatcgaccttggcattagctttcagatctacgtgcttcaggcaggtgcatggcccttaacccaggctccctcttccacattcgccatccctcaggaactcgagaagtctgtgcagatgtttgagctgttttactctcagcacttctctggtagaaagctcacttggcttcactatttatgcactggcgaagtcaagatgaactatctggggaaaccctacgtcgccatggtaacgacataccaaatggctgtactcctggcgttcaataacagcgaaacagtgtcttacaaggaactgcaggactcgacccagatgaacgaaaaagagcttactaagactatcaagtccctgttagacgtaaagatgatcaatcatgatagcgagaaggaagacattgacgctgagagctctttttcactcaacatgaatttcagcagtaagcgcacaaagttcaagattactacctctatgcagaaagataccccccaggttatctctcaaagtcgcgctcggtttaacccttcaatcagcatgataaagaagtgcatcgaagtgctcattgacaagcagtatattgaaagaagtcaggcctccgccgacgagtacagctacgtggcctag

SEQ ID NO: 28142 - DNA, 2121 bp, Artificial Sequence
  Description of Artificial Sequence: Synthetic coding sequence
atgagcctgaaacctcgcgtcgtggatttcgatgaaacctggaataagctgctcactacaatcaaggcagtcgtgatgctggagtatgtggaaagggctacctggaatgatagatttagcgatatctatgcgctgtgcgtagcctatccagaaccactgggcgaaaggctctacactgaaaccaaaattttcctggagaatcatgttcggcatttgcacaaacgggtgctggagagtgaggagcaggtgttggttatgtatcataggtattgggaggagtactcaaagggagctgattatatggactgcctgtaccgatacctcaatacccagtttattaagaaaaataagctgacagaggcagacctgcaatacgggtatgggggagtggacatgaacgaaccactgatggagatcggagaattagccttagacatgtggaggaagcttatggtggaacctcttcaggctatactaatccggatgctgctgcgcgagatcaagaacgatcggggtggggaggatcccaatcaaaaggtgatacacggggtgatcaacagtttcgtgcacgtggagcagtacaaaaaaaagtttcctctgaagttttatcaggaaattttcgagtcacccttcctgactgaaaccggagagtattataagcaggaggccagcaatctgttgcaagagtctaactgctcacaatatatggaaaaagttcttggcaggctgaaagatgaagagatccggtgccgaaaatacctccacccatcctcttataccaaagtgatccacgaatgccagcagaggatggtcgctgatcacttgcagttcctccatgccgagtgccataacatcatacgtcaggagaagaagaatgacatggccaacatgtacgtgctcttaagggctgtctccacgggcctgccgcacatgatccaggagctgcagaatcacatccacgacgaaggtctgagagccacttccaatctgacacaagaaaatatgcctaccctgttcgttgagagtgtgctcgaagtacacgggaagttcgtccaactgattaatacggtgctgaatggcgatcagcactttatgtctgcgttagataaagcacttacatccgtggtgaactacagggagccaaagagcgtttgcaaagcaccagagttgctggcaaagtattgcgataacctcctgaagaagagtgctaagggaatgaccgagaatgaggtggaagataggctaacctcattcataactgtgttcaaatatattgatgataaagatgtctttcagaaattctatgctcgcatgctggctaaaagactcattcatggcttgtctatgtccatggactctgaggaggccatgattaacaagctaaaacaggcttgcgggtacgagttcacatctaaattacacagaatgtataccgacatgtccgtcagtgccgatttgaacaacaagtttaacaattttattaagaaccaggataccgtgattgacctgggcatttcctttcagatttatgtactccaggctggagcttggccgctgacgcaggcaccttcttccacttttgcaattccccaggagttggaaaaaagcgtgcaaatgttcgaactgttctattcacaacatttttctggtcgtaaattaacttggttgcattacttatgcaccggtgaagtgaaaatgaactatctgggcaaaccctatgtggccatggtgaccacctatcagatggccgtcctcctggcgttcaacaatagtgagacagtgagttacaaagaacttcaagactccacccaaatgaatgagaaggaactgacgaagaccataaaatcactactggacgtgaagatgattaatcatgattcagaaaaagaagacattgatgcagagagctcgttctcgctgaatatgaacttcagctcaaagaggacgaagttcaagattactacaagcatgcagaaggacaccccgcaggtgatcagtcagtctcgggctaggtttaatccatctatatctatgatcaagaagtgcattgaggtcctgatcgacaagcaatacatagagcgctcccaggcaagcgccgacgagtactcatacgttgcatag

SEQ ID NO: 28143 - DNA, 2238 bp, Artificial Sequence
  Description of Artificial Sequence: Synthetic coding sequence
atgagcctcaaaccccgagtggtcgattttgacgaaacttggaacaaactgctgacaacaattaaggctgtggttatgcttgaatacgtggagcgcgctacctggaatgaccggttttccgatatttacgccttatgtgtcgcttaccctgaacctctgggagaaaggctgtatactgagacgaaaatcttcctcgaaaaccacgtgcgccatctccataagagggtgctcgaatctgaggagcaagtgctggttatgtaccatagatattgggaagaatacagcaaaggagcagattacatggattgtctatacaggtacctgaatactcagtttatcaaaaaaaataaactaaccgaggccgacttacaatacggttacgggggagtggacatgaacgaacctctgatggagataggagagctggctctggacatgtggcgcaagctgatggttgagcctctgcaagcgattctgatccgaatgctccttcgcgagattaagaacgataggggaggcgaggaccctaatcagaaggtcattcacggcgttatcaactcattcgtccatgtagagcagtacaagaagaagtttcccttaaaattttatcaagagatctttgaatctccttttttaaccgagactggagagtactataaacaggaggctagcaacctcctgcaggagtccaactgttcccaatatatggagaaagttcttggacgactgaaagatgaggagattaggtgcagaaagtacctacatcccagcagctacaccaaagtgatccacgagtgtcagcagcgcatggtggcagaccacttgcagtttctgcatgccgaatgccacaatatcattaggcaggaaaaaaaaaatgacatggccaatatgtatgtgctactgcgcgctgtctctaccggcctcccacacatgatccaagagctccagaatcatatacatgatgaggggctgagagctaccagtaacctgactcaggaaaatatgcccacacttttcgtggagtcagtcctggaagtccacggcaagttcgtccaattgatcaacaccgtcttgaacggggatcagcattttatgtctgcgctggataaggctttgacatcagtcgtgaattatcgcgaacctaaaagtgtgtgcaaggcccctgagctgctggccaaatattgtgacaacctcctaaagaagtctgcgaaggggatgacagaaaatgaggtggaggaccggctgacatccttcattactgtattcaaatatatagatgacaaagacgtgtttcagaaattttatgcaagaatgctggccaaacgactgatacatggcctgtcaatgtccatggattcagaggaggcaatgatcaataagttgaagcaggcttgcggatatgagtttacttctaagctgcacagaatgtatactgatatgtctgtctccgcagatctgaacaacaagtttaataatttcataaagaatcaggataccgtgattgacttgggaatttccttccagatatacgttctgcaggctggcgcatggccactcacacaggctccgtcaagcacttttgctatcccacaggaacttgaaaagtctgtgcagatgttcgagctattctactctcagcatttctctggtcgaaagctaacctggctccactacctttgcacaggcgaggtgaaaatgaactatttgggcaagccttatgtggccatggtcacaacctaccagatggccgtgctactggcatttaataatagcgagacagtttcctacaaagaactgcaagactctacccagatgaatgagaaggaactgactaagaccattaaatctctcctggacgtgaaaatgatcaaccatgactccgagaaagaggatatcgatgccgagtccagcttttctctgaacatgaatttctcgtctaagaggaccaaattcaagatcacaacctcgatgcaaaaggacactccacaagagatggagcaaactagatcagctgtggacgaggacaggaaaatgtatttgcaagctgccatcgttagaatcatgaaggcgagaaaggtgttgcgccacaatgcattaatacaggaggtaatatcccagtcccgggcaagatttaaccccagcatctctatgatcaagaaatgcatagaggttctcattgacaaacagtacatagagagatcccaggcgtcagcggatgaatattcttatgtggcctag

SEQ ID NO: 28144 - DNA, 2238 bp, Artificial Sequence
  Description of Artificial Sequence: Synthetic coding sequence
atgagtctgaaaccaagagtagtcgattttgatgaaacatggaataaactgctgacaactataaaggcagtggttatgctcgaatatgtggaacgggctacctggaacgacaggttctcggacatctatgccctgtgcgtagcttaccccgagccactaggggagaggctgtacacggagacaaagattttcctggaaaatcacgtgaggcacctccataaacgtgtgcttgaatccgaagagcaggtattggtgatgtaccacagatactgggaggagtactccaaaggcgcagattatatggactgtctctatcgctacctgaacacccagtttataaaaaaaaacaaactgaccgaggcggatctgcagtatggatatggaggagtggacatgaacgaaccgctcatggagattggcgagctggccttggacatgtggcgtaagctgatggtagaaccattacaggccattctcatcaggatgctgctgagagagattaaaaatgatcgagggggagaagacccaaaccaaaaggtgatccacggagtgatcaacagctttgtccatgttgaacagtacaagaaaaagttccctctaaaattttatcaggagattttcgaatcaccatttctcacagagactggcgagtattacaagcaagaagcaagtaatctgcttcaggagtcaaattgttctcaatatatggagaaggtgctgggtcgactgaaggacgaagagattcgctgcaggaaatatctgcacccttccagctatacgaaagtgatacacgaatgtcaacagaggatggtggccgatcacctccagtttcttcatgcagaatgccataatatcatccggcaggaaaaaaaaaacgacatggcaaatatgtacgtcctcctcagggctgtctccacaggacttcctcacatgatccaggagttgcagaaccatattcatgatgagggtcttagagccacgtctaacttaactcaggagaacatgcctacattgttcgtcgagtcggtgttggaggtccatggcaaatttgtgcagctgatcaacacggtgcttaatggtgaccaacacttcatgagtgcattagacaaggctctgacaagcgtcgtcaactacagagagccgaaatcagtctgcaaagcacctgagcttctggcaaaatattgtgacaacttactgaaaaaaagcgccaagggaatgactgagaacgaagtcgaggacagactgacctcctttatcactgtgttcaaatacatcgacgataaggatgtattccaaaagttctacgcacgaatgctcgccaagcgccttattcacggtttgagcatgtcaatggattccgaagaggccatgatcaataagctaaagcaggcttgcggctacgaattcacctcaaagctgcataggatgtatactgatatgtccgttagtgctgacctgaacaataagtttaacaatttcattaagaaccaagacacagtaatcgaccttggaatttcattccagatatatgtcctgcaggctggcgcttggccacttacccaggcgccaagcagcacctttgccataccgcaggagctggagaagtccgttcagatgttcgaactcttctacagccagcatttcagcggaagaaagctaacatggctccattacctctgtaccggcgaagtgaaaatgaactacttagggaaaccatatgtggcaatggtgacaacctatcagatggctgtgctgctggcattcaataatagcgagacagtatcctataaggagttgcaggactctacacagatgaacgagaaagaactgacgaaaactatcaagtctctgctggacgtgaaaatgatcaaccacgattctgaaaaagaagatattgacgctgaaagcagcttttctctgaacatgaatttcagttcaaaacggaccaagtttaagatcaccacctcaatgcagaaggataccccgcaggagatggaacaaaccaggtccgcagttgatgaggatcgcaagatgtatctgcaggccgcaatagtgaggattatgaaggcacggaaagttttgaggcataatgcactcattcaggaagttatttcccaatcccgggctaggttcaatccttcaattagtatgataaaaaagtgtattgaagttctgatcgataaacagtatattgagcgatcccaggcaagcgcggatgagtatagttacgtagcgtag

SEQ ID NO: 28145 - DNA, 2238 bp, Artificial Sequence
  Description of Artificial Sequence: Synthetic coding sequence
atgtctctcaagccgcgtgtcgtggactttgacgagacctggaacaagttactgacgacgattaaagctgttgtgatgctggagtatgtggagcgggcaacttggaacgatcgattctctgacatttacgcattatgtgtggcctatcctgagcccctcggcgaaaggctctataccgaaacaaaaattttcctggagaatcatgtgcgtcatcttcacaaacgagtcctggaatctgaagaacaggtcctcgtgatgtaccaccgttattgggaggagtatagcaaaggcgctgattacatggactgcctgtatcgatacttgaatacccagttcatcaagaaaaataagctcacggaggctgatctacagtacggctatgggggtgttgacatgaacgaacccctgatggaaatcggtgaactggcgctggatatgtggagaaaactgatggtcgaaccactccaagcaatcctgatccgtatgctactacgggagataaagaacgaccggggaggcgaagaccccaatcagaaagtgattcacggagtgattaacagtttcgtccatgtcgagcagtataaaaagaagtttccactgaagttctatcaagagatcttcgagtccccctttttgacagagacaggcgaatattacaagcaggaggcgagtaatctgcttcaggagagcaactgttcccagtacatggagaaggtgttggggagactgaaggacgaggaaatccgttgccggaaatacctccacccgtcttcttatactaaggttattcatgagtgccagcaaagaatggttgccgaccacctccagtttctgcacgcagagtgccacaacataatccgacaggagaagaagaacgatatggccaatatgtacgtgttactccgagcggtctccaccgggctgcctcatatgatacaggagctgcagaatcacatccacgacgagggcttaagggccacttcgaatttaacacaggaaaacatgccaaccctctttgtggagtctgttttggaggtccatggtaaattcgttcaactcatcaatacagtgctcaatggggatcagcattttatgagtgctctcgacaaggctctcacatctgttgttaactacagggagcccaagagcgtgtgtaaggcccctgaactcctcgcaaaatactgcgacaatctacttaagaagtctgcgaagggcatgacagagaacgaagtagaagatagacttactagctttatcacagtatttaagtacatcgacgataaggatgtgttccagaagttctatgccagaatgctcgcaaaacgcctcattcacggcctgtctatgtctatggattctgaggaggcaatgattaacaagctgaaacaggcctgcggttatgagttcacaagcaagcttcaccgcatgtacactgatatgtctgtgagcgccgacctgaacaacaaattcaataattttatcaaaaaccaggatacggtgatcgacctcggcatttcgtttcagatatacgtgctacaggcaggcgcttggccactgacacaggcaccaagctcaacgttcgcaatcccccaagaattggaaaaatccgtccagatgtttgagttgttctactcccagcatttctctggacgtaaactaacctggctgcactatctgtgtacaggagaagtgaagatgaactatttaggcaagccatacgtagccatggtcaccacttaccagatggccgtacttctcgcctttaacaactccgagacagtctcttataaagaactgcaggatagcacccagatgaacgaaaaggagctcacaaagaccattaaatctttgctggacgtgaaaatgatcaaccatgattctgagaaagaggacatcgacgctgaatcgtcattctctctcaacatgaatttctcttccaaacggacaaaattcaagatcactacgtcaatgcagaaagataccccacaagagatggagcagacaaggtctgcagtggacgaagacaggaaaatgtacctccaggctgcaatcgtgcgaatcatgaaagctcggaaggtcctgcgtcataacgccctgatccaagaagtcatttctcagtccagggctcgcttcaacccttctatctccatgattaaaaagtgtattgaggtgctgatcgacaaacagtacatagaaaggagccaggcttcagcagacgagtattcatacgttgcttag

SEQ ID NO: 28146 - DNA, 2067 bp, Artificial Sequence
  Description of Artificial Sequence: Synthetic coding sequence
atgctgtatgtttggccaatcctgaatcctctcgaaaaggatttcatccagaaactcaggttcttctggaagatcatgtttggcatatgcatcaggtactgggaagagtactctaaaggcgctgattatatggactgcttatacaggtatctgaatactcagttcataaaaaagaataaactgactgaggccgacctgcagtatggatacggcggtgtggacatgaacgaacctctcatggagatcggcgaactggccctggacatgtggcggaaacttatggtggaacctttgcaggcaatcctcattaggatgttgttgcgcgaaatcaagaatgatcgcggaggtgaggatcccaaccagaaggtgatccacggcgtcatcaactcattcgtccacgtggagcagtacaaaaaaaagttcccgctgaaattctatcaggaaatctttgaatcaccttttctgactgagaccggggagtactacaagcaagaagctagtaacctgctccaagagtcaaattgtagccagtacatggagaaggtcctggggaggctcaaagatgaggaaattcgttgccggaaatacctgcacccaagtagttataccaaagtgatccacgaatgccagcagaggatggtggctgaccatttacagttccttcacgccgagtgccacaacataattaggcaagagaaaaagaacgacatggccaatatgtacgttttactgagagccgtcagtaccggtctgccccatatgatccaggagctgcagaaccatattcatgatgaaggtctgcgcgctacttctaacctcactcaagagaatatgccgacacttttcgtcgagagcgtgcttgaagtgcacggcaagttcgtccagcttatcaatacggtgcttaacggcgaccagcactttatgtccgccttagataaagccctgaccagtgtcgtgaactaccgggaaccaaagagcgtctgcaaagcacctgaactgctcgctaaatactgcgacaatctgttgaagaaatccgcgaaaggtatgacagagaacgaagtggaagacagacttacttccttcattacagtttttaaatacattgacgacaaggatgtttttcaaaagttctacgctcgcatgttggctaaacgactgatccacggcctgtcgatgagcatggattcagaagaagcaatgatcaataagttaaaacaggcatgcggatacgagttcacttcaaagctacacagaatgtacacagacatgtcagtgagcgctgacctgaataacaagtttaataatttcatcaagaaccaagatacagtgatcgatctcggtatctcttttcagatttatgtgctgcaggcaggcgcatggcccctcacacaggcccctagtagtaccttcgcgattcctcaagagctggaaaagagtgtgcagatgttcgagctcttctacagccagcatttcagcggtagaaagcttacttggctccattacctctgtaccggagaggtgaagatgaactatctggggaagccctacgtggccatggttacaacatatcaaatggcggtgctcctcgccttcaataattcggagaccgtttcctataaggaactgcaggatagcacccaaatgaacgaaaaggaactgactaagactataaaatccttactcgacgtaaagatgatcaaccacgactcagagaaagaggacattgatgctgagtcttctttcagcctgaacatgaatttctcttctaaacggactaagttcaagatcacaacatctatgcaaaaggataccccacaggagatggagcaaactaggtccgcagttgacgaagaccggaaaatgtacctgcaggcggctatagtgaggatcatgaaagcgagaaaggtgctccggcataatgccctaatccaggaggtgatcagccagtcacgggctaggttcaatccatctatctctatgatcaagaagtgtatcgaggtactgattgataaacaatatattgagcgtagtcaggcgtccgcggacgagtactcttacgtagcctag

SEQ ID NO: 28147 - DNA, 651 bp, Artificial Sequence
  Description of Artificial Sequence: Synthetic coding sequence
atgagtttgaagccaagagtggttgactttgacgagacttggaacaagctgctgaccactatcaaggctgtagtaatgctggaatacgtcgaacgtgccacctggaacgatcgcttctcagacatctatgcactatgcgttgcatacccagagcctctgggggaacggctttatacagagactaaaattttcctcgaaaatcatgtgcgacatctccacaaaagggttcttgagtccgaggagcaggttctggtgatgtatcaccgctactgggaagagtactctaagggcgcagattatatggactgtctctatcgctacttaaatacccagttcatcaagaagaataaactgaccgaggctgaccttcagtacggatacggtggggtagacatgaacgagcctctgatggagataggcgaactcgcactagacatgtggcggaagctgatggttgagcctcttcaggccattcttattcggatgttactgcgcgaaatcaaaaacgataggggtggggaggatcctaaccagaaagtgatccatggcgtcatcaattcctttgtgcatgttgaacagtataaaaagaagtttccacttaaattttaccaggaaatattcgaaagtccgtttctcaccgagacaggctag

SEQ ID NO: 28148 - DNA, 2295 bp, Artificial Sequence
  Description of Artificial Sequence: Synthetic coding sequence
atgtatcgggttacatggtcgaccttttggctgcgtttccagcattatacctgtaccatgagcctgaagccccgagttgtcgatttcgacgagacatggaacaagctcctgacaactattaaggcagtggtgatgttggaatacgtggagagagctacctggaacgatcggttcagtgacatctacgctctgtgtgtcgcataccccgagccgctgggcgagcgcctttataccgaaaccaagatttttctggagaaccatgtgcgccacctccataagcgcgtgctggagagtgaggaacaggtgttagtcatgtaccataggtattgggaagagtattccaagggagctgactatatggactgtctttaccggtacttaaacacgcagtttattaagaagaataaactgacggaagccgacctgcagtacggttatggtggcgtcgatatgaacgagcccttgatggagattggcgaactcgctctagatatgtggagaaagctcatggtggagcccctgcaggcgatcttgattcggatgctcttacgcgagataaaaaatgatagggggggtgaggatccgaaccagaaggtgatccacggtgtgatcaatagctttgtacacgtcgaacagtataagaagaagtttccactgaagttctatcaggagatattcgaaagtccatttctgaccgaaacgggtgagtactacaagcaagaagcttctaatctacttcaggagtctaattgttcccagtatatggagaaagtgctcgggaggctcaaggacgaagagattcgatgccggaagtatctgcaccccagttcatacactaaggtgatccacgagtgccagcagaggatggtagccgaccatctgcaattccttcacgctgagtgccataatataatcagacaagaaaaaaagaatgacatggctaacatgtatgtgctgcttcgggcagtatcaacagggctcccccacatgatccaggagctgcaaaatcatatccatgacgaaggcctgagggccaccagtaatctaactcaagaaaatatgccaaccctgttcgtggagtctgttctcgaggtacatggcaagtttgtgcagctgattaacactgtgttgaatggagatcagcactttatgagtgctctggacaaggctcttactagtgtggtaaattacagggaaccaaaatcggtgtgtaaggcccctgaattactggctaagtactgtgacaatctgctcaaaaagagcgctaagggaatgaccgagaacgaagtggaagacaggctgactagttttatcacagtgtttaagtatattgacgacaaggatgtgtttcagaaattttacgctcggatgctcgctaaacgactcatccacggattatcaatgtccatggacagtgaagaggctatgattaacaagttgaagcaggcttgtggatatgaattcacttctaagctacaccgtatgtacactgatatgtcagtgtccgctgatttgaacaataagttcaataacttcattaaaaatcaggatacagtcatcgacttgggcatctcttttcaaatctacgtcttacaggctggggcttggccattaacacaggccccatcatctacctttgccatccctcaagagctcgagaaatcagttcagatgttcgaattattttattcacagcattttagtgggcgtaaactgacatggttgcattacctctgtacaggtgaggtgaaaatgaattatcttggtaaaccatacgtagccatggtgacgacttatcaaatggcggtgctcttggcctttaataattccgaaacagtctcatataaagagctccaagactcaacccagatgaacgagaaggaacttacaaagactattaaatcactcctggacgtcaaaatgatcaaccacgactcggaaaaggaggatatagacgccgagtcgagtttcagcctcaacatgaatttcagttcgaagcgaaccaagttcaaaattacaaccagtatgcagaaagataccccacaagagatggagcagactcggagcgctgtcgatgaggacaggaaaatgtatttacaggctgctatcgtgagaattatgaaggcccgaaaggtcctccgacacaacgcgttaattcaggaagttatcagtcagtcaagagctcgatttaaccccagcatcagcatgattaagaagtgcatcgaagtcctgattgacaaacagtatatagagcggagccaggcgagtgccgatgagtattcctatgtcgcgtag

SEQ ID NO: 28149 - DNA, 2307 bp, Artificial Sequence
  Description of Artificial Sequence: Synthetic coding sequence
atgtcaaacctttcgaaaggaaccggttcccggaaggacacgaagatgaggatcagagcctttcctatgacgatggatgaaaagtatgtcaattcgatttgggatctgctcaagaacgccatacaagagattcaaagaaagaacaactccggcttgtcattcgaagaactataccgaaatgcatacaccatggtgctacataagcatggggagaagctatataccgggttaagagaggtcgtaaccgaacatttgattaacaaagtgcgggaggacgtgttaaacagccttaacaataactttcttcagacgcttaaccaggcctggaatgaccaccagactgccatggtgatgattagggacatcctgatgtacatggacagggtctacgttcagcagaacaacgttgaaaatgtctacaatctcggtttaattatctttcgggatcaggtagtacgctatggctgtatccgcgaccatctgcggcagaccctcttggacatgatcgccagggagcgcaaaggtgaggtggtcgaccgaggagcgatccgcaatgcttgccagatgctgatgatactgggccttgaaggcaggagcgtatatgaagaggactttgaagcaccatttctcgaaatgtcggccgaattctttcagatggagtcgcagaagtttttagccgagaattctgccagcgtgtatatcaaaaaggtggaagctcgtatcaatgaggaaatagagcgggtcatgcattgtctcgacaagtcgaccgaagaaccgatcgttaaggtcgtggagcgtgagctcatttctaaacacatgaaaacgatcgtcgagatggagaacagcggcctagtccacatgctcaagaacggaaaaactgaagatctgggctgtatgtacaagctcttctcacgagtccctaatgggctgaaaactatgtgtgaatgcatgtcctcatacctgagggagcagggaaaggccctggtgtctgaggagggggaagggaagaatcctgtcgattatatacagggacttttggacctcaagtctcgtttcgaccgattcctgttggaatcctttaacaatgaccgcttgtttaaacagacgatcgccggagactttgagtactttcttaatctgaacagccgttcgcctgaatacctgtctcttttcattgatgacaagttaaaaaagggcgtaaagggacttacggagcaagaggttgagacaatactcgacaaggctatggtgctgttcaggtttatgcaagagaaggatgtgtttgaaagatactataagcagcatctggctcggagactcttaaccaataagtctgtgtctgatgacagcgaaaaaaacatgatctcaaaactgaagacagaatgtggctgccaattcacctccaagctggaaggaatgttcagagacatgagcatctctaacaccaccatggatgagtttcgccagcatttgcaggccaccggggtgagcctggggggagtggacctgactgtccgtgtattgacaaccggatattggcctacacagagcgctactccaaaatgtaacatcccacccgctcctagacatgcctttgagattttcagaagattttatctagcaaagcacagcgggcgacagctcactctgcagcatcatatgggcagcgcagatctgaatgcaacgttttatggcccagtgaagaaggaggatgggtctgaggtgggggtcggaggcgcacaagtaaccggttccaacaccaggaagcacattctgcaagtgtccactttccaaatgaccatcttgatgctgtttaataacagggagaagtataccttcgaggaaattcagcaggagacagatatcccagaacgggagcttgtaagggcacttcagtcacttgcctgtgggaagccaacacaaagggtcctcacgaaagaacccaagtcgaaggaaatagagaacggtcatattttcactgtcaatgatcaatttacttctaaattgcatcgggtgaagattcagaccgtggcagccaagcagggagaatcagatccagaaagaaaggaaacgagacagaaggtggacgatgatagaaagcacgagattgaggccgctatcgttcgtataatgaaatcccgaaaaaagatgcaacataatgtgctcgtggccgaagttacgcagcagttgaaggccagattcttaccctctccagttgtcataaaaaagaggatcgaggggcttatcgagcgggagtatcttgccagaactcccgaggacaggaaagtctacacctacgttgcatag

SEQ ID NO: 28150 - DNA, 2109 bp, Artificial Sequence
  Description of Artificial Sequence: Synthetic coding sequence
atgagtaatttgagtaaggggactggcagcaggaaagacactaagatgagaattagggcgttccccgttagggaggacgttctgaattcactgaacaacaactttctgcagacgctaaaccaagcgtggaacgaccatcagactgccatggtaatgatcagagacattcttatgtacatggatagagtgtatgttcagcagaacaacgtggagaatgtgtataaccttggcctcatcatttttcgagaccaggtggtccggtacggctgcatccgagatcacctccggcagaccctacttgacatgatcgctcgcgaaagaaagggtgaggtggttgacaggggggcaattcggaacgcctgccagatgctgatgatcctcggccttgaaggtagatccgtttatgaggaggactttgaagcgccttttctggagatgtccgcagagttttttcagatggagtcacagaagttcttggccgagaatagcgcctctgtgtacatcaaaaaagtggaggccaggatcaatgaggaaatcgaacgcgtgatgcactgtctggacaagtctacagaggagcccatcgtcaaagttgttgagcgggaactgatctctaagcatatgaaaacaatagtggagatggaaaactctggcctggtgcatatgctgaagaacgggaagacggaagacctgggttgcatgtacaagctcttttctcgggtccccaatggcctgaagacaatgtgcgagtgcatgagctcatatcttcgcgaacaggggaaggccctcgtatccgaggagggcgaaggtaaaaaccccgttgattatatccaagggttgctggacctaaaaagccgctttgacaggtttctgctggaaagcttcaacaatgaccgcttgtttaaacagactattgcaggcgacttcgagtattttcttaacttgaactcgcgttcccccgaatacttatcactcttcatcgatgataaactgaaaaaaggcgtcaagggactgactgaacaggaggtggagacaatcctggataaagcgatggtactattccgcttcatgcaggagaaggatgtttttgagagatactataaacagcacttggctaggcgccttttgacaaataaatctgttagcgatgacagtgagaagaatatgatttccaagctgaagacagaatgcggctgccagtttacaagtaaattggaagggatgtttagggatatgagcatatcaaacactaccatggacgagttccgccagcatcttcaagccactggcgtgtccctgggtggcgtggacctgactgtgagagtgctgacaactggctactggcccacacaatcagctaccccaaaatgtaacattccaccggctcctagacatgcgtttgagatttttcgacggttttatctcgcaaaacactctgggaggcagctgacccttcaacatcacatgggctccgctgacttgaacgctaccttttacgggcctgttaagaaagaggatgggagcgaagtgggtgttggcggtgcccaagtaaccgggagcaacacaagaaagcacattctgcaagtctccacttttcagatgacaatattgatgctttttaacaatcgcgagaagtacacttttgaagaaatacagcaggagacagatatccccgaacgagagctagtcagggccttgcagtcactggcgtgcgggaagcctacacaacgcgtactgacaaaagagccaaaatctaaggagatcgagaatggacatatcttcacagttaacgatcagtttacctccaagttgcaccgtgtgaagatccagaccgtcgctgctaagcagggcgaatcggaccccgagcgtaaggaaacaagacaaaaagtggacgacgaccgcaagcacgaaatcgaagcagcaatcgtgaggatcatgaagtcccgtaaaaaaatgcaacacaacgtgctcgtggccgaggtgacacagcagctgaaggcgaggtttctgccctctcccgttgtcatcaagaaaaggatcgaggggctgatagagcgtgaatatttggccagaacaccagaggatagaaaggtgtatacatacgtggcctag

SEQ ID NO: 28151 - DNA, 2235 bp, Artificial Sequence
  Description of Artificial Sequence: Synthetic coding sequence
atggatgaaaaatatgtcaattccatctgggatttgctcaaaaatgccattcaggagatacagagaaaaaataattccggcctgtcattcgaggaactctatcggaacgcctataccatggtgctgcacaagcatggcgagaaactatacacaggcttgagggaagtggttacagagcacctgatcaacaaggtacgggaggatgtcctcaacagtttgaacaacaatttcctgcaaaccctgaatcaggcttggaacgatcaccagactgctatggtgatgatcagagatattctgatgtatatggacagagtttatgtccaacaaaacaatgttgaaaacgtctataatcttgggctgattatattccgagatcaggtcgttcggtatgggtgtatacgcgatcatctgcggcagactttgttagatatgattgcaagagaacgcaagggtgaggtcgtggatcgaggcgcaattcgcaacgcttgccagatgctaatgatcttgggtctggagggacggtctgtgtacgaggaggacttcgaagccccttttttagagatgtcagcagaattttttcagatggaatctcaaaagttcctcgctgagaactctgcgtccgtatatattaagaaggtggaagccaggataaacgaagaaatcgagagagtcatgcattgcctggacaaatctacagaggagccaatagtgaaggtggttgaacgtgagctgatttcgaagcacatgaaaaccatcgtggagatggagaatagcggacttgtgcacatgcttaagaacggaaagaccgaggacttgggctgcatgtataagttgttctcaagggtgccgaacgggttgaaaactatgtgtgagtgtatgtcctcgtacctccgcgagcagggaaaggcccttgtcagcgaggagggagaggggaagaaccccgtcgactacatccaagggctcttagacctgaagagccgcttcgataggttcctactcgagagttttaacaacgatcgactgttcaagcaaactatcgccggtgactttgaatactttttgaacctcaactcaagatccccagaatatcttagtttgttcattgacgacaagttgaagaagggtgtgaagggcctgaccgaacaggaagtcgagaccattctggacaaagccatggtgttgtttagattcatgcaggaaaaggacgtgtttgagaggtattacaagcagcacctggcccgaagactactaacaaataagtcagtgtctgatgactccgaaaagaatatgatcagtaagctgaagaccgaatgcgggtgccagttcacctctaagttggagggtatgttcagggatatgagtattagtaacacaaccatggacgagttccgccagcatttacaggccaccggcgtgtctctaggaggcgtcgacctcaccgttagggtcctgacaacaggctattggccgacccagtccgctacacctaaatgcaacatcccacccgcacccaggcatgccttcgagattttccgccgattttacctggccaagcatagtggcaggcaactgacactgcagcaccacatgggttccgccgaccttaacgctactttctacggtccggtgaagaaagaagatggatcggaagtaggtgtcgggggagcccaggtaaccggatctaacacccgcaagcatattctgcaggttagcacttttcagatgactatcctcatgttgtttaataatcgggagaagtacacgtttgaagagatccagcaagaaactgatattcctgaaagagagctggtgcgtgcactacagtccctcgcctgtgggaagccaactcagcgcgtgttaaccaaagagcctaagtccaaggagatcgagaatggacacatctttactgttaatgaccagttcacaagcaaactgcaccgcgtcaaaattcaaacagtggccgcaaaacagggcgagagcgaccctgagagaaaggagacaaggcagaaagtagacgatgatcggaagcacgaaatcgaggccgcaatagtgcggatcatgaaatcgcggaagaagatgcagcacaacgtgctcgttgcggaagtgacacagcagctcaaggctagattcctgcctagcccagtggtgattaagaagcgaattgaggggctcatagagcgagagtacttggcgagaacaccagaagaccgcaaagtgtatacctatgtcgcttag

SEQ ID NO: 28152 - DNA, 2235 bp, Artificial Sequence
  Description of Artificial Sequence: Synthetic coding sequence
atggacgaaaagtatgttaacagcatctgggatcttctcaaaaacgccattcaagaaattcagagaaagaacaactcaggactctcctttgaggagctctaccgaaatgcgtacacaatggttcttcataaacatggtgaaaaactgtacactggactgagggaagtggtcactgagcacctgattaacaaggtgcgagaagatgtcctgaattctctgaataataacttcttacagacactgaaccaagcttggaacgaccatcagacagcaatggtcatgattcgtgacatcctgatgtacatggatcgcgtttacgtgcaacagaacaatgtggagaatgtctacaaccttggccttatcatattccgtgaccaagtcgttaggtacggctgcatccgagatcatctgcggcaaacactgctggacatgatcgctagagaaagaaaaggggaagttgtcgaccgcggagccatccgtaacgcgtgccagatgctcatgatcctaggcctagaggggagatctgtgtatgaagaagatttcgaggccccattcttggaaatgtcggccgagtttttccaaatggaaagtcagaagttcctggccgagaactcagcaagcgtttatataaagaaggtagaggcaagaattaatgaggaaatagagcgggtgatgcactgcttggacaagagcacagaagaacctatagtgaaggttgtggagcgcgaactgatcagtaaacacatgaaaaccattgtggagatggagaatagcggcctggtccacatgctcaagaacggcaagaccgaggacctgggctgtatgtataaactcttttctcgggtaccaaacggcctcaaaactatgtgtgagtgcatgtccagctatctcagagagcaaggcaaagctctggtgtcagaagagggcgaggggaagaaccccgtggattatatacagggattacttgacctcaagagtagattcgataggttcctcctggagagctttaacaatgacaggctttttaagcagacgatcgcgggagacttcgagtactttctcaacctgaatagtaggagccctgagtacctaagtctctttatcgatgacaagctgaaaaaaggtgttaaaggacttactgagcaggaggtcgagaccattctcgacaaagccatggtcctctttaggttcatgcaagagaaggatgtcttcgaacgatattataagcaacacctggcccgacggctgctgaccaacaaatcggtttctgacgacagtgagaagaacatgatctcaaagctcaaaactgagtgtggctgccagtttacgtccaagcttgagggaatgttcagagacatgtccatttctaatacgactatggacgagttcagacaacacctccaggctaccggagtgagcctgggcggtgtcgacctgactgtacgggttctgactaccggatactggcccacccagtccgcgactccaaaatgtaatataccccctgccccaagacacgcctttgagatttttagaaggttttaccttgccaagcactccggcaggcagctaactctgcagcaccacatgggttctgccgatctgaacgccaccttctatgggccagtcaagaaggaagacggctccgaggtgggggttgggggagcccaggttaccggatcaaatacccgcaaacacatactccaggtgagcacgttccaaatgaccattttaatgctctttaacaatcgcgaaaaatatacatttgaggaaatacaacaggagacagacatccctgagcgggaactggttcgcgcactccagtccctggcatgcggtaagccgacccagagagtgttaaccaaagagccaaagtctaaggaaatagagaacggccacatctttactgtgaatgatcagtttaccagcaagctgcacagagtgaagattcaaaccgtggctgcgaagcaaggagaatctgacccggagcggaaggagacccggcaaaaggtggatgacgacagaaaacacgaaatcgaagccgctattgtacgaattatgaaatctaggaaaaaaatgcaacataacgtattggtggcagaggtgacccagcagctaaaggcacgcttccttcccagccccgtggtaataaaaaaacgcattgagggcctcatagaaagagagtacctcgcaagaactccggaagatcgaaaagtgtacacgtacgtagcttag

SEQ ID NO: 28153 - DNA, 1398 bp, Artificial Sequence
  Description of Artificial Sequence: Synthetic coding sequence
atggaaaccggcttccccgcaattatgtacccgggaagctttatcggaggctggggcgaggagtacctaagttgggagggacccggacttcccgactttgtgttccagcaacagcctgtcgaatcggaggccatgcattgctcaaaccctaaaagcggagtcgtcctggcaacagttgcaagagggcctgacgcctgccaaattcttaccagggcgcctctgggacaggatccaccgcagcggaccgtgctggggctcctcaccgcgaatggacagtaccgccgtacttgtgggcagggaattaccagaatccggtgctactcgggcagtgagaatgcttttcctcctgctgggaagaaagctctgcccgactgtggagtgcaagaaccgcctaagcaggggttcgatatctacatggacgagctggagcagggggatcgggatagctgctctgttcgagaaggtatggcgtttgaagatgtctacgaagtggacactgggacactgaagagcgatctccattttctcctggattttaatactgtgagtccaatgctggtggattcatcactcctatctcagtccgaggacatcagcagtttaggcaccgacgtgatcaatgtcacagagtacgcagaggaaatctatcagtacctgcgcgaggccgagattcgccacagacctaaagcccattacatgaagaagcagccggacataaccgaaggcatgaggactatccttgttgattggctcgtggaggtgggtgaggaatataaattacgagctgaaactctgtatcttgccgtcaacttcctcgacaggttcctcagctgcatgtctgtactgagaggaaaactgcagctggtaggaactgccgcaatgctgctggcatcgaagtacgaggagatctacccacctgaagtggacgagttcgtatacatcactgatgatacatacacgaaaagacaactcctcaagatggagcacttactgttgaaggtcctggctttcgacctgacggttccaacgaccaaccagtttttactgcaatatcttaggcgacagggcgtctgtgttcgcacagaaaatctcgccaaatacgtcgctgagttatcactcctagaggccgacccttttctgaagtatctgccaagcctgatcgctgcggctgctttctgtctggctaactacacagtcaacaagcacttttggccagaaactctggcagcgttcaccggctatagcctgtcagaaattgtgccctgcctgtctgaattacacaaggcctacctagatattccgcacagaccccagcaagcaattcgggaaaaatacaaagcctccaaatacttgtgcgtatcactaatggaaccacccgcagtcctgttgctgcagtag

SEQ ID NO: 28154 - DNA, 1395 bp, Artificial Sequence
  Description of Artificial Sequence: Synthetic coding sequence
atggagactggcttcccagccataatgtatccaggctcattcatcgggggatggggtgaagagtatctatcatgggaaggccctggactgcctgactttgtattccagcaaccagtggagtccgaagcgatgcactgttccaatcccaagagcggggttgtcctggcaactgtagctcgcggacctgatgcttgccagatactgaccagggccccacttggccaggatcccccacaacggaccgtgttggggttgcttacagctaatggtcagtaccgcagaacatgcggtcagggcattacccgcattaggtgctatagcgggtcagagaatgcattcccaccggcaggaaaaaaggccctccctgactgcggtgttcaagagcccccaaagcagggcttcgacatctacatggatgaactggaacaaggggacagagacagttgctctgttcgagaagggatggcattcgaagatgtttacgaagtagacaccggcaccctaaagagtgatctacacttcctgctggacttcaataccgtgagccctatgctcgtggatagctccttgctgtcacaatcggaggatatcagctcactcggcacagatgtcataaatgttacagagtatgcagaggaaatttaccagtatcttagggaggccgaaatccgacatcggcctaaggctcactacatgaagaagcaacctgacataactgagggcatgcgcacaatcctcgtggattggttggttgaggtgggagaagagtataagcttcgtgcagaaactctctacttggcagtgaactttctggacaggtttctgagttgcatgtctgtgctcagggggaaattacaattggtcggcaccgcagccatgctcctggccagcaaatatgaggaaatctatcctcccgaagtcgacgagtttgtgtatataacagacgacacctacacaaaacgccagctgctgaagatggaacatctgcttctgaaggtcctggccttcgacctcacagtgccgaccacgaaccagttcttactgcagtacctaagacgccaaggggtgtgcgtgaggactgagaatttggcgaagtatgtggccgagctgtcactattggaggccgaccccttcctcaaatacctgccatccctaattgccgcagccgctttttgtttggcaaactatacggttaacaaacacttttggcctgaaacactcgctgctttcacgggctattcactgagcgaaattgtgccatgtctctccgaactacataaagcttaccttgatatcccccatcgtccccagcaggcaatacgcgagaaatacaaggcttccaagtacctctgcgtgagcctgatggagccccctgcagttctcctgctgcagtag

SEQ ID NO: 28155 - DNA, 1266 bp, Artificial Sequence
  Description of Artificial Sequence: Synthetic coding sequence
atgcattgttccaacccaaaatccggggtggtcctcgcaacagttgctcgcggtccagatgcctgccagattctcacgcgagcacctctgggccaggacccacctcagcggactgtcctcggtctgctcactgcgaatggacaatataggaggacttgcggtcaagggatcacccgcattagatgttacagcgggagcgaaaacgcctttcccccagcaggcaaaaaggcactgccagattgcggtgtgcaggaacccccaaaacaggggtttgatatatatatggacgagctggaacagggagaccgggactcatgctctgttcgcgagggaatggcattcgaagacgtgtacgaggtagacacaggaactctgaaatcagatcttcattttttactggactttaatacagtctcgcctatgctggtcgactccagcctgcttagccagtcagaagacatctcgagtctggggaccgacgttatcaacgtcacagagtatgctgaggagatttaccagtacctgagggaagccgaaatccgacaccggccaaaggcccactacatgaagaaacagccagacattacagaggggatgcgtacaatcctggtggactggctggtggaagtgggtgaggagtacaagctccgggctgagacactgtatttggccgtcaattttctggataggtttctgtcttgtatgtctgttttaagaggcaaattgcagctggttggaaccgcggctatgctgctggcatctaagtacgaagaaatatatccaccggaggtcgacgaatttgtttatatcacggacgacacctatactaagcgacagctgttaaaaatggagcacctcttgctcaaggtcctggcttttgatctgactgtccctacaactaatcaatttttgctgcagtacctgcgtcggcagggggtttgcgtgcgcaccgagaacctggccaagtacgtagctgagctgtctctgctggaagccgatccatttctcaagtatcttccgtccctgatcgccgctgctgcattctgcctggcaaactatacggtgaataagcatttctggcctgaaactttggcagccttcacaggatactccctaagtgagatcgtgccttgcctgtccgagctgcacaaggcctacctcgacatccctcaccggcctcagcaagccatacgagaaaaatataaagcctccaaatacttgtgcgttagcctgatggaacccccagctgttctgctgctgcagtag

SEQ ID NO: 28156 - DNA, 1266 bp, Artificial Sequence
  Description of Artificial Sequence: Synthetic coding sequence
atgcactgctcaaaccctaagagcggcgtggtcctggccacagttgctcggggtcctgacgcctgccagattttgacgcgagcccctctgggccaggacccccctcagagaaccgttcttggcctgctcactgccaacggacagtataggaggacatgtgggcagggtattacgcgaatcagatgctactcagggtctgagaatgcattccccccagccggaaaaaaggccctccccgactgtggggtgcaggagccaccaaagcaagggtttgacatctacatggacgagctcgagcagggcgacagagatagttgcagcgttcgggagggaatggccttcgaagacgtctatgaagtggacactggcaccctgaagtcagacctccactttctgcttgattttaacactgtctcgccgatgttagtagacagctctttattgtcacaaagcgaggacatctcttctcttgggacagatgtcattaatgtgactgaatacgcggaggaaatttatcagtaccttagggaagcggaaattaggcatagacccaaagcacactatatgaaaaagcagcccgacattaccgaagggatgaggacgatcctcgtggactggcttgtggaggtgggggaggaatacaagctgcgagccgaaaccctgtatctggcagtcaatttcttggaccgattcctgtcttgcatgtcggtcctgaggggtaagcttcagctagtcggtactgccgctatgttgctcgcctcaaaatacgaggaaatttacccccctgaagtggatgagttcgtttacatcactgatgacacctataccaaacgccaattgctcaaaatggaacatctgctgctgaaggtcttggcttttgacttgaccgtgcctacaaccaaccagtttctgttgcaatatcttcgaaggcagggagtttgcgtgagaactgaaaaccttgccaagtatgtcgcggagctctctctgctcgaagccgacccattcctcaaatatctgccatcacttattgccgctgccgcattctgtttggcaaattataccgtgaacaagcatttctggcctgaaaccctggccgctttcaccggctatagcttgagtgaaattgtgccctgtctgtcagagcttcataaagcatatctggatatcccccatcgccctcaacaggccattcgtgaaaagtacaaagcgagcaagtatctgtgcgtgtctctgatggagcctcctgctgtgctgctcctgcaatag

SEQ ID NO: 28157 - DNA, 1299 bp, Artificial Sequence
  Description of Artificial Sequence: Synthetic coding sequence
atgctgggaaatagcgctccgggacccgcaaccagagaagctggttctgccttgctggctctgcagcaaacagcgctccaggaagaccaggagaacataaatcccgaaaaagcggcacctgttcagcaacctcgcacaagagccgcactcgcagtgctgaaatccggaaaccccaggggattggcacagcagcagcgacctaaaaccaggagggtggcccctctgaaggatctccctgtgaacgacgaacacgtcaccgtgcccccatggaaagccaatagcaagcagccagccttcaccatccatgtggacgaagccgagaaggaggcccaaaagaaaccagcagagtcacagaagatcgaacgcgaagacgccctggcttttaacagcgctatttcgctgccaggccctcgcaagcctctggtcccgctggattatcctatggacgggagcttcgaaagcccccacaccatggacatgtccatcatcttggaggatgaaaagccggtgtctgtgaatgaggtgcccgactaccatgaagatatccacacctacctcagagaaatggaggtcaaatgtaagcctaaggtgggctatatgaaaaagcagcctgatattactaattcaatgcgggctatactggtggattggttggtggaagtgggagaagaatacaagctgcaaaatgaaaccttgcaccttgctgttaattatatagatagattcctgtcctccatgagcgtcctgcggggtaagctacaactggtcggtaccgccgctatgctgttagcatcgaagtttgaggagatctatccgcctgaagtggccgaattcgtgtacatcacggatgacacatatactaagaagcaagtcctgagaatggagcatctcgtgctgaaagtcctcacattcgacctagcagcaccaacggtaaatcagtttctcacacagtacttcctccaccagcaacctgcaaactgtaaggtggagtcactcgccatgttcctgggggaactgagcctgattgacgccgatccttacctgaagtatctaccatcagtgattgccggagccgcttttcacctggcgttatacaccgtcaccggacagtcgtggccagaatcgctcattcgaaagacaggctataccctcgaaagtctcaaaccgtgcctcatggacctgcaccagacttacctcaaggcaccccaacacgcacagcaatcaatcagggagaaatacaagaacagcaaataccatggggtgagtctactgaatcccccagagactctgaatctgtag

SEQ ID NO: 28158 - DNA, 1302 bp, Artificial Sequence
  Description of Artificial Sequence: Synthetic coding sequence
atggctctgcgggtgacgaggaactcgaagattaacgcggaaaacaaggctaaaataaacatggctggggcaaagcgagtacctacagcacctgcggctaccagtaagcccggactgcgtccacggacagcactaggcgacatcgggaataaagtgagcgaacagctgcaagccaagatgccaatgaagaaagaagctaaaccgtcggcgactggtaaggttatagacaagaagctgccgaaacccttggagaaagtccctatgctggttccagtacccgtctccgagcccgtgcccgaacctgaacccgagccagagccagaaccagtgaaagaagaaaagttatcacctgaacctatcctcgttgatacagcatcccccagtcctatggaaacctccggctgcgctccagccgaagaagacctgtgccaggcattcagcgatgtcatattggcggtcaacgacgttgacgctgaagatggggctgatccaaacctctgttccgagtacgtcaaggatatctacgcataccttcgccaactagaggaggagcaggcagtgcgacccaaatatctgcttggtcgggaagtcactggaaatatgcgggcaatcctcatcgattggctggtgcaggtacaaatgaaattcagactactacaggagacaatgtacatgacagtatcaattattgacagattcatgcaaaataattgtgtgcctaagaagatgcttcaacttgtgggggtcacggctatgtttatcgccagcaaatatgaggaaatgtatccacccgaaatcggggattttgccttcgtaactgacaatacctataccaaacaccaaatccggcagatggaaatgaagatcttacgggctctaaatttcgggttggggaggccattaccattacatttcttgaggcgcgcttctaagataggtgaggtggacgtggaacagcatacactcgccaagtatctcatggaacttaccatgctagattacgatatggttcactttccgccttcccagatagccgcaggggcattttgtcttgccctgaaaattctcgacaacggtgaatggacgcccacactgcagcattatttgtcatataccgaagagtccctgcttccggtcatgcagcatctcgccaagaacgtggtgatggtgaatcagggcttgacaaagcatatgacggtcaaaaacaagtatgcaacttctaagcatgccaagatctctactctgccccaactgaattccgcactagtccaggatctcgcgaaagcagttgcaaaagtgtag

SEQ ID NO: 28159 - DNA, 1191 bp, Artificial Sequence
  Description of Artificial Sequence: Synthetic coding sequence
atggctctccgcgtgacaaggaacagtaaaattaacgctgaaaacaaggcaaaaattaatatggcgggtgctaaacgggtgccaacagctcccgcagcaactagcaagcccggactgcgtccccgtactgcattgggcgatatcggcaataaggtttccgaacagctgcaggccaagatgccaatgaaaaaggaggccaagccttcagcaacggggaaagtgatcgacaagaagctccccaaacctctagagaaagttccgatgctggtgccagtgcctgtgtccgaacctgtgcccgagcccgagcctgaacccgaacctgagcctgtgaaagaagagaagctttccccagagcctattcttgtggataccgccagtcccagtccaatggagacgagtggttgcgcgcctgctgaagaagacctgtgtcaggctttctctgatgtcatcctcgccgttaacgacgtggacgctgaggatggcgctgaccccaatctttgctccgaatacgtgaaggacatatacgcttacctccggcagctggaggaagaacaggccgtgcgacctaaatatctgctcggaagggaagtaacaggcaacatgcgcgcaatcttaatcgactggctggtgcaagtacaaatgaagttcaggctcttgcaggagacgatgtatatgactgtaagcatcattgacagatttatgcagaacaattgtgtgcctaaaaaaatgctgcagctcgtaggagttacagctatgttcattgcttcaaaatacgaggagatgtaccctcctgaaatcggggacttcgcgttcgtgactgacaatacatatacaaaacaccagatcaggcagatggaaatgaagattctccgagccctaaactttggactcggtaggcctttgccgctgcactttctccgcagggccagcaaaattggagaagttgatgtggagcagcacacattagctaaatacttgatggagttaacaatgctggactacgatatggtccattttcctcctagccaaatcgccgcaggcgctttttgtcttgccctaaagatcctggataatggcgagtggactgtgaaaaacaaatatgccacatctaagcacgccaaaatctcgacccttcctcagctgaattcagcgctggtacaggatttagcaaaagcagtcgcgaaagtgtag

SEQ ID NO: 28160 - DNA, 1206 bp, Artificial Sequence
  Description of Artificial Sequence: Synthetic coding sequence
atggctctgcgcgtaacacgcaattcaaaaataaacgctgaaaataaggccaagatcaatatggctggtgcaaagagggttccaaccgctcctgctgcaacatccaaaccgggactcagacccagaacagccttaggcgacatagggaataaggtgagtgaacagctgcaggcaaaaatgcccatgaagaaagaagccaagccaagcgctactggaaaggtgatcgacaagaagttacccaagccactcgagaaggtgcctatgctggtaccagtgcctgtcagcgagccagtacctgagcccgagccagaacccgagcctgaacccgtgaaggaagagaaactctcgcccgagcccattctggtagacaccgccagcccctcgcccatggagacttcagggtgtgcacccgctgaggaggacctttgtcaagctttttctgatgtgatcctagcagtgaacgacgtggatgccgaagatggcgctgaccccaatctgtgctctgaatatgtgaaggatatctacgcctacctccgccaactggaggaagagcaggctgtccgaccaaagtacttactgggtagggaggtgactgggaatatgcgggcaatactaatagattggctcgtgcaggtacagatgaagtttcgactcttgcaggagacgatgtacatgacagtttccattattgacaggtttatgcaaaacaattgtgtgcccaagaagatgctgcagttggtcggggtgactgctatgtttattgccagcaaatacgaagaaatgtatccccctgaaatcggcgattttgcctttgtgactgataatacttataccaagcatcaaatccgccagatggagatgaaaatcttgcgagctctcaattttggcctggggcgtccgcttcccctccacttcctgcggcgagcttcaaagattggagaggtggacgtggagcagcacaccttggctaaatacttaatggagctgactatgctcgactacgacatggtgcactttcctccaagccagatcgccgcaggggcattttgcctggccttaaaaattctggacaacggggagtggacccccacactccagcattacttgagctacaccgaagagagtctcctacctgttatgcaacaccttgccaagaatgtggttatggtgaatcaggggttgacaaaacatatggtgtcacagtag

SEQ ID NO: 28161 - DNA, 1197 bp, Artificial Sequence
  Description of Artificial Sequence: Synthetic coding sequence
atggccctacttagacggcctaccgtgagcagtgatctcgagaatatcgacaccggtgtaaattcaaaggtgaaatcccatgtgactatccggcgaaccgtactggaagagatcggcaatagggtgactacccgggcagctcaggtggccaaaaaggcccaaaacaccaaggtgcccgtgcagcctactaagacaactaatgttaacaaacagctaaagccaaccgccagtgtgaaaccagtacagatggagaagctcgcgcctaagggcccttctcccacaccagaggatgtgtccatgaaagaggagaacctgtgccaagcctttagcgacgctctgttatgtaagatcgaagatatagataatgaagactgggagaatccacaactgtgctctgattacgtgaaggacatctaccagtatctgaggcaacttgaggttctccagagcatcaatccccacttccttgacgggagagatataaacggtcggatgcgggctatcctggttgattggttggtgcaagttcactccaaatttcgcctgttacaggagaccctgtacatgtgcgtgggtattatggaccggtttctgcaggttcagccagtgtcccggaaaaaactgcagttggtcggaataacagctttgcttctggccagtaagtacgaggaaatgttctccccaaacatcgaagactttgtctatatcactgacaatgcctacacatcttctcagatccgagagatggagaccctcatcctgaaggaattaaaatttgagctgggcaggcctctaccgctgcattttctacggcgagcttcgaaagcgggagaagtcgacgttgaacagcacacactggctaaatatttaatggaattgaccctgatcgattatgacatggtgcactaccacccctccaaagtcgccgctgccgcttcttgtctctcccaaaaagtgcttgggcagggtaagtggaatctgaaacaacaatactacactggctacactgagaatgaagttctggaagttatgcaacatatggcaaaaaacgtggtgaaagtcaacgaaaatctcaccaaatttatcgccattaagaataagtatgcttcatcgaaactcctgaagatatcgatgatcccccaactcaactctaaggcagtgaaggacttggccagtcctttgatcgggagaagctag

SEQ ID NO: 28162 - DNA, 432 bp, Artificial Sequence
  Description of Artificial Sequence: Synthetic coding sequence
atggcgggaaatttctggcagtcatcacactatttgcagtggattctggataagcaggaccttcttaaggagaggcagaaagatctaaaattcctgagcgaagaggaatattggaagctacagatcttcttcacgaacgttatacaggctttgggtgagcatcttaagctgagacagcaggtcatcgccaccgccactgtctacttcaagcgcttctatgcaaggtatagcctcaaaagcattgaccctgttctgatggcccctacttgtgtgtttctcgcctctaaggtcgaggaatttggagtcgttagcaatactaggttgattgcagccgctaccagtgtgtgtaaatgtaaaaagtatatatgctttaaagatgtcatactgaaaaaggcaccagagtatatcgacttttttttcttctctttatag

SEQ ID NO: 28163 - DNA, 852 bp, Artificial Sequence
  Description of Artificial Sequence: Synthetic coding sequence
atggcaggtaatttttggcagtcctctcattatctccagtggatcctagataaacaggatctgcttaaggagcgccagaaggaccttaagtttctgtccgaagaggaatactggaaactgcagatttttttcactaacgttatccaggccctgggagaacacctgaaattacgacagcaagtcattgcgaccgccactgtctattttaagcgtttttacgcacgatacagcctgaagtcaatcgatcccgtgctgatggcgccaacgtgcgtctttttggcctccaaagtcgaggaatttggagttgtgtccaataccagactgatcgctgcagccacttctgttctgaagacaagattcagctatgctttccccaaggagttcccataccgaatgaatcacatcttagagtgtgagttctacctgctggagctcatggattgttgcctgatcgtctatcatccatatagacccctgctccagtacgttcaggacatgggccaggaagacatgctgttgccactcgcctggcgaatcgtcaatgatacctacaggaccgatttatgcctgctctatcctcctttcatgatagccttggcttgtctgcatgtggcttgcgtggtccagcagaaggacgccagacaatggttcgctgagctgtctgtggacatggaaaaaattttagagattatcagggtgatcctgaagctatatgaacagtggaaaaattttgacgaacgcaaggagatggcgacaatactgagcaaaatgcccaagccaaaaccacctcccaattccgagggcgagcaaggcccaaatgggtctcagaactcaagttatagccagagctag

SEQ ID NO: 28164 - DNA, 597 bp, Artificial Sequence
  Description of Artificial Sequence: Synthetic coding sequence
atggcccctacatgcgtttttctagcaagcaaagttgaggaattcggagtagtatcaaacacccgccttatagccgctgctaccagcgtgctgaaaacacgcttctcatatgcattccccaaggagttcccatacaggatgaatcatatcctggagtgcgagttttaccttctggagctgatggactgttgcctcattgtgtaccacccgtatcggccacttctccaatacgtgcaggatatgggccaagaagacatgctattgcccttagcttggaggattgttaacgacacgtatagaaccgatctgtgcttgttatatcctccttttatgatcgcactggcttgcctacatgtagcgtgcgtcgtgcagcagaaagatgccagacagtggttcgcggaactgagcgtggatatggaaaaaattctcgagatcatcagggtgatcttgaaactttatgagcagtggaagaacttcgacgaacgcaaggaaatggcgacaatcctgtccaagatgcctaagcccaaaccgcctcctaattccgagggcgagcagggccctaacggatcccagaattcaagctatagtcagtcctag

SEQ ID NO: 28165 - DNA, 597 bp, Artificial Sequence
  Description of Artificial Sequence: Synthetic coding sequence
atggctccgacgtgcgtctttctcgcctcaaaggtcgaggaattcggggtggttagcaatacccggttgatcgctgcagccacctctgtcctgaagacacgcttcagttacgcttttccaaaggagttcccataccgaatgaatcacatcctggaatgcgagttctaccttctcgagctcatggattgttgtctcatcgtgtaccatccataccgtccactccttcagtacgtccaggacatggggcaggaagacatgttactccccttggcatggcgcattgtgaacgatacctacaggaccgacctctgtctgctgtatccacctttcatgattgctctagcctgtcttcacgtggcatgtgtggtgcagcagaaggatgccaggcagtggttcgcggagctttcagttgacatggagaagatccttgaaattattcgtgttattctcaagctgtatgagcagtggaagaactttgacgagcgaaaagaaatggctacaattctgtcgaaaatgcccaagcctaaacctcccccaaactccgagggcgaacaggggcctaacggaagccaaaacagttcgtacagccagagttag

SEQ ID NO: 28166 - DNA, 489 bp, Artificial Sequence
  Description of Artificial Sequence: Synthetic coding sequence
atggcccctacctgtgtgtttctcgcatcaaaagtagaggagttcggcgtcgtgtccaacaccaggctcatcgccgctgcaacaagcgtcctgaaaacacggttcagttacgccttccctaaggaattcccttaccgcatgaaccacatactcgaatgtgagttttatttgctggagctgatggattgttgtctcatcgtgtaccatccttacagacccctgctacagtacgtgcaggacatggggcaggaagatatgcttctcccgctggcctggcgaattgtcaatgatacctaccgtacggacctatgccttctgtacccccctttcatgattgctctcgcgtgcctgcacgttgcgtgtgtggtgcagcaaaaggatgcacgccaatggttcgccgagctaagtgtggatatggagaagatcctggaaatcattagagtcatactcaaactttacgaacagtggaagaatttcgatgaacggtag

SEQ ID NO: 28167 - DNA, 2283 bp, Artificial Sequence
  Description of Artificial Sequence: Synthetic coding sequence
atgtccactgtggaagaagattcggacaccgttacggtggaaacagtaaactcagtgaccttgacacaagacaccgagggcaatctgatattgcattgtcctcagaatgaggccgatgaaatcgactccgaggacagtatcgaacccccacataaacgtctttgcctgtcctctgaggacgatcagtccattgatgatagcacaccctgtattagtgtggtggcgctgccactctcagagaatgaccagagttttgaggtgaccatgaccgcaacaactgaggtcgccgacgacgaagtcacggaggggaccgttacccagatccaaattttacaaaatgaacagttagatgaaatcagcccacttggaaacgaggaggtaagtgctgtatctcaggcatggtttacaactaaagaagataaggacagtctgacaaataaaggacataaatggaagcagggaatgtggagcaaggaggaaatcgatatcttgatgaataacattgagaggtatttaaaggctagaggcatcaaggacgcgaccgagattatattcgagatgtcaaaggacgaacggaaggacttctacaggacaatcgcctggggcctgaaccgtcccctgttcgcagtatacagaagagttctgcggatgtacgatgaccgcaatcatgtgggaaaatacactcccgaagagatagaaaagttaaaagagctacgcataaagcacgggaatgattgggcgactattggagcagctctcgggcgatcagcgtcctcagttaaggatagatgcagactgatgaaggatacgtgtaataccggcaaatggacggaggaagaggaaaagcgattggcagaagttgtacacgaactcactagcacagagccaggcgatatcgtcactcagggcgtctcctgggctgccgtcgccgagcgcgtcggcacaagaagcgagaagcagtgtcgaagcaaatggcttaattatctgaactggaaacaatcaggaggaactgaatggactaaggaggacgagataaatcttatacttaggattgctgagctggacgtggcagatgaaaacgacatcaactgggacttgttagctgagggctggagcagcgtgaggtcgccccagtggctccgttccaagtggtggactattaagaggcagatagcaaaccataaggatgtgtctttcccggtgctgatcaaaggcctcaaacagctgcacgagaaccagaaaaacaatcccacactactagagaacaagtctggctctggcgtccctaacagcaatacaaactcctctgttcaacatgtgcagattagagtcgccagattggaggacaacacagcgatttcctcatcccctatggctgccctccagatccccgtacagataacccatgtgtcctccgctgactcgcctgccaccgtagattctgagactatcaccctcaattcagggacactgcagacatttgaaatactgccgagcttccatttacagcctacggggacacccggaacctatctcctgcagactagctcgagccaagggctgcccctaacccttaccgcaagtccaacagtcacactcacggcggctgccccagcgtccccagaacagatcattgtccacgctctgagtcccgaacacctgctgaatacctcagacaacgtgaccgtccagtgccacactccccgtgtgattatacaaaccgtcgccaccgaagacattacttccagcatttcacaggcagagctgacagtggactccgacatccagtcttccgattttccagaacccccagacgcattggaagcagataccttccccgacgagatccaccaccctaaaatgacggtcgagccgtcgttcaatgacgcccacgtttcaaaattctccgatcagaattcaacagaactgatgaactccgtcatggtgcgcaccgaggaggagatctcagatactgacctgaaacaggaggagtcgccctcggacctggcatccgcttatgttactgagggcttggaaagccccacgattgaagagcaggtggaccagactattgacgatgaaaccattctgatcgttccctcccctcacggctttatccaggcatctgatgttatcgataccgagtcagtgctgccccttaccacccttaccgaccctatactgcagcatcatcaggaggagtctaatatcataggtagcagcctgggtagtcccgtttcagaggactccaaggatgtagaagacttggtaaattgccactag

SEQ ID NO: 28168 - DNA, 858 bp, Artificial Sequence
  Description of Artificial Sequence: Synthetic coding sequence
atgagtacagttgaagaagactctgacacagtgactgtggaaacagtaaacagcgtgaccctcacacaggacaccgaaggaaatctgattctgcactgtccacagaacgaagccgatgagatcgattctgaggacagtatagaaccccctcacaaacgactctgtctttccagcgaggacgaccaaagcatcgatgattctactccatgtatcagcgtggtcgccctaccactgtccgagaacgaccagagtttcgaagttaccatgaccgcgacaacagaagtggcagatgacgaggtaacagaaggcaccgtgacccaaatccagatacttcaaaatgaacaactcgacgaaatcagtccactcggcaacgaagaggtgtcagccgtgtcccaggcctggttcaccactaaggaagataaggacagcctcactaataagggccacaagtggaagcagggaatgtggagtaaagaggagatagacatcctgatgaataatatcgagcggtacctcaaagctcggggtatcaaagatgctacggaaattatattcgagatgtctaaggatgagaggaaggacttttacaggacaattgcatggggccttaaccgcccactgtttgccgtgtacagaagagtgcttcgcatgtacgacgaccggaaccacgtgggaaaatacactccggaggaaatcgaaaaactaaaagagaaaaaggccatcgcagcttgttttttctttactcacagacagctctggactccaaaaaaagggcacacttttaagctctggctgagcaaatactgctgtcctcagctccctaatcagtccaatggaaagaagaaaaacgaggaatag

SEQ ID NO: 28169 - DNA, 2283 bp, Artificial Sequence
  Description of Artificial Sequence: Synthetic coding sequence
atgagtactgtagaagaagatagtgacacggtgactgttgaaactgtgaactccgtaactttaacacaagatacggaaggcaacctaattttgcactgtcctcaaaatgaggccgacgagatagatagcgaggactccatcgagcctcctcataagaggctctgccttagctccgaggacgaccaatccattgatgattctactccatgcatctctgtggtggcactgccattaagtgaaaacgaccagtcttttgaggtaaccatgacggcgacaacagaagttgccgatgatgaagttacagaaggaaccgtgacacaaatacagattctccaaaacgagcaactcgacgaaatctcaccgctcgggaatgaagaagtgtctgctgtctcacaggcctggtttacaaccaaagaagacaaagattccctgactaataaaggtcataagtggaaacaaggtatgtggtccaaggaggagatcgatatattaatgaacaacattgaaaggtatctgaaagctagaggcatcaaggatgccaccgaaatcattttcgaaatgtcaaaggatgaaagaaaagacttttatcgcacaatcgcctggggactgaaccgaccgttgtttgcggtgtacaggcgggtgctccgtatgtacgacgatcgaaaccacgtgggtaaatatactcctgaggagatcgagaaactgaaagaactgcggatcaagcatggtaacgactgggccacaataggcgcagctctgggaaggtcagcctcttcggtgaaagaccggtgccgactgatgaaagacacctgtaacacagggaaatggacagaagaggaagagaagcgcttagccgaagtggtccacgagcttacttcgacggagccgggagatatagttacccagggcgtgtcctgggcagccgtcgccgagcgtgttgggacccggtcagaaaagcaatgccgttctaagtggctgaattatctgaactggaagcaaagtggtggcactgaatggacgaaggaagacgaaattaacctcattctccggatcgcggaattggacgtggcggacgagaatgacatcaattgggatctcctggccgagggatggagcagcgtgagatcaccccagtggctccggtccaaatggtggactattaagaggcagatcgctaaccacaaggacgtgagtttccctgttttgatcaaagggctcaaacaactccatgaaaaccagaagaataaccccacactgctggagaacaagtcaggatcaggggtcccgaactctaacacaaattcaagcgttcagcatgttcagattcgggtagctcgattagaggataacaccgccatcagtagtagtcctatggccgctttgcagatccccgttcagatcacccacgtatcgtctgccgactcccctgccacggtcgattcggaaacaataacactcaattctggtactttacaaactttcgaaatcctcccctcctttcatctgcagccgactggaacccctggtacctatcttcttcagacatcctcaagccaggggttgcctcttaccttgactgcgtcaccaacggtaacgctaactgcagctgcgcctgccagccccgagcagatcatcgtgcatgcattaagtccagaacatctgcttaacacttctgacaacgttaccgttcagtgtcacactcctcgtgtcattatccaaaccgttgccacggaagacatcacaagttcgatttcacaagccgagctgaccgtcgacagtgacatccagtcctccgacttccctgaacctcccgatgctcttgaagctgacacctttccagatgagatacaccatcctaagatgaccgttgagcccagcttcaatgacgctcatgttagcaagttctccgatcagaacagcacggaattgatgaattctgtgatggtccgaaccgaggaggagatatctgatactgatcttaagcaggaggagtctccttctgacttggcttcagcctacgtgaccgaggggctggaatctccaacaatagaggagcaggtggaccagacaatcgacgacgaaaccatactgattgtaccaagtccacacggctttatacaggccagtgacgtcatagacaccgagtctgtattgccactgacaacactcaccgaccccatcctgcagcatcatcaggaggaaagtaatatcatcggatcctcacttggctcacccgtgagtgaggactccaaggacgtggaggacctggttaactgccattag

SEQ ID NO: 28170 - DNA, 735 bp, Artificial Sequence
  Description of Artificial Sequence: Synthetic coding sequence
atgtccactgttgaggaagattccgacactgtgacagtagaaactgtgaattccgtaacattgactcaggacaccgaaggaaacttgatactgcattgtcctcagaatgtgtccgaaaacgaccagtcctttgaggtgacaatgacagcaaccacagaggtggccgatgacgaagtcaccgagggtaccgtgacccagattcagatcctgcagaacgaacaattggacgagatatcaccactgggcaacgaggaagtgtctgccgtgagccaggcctggtttacaaccaaggaggacaaagatagcttaaccaataagggccacaagtggaagcaggggatgtggtctaaagaggagatcgatattctgatgaataacatagaaaggtatctcaaggctaggggcattaaggatgcaacagagattatcttcgagatgagtaaagatgagcggaaggatttctacagaacaatcgcttggggtctaaacagaccactttttgccgtgtatcggagggtgctgcggatgtatgacgatagaaatcacgtggggaaatatacccctgaggaaattgagaaactcaaggagaaaaaagccattgccgcatgtttttttttcacccacagacagctgtggacccctaaaaagggccatacctttaaactgtggctcagcaagtattgctgtccccagctgcctaatcagagtaatggtaagaagaagaacgaagagtag

SEQ ID NO: 28171 - DNA, 819 bp, Artificial Sequence
  Description of Artificial Sequence: Synthetic coding sequence
atgagcaccgttgaagaagatagtgataccgttacagtcgagaccgttaatagcgtgaccctcacacaggatacagaaggtaatttgatattgcactgtccgcagaatgaggcggatgagatagatagcgaggattccatcgagcctcctcataaacggctctgcctaagttctgaggacgatcagtctattgacgactccacaccttgtatttctgttgtagccctccctttgtcagaaaatgaccagagcttcgaggtaactatgaccgccaccactgaggttgccgacgacgaagtgacagagggcactgtcacacagatacagatcctgcagaatgagcagcttgatgagatcagccccttgggcaacgaagaggtgagcgccgtctcccaagcctggttcacgactaaggaggataaggacagcctgacgaacaaaggccacaagtggaaacagggaatgtggagcaaggaagagatcgacatcctgatgaataatatcgaacggtacctgaaggcacgcggaattaaagatgccactgagatcatatttgagatgtccaaggatgaaagaaaggacttctaccggacaattgcatggggtctgaaccgacctctattcgctgtgtaccggcgagtcctgcgaatgtacgatgaccgtaatcacgtaggcaaatacacacccgaggaaatcgagaagctgaaggagcagctttggacgcccaagaaggggcacacattcaaactctggctctccaagtactgttgccctcaattacctaaccagagcaatggtaagaagaaaaacgaagagtag

SEQ ID NO: 28172 - DNA, 2073 bp, Artificial Sequence
  Description of Artificial Sequence: Synthetic coding sequence
atgagcacggtggaggaggactcagacaccgtcactgtggagactgtgaatagtgtgacactgacacaagacactgaaggcaacttaatcctgcactgtcctcagaatgaagccgatgagatcgacagtgaggattctatcgagccaccacataagaggctctgtctttcgtctgaagacgaccagtcaatcgatgacagcaccccttgcatttctgtggtcgctctgccactcagcgagaacgatcagtcatttgaagtcacaatgactgcaacaacggaagtggctgatgacgaagttacggaagggactgtgacccagatccagatcttgcaaaacgaacaactggatgaaatttccccactcggcaacgaggaagtgagcgccgtgtcccaggcttggttcacgacaaaagaagacaaagattcactgacaaataaaggccacaaatggaaacaggggatgtggagcaaagaggagatcgacatattaatgaacaatattgagcgatatctgaaagcaagagggattaaagacgccactgagatcatctttgaaatgtccaaggacgagcggaaggatttctatcgcaccatcgcgtgggggctcaacagacctctgttcgccgtgtatcgccgagtcttacggatgtatgatgataggaaccatgttgggaagtacacccccgaggagatagaaaagctcaaagaactgagaattaagcacgggaacgactgggctaccatcggagccgctttgggacggagcgcctcttcagtgaaagatagatgccgattaatgaaagacacatgtaataccggcaagtggaccgaagaggaggagaaacggctggcagaggtggtccatgagctcacatcgacagaacctggggatattgttacacaaggcgtttcctgggcagcagttgccgagagggttggcaccaggagtgaaaaacagtgtcgatccaaatggcttaactatctaaattggaagcagagcggaggaactgagtggacgaaggaagacgagatcaatctcatcttgcgcattgctgaacttgacgtagccgacgagaacgatattaattgggatctgttggcagagggttggtccagcgtgaggtctccacaatggctaagatccaaatggtggaccattaaaaggcagatcgctaatcataaggatgtgagcttccccgcaagcgccgatagccccgctaccgtcgacagcgagacaatcaccctgaactcaggcaccctgcagacattcgaaattctgccaagtttccacctgcagcctaccgggacacctggcacttacttactacagacttcttcaagtcagggcctgcctctgacactcacggcatcccccactgtgaccctgactgcggcagccccagctagtcccgagcagatcatcgttcatgcgctgtcccctgaacacttgctcaacacctccgataacgtcacggtgcaatgccacactcccagggttatcatacagacagtcgcgactgaggacattacttcaagcatttctcaggcggagctgaccgtggatagcgacatacagagttctgactttcccgaaccaccagacgccttggaagcagatactttccctgatgaaatccaccaccccaagatgaccgtagaaccctccttcaatgacgctcacgtaagcaaattctcagaccagaattctaccgagctgatgaatagtgtaatggtcagaacagaagaagagatatccgacaccgatctcaaacaggaggaaagcccaagcgacctagccagcgcttatgtcacggaaggacttgagtcccccaccatagaggagcaggttgatcagaccattgacgatgagaccatattgatagtgccaagtccacacggcttcatccaagcctcagacgttattgacacagaatcagtcctgccccttacgacactgacagatccgattcttcagcatcatcaagaagagtcgaatataattggcagtagtctcggcagcccagtttccgaagactcaaaagacgttgaggatttggtcaattgtcattag

SEQ ID NO: 28173 - DNA, 1485 bp, Artificial Sequence
  Description of Artificial Sequence: Synthetic coding sequence
atgaaagacacatgcaatacaggaaagtggacagaggaagaagaaaagcgcctggcagaggtggtccacgaactcacctccactgagccgggtgacatagtgacacaaggggtgtcctgggctgctgtcgccgagagggttggtaccaggtcagagaaacaatgtagatcaaagtggctcaattatctgaattggaaacagtctggtggcactgaatggaccaaggaagacgaaattaatctcattctacgcatagccgagctggatgtggcagacgaaaatgacatcaactgggacctgctggccgaggggtggagcagtgtgcggtctccacagtggcttagaagcaaatggtggaccatcaaacgccagatcgcaaatcacaaggacgtgagttttccagtgcttatcaaagggctaaagcagctgcacgaaaaccaaaagaacaatccgacgctgttggagaataaaagcggaagtggtgtacccaattcgaatactaatagttctgtgcagcacgtgcaaatcagagtggcaagactggaggacaacacagccattagcagcagcccaatggcagcccttcaaatccctgtgcagattacacacgtcagtagtgcggactcccccgcaacagttgactctgagacgattactctgaatagcggcacattacagacattcgagatacttccaagtttccacctgcagccaactggcactccaggaacatacttgcttcagacctcctcgtcccagggcctgcccctgactctgacggcctcgccgacagtgaccctgactgcggctgctcctgccagcccagaacaaatcatcgtgcacgcattatcacctgagcatcttctgaacacgtccgataacgtgaccgttcaatgccatactcctcgagtcatcatacaaactgtggccaccgaagatatcacatcttctatttctcaggctgaactgaccgtggacagtgatattcagagcagtgactttccagagcccccagacgcccttgaggcagacaccttcccggacgagattcaccaccctaagatgactgtggagccctctttcaatgacgctcacgtgagcaaattctccgaccagaacagcactgaattaatgaacagcgtcatggtacgcacggaagaggaaattagcgataccgacttgaagcaggaagagtctccatctgatctggcgtcagcctacgtaacggaaggcctcgagtccccaactattgaagaacaggtcgaccagacaatcgacgacgagacaatcctcatagtcccaagtcctcacgggtttatccaagcaagtgacgttattgacactgagtcagtcctgccattgactacgctgactgatccaatcctacagcatcaccaggaggagtccaacatcatcggatcatctctgggctcgccggtgtccgaggattccaaggacgttgaagacctggttaactgccactag

SEQ ID NO: 28174 - DNA, 111 bp, Artificial Sequence
  Description of Artificial Sequence: Synthetic coding sequence
atgagcaccgtggaggaggatagcgacactgtgacagtggaaacagtgaactctgtgactttaactcaggacacagagggtaacctcattttacactgccctcaaaactag

SEQ ID NO: 28175 - DNA, 33 bp, Artificial Sequence
  Description of Artificial Sequence: Synthetic coding sequence
atgactgcaaccaccgaggttgcagacgattag

SEQ ID NO: 28176 - DNA, 111 bp, Artificial Sequence
  Description of Artificial Sequence: Synthetic coding sequence
atgagcaccgtggaggaggatagcgacaccgtcactgtggagacggttaatagcgtcaccctgacccaggacaccgagggaaacctgatcctccattgcccacagaattag

SEQ ID NO: 28177 - DNA, 735 bp, Artificial Sequence
  Description of Artificial Sequence: Synthetic coding sequence
atgtcgacagttgaggaagattccgatacagtgactgtggagacggtcaacagtgtgactttaacccaggataccgaaggcaacttaatcctccactgccctcagaacgtgtctgaaaacgaccaaagtttcgaggtcacgatgactgccacgaccgaggtagccgacgatgaagtgacagaaggaacagtgacacaaatccagatccttcagaatgaacagctcgacgagatttctcctctgggaaatgaggaagtctccgccgtttcgcaggcatggttcactacgaaagaagataaggattcactgaccaataagggtcataagtggaaacagggaatgtggtctaaagaagaaatcgacatcttaatgaacaacatagaacggtatctaaaagccagaggaattaaagacgcaacagagattatctttgagatgtcaaaggacgagagaaaagatttctaccgtacgatagcatggggtttgaacaggcccttgtttgccgtgtaccgccgagttctgcggatgtatgatgaccgaaatcatgtggggaagtatacaccggaagagatagagaagctcaaagaaaagaaagctatcgccgcttgcttcttttttacccaccgccaactgtggacccctaagaagggccacaccttcaaactgtggctgtctaagtactgctgcccgcagcttccgaatcaatcaaacgggaaaaaaaagaacgaggaatag

SEQ ID NO: 28178 - DNA, 582 bp, Artificial Sequence
  Description of Artificial Sequence: Synthetic coding sequence
atgtcaacagtggaggaagatagcgacaccgtgaccgtggaaacagtcaatagcgtgacactgactcaggatacagaggggaatttaatactccattgccctcagaacgaggcggatgagattgattcagaggatagtattgaaccacctcataagcggctatgcttgtcctctgaagatgatcagagcatagatgactctaccccatgtatatctgtggtggctctgcccctgtcggagaacgatcaatcttttgaagtgactatgactgcaactacagaagtcgccgatgacgaggtgaccgaaggcaccgtgactcagatccagatcctgcagaatgagcaactcgacgaaatcagccctctgggtaacgaagaggtgtctgctgtctcacaagcatggtttaccaccaaagaggataaggattctctgaccaataaaggacataaatggaaacagggaatgtggagtaaagaggaaatcgatatactgatgaacaacattgagcgctacctgaaggctaggggcatcaaggacgctacggagataatttttgaaatgtcaaaagatgaacggaagtag

SEQ ID NO: 28179 - DNA, 84 bp, Artificial Sequence
  Description of Artificial Sequence: Synthetic coding sequence
atgtctactgtcgaagaggacagcgatactgtgactgtcgagacagtgaattccgtaacacttacacaagatactgagggctag

SEQ ID NO: 28180 - DNA, 444 bp, Artificial Sequence
  Description of Artificial Sequence: Synthetic coding sequence
atgtcaacagtcgaggaagattccgatacagttacagtcgagactgtgaactctgtgacgttgactcaggatacggagggtaacctaattctccactgccctcaaaacgaagcagacgagattgatagtgaagactccatcgaaccccctcacaaacgtctatgcttgagctctgaggacgatcagtctattgatgactccaccccctgcatctccgtcgttgcattgccactgagcgagaatgatcaaagctttgaggtgaccatgaccgcaacaacggaagtggctgatgacgaagttaccgagggaactgtaactcagatccagatcctccaaaacgagcagcttgatgagatatccccacttggtaatgaggaggtgtctgcagtgtctcaggcatggttcacaactaaagaggacaaagactcccttacaaacaaatag

SEQ ID NO: 28181 - DNA, 222 bp, Artificial Sequence
  Description of Artificial Sequence: Synthetic coding sequence
atgagcacagtggaagaagactctgataccgttacagtggaaactgttaactcagtgacacttacccaggacactgaggggaatctgatccttcactgcccgcagaacgaagccgatgaaatcgattctgaggactccattgaaccacctcacaagaggctgtgtctgtcgtccgaggacgaccagtccattgacgattccactccatgtatttcagtatag

SEQ ID NO: 28182 - DNA, 2019 bp, Artificial Sequence
  Description of Artificial Sequence: Synthetic coding sequence
atgacagcaacgaccgaggtagccgatgacgaagtcactgaaggcaccgtgacccagattcagattcttcagaatgaacagctggacgagatatctcccttaggaaacgaggaggtttctgcagtatcacaagcttggttcactactaaagaagataaagattccctgactaacaaggggcataaatggaaacaggggatgtggagtaaagaagagattgacatactgatgaataatattgagcgctacctaaaagcccgagggatcaaggatgctacggaaatcatatttgagatgtcgaaagatgagagaaaagacttctatcggactattgcctggggactgaacagaccccttttcgcggtgtaccggcgtgtcttgagaatgtatgatgaccgcaatcacgtggggaagtacacgcctgaagaaattgaaaaactaaaagaactgagaatcaagcacgggaacgactgggcgacaatcggggctgcgctcggacgatctgctagttccgttaaagaccgctgccggcttatgaaggatacttgtaacaccggcaaatggacagaggaagaggaaaagcggctcgccgaggttgtccacgaactgacctccactgagccaggagacatagtaactcagggtgttagttgggccgctgtggcagaaagggtaggcaccagaagtgaaaagcaatgccggagcaagtggctgaattatttgaactggaaacaatccgggggtaccgaatggaccaaagaagacgagattaatttaatactaaggatcgctgagctcgatgttgcagatgagaatgatatcaactgggaccttctggcagaaggatggagcagcgttagatctccccagtggctccggagcaagtggtggaccataaaacgccagattgcgaatcataaggacgtgtccttccccgtgcttatcaagggtctgaagcagctacatgaaaaccagaagaacaacccaactctactggagaacaaatctggatctggcgtgcccaatagtaatactaatagctcagtacagcacgttcagattcgtgtggcacgactggaagataataccgctatctcgtcctcccccatggccgctctgcagatccccgtacaaattacacacgtgtcttccgccgatagccccgctaccgttgattctgaaaccataactcttaactctggaactctccagacattcgaaatcttaccctcttttcacctccaacccaccggcaccccgggtacctatttgctgcaaacctccagctcccaggggctgccattgacgctgaccgcatctccaactgtcacccttaccgcggctgcgcctgccagccccgagcagattatcgtccatgcactgtcgcctgagcacttgctaaatacatcagataacgtgacagtccagtgccacacacctcgggtgatcattcaaacagtggctaccgaagacataacttcgagtatctcacaggccgaactaacggttgactctgatatccagagtagcgacttccctgaaccacctgacgcactcgaagctgataccttcccagatgagattcatcaccccaagatgactgtggagccgtccttcaacgatgcacacgttagcaagtttagtgaccagaattctactgaactcatgaatagcgtgatggtgagaactgaagaagagatctctgatacagacctgaagcaggaagagagcccatcagatctcgcttcggcctacgtgacagagggattggagagccctactatcgaagaacaagtagatcagacaatcgatgatgagaccatcctgatagtgcctagtccacacggattcattcaggcctccgatgtcatcgacacagagtcggtgctcccacttacaaccctaactgatcccattcttcaacaccatcaagaggaatccaacatcattggctcttctctgggaagtcctgtctccgaagatagcaaagacgtagaagatctggtgaattgccactag

SEQ ID NO: 28183 - DNA, 291 bp, Artificial Sequence
  Description of Artificial Sequence: Synthetic coding sequence
atgagcaccgttgaggaggatagcgacacagtcaccgtggagacagtcaactctgtcaccctgacccaggacacggaaggtaacctcattctgcattgtcctcaaaacgaggcggatgaaatagacagtgaggattccattgagcccccacacaaacgcttgtgcctgtcatccgaggatgatcagagtattgatgattctacaccctgcataagcgtggtggccctcccgttgtcagagaacgaccagagtttcgaggtgaccatgaccgccaccactgaggttgcgtag

SEQ ID NO: 28184 - DNA, 171 bp, Artificial Sequence
  Description of Artificial Sequence: Synthetic coding sequence
atgagcaccgttgaagaagattctgatactgtgacggtggagaccgtaaactcagttacactgacgcaggatactgaagggaaccttattttacactgccctcagaacgaagcagatgagatcgatagcgaggactccatcgagccacctcacaaacgcctttgcttatag

SEQ ID NO: 28185 - DNA, 858 bp, Artificial Sequence
  Description of Artificial Sequence: Synthetic coding sequence
atgtctaccgtggaggaggacagcgataccgtgacagtggagacagtgaacagcgtcaccctgactcaggatactgaaggcaacctgatccttcattgcccccaaaacgaggccgatgaaatcgatagcgaagatagcattgagccaccccataagagactttgcctgtcctcagaagacgaccaaagcattgacgacagcaccccctgtattagcgtggtcgctttgcccctcagcgagaatgatcaatcttttgaggtcaccatgacagcaacgaccgaagtggcagatgacgaggttaccgagggaactgtgacccagatacaaattctgcagaacgaacaactcgacgagatctccccactaggaaacgaagaagtaagtgctgtgtcccaggcgtggtttacaacaaaggaggacaaagactccctaacaaacaaaggacataaatggaaacagggcatgtggtctaaggaggagatcgatatcttgatgaacaacatcgagcgatacctgaaggctcggggaataaaggacgcaaccgaaatcatcttcgagatgagtaaggacgagcgcaaggatttctatcgcacaatcgcttgggggctgaaccgtccgttgtttgccgtctatcgtcgcgtgcttcgcatgtacgacgacaggaaccatgttggcaaatatacgcctgaagagatagaaaagctgaaggaaaagaaggcgattgctgcatgcttcttcttcactcaccgacagctgtggaccccgaagaagggacacacattcaagttatggctgagcaaatactgctgcccccaattgccaaaccaatctaacggcaagaagaagaacgaggagtag

SEQ ID NO: 28186 - DNA, 150 bp, Artificial Sequence
  Description of Artificial Sequence: Synthetic coding sequence
atgagtaccgttgaagaggactcagacactgttacggtagagacagtgaacagcgtgacattgactcaggacaccgaggggaacttgatcctgcactgcccccaaaatgaagctgacgagattgactccgaggactccattgagccatag

SEQ ID NO: 28187 - DNA, 330 bp, Artificial Sequence
  Description of Artificial Sequence: Synthetic coding sequence
atgtctactgtcgaggaggatagcgatactgtcacagtggagaccgtgaatagtgtaaccctgactcaggataccgaaggtaatctgatcctgcattgtcctcaaaacgaagccgacgagatcgattcagaggacagcattgagcctcctcacaagagactttgtctatcatctgaagacgatcaaagtattgatgactctaccccttgcattagtgtggtagctctccccctttcagagaacgaccagtcatttgaagtcaccatgaccgctaccactgaagtggccgacgatgaagtcacagagggtacagtgacccagatccagtag

SEQ ID NO: 28188 - DNA, 276 bp, Artificial Sequence
  Description of Artificial Sequence: Synthetic coding sequence
atgtccactgtcgaggaggactccgacaccgttactgtggaaaccgtaaattccgtcacgctaacccaggatactgagggtaacttgatactccactgcccccagaatgaggcagacgagatcgattctgaggactccattgagcctccacacaaaagattgtgcctaagcagtgaagatgaccagtccatcgatgatagtaccccatgcattagcgtcgtcgccttacccctttctgagaatgaccaatcttttgaagtgaccatgactgcttag

SEQ ID NO: 28189 - DNA, 1647 bp, Artificial Sequence
  Description of Artificial Sequence: Synthetic coding sequence
atggcaaccggagctaacgccacacctctcgattttccctccaagaagaggaaaaggtctcggtggaaccaggacactatggaacagaagaccgtgatacccggtatgcccaccgtgattccacccggactgaccagagagcaagagagggcctacatcgtacagctgcagattgaagacttgactagaaaattgcgaacgggcgatctcggaatcccacctaaccctgaagatcgctcgccatctccggaaccaatctataattccgaaggcaagagactgaacacacgcgaattccgtacaagaaaaaaattagaggaagagcgtcacaacctcattacagaaatggtggcactgaatccagattttaaaccaccagccgactataagccccctgctacaagggtctccgataaagtgatgatcccacaggacgagtatccagaaatcaactttgtggggctgttaatcggcccacggggaaatacccttaagaacatcgagaaagaatgcaacgcgaagattatgatcagaggtaaaggatccgtgaaggaggggaaggttgggagaaaagatgggcagatgctcccgggtgaggacgagccactgcatgccctcgttactgcaaataccatggaaaatgtgaaaaaagcggttgagcaaattagaaatatcctgaagcagggtatagagactcccgaagatcagaatgacttacgtaagatgcaactccgggaattggctcgattgaacggcaccctgagagaggatgacaatcgcatcctgcggccttggcagagctccgagacaaggtccatcactaacacaacagtgtgcacaaaatgcggtggcgctggccacatcgcttccgactgtaaattccagcgaccaggtgatccccaaagtgctcaggataaggctaggatggacaaggaatacctctcgctgatggccgagctcggcgaagcccctgtgcccgcttccgtaggaagcacctccgggccagcaactaccccactggccagcgctccccgtccagccgcacctgccaacaacccaccacccccttcgctgatgagcacgacccagtccaggcccccatggatgaattctggcccatcagagtctcggccttaccatggaatgcacggcggaggtccgggtggtccaggcggaggtccccattccttcccccatcccctgcccagtctgactgggggacatggcggacacccaatgcaacataatccaaatggacctccccctccttggatgcaaccaccacctcctccaatgaaccagggccctcatcctccaggtcaccacggaccacccccaatggaccagtacctcggaagcacaccagtgggatccggggtttatcggctgcatcagggcaagggcatgatgccccctccacctatgggcatgatgcctcccccaccccctcccccttctggccagccaccgcctcccccttctggtcccctgcccccttggcaacagcagcagcagcagcctccccctccgccacctcccagctctagcatggcttcctcaacacccctgccttggcaacaaagatcactcccagccgcagccatggcacgtgccatgcgtgtgaggacctttagggcccattggtag

SEQ ID NO: 28190 - DNA, 486 bp, Artificial Sequence
  Description of Artificial Sequence: Synthetic coding sequence
atggagcaccaactgctatgctgtgaggtggagaccatacggagggcctacccggacgcaaatctgctgaacgatagggtgctgcgcgctatgctgaaagcagaggagacttgcgcacctagcgtaagctattttaagtgcgtacagactttcgtggcgctgtgcgccactgatgtcaagttcatctctaatcccccatctatggtggctgccggatcagtggtggccgctgtccagggcttgaacctgcggtctcctaacaatttcctgagctattaccgcctgacaaggttcctctccagagtgataaaatgcgatccagactgtttgcgcgcttgccaggagcaaatcgaagccctcctggaatcttcactgagacaggctcaacagaacatggatcccaaagctgcagaggaagaagaggaggaagaagaggaagtagacttagcgtgtacccctacggacgttcgcgatgtagacatctag

SEQ ID NO: 28191 - DNA, 870 bp, Artificial Sequence
  Description of Artificial Sequence: Synthetic coding sequence
atggaactgttgtgtcacgaggtggatcctgtgagaagagcagtccgcgatcgaaacctgcttagggacgaccgcgtcctgcagaatttgctgacgattgaggaacgatatcttccgcaatgcagctactttaagtgcgtgcagaaggatattcagccttacatgaggaggatggtggccacctggatgctcgaggtgtgcgaagaacagaaatgcgaagaagaggtgtttcctttagccatgaactacctagaccgttttttggctggggtcccaacccccaaatctcacctgcagttgctgggggcagtctgcatgtttctggcgtcgaagttgaaagaaacttcccccttgaccgccgagaaactgtgtatctacaccgacaactccattaagccgcaagagctgctggagtgggaattggtcgtgctgggcaagctgaagtggaatctcgccgcagtgaccccacatgattttatcgagcatatcttgcgaaaactgccacagcaaagggagaagctgtcgctcatccgaaagcacgcccagactttcatcgcattgtgcgcaaccgacttcaaattcgccatgtaccctccttccatgatcgcgaccgggagtgtgggggcagccatttgcggtctacagcaggacgaagaggtttcctctttgacctgcgatgctctgacggagctgctggccaagattaccaataccgatgtggactgcctgaaggcttgtcaagaacagatcgaagccgtgctgctgaactctctgcagcaatacaggcaagatcagcgcgacgggtcgaagtcagaggacgaactcgaccaggcgagcacacccaccgatgtgcgggatatcgacctgtag

SEQ ID NO: 28192 - DNA, 729 bp, Artificial Sequence
  Description of Artificial Sequence: Synthetic coding sequence
atgaagtccgctggaggttcgggcagatctttgctcccatcacctcgcgtgtgtgaggagcagcgatgcgaggaggaagtttttcccctggccatgaattacctagatagatatctctcttgtgtgcctaccaggaaggcccaactgcaactgttaggagcggtgtgtatgctcttggcctccaagctgcgggagactacgcccctaacaatcgaaaagctgtgtatctatacagaccacgcagtcagcccccgacagctgcgagattgggaagttctggttcttggtaaactgaagtgggatctcgcagccgtcatagcccacgatttcctggctttcatattgcacagactcagcctcccgagggacaggcaggcactggtgaaaaagcacgcccagactttcctggccctttgcgcaactgactatactttcgccatgtaccccccttcaatgattgctacggggagcatcggtgcagctgtacagggcctgggagcatgttctatgtcaggtgatgagctcaccgaactgctcgccggtatcacaggcactgaagttgattgcctcagggcgtgccaagagcaaatcgaagctgcccttcgggagtcgctgagggaggcttcacaaacctcctctagcccggctcctaaagctccgagaggcagctcaagccaagggccaagtcagacatcaactcccactgacgttaccgctattcacttatag

SEQ ID NO: 28193 - DNA, 636 bp, Artificial Sequence
  Description of Artificial Sequence: Synthetic coding sequence
atgaactatctggataggtacctgtcatgtgtaccgacacgcaaggctcagcttcagcttctaggggctgtctgtatgcttttagcctctaagctgcgcgaaacaacccccttaactattgaaaaactgtgtatttataccgaccacgcagtgtcacctaggcagctccgagactgggaagttctcgtcttagggaaactcaagtgggacctcgccgcagtcatcgcccacgattttctggctttcattctgcaccgcctatcgctgcccagggataggcaggctctggtgaagaagcacgcacagacctttctggccctttgtgctaccgactacacgtttgccatgtaccctccttctatgattgccacaggatcaatcggggctgccgtacagggcctgggcgcttgcagcatgtcaggtgacgagctgacggagctgttggccggtataactgggacagaagtggactgcctgcgcgcttgtcaggaacagattgaggccgctttgagggagtccctgcgggaggcaagccaaacctcgtcctctcccgctcctaaagcccctagaggaagttctagccaaggaccatctcaaacgagcaccccaacggatgtgaccgccatccatctctag

SEQ ID NO: 28194 - DNA, 879 bp, Artificial Sequence
  Description of Artificial Sequence: Synthetic coding sequence
atggaactactgtgctgtgaaggtactaggcacgcccctagggccggacctgaccctagattgctgggagaccagcgcgtcctgcagagtctgctaagactagaggagcggtatgtccccagagcttcttacttccaatgcgtgcagagggaaattaagcctcacatgcggaagatgttagcctactggatgctagaggtatgcgaagaacagcgatgtgaggaagaagtattccctctcgccatgaactacctggaccgatacctgagctgcgttcctacgcgcaaggcccagctccagttgctgggcgcagtgtgcatgctgctggcctcaaagctgcgggagactacacctctgacaatcgagaagctttgtatatataccgatcacgccgtcagtcccagacagttaagggactgggaggtcctcgtgcttgggaaactgaaatgggatcttgccgctgttattgcccacgacttcctggcctttattctccatagactgtccctcccccgagacagacaagccttggtgaagaagcatgcacaaacattcttagcactttgcgcgacagattacacctttgctatgtaccccccatcaatgatcgccacgggtagtatcggagcagcggtgcagggattgggtgcctgctccatgtcaggagatgaacttaccgagttgttggccggaatcacagggaccgaggtagactgtctgcgggcttgccaagaacaaattgaggctgcactgagagagagccttcgcgaggcctcccagacctcatctagcccggcacccaaagcaccaaggggctcttcaagccagggaccgtctcagacatccactcccactgatgtgaccgcaatccatttgtag

SEQ ID NO: 28195 - DNA, 663 bp, Artificial Sequence
  Description of Artificial Sequence: Synthetic coding sequence
atggaactcttgtgttgcgagggaacccggcacgcccctcgcgcaggccctgatcccagactgctcggggaccaaagagtgttgcagagtcttctcaggctggaagaaaggtacgttccaagggcctcatattttcaatgcgtccagcgggagatcaagccacatatgcgtaagatgttggcttattggatgttagaagattgggaggtcctcgttctgggaaagctgaaatgggatctggccgctgtgattgcacatgacttccttgccttcattctccacagacttagtctgcctagggatagacaggcactggtgaaaaagcatgcgcagacctttttggccctctgtgccaccgattacacattcgcaatgtatcctccctctatgatagcaaccgggtcaatcggggctgccgtccaggggctgggtgcgtgctccatgtccggcgatgaattgacggaattgctggcgggtatcacaggcactgaggtggactgcctgcgagcctgccaggagcagattgaggccgctctgagggagtccctccgtgaagcaagccaaacgagttcctcccctgctcctaaggcacctaggggctcctcgagccagggtccttcacagacaagcactccgacagacgtaacggccatccacttatag

SEQ ID NO: 28196 - DNA, 291 bp, Artificial Sequence
  Description of Artificial Sequence: Synthetic coding sequence
atgtaccctcccagtatgatcgctactgggtcaattggcgcagccgtgcaagggctcggagcatgctctatgagcggcgatgaactgactgaactgctggctggtattacaggaactgaggtggactgtctgagggcatgccaggaacagattgaggccgcacttcgagagagcctccgggaggcctcccagacctccagtagcccagctcccaaggcgccacgcggaagtagcagtcaagggccatctcagaccagcacgccaacagatgtcacggctatccatctgtag

SEQ ID NO: 28197 - DNA, 132 bp, Artificial Sequence
  Description of Artificial Sequence: Synthetic coding sequence
atgaattatctggatcgatacttatcgtgcgtccccacacgcaaagcccagcttcagctgctgggggcagtatgcatgctgctggcctcgaaattgcgcgaaaccacccccctgacgatcgaaaagttgtag

SEQ ID NO: 28198 - DNA, 357 bp, Artificial Sequence
  Description of Artificial Sequence: Synthetic coding sequence
atgaactaccttgacagatacctctcatgcgttccaaccagaaaggcacagttgcagctgttgggggctgtctgtatgctcctcgcctccaaactgagggaaacaacccctctgaccattgagaagctgtgtatctacactgaccatgctgtatcccccagacagcttagagactgggaggtgctcgtgcttggtaagctcaagtgggatctcgctgctgtcatcgctcatgatttcttagcttttatcctgcacagactgtccctccctcgggaccgccaggcgctggtaaagaagcacgcacagaccttcctggcgctgtgtgctactgattatacttttgccatgtacccatag

SEQ ID NO: 28199 - DNA, 33 bp, Artificial Sequence
  Description of Artificial Sequence: Synthetic coding sequence
atgtaccccccttccatgattgcaaccggctag

SEQ ID NO: 28200 - DNA, 636 bp, Artificial Sequence
  Description of Artificial Sequence: Synthetic coding sequence
atgaactatctggataggtacttgagctgtgtgcctacacgcaaggcgcaactgcagctacttggagccgtgtgtatgctgctggcaagcaagctcagggaaaccacgcctcttacaatcgaaaagctctgcatatatactgatcatgcggtttcccccaggcagctgagagattgggaagttctggttctgggaaagcttaaatgggacttggccgctgtcatagcccatgacttcctggcattcatactgcaccgcctttctctaccgagggacaggcaggcattagtaaagaagcacgcacaaacctttctcgctttatgcgctactgactacacatttgctatgtatccacctagtatgatcgccacagggtctataggggctgctgtgcagggtctcggtgcgtgctctatgtctggagatgagttgaccgagctgctggctggcatcacggggaccgaggtagattgtctccgtgcttgccaggagcagatcgaggcggctctgcgggaatcactacgcgaggcctcccagacatcctccagcccagcaccaaaggctccgaggggctcgtccagccagggacccagtcaaactagcacacctaccgatgtgaccgctattcacttgtag

SEQ ID NO: 28201 - DNA, 1233 bp, Artificial Sequence
  Description of Artificial Sequence: Synthetic coding sequence
atgccaagagagcggcgagaaagggatgctaaagagcgggacacaatgaaagaagacggtggagccgaattttctgcaaggagccgcaagcgcaaggccaacgttaccgtcttcctgcaagaccccgacgaggaaatggccaagatcgaccgaactgctagagatcaatgcggctcgcaaccatgggacaacaatgcggtgtgtgcagacccctgttctctgattcccactcctgataaggaggatgatgaccgggtgtaccctaacagtacttgcaaaccgcgaatcattgccccaagcagaggttccccactgcctgtgctctcatgggccaacagggaagaagtttggaagatcatgctgaacaaagagaagacctaccttcgagaccagcattttttggaacaacacccgctactgcagccgaaaatgagggcaatcctcttggattggttgatggaagtgtgcgaagtgtataaactgcacagagagacattttacctggcccaggatttctttgaccggtacatggccacacaagagaacgtcgttaagaccttgctgcaactgattggtattagcagcctatttatcgctgccaagttagaggaaatctaccctccgaaattacatcagttcgcttacgtcacagacggcgcatgctctggagatgaaatcctgacaatggagcttatgattatgaaggctctgaagtggcggctgtcgccacttactatcgtgtcatggctgaatgtttatatgcaggtggcttacttaaatgacctgcacgaggtcttgctgccccagtatcctcagcagattttcatacagatagcagagcttctcgatctctgtgtactcgacgtggactgcctggaattcccatacgggatcctcgctgcttctgcattataccacttctcgagcagcgaactgatgcagaaggtaagtggctaccaatggtgtgatattgaaaactgtgtcaagtggatggtaccattcgctatggtcattagggaaactggaagctctaaactaaaacacttccgcggtgtggccgacgaagatgcacataatatccagacccaccgagattcactggatctgctggacaaggctagagccaaaaaggccatgctttcagaacagaatcgcgcatcccccctaccgtcaggactgttaacaccaccccagtcaggtaagaagcagtcttcgggacccgagatggcttag

SEQ ID NO: 28202 - DNA, 1104 bp, Artificial Sequence
  Description of Artificial Sequence: Synthetic coding sequence
atgcccagggagcgaagagaacgagacgccaaggagcgtgatacaatgaaggaagacggaggtgccgaattcagtgcccgatcacgaaagcgtaaggctaacgtaaccgtcttcctgcaagaccccgacgaagagatggcaaagatcgatcggacagcccgagaccaatgcggctcgcagccctgggacaacaatgccgtttgtgccgatccttgtagcttaattccgactccagacaaagaagatgatgatcgagtttatcctaattccacttgcaagccgaggatcatcgcccctagccggggaagtccactgcccgttttgagttgggcaaatcgggaggaggtctggaagattatgttaaataaggagaaaacgtaccttcgggaccagcactttcttgagcagcacccactgctgcagccaaaaatgagagcaattctactcgactggctgatggaggtgtccttgtctttacccgagatctaccctcctaagctccaccaatttgcttacgtgacagatggagcgtgctccggcgacgaaattctgaccatggagttgatgatcatgaaagctctcaaatggagactgagtcccctcacaatcgtgtcatggctcaatgtgtacatgcaggtagcctatctgaatgacttacacgaggtgctgctgccacagtacccacaacagatattcattcagattgcagagctcctcgatctctgcgttctggatgtggattgtctcgaatttccgtacggcattttggccgcttcagctctctaccatttctcttcatctgagttaatgcagaaggtgagcggctaccaatggtgcgatatagagaactgcgtgaagtggatggtgcccttcgctatggtgataagggaaacaggaagttccaagctcaagcattttaggggagtcgccgacgaagacgcccataatattcaaacacatcgagactccctcgaccttttagacaaggcacgcgctaaaaaggccatgttatccgaacagaaccgagcaagtcctctcccttcaggactgttaactcctcctcagtcaggtaagaagcagtcaagtggtccagagatggcatag

SEQ ID NO: 28203 - DNA, 1188 bp, Artificial Sequence
  Description of Artificial Sequence: Synthetic coding sequence
atgaaagaggacggcggtgcagaattctccgcaaggtccagaaaaagaaaagccaacgtcaccgtattcctgcaggaccccgacgaggagatggcaaaaatagaccggactgctagggatcagtgtggcagccagccttgggataacaacgctgtgtgtgccgacccctgctcactcattcccacacctgacaaagaggatgatgacagagtgtaccctaacagcacttgtaaaccccgaattatagcccctagtaggggtagccccctgccggtcctatcctgggcaaatagggaggaagtttggaaaatcatgctcaataaggaaaaaacctacttacgggatcagcatttcttagagcaacatcccctcttgcaaccaaagatgcgagccattttgctagattggctcatggaagtgtgcgaggtttataagctgcatagagagaccttttacctggcccaggatttcttcgatcggtacatggcgacgcaggaaaatgttgtgaagactttactgcaactcattggtataagttccctattcatcgccgcaaagttagaggagatatacccgccaaagttgcaccaatttgcctatgtgacggatggagcctgctctggtgacgaaatcctcaccatggagctgatgatcatgaaggctttaaagtggaggctgtccccactcactatcgtgtcctggcttaacgtttacatgcaagtggcgtatctgaatgatctgcatgaagttttacttccccagtatcctcagcagattttcattcagatagccgagctcctggacctctgtgtcttggatgtggattgcctcgaatttccttacggaattctggcagcttctgcattataccacttttccagctctgagctgatgcaaaaggtgagcggctatcagtggtgcgacattgagaactgtgtgaaatggatggtcccttttgcaatggtgattcgggagaccggaagttccaaactgaagcactttcgcggtgtggccgacgaagatgcccacaatatacaaacgcaccgcgactctctggacctgttggacaaggccagagcaaaaaaagctatgttgagcgagcagaaccgcgcttcaccactcccttccggtttgctgacacccccacagtctggaaagaaacagagctctggtccagagatggcctag

SEQ ID NO: 28204 - DNA, 2106 bp, Artificial Sequence
  Description of Artificial Sequence: Synthetic coding sequence
aggacttcatggccatccgaactcgccgctgaaaagggtaatttcgaagctgcagttaaactgggcattgcatatctgtacaacgagggcctcagcgtctctgatgaggcacgggcagaggtgaatggtctgaaagcatcccgtttcttctccctggcggagcgacttaatgtgggcgctgctcctttcatctggctcttcatcagacccccatggtcagtttccggctcttgctgtaaagcagtggtacacgaaagtcttagggctgaatgtcaattgcagcggacccacaaggctagcatactgcattgcctcgggcgagtgctgtccctgtttgaggatgaagaaaaacagcagcaggcccacgacttgtttgaggaggcggctcatcagggatgtctgacttcatcctaccttttgtgggaaagtgatcggaggactgatgtgtctgaccccggacgatgtctgcatagcttccgcaagctgcgagactacgctgctaagggctgttgggaagcccaactgtccctcgccaaggcctgcgccaatgcgaatcaattgggcctcgaagtgcgtgcctctagtgaaattgtgtgtcagctctttcaggcttcacaggcagtttcgaaacagcaggttttttcagtgcagaagggcctgaacgatacaatgagatacattctcattgactggttggttgaagttgctaccatgaaagacttcactagcctgtgtctgcacctcaccgttgagtgcgtggataggtatcttcgacggaggcttgttcctaggtatcgccttcagctgctgggcattgcgtgtatggttatctgtacgaggttcatctccaaggaaatcctcactatcagagaagcagtgtggctcacagataacacttataagtatgaggatctggtcaggatgatgggagaaattgtctcagctttagaggggaaaataagggtccccacagttgtggattataaggaagtcttattaaccctcgtccccgtcgagctgcgtacacagcatctgtgttcttttctttgcgagttgtccctcctgcatacatcactgtcagcatacgcccctgcgagactagcagcagctgctctgctcttagcacggcttacccacggacagacccagccgtggaccacacagctgtgggatcttaccgggtttagttacgaggacctgatcccatgcgtcctcagcttgcacaaaaagtgcttccacgacgacgcacccaaagactataggcaggtgtcactgacagcagttaaacagaggtttgaggataagagatacggggagatttcccaagaagaagtcctgagctacagtcaactgtgtgccgctctgggagtgacacaggactcgcccgaccctccaactttcctgtctactggagaaatacacgcttttctaagcagtcctagcggcaggagaacaaagcgaaagagggagaacagcctacaagaagatcgtggaagttttgtcactaccccgacagcggagctgtcaagccaggaggaaaccctcctcgggagcttcctggactggagtctggactgctgtagcggatacgaaggcgaccaggagtctgaaggcgagaaggaaggagacgtgaccgcgccatccggaatcctggatgtcaccgtggtctatctcaaccctgagcaacattgctgtcaggaatccagcgacgaggaggcctgcccagaagacaagggtccccaagacccacaggcccttgcactggatacacagatccccgctacccctggtcctaagcctctcgtcagaacgtcccgtgagccgggtaaagacgtaacgactagtggctattccagcgtgagcactgccagtccgacatcttcagttgacggaggtctgggggcacttccgcagccgacaagtgttttgtctcttgactcagattcccatacccagccctgtcaccaccaggccaggaagagctgccttcagtgtcgccctccctccccaccagaaagcagtgtgcctcagcaacaggtgaaacggattaacctgtgtatccattctgaggaggaagatatgaacctggggctcgttcgcctgtag

SEQ ID NO: 28205 - DNA, 2361 bp, Artificial Sequence
  Description of Artificial Sequence: Synthetic coding sequence
atgggctcagggggtgtggttcactgccgctgtgctaagtgtttctgctatccgacaaagaggaggatccgtaggcgaccaagaaacttgaccatcctctcattgccggaagatgtgctcttccatatccttaagtggctgtccgtcgaggacattcttgccgtacgggctgttcactcacagctgaaggatctcgtagataatcacgcgtcagtctgggcctgcgcaagttttcaggagttgtggcccagtcccggaaatctaaaattgttcgagcgtgcggcagagaagggcaacttcgaagcggcagtcaagctggggattgcctatctttacaacgaagggctatctgtgtctgatgaggccagggctgaggtgaacggcctgaaggcttcccgattcttctccctggccgaacggctgaacgtcggtgccgctccatttatctggttgttcatcaggccaccttggtccgtctcgggatcatgctgtaaagcagtcgtgcatgaatctctacgggcagagtgccaactgcagaggacgcacaaggcctcaattttacattgccttgggagagtactgtcactgtttgaagacgaagaaaagcagcagcaggcccatgatttgttcgaagaagccgctcaccaggggtgtttaacgtccagttatttactatgggagtccgacagacgaactgatgtctcagaccccggaaggtgcctccacagtttccgtaagctccgtgattacgcagccaagggctgttgggaggcgcaattgtcattggctaaagcctgtgccaatgctaaccagctcgggttggaggttcgggctagcagtgaaattgtttgccagttattccaggcctcccaggcagtgagcaaacagcaggtgttctccgtgcagaaaggcctgaatgatactatgagatatatcttaattgactggctggtggaggtggcaaccatgaaggacttcaccagcctgtgcctgcacctgactgttgagtgcgttgatcggtatctccgaagacgcctggtgcccagatatcgactgcagctactgggcatagcttgtatggtgatctgtacacgctttatctccaaggagatccttaccataagggaggccgtgtggttgaccgataacacgtacaagtacgaagacctggtgcggatgatgggagagatcgtatccgctctggaaggcaagattcgggtgcccaccgtggtagactacaaagaggtgctactgacactcgtgcctgtagaacttcggacccaacatctgtgctccttcttatgtgaactgtctttgcttcacacatctctgtcagcttacgctcccgctagattagccgcagccgcattgctgctggcacggcttacacatggccaaacccagccttggacaactcagctctgggatttaaccgggttctcctacgaggacctgatcccctgtgtactgtccctacataaaaaatgcttccatgacgatgctcctaaggattacagacaggtcagcctgactgccgttaagcaaaggtttgaggataagagatatggcgagatttcacaagaagaagtcttatcctattcccagttgtgtgctgccttgggcgttacacaggatagccctgaccccccaactttcctgtctacaggcgaaattcacgcttttctgagcagcccctccgggaggcgaacaaaaaggaagagagagaactccttgcaggaggaccgtggaagctttgtgaccactccaaccgccgagctgtccagtcaggaagagactttgctgggttcttttctagactggtccttggactgttgctccggctatgagggggatcaggaatctgagggtgaaaaagaaggggacgtaacggctcccagcgggatcctagatgtgaccgttgtatatctaaacccagaacagcactgctgtcaggaatccagcgatgaagaagcttgtccggaggacaagggccctcaggaccctcaagccctggccttggatactcagattcctgcaaccccgggtccaaagcctctggtccggacctcacgggagccgggtaaagatgtgacaacatcaggatattcctccgtgtccaccgcctctcctacaagttcagttgacgggggattgggggctttgccccagcctacctctgtgctgtccctagattctgactcccacacgcagccatgccaccaccaggccaggaaatcatgtctccaatgcagaccaccatcaccaccggaaagcagcgtaccgcagcagcaggttaagcgtatcaacctttgcatccattcagaagaagaagatatgaatttaggcttggtgagactttag

SEQ ID NO: 28206 - DNA, 888 bp, Artificial Sequence
  Description of Artificial Sequence: Synthetic coding sequence
atgattgaggtgcttaccacaactgattcccagaagctgctacatcagcttaatgctctcctcgagcaagaaagccggtgccagcctaaagtgtgtgggctccgcctgattgagagtgcccacgacaatggtcttcgcatgaccgccagactccgggatttcgaggtgaaagacctccttagcttgacccagtttttcggtttcgacactgagacattctccctcgctgttaatctgctggaccgattcctcagtaaaatgaaagtccaaccaaaacacctgggttgcgtaggcttgagttgtttttacctcgctgtcaagagtatcgaagaggagagaaatgttccactggcgacagatctaatccgtatttctcagtacaggttcacggtgtctgacttgatgcgcatggagaagatcgttctggagaaagtttgctggaaggtgaaagccacaaccgcttttcagttcctccaactgtattattctctacttcaggaaaaccttcctcttgagcgcaggaactccataaatttcgaacgacttgaggcccagctaaaagcctgtcattgccgaattattttttccaaagccaaaccctctgtcctggccctgagcataatcgctttggagattcaagcccagaagtgcgtagagctcacagaaggcatcgaatgtttgcagaagcactccaagatcaatggcagggacctgacgttctggcaggaattggtaagcaaatgtctgactgagtacagttctaataagtgttcaaaaccaaatgtgcaaaagctgaagtggatcgtgtctggaagaacagcacgccagctgaagcattcctattaccgcatcactcatctcccaacgattcccgagatggtaccctag

SEQ ID NO: 28207 - DNA, 888 bp, Artificial Sequence
  Description of Artificial Sequence: Synthetic coding sequence
atgatcgaggtactgaccaccactgactctcagaagttgctgcaccaattaaatgcactactagagcaggagagcagatgccaacccaaagtgtgtgggctccgattgattgagtccgcacatgataacggcttgcgaatgaccgctcggttgagggattttgaagttaaagacctgttgtcactaactcagttctttgggtttgacacagagaccttctcactggccgtgaaccttcttgacagatttctctctaagatgaaggtacagccaaaacaccttggatgcgtgggccttagttgcttctatctggccgtgaagtctatcgaggaggagcgcaatgtgcccctagcaacagacctcattcggatctctcagtaccgctttacagtcagcgatctgatgcggatggagaagatcgtgttggaaaaggtgtgttggaaggtgaaggctactactgcgtttcaatttttgcagctgtactactccctgcttcaagagaacctccccttggaacgccgtaacagcattaatttcgaaaggctcgaggctcagctgaaagcatgtcactgtaggatcattttttccaaagccaagcctagtgtcctggcactgtctatcatagcactcgaaattcaggcccagaaatgcgtagaacttaccgaaggaatagagtgcctgcagaagcatagtaagattaatggtagagatctgactttttggcaggagcttgttagcaaatgcttaacagagtacagtagtaataagtgctcaaagcctaatgtgcaaaaacttaaatggatcgtgtccgggcgaactgccagacagttgaaacacagctactatcgcattactcacctccctaccatccctgagatggtcccttag

SEQ ID NO: 28208 - DNA, 411 bp, Artificial Sequence
  Description of Artificial Sequence: Synthetic coding sequence
atgatcgaagtgttgactacaacagatagtcagaagttactacatcaactaaacgcacttcttgaacaagaaagtaggtgtcaaccaaaagtttgcggcctgcgattgatcgagagtgcacatgataacggactccgcatgaccgccagactgcgcgatttcgaggttaaggacttgctatcgctcacccagttttttggatttgacaccgagacatttagtctcgccgtgaacttgctcgatcggtttttgtctaaaatgaaggtccagcccaagcacctgggatgtgtcgggctttcttgtttctacctggcggtgaaaagcattgaggaggagcgcaatgtaccgttagccactgatctcattaggatctcccagtatcggtttaccgtatccgatttaatgcgatag

SEQ ID NO: 28209 - DNA, 411 bp, Artificial Sequence
  Description of Artificial Sequence: Synthetic coding sequence
atgattgaagtgctcactacaaccgattcgcagaaactcctccatcagctcaatgccttgctggaacaggagtcaagatgtcagccaaaagtgtgtggcctccggctgatcgagtcggcgcacgataatggtctgcggatgaccgccagattacgagacttcgaggtcaaggacctgctgagcctcactcaatttttcgggttcgataccgaaacattctcattagcagtgaacctcctggatcgcttcttgagtaaaatgaaggtgcagcctaagcacctggggtgcgtgggcctgtcatgcttttatctcgccgtcaaatcgatcgaagaagagaggaacgtacccctagcaacagacctgatccgcatttcccagtacaggttcaccgtgtccgatttaatgaggtag

SEQ ID NO: 28210 - DNA, 504 bp, Artificial Sequence
  Description of Artificial Sequence: Synthetic coding sequence
atgtctgccaaagatctgatgagaatggaaaaaattgtgctcgaaaaagtgtgttggaaagtcaaagccaccacagcttttcagttccttcaactgtattattctctgcttcaggagaacctgccactggaacggaggaacagtattaattttgagagactcgaggctcagctgaaggcatgccattgccggatcattttctcaaaagcaaaaccctcagttctggctctttccatcatcgctttggaaattcaggcccaaaaatgtgttgagctaaccgaaggaatcgagtgtctccagaagcattccaagatcaacggacgagatctcaccttctggcaggagctggtgagcaaatgtcttacagaatactcaagtaacaagtgctctaaacctaatgttcaaaaacttaagtggattgtgagcggtagaaccgccagacagctcaaacacagctattacaggatcacgcaccttcccacgatccccgagatggttccatag

SEQ ID NO: 28211 - DNA, 348 bp, Artificial Sequence
  Description of Artificial Sequence: Synthetic coding sequence
atgattgaggtgctgacgacaactgattctcagaaactgttacaccaactgaatgcattattggaacaggaatctcgctgccagcccaaggtctgtggtctgagactgatagagtcagctcacgataatggactgcgcatgaccgccaggttgcgggacttcgaggtgaaggaccttttgtcgctgactcagttcttcggctttgacactgaaacgttcagtctggccgttaaccttctggaccgcttcttgtctaagatgaaagtgcagcctaagcatctgggatgtgtcggcctgtcatgtttttacttggccgtgaagtccatcgaagaggaacgaaacgtgtag

SEQ ID NO: 28212 - DNA, 486 bp, Artificial Sequence
  Description of Artificial Sequence: Synthetic coding sequence
atgaggatggagaagatagtgctggagaaagtgtgctggaaagtcaaagccaccacggccttccagtttctccagctgtattacagtctcctccaggagaacctgcctctcgaacggagaaattcgattaactttgagagacttgaagcgcagctgaaggcttgccactgccgaatcattttcagcaaagccaaacctagtgtgctcgctttaagcattattgccctggagattcaggctcagaagtgtgttgaactgaccgagggtatcgagtgcctacagaaacattctaagattaacggcagagatctcacgttttggcaggagctagtgagtaagtgtttgaccgaatactctagtaataagtgttcaaagcctaacgtccagaagttgaagtggattgtttcaggcaggactgcaagacagctcaaacactcatactacagaattactcacttgccaacaatccccgaaatggtgccatag

SEQ ID NO: 28213 - DNA, 486 bp, Artificial Sequence
  Description of Artificial Sequence: Synthetic coding sequence
atgagaatggaaaaaatagtgctcgagaaggtgtgttggaaagtcaaggctaccaccgcttttcagttccttcagctgtactatagcctgctccaggaaaacctgccactcgagcgacgcaactccattaacttcgagcggttagaggctcaattgaaggcgtgtcactgtcggatcatcttctcaaaggcgaaaccctctgtgctagcgctgtcaataattgccttagagatacaggcacagaaatgtgtggaactgactgaaggcatcgaatgccttcagaaacatagcaagatcaatgggagagatctgacattctggcaggaactggtgtccaagtgcctcacagagtattcatccaacaagtgctccaagccaaacgtgcagaaactgaaatggatagtatccggtaggactgctcggcagcttaagcactcctattatcggattactcatctgcctaccatcccggaaatggtcccttag

SEQ ID NO: 28214 - DNA, 105 bp, Artificial Sequence
  Description of Artificial Sequence: Synthetic coding sequence
atgatcgaggtccttactactactgactcgcaaaagttactgcaccagttgaacgctcttctggagcaggagagccgctgtcaacccaagaggcatttcctctag

SEQ ID NO: 28215 - DNA, 1035 bp, Artificial Sequence
  Description of Artificial Sequence: Synthetic coding sequence
atgaaagacctcggtgctgagcatctggccggacacgagggtgtacagctgctaggactgctgaatgtgtatctggagcaggaggagagattccaacccagggagaagggactttccttgattgaggcaactcctgagaatgacaataccctgtgccccggactgcgcaatgcaaaagtggaagatctcagatccctcgccaacttcttcgggagttgcacagagacattcgtcctagccgtgaatatattggacaggtttttagcactcatgaaggtgaagcccaagcatctgagctgtatcggcgtctgttcatttctacttgcggctcgcatcgtggaagaggactgtaatattccctccactcacgacgtaatcaggatctctcagtgtaaatgcacagcttcagatatcaaaagaatggaaaagatcatttccgaaaaacttcattacgaactcgaagccactacagctttaaactttctgcatctgtatcacaccattatcttgtgccatacaagcgagcggaaggagattctaagcctggataaactggaggcgcagctgaaggcatgcaactgccgcttgatcttttccaaagccaagccttcagtcctcgccctttgcctcctcaaccttgaagtggagaccctgaagtctgtcgagctgctagaaatactgctgctggttaagaagcattctaaaatcaacgacaccgaattcttctactggagggaactggtgtccaaatgtttggccgaatactcaagcccagagtgctgtaaaccagacctgaaaaagcttgtgtggatcgtctccaggcgtaccgcacagaacctgcacaattcttattactcagtgcccgagctgcctactatccccgagggaggatgttttgacgagtctgagtctgaagactcttgcgaggatatgagctgcggcgaggagagcctgtccagtagccctccaagcgatcaggaatgcactttcttctttaatttcaaggtcgctcagaccctttgctttccaagctag

SEQ ID NO: 28216 - DNA, 1035 bp, Artificial Sequence
  Description of Artificial Sequence: Synthetic coding sequence
atgaaggaccttggggcagaacacctcgccggacatgaaggagtccagcttctcggcctgctgaacgtatacttggagcaggaagagcgatttcagccaagagagaaaggtctgtccctcatcgaagctacccctgagaatgacaataccctgtgccctgggctcagaaatgctaaagtggaagatttgcggagcttggcaaacttttttggttcatgcacagaaacattcgttctggccgtcaacatcctcgaccgcttcttggcacttatgaaagtcaagcccaagcacttatcctgtataggcgtttgcagtttccttctagctgcacgaattgtggaagaagactgcaatatcccttccacccacgatgtgatacgaatctctcagtgtaagtgtaccgcatcggacatcaaaagaatggagaaaattatcagcgaaaaactccactatgagctcgaggcgacgacagccctgaacttcttgcacttgtaccacactattatactatgccataccagcgagaggaaagagattctttctctggataagttggaggcccaactaaaggcttgcaactgcagactcattttctcaaaagcgaaaccttctgtgttggcgctgtgcctcctcaacctcgaggttgaaacgctgaagtccgtggagctactggagattctactcctggtcaaaaagcatagtaagatcaatgataccgagtttttctactggcgtgagctcgtctcaaaatgcctggctgagtacagtagtcctgagtgctgtaagcctgatttaaagaaactagtgtggattgtaagcaggagaaccgcccagaacctacacaactcctattactccgtgcctgagctgcctaccatacctgaaggtgggtgtttcgatgagtccgaaagtagtgtggctcaggcgggagttcagtggcctgacctgtcaagttttcagcctcctccaacacgcttcaaaagattctcatgtctcagtttgcggtcctcctgggactactcctcttggacctag

SEQ ID NO: 28217 - DNA, 1035 bp, Artificial Sequence
  Description of Artificial Sequence: Synthetic coding sequence
atgaaggatctgggcgcagagcatctggctggccacgagggtgtgcagctactgggcttgcttaacgtttacctggaacaagaggaacgattccaacccagggagaagggcctgtccctgatcgaagccacgccagagaacgataatacactctgccccggactccggaacgccaaggtggaggatttgaggtccctagccaatttttttggctcatgcactgagactttcgttctggctgtgaacatactcgacaggttcttggcactgatgaaagtaaagcctaaacacctgagttgtattggcgtttgctccttcctgctggccgcacgcatcgtagaagaagactgtaacataccctccacccacgacgtcattcggatcagccagtgtaagtgcacagcctccgatatcaagcgcatggaaaaaattatcagtgagaaactccactatgaactcgaagccacaaccgccctcaacttcctgcacctctatcatactatcattctgtgccacacgagtgaaaggaaggaaatcctgtcattggataagctcgaggcacagctaaaagcttgtaactgccggctgatcttcagtaaggcaaagccatccgtcctcgcactctgtctcttgaacctggaggtggaaacgctcaagagtgtggagctcctcgagatccttttgctcgtgaagaagcactccaaaattaacgatacagaatttttctactggagagaattggtctctaaatgcctggcggaatactcaagtccagagtgctgcaaaccagacctgaaaaagctggtgtggatcgtcagtcggaggaccgcacagaatttacacaattcttactactcagtgccagagcttcctactattcccgaaggcggatgtttcgacgaatccgagagtgaagattcttgcgaggacatgagctgcggtgaggaatctctgtcgtcgagccctccttctgaccaggaatgcacgtttttttttaatttcaaggttgcacagaccctttgcttcccctcctag

SEQ ID NO: 28218 - DNA, 1035 bp, Artificial Sequence
  Description of Artificial Sequence: Synthetic coding sequence
atgaaagatttgggggctgaacacctcgctggacatgagggtgtgcagcttctcgggctgcttaatgtgtatctagagcaagaagaaaggttccagcctagagagaaaggactgtcattgatcgaggccacacctgagaacgacaacaccctgtgtccaggactgcgcaacgctaaagtagaggacctgagatcgctggcaaatttcttcggctcatgcactgaaaccttcgttctggctgttaacatcctagatcggtttctcgcgttgatgaaagttaagccaaagcacctctcctgcattggagtttgttccttcctgttggcagctcggattgtggaagaagactgcaacatcccgtccacacacgatgtgattcggattagtcagtgcaagtgcacggcctcagatattaaaaggatggagaaaattatctccgaaaagctgcactatgaattggaagccacaactgccctgaattttctccatctgtatcatacaattatactgtgtcatacttcagagaggaaagagatcctctctttggacaagcttgaagctcagctcaaagcgtgcaactgcagactgatttttagtaaagctaagccctctgtgctcgcgctctgtttgctgaacctggaggtggagacccttaagagtgtggagctgttggagatacttctgttggtaaagaaacattcaaagattaatgatacagaattcttttactggcgtgagctggtgtccaagtgcctggcagaatattcttcaccagagtgctgcaagccagacttgaaaaagcttgtctggatagtctccaggcgtacggctcagaacttgcataactcctactactctgtccccgaacttccaacaatcccagaaggtggatgttttgacgaaagcgagagcgaagactcctgtgaagacatgtcgtgtggcgaggagagcctttcatcatctcctccttcagaccaggagtgcacattcttctttaacttcaaagtggctcagaccctatgcttcccctcgtag

SEQ ID NO: 28219 - DNA, 483 bp, Artificial Sequence
  Description of Artificial Sequence: Synthetic coding sequence
atgaaagatctcggcgcagagcatttggccggacatgagggtgtccagctgctgggcctcctcaatgtgtatttggagcaggaagaaagattccagcctagggagaaaggactcagtctgatcgaagcaacacccgaaaacgacaacaccctatgcccagggctgcggaatgccaaggtcgaagatctacgctcgctggctaatttcttcggctcatgcaccgagacgtttgttctggctgtcaatattctggacaggttcctggcattgatgaaagtgaagcctaagcatttgagctgtatcggtgtgtgttctttcctgttagcagctcgaattgtggaagaggattgtaacatcccctccacccacgacgttatacggatctcgcaatgcaaatgcaccgcctctgacatcaaaagaatggagaagattatctctgaaaagctgcactatgaactagaggccacaacagccttaaactag

SEQ ID NO: 28220 - DNA, 972 bp, Artificial Sequence
  Description of Artificial Sequence: Synthetic coding sequence
atgtatcacaactcctctcagaagaggcactggaccttttctagcgaagaacagctggcgaggttgagagccgatgccaatcgaaaatttaggtgcaaggcggtggccaacgggaaggttttgcccaatgatcccgtttttctggagccacatgaggaaatgactttgtgtaaatactacgagaagaggttgttagaattttgcagcgttttcaaacccgcaatgcctaggtcagtggtgggtaccgcttgcatgtattttaagaggttttacctcaataattctgtgatggaataccatccccgaatcataatgctgacttgcgcatttttagcatgtaaagttgatgagttcaatgtgtcctcacctcagttcgtggggaacctgagggaaagtccactcggccaagaaaaagccctcgaacagattctcgaatacgaactcctcctgatacaacagctgaatttccacctaatcgtgcacaacccatatcgtccttttgaggggtttctgatcgatttgaagacgagataccccattctggagaaccccgaaatacttcgcaaaacagcggacgatttcttgaacaggatcgcactcactgatgcttatctcctttacacaccttcccagattgccctcacagctatccttagcagcgcaagcagggctggcatcacaatggagagttacctttcggaatccctaatgcttaaggagaatcggacctgtctgagccagctgctagacatcatgaaaagtatgcgcaacctggtgaaaaagtatgagcctcccaggagtgaagaggtcgcagttctgaagcagaaattggagagatgccactcagcagaacttgctcttaacgtcattacaaagaaaagaaaagggtacgaggatgatgattatgtctccaagaaatccaaacacgaggaagaggaatggaccgacgacgacttagtggagagcctctag

SEQ ID NO: 28221 - DNA, 768 bp, Artificial Sequence
  Description of Artificial Sequence: Synthetic coding sequence
atgcccagatcggtcgtgggcacagcctgcatgtactttaagcgcttctacttaaataactccgtgatggagtatcacccccgaatcatcatgctgacatgcgcatttcttgcctgtaaggtggatgagtttaacgtgtcctcaccccaatttgtgggtaatctgcgagagagccctttgggacaggagaaagcccttgagcaaatcctcgagtacgaactgctcctaatccagcagcttaattttcacttaatcgtgcacaatccctatcgcccattcgaaggctttcttatagacctgaaaacgcgttaccccattttggagaacccggaaatcctcagaaagactgccgatgactttctaaacagaatagccctgacagatgcctacctgctatacactccgtctcaaatcgccctgacagccatcctgtctagtgccagccgcgcagggattacaatggaatcctacctctccgagagtctcatgctgaaagagaacaggacctgtctatctcaacttctggatataatgaagtctatgcggaacttggtgaaaaagtacgaaccacccaggagcgaagaagttgccgtactcaaacagaagttagagcgctgccactccgcagagctcgcccttaatgtaataaccaagaaaaggaagggatatgaggacgatgattacgtttctaagaagtcaaagcatgaagaggtgtgcttcacacccaaaatgaacagcaagctcttcctgctatacattctggtgtag

SEQ ID NO: 28222 - DNA, 750 bp, Artificial Sequence
  Description of Artificial Sequence: Synthetic coding sequence
atgccacggagcgtcgttggaacggcttgcatgtacttcaagcgtttctacctaaacaactcagtgatggaatatcatccccgaatcatcatgctcacctgcgctttcctggcgtgtaaggttgatgaattcaatgtctcatcaccccagttcgttggcaacctacgcgaatcccctctgggacaggagaaggctctggagcaaatcctcgagtacgaattactcttaatacagcagcttaatttccatctcatcgttcacaatccatatcgtcctttcgaaggattcctcatcgaccttaaaacccggtacccgatactcgagaatcccgagattctcaggaaaacggctgatgatttccttaatcgaattgccctgacggatgcttaccttttgtacacccccagccagattgcactaaccgccatattgagcagcgcctcccgcgctggcataactatggagtcttatctatctgagtctcttatgctgaaggaaaatcgtacatgtctttcccaactgctggatatcatgaaatccatgcgcaatctcgtgaaaaagtacgagccacccaggtctgaggaggtggctgtattgaaacaaaaattagagcggtgccactcagccgaactcgccctgaatgttattaccaagaagcgaaaaggatatgaggatgatgattacgtctctaagaaatctaagcacgaggaggaggaatggaccgatgacgatctggtggagtccctgtag

SEQ ID NO: 28223 - DNA, 1053 bp, Artificial Sequence
  Description of Artificial Sequence: Synthetic coding sequence
atggttaccccatgtcctaccagtccaagttccccagctgcaagagcaggcaggcgggacaatgaccagaacttgagagctccagtcaagaagtctcgcagacctagactccgcagaaaacagcctctccatccactgaatccgtgtcccctcccgggagacagcggcatttgcgatctatttgagtcccctagctctggctctgatggagccgagagcccctccgcagctagggggggttcccccctgcctggaccagctcaaccagtagcccagctggatttacagacatttagggattacggacagtcctgctacgcttttagaaaggcccaggagtcccactttcaccctcgggaagccctggcgagacagccacaggtcaccgctgaaagcaggtgtaagctgctaagctggctcatcccagtgcaccggcagttcgggttgagcttcgaaagcctttgcctgacagttaatacgctcgatcggtttttgacaacgacccctgtggccgcagactgctttcagctcctcggcgtcacttctctgttgattgcctgcaaacaagtggaggtgcatccgcctcgggtgaagcagctgctcgctctgtgttgcggggctttctcaaggcaacagctgtgcaatcttgagtgcattgtcttacacaagctgcatttcacccttggggctccaaccatatcgttttttcttgagcactttacccacgcacgcgtcgaggcgggacaggcagaagcctccgaagctctcgaagctcaggccctcgccagaggggtcgccgaattgtctctcgctgactatgcctttacatcatactcaccaagcctgcttgccatctgttgcttggctcttgcggacagaatgctgagggtttcaaggccagtggacttaagactgggcgaccacccggaagctgccctcgaggattgtatgggaaaactccaactgctggttgccattaattccaccagtctcacccacatgctgcccgtgcagatttgcgaaaaatgcagtctccccccatcctctaaatag

SEQ ID NO: 28224 - DNA, 2181 bp, Artificial Sequence
  Description of Artificial Sequence: Synthetic coding sequence
atggagggagagcgcaaaaataacaataagagatggtactttacccgggaacaactggaaaattcaccaagccgacgattcggcgtagacccagacaaagagcttagctatcggcaacaggccgcaaatctgttacaggatatgggccagcgtttgaacgtttcacagctgacaatcaacaccgccatcgtatacatgcaccggttctacatgattcagtccttcacgcagttcccagggaacagcgtagctcccgcagctctgttcctggcagccaaggttgaggagcagccaaagaagttagagcacgtaatcaaggttgcgcacacctgcttgcacccacaggagtcactcccagataccaggtcagaagcttacctccagcaggtgcaggacctggtgattctcgagtctatcattcttcaaacgttgggctttgaactgaccatcgaccacccccatacacacgttgttaaatgcacacaacttgtacgcgcttccaaagacctggcccagaccagctacttcatggccacgaactctctgcatctcaccacattcagtctgcagtacaccccccctgttgtggcgtgcgtctgcatccatctggcctgcaaatggtcaaattgggagatccccgtgtctacagatgggaagcactggtgggagtacgtggatgcaactgttaccctggaacttcttgatgagttgacgcatgagtttctgcagatcctggaaaagacccccaatagactgaaacggatttggaactggcgcgcatgtgaggcggctaagaaaacaaaggctgatgatcgcggaactgacgaaaaaacctctgaacaaacgatacttaatatgatcagccagagcagctcagacaccaccatagccggactgatgagcatgtcaacttctaccaccagcgctgtgccctccctgcctgtttctgaggagtcgagttccaaccttacaagcgtggaaatgctgccaggtaaaagatggctgtcttctcagccctcttttaagctggagcccacccagggacataggaccagcgagaatctcgcattgaccggggtggaccattctctgccccaggatggttctaatgcattcatcagccagaagcaaaattccaagagtgttccatctgcaaaagtttcactgaaggagtacagagcaaagcacgcggaggaactggcagcacagaaacggcaactggagaatatggaggcaaacgttaagtcccagtacgcctatgctgcccaaaatttgctgtcacaccatgattcacactcgtcggtaattttgaaaatgccgattgagggtagcgagaacccagagagaccttttctggagaaggcagacaagacagctcttaagatgcgaatcccagtagccggaggcgacaaggccgcaagttctaagccggaggaaatcaagatgagaattaaggttcatgccgctgctgacaagcataacagtgtagaggatagcgtgacgaagtctcgagagcacaaggaaaagcataagactcatccgagcaatcaccatcaccatcacaaccaccactcccacaaacattcccactcgcagcttcctgttggaactggcaataagagaccaggtgaccccaagcactccagccagacatcaaacctcgctcataagacgtactctctgagcagttccttttcttcatccagctccactcggaaacgaggcccatccgaggaaaccggcggtgctgtgttcgaccacccagccaagattgctaaaagcactaagtcctcttctctcaatttctcttttccgtcactccccacaatggggcagatgcccggacattcttctgacaccagtggactgtctttctcccagccttcctgcaagaccagggtcccccattcaaagctggataaggggcctactggagccaacggccacaacactacgcagacaattgactatcaggacactgtgaacatgctccactcactgctgtcggcccagggcgttcagccaacgcagccaacagctttcgaattcgtccggccttacagtgactatctcaatcccagaagcggtggcatctcctccagatcaggtaacacggataaacctcggccacctccactcccctctgagccacccccacccttgcctccactgcccaaatag

SEQ ID NO: 28225 - DNA, 723 bp, Artificial Sequence
  Description of Artificial Sequence: Synthetic coding sequence
atggaggactatactaagatagagaaaatcggcgaggggacatacggagtggtttacaagggcaggcataagacaacgggccaggtggttgccatgaagaaaattcgcctggagtccgaggaggaaggagttccatcgaccgctataagggagatttccctgctaaaggagctcaggcaccctaacatcgtgtctctccaagacgttctgatgcaggatagtcgcctgtatcttatctttgaattcttaagtatggacctgaagaaatatctggattctatcccacctggccagtacatggacagtagcctggttaaagtcgtcacactttggtaccggtctcccgaggttttactcggatccgccagatactccacaccggttgatatttggtctattggaaccatattcgctgaactggccactaagaaacctctgttccacggcgactccgagatcgaccagctattccgcattttccgcgctctgggcacaccaaacaatgaggtgtggccagaggtggaaagcctccaggattacaagaatacatttcctaagtggaagcccggtagcctggccagtcacgtgaagaacctcgatgagaacggcctggatctgctgtccaagatgttgatttatgaccccgctaaaagaataagtggcaaaatggccttgaatcatccctacttcaatgatctggacaaccaaatcaaaaaaatgtag

SEQ ID NO: 28226 - DNA, 723 bp, Artificial Sequence
  Description of Artificial Sequence: Synthetic coding sequence
atggaagactatacaaagatcgaaaaaattggagaaggcacatacggtgttgtctataagggcaggcataagaccaccggccaggttgtagcgatgaagaagatacgactcgaatcagaagaggagggagttccctccacagctattcgggagataagcctcctcaaagagctgcggcaccccaacatcgtgtccctacaggatgtcttgatgcaagactcccgcttgtacctcatctttgaattcttaagtatggatctgaagaaatatctcgacagcatcccccctggccagtatatggattcctctctggtgaaggtcgtcactctgtggtacagatcacctgaagtcctgctcggcagtgccagatatagcacgccagtggatatttggtccatcggcaccatattcgcagagttggccactaagaagcccctgttccatggtgacagtgaaatcgaccaactgttccgaatctttcgcgcactgggcacccccaataatgaggtctggccagaagtcgagagtcttcaggattacaagaacactttccctaagtggaaacctgggtccttagctagtcacgtgaagaacttggatgagaacggactggacttgctctccaagatgttgatctatgatcctgcaaagcgaatcagcgggaaaatggcccttaatcacccatatttcaatgacctggacaaccagataaagaaaatgtag

SEQ ID NO: 28227 - DNA, 894 bp, Artificial Sequence
  Description of Artificial Sequence: Synthetic coding sequence
atggaggactataccaaaattgagaagattggggaggggacgtatggagtggtctacaagggtaggcacaaaaccactggccaggtggtagccatgaagaagattcgcttggagagtgaggaggaaggggtcccctctacggccattcgggaaatttcgctcctgaaggagttgagacacccaaatatcgtgtcactacaggatgtactgatgcaggattcccggttgtacttaattttcgagttcctgtctatggacttgaagaagtatctggacagtattcctccaggtcagtacatggactcttccttagtaaagagctatctctaccagatcctgcaggggatcgtattttgccactccaggcgcgttctgcacagagacctgaaaccgcagaatctgctgatcgatgataagggaactataaagttagcagatttcggcctggcaagagcatttgggatccctatacgggtttatactcatgaagtagtgactctgtggtaccgaagccctgaggtgctgctgggatcagccagatacagcacgccagtggatatttggtcaatcggcaccattttcgccgagctggccaccaagaagccgctgttccatggtgacagtgagatcgaccagctctttcgaatctttcgggcacttgggactcctaacaacgaggtgtggcccgaggtggaatccctacaggattataaaaatacgttcccaaaatggaagccgggtagtttagctagccatgtcaagaatctcgacgaaaatggtctcgacctcttgtcaaagatgctgatatacgaccctgcaaagaggatcagcggaaagatggcgctcaatcacccctatttcaacgatctagataatcaaataaagaagatgtag

SEQ ID NO: 28228 - DNA, 894 bp, Artificial Sequence
  Description of Artificial Sequence: Synthetic coding sequence
atggaggattataccaagatcgaaaagattggagaaggcacatacggcgtggtctacaaagggagacataagaccaccggacaagtagtggccatgaagaagattcgtctggaaagtgaggaagagggcgtgccctccactgccatcagagagataagtttattaaaggagctgcgacatccaaatattgtctctcttcaggatgtgctcatgcaggacagtcgcctgtacctgatcttcgagttcctctctatggacctcaagaaatacctggactccatcccccctggccagtatatggatagttccctggtgaagagctacctgtatcagattcttcaaggcatcgtgttctgccattcccgcagagtcctgcaccgagacttgaaaccacagaacttgttaattgatgacaaaggcacgataaaattagctgacttcggcttggctcgggcttttggaatacctatccgcgtttatacacacgaggcaattacactgtggtatcgatctcctgaagtgctactgggctctgctagatacagcacccctgttgacatctggagcataggcaccatttttgccgagctggcgaccaaaaaacctctgttccacggcgatagcgagatcgaccagttatttcggatctttagggcactgggaaccccaaataatgaagtctggcccgaagtcgaaagtcttcaggactataaaaacaccttccccaaatggaaacccggatctttggcaagtcacgtgaagaaccttgacgagaatgggttggatctgctatctaaaatgctgatatacgatccagccaaaagaattagcggaaaaatggctcttaaccatccttacttcaacgatttggacaatcagattaagaagatgtag

SEQ ID NO: 28229 - DNA, 570 bp, Artificial Sequence
  Description of Artificial Sequence: Synthetic coding sequence
atggaagattacaccaaaatcgaaaagattggtgagggcacttacggcgtggtgtacaagggccgacataagacaactgggcaggtggtcgccatgaaaaagatccgacttgagagcgaagaagagggagtgccttctactgcgattcgggaaatctccctgctgaaagagttgcgccaccctaacattgtgtccctgcaggacgtactgatgcaggactcacggctatatctgattttcgaatttttatccatggatctgaaaaagtaccttgactccatcccaccaggccagtacatggatagcagcctcgtgaaaagttacctctaccaaatcttgcagggtatagtattctgtcattcccggagagtcctgcacagagatcttaagccacagaacttgctgatcgacgataaaggtaccatcaaactagcagacttcggtctcgcaagagctttcgggatccctatcagagtttatacacacgaggcgattaccctttggtaccggtctcccgaggtgctccttggcagcgctcgctactcaaccccagtcgatatctggtcgtag

SEQ ID NO: 28230 - DNA, 897 bp, Artificial Sequence
  Description of Artificial Sequence: Synthetic coding sequence
atggaaaattttcagaaggtggaaaaaatcggagaagggacctacggtgtggtgtacaaggcaagaaacaaactgactggcgaagtggtagcactcaaaaaaattcgtcttgacaccgaaacagaaggagttcccagtaccgccattcgagaaatctccctgctcaaggagctgaatcaccctaacatcgtgaagctgttagatgtcattcacacagagaataaattatatctcgtgttcgaattcctacaccaggatctgaagaagtttatggacgcaagcgctttgacagggattcccctgcctctcatcaagtcatatctgttccagctgcttcaggggttagctttctgccacagccatagagtgctccatcgcgatctaaagccacagaatcttcttataaacacagaaggcgctatcaagttggctgatttcgggctggccagggcctttggagtgccggtgcggacctatacccatgaagtagtaaccctgtggtatagggcccctgagatactgttgggttgtaaatattattccactgcggttgatatctggagcctggggtgcatcttcgctgagatggtcacacgccgagcgctgttcccaggggattcggagatcgatcaactgtttagaatcttccgcaccctgggtacgcctgacgaggtagtatggcctggggtcacttccatgcctgattacaaaccctcattcccgaagtgggctcggcaggacttttccaaagttgtaccaccactggacgaagatggtaggagcctactgagccaaatgttacattacgaccctaacaaacggatatcagcgaaggccgcactcgcccatcccttcttccaggatgtaacgaaacccgtgcctcatttgaggctgtag

SEQ ID NO: 28231 - DNA, 795 bp, Artificial Sequence
  Description of Artificial Sequence: Synthetic coding sequence
atggaaaatttccaaaaggtggaaaaaatcggagaggggacctacggggtggtgtacaaagcacgcaacaagttgactggcgaagtcgtggcattgaagaaaattcggcttgacactgaaacggaaggcgttccttccaccgccatcagagagatcagtctgcttaaagaactcaaccatccaaatattgtgaagcttctcgatgtcatacacacggagaataagctatacctggtgttcgagtttttgcaccaggatctcaaaaaattcatggacgcctcagcattgactggcatccccctgccactcatcaaatcttacctgttccaactgctgcaaggtctggccttttgtcattcccatcgcgtgctccaccgagacctgaagccccagaatttactgataaatacggagggcgctattaagctggctgacttcggtctcgccagggcttttggagtgcctgtcagaacctacacgcatgaggtaacaaggcgggcactcttccccggagacagcgagattgatcagctgttcagaatctttagaactcttgggacacccgacgaagtggtgtggcccggagtcacatctatgcctgactacaaaccatctttcccaaaatgggccagacaggacttttctaaagtggtgccacctctcgatgaggacgggagatccctgttgtcacagatgttgcattacgatcctaacaagcgtatcagcgctaaggctgctctggcacatccttttttccaagatgttacaaaacccgtgccccatctgcggctgtag

SEQ ID NO: 28232 - DNA, 348 bp, Artificial Sequence
  Description of Artificial Sequence: Synthetic coding sequence
atgtcatacaagccgaacttggctgctcatatgcctgcagctgcactgaacgcagctggatccgtgcatagcccttccactagcatggccactagtagtcagtaccgccagctcctcagcgactatggcccaccaagcttaggctacacccagggaaccggcaactctcaggttccacagtccaagtatgcagaacttctcgccattattgaggaactggggaaggaaattcgccctacatacgccggatcaaagagtgctatggaacgcctcaagcggggtataatccacgccagaggactcgtgcgggagtgccttgccgaaaccgaaaggaatgccagatcctag

SEQ ID NO: 28233 - DNA, 912 bp, Artificial Sequence
  Description of Artificial Sequence: Synthetic coding sequence
atggcgacatcccggtacgagccggtcgctgagatcggcgttggggcatacggtaccgtgtacaaggccagagaccctcactccgggcatttcgttgcgctgaaatcagtgagggttccgaatggtggaggcggaggaggcggacttcctatcagcactgtgcgggaagtggccctgctcagacgcttggaagctttcgagcacccgaacgtcgtgagactcatggacgtttgcgcaacatctcgcacagaccgtgagatcaaagtgacactggtgtttgagcacgtggatcaggacctcagaacatacctggacaaagcgccaccaccagggctccctgccgagaccatcaaggatctgatgcgccagtttttgagaggcctggatttcctgcacgcaaactgcatcgtccatcgagacctgaagcccgaaaatattctcgtcacgtccggtggcactgttaagcttgccgatttcggcttggctcgcatatactcctatcagatggcactgacccctgtggttgtcacattatggtaccgtgctccagaggtactattgcagtctacttatgcgactcccgtcgacatgtggtctgtaggttgcattttcgccgagatgttccgccgaaagcccctattctgtggaaactccgaagccgatcaactcgggaaaatcttcgacttgataggcctccccccagaagacgattggcccagggacgtttccctgcccagaggcgcatttcccccaaggggaccccgaccagtgcagagtgtagtgcccgaaatggaagagtccggtgcacagttgcttctagagatgctaacatttaacccccataagcgaataagcgcctttagggccttgcaacacagctatctacacaaggacgaagggaatccagagtag

SEQ ID NO: 28234 - DNA, 336 bp, Artificial Sequence
  Description of Artificial Sequence: Synthetic coding sequence
atggccactagccgctatgaacccgtggcagagataggagtgggggcatatggaacggtttataaagcccgagatcctcattccggacactttgtcgccctcaaaagtgtaagagtgccgaatggaggtgggggaggtggtggattacctatttctactgtccgagaggtagctctgctgcggcgactcgaagcgttcgagcacccgaacgtggtgaggctcatggacgtgtgcgctacgtctaggaccgaccgtgagataaagaggtgcttcgtggaaagcttgtcttcagtggagaccctgaaacctactagttgggctaaaagcctgacctag

SEQ ID NO: 28235 - DNA, 552 bp, Artificial Sequence
  Description of Artificial Sequence: Synthetic coding sequence
atgaggcagtttctgcggggtctggattttttgcacgccaactgcatcgtccaccgggatctcaaaccagaaaatattcttgttacgtccgggggtactgtcaaactcgcagactttgggctagctcgcatatactcctatcagatggcccttacacctgtggtggtgaccctctggtaccgcgcacccgaggtcctgctgcagagcacatatgctaccccagtcgacatgtggagcgtggggtgtattttcgccgaaatgtttaggcgtaagcctttattctgcggaaattccgaagcggatcagctaggcaaaatctttgatcttatcggtctgcccccagaagatgactggccccgagatgtgtcattgcctcgcggagctttccctcctcgtggacctcgaccagtccaaagtgtggtgcctgagatggaagagagtggggctcaattgttgttggagatgctgaccttcaatcctcataagcggatcagtgcgttccgcgcactgcagcactcttacctgcataaagacgaaggcaatcccgagtag

SEQ ID NO: 28236 - DNA, 9 bp, Artificial Sequence
  Description of Artificial Sequence: Synthetic coding sequence
atggcctag

SEQ ID NO: 28237 - DNA, 612 bp, Artificial Sequence
  Description of Artificial Sequence: Synthetic coding sequence
atggccacgtcacgctacgagcccgtggcggaaattggcgtgggcgcttacggtacagtctacaaggccagggatccccatagtggccactttgtagccttgaagagcgtacgagtccctaatggcggaggaggcggaggcggtttgccaatttctactgtgcgcgaagtcgcacttctgagaaggcttgaagccttcgaacatcccaacgtcgtgcggcttatggacgtttgtgccacttctcgtacagacagggaaatcaaagttactctggtgtttgaacacgtggaccaggatttaagaacctatcttgacaaggcacctccacccggtctgccggctgaaactataaaggatcttatgcgccagttcctgcggggtctggatttcttacatgccaactgcattgtccatcgagacttaaagccggagaacatcttggtaacctctggtggaactgtgaagcttgctgatttcggtctggcgcgtatctattcttatcagatggccctgacacctgtggtggttacactgtggtaccgggctccggaagtgctcctgcagagcacctacgctacacctgtagatatgtggtctgtcggatgtatttag

SEQ ID NO: 28238 - DNA, 513 bp, Artificial Sequence
  Description of Artificial Sequence: Synthetic coding sequence
atggcgacgtcccgctacgagcctgtggccgagattggggtgggcgcatatggaacagtctataaagccagagatccccattccgggcacttcgtggcgctcaaaagcgtccgcgtgcccaacgggggtggcggaggcggaggtttgccgatatcaactgtgcgggaggtggcccttctgaggagactggaggcttttgagcatcccaatgtggtccgtctgatggacgtgtgcgcaacctcgcgaacagatcgtgagatcaaagtgacccttgtgttcgagcacgttgatcaggatttgcggacatatctggacaaggctccaccacccggactgccagctgaaaccattaaagatttgatgcgtcagttccttcgaggtctggacttcctgcatgccaattgcatcgtacatcgagatcttaaacctgaaaacatactagttacgtccggcggaacggtgaaattggctgatttcggactcgccagaatctactcatatcaaatggcctag

SEQ ID NO: 28239 - DNA, 348 bp, Artificial Sequence
  Description of Artificial Sequence: Synthetic coding sequence
atggccacatcaaggtatgagccggtggctgagattggcgtgggagcttatggtacagtgtataaggctagagatccacattcaggtcattttgtggccttaaagagcgtccgcgtacccaacgggggaggcggtggagggggactaccaattagcactgtaagagaagtcgcactgctgcgccgactggaggccttcgagcacccgaatgttgtgagactgatggacgtctgcgccacctccaggacagaccgcgaaattaaggttactctggtctttgaacacgtcgatcaggatttgcgcacatacctggacaaggcaccccctcccggactgcctgcggagtag

SEQ ID NO: 28240 - DNA, 924 bp, Artificial Sequence
  Description of Artificial Sequence: Synthetic coding sequence
atgggcacggtactgtctctgagtccaagttaccgcaaggctactctgttcgaagatggcgctgcaaccgttggtcactacactgcagtgcagaactcaaagaacgcaaaggacaagaacctgaaaaggcattctattattagcgtgctgccctggaaacgcatcgttgcagtctcagctaagaaaaaaaactccaagaaggtgcagccaaactcgtcttatcagaacaacatcacccatctcaacaacgagaacttaaaaaagtctctgagctgtgccaacttatccacattcgcgcagccaccccctgcgcagccccctgcaccgcctgcgagtcaattgtctggctcccagaccgggggttcctctagtgtgaaaaaggcaccccaccctgccgttaccagcgccggaaccccaaaaagggtcattgttcaggcatccacttcagagctgctgagatgcctcggtgagtttctgtgtagacgctgttatcggttaaaacacttgtccccgaccgatcctgtgctttggctgcggagcgttgatcggagtttattactgcagggttggcaagaccagggattcatcacgccagcgaatgtcgtgttcctttacatgctgtgcagagatgtaatcagcagtgaagttggcagtgatcatgaactgcaggccgtgctcctgacctgcttgtatctgtcctattcctacatgggcaatgagataagttatcctctgaaacccttcctggtggaaagttgtaaggaagctttttgggaccgatgtttatcagtgattaaccttatgtcgagtaagatgctgcagattaacgctgacccccactacttcacacaggtcttctctgatcttaaaaacgagagtggtcaggaagataaaaagcgcctgctcctgggcctggataggtag

SEQ ID NO: 28241 - DNA, 981 bp, Artificial Sequence
  Description of Artificial Sequence: Synthetic coding sequence
atggagaaggacgggctgtgtcgggcagatcagcagtacgagtgtgtagcagaaattggtgaaggggcttatggtaaggtttttaaggctcgagatctgaagaacggtggacgttttgtcgctctgaagcgagtgcgtgtccagaccggcgaggaagggatgccactaagcacgattcgcgaagtggctgttctgaggcaccttgagacctttgagcatcccaatgtggtcaggttgttcgacgtgtgcaccgttagccgaactgaccgggaaactaagctgactctagtatttgaacacgtcgaccaagatctgaccacatacctggataaggtgcccgagcccggtgtgcccacggaaacaatcaaagacatgatgttccagttgctccgaggcctggatttcctccattctcatagggttgtacacagggacttgaagccgcagaatattctcgtaacgtcctcaggacagattaagctggccgactttggcctagcgagaatctactctttccaaatggccctaacgagcgtggtggtgacactgtggtacagggcccctgaggtcctgcttcagtcctcctatgcaactccggtggacctgtggtctgtgggctgcattttcgcggagatgtttcggcgtaagcccttatttcgcggatcttctgacgttgaccagcttggaaagatcctcgacgtcattgggttgccaggcgaagaggactggccgagagacgtggctttgcctcggcaagcttttcattctaaatctgcccaacccattgaaaaatttgtgacagatatcgacgaattaggtaaggatttgcttctcaagtgcctgacctttaaccccgcaaagcgcatctccgcttactccgcgttatcccatccatactttcaggatctggagcgttgcaaggaaaatctggattctcatctgccgccaagtcaaaacacatctgagctaaatacagcctag

SEQ ID NO: 28242 - DNA, 981 bp, Artificial Sequence
  Description of Artificial Sequence: Synthetic coding sequence
atggaaaaagacggattgtgccgagcagaccagcagtacgagtgcgtggcagagatcggagaaggagcatacgggaaggttttcaaggccagagacttgaagaacggagggagattcgtggcgttaaaaagagtgcgtgttcagacaggagaagaagggatgccattgtctaccatcagggaggttgctgtgttgagacacctggagacgtttgagcacccaaatgtcgtgagactgtttgatgtgtgtaccgtctctcgtactgatagagagaccaaactgactcttgtctttgagcatgtggaccaagatctcactacatacttggataaggttcccgagcctggcgtcccgactgagaccattaaggatatgatgtttcaactactgcggggattggattttttacacagccatagagtagtgcatcgggatctgaagccccagaatatcttggttacctctagtggccagattaaactagccgactttggtctggccaggatatactcattccagatggccctcacctctgtggtggtgactttatggtacagagcaccggaggtcttgttgcagtctagctacgctacccccgtggacctgtggagcgtcggctgtatttttgcagaaatgtttaggcgtaagccactgttccgcggttcctctgacgttgaccagctaggcaaaatactcgatgtgattggtctgccaggagaggaagactggcccagggacgtggctctgcctaggcaggctttccattcaaagagtgctcagcccatagagaaattcgtgactgacatcgacgaactggggaaggatctgctcctgaaatgcctgaccttcaaccctgctaaacgcattagtgcatactccgccctcagccacccatactttcaggatttagagcggtgcaaagaaaacctcgactcacaccttcccccatctcaaaatacatccgagttaaatacggcctag

SEQ ID NO: 28243 - DNA, 1041 bp, Artificial Sequence
  Description of Artificial Sequence: Synthetic coding sequence
atggcgctggatgtgaaatcacgcgctaagagatatgaaaagctcgactttctgggtgagggccagttcgctacagtgtataaagctagagacaaaaatacaaaccagatagtcgcaataaaaaagataaagcttggacacaggagcgaagcgaaagatggcatcaatcgcaccgccctgcgggaaattaagttgttgcaggagctgagccatcctaacattattggactgctcgacgcctttgggcacaaatcaaatatctccctggtgttcgactttatggagactgacttagaggtgatcatcaaggacaattccctcgtcttgacgccaagtcacattaaagcctacatgctgatgactctgcagggccttgaatacctgcaccagcactggattttacaccgggacttaaagccaaacaatctgctgttggatgagaacggcgtcctgaagcttgccgacttcgggttggccaagtcctttgggtccccaaaccgagcatacacacatcaggtcgtgacccgatggtaccgcgctcctgagctcctgtttggcgctcgcatgtacggcgtgggcgtggacatgtgggcagttggatgcatcctcgcggagctcctcctcagagtccccttcctccccggtgactcagacctggatcagctgacccggatctttgagactctgggaactcctaccgaggagcagtggcctgatatgtgttctcttcctgattacgttaccttcaaatccttcccagggatcccactgcaccatatcttttcagccgctggcgacgacctattggacctcatccaaggcttatttttattcaacccgtgtgccagaatcacagccactcaggcacttaagatgaagtatttttccaatcgacccggacccacaccgggttgccagctgcctcggcctaattgccccgtggagacattgaaggagcagtccaacccagctctggctattaagcgcaaacgaacggaagcgctggagcagggtggcttgccaaaaaaattaattttttag

SEQ ID NO: 28244 - DNA, 1395 bp, Artificial Sequence
  Description of Artificial Sequence: Synthetic coding sequence
atggattacgattttaaagtgaagttgtcctccgagagagagcgcgtggaggacctttttgaatatgaaggatgcaaggtaggtagaggcacttacggccacgtctataaagccaagcgcaaagacggcaaagatgataaagattacgctctgaaacaaatcgagggaaccgggattagtatgtcagcatgtagagagatcgccctgctccgggagttgaagcacccaaatgtaattagcttgcaaaaggtgttcctgtcacatgcagaccggaaggtttggttgctttttgattatgccgaacacgacctttggcatatcattaagttccacagagcctccaaggctaacaaaaaacccgttcagttgccacgcggtatggtgaagtctttgctctatcaaattttggacggaattcattacctgcatgctaattgggtactgcaccgtgatttaaagcctgctaacatcctggtgatgggcgagggcccagagcgtggtcgcgttaaaatagccgatatggggtttgcccgtctctttaactcccctctcaagcccctggcagacctggacccagtggtggttaccttctggtaccgcgcacccgaactgctcctgggagcacgccactacactaaggctatcgacatttgggcaatcggctgtatctttgccgagttactcacgtcagagcctattttccactgccgccaggaagacattaagacatcaaacccttatcatcatgaccagctcgataggatcttcaacgtgatgggcttccctgccgacaaggattgggaagacatcaaaaaaatgcccgagcacagcaccctcatgaaggactttaggcggaacacctacacgaactgtagcttgattaagtacatggagaagcataaggtgaagcctgatagcaaggcctttcaccttctgcagaaacttcttacaatggaccctattaagcggataaccagcgagcaggctatgcaggacccttatttcctagaagatcccttgcctacgtctgacgtcttcgccggatgtcagataccctaccccaagcgcgaattccttaccgaggaagaacccgatgacaagggtgacaagaagaatcagcagcagcagcaggggaacaatcacacgaacggcaccggacatcccggaaatcaagactcatcccatacacagggcccaccacttaaaaaggttcgcgtggtgcccccaactaccacaagcgggggattgatcatgactagtgattaccaacgcagtaaccctcatgccgcttacccaaacccgggaccctccacctctcagccgcagagcagcatggggtattcagccacatctcagcagccgcctcagtatagccaccaaactcatagatactag

SEQ ID NO: 28245 - DNA, 495 bp, Artificial Sequence
  Description of Artificial Sequence: Synthetic coding sequence
atggactacgatttcaaagttaagttgtcatccgaacgagagagagttgaggatcttttcgagtatgagggctgtaaggtggggcgtggaacatacgggcacgtctacaaggccaaaagaaaggacgggaaagacgataaggattatgcattgaaacagatagaaggaaccgggatttccatgagcgcatgcagggaaatagccctgttgagggaactgaagcatccaaacgttatctcgctgcagaaggttttcctgtcccacgctgacaggaaagtctggcttttattcgattacgcagagcacgatctgtggcacattatcaagttccaccgagcttccaaggccaacaagaaacctgtccagttacccagaggtatggttaaatcactcttataccagattctggacggcatccactatttgcacgctaactgggtcctccatagggaccttcttacatgggcactacccgattacctgatccatctgtag

SEQ ID NO: 28246 - DNA, 1119 bp, Artificial Sequence
  Description of Artificial Sequence: Synthetic coding sequence
atggccaagcagtatgacagcgtagaatgtccgttttgcgacgaggtttccaaatacgagaaactcgctaaaattggccaggggacttttggggaggtctttaaagcgagacaccggaagacgggccagaaagttgccttaaaaaaagtgctgatggaaaatgagaaagaagggttcccaatcaccgcactccgagagataaagattctgcaactccttaaacacgaaaatgttgtaaatcttatagagatttgtcgaaccaaggccagcccctataatcgctgcaaagggagtatttacctggtgtttgacttctgcgaacacgacctcgccggtcttttgagcaacgtgttggtcaaattcaccctgagcgagatcaagcgcgtgatgcagatgctccttaatggtctgtactatatccatcgaaataagatcctacaccgagatatgaaggcagccaacgttctgattactcgggacggggtgcttaaactggcagatttcggccttgctcgcgctttctctttagcaaaaaattctcagccgaatcgttatacaaaccgggtcgtaactctgtggtataggccaccggaactgctgcttggtgagcgtgactacggccctccaatagatctctggggtgccggatgtatcatggctgagatgtggactcgctcgcctatcatgcaggggaatacagaacagcaccaacttgcactgatatcccagttatgcggatcaatcacacccgaagtttggccaaacgtagacaactacgaattatacgagaagctggaactagtcaaggggcagaagcgaaaagtcaaggaccgcttaaaggcttatgtgcgtgatccctacgctctggatttaatcgataaattgctcgtgttggacccagcacaaagaatagattccgatgacgcccttaatcatgattttttttggagcgacccaatgccttccgacttaaagggaatgctctcgactcacctcacaagtatgttcgagtacctggctccccctcgcaggaagggcagccagatcacccagcagtcaactaaccagtctcggaatccagctacaactaatcagactgaattcgagcgcgtattctag

SEQ ID NO: 28247 - DNA, 1470 bp, Artificial Sequence
  Description of Artificial Sequence: Synthetic coding sequence
atgcaaagggacgcaccacctcgggctcccgctcccgctcccaggttgcctgctccccctatcggggctgctgcctcaagcggtggagggggaggcggtggcagcggcggtggcggtggcggagcttccgctgcacctgcacctcctgggctgtcaggtacaacgagtcccagaggcccagggggtggcagacgagccgaggaggccggttctgcgccacgaggtcgaaaatggccttggaggaggaaatggcgcggaagaggtggcgcttggagtgccgctgccgctggtccaggggctggtgctgcagctgcagccaccgggggagggggaggggctctcgaggcggctatggccaagcagtacgacagcgtggaatgtccgttctgcgatgaggtatctaaatacgaaaagctcgccaaaatcgggcagggcacttttggcgaggttttcaaggcccgacacaggaaaactggacagaaagtggccctcaagaaggttctgatggaaaatgagaaggaaggatttccaatcaccgcactccgcgagatcaagatcttgcagctgctgaagcacgagaacgtggttaacttgattgagatttgccggactaaagcatcaccctataaccgctgtaaaggatcgatctatcttgtgttcgatttttgtgagcatgatctcgctggcttgctctctaacgttctggtgaaattcactctgtcagagataaagcgcgtgatgcagatgctcctaaacgggctttattatattcatcgaaataaaattctccacagagacatgaaggcagctaatgttctcataactagggacggcgtgctcaagctcgccgactttggattggccagagccttctcattagctaaaaactcccaacctaacagatacactaaccgggttgttacattgtggtacaggccccctgagctacttctgggcgagagggactatggacctccaatcgatctctggggagcgggatgcattatggcagagatgtggactcgtagcccgatcatgcagggcaacaccgaacagcatcaactcgccttgatttcccagctgtgtggttctatcacgccagaagtttggcctaacgtggataactacgagttatacgagaagctggagctagtgaaaggccaaaagagaaaagtcaaggacagactcaaagcatatgtgagggacccctacgcgctggacttgattgacaaactgctcgtcctggatcccgctcagaggatcgacagtgacgacgcgctcaatcacgacttcttctggtccgatccgatgccatccgaccttaagggcatgctttcaactcatctcaccagcatgttcgagtatctggccccaccgcgacggaaggggtctcagattactcaacagtccacaaaccaaagtcgtaaccccgcaacaacaaaccaaaccgaatttgaaagagtcttttag

SEQ ID NO: 28248 - DNA, 585 bp, Artificial Sequence
  Description of Artificial Sequence: Synthetic coding sequence
atgcagagggatgctcctccgagagcccctgctcctgcaccaagattgcccgctcctcccattggggctgctgcatctagcggcggagggggtgggggtggctcagggggagggggtggcggtgccagcgctgctcccgctcctccgggtctctctggtacaacatcccctcggggacccggtggaggcaggcgcgctgaggaagcgggtagtgcccctcggggacgcaagtggccttggcgacgcaagtggagaggcagaggaggagcttggtccgctgctgctgccggtccaggcgctggtgctgccgcagccgctaccgggggagggggaggggctctggaggccgctatggccaagcagtatgactctgtggaatgccctttctgcgacgaggtctccaagtacgaaaagttggcaaaaataggccaggggacattcggtgaggtgttcaaagctagacatcggaagaccggccagaaagtcgctctgaagaaagtgctgatggagaacgagaaggagggtttccccatcaccgcactgcgcgagataaagatcctgcaattacttaagcacgaaaactag

SEQ ID NO: 28249 - DNA, 495 bp, Artificial Sequence
  Description of Artificial Sequence: Synthetic coding sequence
atgagcgaacccgcaggcgacgtgagacagaacccctgcggatccaaggcatgtaggagactgtttggcccagtagactccgagcaattaagcagggattgcgatgccctcatggccggttgtattcaagaggccagagaaaggtggaattttgatttcgtgaccgaaacacccctggaaggcgatttcgcctgggaacgcgtccgcggtctgggtctaccgaagctgtacctgccgacaggcccaaggagagggcgtgatgagctaggaggagggcgacgtcctggcactagcccagccctattacagggtaccgccgaagaggatcacgtcgacttaagcctgtcatgtaccctggtgccccgttctggggagcaggccgagggttcaccagggggtcctggtgactctcaagggagaaagcgcagacagacttcaatgacagacttctaccacagcaagaggcggctgattttctccaagcggaagccatag

SEQ ID NO: 28250 - DNA, 495 bp, Artificial Sequence
  Description of Artificial Sequence: Synthetic coding sequence
atgagcgagccggctggcgacgttcgccagaacccttgcggatcgaaggcctgccggaggttgtttggtcctgtcgactccgagcagctttctagggattgcgatgctcttatggccggttgtatccaagaagctcgggagcgctggaacttcgactttgtgactgagacacccctggagggcgattttgcctgggagagggtgcgcggactcggactgcctaagctgtatctccctacaggccctagacgtggccgagacgaattgggcggaggccgaaggcctggcacctcacccgctctgctgcaggggactgccgaagaagatcacgtcgatctatctctgagttgcacgctagtgccacgcagcggcgaacaagccgaagggagcccagggggtcctggcgatagccaaggtcgtaaacgtaggcagacaagcatgaccgacttttatcactcaaaaagacgtttaatattcagcaagaggaagccttag

SEQ ID NO: 28251 - DNA, 495 bp, Artificial Sequence
  Description of Artificial Sequence: Synthetic coding sequence
atgagcgagccagctggagatgtgagacaaaatccctgcggctcaaaagcctgccggaggcttttcgggcctgttgacagtgagcagctgagcagagattgcgatgctctcatggccggatgcattcaagaagctagagaaaggtggaattttgattttgtcacagagacccctctcgaaggggactttgcttgggagcgtgtgaggggtctcggcctccccaaattgtacctccccactggaccccgacgaggacgcgacgagctcggcggaggcagacgccctggtacatcaccagccctgctccaggggacggccgaggaggaccacgtggatcttagtctgtcttgtaccctggtgccacggtccggtgaacaagccgagggctctcctggcggtccaggtgacagtcaaggtcgtaaacggcgtcagactagcatgacagacttctaccactcaaaacgaaggttgattttctccaagcgcaaaccatag

SEQ ID NO: 28252 - DNA, 597 bp, Artificial Sequence
  Description of Artificial Sequence: Synthetic coding sequence
atgtggggggtgtttcgcagacagactactcactcctcaaaccctcccctccccggtcagcaaagctgttgtaaccaccgagacttcttctgttctggcgcaatgtccgagcccgctggagatgtcaggcagaatccctgcggctccaaggcttgtagacggctgtttggccctgtggattccgaacagctgtccagggattgtgacgccctgatggcagggtgtattcaagaggcaagggagcgttggaattttgattttgttaccgaaaccccactggagggcgactttgcttgggagcgggtgaggggcttggggctgcccaaactctacttgcccaccggccctaggcgcggtcgtgatgagctaggagggggaaggcggccagggacgtctcccgcattgctgcagggcacggcagaagaggaccacgtggacctaagcctcagttgcacgctcgtcccgaggtccggtgagcaggccgaggggagccctggtggacccggagattcccaaggccgaaaacgccgacagacttctatgaccgacttctatcactcaaagcggaggctaatcttctcgaaaaggaaaccttag

SEQ ID NO: 28253 - DNA, 363 bp, Artificial Sequence
  Description of Artificial Sequence: Synthetic coding sequence
atggacgattccaaggtcgtgggcggaaaggtcaaaaaaccgggtaaacggggaagaaaacctgctaagatcgatctaaaggccaaactggagcggtctcggcagtcggcccgagagtgtagggccagaaaaaagctgaggtatcagtacctggaggaactggtgtcttcccgggagcgtgccatttgtgctcttagggaagagttggaaatgtataagcaatggtgcatggctatggaccagggtaaaatcccatctgaaataaaagccctgctgactggtgaggagcaaaacaaatcccagcagaatagctccaggcacacgaaagccggaaagaccgatgcaaactctaatagctggtag

SEQ ID NO: 28254 - DNA, 444 bp, Artificial Sequence
  Description of Artificial Sequence: Synthetic coding sequence
atggaggaggcctctcagaggaagtggaacttcgacttccagaaccataagcccttggaaggaaagtacgagtggcaggaagtcgagaagggctcccttcctgagttttattacagaccgcctagacctcccaaaggcgcttgcaaagtgcctgcacaggagagtcaagacgtgagtggaagccggccagccgctccactgatcggcgctcccgctaatagcgaagacacacatttagtcgatcctaaaaccgacccgagcgactcccagacgggactcgcggaacagtgtgctgggatacgcaagcgcccagcaaccgacgatagcagcacgcagaacaaaagagcaaacagaactgaggagaacgtgagtgacggctcacctaacgccggatctgttgagcaaacccctaaaaagccaggactgcgcagacgccaaacttag

SEQ ID NO: 28255 - DNA, 918 bp, Artificial Sequence
  Description of Artificial Sequence: Synthetic coding sequence
atggagcgactagtggcccgaggtacgtttcctgtactggttaggaccagtgcgtgtaggtctttatttggacccgttgaccatgaggagctgtctagagagctgcaggccagactagccgagctgaacgctgaggaccagaacaggtgggactacgatttccagcaggacatgcccctcagaggccctggacgattgcagtggacagaagtggacagcgattcggtccctgctttttacagagagacagtgcaggtagggaggtgtcgattactgttagcaccccgtccagttgccgtggcagtggctgtgagtccacccctggagccagccgctgaatctctggatggcttggaggaggccccagagcaactgccctcggtgcccgtgccagcacccgcttccacccccccacctgtccctgtcttagcccctgctcctgccccagccccagcccctgtcgcagcccctgtcgcagctcccgttgccgtggccgtcctggctccggctcctgcccctgctcctgcgccagcgcctgcgcctgctccagtggcagctcccgcacctgcaccagctccagcccctgctccagcgccagcgccagccccagccccagacgcagccccacaggaatccgcagagcagggggctaaccagggacagcgaggccaagaacccttagccgaccagctgcattctggaatttccggtagaccggcagccggtacagctgccgcttctgccaacggcgcagctattaagaaactttctgggcctcttatttccgacttctttgccaagcggaagagatctgctcctgagaagtcttcaggggacgtgcctgctccgtgtccatcccccagtgcagcaccaggagttgggagcgtggaacagacacccaggaagagactgagatag

SEQ ID NO: 28256 - DNA, 951 bp, Artificial Sequence
  Description of Artificial Sequence: Synthetic coding sequence
atgagtgacgcttctctccggagtactagcaccatggagcgcctcgttgccagaggaacctttccagtgctggtccggactagtgcatgtcgatctctgttcggtcccgtggaccacgaggagctgtcccgtgaactccaagctcgcctcgccgaattaaacgccgaagaccagaatcgctgggactacgacttccaacaggatatgccgcttaggggaccaggcagactacaatggacggaagtggattctgatagcgtgcccgcattttatcgggaaactgtgcaggtgggcaggtgcagacttctcctggcccctcggcctgtggcggtggccgtcgccgtgtcaccgcctttggaacccgcagccgaaagcttggacggcctggaggaggctccggagcagctaccatccgtgccagtgccagctccggcttctactcctcctcccgtcccggtcttagctccagctcccgcacctgcacccgctcccgtcgccgcaccggtcgccgcaccagtggccgttgcagttctcgctccagcccctgcgcctgccccagccccagcgccagccccagccccagttgcagctccagctccagctcccgcacctgccccagccccagcacccgctcccgctcctgcccctgatgcagcaccccaggagtcagccgagcagggcgctaaccaagggcagagaggtcaggagcccttggccgaccaactacactcagggatcagtggtaggcccgctgccggtacagctgccgcttctgccaatggggcagccattaagaagctgtctgggcctctgatatctgatttcttcgccaaaagaaagcgatcggcccctgagaagtcgtccggcgacgtgcctgcgccttgtccctccccaagtgcagcacctggcgtgggttcagtggaacagactccgcgaaagcggttgcggtag

SEQ ID NO: 28257 - DNA, 951 bp, Artificial Sequence
  Description of Artificial Sequence: Synthetic coding sequence
atgtcggacgcaagtctccgctcgacctcaacaatggaacgcctcgtggctcggggaaccttccccgtgctcgtgcgtaccagcgcatgtcggtccctctttggccctgttgaccacgaggagctctctcgcgagctacaagccagactggcagagcttaacgcggaggaccagaatcgttgggattatgactttcagcaggacatgcctctcagggggcctggtagactccagtggacagaagtggactccgatagtgtccctgccttctatagggaaacagtgcaagtaggcagatgcagattactactggctccgcgacccgtggccgtggccgtcgcagtgtcgcctcctctggaaccggctgcagaatcccttgatggactggaggaagcgcctgagcagctgccgtctgtcccagtacctgctcctgcctcaacacctcccccagtgccggtcctcgctcccgcacccgcacccgcacctgctcctgtcgcggctccagtggcagctccggtggcagtcgctgtcttggccccagcacctgctcccgctcctgccccagcccctgcaccggctcccgtagccgctcccgctccagcaccagcgccagctccagcccctgctcctgccccagcccctgcaccagatgccgctcctcaggagtctgccgaacagggagccaaccagggacagcggggtcaggagccattagccgatcagctgcacagcgggattagcgggagacctgccgctgggaccgccgctgcttcggctaatggagccgcaattaaaaaattgtcgggaccactcatctcggatttcttcgctaagagaaaaaggtccgcgcctgaaaagtcatccggcgatgtacctgccccatgcccctcgccatctgctgctccaggcgtcggttcagtggagcaaactccaagaaagcgactgagatag

SEQ ID NO: 28258 - DNA, 918 bp, Artificial Sequence
  Description of Artificial Sequence: Synthetic coding sequence
atggaacggttggtggctcggggaactttccctgtgttggtacgtacatccgcctgcagatctctatttggccctgtggaccacgaagagctaagccgagaattgcaagccagactggcagagttgaatgccgaggatcagaatcgttgggactacgacttccagcaagatatgccacttaggggccctggcaggctgcagtggactgaagtcgactccgatagtgtaccggcattctacagggagactgtgcaagtggggcgttgtcggcttttgctggctcctcggcctgttgccgtggccgtggcggtgagcccccctctggaacctgctgcagagtcgctggatgggctagaagaagccccagaacaactgccctcagttcccgtgccagctcccgctagtaccccccctcctgtgccagttctggccccagctcccgctcctgctcccgctccagtggcggcacccgtggcggctcccgtggccgttgcagtgctggcacccgcacccgctcccgcaccagcccctgctcctgctccagcccctgtggctgcccctgcccctgcacctgcccctgctcccgctccagcaccagcccctgcgcctgctcccgatgccgcacctcaagagtccgctgaacagggcgcaaatcagggtcaaaggggtcaggaacccctggctgatcagctgcattccggtataagtggcaggcctgcggcaggcactgccgcagccagtgccaacggggctgccatcaagaagttgtctgggccacttatttcagacttttttgccaaacgcaagagaagcgccccagaaaaatcgagtggagatgtgcctgccccatgcccttctccttccgctgcccctggtgttggtagtgtggagcagacgcccaggaaaagacttagatag

SEQ ID NO: 28259 - DNA, 504 bp, Artificial Sequence
  Description of Artificial Sequence: Synthetic coding sequence
atggagcccgcagccggaagtagtatggagccctcagcggactggttagccaccgcagccgctcggggacgggttgaggaggttcgcgctttgttggaagctggtgcacttcccaacgccccaaattcatacggccgtagaccaattcaggttatgatgatgggcagcgccagggtagccgagcttctcttgcttcatggggctgaaccgaattgcgctgaccctgccaccttgacaagacctgtgcatgatgccgctagggagggatttctggacacccttgttgtactgcatagagctggcgctcggttggatgtgagagacgcctgggggagactgcctgtggatttggctgaggagctcggccacagggatgttgctcgttacctgcgggctgccgctggcggaacccgcggtagcaatcatgcccgaatcgatgcagcagaggggccttctgaaatgatcggaaatcacctgtgggtgtgtagaagccgccatgcttag

SEQ ID NO: 28260 - DNA, 471 bp, Artificial Sequence
  Description of Artificial Sequence: Synthetic coding sequence
atggagcccgctgccggtagttccatggagccctcggcagattggctggccaccgctgctgcccgtggaagagtggaagaggtaagagcactgctcgaggcaggagctttaccaaatgccccaaactcttacggcagacgacccattcaggtgatgatgatgggatcggcccgtgtggccgaacttctgctgctccacggcgcagaaccaaattgcgccgaccccgctacattgacacgcccagtccacgacgccgcaagggaaggcttcttggataccctggtcgtcctacatcgagcaggggctcggctcgacgtcagagacgcatggggcaggctgccagttgacctggctgaggaactgggccatcgtgatgtggctcgctacctgagagccgctgcgggaggaacccgaggctcgaatcatgctcgtattgatgccgctgaggggccatccgacatcccagactag

SEQ ID NO: 28261 - DNA, 522 bp, Artificial Sequence
  Description of Artificial Sequence: Synthetic coding sequence
atgggcagaggccgttgcgtgggcccatcgctacaactgagggggcaggagtggaggtgcagtccgctagtccccaaaggcggagccgcagccgctgaacttggcccaggagggggagagaacatggtcagaagattcctggtgaccctgaggatcagacgcgcttgcggccctcccagagtgagagtattcgttgtgcatattccacgcctgacaggcgagtgggcagcccctggcgctcccgcagccgtggcccttgtactgatgttacttcggtcacagcgcttaggccagcagcctctgccacggcgacccggacacgacgacgggcagcggcctagcggcggagccgctgcagccccacggcgaggcgcacaactgagaaggcctagacattcacaccctaccagggccagacggtgccctggtggcttacccggtcatgcaggcggtgctgctccaggaaggggagcagccggacgggctcgctgccttgggccatcagcgaggggtccaggatag

SEQ ID NO: 28262 - DNA, 504 bp, Artificial Sequence
  Description of Artificial Sequence: Synthetic coding sequence
atggaacccgctgccggttcatctatggagccgagtgccgattggttggctacggccgcagctagaggacgggtggaggaagtaagagcactgctcgaggctggcgctctacctaatgcgcctaacagctacgggcgtcgtcctatccaggtgatgatgatgggcagcgcaagggtggcagaacttttgctgctccatggtgcagaacctaactgcgccgaccctgccactttgacgagaccagtgcatgacgcggcaagagaaggctttctggacaccctcgtagtgctgcatagggcaggggcacgcctggacgtgagggacgcctggggccgtctcccagtggacctggccgaggagctggggcacagggatgtggcacgctacctacgggctgcggcaggaggcacacgcggtagcaaccatgctaggatcgatgccgcagaaggcccaagtgaaatgatcggaaatcacctgtgggtgtgccgaagtcgccacgcatag

SEQ ID NO: 28263 - DNA, 399 bp, Artificial Sequence
  Description of Artificial Sequence: Synthetic coding sequence
atggtgcgaaggttcctggtgacactacgcataaggcgggcatgtggcccacctagggtccgggtttttgtcgtccacataccaaggctgaccggggaatgggccgcaccaggggctcctgccgctgttgcccttgtcctaatgctcctcagaagccaacggctggggcagcagcccctgcccaggcgccctggccatgatgacggccaaagacccagcggcggagccgcagccgctcctcgtcggggagcccagctgcggcgaccacgacatagtcacccgactcgggcacggcgatgcccaggtgggctgcccggacatgccggaggtgcggcacctggccgtggggcagccggacgagccaggtgtctgggaccatcggctcgtgggcctggatag

SEQ ID NO: 28264 - DNA, 417 bp, Artificial Sequence
  Description of Artificial Sequence: Synthetic coding sequence
atgagagaggagaataaaggtatgccctccggagggggatctgacgaggggttagcaagtgccgcagccaggggcttggtcgaaaaagtgagacagctgctagaggcaggggctgacccaaacggggtgaacagattcggcaggcgggctatacaggttatgatgatggggtccgccagggtcgctgagctcctcctgttacacggcgcagaacctaattgtgctgacccagcgaccctgaccaggccggtgcacgacgccgctcgcgagggcttcttagacacactggttgtcttacaccgagctggtgcacgcctggatgtgagagacgcatggggcagactgccagtggatctggcagaggaacggggtcacagagatgtcgcgggatatctgcgcacggccactggagactag

SEQ ID NO: 28265 - DNA, 237 bp, Artificial Sequence
  Description of Artificial Sequence: Synthetic coding sequence
atgcgtgaggagaataaaggtatgccttctggcggtggaagcgacgaggggcttgcttccgccgcagctcggggacttgtggagaaagtgcgacagctgctagaggcaggagccgatcctaatggcgtcaatcgatttggcagaagggccatacaggtggccggagccccagggccaaggagacagggcgctagggagcgcggtgcccgtcctagacgcatcggagccggaacatag

SEQ ID NO: 28266 - DNA, 237 bp, Artificial Sequence
  Description of Artificial Sequence: Synthetic coding sequence
atgagagaggaaaacaagggtatgccttctggtggtggtagtgatgagggcctcgcttcagcggctgctcggggtctcgtggaaaaggtacggcaactcctcgaagccggtgcggatcctaacggcgtcaatcgctttggaaggagggccattcaggtcgctggagctcccggtccccgtcgtcaaggcgctagggaaaggggcgcacggccacgccgtatcggcgctgggacatag

SEQ ID NO: 28267 - DNA, 507 bp, Artificial Sequence
  Description of Artificial Sequence: Synthetic coding sequence
atggccgaaccctggggcaatgaactggcatctgctgcggcacgcggagacctcgagcagctaaccagtctgctgcagaataatgttaatgtgaatgcacaaaatggtttcggtcggactgctctgcaagtaatgaagcttgggaaccctgagatcgcgagacgccttcttctccgcggtgctaaccccgacctgaaggaccgtacagggtttgccgtaattcacgatgcagctcgcgcaggttttcttgataccttgcagaccctgctcgagttccaggccgacgtcaacattgaagataacgagggcaatctgcccctgcacttagcagcaaaagaaggtcatctcagggttgtggaattcctggtgaaacatacagcaagcaacgttggccatcgcaaccataagggggatactgcatgcgacctggccagactgtacggcagaaatgaggtagtctccctcatgcaggccaatggcgctggaggcgctacgaacctgcaatag

SEQ ID NO: 28268 - DNA, 507 bp, Artificial Sequence
  Description of Artificial Sequence: Synthetic coding sequence
atggccgagccatgggggaatgagctagcatcggcagctgctagaggggaccttgagcagttgaccagcttacttcaaaataacgtgaacgtgaacgctcagaacggattcggcagaactgctctgcaggtcatgaaactcggcaatcccgagatcgccaggcggctactgctgagaggcgctaatcccgatcttaaggatcgcactggttttgccgtgatacacgacgccgctcgggctgggtttctggacacgttacagaccctgctcgagtttcaggctgatgttaacatagaggacaacgagggcaacctgcccctgcatctcgccgctaaggaaggtcacttgcgtgtagtggagttccttgtcaagcatacggcaagcaatgtaggccatagaaaccataagggagacactgcctgcgacctggccagactttacgggaggaatgaagttgtgtcgttaatgcaggccaatggggctgggggtgctacaaacctccagtag

SEQ ID NO: 28269 - DNA, 507 bp, Artificial Sequence
  Description of Artificial Sequence: Synthetic coding sequence
atggcagagccctgggggaatgaacttgcatctgcggctgcaagaggtgatttggagcagcttacgagtttgttgcaaaataacgtgaatgtgaatgcacagaatggcttcggacgtaccgcccttcaggtcatgaaactggggaaccctgagatcgccaggaggctcctgctgcgcggtgcaaatccggacctgaaagaccgtactggattcgcagtaatccatgatgcagcgcgagctggattccttgacactctgcagacacttctggagtttcaggccgacgttaatattgaggataatgaggggaaccttccgctgcatctggctgcgaaagagggccacctgcgggtcgtggagttcctggtgaaacacacagctagcaatgttggacacaggaaccataaaggcgacaccgcatgcgacctggccagactttacggacgcaatgaagtggtcagcttgatgcaggctaacggcgctggcggagcaaccaacctgcagtag

SEQ ID NO: 28270 - DNA, 501 bp, Artificial Sequence
  Description of Artificial Sequence: Synthetic coding sequence
atgctactggaagaagtaagagctggcgaccgcctcagcggcgcagctgcacgtggtgacgtgcaggaagtgaggagattgcttcatagggagctcgtgcatccagacgctctcaatcggttcggcaagactgccctgcaggtgatgatgtttgggtcgacagcaatcgccttagagttgctaaaacagggcgcttctccaaatgtacaagacacctcagggacttcaccggtgcatgatgctgctcgaacaggtttcctggatacgcttaaggttctggtcgagcatggagctgacgtaaatgtacccgacggtacaggtgcgctgcctatacacctcgccgtacaggaaggtcatacagctgtagtgagcttcttagccgctgagtcagaccttcatcgaagagatgctaggggtttgactccactggagctcgctctgcagcgcggagcgcaggatttggtcgatatcctacagggccacatggtcgcccctttgtag

SEQ ID NO: 28271 - DNA, 501 bp, Artificial Sequence
  Description of Artificial Sequence: Synthetic coding sequence
atgctgctcgaggaagttagagctggagataggctgtctggggcagctgccagaggtgacgttcaagaggtgcgtagactgcttcaccgagaactggtccacccagatgcacttaacaggttcggaaagacggccttgcaggtcatgatgtttgggtccacagcaatcgccttggagctcctcaagcagggagcctcacccaatgtgcaggataccagcggcacatcccccgttcatgacgccgctcggaccggctttctggatactctgaaagtgctcgtcgagcacggagccgacgtcaatgtgcccgatggtactggagctctgcctattcacctcgccgtgcaagaaggccacaccgctgtcgtgagttttctcgcagctgaatcagatctgcatcgcagagatgcacgcggactgacccccctggaattagccttgcagcgaggggcacaggatcttgttgatattctccaaggtcatatggtcgcccctctctag

SEQ ID NO: 28272 - DNA, 639 bp, Artificial Sequence
  Description of Artificial Sequence: Synthetic coding sequence
atgaaaccaccttcttccatccaaacctccgaattcgattctagtgatgaggaacccattgaagatgaacagacaccgatccatatcagctggctgtcgctgtctagagtgaattgtagccagttcctcgggctttgtgctcttcccggttgcaagttcaaggatgtccgcagaaacgttcaaaaggataccgaagagcttaagtcctgcggcatccaggacatttttgtgttctgtacaagaggtgagctatcaaagtacagggtgcccaacctgctggatctctaccagcagtgcgggatcattactcaccaccatcccatagccgatggtgggaccccggatatcgcttcatgctgtgaaataatggaggaactgactacctgcctcaagaactaccggaaaaccctaatccattgttatggcggtttgggaaggtcgtgtttggtagctgcctgcttacttttgtacctgagcgacacaatcagtcccgaacaggctattgattcactccgagatctgagaggctctggtgccattcagacgattaagcagtataactatctccatgagtttcgcgacaaattggctgcacacctctcctccagggactcccagtcacggtctgtgtctcgatag

SEQ ID NO: 28273 - DNA, 501 bp, Artificial Sequence
  Description of Artificial Sequence: Synthetic coding sequence
atgaatccgtgctgtaaatttaaggatgtgaggagaaacgtgcagaaagacactgaggagctgaagagttgcgggatccaggacatcttcgttttctgcactcggggagagctctctaagtacagagttcctaacctgctcgacctgtatcagcaatgtggtataatcacccaccaccaccctatcgcagacgggggaacaccagatatcgccagttgttgtgagattatggaggaattgacgacatgcctcaagaactatcgcaaaacgctcattcactgttacggcggacttgggaggtcctgtctcgtagccgcatgccttttgctgtacctttccgatacaattagcccggagcaggcgatcgactccctacgggatttgaggggatcaggggctatacaaaccatcaagcaatacaattacctccacgaatttagagataaactggccgctcacctgtctagcagagatagccagagcagaagtgtgagtaggtag

SEQ ID NO: 28274 - DNA, 210 bp, Artificial Sequence
  Description of Artificial Sequence: Synthetic coding sequence
atgaaaccaccaagctctatccaaacgagtgagttcgactcctccgacgaagagcctatcgaggacgagcaaactcccatacatattagttggctgtcactgtcaagggtgaactgttcacagtttctgggactttgtgcactgccaggctgtaagttcaaagacgtgcgacgcaatgtacagaaggagaaaaagaaaaagaagaaatag

SEQ ID NO: 28275 - DNA, 624 bp, Artificial Sequence
  Description of Artificial Sequence: Synthetic coding sequence
atgaagcccccatcctcaattcagacgtccgaatttgactccagcgatgaggaaccgattgaagatgaacagacccccatccacatctcatggctgtctctgtcccgcgttaactgctctcagttcctgggactgtgcgcactacctggatgtaaattcaaggacgtgcgaaggaacgttcagaaggataccgaggagctgaaatcatgtggaattcaggacatattcgtgttttgcactcggggagagttgagtaagtatcgcgtcccgaacctgctggacctgtatcagcaatgtggtatcataacccaccaccatccaatcgctgatgggggaactcctgatatcgccagctgttgcgagattatggaggagcttacaacatgtttgaaaaatctcttttgctatggtggcctggggaggtcttgcttggttgcggcatgcctcctgctgtatctctctgacactatcagcccagaacaggcgatcgattcattgcgggatctgagaggatccggcgcaatacagaccatcaaacagtataattatcttcacgagttccgcgataaattggctgctcacctcagcagtagagactcccagtcacggagcgtgagcagatag

SEQ ID NO: 28276 - DNA, 519 bp, Artificial Sequence
  Description of Artificial Sequence: Synthetic coding sequence
atgaaacctccttcaagcatacagacgtcatgtaaatttaaggatgtccgaagaaatgttcagaaggacactgaagaacttaaaagctgcggcatccaggacatctttgttttctgcacccggggagagttgtcaaagtaccgggtgcccaacttgttagatttgtaccagcaatgcggtattataacccaccaccaccccattgctgatggaggtaccccagacattgcgagttgttgcgagatcatggaagagctgacaacttgtctgaagaattaccggaagaccctcatccattgctatggtggccttgggaggagttgtctggtcgccgcttgtctcctgctctatctcagcgacaccatttcgcccgagcaggccattgattcgctgagggaccttagaggttccggtgcgattcagaccattaagcagtataattacttgcacgaatttagagataaactggccgcacatctgagctcccgggacagtcagtcacgttccgtctccaggtag

SEQ ID NO: 28277 - DNA, 2871 bp, Artificial Sequence
  Description of Artificial Sequence: Synthetic coding sequence
atgagtagcgggttatggagccaggagaaggtgaccagcccctattgggaagaacgaatcttctacttgctcctccaggagtgttctgtgacagataagcagacccagaaactcttgaaggttcctaagggcagtattggccagtacatacaagacagaagcgtaggccactctagaattccctctgccaaagggaaaaaaaaccagatcgggttgaaaatactagagcagccccatgccgtgttatttgtggacgagaaagatgtcgtagagattaacgaaaaatttaccgaactgctgcttgcaatcaccaactgtgaagaacggttttcactcttcaagaataggaatagactgtcaaagggactccagattgatgtgggctgcccagtcaaggtacagttacgatctggcgaggaaaaattcccaggcgtggtgaggtttcgcggacccctactcgcagagcgcacagtgtctgggatctttttcggggtagaactgctcgaagaaggacggggacaaggtttcacagacggcgtgtaccagggaaaacagctattccaatgcgatgaggactgcggagtctttgttgccctcgataagctggagcttattgaggatgatgacaccgcactagaaagcgactacgcaggaccaggtgacacgatgcaggtcgagctgccgcctctagagataaatagtcgagtttcactgaaggtgggcgagactatcgaaagcggtacggtaatcttctgtgacgtgctgccgggtaaagaaagtctagggtacttcgtgggagttgacatggataaccccattggcaattgggatggacgctttgatggcgtccagctgtgctccttcgcttgtgtggagtccacaattctcctccatatcaatgacatcataccggctctctccgagtctgtcacccaagagcggagacccccaaaattggcctttatgagtaggggggtaggcgacaagggatctagtagtcataacaagccaaaggcaaccggctctacttccgaccccggtaacaggaatagaagtgaactgttttatactctaaacggctcttccgtagacagtcaaccccagagtaaaagcaaaaatacatggtacattgacgaggtagccgaggatccggcaaagtcgctgactgaaatttcgactgattttgaccgatcatccccgccactccaaccgccacccgtgaattccctcaccaccgagaacagatttcacagcttacccttcagcctgacgaagatgcccaataccaatggaagtatcggacattcacccctgagcctgtcagcccagagtgtgatggaggaacttaatacagcacccgtccaggagtcaccaccactggccatgcccccaggaaatagtcacggtcttgaggtgggatcacttgctgaggttaaagagaaccctccgttctacggcgtgatccgctggataggccagccgcctggactgaatgaggtactggccggactggaactcgaggacgagtgcgctggatgcacagatggtacatttaggggaacccgctactttacatgcgcactcaaaaaggctctctttgttaaactcaaatcttgccgtccggacagtcgcttcgcctctctgcagcccgttagcaatcagatagaacgctgcaattctttggcttttggtgggtacctctcggaggtggtggaagagaacactccgcctaagatggagaaggagggtttagaaattatgatcggcaagaagaagggcatacaagggcactataattcatgttatctggatagcaccctcttttgcctgtttgccttttcatcagtgctggacacggtcttgctacggccaaaggagaagaatgacgtggaatactatagtgaaacccaagagctgctacgaaccgaaattgtcaatccattgcgaatatacgggtatgtgtgcgccaccaaaattatgaagctgcggaagatacttgagaaggttgaggccgctagcggtttcacttcagaggagaaggatccagaagaatttctcaacatactgttccatcatatactccgggtggaaccacttcttaagatccgctccgcgggtcaaaaggtccaggactgctacttctatcaaatctttatggaaaaaaatgagaaggtgggggttcctacgattcaacagctcctcgaatggagctttattaattccaacctgaaattcgctgaggcaccgagttgccttattattcaaatgccacggttcgggaaggattttaaactctttaaaaaaatttttccaagcctggagctcaatatcaccgacctcctggaagacacacccaggcagtgcaggatctgtggaggcctggctatgtatgaatgtcgggagtgttacgacgatcccgacatctctgccggtaagatcaaacagttttgtaagacgtgcaatacacaggtgcacctgcaccctaaaagactcaaccataagtacaatcctgtctctctgcccaaagaccttccagactgggactggaggcacgggtgtattccgtgccagaacatggagctattcgcggtgctgtgtatcgagacgtcacactacgtggcttttgtgaagtacggtaaagacgacagcgcctggttgttctttgacagtatggctgatcgcgacggagggcagaacgggtttaacattccgcaggttacgccctgccccgaggtgggtgagtacctgaagatgagcttggaggacctacactctctcgacagtcgtcgcattcagggttgcgccagaagattgttgtgtgatgcctacatgtgtatgtaccagtcgccaaccatgtccctgtataagtag

SEQ ID NO: 28278 - DNA, 2862 bp, Artificial Sequence
  Description of Artificial Sequence: Synthetic coding sequence
atgtcctcaggcctatggtcccaggagaaggtgaccagcccttattgggaagaaaggatcttttacctgcttctgcaggagtgtagcgtcactgacaagcaaactcagaagctgctgaaggtgccaaagggctctatcggtcaatatattcaggatcgctccgtgggacattctcggatcccctccgctaagggaaaaaaaaatcaaatagggttgaaaatacttgaacagccccatgccgtgttatttgtggatgaaaaggatgtggtggagattaacgaaaagttcaccgaacttttgctcgcgattaccaattgcgaggagaggttttcccttttcaagaaccgaaaccggctgagcaagggcttgcagattgacgtgggctgtcctgtgaaggtccagctgagatctggggaagagaagttccccggagtcgttcggttcaggggacctctgttggccgagaggactgtctcagggattttttttggcgtggaacttctagaagaggggagaggccagggtttcaccgacggggtctatcagggtaaacagttattccagtgtgacgaggattgcggcgttttcgtcgctctggacaagctggagctgatagaggacgacgacactgccctcgaaagcgactatgccggaccaggagatacgatgcaggtcgaattgccgcctctagaaataaattcacgagtgagcctgaaagtcggggagaccattgaatccggcacagtgatcttctgtgacgtcctccccggaaaggaatccctgggatactttgtgggcgtggacatggataatccaatcgggaactgggatggaagatttgacggagtgcagctctgctcttttgcctgcgttgagagcacaatcctactccatatcaatgacattatccccgaaagtgtcacccaggagagaaggcccccaaagctggcgttcatgagtcggggagtcggggacaagggatcgtcctcacacaacaaacctaaagcaacaggctccacaagcgacccaggcaacaggaaccgcagtgaacttttttataccctgaacggctcaagtgtggatagtcaaccacagagtaagtctaaaaacacgtggtacatcgacgaggttgccgaggaccctgccaaaagcttgactgagatcagcaccgattttgaccgtagcagtccaccactccaaccaccgccagtcaactccctgacaacggagaataggtttcacagtttaccattcagtcttacaaaaatgccaaacacaaatgggtcgatcggtcatagccccctgagcctcagtgcccagagtgtgatggaggaactaaacacagccccagtacaggaatctcctccactggcgatgcctccgggaaatagtcacgggctggaggttggctcactcgctgaagtcaaagagaacccacctttctatggggtcataaggtggatcggccagccgccaggcctgaatgaggtgctggctggactcgaacttgaagatgaatgcgctggatgtacagatgggacatttagggggactcgttacttcacgtgcgctctcaaaaaggctttgttcgtgaaattgaagagctgccgtcccgacagccgcttcgcttccctccagcctgtctccaaccagatagagcggtgtaattccctagcgttcggcggttaccttagcgaggtcgttgaggaaaacactcctcctaaaatggagaaagagggcctggagattatgatcgggaagaagaaaggcatacagggtcattacaacagctgttatctggatagtaccctattttgcctgtttgctttctcaagcgtgctggataccgtcttgttaagacccaaggagaaaaatgatgtggagtattactcagaaacccaagagctcttgaggacggagattgtcaatcctctgcggatttatggttacgtctgcgctaccaaaattatgaagttaagaaagatcctggagaaggtggaagcggcttctggatttaccagcgaggagaaagacccggaggaattcctgaacatcctctttcaccacatactacgcgtggaacctctcctcaagataagatccgcagggcagaaggtgcaggactgctacttctatcagatattcatggagaaaaatgagaaagttggcgtgccaaccattcagcagctgcttgagtggtctttcatcaatagtaatctcaagttcgctgaagccccaagctgtctgataatccagatgccgagatttggcaaggattttaagttattcaagaaaatcttccctagtctcgaactgaacataacagacttgctcgaggacacacctagacagtgtcgaatctgcgggggactcgcaatgtacgagtgccgtgagtgctatgatgacccagacatcagtgccggaaaaatcaagcagttctgcaagacttgtaatactcaagtgcatttgcatcccaagagactcaaccacaaatacaaccctgtttcattgccaaaggacctgcctgactgggactggagacacgggtgcatcccttgtcaaaacatggaactgtttgcagtactttgcattgagacttctcattacgtcgcgttcgtgaagtacggaaaagatgactccgcgtggctgttcttcgactccatggcagatcgtgacgggggacagaatgggttcaatatcccccaagtgaccccttgcccagaagttggggaatatctgaagatgtctctggaagatttgcattcactagatagccgtaggatccagggctgtgccaggagactcctatgcgacgcctatatgtgtatgtatcagtcccccaccatgagtctctataaatag

SEQ ID NO: 28279 - DNA, 2862 bp, Artificial Sequence
  Description of Artificial Sequence: Synthetic coding sequence
atgtcatctggtctttggtctcaggagaaggtgaccagcccttactgggaagagaggatattttacttactgctgcaggaatgttctgttaccgataagcagacccagaagctcctgaaggtgcctaaagggtccattggccagtacatccaggatagatcggtgggtcattccagaattccatccgcaaaaggcaagaagaaccagataggcctgaagatcctggagcagccccatgcggtcttgtttgtcgacgaaaaggacgtggtggagattaatgaaaaattcaccgaactgctgctcgcaattactaattgcgaggaaaggttctccctgtttaaaaacaggaatcgcctctcaaaaggactccagattgatgtgggttgtccagtgaaagtccaactgcgatccggagaggaaaaatttcctggtgttgtgcgctttcgcggacctctgctcgctgagagaaccgtgtcaggaatcttcttcggcgtcgaactgctggaggagggcagaggccagggatttacggacggggtgtaccagggcaaacagttgtttcagtgtgatgaggactgtggagtttttgtcgctctcgacaaattagagcttatagaggatgatgacactgccttggagtccgactatgctggacccggagatactatgcaggtggaattaccaccgttggagatcaactcccgcgtgagcctgaaagtgggtgagaccatagagagcggaacagtcatattctgtgacgtcctgcccggtaaagagtccttgggttacttcgtgggggtcgatatggataatccgattggaaactgggacggcaggttcgatggtgtgcagctctgtagcttcgcctgcgtagagagtacaattttgctacacatcaacgatatcatcccagaatccgtcacccaggaaaggagaccaccaaagctggccttcatgtcacggggagtgggagataaggggagttccagccataataaacctaaggctacaggcagtacaagcgacccaggcaacagaaatcggagtgagttgttttacacacttaatggaagttcagtagatagccagccacagtctaagtcaaaaaatacctggtacatcgatgaagtcgccgaggacccagccaagtcattgaccgaaatttcgacagactttgacagaagctcacctcccttgcagcctccccctgtcaactctctgactacagaaaacagatttcatagccttcccttttcgctaaccaagatgccaaatacaaacggatcaatcggtcactctcctttgagtctatcagcccaatccgtcatggaagaactgaacaccgcaccagtacaggaatcaccaccgctggcgatgcccccaggtaattcccacggtctcgaagtgggatctctcgccgaggtaaaggaaaaccctccgttctacggcgtgatcagatggatcggccagcctcctggtttgaacgaagtcttagccggacttgagttggaggatgaatgcgcaggttgtacggacgggacttttcgaggcaccagatactttacttgcgctctgaaaaaagcactgttcgtaaagctcaaaagctgtaggcccgacagcaggttcgcatccctccagcccgttagtaatcaaatcgaacgctgcaattccctcgccttcggaggatacttatcggaggtggttgaagaaaatacacctccgaagatggagaaagagggattggagattatgatcgggaagaagaaggggatacaggggcattacaacagttgctacctggactctactctgttttgcttgtttgctttttcttccgtattagacacagtcctcctcaggcccaaggagaaaaatgacgtggagtactatagcgaaacacaggaattactgagaacagaaatcgttaacccccttcgcatatacggatatgtgtgtgccacaaagattatgaaactgaggaagattctcgaaaaagttgaggccgctagcggttttacaagcgaagaaaaggacccggaggagtttttgaatatcttattccaccacattctgcgagtagagcctttactaaaaattcggtccgccggacaaaaggtgcaggactgctacttttatcagatttttatggagaaaaacgagaaggtaggagtccccacaatacagcagctgctggaatggtctttcattaattcgaatctaaaattcgccgaagcaccctcatgcctcatcatccagatgccaaggtttggcaaggatttcaagctgttcaagaagatatttccttcactggagttgaacattactgatttgctggaagatacaccaagacagtgccgcatctgcggaggactcgctatgtacgaatgcagggaatgctacgatgaccctgacatttctgccggaaagatcaaacagttttgtaaaacttgcaacacacaagtgcatttacacccaaagagactgaatcataaatataaccctgtatctctgccaaaggatctgcctgactgggactggcggcatggttgcattccgtgtcaaaatatggaattatttgctgtgttgtgcatcgagacctcccattacgtggccttcgttaagtacggcaaggatgattctgcctggctttttttcgacagcatggcggaccgagacggcggacaaaacggattcaacatccctcaggtgaccccctgcccagaggttggcgagtacctcaagatgtccctcgaggacctgcacagcctggactctcgcaggatacagggttgcgccagacgcctgctgtgtgatgcctacatgtgcatgtatcagagcccaaccatgtcgctttacaaatag

SEQ ID NO: 28280 - DNA, 2871 bp, Artificial Sequence
  Description of Artificial Sequence: Synthetic coding sequence
atgagctctggattatggtctcaggaaaaagtgacttcaccctactgggaagaacggatcttttacctgctgctccaagaatgctctgttaccgataagcaaacccagaagttactaaaggttccaaagggcagtattggccagtatatccaggatagatccgtcggtcacagcagaataccaagtgctaaaggcaagaagaaccaaatcggtctcaaaatcttggaacagccacacgccgtcctcttcgttgatgaaaaggacgttgtggagattaacgagaaatttactgagctacttctggcaatcacgaattgcgaggagcgcttttccctgtttaagaacagaaaccggctgtccaaaggactgcagattgatgtcggctgtcctgtgaaggtccagcttcggtctggagaagagaaattccccggagtcgttcgcttccggggtcctcttttggcagagagaaccgtgtcaggtattttctttggggtggagctcctggaggaaggcaggggccaggggtttaccgatggggtgtaccagggaaagcaattgtttcagtgtgacgaggactgtggagttttcgttgccctcgacaaactagagctgattgaggatgacgacacagccctggaaagcgattatgccggtcccggtgataccatgcaagtggaactgcccccacttgagataaacagccgcgtctctttgaaagtgggtgagacaattgaaagcgggacagtgatcttttgtgacgtcctgcctggaaaggaatcactggggtactttgtgggagtggacatggataaccccatcggaaattgggacgggaggtttgatggggttcagctatgctcctttgcgtgtgttgaatctaccatccttctgcacatcaatgatatcattcccgctgtgagcgagtctgtgactcaagaacgtagacccccaaagctggcattcatgagccggggtgtgggcgataagggcagcagttcccataataagcccaaagcgactggaagcacctctgatcccggtaataggaatcgaagtgaactgttctatactctaaatgggagctcagtggattctcagccacagtcaaaatctaagaatacatggtacatagacgaagtcgctgaggaccccgcaaagtctctcacagaaatttcaacagattttgaccgatccagcccgccactgcaacctccgcctgtcaattctctgacaaccgagaaccgattccactctctacccttctctcttaccaagatgccgaacaccaatggcagcatagggcacagcccacttagcttatccgcccagtccgtaatggaagaactgaatacggcccctgtgcaggaaagcccacctctggccatgcctcctggcaactcacacggcctcgaagtcggaagcctcgcggaagtcaaggagaatcctcccttttacggggtgatccgctggattgggcaaccacctggtcttaatgaggtcttagccggactggagttggaggacgagtgcgcgggatgcactgacggaaccttccgtggcacacgctattttacttgcgcattgaaaaaagccctgtttgtgaaactgaagagctgcagacctgactccagattcgccagcttgcagcccgtgagcaatcaaattgaacgatgcaactcactagcgttcgggggatacctctctgaagtagttgaggaaaacacaccccctaaaatggagaaggaagggctcgagataatgatcggaaaaaaaaagggtatccagggccattacaacagctgttatttggacagcaccctgttttgcctgttcgcattttcaagcgttctggacactgtcctgttgagacctaaggagaaaaacgacgtggaatattactctgagactcaagaactgttgcgtactgagatcgtcaatccactgcggatctacggatacgtgtgcgctacaaaaatcatgaaattacgcaagattctggaaaaagtggaggccgcttcaggctttacaagtgaggaaaaggatccagaagaattccttaatatcctatttcatcatatcttgcgggtggaacctctgttaaagatccggtctgcaggccagaaggtccaggactgctacttttaccagatttttatggagaaaaacgagaaagtgggggtgccaacaattcagcagctgctggagtggagcttcattaatagtaatttgaaattcgctgaggctcctagctgcctcattatacaaatgccacgctttgggaaggacttcaagctgttcaaaaaaatatttccttccctagaactgaacattacggatctgctcgaggacacaccccgacagtgccgaatttgtgggggactggccatgtatgagtgccgagaatgttacgatgaccctgacatatctgccggaaagattaagcagttctgcaaaacatgcaacacacaggtccatctgcaccccaagcgtttgaaccacaagtacaatcctgtgtctcttcccaaggatctgccagactgggactggagacatggatgtattccatgccaaaatatggaactgtttgccgtgctgtgcatagagacttctcattacgtcgcttttgtaaagtatgggaaagacgattcggcctggcttttctttgactcgatggctgaccgcgatggaggacagaatggcttcaacatcccacaagttaccccatgtcccgaagtcggagagtacctcaagatgtctctcgaagatttacactcgcttgatagtcgcaggatccagggctgcgcaagacgactgctatgcgacgcttacatgtgcatgtatcagtctcctaccatgtcgctctataaatag

SEQ ID NO: 28281 - DNA, 450 bp, Artificial Sequence
  Description of Artificial Sequence: Synthetic coding sequence
atggctagatctaatctgccactggcgctcggcctggctttggtggctttttgcctgcttgcgctgcccagagacgcgcgtgctaggccacaggagagaatggtgggagagttgcgtgatctcagcccggatgacccacaagtgcagaaagctgcacaggcagcagttgcttcatataatatggggagcaattccatttattatttccgcgacactcacatcattaaggcacagtcccaactggtcgccggaatcaagtatttcttaaccatggagatgggcagtacagattgcagaaaaactcgggtcaccggggaccacgttgacttaactacatgccccctggctgcaggtgcgcagcaggagaagctccgttgcgatttcgaagtattggttgtcccctggcaaaattcatctcagttacttaaacataactgcgtgcagatgtag

SEQ ID NO: 28282 - DNA, 504 bp, Artificial Sequence
  Description of Artificial Sequence: Synthetic coding sequence
atgctgcctgagaaggctttacacggccaccctcagctgcctcggactgtgcccactagagctgccatgcgggctgccggaaccctgttggcgttctgttgtttagtcctgtcaactactggcggaccatccccagacacttgtagtcaggatcttaactctcgggtgaagcctggatttcccaagaccatcaagacaaatgatccaggggtgctgcaggccgctcggtattctgtggagaagttcaacaattgcaccaatgacatgtttttgttcaaggagagcagaatcacacgcgcactagtccaaatcgtgaagggtctgaaatacatgttagaagtggagattgggagaacaacctgtaagaagaatcagcacttgcgtttggacgactgtgatttccaaactaaccataccctgaagcaaaccttaagctgctacagcgaggtctgggtcgtgccctggttgcagcacttcgaggtccccgtcctacggtgtcactag

SEQ ID NO: 28283 - DNA, 438 bp, Artificial Sequence
  Description of Artificial Sequence: Synthetic coding sequence
atgagggctgctggaaccctgctcgcattctgttgtttggtcctcagcaccacagggggacctagtccagacacatgctctcaggatctgaattctcgagtgaagccaggttttccaaaaacgatcaagacaaacgaccccggagtgctccaggccgcacggtactcagtcgagaaatttaacaattgtacaaatgatatgttcctctttaaggaaagccgtattacacgggcactcgtccagatcgtgaaaggcttaaagtacatgttggaggtcgaaataggtaggacaacatgcaagaagaaccagcatttgcgactagatgactgcgacttccagacaaaccataccttgaagcaaacactgtcctgttattctgaggtttgggtggtaccgtggctgcagcacttcgaagtccccgtgctcagatgccattag

SEQ ID NO: 28284 - DNA, 453 bp, Artificial Sequence
  Description of Artificial Sequence: Synthetic coding sequence
atgctaggagcagcccttcgccgatgtgccgtcgccgctaccactagggctgatccgaggggcctgttgcattcagcgcgaactcccggtccagccgtcgcaattcagtcagtgcgttgttactcccatgggagccaagagacagacgaggagtttgacgctcggtgggtgacctatttcaacaagccggatatagatgcttgggagctgaggaagggcatcaacacgctggtgacttacgacatggtgcccgagccaaagataatcgacgccgcattgcgagcttgccggagactcaacgattttgcttcaacggtgcgcatcctggaggtcgtgaaggataaggctgggccacacaaggaaatttacccctacgttatccaggagttacgcccaacattgaacgagctcggtattagtacgcccgaagaactgggactggataaggtttag

SEQ ID NO: 28285 - DNA, 318 bp, Artificial Sequence
  Description of Artificial Sequence: Synthetic coding sequence
atgggcgatgtggagaagggcaaaaaaatttttattatgaagtgttctcagtgccatactgtcgagaagggcggtaaacataaaactggaccaaacctgcacggactatttgggaggaagactggacaagctcccggatactcatatacggctgctaacaagaacaagggaattatttggggcgaggacacactgatggagtatctggagaacccgaagaaatatattccaggtactaaaatgatatttgtcggcatcaaaaaaaaagaggaacgcgctgacttaattgcctacctaaaaaaagccactaacgaatag

SEQ ID NO: 28286 - DNA, 318 bp, Artificial Sequence
  Description of Artificial Sequence: Synthetic coding sequence
atgggcgatgtggagaagggaaaaaaaatttttataatgaaatgcagtcagtgtcatacagtggaaaagggaggcaagcacaaaacgggaccaaacctccacggcttgtttggtaggaaaacgggtcaggcacccggatattcctatacagctgctaataagaacaaggggattatctggggagaagatactctgatggaatacctcgaaaaccctaaaaaatatatacctgggacaaaaatgattttcgtggggattaagaagaaggaggagagagctgacctcatcgcttatttaaagaaggctactaacgagtag

SEQ ID NO: 28287 - DNA, 318 bp, Artificial Sequence
  Description of Artificial Sequence: Synthetic coding sequence
atgggtgacgtggagaaaggcaaaaagattttcattatgaaatgcagccagtgtcacacagttgagaaaggaggcaagcacaagacaggacccaatttgcacggcttatttgggcgtaagaccggtcaagccccaggatacagctatactgccgcaaataaaaataagggcataatctggggagaagataccttgatggagtacctggagaaccctaaaaagtatatccccggaacaaaaatgatctttgtagggataaagaagaaagaggagagggcagatttgatcgcctacctgaagaaggccaccaatgagtag

SEQ ID NO: 28288 - DNA, 306 bp, Artificial Sequence
  Description of Artificial Sequence: Synthetic coding sequence
atgggagacgttgagaagggaaagaaaatctttattatgaaatgttcccagtgccatacagtggagaaggggggaaagcataaaacaggcccaaatctccatggccttttcggcagaaagaccgggcaggcgccaggatacagttacacggccgcaaataagaacaagggtataatttggggtgaggacactttgatggaatatcttgagaatcccaagaaatatattcctggcaccaaaatgatcttcgtaggcatcaaaaagaaagaggagcgggctgatctgatcgcatatttgaagaaatag

SEQ ID NO: 28289 - DNA, 1632 bp, Artificial Sequence
  Description of Artificial Sequence: Synthetic coding sequence
atgggaacttccctgagcccaaacgatccctggcccctgaatcccttgagcattcagcagaccaccctactcctcttactttctgttctcgcaaccgtccacgtgggccagcggctgctgcggcagagacgcaggcagctcaggtccgctcccccagggccattcgcatggcctctgattggcaatgcggcagctgttggccaggcggcacacctgtcgttcgcccgactggctcgtaggtacggggatgtcttccaaatacgtttgggcagctgccccattgtggtcctcaacggtgaacgggctatccaccaggccctcgttcagcagggctcggcattcgcagacagaccagctttcgctagctttagggtggtgagcggcggacgaagcatggcctttggccactatagtgaacattggaaagttcagcgacgggctgcccactcaatgatgagaaattttttcacccggcaacctcgctcacgacaggtgctggaggggcacgtcctcagtgaggcgcgagagctggttgcgctgctcgttagaggatctgcagatggggctttcttggaccctcggccattgacagttgtggcagtggccaacgtcatgagcgccgtctgttttggatgccggtactctcacgatgacccagaattccgcgagttgctgtcgcataacgaagagttcgggagaaccgtcggcgcaggctcgctggttgacgtgatgccctggcttcagtactttccaaaccccgtaaggactgttttccgcgagttcgagcagctaaacaggaacttcagcaattttatcctggacaaattcttaagacactgcgagtcgctccgccctggtgcagcccctagagatatgatggatgccttcatccttagtgcagaaaagaaggccgctggagactcgcatggaggcggagctcggctggatctcgaaaacgtacccgcaactatcacagacatctttggagcatcacaggacacactcagcacggccttgcagtggctcttattgctcttcactcgatacccagatgtacagaccagggtgcaagcggaattggatcaggtcgtgggccgagatcggcttccctgtatgggtgaccagccaaatctgccgtacgttctggcttttttgtatgaggcgatgcggttctcttcttttgtaccagtgacgatacctcacgccacaacagccaatacctctgtactgggataccatattcctaaagatactgtggttttcgtcaaccaatggtccgttaatcacgatccggtcaaatggccaaacccggagaacttcgatccagcccgattcttggataaggacggattgatcaacaaggacctgacgtctcgcgtgatgatcttctctgtgggaaaacggagatgtatcggagaagagctcagcaaaatgcagctatttctctttatcagcatactggcccatcaatgcgacttcagagctaatcccaacgaacctgcaaaaatgaattttagttatggactcaccattaagcccaagagttttaaggtcaatgtgactttgagagagagtatggaactgctggattccgctgtgcaaaatcttcaggctaaggagacctgccagtag

SEQ ID NO: 28290 - DNA, 1632 bp, Artificial Sequence
  Description of Artificial Sequence: Synthetic coding sequence
atgggtacgagtctcagccccaacgatccatggcctctgaaccctctctccatccaacagactacactcctgttactactgtccgtactggcaacagtacacgtcggccagaggcttctccggcagcgaaggcgtcagctacgctctgcaccccctgggccattcgcttggcctttgattggcaacgctgccgcagtgggccaggccgctcacctaagcttcgccaggctcgctagacggtatggggatgtgttccagatccgtctcggtagctgtccgatcgtagtgctcaatggcgagcgggcaatacaccaggccctggtgcagcagggttctgcctttgccgatcggccagctttcgcaagtttccgggttgtctcaggcggacggtccatggcgttcggtcactactctgaacactggaaagttcagcgaagggccgcacactctatgatgcgtaatttctttacaagacagccccgttctcggcaagtcctggagggacacgtattatcagaggcacgcgagctcgtggcacttcttgtcagaggaagtgcagacggagcatttctggacccgagacctctcacggtagtggctgtggcaaacgtcatgtcggccgtttgcttcgggtgcagatactcgcatgatgatcccgagttccgcgaactgctgtcccataacgaggagtttggtcggactgtgggtgccggaagtttagtcgatgtgatgccatggttgcagtactttccaaaccctgttaggacagtgtttcgcgagtttgagcagctgaacaggaacttctccaatttcattctggacaaatttctgagacactgtgagagtctgcgacccggtgccgctccccgtgacatgatggatgcctttattttgtctgcagaaaaaaaagcagccggagactcccacggaggaggcgcacgtctggatcttgaaaatgtacctgccactattactgatatattcggggcttcacaggacactctcagcacagcactccagtggctcctgctgctgtttactcgctaccccgacgtgcagacccgggtccaggcggagttggaccaggtggtgggaagggaccgactgccatgtatgggggatcagcccaacctgccttatgtgctggccttcttgtatgaagcgatgcgattttcctcattcgtacccgtcactattccccacgctaccacagcgaatacttcagttctgggttaccatattcccaaggacacagtcgtgttcgtaaaccagtggtctgtgaaccacgaccctgtaaaatggccgaacccagaaaactttgatcctgccaggtttctggacaaggacggactcataaataaggatttgaccagtagagtgatgatcttctctgttgggaaaaggagatgcataggcgaagagctctctaaaatgcagctcttcctgttcatatccattctggctcaccagtgcgactttcgggcaaatcccaacgagccagccaaaatgaacttctcttatggtctgaccattaaacctaaaagcttcaaggtaaatgtgactctcagggagagcatggaactgcttgattccgccgtacagaacttacaggcaaaggagacctgccagtag

SEQ ID NO: 28291 - DNA, 3399 bp, Artificial Sequence
  Description of Artificial Sequence: Synthetic coding sequence
atggagcccgacagccttctggaccaggatgattcttacgagtcccctcaggagcgaccaggatctcgccgaagtctccctggatccctcagtgagaaatcccctagcatggagccctcagcagccacgcctttcagagtcactggattcttatctaggagactgaaagggtcgatcaaaaggacaaagagccaaccaaagctcgaccggaaccactcctttagacatattttaccgggattcaggtccgcagcagccgctgccgctgacaatgaacgcagccatttgatgccacgactgaaggagtcacggtcccacgagtctctgctgtcaccatcctcagctgtggaagcgctggacctaagcatggaggaggaggtagtcattaaaccagtgcattctagtatccttggccaggactactgcttcgaagtcaccacatcttccggcagcaaatgcttcagttgccggagcgctgcagagcgcgacaaatggatggaaaacctacgccgagccgtgcatccaaacaaggataattcccgcagggtcgagcacatcttgaagctctgggtgatagaggctaaggacctccccgcaaaaaagaagtacctttgcgaactctgtcttgatgacgtgctctacgcccgaactactggcaaactcaaaaccgataacgtcttctggggtgaacatttcgaatttcataatctcccccctttaaggacagtaaccgttcacctgtaccgggaaacagataagaagaaaaaaaaggaacggaacagctacctggggctggtaagtctccccgcagcttcagtcgctggtagacaattcgtagaaaagtggtacccggtggttacccctaacccaaagggagggaaggggccaggacctatgatccgtataaaggcaagataccagaccataaccatccttccaatggagatgtataaggaattcgcagagcacatcacgaatcattacttgggactttgcgccgcactggagcctattctgagcgccaaaacaaaggaggagatggcaagcgccctggtacacatactgcagagcaccggtaaagtcaaggatttccttaccgacctgatgatgagcgaagtggaccgttgcggggacaatgaacacctgattttccgggaaaatacccttgccaccaaggcaatagaggagtacctgaaattggtgggccaaaagtacctccaagacgccttaggtgaattcattaaggccctttatgaaagtgatgaaaattgtgaggttgatcctagcaagtgctccgccgcagaccttcccgagcatcaggggaacttaaagatgtgttgcgagttagcgttttgcaaaatcatcaacagttattgcgtgttccctcgagagctgaaagaagtgtttgccagctggaggcaagaatgctcgtccaggggaagaccggacatttccgagagattaatctctgctagcctgtttttgagattcctttgcccagccattatgtcaccctctctgttcaatctcctgcaggagtacccagacgacaggaccgccagaaccctgactttgatcgccaaggttactcagaatctggcgaattttgcaaagtttggttcaaaggaggaatatatgagctttatgaaccaatttctcgagcatgagtggacaaacatgcagaggttcctgctagagattagtaacccagaaacactgtctaacactgccggttttgaggggtatattgacctgggcagggagcttagcagtctgcattcacttctgtgggaggcagtgtcccagcttgagcagtccatcgtgagcaagctcggacccctgcctcgcatccttcgcgatgttcacactgctctatccaccccaggctcagggcagttgcccggaaccaatgatctggcctccaccccaggaagtggctctagctccattagcgccggacttcagaaaatggtgattgagaacgacctgtccgggctaattgacttcactaggctgccatctcctacacctgagaacaaggatctcttttttgttactcggagctcaggcgtacagcctagtcctgcccgttccagtagttatagcgaggcgaacgagcccgatcttcagatggcgaatgggggaaagtccctctctatggtggatcttcaggacgccagaactctggatggggaagcaggaagcccagccggtccagacgtcctgcctactgatgggcaggccgcagctgcgcagctcgttgctggctggcccgcaagagctacccctgtgaatctcgctggtctagccactgtgagaagggcgggacagacacccacaacacccggaacttctgagggcgcaccaggcaggccccagttactggcacccttgagttttcagaaccccgtgtatcagatggccgctggcctgcctctgtccccaagaggtctgggagattctggcagcgagggccactcaagtctttcgagccattcaaatagtgaggagctggccgctgctgccaaactggggtcattctcaaccgccgctgaagaactcgccagaaggccgggtgaactcgccagacgacagatgagcctaacagagaaaggtggccaacctaccgtgccaagacagaactctgcaggacctcagcgacggatagaccaaccccctccaccccctccccctccaccacctgccccacgcggtagaaccccgccaaatctgctgtctacccttcaatacccgcgacctagttctggcaccctggcatctgccagcccggactgggtcgggccttccacaaggctccgccagcaatcatccagctcgaagggagattccccagaactgaagcctcgggctgtccataagcagggtccgagcccagtgagtcccaacgctttggataggactgccgcttggttgctcaccatgaatgcacaactgttagaggacgaaggcctgggcccagaccccccacatagagatagactgcgtagtaaggatgaattaagccaggctgaaaaggacctcgccgtgctgcaggataaactgcggatatcaacaaaaaagttagaagagtatgaaactctgtttaaatgtcaggaggagaccacgcagaaacttgtccttgagtaccaggccaggttggaagaaggcgaggagaggctccgccgacagcaggaggacaaagacatccagatgaaaggcatcatcagcaggttaatgagcgtcgaagaggagcttaaaaaggaccacgcagaaatgcaggccgctgtggactccaagcagaagattattgatgctcaggaaaagcgtatcgccagccttgatgcggctaatgcacgactaatgtcagctttgactcagctcaaggaaagcatgcattag

SEQ ID NO: 28292 - DNA, 3198 bp, Artificial Sequence
  Description of Artificial Sequence: Synthetic coding sequence
atgccacggttgaaggagtctaggagccatgagtctcttttgtcccccagctcagccgtggaggccttggatttgtccatggaagaggaagtcgtgatcaaaccggtccacagctccattctgggtcaggactactgtttcgaagtgacgacgtccagtggaagcaagtgcttttcctgtcggagcgcagcagagagggataagtggatggagaatctgaggcgcgctgtgcaccctaataaggataattctaggcgagtcgaacatattttgaagctttgggtaatcgaggctaaggacctacctgctaagaagaaatatttatgcgaactgtgtttggatgatgttctgtatgctcgaaccaccggaaaattgaaaactgataatgtgttttggggtgagcacttcgagttccacaatctgccacccctgcgcactgtaaccgttcacctgtaccgagagactgataaaaagaagaaaaaggaacgcaattcctaccttggcctggtgagcttaccagccgcttccgtggccggaagacaattcgtcgaaaagtggtaccctgtagtaactccaaaccccaaggggggtaagggacctggcccaatgattcgcatcaaggctcgatatcagaccatcacgattctgcccatggaaatgtacaaggagttcgctgagcatatcacaaatcactaccttgggctatgcgcagccttggagcccattctgtctgccaagactaaggaagaaatggcttctgcacttgtccacatcttacagtccacagggaaagtaaaggacttcctgacggatttgatgatgtcagaggttgatagatgcggagacaatgaacatttaatattccgcgaaaacactctggccaccaaagcaattgaggagtatctcaagctggtaggccagaaatacctgcaggacgcattgggtgagtttattaaggccctttacgagtctgacgaaaactgcgaagtggacccatcaaagtgttccgccgcagacctgcccgagcaccaggggaacctcaaaatgtgctgtgagctcgcattctgcaagatcatcaatagctattgtgtcttcccaagagagctcaaagaagtattcgcatcttggaggcaagagtgttcttctcgaggtcgcccagacatttctgagagacttattagtgcttcattgttcctgagattcttgtgccccgctattatgtccccaagcctttttaatctgctgcaggaatatccagatgaccgcacagcacgcacattgaccctgatcgcaaaggtgactcagaatctcgctaatttcgccaaattcgggagcaaagaggagtacatgtccttcatgaaccagtttctggagcacgagtggaccaatatgcaacggttcctgcttgagatatctaacccagagacactgagcaacaccgccggatttgaaggctacattgatctggggcgagaactgagctctctgcattccctcttgtgggaagctgttagtcaattggagcagtctatcgtatccaaactcggcccactgccccgtatcctgagagacgtccacaccgctctgtccacccccggttctggtcagctacctggcacaaatgacctggcgtctaccccaggctcaggatcttcctccatatctgccggactacagaagatggtgattgagaacgacctgagcggactgatcgatttcacccgcttgccctcccctacaccggagaataaggacttattcttcgtaacacggagtagcggggtgcaaccatctccggcaaggagtagttcttattccgaggccaatgagccggatctgcagatggccaacggcggaaaaagtctgtctatggtcgatctgcaggacgctagaactctcgatggtgaggcgggaagccctgccggtcccgatgtgcttcctaccgatggtcaggctgcagccgcacagttggttgctggttggcctgcgagagctacccccgtaaacttggctggcctcgctacagtgaggagagcaggccagactcctaccacaccaggtacatccgaaggggcacctggccgtccgcaactgctcgctcccttgtccttccagaacccagtgtaccagatggctgctggactccccctgtcccctcgagggctgggtgatagtggcagcgaggggcatagcagcctctcaagtcattccaacagcgaggagcttgctgccgctgccaagctgggttcattctccactgccgctgaggagctggcaaggagaccgggtgagctggcaaggcggcagatgtccttaaccgagaaaggcggacaacccacggttcccaggcagaattccgcaggaccgcagcggaggatcgatcagccaccacccccacccccaccccctcctcccgcacctcggggtcgaaccccccctaatcttctgagtaccctgcagtatccacgcccatcgagcggaacattagcgtctgccagcccagactgggtggggccatccactcggctgaggcagcaatcaagttcatcaaagggagatagccctgaactcaaacccagggctgtacataaacaaggaccatcccctgtcagtccaaacgctcttgatagaaccgcagcctggctcttgaccatgaacgctcagttgttagaagacgaaggcttggggcctgatccccctcatcgagacaggctaaggtccaaagacgagctgagccaggccgaaaaggatctcgccgtgcttcaggataagcttaggatttccaccaaaaagcttgaagagtacgaaaccttgttcaaatgtcaggaggaaactacacaaaaactggtcctggaatatcaggccagactggaagagggcgaggagcgactgcgacgccagcaggaagataaggatattcagatgaaggggattatctcacgccttatgtcggtcgaggaggagcttaagaaagatcacgccgaaatgcaggcggcagtagactcaaaacaaaaaatcatcgatgcacaggaaaagcggatagcctcactggacgccgcaaatgcacgccttatgagtgctctgacgcagctgaaggagcggtatagtatgcaggccagaaatgggatctcccctactaatccaacaaagcttcagatcaccgaaaatggcgagttcagaaattcgagcaattgttag

SEQ ID NO: 28293 - DNA, 3210 bp, Artificial Sequence
  Description of Artificial Sequence: Synthetic coding sequence
tcccaaccaaaactcgaccggaaccattcttttcggcacatccttccaggtttccgaagcgcggcagccgctgcggctgacaatgagaggtcccacctcatgcccagactgaaggagagcagaagtcatgaaagcctgctctcaccctcaagcgcggtggaggccttggacctctctatggaagaagaggtcgtaataaaacctgtgcactcatcaatactaggacaagattactgctttgaggtcaccacctcaagtggatccaagtgttttagctgcaggagtgcagcggagagagacaaatggatggagaacctcagacgggcagtacatccaaacaaggacaacagccgcagggtggagcacatcctcaaactgtgggtcattgaggccaaggacctgcctgcaaaaaaaaaatatctgtgcgagttgtgcctagacgatgtgctctacgccagaaccacaggaaagctgaagaccgataatgtgttctggggtgagcacttcgaattccacaacttacctccattgaggactgtcactgttcacctgtaccgggagactgataaaaaaaaaaagaaggagaggaattcgtatcttggcctggtgtctctccctgctgccagcgtggccggaagacaatttgtcgagaagtggtaccctgtggtgacacctaatccaaaaggagggaaaggaccgggacctatgatacggattaaggctagataccagacaattactatcctgcccatggaaatgtataaggagttcgcagagcatatcacgaaccattatcttggtctctgcgccgctttagagccgattctgtcagccaaaaccaaggaggaaatggcctccgccttagtgcatattctgcagtctacgggcaaggttaaggattttctcactgacctgatgatgtccgaagtagatagatgtggcgacaacgaacaccttatatttagagagaacactcttgcaaccaaggccattgaagaatacttgaaactagtgggccaaaagtacctgcaggatgccttgggcgaatttatcaaggcactgtacgagagcgacgaaaactgtgaggtggatcccagcaagtgcagcgctgccgacctccctgaacatcagggtaatctgaagatgtgctgcgagctcgccttttgtaagatcattaattcttattgcgtgttccctcgagaactgaaagaggtgtttgctagctggcgccaggagtgtagcagccgcggacggcctgatattagtgaaaggttaatctccgctagtctatttctgagatttctttgccccgctattatgtcaccatcactgttcaacttgttgcaggagtatcccgacgatagaacagccagaacactgaccctcatcgcaaaggtaacccaaaatctggccaacttcgccaagttcggcagcaaagaggaatacatgtcatttatgaaccaatttcttgagcatgaatggaccaatatgcagagatttttgctggagatatcgaacccagaaacgctcagcaacaccgctggtttcgagggctatatagatcttggtcgggagctgagctcactgcacagcctcctgtgggaggcagtctcacagctggaacagtctatagtctccaaactaggcccactaccacgaatcctgagggatgtccacacagctctgagcacacctgggtcaggtcagttgccaggaactaacgacttagctagtactccagggtccgggagctcctccatcagtgctggcctccagaaaatggtcatcgagaatgacctgtcgggcttgattgactttacccgcttaccttctcctacaccagaaaataaggatctgtttttcgtgactcgcagttccggagtccagccgtcaccagccagaagttcctcttactcagaggcaaacgagcctgatcttcagatggccaatggaggcaaatcattatcgatggtggaccttcaggatgccagaacactggatggggaggcagggagtccagccggtcccgatgtcttacctacagatggacaggcggcagccgcacagcttgtagctgggtggcctgctcgggcaacaccggttaatctggctggcttagccactgtccgtagggccggacagactccgaccaccccaggcacaagcgagggcgcaccgggaaggccccagctgcttgccccactttcctttcaaaaccctgtgtaccagatggctgcaggtcttcctctgagcccccgaggtttgggcgatagcggctcagagggccatagttcactgagctcgcatagtaactcagaagaacttgctgctgccgcaaaacttggatcttttagtacagccgcagaagagttagcccgtaggcccggagaactcgcacgaaggcagatgtcgctgacagagaaaggtggacagcctactgtgccccgtcagaattccgcagggcctcagagaaggatcgatcagccacctccgcctcccccaccccctcctcccgctcccagaggtcgtactcccccaaatctcctgagcacattgcagtacccaaggcccagcagcgggaccttggccagcgccagccctgattgggtcgggcctagcacccggctgcggcagcagtcatcatctagcaagggtgattcccccgaacttaagcctcgtgccgtgcataaacaaggcccatcgcctgtgagccccaatgcgttggacaggacagcagcctggttactcaccatgaatgcccaactcctggaggacgagggacttgggcctgatcctccacatcgcgatcggctgcggtctaaggacgaactcagccaggcagaaaaggacctcgcagtcctacaggataagctcagaatctccactaagaagctcgaagaatatgagaccctgttcaagtgccaggaggagactacccagaaattggtcctcgagtaccaagcccgtctggaagaaggggaggaacggctacggcgacagcaagaggacaaggatatccagatgaaaggcattattagccgtctcatgtccgtcgaggaagagctcaaaaaggatcacgctgagatgcaggccgctgttgactcaaaacagaaaattatagacgcccaggaaaagcgaattgcttccttggacgcagccaatgcacgcttgatgagcgccctgactcagctcaaggagagtatgcattag

SEQ ID NO: 28294 - DNA, 876 bp, Artificial Sequence
  Description of Artificial Sequence: Synthetic coding sequence
atggagcctgattcattgctggatcaggatgactcttatgagagtcctcaggagcggcctggtagccgccgtagtctgccaggaagtctgtcggagaagtcaccatcgatggaaccctccgctgccactcctttccgcgtcactgggttcctctctaggcgactcaagggttctatcaagcgcactaaaagccagccaaaactggacagaaaccattccttcagacacatccttcccggattcaggtcagcagccgcagccgctgcagataatgaacggtcccacctgatgcctagacttaaggaaagtaggagtcatgaaagcctgctctctccctctagtgctgtcgaggcacttgacctgtccatggaagaggaagtggtgataaagccagtgcactcgtcaatcttgggacaggattattgcttcgaggtaacgacctcctctggtagtaagtgtttctcctgtcgctccgctgccgagcgggataaatggatggaaaatttgcggagagccgtgcatcccaataaagacaacagtaggcgggtagaacacatcctgaagctgtgggtgattgaagctaaggatctgcccgcaaaaaaaaaatacttatgtgaactgtgcctggacgatgtgctgtacgccagaactaccgggaagcttaagactgacaacgtgttttggggtgaacactttgaattccataacttgccacctctgagaaccgtgactgtgcacctctaccgcgagactgataagaaaaagaaaaaggaaaggaactcctatctgggattagtttcacttccggcagcctctgtggcagggcgacaattcgtggaaaagtggtatcctgtggtgaccccaaaccctaaatag

SEQ ID NO: 28295 - DNA, 3570 bp, Artificial Sequence
  Description of Artificial Sequence: Synthetic coding sequence
atgtcggcgggaggtagcgcaaggaagagtactggcagaagttcttattattatcggctactgaggcggccaagactgcagcgccagcgcagtaggtctagatcacggaccaggcctgcacgtgagtctccacaagagcgtccaggatcacgtaggagtttgcctggatccctctccgagaagtcccctagcatggagccttctgcggctacgccattccgggtgaccgggtttctgagccgtcgcctgaaaggctctatcaaaaggaccaagtcgcagcctaagctcgatagaaaccattcattcaggcatattcttccagggtttcgctctgctgccgctgccgctgcggataatgaacgatcccacttgatgcctaggctcaaagagagccggagccacgaatctttactgagtccctcttctgcagtcgaggctctggacctgtcaatggaggaggaagtggttataaagccagttcactcgagcatcctcggacaggattactgcttcgaagtcactacctcaagcggctccaagtgcttttcatgccgcagtgcggctgagcgagacaagtggatggagaacctgaggagggcagtacaccccaacaaagataattcccggagggtggaacacatcttgaaactgtgggtgattgaagctaaggatttgcccgcaaagaaaaaatacctgtgcgagctctgcctcgacgatgtgctttacgccagaaccactggtaagctcaagaccgataatgttttttggggcgaacacttcgaattccacaacctgccccctttacggaccgttacagttcacctgtatagggagacagataagaaaaagaaaaaggaacgcaattcctacttgggactggtcagcctgcctgccgcaagcgtcgccggtaggcagttcgttgagaagtggtatccggtcgtcactcctaacccaaaggggggtaaaggcccaggtcctatgatccggatcaaagccaggtaccagaccattaccattttgcccatggaaatgtataaagaatttgccgaacatatcacaaaccattacctgggcctgtgtgccgctctggaaccaatcctcagcgccaaaactaaggaagaaatggcttccgctctggtgcacattctgcagtcaaccggaaaggtgaaggacttcctgactgacctcatgatgtcagaggtggatcgctgtggtgataacgagcacctaatcttccgcgagaacacactcgctactaaagccatcgaggaatatctgaaactggtagggcagaagtatcttcaggatgcattaggggagtttattaaggctctctatgaatctgacgagaactgtgaggtggatcctagcaaatgtagtgctgcagatttgccagagcaccagggcaatctaaagatgtgctgtgagctcgcattctgcaaaataatcaattcttattgcgtgttcccacgggagctaaaagaggtctttgcgagttggagacaggaatgttcatcccgcggacgcccagatatcagcgaacgcctgatcagcgcatcgttgtttttaaggtttctatgcccagcaatcatgagtccatctctgttcaacctcttacaggagtatccagacgatcggacagccagaacactcaccctgatcgcaaaggttacccagaatttagccaatttcgccaagttcggcagtaaagaagagtacatgtctttcatgaaccagtttcttgaacatgagtggaccaacatgcagagattcctgctggagatctcaaaccccgagacgctgtccaacaccgccggatttgagggctatatagatctgggacgggaactgagtagcctacactcccttctgtgggaagctgtctcccagctcgagcagagcattgtttcgaaactcggacccctgcctcgaatcctccgggacgtgcacaccgcactttcaaccccaggaagtggccagctgcccggtactaacgatctggctagcacacctggatctgggagttccagcatctctgctggtttgcaaaaaatggttattgaaaacgatctaagcgggctgattgattttacacgactgcccagtcctacaccagagaataaggacctattcttcgttacgaggtcttccggtgtgcagccctcgccagctaggtcatctagctactcagaagctaatgagcctgatctgcagatggctaatggcggtaagtccctgagcatggtcgacttgcaggatgctaggaccctggacggtgaggccggaagtcctgcgggacccgatgttcttcctaccgatgggcaggcggcagcggcacaattggtggcagggtggcccgcaagggctacccccgtgaatctggctggattggccacagtgcgcagagccggacagaccccaacgacccccggtaccagtgaaggggcaccagggaggcctcagctgcttgcccctctgtctttccagaatcccgtctaccaaatggccgctgggctccccctgtcccctcgcggtctgggtgactcgggctcagagggacactcctccctcagctctcacagtaatagcgaagagctcgccgctgcagccaaactgggctcattttcaacagccgctgaagagctggctcgcagacctggggagcttgccagacggcagatgtcactcacagagaaaggcggtcaacctaccgtgcccaggcagaattcagctgggcctcagagacgcattgatcagcctccaccacccccaccccctcccccaccagccccaagagggcgaactccaccaaacctgctgtcaacactccagtatcccagaccctccagcggaacgttagctagtgcctcccccgattgggtcggaccctccaccagattacggcaacagtccagctcaagcaagggggacagtcccgaactcaaacctagggccgtgcacaagcaggggccaagccccgtaagccccaatgctctcgatagaacagctgcatggttgctgaccatgaacgcgcaactgctcgaggacgagggactggggcctgatcctccccatcgagatagactacgatctaaagacgagctgagtcaggccgagaaggacctggccgtcctgcaggataaactgcggattagcacaaagaagctggaagagtatgagaccctcttcaagtgccaggaggagacgacacagaaactggttctcgagtaccaagcgcgactggaagagggcgaggagcgcctgcggagacaacaggaggacaaggacatacagatgaaagggattatctccagactgatgtcagttgaggaggagctgaaaaaggatcatgcagaaatgcaggcagcggtcgatagcaagcagaaaattattgacgcgcaggagaagaggattgccagcttagatgcagctaatgcgcgactgatgagcgccctgacccaactcaaagaaagatactccatgcaggccaggaatgggatctccccgaccaacccaaccaagcttcagatcactgaaaatggggaattccgcaactcatccaactgctag

SEQ ID NO: 28296 - DNA, 690 bp, Artificial Sequence
  Description of Artificial Sequence: Synthetic coding sequence
atgccacgactgaaggagtctaggtcgcacgagagcctcctttcaccaagttctgccgttgaggctctggatctgagcatggaagaggaagtcgtgatcaagcctgtccattccagcatactagggcaggattactgtttcgaggtaactacaagctccgggagcaagtgtttttcctgcaggtcagcagcagagcgggacaagtggatggagaacctgcggagagcagtgcaccctaataaggacaatagccgaagggtcgagcatattctgaaactgtgggtgatagaggcgaaggatctgcccgcaaagaaaaaatacctgtgcgagctgtgcctggacgacgtgctatatgctcggactaccggtaagctgaagaccgacaacgtgttctggggcgaacattttgaattccacaatctaccaccactgcgcactgtgacagttcacctctaccgcgaaacagacaagaaaaaaaaaaaggaaaggaactcttatttggggctggtgtcactgcccgctgcctctgtggcgggacggcagtttgtcgagaagtggtatcctgtggtcacccctaaccctaagggaggaaaggggccaggaccgatgatcaggatcaaggcacgctatcaaactatcacaatcctacccatggagatgtacaaggagttcgccgagcacattacttag

SEQ ID NO: 28297 - DNA, 3423 bp, Artificial Sequence
  Description of Artificial Sequence: Synthetic coding sequence
atgagctacaattatgtcgttactgcccaaaagcctaccgcagtcaacggatgcgtcaccgggcatttcacatccgctgaagatttaaacctactcattgccaaaaacacgcggctggagatttacgttgttactgctgaaggtctgcggcctgtgaaggaagtgggaatgtacggaaaaatcgcggtgatggaacttttccgcccaaagggcgagtccaaagatcttctttttatcctgaccgcaaaatacaacgcatgcattctcgaatacaaacagagtggagagagcatcgatatcattacacgtgctcatggaaacgtgcaggacaggataggtcgtccatctgagaccggaattatcgggattatagatcctgagtgtcggatgatcgggttacggttgtacgatgggctcttcaaggtaatcccactggaccgagataataaggagctgaaagcatttaatatccggctggaagagctgcacgtaatcgacgtgaagttcctttatggttgccaggctcccacaatttgttttgtatatcaagatccccaggggaggcatgtcaagacctacgaagtttctctgcgcgagaaggagttcaataaaggaccttggaagcaggagaacgttgaggcagaagctagtatggtgatcgccgtgcctgagccatttgggggtgccattattattggtcaggaatcaatcacgtatcacaacggggataagtacttagccatagcgccacccatcatcaaacagtccaccatcgtctgtcacaatagggtggatcccaacggttcacggtatttactgggagatatggaggggcgtctctttatgctgctgctggagaaagaggagcagatggacggcaccgtcactttgaaggacctccgagtcgaactcctgggagagacctctattgccgagtgcctcacgtacttagataacggggtcgtgttcgtcggctctagactaggagactcacagctggttaaactgaatgttgacagtaacgaacagggcagctacgtcgttgcaatggagacgtttactaatctaggcccaatagtggatatgtgtgtggtggatttagagcgacaggggcagggccagctggtgacctgtagcggtgcttttaaggaaggttctctaagaataattagaaatggtattggcatccatgagcacgctagcattgatctgcccggaatcaagggactgtggccacttagaagtgatcctaatcgggagaccgatgacacgttggtactctcctttgtgggacagacacgggtcctcatgctgaacggcgaggaagtggaggaaacagagctcatgggcttcgtggacgatcaacagacgttcttctgcggtaatgtcgcacatcagcagctcattcaaataaccagcgcttccgtgcgtctggtgtcacaggaacccaaggccctggtcagcgagtggaaggagccccaggcgaagaatatctcagtcgctagctgcaattcaagccaagtggtggttgccgtgggcagagccttgtattacctgcaaatccatcctcaggagctgcgtcagatttcacatacagagatggagcacgaggttgcctgtctggatatcactccccttggcgactccaacggcttaagccctctctgtgccattggcctctggaccgatatctccgcaagaatcctcaaattgcccagctttgagctcctccacaaggagatgctcggaggagaaattatacctcgttcaattttaatgacaaccttcgaatcatctcactacctactgtgtgctctgggcgacggggctcttttttacttcggcttgaatattgaaacgggactgttatccgataggaaaaaggtcacgctgggaactcagccaaccgttctgcgaacttttcgaagtttaagcacgaccaacgtcttcgcgtgcagcgatcggccaaccgtcatttactcgtcgaaccacaagttagttttttccaatgtcaacctcaaagaggtaaactacatgtgccctcttaatagtgatggataccccgacagtctggccctggccaataattcaactctgaccataggaactatcgatgaaatacaaaagctgcacattcgtacagtgcccttgtatgagtcgcccaggaaaatatgctatcaggaggtgagtcagtgttttggggtgctgagctctagaatcgaggtgcaggataccagtggtggaaccactgctctgcggccaagtgcgagcacacaggccctgtcttcctcagtttcatccagcaaattatttagctcttcaactgcaccacatgagacatcattcggtgaggaggttgaggtgcataatctgctgattatcgatcagcacaccttcgaggtccttcacgctcatcagtttttgcagaacgaatacgctctgagcctggtatcttgtaaactcggaaaggacccgaacacatactttattgtggggaccgccatggtttatccagaggaggcggagcccaagcaaggtaggatagttgttttccagtacagcgatggcaagttacagactgtggccgagaaggaggtgaaaggagccgtgtactcaatggtagaattcaacggaaaattgctggcttccatcaatagtactgtccgcctctacgagtggaccaccgaaaaagagctccgtactgagtgcaaccactacaataacattatggcgctgtacctgaagacgaagggggatttcatcttggtgggcgatttaatgcgtagtgtgcttctgctggcatacaaacccatggaaggcaatttcgaggagatcgctcgagatttcaaccctaattggatgtctgcagttgagattttagatgatgacaacttcctcggtgcagaaaacgcttttaatctattcgtctgtcagaaagactctgcagcaacgaccgatgaagagcgacagcatctccaggaggtcgggctcttccatctgggagagtttgtgaatgtcttctgtcatgggtcactggtgatgcagaacttgggtgaaacctctacccccactcaggggagcgtcctattcggcacggtgaacgggatgatagggttagtgacatctttatccgaaagttggtataatcttcttttggatatgcaaaatcggcttaataaagtgatcaagtccgtcggtaagatcgagcactcattttggaggtcttttcacacagagagaaaaaccgaaccagccactggcttcattgacggcgacttaattgaatctttcctggatatttcccgcccaaagatgcaagaagtcgtggccaatcttcagtacgatgatgggagcggaatgaagcgcgaagccactgccgacgatctgattaaggtcgtggaggaattaactcgcatccattag

SEQ ID NO: 28298 - DNA, 1356 bp, Artificial Sequence
  Description of Artificial Sequence: Synthetic coding sequence
atgagctacaattacgtggtgaccgctcagaagccaaccgcagttaacggctgtgtgaccgggcacttcacatcagccgaagatctgaatctgttgatcgcgaaaaatacaaggctcgagatctacgttgtaacagctgagggtttacgccctgtgaaggaggtaggaatgtacgggaaaattgccgtcatggaactgttccggccaaaggccttatcttcttcagtgagtagttccaagttgttcagtagctctacggcccctcacgaaacatccttcggagaagaagtggaggtgcataacttgctcattattgatcagcataccttcgaggtactgcacgcccaccagtttctgcagaatgagtacgcgctctcactggtaagctgtaagctggggaaagatccaaatacttactttatagtcggcacggcaatggtgtaccctgaagaggctgagcctaagcagggacgaattgtcgtatttcaatacagtgacggtaagctccaaactgtagcagaaaaggaggtaaagggagcggtctacagtatggtagagttcaacggaaagttgttggcctcaatcaattctactgtacgcctgtacgagtggaccaccgagaaggagctccgcacggaatgtaatcattacaataacataatggccctgtacctcaagaccaaaggagacttcatacttgtgggagatctcatgcgcagtgtcctgctccttgcgtacaagcccatggaggggaatttcgaagagattgctagagacttcaaccccaattggatgagcgctgtagaaattctcgacgacgataacttcctgggtgctgagaacgcctttaacctatttgtgtgccagaaggattctgccgcaactaccgacgaggagcgacaacaccttcaagaagtggggctgttccatttaggtgagtttgtgaatgtcttttgccacggctctctggttatgcaaaatctgggggagacctccacacctactcaaggatccgtgctcttcggaaccgtgaacggcatgattggcctcgtcacgtccctgtcagagtcgtggtacaatttgctcctggatatgcagaatagactgaacaaggtcattaagagcgtcggtaaaatcgagcacagcttctggcgttcctttcacaccgaacggaagactgaaccagctacgggattcatcgacggcgacctgattgagtccttcctggatattagccgcccaaagatgcaggaggtcgtcgctaacctccagtacgacgacggctcgggtatgaaacgggaggctactgcagatgacctcattaaggtggtggaggagctgacgagaattcattag

SEQ ID NO: 28299 - DNA, 441 bp, Artificial Sequence
  Description of Artificial Sequence: Synthetic coding sequence
atgtcgtacaactatgttgttacggcccaaaagcctactgccgtgaacgggtgtgtgaccggccacttcacgagcgccgaggatctgaatctgttgattgcgaagaatacgcgcctcgagatttatgtggtcacagctgaagggctgcggcctgtaaaagaagtgggcatgtacggtaagatcgcagtcatggagctgtttaggccaaagggagagtcgaaagaccttctgttcattcttacagccaagtacaatgcctgtatcctggagtacaagcagagtggcgaaagcattgatattattacgagggcgcacggcaacgtccaggaccggattggacgccctagtgaaacaggcatcattggaataatagaccctgagtgccggatgatcgggttgagactgtatgacggactcttcaaggtgatccctcttgattag

SEQ ID NO: 28300 - DNA, 330 bp, Artificial Sequence
  Description of Artificial Sequence: Synthetic coding sequence
atgagttacaattatgtggtgacagctcagaagcccacagccgtgaatgggtgtgtaaccgggcactttacctcggccgaggaccttaacctcttgattgcgaaaaacacgagactggaaatatacgttgtgaccgccgaagggctgcgccctgtgaaagaggttggcatgtatggtaagatagcagtcatggagctctttcgccctaagggcgagtctaaagatttattgttcatcctgacggcgaaatacaatgcctgtattctggaatacaaacagtccggtgagagcattgatatcatcactagagcccatgggaacgtacagtag

SEQ ID NO: 28301 - DNA, 1284 bp, Artificial Sequence
  Description of Artificial Sequence: Synthetic coding sequence
atggccccaaaaaagaggcccgagactcaaaagaccagtgagattgtgctcagaccaagaaacaagagatccaggtccccactcgagcttgaacccgaggcgaagaagctgtgcgcaaaggggtctggcccttccagaaggtgtgattcagactgtttatgggtgggactggccggtcctcaaatcttacctccttgccgctctattgttaggacgctgcaccagcacaaactcgggagggcgtcatggccttctgtgcagcagggcctgcagcagtcttttcttcacaccttggactcgtataggatcctccagaaagccgcaccctttgacagaagagcgacctctctcgcttggcatcccacccatccaagcactgttgcggttggcagtaagggtggggatataatgctctggaacttcggaattaaagacaagcccactttcatcaaaggcatcggggctggcggaagcataaccggacttaaatttaatcctctgaacaccaaccaattttacgcctcctccatggaaggtaccacgagactgcaggactttaaaggcaatatcctgcgggtattcgcatcttcagatacaattaatatctggttctgttctctggacgtatcagcctcttctcgcatggtcgttaccggtgataacgtaggaaatgtgatcttgctcaacatggatggcaaagaactgtggaatctcagaatgcacaagaagaaggtgactcatgtggcattaaatccctgctgtgattggttcctggccactgcatccgtggatcagacagtgaagatttgggatctcagacaggttagagggaaggcctcattcctgtacagtctgccacaccggcatcccgtgaacgccgcatgctttagcccagacggagctcgcttactcacaacagaccagaagagtgagatccgggtgtattcagccagtcagtgggactgtcccctgggcttaatcccccatccccaccgccattttcaacacctgactcccattaaagctgcttggcatccacggtacaatttgatcgtggtggggaggtaccctgacccaaactttaagtcatgcacaccatacgaattacgtaccatcgacgtgttcgacggcaacagtggtaagatgatgtgccagctatacgatccagagtcgtcgggaattagtagcctaaacgagttcaaccccatgggcgatacactagcgagtgcaatggggtatcacattctcatttggtcccaggaggaggcgagaaccagaaagtag

SEQ ID NO: 28302 - DNA, 717 bp, Artificial Sequence
  Description of Artificial Sequence: Synthetic coding sequence
atggcaccaaaaaagagacctgaaactcagaaaacttcagagattgttctgagacctcgaaacaaacggtccagaagcccactcgaactcgaacctgaggccaagaagttatgtgcaaaagggtccgggccttccagacggtgtgattcggattgtctttgggttggccttgctgggcctcaaatccttccgccatgtaggtccatcgttcgaaccctgcaccaacataaactggggagggcttcgtggcccagcgtgcagcaggggctgcagcagagtttcttgcacaccctggactcctacaggatcctacagaaggctgctcctttcgatcggagggcaaccagtttagcgtggcaccctactcacccttctacagttgccgtcggaagcaagggaggtgacataatgctctggaactttggcattaaggacaaacccacatttattaaaggcgctgcatggcacccgaggtacaatctgattgtcgtgggtagatatcccgaccccaactttaaatcatgcactccctatgaacttcgcaccattgatgtctttgacggcaatagtggcaagatgatgtgccagctctatgaccctgagagtagcggcatctccagtctcaacgaattcaacccgatgggagataccctggcaagcgcaatggggtatcacatactcatctggagtcaggaggaagccaggactcgcaagtag

SEQ ID NO: 28303 - DNA, 735 bp, Artificial Sequence
  Description of Artificial Sequence: Synthetic coding sequence
atggccccaaaaaagagacccgagacacagaaaaccagtgagatcgttcttcggcctcgaaataagcggagtcgatcccccctggagttggagcccgaagccaaaaaactgtgtgctaagggaagcggaccctcacgtcggtgcgactctgactgcttgtgggttggcttagcaggccctcagatactgcccccttgccggtcaattgtgcgcacactgcatcaacacaaactgggccgagcttcttggccctctgttcagcagggcctacaacaatcatttctccatactcttgactcctatagaatcctgcagaaggctgcaccattcgacagacgcgcaacatcactggcctggcaccctactcacccttctactgtcgcagtgggttccaagggaggagatatcatgctgtggaactttggcatcaaggacaagcccacattcattaaagggataggggcaggcggaagcataaccggactgaaatttaaccccctgaataccaaccaattttacgctagttccatggagggcacaacgcgcctccaagattttaaggggaatatcctcagagtttttgcctcttccgatacaatcaacatctggttttgcagtctagacgttagtgcctcttcaaggatggtcgtgactggcgataatgtgggcaatgtaattctgttaaacatggacggcaaagagttggtgagcgtccccatggaaccagggtcttag

SEQ ID NO: 28304 - DNA, 1092 bp, Artificial Sequence
  Description of Artificial Sequence: Synthetic coding sequence
atggctcccaaaaaaaggccagaaactcaaaagaccagtgaaatcgtgctgcgccctaggaataagcgatctcgctcacctctcgaactggaacccgaggcaaaaaagctttgtgcaaaaggtagcggtccctcacgcagatgcgactctgactgcctgtgggttgggctcgctggacctcagattctgcccccttgtaggagtatagtgcggacgttgcaccagcataaactcggacgggcttcctggcctagcgtacagcagatcggagccggtggatctatcacaggtctcaaatttaatcccctgaacactaatcagttttatgcaagcagcatggaaggaaccactaggctgcaggactttaaaggaaacattctccgcgtgttcgcctcatctgataccattaacatctggttctgttcactagatgtttcggccagttccagaatggtggtgactggtgacaatgtgggcaacgtaatcttgttgaacatggatgggaaggaactttggaatctaaggatgcacaagaagaaggtgacccacgtggctcttaacccctgctgtgattggtttctggctactgcttccgtagaccaaacagtcaaaatctgggaccttcgtcaagtgagaggcaaggctagcttcctgtatagtttaccccataggcacccagtgaacgccgcatgttttagcccagacggggctcggcttttgaccactgaccagaagtcggagatccgagtgtattccgcgtctcagtgggattgcccactgggcctgatcccccacccacaccggcactttcaacatttgaccccgattaaagcagcatggcatcctcggtacaacctcatcgttgtcggacgatacccagatcccaacttcaagagctgcaccccttatgagctgcggaccatcgatgtgttcgacgggaatagcggaaaaatgatgtgccagctgtatgaccccgaatcctcaggaatatcctcattaaatgaatttaatccaatgggagacacacttgctagcgcgatgggctatcacatcttgatttggagtcaggaagaagccaggacccgcaagtag

SEQ ID NO: 28305 - DNA, 1119 bp, Artificial Sequence
  Description of Artificial Sequence: Synthetic coding sequence
atgtccgaggccggagaggcaaccaccacaaccactacgaccctgccccaagcaccaaccgaggcggcagccgcagcacctcaggaccctgctcccaagagtcccgtagggtctggagctccacaggccgctgctcctgcgccagccgcacacgtcgctggcaacccaggaggcgacgccgctccagccgcaactggcaccgccgcagccgcatccctcgccacagcagctggatcagaggacgctgaaaagaaggtcctcgcaactaaggtcctcggaaccgtgaaatggttcaacgttagaaatggctatggattcatcaataggaatgacaccaaagaggatgttttcgttcaccagacggccataaagaaaaacaacccccgaaagtatctgcgctccgtgggggatggggagactgtagagtttgacgtggtggagggagagaagggagcggaggcagcaaatgtaactgggccagatggtgtgcccgtcgaaggcagccgttatgcagccgacaggcgaaggtaccgccgtggctactatggccgaagacgaggcccacccagaaactacgccggtgaggaggaggaagagggctctggatcaagcgagggcttcgacccacctgctacagatcggcagttcagcggcgctcgaaatcagctgcgacgtccacagtatcgccctcaatatcgtcagcgtcggtttcccccttatcacgttggacagacattcgatagacgctcacgggtgctgccccaccccaaccgaattcaggccggtgaaatcggcgagatgaaggacggggttcccgagggagcgcaactccagggacctgtgcatagaaacccaacttatcgaccgagatacaggtctcgcggtcctccgaggccaaggcctgcgccagctgtcggggaagcggaagacaaagagaatcagcaggctacttccgggccaaaccaaccgtctgttagaagaggctatcggaggccctacaactacagacgtcgcccaagaccccctaacgcaccttcgcaggacgggaaggaggcgaaggccggagaggcaccgactgaaaacccggctcccccaacacagcagtcttcagcagaatag

SEQ ID NO: 28306 - DNA, 867 bp, Artificial Sequence
  Description of Artificial Sequence: Synthetic coding sequence
atggcaaacgaaacccagaaggtaggagccatccacttcccttttccgttcacaccttattcaatccaggaagattttatggccgaactgtacagggtcttagaggccggtaagataggtatttttgagtcacccacaggcaccggtaaatcactctctctgatctgtggtgccctctcgtggctgagggatttcgagcagaagaaaagggaggaggaagcacgcctactggaaactggtacagggccactgcatgacgagaaagacgagtctctgtgcctgtcctcgagctgcgagggggctgcaggcactcccaggcccgctggtgaacctgcgtgggttacacaatttgtacaaaagaaggaggaacgggaccttgtggacagactgaaagccgaacaagctaggagaaaacaaagagaagaacggctccaacagctccaacaccgggtgcagttaaagtatgctgctaaacggctgagacaagaggaggaggagcgcgaaaatctgctgcgtctctcccgcgaaatgctggaaactggacccgaagctgaaagactggagcagcttgaatccggtgaggaggaactggtcctcgccgagtatgaaagcgatgaggaaaaaaaagttgcttctcgcgcaccctctgacgccacatcaagcaggcacccccctgatgcaagcttccccgcagccctgaactttttacagcggactagaccaagcagcgtgctgtcggaagatttactgatgcagcgtgctgtcgccaaacaccccgctttgttgccgtggcagatgagttcctctccactccggcctggcagcgagtggatgcgcatgcgcatgacttggcggaagaacacatag

SEQ ID NO: 28307 - DNA, 2571 bp, Artificial Sequence
  Description of Artificial Sequence: Synthetic coding sequence
atggccaacgaaacccagaaagtaggcgcaatccatttcccctttcccttcacgccttatagcatacaagaggattttatggctgaactttacagggtgttggaagccggtaaaatcggaatctttgagagtccaaccggcaccggcaaaagcttaagtctgatttgcggcgcactgagctggctcagggacttcgagcaaaagaaaagggaagaagaggctagattgctggaaactggcacaggccctctccacgacgaaaaagatgaaagtctgtgcttgagttcttcttgcgagggggctgctgggacaccccgacccgcaggcgagcccgcttgggtcacccagtttgtccagaagaaggaggaacgagacctggtggacagactaaaggccgagcaagcacgcagaaagcagagagaagagaggctccaacagctgcagcaccgcgttcaactcaaatacgcagccaaaaggctgcggcaagaggaggaagagcgcgaaaacctccttcgattgagcagagagatgctggaaacgggtcctgaagccgagagactggaacagctggaatcaggggaggaagaattagttttggctgagtatgaatcagatgaagagaagaaggtggctagccgggtggacgaagacgaagacgatctggaggaggaacatattaccaaaatctattactgctctagaacccacagccaactcgcccagttcgtgcacgaagtgaagaagtctccttttggtaaggacgtccgtttagtatctctcgggtcacgtcagaatctctgcgtcaacgaggatgttaagtccttggggtctgtgcagcttatcaatgataggtgcgttgacatgcagcgcagcagacatgaaaagaaaaaaggcgctgaagaggaaaaacctaagcggagaagacaggaaaaacaggcggcttgtcccttctacaatcacgaacaaatggggctcctcagagacgaggccctggccgaagtgaaagacatggagcaactccttgccctggggaaggaagcacgggcatgcccctactacggatctagactggctattcccgcagcgcaactcgtggtattgccgtatcaaatgctcctgcacgccgcaacccgccaagcagccggaatcaggctccaggaccaagtggttattatcgatgaagcacataatctgattgatacaatcactgggatgcatagtgtagaagtgagtggatctcaactgtgtcaggcccactcccaactcttgcagtacgtagaaagatatggaaaacgcctgaaggcaaaaaatctcatgtatcttaagcagatcttgtacttgctcgaaaagttcgtcgccgttctgggcggaaacattaaacagaatccgaacacacagagccttagtcagacaggcactgaactaaaaacaatcaatgactttctgttccagagccagattgacaacattaatctgtttaaagttcagagatattgtgaaaagtctatgatttctagaaaactctttgggttcacagagagatatggggcagtctttagctcccgggaacagcccaagcttgcgggatttcagcaattcttacagtcactccagccccgtacaacggaggcactcgccgctcccgctgatgaaagccaggctagcactttgcggccagcttcccccctgatgcatattcagggctttctagccgctttgaccaccgccaatcaagatgggcgtgtgatcctgtcacgtcaaggcagcctcagccagagcacccttaaattcttattattgaaccccgctgttcacttcgctcaggtggtgaaagagtgccgggcagttgtgatcgccggtgggactatgcagccagtaagcgacttcaggcaacagctgcttgcctgtgcgggagtcgaggccgagcgggttgtagagttcagctgcgggcacgttataccacctgacaatattctgcctctggtaatctgttccggcatttcaaatcagcctctggaattcacattccaaaagagagagctgccccagatgatttttcaggaaccaaagtcggcccaccaggtcgaacaggtgttgctcgcatatagccgatgcatccaagcatgcggtcaggagcggggacaggtgaccggggcacttttgctgtcggtggtgggcggtaagatgtccgagggtataaatttcagcgataatttgggaagatgcgtcgtgatggtcgggatgcccttcccaaatatcaggagtgcagagcttcaagagaagatggcatacctggatcagaccctgcccagggcccctggacaggcgcctcccggtaaggctctcgtcgagaacctctgcatgaaagctgtgaatcagtctattgggagagccattcgccatcaaaaggattttgcctccgtggtgctgctcgatcagaggtatgcccgacctccagtccttgccaagctgccggcatggattagggcaagggtcgaggtgaaggctactttcggaccagccatcgccgcagttcaaaagttccatagagagaagtccgcgtcttcttag

SEQ ID NO: 28308 - DNA, 1671 bp, Artificial Sequence
  Description of Artificial Sequence: Synthetic coding sequence
gaggaagaacctctgtggcagggctgcagcgccggactcccatggttaccagcagagaaaaagaaaggggctgaggaggagaaaccaaaaagaagaagacaggagaaacaggctgcctgccctttctacaaccacgagcagatgggtttattgcgagatgaagctctggctgaagtaaaggacatggagcaactcctggcgctgggaaaagaggcacgggcttgcccatactatgggagccggctagcaattcccgctgcgcagttggtcgtattaccataccagatgctcctgcacgccgcaactcggcaggcagctggaattagattacaagaccaagtcgtgatcattgacgaggcccataacctgatcgatactatcacaggtatgcatagcgtcgaggtgtctgggtcccagctatgccaggcacactcccagctcctccagtacgtagagaggtacggcaaacggctgaaggccaagaatctcatgtatctcaagcagatcctgtatctcctggagaagttcgtggccgtgctcgggggtaacatcaaacaaaatcctaatacccagtccctttcccaaacagggaccgagttaaagaccattaatgatttcttattccagtcacagattgacaacataaatctgttcaaagtccagcgttactgtgagaaaagtatgatctctaggaaactcttcggtttcaccgagcggtacggagccgtcttctcctctcgtgagcagccgaaactcgccggattccaacagttccttcaatctcttcaacctcgaactacagaggcattggctgctccagcagatgagagtcaggcatccacgctgcgccctgcatcccccctgatgcacattcaggggtttctggctgctctcaccacggccaaccaggatggacgtgtgattctgtctaggcaggggtccctcagccagtcaacacttaaatttctgttactgaacccagcagtgcattttgcacaggtcgtcaaggagtgtcgagccgtggtgatcgccggaggaacaatgcagccagtgagtgacttccgccaacaacttttggcctgcgcgggtgtggaggctgaaagggtggttgaattcagctgtggacatgttatacctccagataatattctcccactagtgatttgtagtgggatcagcaaccagcccctggagtttacatttcaaaagagagaattgccccaaatgatggacgaggtcggtcggattctgtgcaatctttgcggggtggttccaggaggcgtggtgtgcttttttccttcttatgagtacttgagacaggtgcacgcccactgggaaaaaggaggcctgctgggccgactagccgctcgcaaaaaaatcttccaggagcccaaatcagcccatcaagtggagcaggttttgctcgcctactcccgatgtatacaggcctgcgggcaggaacgagggcaggtgactggagctctcctcttgagcgttgtaggaggtaaaatgagcgaaggcatcaacttttcagataacctgggtcgatgtgtcgtcatggtcggcatgcccttccctaacatcagatccgctgagttacaggagaaaatggcttatcttgaccagaccctcgctggaccctccggcacaaggaggattctgcccgcttag

SEQ ID NO: 28309 - DNA, 2913 bp, Artificial Sequence
  Description of Artificial Sequence: Synthetic coding sequence
atggccaacgagacccagaaggttggggctattcactttccttttccctttacaccctattccatccaggaggattttatggccgagctgtatagagtactcgaggctggcaagatcggtatattcgagagccctaccggcaccggaaaatcactgtctctcatctgtggcgcactcagttggctcagagacttcgagcagaagaagagggaagaggaggccagattgctcgagacaggaactggcccactgcacgacgagaaggatgagtcgctttgcctgagctcatcgtgtgagggtgccgctggcacgccccgacccgctggtgagcctgcatgggtgacgcagttcgttcaaaaaaaggaagagcgagacttggtcgatagactgaaggctgagcaggcaaggcgtaagcagagagaggagagactgcaacagctgcagcacagagtccagctgaaatatgcggctaaaagacttagacaggaggaggaggaacgagagaatcttttgcggctgtctcgtgagatgctggagaccggccctgaggcagagcgcctggagcaattagagtccggcgaggaagagctggtcctcgcggagtacgagagcgacgaggaaaaaaaggtggcaagtagagtggacgaggatgaagacgacttggaagaagaacacattacaaagatatactactgctccaggacacactcccagctggcccaattcgtgcatgaggtgaagaaaagtccttttggaaaggacgtaaggctggtaagtcttggcagccggcagaacctctgcgttaatgaggacgtcaaatctctcggatctgtccagcttataaacgataggtgcgtggacatgcagcgttctcggcacgaaaaaaaaaagggagccgaggaggagaagcctaaacgcagacgacaggaaaagcaggctgcctgccctttttacaatcatgagcaaatgggcttgctccgcgatgaggctctggctgaagtgaaggacatggagcagcttctcgcattgggcaaggaagctagagcttgtccatattacgggtcccgactggccatccccgctgcccaactagtggtactgccttaccagatgttactccatgcagccactaggcaggcggcaggcattcgtctgcaagatcaggtggtgataatagatgaagcacataacctcatcgacaccataactggtatgcatagtgtggaagtttccggcagccaactgtgtcaggctcactcgcagcttctgcagtacgtcgaacgatatggtaagagactgaaagctaagaatctgatgtacctgaaacagatcctttacttacttgagaaatttgttgcagtgctgggtggaaacattaaacagaatccaaacacccaatccctcagtcaaacaggcactgagttgaagaccatcaatgatttcctgtttcagagccagatagataatatcaatctgtttaaggtgcaaaggtattgcgaaaaatccatgatcagccgcaagctcttcggcttcaccgagaggtacggcgctgtcttcagcagtcgagaacaacctaagcttgccggatttcagcagtttctccagtcactgcagcctagaacaaccgaggccctggctgcgccagccgacgagtctcaggcgagcacgctgcgccctgcgagccctctcatgcacattcaggggtttctcgctgccctcaccacggctaatcaagacgggagagtgatcctgtcacggcagggatccctgtctcagagcaccctgaagttcctgctgttgaacccagccgtccatttcgctcaggtggtgaaagagtgccgagcggttgtgatcgctggtgggacaatgcagccagtcagcgacttcaggcagcagctgctggcctgtgctggggtggaggccgaacgtgtagttgagttcagctgcggccatgtgatccctccagacaatatcctgcccttggtcatctgctcaggtatctcgaaccagcctctggaatttactttccagaaacgggaactgccacagatgatggacgaggtgggcagaatcctttgtaacctctgcggtgttgttccaggaggggtggtgtgtttttttccttcctacgaatatctccgacaagtgcacgcacactgggagaagggcggactgttgggcagactggcggcaaggaaaaagattttccaagaacccaaatcggcacaccaagtcgagcaggtgctgctggcctattccaggtgtatccaggcctgtggccaggagcgtggacaggtcaccggtgctctgctcctgagcgttgttgggggaaagatgtccgagggcatcaatttttctgacaacctaggtagatgtgttgtaatggtcgggatgccttttcccaacatacgctccgccgaattgcaggagaaaatggcatatttagaccagactctgtcacccagacctgggaccccacgagagggttccggaggtgaaccagtgcacgaggggaggcagccggtacaccgtcagggtcatcaggctcctgaagggttctgccagcggagtgcacccggtccagctatctgcccggcaccttgcccaggacaggctgccggattggacccttccccatgtggtgggcagtcatacctctggccacgacactgttgttgtgcggaggtctcccccggagaggttgggctttttctgatggggaatcacactacagcctggcgtagggctcttcccctgtcctgccccctagaaaccgtctttgtggtcggcgtggtctgtggtgaccctgttacaaaagtgaagccaagacggagggtgtggagtcctgaatgctgccaggaccccggaaccggggtgtccagccgtagacgcaagtgggggaacccagagtag

SEQ ID NO: 28310 - DNA, 675 bp, Artificial Sequence
  Description of Artificial Sequence: Synthetic coding sequence
atggctgagttataccgtgtgctggaagctggaaagattggcatattcgaaagcccaacagggaccggcaagtcgctgagtctgatttgcggagccctatcgtggctccgtgatttcgaacaaaaaaaacgcgaggaggaagcacggcttctggagactgggactggaccgctccatgacgagaaagacgagagcctctgcctgtcatcttcgtgtgagggcgcagccggtacacctcgcccagccggagagcccgcatgggtaacccagttcgtgcagaagaaagaggaaagagatcttgttgatcggcttaaagccgagcaggctagacggaagcagagggaagagcgccttcagcaactgcagcatagggtgcagctgaaatatgcggctaagaggcttcgacaggaggaagaggaacgcgagaatctgctgcggctgtcccgcgagatgctggaaactggacctgaagccgagagactcgagcagttagaatccggcgaagaggaactagtgcttgcggaatacgaatcagatgaagagaaaaaagtggcctctcgagttgacgaagatgaggatgacctggaagaagaacatattacaaaaatctactactgttcaagaacccactcccagcttgcacagttcgtccatgaggttaaaaagtctccatag

SEQ ID NO: 28311 - DNA, 2721 bp, Artificial Sequence
  Description of Artificial Sequence: Synthetic coding sequence
atggccaacgagacccaaaaggtgggggcaatccacttccctttcccatttactccttattctattcaagaagacttcatggctgagctgtaccgggtgctagaggccggaaaaatcggtatctttgaaagcccaacgggcacaggtaagagtctgtcccttatatgtggtgccctctcttggttaagggacttcgagcagaaaaagcgtgaagaagaagccagacttctggagacgggaactggtccccttcacgacgaaaaagatgagagtctgtgcctctccagttcctgtgagggcgcagctggcacacctaggccagctggagaaccagcctgggtgacccaatttgtgcagaagaaggaggagcgcgaccttgtagaccggctcaaagccgaacaggctcggcgtaagcagagagaggaaaggttgcagcagctgcagcaccgcgtgcagctcaagtacgcggcaaagaggctgcgacaggaagaagaggagagggagaacctcctccgcctgtcgagagaaatgctcgagaccggcccagaggctgaaaggttggaacagctggagagtggagaagaggagcttgtcctggctgaatatgaatctgatgaggaaaagaaagtggcatcaagagtcgatgaagatgaggatgatttggaggaagaacacattactaaaatttattattgttcccggacccatagccagttggcccagtttgtacacgaagtgaaaaagtcgccatttggaaaagatgtgcgcttggtcagcctcggctcgaggcagaacctctgcgtgaatgaagacgtgaagagtctgggtagtgtccagttaatcaacgatcggtgtgtcgacatgcagagatcacggcatgagaagaaaaaaggggctgaagaggagaagccaaagcgccgacggcaggagaaacaggcagcatgccctttctataatcacgaacagatgggactgctgagggacgaggcacttgctgaggtcaaagacatggaacagctactggcgttaggaaaggaagcaagagcttgcccttactatggttcccgcctggcaatacccgctgctcagctggttgttcttccataccagatgctccttcacgctgcaactcgccaagcagccggaatccgactgcaggatcaagttgttatcattgatgaggcccacaacctgatagatactatcactggaatgcactcagtggaagtgagtggctcacaactctgccaggcccacagccagctcctacaatatgtcgaaagatacggcaagcgactgaaggctaaaaacctgatgtatctgaagcagatactctacctcctggagaagttcgtagctgtcctaggtgggaacatcaagcagaatccaaacacacagtcactatcccaaaccgggacagaactgaagaccataaatgatttcctctttcagagccagatagataacataaacctgtttaaagtgcagcgttattgcgagaaatccatgatttctcgcaaattgtttggctttacggagagatacggcgctgtattcagtagtcgcgaacaacctaaactggcgggtttccaacagtttctgcagtcactgcagccgaggacgacagaggctctagcggctcctgcagacgagtcacaagctagcacactcaggccagcgtcacctctgatgcacatccaggggttcctcgccgctttaacgacggcgaatcaggacggcagggtcattttaagccgccagggctctcttagccagagcacacttaaatttctgctgctgaaccctgctgttcattttgctcaggttgtgaaggagtgccgtgcggttgtcatcgctggcggaaccatgcagcctgtatctgacttcaggcagcagctcctcgcttgcgctggggttgaagcagaacgcgtcgttgaattttcttgtggacatgtcatccctccggataacattctacctctcgtcatatgctcgggtatctcaaaccagccactagagtttaccttccaaaagcgtgaacttcctcagatgatggacgaagtggggaggattctctgcaacctgtgtggagttgtacccggaggagtggtatgcttcttccccagctacgaatatctgcgtcaggtacacgctcattgggaaaaggggggtctattgggtcggctggccgcacgcaaaaaaattttccaggagccaaaatccgcccaccaggtagaacaagtcctactggcttactctcgatgcatccaggcgtgtgggcaggagagaggacaagtgactggcgcactcttactatccgtggtgggcggaaaaatgtcggaaggtataaatttttccgataaccttggtaggtgtgttgtaatggtgggcatgcctttccccaacataaggagcgccgaattacaagaaaagatggcatacttggaccaaaccctaccccgagccccaggccaggccccaccaggaaaggccctggtggaaaacctgtgcatgaaagcagtgaaccagtccatcggaagggctattcgccatcagaaggatttcgcctccgtggtactgctggaccagcgctacgcgcgaccgcctgttctagctaaacttccagcctggatccgggcacgtgtggaggtgaaggccaccttcggtcctgccatcgccgctgtgcagaagtttcatagagagaaatccgcatccagctag

SEQ ID NO: 28312 - DNA, 2913 bp, Artificial Sequence
  Description of Artificial Sequence: Synthetic coding sequence
atggccaatgagactcagaaagtgggcgcaatccacttcccgtttcccttcacaccctactcaattcaggaagatttcatggcagaattatatcgggttctcgaggctggcaaaattggaatattcgaatctcctaccgggactggcaagtcactgtctcttatctgtggggctctctcctggttaagggattttgagcagaagaaaagagaagaggaagctaggctgctggagaccggcactggtccgttgcacgacgagaaagacgaaagcttgtgcctgagctcttcctgtgagggcgcagccggaacacctagacctgcaggagagccagcgtgggtcacccagtttgtgcaaaagaaggaggaacgcgaccttgtggacaggcttaaggcagaacaggcacgaagaaagcagcgcgaggagcgcttgcagcagctccaacatcgggtgcagctgaaatacgcagcgaagcgcctgagacaggaggaggaagaaagagaaaatctcttgagattgagcagggagatgctagagacaggacctgaggctgaacgactggaacagctcgagtccggagaggaggaactggttctggctgaatacgaatctgatgaggagaagaaagtggcatcccgtgtcgacgaagatgaggatgacctagaggaagaacatattaccaagatttactactgcagtagaacacactcccaactcgctcagtttgtccacgaagtgaaaaaaagcccttttggaaaggacgtcaggctggtgtctctgggttcccgacagaacctttgcgtaaacgaggatgttaaatctctgggttccgtgcagctgattaatgacaggtgtgtggacatgcagcgatctcgacatgagaaaaagaagggggctgaggaggagaagccaaagcgtcgccgacaggagaagcaagccgcttgcccattctataatcatgagcagatgggtctcctgcgcgacgaagccctggctgaggtgaaagacatggaacagttgctcgccctgggcaaagaggcaagggcctgtccttattacggaagcagactggcaattcccgctgctcagctggtagttctcccctatcagatgctcctgcacgctgcaactcgccaagcagctggaatacgccttcaggatcaagttgtcatcatcgacgaggcccacaatctgatagacaccattacgggaatgcactccgtggaggtatcgggctcccaactgtgccaagctcactctcagttactgcagtatgtcgagaggtacggtaaacgcttgaaggccaaaaatctgatgtacctgaaacagattctgtatcttttggagaaatttgttgcagtgctgggcggaaatataaagcaaaaccctaatacccagtcactgagtcaaacaggcacggaactgaagacgattaacgacttcctgttccagtcccagatcgataatatcaatcttttcaaagtgcagagatactgcgagaaatcgatgattagccggaagctctttggcttcacagaaaggtatggagctgtcttctcatctcgagagcagcctaagctagcgggttttcagcagttccttcagagcctacagccgaggacgacggaggcattagccgcaccagcagatgaatcacaggcttcgacattacgaccagcttctcctctcatgcacattcagggcttcctggccgcattgacgacggcaaaccaggatggcagagttattctgagccgacagggcagtctgtctcagagcacacttaagttcctcctgttgaatccagccgtccacttcgctcaggttgtcaaggagtgtagggctgtggtcatcgccggtggtactatgcagcccgttagtgacttccggcagcagttgctggcctgcgcaggagtcgaggcagaacgcgtggtggagttctcgtgcggtcacgtgatcccccctgacaacatcctgccactggtgatctgttctggcatcagcaatcagcctttggagtttacattccagaagagggagctgcctcagatgatggacgaagttggcagaatactttgtaacctgtgtggcgtcgtgcctggcggagtggtgtgctttttcccctcttacgagtatttgcgccaggtccatgcccactgggagaaagggggtctcctcggccgtctcgcagcgcgaaagaagatcttccaggaacccaagtcagctcaccaggtggagcaagttttgctggcgtattctaggtgtattcaggcctgtggtcaggaacgcggacaggtcacaggggctttgctgctgagcgtcgttggtggaaagatgtccgaggggattaatttctcagacaacttgggcagatgcgtagtgatggttggcatgccttttccaaatatccgctcggctgaactccaagagaaaatggcctacctcgaccagaccctgagcccacgccctgggacccctcgcgaaggctcaggcggtgaacccgtacatgaaggccgacagccagtccatcggcagggccatcaagccccagaggggttttgtcagaggtctgcccctggacctgcaatctgtccggcaccatgcccgggtcaagccgctgggctggatcctagtccctgcggaggccagtcttacctgtggcctaggcattgctgttgcgcagaggtgtcaccaggagaggttggcctctttctgatgggcaatcacaccaccgcctggcgcagagctttgcctctcagttgtcctctcgaaactgttttcgtggtgggtgtggtctgcggggatccggtgactaaggtgaaacctaggcgcagggtttggtctcccgagtgctgccaggatcctgggactggggtgtcatcccggaggcgaaagtgggggaaccccgagtag

SEQ ID NO: 28313 - DNA, 4293 bp, Artificial Sequence
  Description of Artificial Sequence: Synthetic coding sequence
atgaccgtctttagacaggagaatgtggacgattattacgacacgggggaggagctgggaagcgggcagttcgctgtggtcaagaaatgcagggaaaagagtactgggctgcagtatgccgcaaagttcattaagaaacgccgtactaagtcaagtcggagaggcgtatcaagggaagatatcgagagagaagtctccattcttaaagagattcagcaccccaatgttatcacacttcacgaagtttacgagaacaaaactgacgtgatcttgattctcgaacttgtagctggaggggaattgtttgattttctagcagaaaaggagtccctcactgaagaggaagctaccgaattcctgaagcagatcctgaacggagtttattatcttcactctctgcaaattgcacacttcgacctcaagcccgaaaacatcatgcttctggacagaaacgttcctaagcctcggattaaaattattgactttggcctcgcacataaaattgattttggaaacgaattcaagaatatttttggcacacccgagttcgtcgcacctgagattgttaattacgaacctctgggactggaggccgatatgtggtcaatcggtgtgatcacttatattctgctgtcaggcgcatcacccttcctgggcgataccaagcaggagacactcgctaatgtaagcgctgtgaattacgaatttgaggacgagtacttctcgaacacatctgctttggcaaaggattttattcgcaggttactggtgaaggatcccaagaagcggatgacgattcaagactccctgcagcatccatggattaagccgaaagatacgcaacaagcgctctctcgcaaagcatcagccgttaatatggagaagtttaagaagttcgccgctagaaaaaaatggaagcagagcgtacggcttatcagtctatgccagcgcctttccagaagttttctgagcaggagcaacatgtcagtggcacgatctgatgatacactggacgaggaagatagctttgttatgaaagctattatacatgccatcaatgacgacaacgtgcctggccttcaacatctactgggatcccttagtaattacgatgtcaaccagcccaataagcacggaaccccgccactgctcatcgccgcaggctgtggcaatattcagatcctgcagttgctgatcaaacggggttctagaattgacgttcaggacaaagggggttcaaatgctgtgtactgggctgccaggcatggtcacgtggacacacttaaatttttgtcggaaaacaagtgcccattggacgtgaaggataagagcggtgaaatggccttgcacgtcgcagcccgttacggccacgctgatgtggctcagctcttatgctcatttgggtcgaacccaaacatccaggacaaagaggaggagaccccattgcattgtgctgcctggcatggctactacagcgtcgctaaagcgctctgtgaagctgggtgtaacgttaacatcaaaaatagagagggcgaaactccactgctcacagcaagtgcaaggggataccacgatatcgtggaatgtctcgctgagcacggggctgatctcaacgcctgcgacaaagatgggcacatcgcgttacatctagccgtccgcaggtgtcaaatggaggtgatcaaaacactgctttcacagggatgcttcgtggattaccaggacaggcacggcaatacacctctgcacgttgcttgtaaagacggcaatatgccaatcgtagttgccttgtgcgaagccaactgtaatctcgacattagtaataagtacggacgcactccactccacctggcggcaaataacgggattctagatgtggttaggtacctgtgtctgatgggcgcatccgtggaggccctgacaaccgacggcaaaactgcagaggatctggccaggtctgagcagcacgaacatgttgcagggctgctcgctcgtttgcgaaaagatacccacagagggctcttcattcaacagctacgtcccacgcaaaatctgcagccaaggattaagctgaaactgtttggccactccggatccggcaagaccacgttggttgagagcctgaaatgtggcctgttacggtcctttttcaggaggcgtagaccaagactgagctcaacaaattcatccaggttccccccttcacctctcgcaagcaaaccaaccgttagcgtttcaatcaataacctctacccgggatgtgaaaatgtcagcgtgagaagcaggagcatgatgtttgagcccggacttaccaagggaatgctggaggtgttcgtggcccctactcaccacccccactgcagcgctgacgatcagtctaccaaggccatagatattcagaatgcctatctgaatggggtgggagattttagcgtctgggaatttagtgggaatcctgtttacttctgttgctacgactacttcgccgctaacgaccccacgtccattcacgtggtggtgttttcactggaggaaccgtatgaaatacagttaaaccaggtgatcttttggctgtcatttctgaagagcctggttccagttgaggaacctattgccttcggcggtaaactgaagaacccgctccaggtggtgctggtcgctacccacgcagatattatgaacgtcccgagacccgcaggcggtgagtttgggtatgataaggatacttcattactgaaagagattcgaaataggttcggcaatgatcttcacattagcaataagctatttgttcttgacgccggtgcctctggtagtaaagacatgaaagttctcaggaatcatctgcaggaaataagatcccagatcgttagtgtgtgccctcccatgacacacttgtgtgagaagataatttctacgctcccctcctggaggaagctgaatggccctaatcagttgatgagcttgcaacagttcgtctacgatgtgcaagatcagttgaatcccttggcatccgaggaggatttacgcaggatagcccaacagctccacagcactggcgagataaatatcatgcagagcgagacggtacaggatgtgctccttttggatcctcgatggctgtgcactaatgttctggggaagctgctttccgtagaaactccacgggcactgcaccactatagaggacgctatacggtggaagacattcagcgtttagttcccgactccgacgtcgaagagctgcttcagatcctggacgcgatggatatttgcgctcgggacttaagcagcggcactatggtggacgttcctgccctcataaagacggacaatctgcatcgctcttgggccgacgaggaagatgaggtcatggtttatggcggagttaggattgtcccggtggaacatctcaccccgttcccgtgtgggatctttcataaggtgcaggtaaacctttgtcgatggatacatcagcagagcactgagggtgatgcggatattcggctctgggtgaacgggtgcaaactggccaataggggcgcagaactactcgtgctcctggtcaatcatggccagggcattgaagtccaagtccgcggattggaaacagagaaaatcaagtgctgtctcctcctcgactctgtgtgtagtaccatcgagaatgtcatggcaactaccctgcccggattattgactgtgaagcattatctcagtccccaacaattgagagaacatcacgagccagtgatgatttatcaaccccgtgactttttcagggcccagacattgaaagagacaagcttgaccaacaccatggggggatacaaggaaagtttctcttccataatgtgcttcggctgccatgatgtctattcgcaggccagtctgggtatggatattcatgcaagcgatctcaatcttcttaccagacggaaactttctcgtttattagacccccctgaccccctcgggaaagactggtgtctcctagccatgaatctgggcctgccggacctcgtagccaaatacaatactagcaatggtgcacccaaggattttctccccagccccttgcatgcactgttgagagagtggacaacttacccggagtctacagttggcacgctgatgtccaagctgcgtgagttggggagaagggacgctgccgatttcctcctgaaggcgtcaagcgtctttaaaatcaacctcgacggaaacggccaggaggcctatgccagttcctgcaattcaggaacttcttataactcaatctcctcagtggtgtctagatag

SEQ ID NO: 28314 - DNA, 4293 bp, Artificial Sequence
  Description of Artificial Sequence: Synthetic coding sequence
atgacagtgttcagacaggagaacgttgacgactactatgacaccggcgaggagctcgggtcggggcagttcgccgtggtaaagaagtgcagagagaaatctacagggctgcaatatgcggcaaagtttatcaagaaacgaaggacaaaaagttccaggcgaggggttagccgcgaagatattgaaagagaggtgtccattctgaaagaaatccaacatcccaacgtcataacgctgcacgaggtgtacgaaaacaagaccgatgtgatactgattctggaattagttgctggcggtgaattgttcgacttccttgccgagaaagagtccttaacagaggaggaggccaccgagttcctgaagcagatccttaacggagtatattatctgcactccttgcagatcgcccatttcgatctgaagccggaaaacataatgctcctggatcgcaatgtgcccaaaccaagaatcaaaatcattgacttcggattggcccacaaaatagactttgggaatgagtttaagaacatattcggtactccagaatttgtagcaccggagatcgtcaactatgagcctcttggcctcgaggccgatatgtggtcaatcggagtgataacttatatcttacttagcggagctagccccttcttgggcgacaccaaacaagaaacgcttgccaatgtctcagcagtgaactatgagtttgaagacgaatatttcagcaacacatcagctttggccaaagacttcatacgacgattgctcgtgaaggaccccaagaaacggatgactattcaggacagtctgcaacacccgtggatcaaaccaaaggacactcaacaggccctgtccagaaaagccagtgcagtgaatatggaaaagttcaagaaatttgcagccaggaaaaaatggaaacagtccgtgcgactcatttccctgtgccaaaggctatcaaggagttttctgagtaggagcaacatgtccgtcgccagatccgatgacacactggacgaagaggattccttcgtaatgaaagccataattcacgcaatcaacgatgataacgtgcctgggctgcagcacctgctcggcagcctcagtaactacgacgtgaatcagcctaacaagcatggaactcctcccctgctcatcgccgctggttgcggtaacattcagattctgcagcttctgattaagcggggaagccgcatagatgtgcaagataaaggaggctctaacgcggtttactgggccgctcgccacgggcacgtggacaccttgaaatttctgagcgaaaataagtgcccgcttgacgttaaagacaagtctggagagatggccctgcatgtggctgccagatatggtcacgcggacgtcgcccagctgctgtgcagcttcgggagtaatcctaatattcaggataaggaggaggagaccccgctccactgcgctgcgtggcatggatactactctgtggcaaaggccttgtgcgaggctggatgcaatgttaacatcaaaaacagggagggcgagacaccactgctcaccgcaagcgccagggggtaccacgatattgtggagtgcctggccgagcacggtgcagacctcaatgcttgcgataaagacggccatatcgccctgcacctcgccgtgcgccgatgtcaaatggaggtgattaagaccctgttaagccagggatgttttgtggactaccaggatcgccacggaaatacaccactgcatgtggcctgtaaggatggaaacatgcccattgttgtggcattatgcgaggcaaattgcaacctcgatattagtaacaagtacggcagaacccccttacatcttgcagcaaacaatggcatcttagacgtcgtcagatacttatgtctcatgggagcaagcgtggaggccctaacaactgatggcaaaacagcggaggatttagccaggtccgagcagcatgaacacgtcgccggtctgctagcacgactgaggaaagatacccaccgtgggctgttcattcagcagcttagacccacccagaacttgcagcctcgaatcaagctcaagcttttcggccattcagggagtggaaagacaaccctggtcgaatccttaaaatgtgggctccttcggtccttctttagacgcaggcgaccaaggctttcatcgacaaattcctcccgtttcccaccatctccactggcctcaaagccaaccgtcagcgtgtctattaataacctgtatcctgggtgtgaaaatgtgtcagtccggtcccgcagcatgatgttcgagccaggactgacaaaaggcatgttggaggtgtttgttgcaccaacccatcaccctcattgctcagcagacgatcagtcaaccaaagcgatcgatatccaaaatgcgtatcttaatggagtcggcgatttttcagtctgggagttctcaggcaaccctgtgtacttttgctgctatgactactttgctgccaatgacccaacttcaatccacgtggtggtgttttcgctcgaggagccatatgagattcagctgaaccaggtaatcttctggcttagctttctgaagtcactagttcctgtggaggagccaattgcattcgggggtaagctgaagaatcccctgcaggtagtgctcgtggcgactcacgctgacatcatgaatgtgccacgtcccgcaggtggcgagttcggttacgacaaagataccagccttctaaaggagattcgcaatcgatttgggaacgacctgcacatctctaataaacttttcgtcctggatgctggcgcatccggcagtaaggacatgaaagtcctgcggaaccaccttcaggaaattcgctctcagatcgtgtctgtgtgccctccaatgactcacttgtgcgagaagatcatctccacactccctagttggaggaagcttaatggccctaaccaactgatgtcgttacagcagttcgtatatgacgtccaggaccagctgaacccactcgccagtgaggaagacctgagacgtatcgctcagcagctgcatagtaccggggagattaacataatgcagagcgaaaccgtgcaggatgtgctcttgctggacccacggtggctctgcaccaacgttttaggaaagttgctgtcagtggagaccccaagggccctgcaccactaccggggacgctacaccgtcgaggatatccagcggctcgtgccagacagcgacgtggaggaacttctgcagatcctcgatgccatggacatttgtgcgcgagatctgtcttccgggaccatggttgacgtcccagccctgataaagacagacaacctgcataggagctgggccgacgaggaagacgaggtcatggtgtacgggggtgtaagaattgttccagtggaacacctcacaccttttccatgtgggattttccataaggtgcaggtgaatctgtgcaggtggattcaccagcaaagtaccgagggtgatgccgatatcaggttgtgggtcaacgggtgcaagctggcgaaccgaggtgccgagctcctggttctgttggtcaaccatgggcaaggcatagaggtacaggttaggggacttgaaaccgagaaaatcaagtgttgcctgctgctggatagcgtttgctcaacaatcgaaaatgtcatggcaacaactctccccggtttactaaccgtcaagcactatctgtcaccacagcagctgagggaacaccacgagccagtgatgatctaccaacctcgcgatttttttagggcccagacgctgaaggaaacctctctgaccaataccatgggcggatacaaggaatctttcagtagcatcatgtgcttcggatgccacgatgtctacagtcaagcaagcttaggcatggatatccacgcttctgacctgaacctgcttactcggagaaaactcagccgcctactggatccgcctgacccgctggggaaagactggtgcctgctggccatgaacctaggacttcccgacctggtcgccaaatacaacacctccaacggcgcacccaaggattttctgccctcaccccttcacgccctcctccgcgagtggaccacatatcctgaaagcaccgtaggcacgctcatgagcaagctgagagaattgggaagacgcgatgcggcagatttcctccttaaagcatcctccgtgtttaaaatcaacttggatggaaacggccaagaggcatatgcctctagctgcaacagtgggacctcatataactcaatttcatcagttgtaagtagatag

SEQ ID NO: 28315 - DNA, 4368 bp, Artificial Sequence
  Description of Artificial Sequence: Synthetic coding sequence
atgaccgtgttcagacaagagaatgtcgacgattactacgacacaggtgaagaattgggtagcggccagttcgccgtggtgaaaaagtgcagagaaaagtcgaccgggttgcagtacgccgctaaatttattaagaagagacggaccaaatccagtcgaagaggcgtgagccgagaagatatagaacgagaggtgtctattctgaaagaaatccaacaccctaacgtaataacactgcacgaggtttacgagaacaagacggacgtgattctgatcctggaactggttgccggaggtgagctgttcgattttctggcagaaaaagaaagcctcaccgaggaggaggctactgagtttctgaaacaaatccttaacggggtgtactacttgcattcgttacaaattgcgcactttgacctgaagcctgaaaacattatgttgctcgaccggaatgtgccaaaacctcgaattaagataattgattttggactggcacataagatagactttggcaatgagtttaagaatatattcggcacgcccgagttcgtggctccagagattgtcaactacgagccactggggcttgaagctgatatgtggtccattggcgtcatcacttatattctgctcagcggagctagcccgtttctcggcgatactaaacaagaaacattagcaaacgtgagcgcagtgaactatgaatttgaagacgagtacttcagtaatacatccgccttggccaaggatttcatccgccgactcctcgtcaaggatccgaagaagagaatgacaatacaggatagcttacaacacccctggatcaaaccaaaagatactcagcaagcgctctcaagaaaagcatcagccgtcaatatggagaaatttaagaagttcgccgcacggaaaaagtggaagcagagtgtgaggctcatctcgctgtgccagaggctgagccgctcatttctatcaagatctaacatgtctgtcgctcggagtgacgacaccttggacgaagaagactcattcgtgatgaaagccattattcacgccattaacgatgacaatgtacccggactccagcatctactcgggtccttgtctaactatgatgtgaatcaacccaacaagcacggaacccctcccctgttaattgcagctggctgcggaaatattcagatcctgcagttactgatcaaaagaggctcccgaattgatgtccaggataagggcggttcaaatgccgtatattgggccgcacgccatggccatgtggacaccctgaagtttctgagcgagaacaaatgccccctagacgtaaaagacaaaagcggtgagatggcactccatgtggccgcacgctacggtcacgcggacgtggctcagctgctatgttccttcggcagtaacccaaatatccaagacaaggaagaggaaacccccctacactgcgccgcatggcacgggtattattcagttgccaaggctctttgtgaggctggctgtaacgtgaacattaaaaacagggagggtgaaacacctttacttacagcaagtgccagaggctaccacgatatcgtcgagtgcttagctgaacatggagctgacctgaacgcatgcgacaaagatgggcatattgccttacacctcgctgtgaggcgctgtcagatggaagtgatcaaaacgcttctgtcccaaggctgtttcgtggactaccaggaccgccatgggaacactccactgcacgtggcttgtaaggatgggaacatgcctatagtggtggccctctgtgaggccaattgcaatctggacataagtaataaatatggtcggacccctcttcacctcgcagcaaacaatggtatcctggatgtcgtccgttacttgtgccttatgggggcttccgttgaagccctgaccacagacggcaagaccgccgaggacttagctcgatctgaacagcacgaacacgttgctggattactggctagattgcgcaaggatactcatagaggcttgttcattcagcagctgcgacccacccagaacttgcagcccagaattaaactgaaactgtttggccactccggatctggtaaaactactttagtggagtcgttaaaatgtgggctcctcaggtccttctttcgccgtagacggccacggctgtcaagcaccaattcctcgaggtttccaccatcccctctggcgagcaagcctaccgtgagtgtatcgatcaataatctatatccgggatgcgaaaatgttagcgtgcgcagccggtccatgatgtttgaaccaggcttgacaaagggaatgctcgaggtttttgtggcaccaacccaccatccccactgcagcgccgatgaccagagcactaaggccatagacatccagaacgcctacctcaacggcgtgggggacttctcagtatgggagtttagcgggaaccccgtttatttctgttgctatgactactttgccgctaatgacccaacaagcatccatgtcgtcgtgttttctctggaggaaccttacgaaattcagttgaatcaggttattttctggttaagctttctaaaaagcctggtgccagttgaagaaccaatcgcctttggtggaaaattaaaaaaccctctgcaggtggtcctcgtcgccacacacgcagatatcatgaacgtgcctcggcctgccggtggcgagtttggctatgataaggacacgtccctgctgaaagaaattagaaaccgtttcggaaacgatcttcatatatccaacaaacttttcgtcttggacgccggagcctccgggtctaaagacatgaaggtcctgagaaatcatttgcaagaaattcggtcacaaatcgtaagcaagacattgccgtttaccccggacatattggtgggggtcccactgtggcatcaccaaaaaatcggcggtagccccgtgtgtccgccaatgacgcacctctgcgaaaagataatcagtacgttaccctcctggcggaagctcaatggccctaaccagctgatgagcctccagcaattcgtatatgacgtgcaggatcagctcaatccgctagcctcggaagaggatctcaggcggatcgcacagcagctccactcaactggagagatcaacatcatgcagtccgagacagtacaggatgttctcctgctcgatccaagatggctgtgtacaaatgtcctgggaaaactgctgagtgttgagacccccagggccctgcatcattacagagggagatacaccgtcgaagatatccagagactcgtgccagactccgatgttgaggagctactgcagatcctcgatgccatggacatctgcgcgagggacctgtcttcaggcaccatggtcgacgtgccagctcttataaaaactgacaacctccataggtcatgggctgatgaagaggacgaagtcatggtgtacgggggagtgaggatagttccagtcgagcacttgactccatttccatgtgggatcttccacaaggtacaagtgaacctgtgtcgctggattcatcagcagtccactgagggtgacgcagacattagactctgggtgaacggctgcaaattggccaaccgcggtgccgaactgctggtgctacttgttaaccacggccagggtatagaagttcaggtccgtggcttggagactgagaagattaaatgctgcctgctgctggatagcgtatgttcgaccattgaaaacgtaatggcaactaccctgcccggattgctgaccgtaaagcattacctgagtccccaacagctgcgagagcatcacgaacctgtgatgatctaccagcctcgtgatttctttagggcccagacattgaaggagacatctctcacgaacaccatggggggatataaggagtccttcagttccataatgtgcttcggctgccacgacgtgtactctcaagcttccttaggtatggacattcatgcctctgacctgaacctgctgacacggaggaagctgtcgcggctcctggatcctccggatcctctgggcaaggactggtgcctgttggccatgaaccttggcctgccagaccttgtcgccaaatataataccagcaatggggcacccaaggattttctgccttccccattgcacgctctactgagagagtggacaacataccctgagagcacagttgggacgctaatgtctaaactcagagaactcggccgacgagacgctgccgactttcttctcaaagcttcaagtgtgtttaaaatcaatctggacgggaacgggcaggaagcatatgccagttcttgcaattctggcacctcctataacagcataagttccgttgtgtctcgctag

SEQ ID NO: 28316 - DNA, 4293 bp, Artificial Sequence
  Description of Artificial Sequence: Synthetic coding sequence
atgactgtgttccgccaggaaaatgttgacgattactacgatactggggaggaacttggctctggacagttcgcagtagtgaagaaatgtcgcgaaaaatctacgggcttgcagtacgcagccaagtttatcaaaaaacggaggacaaagagctccagaagaggagtgagtcgggaagatatcgagagagaggtgagcattttaaaagagatacagcacccgaatgtgatcaccttgcacgaagtctacgagaacaaaacagacgttattctgatcctggaactggtcgcaggtggagaactgtttgattttctggcagagaaagagtcactcacagaggaggaggcgacggagttcctgaaacagattttgaatggcgtgtattacctccactctctccagatcgcacactttgatcttaagccagagaacatcatgttgctggatcggaatgttccaaaaccaagaattaaaattattgacttcggactggcacacaaaattgactttgggaacgagtttaaaaacatattcggcacaccagagttcgtagccccagagatcgtgaattacgaacccctggggttagaagccgatatgtggtctatcggtgtgatcacatatatcttgctgagtggcgcaagtccttttctcggcgatacgaagcaggaaaccctagctaatgtctcggcagttaactacgaatttgaagatgagtacttttctaacacgagcgcccttgccaaggattttataagacgtctgctggtcaaagacccgaagaaaaggatgaccattcaggatagtctgcagcatccatggataaaaccaaaggacactcagcaggcactctcccggaaagcctcagctgttaacatggaaaagttcaaaaaattcgcagcaagaaagaagtggaaacagtccgtcaggctgattagtctatgccagcgactgtcccgctccttcctgtcccgcagcaatatgagcgtcgcacgctctgatgatactttggatgaagaagatagcttcgtcatgaaggctatcatccacgctatcaacgatgataacgtcccaggcctccagcatctgctgggctctctttcaaattacgatgtgaatcagcctaataagcatggtaccccacctctgctgatcgccgctggatgcggaaatattcagatactccaactactcatcaaacggggatcccggattgacgtacaagataaaggaggttctaatgccgtgtattgggccgctagacatggccatgtggatactctgaagtttctgagcgaaaataaatgtcccctcgacgtcaaagacaaaagcggagaaatggccctccatgtggcagccagatatggccacgctgatgttgcgcaactcttgtgctctttcggttcgaatccgaacatccaggacaaagaggaggagacgccgctccattgtgctgcctggcatggttattatagcgtggccaaagccctatgtgaggccggatgtaatgtaaacattaaaaaccgggaaggcgagaccccgctgctcactgcgtctgctagggggtaccatgatattgttgaatgtttagccgagcatggcgctgatcttaatgcctgcgataaggacggacatatcgccttgcatttagctgtccggagatgccagatggaagtgataaagacgttgctatctcagggctgtttcgtggactaccaagaccgccatggcaacacccctctccacgtagcttgtaaggatggcaacatgcccatcgtggtagcactgtgcgaggccaactgtaatcttgacatcagtaacaagtacgggaggacacccctgcacctagccgcaaataacggtatactggacgttgtaaggtacctgtgtttgatgggcgcaagcgtggaggcactgaccaccgatggcaaaacagcagaagacctcgccagaagtgaacagcacgaacatgtggccggtctcctcgccagattacggaaggatactcatagaggcctgttcattcaacagctgaggccgacccaaaacctgcaacctaggatcaaactcaagttgtttggccattccgggagtggcaaaactacactcgttgagagtttgaagtgcgggctactacgttcatttttccggcgacggcgtccccgtctctcctccaccaattcttccaggttccccccttccccactggctagtaaacccaccgtgtcagtgtccataaataatttgtaccctggatgcgagaacgtgagcgtgagatctcgaagcatgatgtttgagccaggcctcacgaaaggcatgcttgaagtctttgttgcccctacccaccaccctcactgttcggccgacgaccagagcactaaagccatcgatatccaaaacgcttacctgaatggtgtgggcgactttagcgtgtgggagttcagcggcaaccccgtatacttctgttgttatgattattttgccgcaaacgatcccacctccattcacgtagttgtcttttccctcgaagagccctatgaaatccagttaaatcaggtgattttctggttgtccttcctgaagagtcttgtgcctgtagaagagcctatcgcctttggtgggaagttgaagaatcccctgcaggtcgtgttagtcgctactcatgctgatatcatgaatgtcccacggcctgccggtggagagttcggctatgataaagatacgtctctgttaaaggagattagaaaccggttcggcaatgacctgcacatttcgaacaagctctttgtcttggacgcgggagccagtggttcaaaagatatgaaggtactgaggaatcaccttcaggagattagatcgcagatagtctctgtctgtcctccaatgacccatctgtgtgaaaaaatcattagtactttgccgtcctggcgcaaactgaacggccctaatcagttgatgtccctgcagcagttcgtctatgatgtgcaggaccaactgaatcctctggcatccgaagaagaccttcggcgtatcgctcaacaactgcattcaacgggcgagattaacatcatgcagtcggaaacggtgcaagacgtcctgctgctggaccccaggtggctttgcacgaacgtactgggcaagttgctgtccgttgagaccccacgtgcactccaccactatagaggtagatataccgtggaagacattcagcgacttgtaccagacagcgatgtggaggaattgctccagattttggacgccatggacatctgcgccagggacctaagctcaggaactatggtcgatgtgcccgctctcatcaagaccgataatctccaccgatcttgggccgatgaagaagatgaagtgatggtatacggcggtgtgcgtatagtgcccgtagaacacctcacaccatttccctgtggaatcttccataaggtgcaggtgaacctgtgccggtggattcaccagcagagcacagaaggcgacgctgacatccggttgtgggtgaatgggtgtaagttagccaatcgaggtgctgagctgctggtgcttctcgtgaatcacggccaggggatcgaagttcaggtgcggggactcgaaacagagaaaatcaaatgttgcctgctgttggattcggtgtgctcaactatcgagaacgtgatggcaaccacgctgcccggtctactgaccgtaaagcattacctgagcccccaacagttgcgagaacatcatgagcccgtgatgatatatcagccccgagacttttttcgcgctcaaaccctgaaggagacctccctgacgaatactatgggtggctacaaggagtcctttagcagtatcatgtgtttcggttgccacgatgtgtacagtcaggcgagtctcggcatggatattcatgcttccgacctcaatctgttgacccgccgaaaactttccagactgctggatcccccagatcccctgggtaaggattggtgcctcctggccatgaatctaggcttgccggacctggtggccaaatacaacaccagcaacggggcaccaaaagattttcttcctagccctcttcacgctctgctgcgtgaatggactacctaccctgaatctaccgttgggaccctgatgtcaaagctgcgggaactgggcagacgcgatgctgcagactttcttctgaaggccagctctgtcttcaagatcaatctcgacggtaacggtcaggaggcctacgccagtagttgtaattcaggcacttcatataatagcattagcagtgtggtcagccggtag

SEQ ID NO: 28317 - DNA, 4095 bp, Artificial Sequence
  Description of Artificial Sequence: Synthetic coding sequence
atgaccgtcttcaggcaggaaaatgttgacgattactacgacaccggcgaagaactgggaagcggccagttcgcagtagtcaagaaatgtcgtgagaaatcaactggtctgcagtatgctgctaaatttatcaagaaacgccgtacaaaatcatccagaagaggcgtatcgagggaggacatagagagagaggttagcattctcaaggagatccagcaccctaatgttatcacactgcacgaagtgtacgaaaataagacagacgtgattttgatcctcgagctggtagcaggcggagaattgttcgatttcctggccgagaaagagtcccttactgaggaggaagccactgagttcttgaagcagatcctgaacggtgtatactaccttcactctctccagatcgcccacttcgacttgaaaccagaaaacattatgctcctagaccggaacgtccccaagccccgaatcaagatcatagatttcggactggcacataagattgattttggcaatgagttcaagaacattttcgggacccccgaattcgtggctcctgagattgttaactatgaaccgcttggactggaggctgacatgtggtccattggagttattacatatatcctgctaagtggagcctcaccgtttctcggcgacacaaaacaagagaccttggcaaatgtttctgctgtgaattacgaatttgaggacgagtactttagtaacacctctgccctggcaaaggatttcatcagaagattactggtgaaagaccctaagaaaagaatgacaatccaggactccctgcagcacccctggataaagcctaaggacacccagcaagccctctcgcgcaaagcatctgctgtgaacatggagaagtttaaaaagttcgctgccaggaagaagtggaagcagtctgtgaggctaatttccctctgccaacggctcagccggtcttttctctcacggagcaacatgagcgtggcaagatctgatgacactctggacgaggaggactcatttgtcatgaaggcaattattcatgccatcaatgacgacaatgtgccgggactacaacatttgctgggaagcttatccaactacgacgtgaaccagccgaacaagcacggcactcctcccttgctaatcgcggcagggtgcgggaatatacagatccttcagttgcttattaagcgtggttcgcgcatagacgtgcaggataagggcggaagtaatgctgtttattgggcggcacgtcatggccacgtggataccttaaagtttctctccgaaaacaagtgccctctcgatgtcaaagacaagtctggggagatggcattacatgttgccgcacggtatgggcatgctgacgtcgcccaattgctgtgttctttcgggtccaaccctaatatacaggacaaggaggaggaaactccactgcattgtgcagcttggcatgggtactactccgtcgccaaagccttatgtgaggcagggtgtaacgtcaacattaaaaatagagagggcgaaaccccactattgacggcttccgctaggggctaccatgacatcgtcgagtgcctggctgagcacggcgctgacctcaatgcttgcgacaaggacgggcatatagccctgcatcttgcggtcaggcgatgtcagatggaggtaataaagacacttttgagccaggggtgttttgttgactaccaggaccggcatggcaacactcctctgcacgtggcatgtaaggatggcaacatgcctatcgtagtggcactctgcgaagctaattgtaatttggatattagcaacaaatacggcagaactccgcttcatttggccgctaataacggcatcctggatgtcgttagatacctctgcctcatgggggcaagcgtggaggcgttaacgacagatggcaagactgccgaggacttggccagatccgaacagcacgagcacgtggccggtttgctagcgagacttaggaaagacactcaccgcggtctgttcatacagcagctgagacccactcaaaatttacaaccaagaatcaagctaaaactgtttggccacagcggctccggtaaaaccacattggtcgaatccttgaaatgtgggctgctgagatcatttttccgcagacgccgtccgcgtctatcctctactaattcttccaggttccccccatccccactcgcttcaaaaccgaccgtgtcagtctcaatcaacaatctctatccagggtgcgagaacgtctcagtgagaagccggtctatgatgtttgagccgggtcttaccaaggggatgctcgaagtattcgtagcgccaacccaccacccacactgcagtgccgatgaccagtccactaaggcaatcgacattcagaacgcatacctaaatgcgtttggcggtaagctgaaaaatcccctccaagttgtgctggtggccacgcacgctgacataatgaatgttcctcgccctgccggtggcgagtttggttatgacaaagacacgtccctgctgaaagaaatcaggaaccgcttcggcaacgatctacacatttcaaacaagctttttgttctggatgctggagccagcggtagcaaagatatgaaagtgctgcgtaatcacctccaggaaatccgctcccagattgtgtctgtctgtccgcctatgacacatttatgcgaaaagatcatcagcactttgccctcctggcggaagctgaacgggccaaaccagctaatgtccctgcagcaatttgtttacgacgtacaggaccagctcaaccctctggcatcggaagaggatctgcggaggatcgctcagcaactgcatagcacgggggagatcaacataatgcagagcgaaacagtccaggacgtactcttactcgaccccaggtggctgtgcactaacgtgttgggcaagctcttatccgttgagactccgagagcattgcatcactatcggggtcgttacacagtggaagacatccagagactcgtacccgatagcgatgtggaagaactccttcaaattctggatgcaatggatatatgcgccagagatctgtcttctgggacaatggtcgatgtccccgcactgatcaagaccgacaacctgcaccgcagctgggcggatgaagaagacgaggtgatggtgtatggcggtgttcggattgtacccgttgagcatctgactccttttccatgcggtatctttcacaaagtccaggtgaacttgtgtcgctggatacaccagcagtccactgaaggcgacgccgatatacgcttatgggtgaatgggtgcaaactggctaacaggggtgcagaactgctcgtgctcctggttaaccacgggcaagggattgaggtgcaggttagaggactggagacggagaagatcaagtgctgtctgctcctggatagcgtttgtagcaccattgagaacgtaatggccaccactctgcctggtctgctgaccgtgaagcactatctcagtccccaacagctacgagagcaccacgagcctgttatgatttaccagccacgggatttctttcgcgcacaaacactcaaggaaacctcacttacgaatacgatgggcggatataaagaatcatttagcagcatcatgtgctttggctgccatgatgtgtactcccaggcctcattggggatggacattcacgcttctgatttgaacctgttgacccgaaggaaactgtcaagactgttagacccccctgacccactgggtaaggattggtgcttgcttgctatgaacctcggacttcctgatctcgttgccaagtataacactagcaatggagcacctaaggactttctgccgagcccactccacgccctcttgagggagtggactacctacccagagagcacagttggcacgctcatgtccaagttaagggagctgggccgacgagatgccgcagactttttactgaaagctagctcagtattcaagattaatttggatggcaacgggcaggaagcttacgccagctcatgcaactccggaacttcctacaactctatctcctccgtcgtgagccgatag

SEQ ID NO: 28318 - DNA, 2223 bp, Artificial Sequence
  Description of Artificial Sequence: Synthetic coding sequence
atggctacggctaactccattattgttttagacgatgacgacgaggacgaggcagcagcccaacctggcccttcccaccccctgccgaacgccgctagcccgggagccgaggcccctagttctagcgagccccatggagcccgtggctcgtcctcttcggggggtaagaagtgttacaaactggagaatgagaaactctttgaagaatttttggagctgtgcaagatgcagactgccgatcatcccgaggtggtgcctttcttgtacaacaggcaacagcgcgctcactccttatttctggcttccgctgagttctgcaatatcctcagcagagttctcagccgcgctcgctcacggcctgccaagctctacgtttatattaatgagctctgcacggtgttgaaggctcactcggcaaagaagaagttgaacctggctcccgctgcaacgacgagcaacgagccgtctggcaataaccctccaacccacttaagtctggaccccaccaatgctgaaaacacagcatcacaaagccctagaacaagaggctcaaggaggcaaatccagcggctagagcagctgttagcattgtatgtggctgagattaggagactgcaagagaaagagctggatcttagcgaactcgatgaccccgatagcgcctatcttcaagaggctcgcctgaaacggaaactgatacgactgttcggccgtctttgcgagttgaaagactgcagttcattaaccggtcgggtgatcgagcaaagaataccctataggggaacgcggtacccggaggttaacaggcgcatcgaacggctcataaataaaccagggccagacacatttcctgactacggagacgtcctgagagcagtcgaaaaagccgctgccaggcattctctagggctgccaagacagcagcttcagctaatggcgcaggatgcctttcgggacgtagggattagactccaggaaagacggcatcttgaccttatctacaattttggttgccatttgacagatgattatcggccaggggtcgatcctgcccttagtgacccagtcttggcgcgtcgtctgagggagaaccggagcctggccatgagtagacttgatgaggtgatcagcaaatatgctatgttacaagataaatccgaagaaggtgaacgcaaaaaacggagggctcgattacaggggacaagttcgcattctgcggacacacccgaggcctctctcgactctggggagggtccttctgggatggcctcacaggggtgtcctagcgcgtctcgggctgagactgatgatgaggacgacgaagaatctgatgaggaagaagaagaggaagaggaagaggaggaggaagaggcgaccgattctgaagaggaagaggacctcgagcagatgcaggaaggacaggaagatgacgaggaggaggacgaagaggaggaggccgcagccggtaaggacggggataagtctccaatgtcctccctgcagatttcaaatgaaaagaatttggaaccgggtaagcagatctcccgttcctccggggaacagcagaataagggtcgtattgtatccccgtccctattgagcgaggagcccctcgcccctagctccattgacgctgaatcaaacggtgaacagcctgaagagctaaccctcgaggaggaatcacctgtcagtcagctgtttgaacttgaaatagaggccttgcctctcgatacccccagctccgttgagacagatataagctcatccagaaaacagtccgaggagccttttaccacggtcctggagaatggtgcaggaatggtgtctagcacttcttttaatgggggtgtatcccctcataattggggagacagcggacctccctgcaagaagagccggaaggagaaaaaacagaccggcagcggacctctgggtaatagctacgtagagagacagagatctgtgcacgagaagaacggaaagaaaatctgtaccctccccagtcctcccagccccctcgctagcctggcgcctgttgctgattccagcacaagggtcgacagtccaagccatggactagtcacaagctctctgtgcatcccatccccggctagactgtcccagaccccacattctcagcctccccgtccagggacttgcaagacatctgtcgctacacagtgcgaccctgaggaaattatagttctctctgacagcgattag

SEQ ID NO: 28319 - DNA, 2223 bp, Artificial Sequence
  Description of Artificial Sequence: Synthetic coding sequence
atggcaacagccaatagcatcatcgtcctcgacgatgatgacgaggacgaggctgctgcacagcccggtccatcgcacccattacctaacgccgcatcaccgggagcggaagctcccagttcatccgagccgcatggcgctagaggatcgtcttcttccgggggaaaaaaatgttataagctagaaaacgaaaagcttttcgaggagtttctcgaattatgtaagatgcaaacagcagatcaccccgaagtcgtgccattcctgtacaatcggcagcagagagcccactctctcttcctcgctagtgcagaattttgtaacattctgtcccgcgttctatcacgagccagaagccgccctgccaagctgtacgtgtatattaacgaattgtgcacagtgttaaaggcacactccgcaaaaaaaaagctaaatctggcccctgcagctactaccagcaacgaacctagcggtaacaatcccccaactcacctctcattggaccctacaaacgcagagaatacggcttctcagagcccccgaaccaggggctcaagacgccagatccagcgacttgagcagttactggcattatacgtggcagaaatccgaaggctgcaggagaaggagttagatctatcagagttggatgacccagattccgcgtacctccaggaagccaggcttaagaggaagctcatccgcctatttggaaggctatgtgagctaaaggattgctcctccctgacaggcagggtgatcgaacagcgcattccttatagaggaacgcggtaccctgaggtgaaccgcagaatagaacggctgatcaataagcctggcccagacaccttcccggactacggagacgtgctccgcgctgtggaaaaagccgcagctaggcacagcctgggcctgcctcgccagcagctacagctcatggctcaggacgcctttcgcgatgttggcatccgcctccaggagagacgccacttggatctaatctataacttcggctgccacctcactgacgattacagacctggagtggaccctgctctgtcagaccccgtcctcgcccgacggctccgggagaatcgatcactggccatgtcacggctggacgaggtgatctccaagtacgccatgctccaggataaatcagaggaaggcgagcgcaagaagcgcagagctcgtctgcaaggcacttcaagtcacagcgccgataccccggaggcttctctggactctggggaaggaccgagtgggatggccagccagggatgcccctctgcttcacgcgctgagacagacgacgaggatgacgaagagtccgacgaggaagaggaagaggaagaggaggaagaggaggaggaagcaaccgattcggaggaagaagaggatctggagcagatgcaagaagggcaagaggatgacgaggaagaggacgaggaagaggaggctgccgctggcaaagatggtgacaaatcaccaatgtcttcactgcagatttctaatgagaaaaacttggagcctggcaagcagatcagtagatcaagcggagagcagcagaacaaggggagaatcgtttcaccaagccttttgtctgaggagccccttgctccaagctcaattgatgctgagagcaacggggagcagcctgaggaactgacactggaggaggagagtcccgtctctcagctttttgagctcgagattgaagccctcccactcgatactccgtcatccgtcgagaccgacatttcctcaagcaggaagcagtctgaggaacctttcaccacagtgctggagaatggagctgggatggtgagcagcacctcattcaacggcggagtgagccctcataactggggagatagtggacccccatgtaagaaaagccgcaaagaaaaaaaacagactggctccggaccattgggaaattcctacgtggagcgccagcgctccgtgcatgagaagaatggtaagaaaatttgcacgttgccatctcctccttcccccctcgccagcttggcccctgtagcagactcctccacccgggtagattctccttctcacgggctggtaacttcttccctctgcatcccctcgcctgcccgactatctcagactccccacagccagccgccaagaccgggtacctgcaagacaagcgtagccactcaatgcgatcccgaagagatcattgtgttgtctgactcggactag

SEQ ID NO: 28320 - DNA, 1998 bp, Artificial Sequence
  Description of Artificial Sequence: Synthetic coding sequence
atgcaaaccgccgaccacccagaagtggtcccctttctctataatcggcagcagcgcgctcacagtctgttcctggcgagcgccgaattctgtaacatccttagtcgggtcctgagccgcgctcgtagtcgacccgctaaactttatgtgtacataaacgagctatgcaccgttctgaaggctcatagcgcaaaaaaaaaactgaacctggccccagcagctactacatctaacgaacccagtgggaataacccccctacgcacttgagcctggaccccactaacgcagaaaatactgcgtcccagtctccacgtacccggggttctcgacgtcagattcagcggctcgagcagcttctggcactgtacgtcgctgagatcaggcgcttgcaagaaaaagaacttgatcttagcgagctggatgacccagattccgcatacctccaagaagccaggttgaagcggaagttgatccgtctttttgggaggttgtgcgaactcaaggattgctcatctctgaccgggcgtgttatcgagcagcggataccttatagaggaacaagataccctgaggtgaataggcgcatcgagcgtcttatcaataaaccaggccctgatacattccccgactacggagacgtcctccgagccgtggagaaagccgcagcaagacattctctgggattacctcgtcagcagctgcagctgatggctcaggacgcttttagggacgtgggcataaggctacaggagcgcaggcacctcgacctgatctacaactttggctgtcatctgacagatgattatcggcctggtgtagaccctgcactctctgatcctgtgctcgctagaaggctgcgagagaaccgctctctggccatgtccaggcttgatgaagtgatttcgaagtacgccatgctgcaagacaagtccgaggaaggcgagcgaaagaaacgcagagccagactgcagggcactagttctcactctgctgacacacctgaggcatctcttgattcgggagagggtccaagcggcatggcgagccaggggtgccccagcgcttcccgcgcagagacagacgacgaggatgatgaggagtccgatgaggaggaggaagaagaagaagaagaagaggaggaagaagctacagactctgaggaggaggaagacctagagcagatgcaggagggccaggaagatgacgaagaggaagacgaggaggaagaggctgcggctggcaaagacggagataaatctcctatgtcctccctgcagatatcaaatgaaaagaatctggagccaggaaagcagatctccaggagtagcggggaacagcagaataaggggaggatcgtttccccgagcctcttgagcgaggagcctttggcaccgtcatctattgacgctgagtccaatggcgaacaaccagaggagttgacactcgaagaagaaagtccagtttcacagttatttgagttggagatagaagccctgccgcttgatacaccttctagcgtggagaccgacatcagctctagccggaagcaatctgaagagccgtttacgaccgtgctcgaaaatggggcagggatggtttcctccacctccttcaatggtggggtctctccgcacaactggggcgattctggacccccatgtaagaaaagtaggaaggagaagaagcaaactggaagcggtcctctaggtaatagttatgtggaacgccaacgctcagttcatgagaagaacggaaaaaagatttgcaccctcccttctccaccttcaccactggcgtccctggcaccagtagccgactcctcgacacgtgtggactcaccttctcatgggctggtgacttcctcgctgtgtataccctcccctgcccgtctcagtcaaacccctcactcgcagcccccacggccaggcacctgtaagacatcagtggcaacacaatgcgatccagaggaaatcattgtgttgtccgattctgactag

SEQ ID NO: 28321 - DNA, 537 bp, Artificial Sequence
  Description of Artificial Sequence: Synthetic coding sequence
atggccaccgcgaattccatcattgtgctggacgacgacgacgaggatgaggccgctgcccagcctgggccatctcatccattgccaaatgcggcatctccaggggcagaagctcccagcagttctgagccccacggcgcaagaggaagttcttccagcggaggaaagaagtgttataagttggagaacgagaagctcttcgaggaattcctggaactgtgcaagatgcaaacagctgatcatcccgaggtcgttccgtttctttacaaccggcagcaaagagctcattctctcttcctggcctctgctgaattttgtaatatcctctctagagttctttcacgggcacggtctcggcctgctaagctatacgtgtatataaacgagctttgtactgtgctcaaagcccactccgccaagaaaaaactgaaccttgctccggcagcaacaacgtcaaacgagccatcgggcaacaacccacctacacatttgagcctggatcctacaaacgctgaaaacacagctagccagtcctag

SEQ ID NO: 28322 - DNA, 147 bp, Artificial Sequence
  Description of Artificial Sequence: Synthetic coding sequence
atggccaccgccaactctattattgttctggatgatgacgacgaggacgaggcagccgcacagcccggacccagccatcctctgccgaatgcagcaagtccgggagcagaggccccatcttccagcgagccccatggcgcaaggtag

SEQ ID NO: 28323 - DNA, 393 bp, Artificial Sequence
  Description of Artificial Sequence: Synthetic coding sequence
atggccaccgctaattcaattatcgtgctcgacgatgacgatgaggatgaagctgctgcccagccgggtccttcacatccccttcctaacgccgcttcacctggcgctgaggccccatcatctagtgaaccccacggggcaaggggttcttcctcaagtggagggaaaaagtgctacaaactggaaaacgagaaactcttcgaagagttccttgaattgtgtaagatgcagaccgcagaccatcctgaagttgtgccattcttatacaaccgacagcagcgggcacacagtctgttccttgccagcgcggagttctgcaatatcctctccagggtgctctccagagccagaagtcgacctgcaaagctctatgtgtatattaatgaactgtag

SEQ ID NO: 28324 - DNA, 2316 bp, Artificial Sequence
  Description of Artificial Sequence: Synthetic coding sequence
ggagtgcccgtgataaaatggaagaaagatgggatacatctcgccttgggcatggatgagaggaaacagcaactctctaacgggtctctgcttatccaaaatatccttcacagccgccaccataagcctgacgaggggctctaccaatgtgaagcgagccttggagattccggatcaattataagcagaactgcaaaagtggcggttgcgggtcctctgagattcctttcccagactgaaagtgttactgcctttatgggcgacacggttcttcttaaatgtgaggtgattggagagccaatgccaaccatccattggcagaaaaatcagcaagatttgactcctattccaggcgactcccgcgtggtggtgctccccagtggcgcactgcagatcagccgcctgcagcctggggatataggtatttaccggtgctcagcaaggaacccggctagctctagaactggcaacgaggcagaagtaaggattctgtccgacccgggtttgcatagacagctgtacttcctccaacgcccttctaatgtagtggccattgaaggcaaggatgcagtcctcgaatgctgcgtttcagggtatccaccgcctagctttacatggttacggggagaggaagttatccagctacggtccaaaaagtattccctcctggggggtagcaacctactgatctccaacgtcactgatgatgacagcggaatgtacacatgcgtggttacctataaaaacgagaatatttccgctagcgccgagttgaccgtactcgtgcccccttggtttctgaaccacccgtctaatctgtacgcctacgagtcaatggatatcgagttcgaatgtaccgtctctggtaagccggtgcccacggtgaactggatgaagaacggcgacgtggtcataccaagcgactattttcaaatcgtcggcggatctaacctccgcatcttgggcgtggtgaaatcagatgaaggcttctatcaatgcgtggccgagaatgaggctgggaacgctcaaacgagtgcccagctcattgtgccaaagcctgctataccctcctccagcgtgcttccctccgctcctcgcgatgtggtccccgtcctcgtgtcaagtcgttttgtcaggctgtcctggcgaccccctgccgaagccaaaggaaatatccagacattcaccgtgtttttcagtcgagaaggtgataatcgggagcgggctctcaacacgacccaaccaggctccctgcagctgacggtgggcaacctgaagcccgaagctatgtatacattccgcgtcgtggcatacaatgaatgggggcctggtgaatctagccaacccattaaggtagcaacccagcccgagctgcaggtgcccggtccagtggagaatctgcaggcagtctcaaccagtcccacctcaatcttaatcacatgggagccacctgcttatgctaatgggcctgtgcaaggataccgcttattctgcacagaggtcagcacagggaaggagcagaacattgaagtagatggtctgtcgtacaaactggaaggcttgaaaaagtttactgagtactctcttcgattcctcgcctacaacaggtatggtccaggcgtgagcacagacgatatcacagtggttacgctctcagatgtcccctcagcgcctccccagaacgtctccctcgaggtcgtgaatagcagaagtataaaggtgtcgtggctgcccccaccatcaggcacccagaacggatttattactggctacaagatccggcaccggaaaaccactaggcggggagaaatggaaaccctggagcccaacaatctgtggtatctttttaccggcctggaaaagggttctcagtattcattccaggtctccgctatgaccgtgaatgggacagggcctccatcgaactggtacactgccgagacccctgaaaacgaccttgatgaatcacaggtgcctgatcagccttcctcactgcacgtcagaccccagaccaattgtatcataatgagttggacacctccgctgaatccaaacatcgtcgtgaggggatacattatcggctatggagtcgggtccccctacgctgagaccgtgcgagtggattccaaacagcggtactacagtattgagaggctagaatctagcagccactacgtgatttcactgaaggccttcaacaatgccggtgagggtgtgcccctttatgagtccgcaacaaccaggtcaataaccgtgcggaggcataacattagcaaactgcactccaaccggcctcaaacaaagcataatgtctag

SEQ ID NO: 28325 - DNA, 2694 bp, Artificial Sequence
  Description of Artificial Sequence: Synthetic coding sequence
atgggcgacaccgtgttactcaagtgcgaggtgatcggggagccaatgcctacaattcattggcaaaagaatcaacaggatctgactccgatccctggcgacagcagagtggtcgtgctgccatccggcgcactccagatctctagacttcagcccggtgacatcgggatctatcgttgcagtgccaggaatcctgcaagctcccgcactgggaacgaggcggaggtgcgcattctcagcgatcctggactgcaccggcagctgtactttctgcagcgaccgtcgaatgtggtggcaattgagggtaaagatgccgtgcttgaatgctgtgtatcaggctacccacctccttcatttacatggctgagaggggaagaagtaatccagttgcgttccaaaaagtattctcttctcggcggttctaaccttctgattagcaacgtcacagacgacgactccggcatgtatacctgcgtggtgacttacaagaatgagaatatttctgcgagtgctgagctgacagtgctagtgccgccatggttcctgaaccacccttccaacctttatgcctacgagagcatggatatagagtttgagtgcaccgtctccggaaagcctgtccccaccgtgaactggatgaaaaatggtgatgttgtcatcccttctgattactttcagatagtcggagggagtaatctgcggatcctaggagtggttaaaagcgatgagggcttctaccagtgcgtggccgagaatgaagctggcaatgcacagacgagtgcacaactcatagtccccaagcctgctattcccagcagctccgtcctgcccagcgcacctcgggacgtggttccagtgctcgtgagttccaggttcgtgagattgagttggagaccaccagccgaagctaaagggaatatccagacctttacagtttttttttctcgcgaaggggataatagagagcgcgctctgaataccacacagccagggtctctccaactcaccgtcggaaacctgaaaccggaagccatgtatacattcagagtggtagcgtataacgaatggggacctggggagtccagccagcctatcaaagtggccacccagcctgagttgcaggtgcccggaccagtcgaaaacctacaagctgtgtccaccagtcccaccagtattctgatcacctgggaacctcctgcatacgcaaatggacccgtacagggctaccgattgttttgcactgaggttagcacaggcaaggagcagaacatagaggtcgatggtctgtcatacaaactcgagggtctgaaaaagttcactgagtattctttaaggtttcttgcctataaccgatatggtcctggggtaagtaccgacgatatcacggttgttactttaagcgacgtgccctccgctcctccccagaacgtgtcactggaagtggtgaattctagatccattaaggtctcctggctgcccccaccctccgggacgcaaaacggattcattactggatacaaaattcgacataggaaaaccacaagacgtggagaaatggaaacactggagcctaataatttgtggtacctgttcactggattagagaaagggagtcagtattcattccaagtgagtgctatgactgtgaacggcaccgggcctccctcaaattggtacaccgccgagacaccagaaaatgaccttgatgaaagccaggtaccagaccaacctagcagcttacacgtccggccacagactaattgcattataatgagttggacaccaccactaaatcccaatatcgtagttaggggctacatcattgggtacggagttggttctccttacgctgagacagtgagggtggactccaagcagagatactatagcatcgagaggctcgaatcctcttctcactacgtgatctctctgaaggcttttaataacgccggtgagggagtccctctgtatgagtcagctacaacacgcagcataacagacctctcaacccctatgctccctcctgtcggcgtccaggctgtcgcactcactcacgacgcagtccgagtgtcttgggcagataacagcgtgccgaaaaaccagaaaacctccgaagtcagattgtacaccgtccggtggagaacctccttctccgcttccgccaagtataagagcgaagacaccacaagcctgtcttataccgccaccggactcaagccaaatactatgtatgagtttagtgtcatggtgacaaaaaatcgacggtcctcgacctggagcatgacagcccatgccactacttacgaggccgctcccacctcagcaccgaaggacttgacagtcataactagagaaggtaagcccagggctgtgatcgtgtcatggcaacctcctttagaggccaacgggaaaatcaccgcgtacatacttttctacaccttggacaagaacattcccattgatgattggatcatggagaccatttccggcgaccggctgactcaccagattatggacttaaacctcgatacaatgtattactttcggatccaagctcgcaacagcaagggggtgggacccctcagcgatcccattttgttccggactctcaaggtcgaacacccagataagatggccaacgaccaggacactggtgtcaccatcaatctggtgaacgaggtattgcttggctag

SEQ ID NO: 28326 - DNA, 4343 bp, Artificial Sequence
  Description of Artificial Sequence: Synthetic coding sequence
atggaaaacagcctgaggtgcgtctgggtgccaaaattggcctttgttttgtttggggctagcctgttcagcgcacatcttcaagtgaccggattccaaatcaaagcattcaccgcgctacggttccttagcgaacccagcgacgccgtgaccatgcgaggcggtaacgtgctgcttgattgctctgcagagtcagaccgaggagtgcccgtgatcaaatggaagaaggacgggattcacctggcccttggaatggacgaaaggaagcagcagctttcaaatggtagcctgctgatccagaatatactacattctcgccaccataaacctgatgaaggtctctatcaatgcgaagccagtttgggggactccggatctattatttcccgcacagcaaaagttgctgtcgcgggtccactgcgctttctcagtcagaccgagtccgtgaccgcctttatgggagataccgtgctgttgaagtgtgaggtgattggtgagcctatgccaaccattcactggcagaagaatcagcaagatcttactcccatccccggagattcccgtgtggtcgttctgcctagtggagctctccagatatcaagactccagcccggtgacatcgggatctatcgctgtagtgctagaaatccagcctcttcccgtactggaaacgaggccgaggtgagaatcttatccgatcctggactccataggcaactgtattttctacagagaccttccaacgtggtcgccattgagggtaaagacgctgttctggagtgttgtgtctccggctacccccctccttcatttacctggctgcggggagaagaagtgatccagctgaggtctaaaaaatacagcctgttggggggttcgaatctgctgatatcgaacgtgacagacgacgactctggaatgtacacttgcgtggtgacttacaagaacgagaacattagtgctagtgccgagctaaccgttctggttccaccctggttcctgaatcaccctagcaatctctacgcttatgagtccatggacatcgagttcgagtgcaccgtgagcggcaaaccggtcccaaccgtaaattggatgaagaatggggatgtggtgatcccctctgattactttcagatcgtcggaggatctaacctgcgcatattgggagtagtgaaatccgacgaaggtttctaccagtgcgtggcagagaacgaagccggaaacgcacagacctcagcacagctcattgtacctaagccagcgatcccttctagctcagtgctccctagcgcaccccgtgacgtagtccccgtgctggtgagcagtaggtttgtcaggctgtcgtggcgacctcccgctgaagccaagggtaatatccagaccttcaccgtatttttttctcgggagggggacaacagagagagagctcttaataccacacaacccggtagccttcaactgactgtcggcaatctgaaacccgaagctatgtacacatttagggtagtggcctataacgaatggggcccaggagagagttctcagccgatcaaagtggctacccagccggagttacaggtgccagggccagtcgaaaacctgcaggctgtgtcaacaagccctaccagcatccttattacatgggagccacccgcatatgctaacggacccgtgcaggggtatcgcctgttctgtaccgaggtttctaccggaaaggaacaaaacattgaagtggacggcctgtcctacaaactggaggggcttaagaagtttaccgagtacagccttcgcttcctggcttataatcgctacggacctggcgtgagcaccgatgacatcacagtcgtgactctgtctgacgtgccatcagcacctccacagaacgtgtcactggaggttgtcaattcaaggtcaattaaggtgtcttggcttcctccgccatccgggacccagaatggctttattaccggctacaagataagacaccgcaagactacgcgtaggggggagatggagacactagagcctaataatctgtggtatttattcacgggactggaaaagggctctcagtacagttttcaagtttcagcaatgactgttaatgggactgggcctcccagtaattggtatacagcggaaacacctgagaacgatctggatgagtctcaggtgcctgatcagcctagctctctgcacgtgaggccccagaccaactgcattattatgtcttggactcccccattaaacccaaatattgtggtgcgaggctacattatcggatatggggtgggatctccatatgccgagaccgtcagagtggatagcaaacaaagatactatagcattgagcgtctggaatcgtccagtcattacgtcatctcattgaaagcattcaataacgccggagaaggtgtgccactttacgagagtgctacaacacgctctataaccgaccctacggatccagtagactattaccccttattggacgactttcccactagtgttcccgatcttagcacccccatgctccctccagtgggcgtacaagcagtggctctgacgcacgacgccgtcagggttagttgggctgataattcagtgcctaagaatcagaagacatcagaggtacgactctacactgtccggtggaggactagtttctccgcaagtgcaaaatacaaatcagaagacacaacctctttatcgtacaccgctacggggctgaagcctaacacaatgtatgagttttctgtaatggtgactaagaaccgccgatcttctacttggtctatgactgcgcacgccaccacatatgaggctgcaccaacttccgcaccaaaagacctcaccgtgatcacacgggagggcaaaccgcgagccgtcatcgtctcttggcagcctccgctggaggccaacgggaaaataactgcttacatcctgttttacacactggataagaatatccctatagatgattggatcatggaaactatctctggagatcggcttacacatcaaatcatggacctaaacctagacacaatgtactacttccgcatccaggccagaaactccaagggggtggggccactgtcggacccaattctgttcagaactttaaaggtggaacaccccgataagatggccaacgaccagggaagacatggagacgggggatactggccagtggacaccaacctgatcgatcggtccactcttaatgagccaccgattggccaaatgcatcccccacacggttccgtcactccgcaaaaaaactcaaacctgctcgtgataatcgtagtgacggttggggttatcacggtccttgtcgttgttatcgtggcagtcatctgcactaggaggagtagtgcccagcagagaaaaaaaagagccacacacagcgctggcaaacgcaaaggctcgcagaaggatctgcgaccacctgacctgtggattcaccatgaagagatggagatgaaaaatatcgaaaagccctcaggaaccgacccggctgggagagattcccccattcagagctgtcaggatctaacccccgtgagccattcccagtcggagacacagctgggaagtaagtctactagccatagcggacaagataccgaggaagcaggatccagtatgagtaccctggagaggtcactggcagcaagacgtgccccacgggctaagctcatgataccgatggacgcacagagtaacaatcccgcagtggtctccgctattccagtgccaactctggaaagtgcccagtaccctggcattctcccttctcctacttgtgggtatccccatccacagtttactctcagaccggtcccttttcccactttaagcgtcgatcggggattcggcgcaggacgatctcagtcagtgtccgaaggtccgacaactcagcagccacctatgctgcctccatctcagccggaacattcttcctccgaagaagcaccttcccgtacgattcccacggcttgtgtgcgccctactcaccctttacggtccttcgctaatccgctgctgcctcccccaatgagcgccatcgagccaaaagtgccgtacactccgctgctgtctcagccgggaccgacgttgcccaagacacacgtgaaaactgcctccctgggcctggccggaaaggcgaggagccctctcctgccagtcagcgtgcccaccgctcctgaagtcagcgaggagagtcataaaccgaccgaggattcagcgaatgtttacgaacaggacgacctgtctgaacagatggcaagcctcgaaggcctgatgaagcaattaaacgcaatcacaggttccgcatttta

SEQ ID NO: 28327 - DNA, 213 bp, Artificial Sequence
  Description of Artificial Sequence: Synthetic coding sequence
atgacaatgaacgtcctcgaggccggtaagtggaagtcgattgtacctgcgcctggagagggtctgctggctgtcctgcacatgatggtattcacagacgctctgcacagagaacggagtgtgaaatggcaggcaggcgtctgttacaacggtggcaaggactttgccgtttcgttagctcgccctaaagccgctgaaggtattgccgattag

SEQ ID NO: 28328 - DNA, 1392 bp, Artificial Sequence
  Description of Artificial Sequence: Synthetic coding sequence
atgagcgtggccattaggaagagatcatgggaggagcatgtcactcactggatgggacagccatttaactccgacgaccgcaataccgcgtgtcaccacggcctagtggctgattcactgcaggcctctatggagaaggatgctactctgaacgtggatcgaaaagagaaatgcgtttccctgccagactgttgccacggatccgaattaagagattttcccggtagacccatggggcacctgtccaaggatgtggatgagaacgatagccatgaaggtgaggaccagtttctctctctagaagcaagtactgaaacgctggtgcacgtgtcagatgaggataataatgccgacctgtgtctgacagacgacaaacaggtactgaatacacagggccagaaaacatctggacagcatatgatccaaggagcagggtcacttgagaaagccttacctattatacaatccaatcaggtgtcatccaactcctggggcatcgccggagagacagaactggctttagtgaaagaatccggggagcgcaaggtgactgactctatatccaagtccttggagctctgcaatgagattagcctgtcagagatcaaagatgccccaaaagtgaacgcagtggacacactcaatgttaaggacatagcacccgagaaacaactgctcaacagcgccgtgattgctcaacaacgtcggaaacctgatccaccaaaggacgaaaacgagcggtccacttgtaacgtcgtgcaaaacgagtttcttgacaccccctgtaccaatagaggcctacccctgctgaagactgatttcggttcctgccttttgcagcctcctagctgccctaatggcatgtccgcagaaaacggactagagaagtctggattcagccagcatcagaataagagcccacccaaggtcaaggcagaggacgggatgcagtgcttgcaactcaaggaaacgctcgccacccaggaacctaccgacaaccaagtcagactgcggaaacggaaagaaataagggaggatcgagaccgagcgagactggactctatggtgctcctgataatgaagttggaccagctggatcaagatatagagaatgctctgtccacctccagcagtccaagtggcacaccaaccaaccttcgacgccatgttccagacctggagagcgggagcgagagtggggctgacactatcagcgtcaatcagacacgcgttaatctgagctccgataccgaatcaacggatctaccaagctctaccccagtggcaaactccggtaccaagcccaagaccaccgccattcaaggtatatccgaaaaagagaaagctggcaaactcacattctggttttgtttcttggccaatttgttctag

SEQ ID NO: 28329 - DNA, 5267 bp, Artificial Sequence
  Description of Artificial Sequence: Synthetic coding sequence
atggagactcgctctagcaagacccgcagatctctggcctcccggacgaatgaatgtcagggaaccatgtgggcccctaccagtccacccgctggctcttctagccccagtcagccaacctggaagtctagcctctactcgagtctggcttattctgaagcattccattattccttcgccgctcgccctcgtaggttgacccagttggcactggctcaaaggccagagccacagctcctgcgcctgcgcccttcatcgcttcggactcaagatatcagccacctgctcactggagtgttccgcaatttgtacagtgctgaggtgattggcgacgaagtgagtgccagcctcatcaaagccaggggcagcgaaaacgaacggcacgaggaatttgtggaccagctgcagcagattcgggaactctacaagcaacgcctggatgagtttgaaatgctggaacgccatatcacacaggcccaagctcgggctatagcagagaacgaaagggtgatgtcccaggcaggagtgcaggatctggaatcactagtgcggctccctcccgttaaaagcgtgtcacggtggtgcatcgactccgagctgctaaggaagcaccacctgatctctccagaagactactacacggacactgtgccgttccattctgcccctaagggcatatctcttcctggatgttccaaactgacctttagctgcgaaaaacggtctgtgcagaagaaagagctgaacaaaaaattagaagacagttgccgtaaaaaactggctgaattcgaggacgaattggatcacaccgttgacagtttaacctggaacctaactcccaaggccaaggaaaggaccagggagccactcaagaaggcttcacaaccgaggaataaaaactggatgaaccaccttagagtgccccaacgagagttggaccggcttctgctggccagaatggagtcaagaaatcacttcctgaaaaatcccaggttcttcccccctaacactcgctacggtgggaaatccttagttttcccaccaaagaaaccagcccctatcggggagttccaatctacggagcccgaacagtcatgtgccgacacaccggtctttctggcgaaaccgcctattgggttttttactgactatgaaataggccctgtgtacgaaatggtcatagctctgcagaacacgaccactaccagccgatatttacgtgtcttaccaccctccactccttactttgctctgggtctgggtatgtttcccggaaaaggcggaatggtcgcgccaggtatgacctgccagtatatcgtccagttttttcccgattgtcttggcgacttcgatgattttattctggtggaaacccaaagtgcgcatacgctgctgatccccttgcaggctaggaggcctcctcccgtcttgaccctgagtcccgtgttagattgcggatattgcctgataggaggcgtgaaaatgacccgcttcatttgcaagaatgtcggatttagcgtgggtcggttctgcattatgcctaaaaccagctggcctcctctcagctttaaagcaatcgcaacagttggctttgtggaacagcctcctttcggaatcttgcccagcgtttttgagctcgctccaggccacgccatcttggtagaggtcttgttcagcccaaaatctctcggtaaagctgaacagacattcatcattatgtgcgacaactgccaaatcaaagaactcgtgaccatcggcatcggccagttaattgctttggatctcatctacatcagtggtgagaagtcgcagcctgatcctggagagttaacggaccttacagctcagcactttatccgatttgagcccgaaaacttgcggtccacagccagaaaacaactgattatcagaaatgcaactcacgtggaactcgctttttactggcagatcatgaaaccaaatctgcagcctcttatgccaggggagacattctcaatggactccataaagtgttaccctgataaggagactgcattttcgatcatgcccaggaagggcgtgctttcccctcataccgatcatgaatttatactatctttttcgccccatgagttaagggacttccactccgtcctccagatggtattagaggaggtgccggagcctgtctcatcagaggcagaaagcctcgggcattctagctatagtgtggacgacgtgatcgtacttgaaattgaagtcaagggcagtgtcgaacctttccaggtcttgcttgagccatacgcacttatcatcccaggagagaactacatcggaatcaatgtcaagaaagcctttaagatgtggaacaacagcaagtctccaatccgatatctgtggggaaaaataagtgactgccacattatcgaggtcgagccaggcaccggcgtgattgaaccgtccgaagtcggggacttcgagctcaacttcaccggcggtgtcccaggtccaacatcccaggatcttctctgcgagattgaggattctccctcccccgtagtcctgcatatcgaggctgttttcaaaggcccagccttgattattaacgtgagtgcgctccagtttggactgttgagacttggtcaaaaagccacaaatagtattcagattcgcaacgtttcccagctccccgctacttggagaatgaaagagagccctgtgagtctgcaagagcgcccagaagacgtgtcaccattcgacatagagccatcaagcggtcagttacactccctcggcgagtgccgcgtggacattacactggaggcactacactgtcagcatctggagaccgtcctggagctcgaagtggagaacggagcgtggtcctacttgcccgtgtacgccgaagtccaaaaacctcacgtgtacctccaatcaagtcaagtcgaagtacgcaacctctatctgggcgttcccaccaaaacaacaatcacattgattaacggtacactcttacctacacagttccattggggaaaactgttgggccaccaggctgaattctgcatggtgaccgtgtcccctaagcatggccttctgggaccaagtgaggaatgccagctaaagctcgagctcacagcacatacccaagaagagctcacccacctggctctgccatgccatgtgagtggaatgaagaagccattggtcctgggcatctcaggaaagcctcaggggctgcaggtggcgattacaatctccaaggaatctagtgattgcagcaccgaacagtggcctggccatccaaaagagctcagattagattttggttcggccgtgccactcaggactcgggtcactcgacagctgatcctgaccaacagatctcctatcaggacacggttctctctgaagttcgaatatttcggatctccccagaacagcctgtctaaaaagaccagcctgcccaatatgccacccgctttattgaagactgtgcgaatgcaagaacatctggctaaacgggaacaactggatttcatggaaagcatgttgagtcacgggaaaggcgctgcttttttcccccattttagccagggtatgctcgggccttatcagcagctgtgtatcgacattaccgggtgtgccaatatgtggggagaatactgggacaatcttatatgcactgtgggcgatctactacccgaggtcatcccagtgcacatggcggctgtgggatgccctatttcgagcttaaggacaacgagctacaccatcgatcaagcacagaaagaacccgcaatgcgctttggaacccaggttagtggcggtgataccgtgacacgcaccttgcggctcaataattccagcccatgcgacattcgactcgattgggagacctacgtgcctgaggacaaggaagatagactcgtcgagctgctggttttttacggcccaccttttcctctgcgagaccaagctggtaacgagcttgtatgcccagacacacccgaaggagggtgtctcttgtggagcccgggaccgagcagctcttccgagttttctcatgaaaccgacagctctgttgaggggtcctcttcagcctcaaaccgcgttgctcaaaagttgatctccgtgattcttcaggcacatgagggagtgccaagtggccatttatactgcatttctcctaagcaagtcgtcgtgcctgccggagggtcctctaccatatatataagctttacccccatggtccttagcccggaaatcctgcacaaagttgaatgcaccggttatgccctcggtttcatgagcctggactccaaagtcgaaagagagattcccggaaaacggcaccggctacaggactttgcagtcgggcctctgaagctggatttacacagctacgtcagacctgctcagttaagcgttgagctggattatgggggttcaatggaatttcagtgccaagccagcgacctcatcccggagcaaccttgctccggggttttatccgagctggtgaccacccatcacttaaagctcacgaacacaaccgagatacctcactattttagactcatggtctctagaccgtttagcgttagccaggatggcgcatcccaggatcatagggccccaggcccaggtcaaaagcaggagtgtgaggaagaaactgcaagtgccgacaagcagctcgtactgcaggctcaagaaaatatgctggtgaatgtgtctttttcactgagccttgagttgcttagctaccagaaactgccggctgaccagacactgcccggagtggacatccagcagtcggctagtggggagcgggagatggtcttcacacagaatctgctgctggagtataccaatcagacaacacaagtggtgcctctgcgggcagtggttgcagtgccagagctgcaactgtcaaccagttgggtggatttcggtacatgctttgtttcccagcaacgggtcagagaggtgtatctgatgaacctatcgggctgcaggtcttactggacaatgctcatgggccaacaggagccagccaaggcggctgtggcgttcagggtaagccccaactccggcttactagaggccaggtcagccaacgcgcctccgactagtattgctctgcaggtcttctttaccgcacgcagttcggagctgtatgagtctaccatggtggtggagggcgttctcggtgagaaaagctgtacactccggcttcgcggacaaggcagctatgatgagaggtacatgctcccccatcaaccata

SEQ ID NO: 28330 - DNA, 5336 bp, Artificial Sequence
  Description of Artificial Sequence: Synthetic coding sequence
atggagacacgatccagtaagacacgcaggtcactcgccagtaggactaacgagtgtcagggcaccatgtgggcgccaacaagtcctcccgcaggcagttccagtcctagccagcccacttggaaaagctctctctactccagcctggcttactccgaagcttttcactactctttcgcggctcggcctagacgcctaacccagctggccctggcccagagacccgaaccacagctgttacgactgcgcccttccagcctcaggacgcaggacatcagccatttactgaccggcgtgtttcggaacctctattccgccgaagtcatcggagatgaggtctccgcgtcattaatcaaagcgagaggatcggagaacgaaagacatgaagaatttgtggatcagctgcagcaaatacgcgaattatataaacagcgtctggatgagtttgaaatgttggagcgccatatcactcaggctcaggcgagggcaattgctgaaaatgaaagggtcatgtcccaggctggcgtgcaggatttagaatcactagttagactccccccagtgaaatccgtgtcacgctggtgtatcgactcagaacttttgcgaaaacatcacctcattagcccggaagattactacactgatacagttccttttcactctgcccctaaagggatctctctgcccggatgcagcaagctgaccttcagctgtgagaagaggtccgtccagaaaaaggagttgaataagaagctggaggatagctgcaggaaaaagctggcggaattcgaagacgaactggaccataccgtggacagccttacttggaacctgacaccgaaagccaaagaacggacacgcgaacccttgaaaaaggcgtcccagccaagaaataagaactggatgaaccacctccgggtgcctcagcgtgaattggaccgcttattactcgccagaatggagtcaagaaatcactttttgaaaaaccctcggttctttccacccaacacgagatacggaggaaagtcattagtgtttccgcctaagaaacctgcccctattggtgagtttcagtccaccgaacctgagcagagctgcgccgacacaccagtttttctggctaagcctccaataggcttttttacagactacgagattggccctgtttacgaaatggtcatagccttacaaaatacaactacaacgtcccgatacttacgggtgctacccccaagcacgccctactttgccctggggctcgggatgttcccagggaaagggggaatggtggcgcctggcatgacttgccagtacattgtgcagttcttccccgactgtctgggtgactttgacgactttattttagtggagacccagagcgcacacacacttctgattccattacaggctcgtcggcctcctccagtcctcaccctgtcccctgttctcgactgcgggtattgcctcatcggtggcgtgaagatgactagatttatctgcaaaaacgttggctttagtgtaggcagattctgtatcatgcccaaaacctcatggccccctctttcttttaaggcaatagccaccgtgggctttgtggagcagccacccttcggtattttgccgagcgttttcgagttagctcctgggcacgccattctggtcgaggtcctctttagccccaaatcacttggcaaagccgaacagactttcatcattatgtgtgataactgtcaaataaaggagctggtgacaatcgggatcggacaattaattgccctggatctgatatatatctcaggcgaaaaatctcagccagatcctggggagctcactgatctaactgcccagcattttatcaggtttgagcctgaaaacctcaggtcaacagctcggaagcaactcatcataagaaatgctacccacgtggagttggcgttctactggcagatcatgaagcctaacctgcaaccactgatgcctggtgaaaccttctccatggattctattaaatgttacccagataaagaaacagccttttcaataatgccgagaaagggtgtgctgtccccccacaccgatcacgagtttatactgtccttttcacctcatgagctaagggactttcatagcgtgctccagatggttctcgaggaggtcccagagccggtatcctccgaagccgaaagtctcgggcactcctcttactctgtggacgacgtgattgtactcgagatagaggtcaaaggtagtgtggagccttttcaggtcctgctggagccttacgccctcatcatccccggtgaaaattacattggcattaacgtgaaaaaagctttcaagatgtggaataattccaagtcccccattagatatctgtggggcaagatcagtgactgccatattattgaggtggagcctggcaccggggtcattgagccttcggaggtgggggattttgagctcaattttactgggggagttccgggaccaacgagtcaagacttgctctgcgagattgaagattctccttcccccgtggtcctccatattgaggcagtctttaaaggccctgccttgatcatcaacgtgagcgcactgcaattcggattgttgagacttggccagaaagcgactaattctattcagattagaaacgtttcccagttgccagccacgtggaggatgaaagagtcccccgtgtcgctccaagaacggcctgaagatgtcagccctttcgatattgagccatcctcggggcagctccactcccttggggaatgccgggtggacataaccctcgaggccttgcactgtcaacatctcgaaacagtgcttgaacttgaggttgagaatggtgcatggtcctaccttcctgtgtatgccgaggtacagaaaccccatgtctacttacagtcttcccaagtggaggtcagaaacttgtatctgggcgtgccaactaagacgactatcaccttgataaacggcactttgctccccacccagtttcactggggaaagctgttgggccatcaagccgagttctgcatggtcaccgtgtctccaaagcatggcctcttgggcccaagcgaagagtgccaactgaagctggaactaacagcacacacccaggaagaactgacccacctggccctgccatgtcatgtgagcggtatgaaaaagcctctggtcctgggtatctcaggcaagcctcagggactgcaggttgcaattaccatatcaaaagaatcctcagattgcagcacagagcaatggccaggccacccgaaggaactgagactggacttcggatccgctgtacccctgaggacacgcgtcaccaggcagcttattttgacaaacagaagtcctattcggacgagattttcacttaagttcgagtattttgggagcccacagaacagcctcagtaagaaaacgagtctgcccaacatgccaccggctctcctgaagaccgtgcggatgcaggagcacctcgccaaacgcgaacagctggattttatggagtcgatgctgtcccacggtaaaggcgctgccttcttcccgcatttcagccagggtatgttagggccttatcagcagctgtgcattgatatcacggggtgtgccaacatgtggggtgaatactgggataaccttatttgtaccgtgggcgatttactgcctgaagtaatccccgtgcatatggccgcagtgggctgtccaatcagtagcctgcgaacaacctcctatactatcgatcaggcccagaaggaacccgcaatgagattcggtacccaagtatctggaggcgatacagtaacgagaacactgaggttgaataactcatccccgtgtgatatacgcctcgactgggagacatatgtcccggaagacaaggaggaccggctagttgagctactggttttttatggtcctccgtttcccctgcgcgatcaggcgggaaatgagctggtgtgccctgacacgcccgaaggcggatgtctattgtggtcacctggcccttcctcttcatccgagttttcccacgaaacggactccagtgtggagggctcctcctctgcttctaatagggttgctcagaagctgattagtgtgatcttgcaggcacatgagggggtcccgtccgggcatctgtactgtatttctcctaagcaggttgtcgtgccggcaggcggaagctccaccatttacatcagtttcacgcccatggtcctgagccccgagattcttcacaaagtcgaatgtactggctacgcgcttgggtttatgtccttagattctaaagtggaacgcgaaattccaggtaaacgccatcggttacaggactttgccgttggacccctcaagttggatcttcattcatatgtgcgcccagcacagctgtccgtggagctggattacggtggcagcatggagttccagtgtcaggcgtccgacctcattcccgagcagccctgttctggcgttttgtcagaattggtaaccacgcatcatctcaagctcacgaacaccactgaaattcctcactactttcggctcatggtctcgcggccttttagcgtgtctcaagatggcgcttcgcaggaccatcgggcacccggacccggtcagaaacaggaatgtgaggaagagacagcttccgcagacaagcagctcgttttgcaggcccaagagaatatgctggtgaatgtctctttcagtctctccttggagcttctatcctatcagaagctcccagcagatcagactctgccaggcgtggacatacagcagtctgccagcggagaaagggagatggtgtttacacagaacctgttgctcgagtatactaatcaaaccacgcaagttgtgccactgagggctgtcgttgctgtacccgagctgcagctgagtacgagctgggtcgatttcggcacttgctttgtgtctcagcagagagtacgtgaggtatatctgatgaacctgagcgggtgtcgcagttactggactatgctgatgggagtcgtctcgtgcaccagcccacggtggtggtggaaggtgtgttcggtacggtcacctgcaccatgtggttccggggcaaaagccccaatgatgagggacacttgctgcctcacaagccccgaggctcccccacagccgtctgcccctggtccgtcctggcgcaaaaatattgcccagggtctcggcgcagcccttcagcataaagacaccgatcttggaacttggggtcccctcggatcctcctggaatggtaggactcctttccacaatggattgtcactggggcctcacgacatgtccagtgaactgacgta

SEQ ID NO: 28331 - DNA, 5276 bp, Artificial Sequence
  Description of Artificial Sequence: Synthetic coding sequence
atggagacacgatcctctaagactcgccgatcactcgcgtcccgaactaacgagtgtcaggggacaatgtgggcacctacttctccgcctgccggatcatctagcccttcgcagccgacctggaaatcctccctgtactcttcactggcttactctgaggcgtttcattatagtttcgcagccagaccccgaagacttactcagctggcgttggcgcagaggcccgaaccacagctccttcgtctgcgcccttcttctttgcgaactcaggacatcagccacctgctaactggggtgtttcgcaacctgtattccgcagaagttataggtgatgaagtttcagcttccctgatcaaagctagaggctcagaaaacgaacgtcacgaggaatttgttgaccagctccagcagattagagagctgtacaagcagcggttagatgaattcgagatgctggaaagacacattacccaagcacaggccagggctatcgcggaaaacgaaagggtcatgtcacaagcaggcgtgcaggatctcgaaagcctggtgaggctcccaccagtaaaatcggtatcccggtggtgtatagacagtgaactgctgcgcaaacaccacctaatctcccccgaggattactacacagatactgtgcccttccacagcgctcccaaaggcatttccctacccggatgttctaagttgacatttagttgcgagaagagaagtgtacagaagaaggaactcaataaaaagctggaggattcatgcagaaagaaactggccgaattcgaggatgaactagaccacacggtggattcgctgacgtggaacctgacacccaaggccaaggagcggacaagggaaccgctcaaaaaggcctcacaaccacgaaacaaaaattggatgaaccacctgcgcgtcccacaaagagagcttgatagactgctcctcgctcggatggagtccagaaatcactttctgaagaatcctcgctttttccctccaaacaccagatatggcggaaaaagcctagttttccctcccaagaaaccggctcctatcggtgaattccagagcacggagcctgaacagagttgcgctgatacccccgtattcttagctaaaccaccaattggattcttcacagactatgagataggcccagtgtacgagatggtcatcgccctgcagaacactaccacgaccagccgctacctgagggtactaccgccatccacaccatactttgctctgggcttaggaatgtttcctgggaaaggagggatggtggcccctggtatgacctgtcagtacatagtccagtttttccccgactgcttaggagattttgatgattttattctggtcgagactcagagtgcgcacacactgctcatacctttgcaggctcggcgtcccccacccgtgctcactctgtccccagtgctggattgtgggtattgcctgataggcggagtgaaaatgactaggtttatctgcaaaaatgttggcttttctgtcggccgtttctgcatcatgccaaagactagctggccgcctttatcatttaaagcaatcgccacggttggattcgtggagcagccaccatttggcattctaccatctgtttttgagctcgcgccaggacacgcaatactagtggaggtgttgttcagcccaaagtctttggggaaggcagaacagacgttcatcatcatgtgcgacaactgccaaattaaggagctggttacaattggtattggacagctgatcgccttggatctcatctacattagcggcgaaaagagccaacctgacccaggtgaattgaccgacttgacagcccagcattttataagattcgaacccgaaaacttgaggtctaccgcacgcaagcaactgataataagaaacgccacacacgtggaattagccttttattggcagattatgaagcccaatctgcagccactgatgcccggtgagactttttctatggactcaatcaagtgttatccggacaaagaaacagcattctcaattatgccaagaaaaggagtacttagtccgcatacggaccacgaatttatcctttccttcagtccccacgagctgcgcgatttccactccgttttacagatggtcctagaggaggttcccgaacctgtgtcctcagaagctgaatccctggggcacagctcctacagcgtagatgatgtgatcgtactggaaatcgaggtgaagggtagtgtcgagcctttccaggtgctcttggagccctacgccttgatcatccccggtgaaaactatattgggatcaatgtgaaaaaggcttttaaaatgtggaataactccaaaagcccgataaggtacctctggggaaaaatctcagattgtcatattatcgaggtcgagccgggaactggggtgatcgaaccatccgaagtcggcgatttcgaactgaactttactggcggagtcccaggacctacatcccaagacctgctgtgcgaaatcgaagatagcccctcgcccgttgttctccatatagaggccgtcttcaagggccctgccctgatcattaatgtcagtgctctgcagttcgggctgctccgcttgggccagaaagccaccaactccattcagattcgaaatgtcagtcagctgccagcaacatggcgaatgaaggaatcacccgtgtccctgcaagaaaggcctgaggatgtatcccctttcgacatcgaaccttcatctgggcaactccactctctgggcgaatgtcgtgtagacattactttggaggcactgcactgccagcaccttgaaacagtgctggagttggaggttgagaatggggcatggtcctacttgcccgtgtatgcagaggtacagaaaccccatgtgtatctgcagagtagtcaggtggaagtgagaaatctatacctcggggtccccaccaagacgacaattacgcttatcaacggaaccctgcttccaacccagttccactggggcaaattacttggacaccaggcggagttctgtatggtgacagtctctccaaaacatggcttattgggtccttcagaggaatgtcagctcaaactggagcttacagcacatacgcaggaagaattaacccacctcgcactgccttgccacgtttcgggtatgaagaaaccacttgtgttggggatcagtggcaaaccccaaggcctgcaagtcgccatcacaatatcgaaagagtcgtctgattgttcagtattttctacagagcagtggccagggcacccaaaagagctgagactcgatttcggctccgccgtcccacttcgaacccgggtcacccgccagttgatattaactaacagatcgccgatcagaactcgattctcactaaaatttgaatattttggcagcccacagaactctctttccaaaaagactagcctccctaacatgccccctgctctcctgaagactgtgaggatgcaggagcacctggccaagagagagcagttagatttcatggagtccatgctgagtcacggcaaaggagcagcattcttcccccacttctcacaagggatgctcggcccttaccagcagctttgcatcgatattactgggtgtgctaacatgtggggtgaatattgggataacctgatctgtacggttggagacctcctgcctgaggtgatccccgttcacatggcggcagtgggttgccctatctcctcactacgcacaacctcttacaccatcgatcaggctcagaaagagccagctatgcgtttcggaactcaggtgagcggaggcgatacagttacgcgcaccctgaggttaaataatagcagcccatgtgacatccggctggactgggagacctacgtcccagaggacaaggaagacagactggtcgaactacttgttttctacggacccccattcccccttagggatcaggctggcaatgagctagtgtgtccggacactcccgaaggtggttgtctgctgtggtctcctggtccatcctcttccagtgagtttagccacgagactgatagctccgtagaaggcagtagcagtgcatctaatcgggtagcacagaagcttatctctgtgattctgcaggctcacgaaggagtgccctcaggacatctctattgcatttcaccgaagcaggttgtcgttcccgcaggaggctctagcacgatttacatctccttcacgccaatggtgttgagccccgaaatcttgcacaaggtagaatgtacaggatacgctttaggctttatgtcactcgattccaaagtcgaacgggagatccctgggaagcgccatcgcttacaggattttgccgttggtcctctcaaattggacctgcacagctacgtcagaccagctcagctgtcagtggagctcgattatggtggatccatggagttccagtgtcaggcttctgacctgatccctgagcagccttgtagcggcgtcctctccgaacttgtcaccacgcaccatttaaagttgacaaacacaacggagatccctcattactttcgcctgatggtgagcagaccctttagtgtgagccaggacggcgcaagtcaggatcacagggcgccaggtccgggacagaagcaggagtgcgaggaagaaacagcaagtgctgataagcagttggtgctccaggcacaagagaacatgctggtgaatgtctccttctcactttcactggaacttctgagctaccagaagcttcccgctgatcagacgctgcccggagtggatattcagcagtctgcctccggcgagcgcgaaatggtgtttactcaaaatctgctcctggagtacaccaaccaaaccacacaagtagtgcctttgcgggctgttgtggcggttccagagctgcagctttccacctcatgggttgactttggaacttgtttcgtctcccagcagagggtacgcgaagtttatctgatgaatctgtcaggctgccgcagctactggaccatgctcatggggcaacaagaacctgcgaaagcggctgtggcatttagagtgtcgcccaattcagggctcttggaggcacggtccgctaatgctcctcccacaagtatcgctctccaagtgttcttcaccgcccgatcatccgagctgtatgagagcacaatggtggttgagggcgtgctgggagaaaagagctgcaccttaaggctgagaggtcaaggcagctacgacgagcgttatatgttgcctcatcagcccta

SEQ ID NO: 28332 - DNA, 237 bp, Artificial Sequence
  Description of Artificial Sequence: Synthetic coding sequence
atgcgcccttgcatatggattcatgttcatttgaagccaccatgtcgactggtcgagcttctcccattcagtagtgcgctgcaggggctgtcccacttgtcactggggacaactctgcccgttatactacccgagagaaacgaagaacagaacttacaggagctgagtcacaatgcagataaataccaaatgggcgattgttgcaaagaggagatcgacgactcaatcttttactag

SEQ ID NO: 28333 - DNA, 2940 bp, Artificial Sequence
  Description of Artificial Sequence: Synthetic coding sequence
atgagaggttaccacggggaccgtggctctcatccacggccagcaaggtttgccgatcaacaacacatggacgttggacctgccgctagggcaccatatctcttgggatctagagaagccttcagcaccgagcctagattttgtgcgccacgggcaggtctaggccatatttcccccgagggtcctctgagcctgtcagaaggcccaagcgtaggtccagaggggggaccagcaggagccggagtggggggagggtcatccacgtttcctcggatgtaccccggacaagggccttttgatacttgtgaggactgtgtggggcacccacagggtaagggagctccaaggttacccccaaccctgttggatcagttcgagaagcaactacctgttcaacaggatggctttcatacacttccatatcaaaggggtcctgccggagcaggacccggacccgcacctggtacagggacagcaccggagccccgttccgaaagcccatcccggatccgtcacttggtacacagcgtgcagaagctgttcgccaagtcccatagcctcgaggctcccggtaaaagggactataatggccctaaagccgagggtcggggtggcagcggcggtgattcctacccaggcccaggctcaggcggtcctcacacatctcaccaccaccatcatcaccaccaccaccaccatcaccagtctcgccacggaaagcgatccaagtcaaaggaccggaagggcgacggacgacatcaggctaagagcaccgggtggtggagctctgacgacaacctcgattccgacagtggatttttggctggcggaaggcctcccggtgagcccggtggacctttctgtttggaagggccagatggttcctatagggacttaagttttaaaggtcgctctggcggttccgagggtaggtgcctcgcgtgcactgggatgtcaatgtcactagacgggcaatctgtaaaaaggagcgcttggcacaccatgatggtgagtcaggggcgagatggttatcctggggctggaccgggaaaaggtctccttgggcctgagacgaaggccaaagccaggacctaccattacctccaggtgccacaggacgactggggaggttaccccacaggtggcaaggacggtgaaatcccctgccgtcgcatgcggagcgggagctatataaaggccatgggggacgaagagagcggagatagcgacgggagccctaagacttctcccaaagcagtcgctcgtcgtttcaccacccggcgatcctcgtccgttgaccaggctaggattaactgctgcgtgcctccaaggatccatcccagaagctcaatcccagggtattctcgaagtctgacaaccggacagctgtctgatgagctgaatcaacagttggaggcggtctgcggcagtgtgtttggagagctcgagtctcaagctgtagatgcattagatttgcccggttgcttccgaatgaggtcccattcatatctgagagctatacaggcaggatgttcgcaggacgatgattgtctgccgctgttggccactcccgcagcggtcagtgggcgtcccggaagttccttcaacttccggaaagccccacctccaattccaccgggttcgcaggcacctcctaggatttccatcaccgctcagtcatccacagattccgcgcatgagtctttcactgccgctgaaggacccgctagaaggtgttcctccgccgatggactcgatggacctgccatgggtgctagaaccctcgagctggcgccagtgcccccaagggctagccctaaacctcctacgttaattattaaaacaatccccggaagggaagaactaaggagcctcgcccgacagaggaagtggagaccaagtattggagtgcaggtcgagacaatttccgactcagatacggaaaacagatccagacgggagttccacagtatcggcgtgcaggtagaagaagataagagacgcgcaagatttaagcgctccaatagcgttaccgctggggtgcaggccgatctcgagttggaaggcctcgccggactcgctaccgtcgccactgaggacaaagcactccaattcggcaggtcatttcagagacacgcttctgaaccccagcccggtcctcgcgcacctacatactccgtgtttcggactgtgcatacccagggtcagtgggcataccgcgagggatatccgctgccctatgaaccaccagccaccgacgggagccccggacctgcacccgctccaaccccaggtcccggagctggacggcgagattcttggattgaaagaggatctcggagccttccagatagtgggagagcatctccctgtcccagggacggggagtggtttataaagatgcttcgtgccgaagtggagaagctcgagcactggtgccagcagatggagcgggaggcggaagattatgagctgcccgaagagatattggagaaaattcggtcagccgtagggtctacacaactgctccttagtcagaaagtccagcagttctttagattatgccagcaatccatggacccaacagcttttcccgtgccgacattccaggacttggccggattctgggaccttctgcagttgtccatcgaagacgttaccctgaagtttctggagctgcaacagctgaaggccaactcatggaagctgttagagcccaaggaggagaagaaagttcccccacctattccaaagaagcccctcagaggacgtggagtgcctgtgaaggagcgatccctggattccgtcgacaggcagcgccaggaggcccgaaaacggctgctggctgcgaaaagagctgcttcatttcgacatagttcagcaactgagtccgccgattccatagagatttacattcccgaggcccagactaggttgtag

SEQ ID NO: 28334 - DNA, 5357 bp, Artificial Sequence
  Description of Artificial Sequence: Synthetic coding sequence
atgggtattagtacggtgatccttgaaatgtgcctcctgtggggtcaggtgctgtcaaccgggggatggattccacgcactaccgattacgcctcactgatcccctccgaggtgcctctagatcccaccgtggcagagggatctcccttcccctccgaaagtactctggagtcgacagttgcagagggcagccccatttccttggagagtaccttggagagtacagtggcggagggcagtctcatcccctccgagtcaaccctagagagcactgtcgccgagggttccgacagcggactcgccctgcgcctcgtcaacggtgatggcaggtgtcaaggacgagtagagatactctatcgcggatcatggggtactgtctgtgacgattcctgggataccaatgacgccaatgtggtgtgtagacagttgggctgtggatgggcaatgtcagcgccaggtaatgcttggtttggccagggatcaggccctattgccctggacgacgtgcggtgttccggccacgagtcctacctgtggtcttgcccgcacaatggatggctttcccacaactgcggccatggcgaggatgctggagtgatctgttcagccgcacaaccccagtccactctgagaccagagtcctggcccgttaggatttctccacccgtgcccaccgagggatccgaatcttctctcgcacttagactagtgaacgggggtgatcgatgccgcggtagagtggaggtgctgtacagagggagctggggtacggtttgcgacgattattgggataccaatgatgcaaatgtcgtgtgtaggcagttaggctgtggttgggcaatgtccgcgccaggaaatgcacagttcggacaaggcagcggtccaatcgtcctggatgacgtgcgatgctccggacatgaatcatacctttggtcatgccctcacaatggatggctcacccataattgcggtcattcagaggacgccggagtcatatgttctgcgcctcagtcccgcccaacaccttcgcccgacacctggccgacatcccatgcttcaacggcgggacccgagtcgtctctggccctgcgccttgtgaacggtggagatcgatgccaggggcgagtagaagttctttacagagggtcctggggcaccgtgtgtgatgatagttgggacacatccgacgcgaatgtagtctgtcggcaactgggttgtggctgggccaccagcgccccagggaacgctcggtttggacagggctccgggcctatcgttctggatgacgttcgctgttcaggatatgagagttacctgtggagctgtcctcataacgggtggcttagtcataactgtcagcactcggaggacgcaggggtcatctgttccgccgcacattcatggtcaaccccaagcccagatactcttcccaccatcacactgcctgcttcaacagtcggaagcgaatcaagcctggctctgaggcttgttaatggaggcgataggtgtcaggggagagtagaagttctataccaggggtcctgggggactgtgtgcgacgactcctgggacacaaatgatgcgaatgtggtgtgccgccagctggggtgtggatgggccatgtccgcacccggaaacgcccgtttcgggcagggatccggccctatcgttctggatgatgtacgttgttccgggcacgagtcctatctatggtcatgtcctcacaatggctggctgtctcataattgcgggcacagcgaagacgccggagtaatctgttccgccagccagtccaggcctacgccctctcccgatacttggcccacaagccatgcttctaccgccggaagtgagagctccctcgcactccggctggtgaacgggggtgaccgatgtcagggcagggtggaggttctgtataggggctcttggggtacggtctgtgacgattattgggataccaacgacgccaacgtcgtgtgtcgccaactgggctgcggatgggcgatgtccgctccgggaaatgcgcgatttggccaaggcagcggacccatcgtactggacgatgtccggtgttccggccatgaatcatatctatggtcttgccctcacaacggatggctgtcgcacaattgtggtcaccacgaagatgctggagtgatctgttcggcttcccagtcacagcccacccccagtcccgatacttggcccacctctcatgcctctacagcaggctctgagtcttccttggccctccgcctggttaatggcggtgatagatgccagggtagagtcgaggtactgtacagaggcagctgggggacagtttgtgacgattattgggataccaatgatgctaacgtggtgtgtaggcagctcggatgcggctgggccaccagcgcccctggcaacgctaggtttggccagggatctgggcctattgtactcgacgatgtgcgatgttccggccatgaatcctacctgtggtcatgcccccacaatggctggctgtcccacaactgtgggcatcatgaagacgctggtgtgatatgttctgcatctcaatcccagccaactccttcacccgatacttggcctacctcaagggcatctacagcgggatccgaatccactctggccctccgcctggtgaacgggggtgacaggtgccgcggtcgtgttgaggtgctttatcagggaagttggggcactgtgtgcgacgactattgggataccaacgatgctaacgttgtctgccgccaattgggttgcgggtgggccatgtccgcccctggcaacgctcaatttgggcagggttcaggtcccattgtcttggacgatgtgcgatgctctggacacgaatcctacctctggtcttgtcctcacaacggctggctatcacacaactgtggtcaccatgaagacgcgggtgttatctgttcagctgcacagtcgcagtctactcctaggccagatacctggctgacaactaacctgcccgctttgaccgtgggtagtgagtctagtctggccctgcgattagttaatgggggagatcgttgtagaggacgagtggaagtgctttaccgagggagttgggggacggtatgcgacgattcctgggataccaatgacgccaatgtggtttgccgtcagctgggatgtggatgggctatgagtgcccctggtaacgctagatttggacagggctctggtcccattgtgctggatgacgttcgctgttctggcaatgagagttacttatggtcctgtccacacaagggctggctgacccacaactgtggccaccacgaagacgccggagtgatttgttctgccacccagattaatagcaccacaactgattggtggcaccctacaacaaccaccacagctcgccctagcagcaactgtgggggatttctattttacgcttccggaacattctctagccctagctatcccgcatattatcccaacaatgctaagtgtgtctgggaaattgaagtgaacagcgggtaccgcataaacttaggatttagcaatctcaaattggaagcacatcataactgtagctttgattacgtcgaaatctttgatggcagtctgaactcatcgcttctcctcgggaagatctgcaacgatactaggcagatctttacaagctcgtacaacagaatgaccatccacttcaggagcgacatctcatttcagaatacaggatttctggcctggtacaattccttccccagtgatgctaccctccgcctggtcaacctcaattcctcgtatggcctgtgcgctggtagggtagaaatataccacggaggcacgtggggaacagtttgtgacgatagttggactatccaagaagctgaagtcgtgtgccgccagttagggtgtggacgtgccgttagcgctctggggaacgcttacttcggttctggcagcggacccatcaccctagacgatgtggagtgcagcgggactgagtcaactctgtggcagtgtcgtaacagggggtggttttcacataactgcaatcaccgggaggatgcaggagtcatttgtagtggcaatcacttgtcaactcctgcgccattcctgaatatcacccggccaaacaccgactatagctgcgggggttttctctcacaaccctctggtgactttagcagccccttctatccgggaaactatcccaataatgcaaagtgcgtttgggacattgaggtccaaaacaattacagggtcacagtgatcttcagggatgtccagctggaaggcggatgtaactatgattacattgaggtctttgacggcccttaccgaagcagcccacttatagccagggtctgtgatggtgctcgcggaagtttcacaagctcttccaactttatgtccattagatttatcagcgaccatagcattaccagacggggatttcgtgccgagtattactcctccccatccaatgactccactaatctcctgtgtcttccaaaccacatgcaggcttctgtatcacgcagttatctgcagagtctgggctttagcgcttccgacctggtgattagtacatggaatggctactacgagtgccggccacagatcacccctaatcttgtgatttttacaatcccatactccgggtgtggtacattcaaacaagcggataacgacacaattgactactctaacttccttacagccgctgtctcgggcggtatcataaaacgaagaactgacctgcgcatccacgtaagttgtcggatgctgcagaacacttgggtagacactatgtacatagctaatgacaccatccatgtggccaacaacacaatacaagtcgaggaagttcaatatggcaatttcgacgtcaatatctccttctatacatcttcgagctttctgtatcctgttacctcccggccatactatgttgacctgaatcaggatctgtatgttcaagcagaaatcttacactctgacgcagttctgacattgttcgtagacacgtgcgttgcaagcccttacagtaatgacttcacctcgttaacctacgacttaatccggagcggatgcgtcagggacgacacatacgggccatatagctcaccaagcttgcggatcgcgcgatttagattcagagccttccacttcctgaaccgattcccgtctgtctacctgcgttgcaagatggtagtgtgtcgcgcatatgatcctagcagccgttgttatcgaggttgtgtattgcggagtaaacgggacgttggatcatatcaggaaaaggtcgacgtggtattggggccaattcagctgcagactcctccccgtagagaagaggagcctaggta

SEQ ID NO: 28335 - DNA, 5357 bp, Artificial Sequence
  Description of Artificial Sequence: Synthetic coding sequence
atgggcatctccaccgtaatccttgagatgtgcctgctgtgggggcaggtcctaagcaccggcggatggatcccaagaacgaccgactatgcatcactgataccttcggaagtacccctggatcctactgtcgcagaaggatctccctttccatccgagagcacgctggagagcacagttgcagagggtagccccatttcactcgaatctacgctagagagcactgtggcggagggctcactgatacccagcgaatccacactggaaagcaccgtcgccgaagggtctgattcaggactggcgctgagactggttaacggagacggacggtgtcagggccgagtggagattctgtataggggcagttggggcacagtctgcgatgacagctgggacactaacgacgcgaatgtcgtgtgccggcaattaggttgcggatgggccatgagcgccccaggaaacgcctggtttggccaggggtctggacctattgcattagacgatgtgaggtgctcagggcacgagagctacctgtggtcatgtccccataatgggtggctgagccacaactgtggccatggtgaggatgccggagttatttgttccgctgcacagccccagagtactctgcgaccagaatcttggcctgtgcggatcagcccgccagtgcccactgagggctctgaatctagcctcgctttgcggctcgtcaatggcggagaccgctgtcggggtcgcgtggaggtactctacagaggctcctggggaacagtgtgtgacgattactgggataccaatgacgccaacgtggtgtgccgtcaattaggatgcggctgggccatgtccgcccctggaaacgcccagttcggccaaggttcaggcccaatcgtgttagatgacgtgcgctgttctggtcacgagtcctacctgtggtcttgtccacacaatgggtggctgactcacaattgcggtcattctgaggatgccggtgtgatttgttctgctccacagagccgcccaacaccaagccctgatacatggcctacctcacatgccagcacagcgggtccggaaagttccctggccctcaggctggtgaacggaggggacagatgccagggtcgagtcgaggtgctatacagaggatcttggggaactgtttgcgacgactcttgggatacgagtgacgctaacgtggtgtgccggcaactcggatgtggctgggccacgtctgctcccggtaatgcgcgtttcggacaaggctcaggaccaattgtgctggatgatgtgaggtgttccggatacgaatcttacctgtggtcgtgccctcacaatgggtggctgtcacataactgtcagcattcagaggatgcaggggtcatctgcagcgccgcacattcttggagtacaccctccccggacaccctaccaactattactttacccgctagcacggtcggaagtgaatcatcactcgccctcaggctggtaaacggcggtgatagatgccaaggtcgggtcgaggttctttaccaggggagttggggcacagtatgtgatgacagttgggacacaaacgatgcgaatgtagtgtgtaggcagctcggctgcggctgggcaatgagcgcacctggcaacgcccgattcggccaaggtagcgggccaatcgtgctcgacgatgtaagatgttcaggccatgaatcttacttgtggtcctgtccacacaacggctggctgtcccacaactgtggtcattctgaggacgctggcgtaatctgttcagcttcacagtcgcgccctactccttctccggacacctggcctacatcccacgcatcgaccgccggttccgaaagctctctggccctccggttggtaaatgggggtgatcgctgtcagggacgggtggaagtgctttatcggggtagttggggcacagtgtgtgatgactattgggatacaaacgacgcgaacgtcgtgtgcagacaactgggatgtgggtgggcgatgagcgcgccaggaaatgccaggttcggccagggcagtggcccaatcgtgctggatgacgtgaggtgcagtggccatgagtcatatctgtggtcatgcccacacaatggctggttgtcacacaattgtggacaccatgaggacgcaggggttatctgttcggcaagtcagtcgcaacccaccccgtcccccgatacatggcctacttcccatgcatcaaccgcaggaagcgagtcctcccttgcactgaggctcgtcaacggaggtgatagatgtcaaggcagggtcgaagtattataccggggttcctggggtacagtctgcgacgactattgggacacgaacgatgcaaatgtcgtgtgtcgccagttggggtgcggctgggccactagtgcaccagggaatgcccgttttgggcaaggatccggtcctatcgtgttggatgacgttcggtgcagcggacatgagtcctatctttggtcctgcccccacaatgggtggctgagtcacaactgcgggcatcacgaagatgctggagtgatttgttctgccagccagtctcaacccacaccgtcccctgacacttggcccactagtagggcgtcgaccgccggaagcgagtctactttggcactgagactggtgaacggcggtgatcgctgcagggggcgagttgaagttctgtatcaggggagttggggaaccgtgtgtgatgattactgggacactaacgatgcaaatgtggtgtgcagacagctgggctgcgggtgggccatgagtgcccctgggaacgcacaatttggacagggctccggaccgatcgtgcttgacgacgttcgctgttcaggccacgagagttatttgtggagctgtcctcataatggatggctgagccataattgtggtcaccatgaagatgcgggtgtaatttgcagcgcggcacagtcccagtccacccctagacccgatacctggcttaccacaaatctgcccgcactgacagtcggaagcgagtcttctctggctctccggttagtgaacggcggagatcgttgccgtgggagagtcgaggtgctttatcggggatcctggggaaccgtttgcgatgacagttgggacaccaacgacgcgaatgtggtgtgccgccaactgggttgcgggtgggcaatgagcgccccaggcaatgcacggtttggtcaagggagcgggcctatcgtattggatgatgtaaggtgttccggaaacgagtcttacctctggagctgtccgcacaagggctggctcacccacaactgtggacaccacgaagacgccggagtcatttgctcagccactcagattaacagtactacaactgattggtggcatcccacaactacaactactgctcgtccatcgtcgaattgtggagggtttctgttctatgcatctgggactttcagctccccctcatatcccgcatactaccctaataacgccaaatgcgtgtgggagatcgaggttaactcgggttacaggattaacctgggattttcgaacctcaaactggaagcccaccacaactgctccttcgattacgtggagatttttgacggtagcctgaacagctcgctgctcctcggaaaaatttgcaacgacactcgccagattttcacctcctcctataaccgcatgacgatccacttccgaagtgacatcagttttcagaatacagggttccttgcctggtacaactccttcccctctgatgcaaccttgcggctagttaacctgaattcgagctatgggctgtgtgccggaagggtggaaatataccacggtggaacctgggggaccgtttgtgatgatagctggacaatacaggaagccgaggtggtctgtcggcagctggggtgcggtagagccgtcagcgcactggggaatgcctacttcgggagcggctctggcccaatcacactggacgacgtggagtgttccggcaccgagtccacgctgtggcagtgcagaaacagaggctggttcagccacaattgcaatcaccgtgaggatgcgggagtaatctgcagcggcaatcatttgagcacgccagcgccatttctcaatattacccggcctaacaccgattacagttgtgggggatttctgagccagcccagcggagacttttcgtctcctttctatcccggtaactaccccaataacgcaaagtgtgtgtgggatatcgaggttcagaataactatagagtgacggtcatctttcgtgatgtgcaactggaggggggttgtaactatgactatattgaagtgttcgacggaccatatagatcatcgccactgattgcacgcgtgtgcgacggcgctagaggcagcttcacttcaagttcaaatttcatgtctattcgttttataagtgaccattcaatcacacggcgaggtttccgcgctgaatattacagcagtccatctaatgactcaactaatctgctctgtctgcctaaccacatgcaggcctccgtgtcccggtcgtacctgcagtctctgggatttagcgcatcagacctggtgatcagtacctggaacggatattacgagtgtagaccccaaatcactccaaatctcgttatatttacaataccttatagcgggtgtggcacattcaagcaggccgacaacgataccatcgactattcaaacttcctgaccgcggctgtgtctgggggaattattaaacgaagaacagacctgaggattcacgtgagttgcagaatgctacagaacacctgggtggacacaatgtacatagcaaacgatacaattcatgtggcaaataatacgatccaggttgaggaggttcagtatgggaattttgatgttaacatctccttttacacgtcaagctccttcctgtatccagtgactagcagaccgtactatgtcgatttgaaccaggacctttacgtccaggcggaaattctgcacagcgacgccgtgctgacattgtttgtggatacatgtgtggcatccccctacagcaacgacttcacatccttgacgtatgatctgatccgttcaggttgcgtgcgggacgacacatatggtccttacagctctccctctctccgaatagctaggtttagatttcgtgcttttcacttcctgaaccgtttcccttccgtgtatttacgttgtaagatggttgtatgtcgagcatacgatccgagctctcggtgctatcgtgggtgcgtattacgtagcaagcgggatgtggggtcttaccaagagaaggtggacgtggtgttgggcccaattcagctacagactccccctagaagggaggaagagccacggta

SEQ ID NO: 28336 - DNA, 7241 bp, Artificial Sequence
  Description of Artificial Sequence: Synthetic coding sequence
atgggtatatccacggtcatactggagatgtgtctcctgtggggtcaggtgctcagtactgggggatggataccaagaacaaccgactacgcgtccctgatcccaagtgaagtacctctggacccaactgttgccgaaggttcaccatttcccagtgagagtacactcgaatcaactgtggcggagggcagcccaattagcctggagtccactctggaatctaccgtggcggaaggaagcctcattccttcagagtccacactcgagtctacggtggccgagggttccgactctggtcttgccttgcggctcgtcaacggggacggccgttgtcagggcagagtcgagattctctacagaggctcatggggaactgtttgcgatgattcctgggatacgaatgatgcaaacgtggtctgccgccagcttggctgtggttgggcgatgagcgcccctggcaacgcttggttcggccagggaagcggtccaatagcattggatgacgtgcgttgctccggacatgagagttacctgtggtcctgccctcacaatggctggctgtcacacaattgcggtcatggcgaggacgccggtgtgatctgctctgcggctcagccccagtctaccctgaggcccgagagctggcccgtccgaatttctccgcctgtgccaacagagggtagcgaaagctctttggcccttcgtctggttaacggcggagataggtgccgaggcagggtagaagtcttatatagaggatcatggggaaccgtctgtgatgactattgggataccaatgacgcaaacgtcgtgtgtcgccagctgggctgtgggtgggcaatgtccgccccagggaacgcgcagttcggacagggaagtggtcccatagttctcgacgatgtaaggtgcagcggacatgaaagttacctgtggtcttgccctcacaatggttggctgacacacaactgcggccatagcgaagacgccggagttatatgtagcgctcctcaatcacgtccaacccccagccctgatacatggccaacaagccatgcctcaacagccggaccagagagtagtctggccctgaggctggtcaatggaggcgatcgttgtcagggccgagtcgaggtgctatatagaggatcctggggaactgtgtgcgacgactcttgggacaccagcgatgccaacgttgtctgtagacagctgggatgcggctgggccaccagtgcccctggcaatgccagatttggccaggggtccggccctatcgtgctggatgacgtgcgctgcagcggctacgagtcttacctttggagttgtccacacaatgggtggctttctcataattgccagcatagcgaagacgcaggggtaatctgttctgctgcccatagttggtccacacctagccccgacactctgcccaccatcacattacccgctagtactgtagggagcgaatcctccctcgcattgcgactagtcaacggaggagatcgatgccagggtcgggtggaagttctgtatagaggcagctgggggacagtctgcgatgactcctgggacaccaatgatgccaacgtcgtctgtcgccagctggggtgtggatgggccatgctggctccaggcaatgcacgctttggacaagggtctgggcctatcgttctcgatgacgtacgttgcagtggaaacgagagctacctgtggagctgcccacacaatggatggctgagtcataattgcggccacagtgaggacgccggagttatctgttctggccctgagagttctctggctctgcggctggttaacggaggggatcgctgtcaggggagagtggaggttctgtaccgagggtcatggggaaccgtctgcgatgattcatgggatactaatgatgccaacgtggtgtgcagacagctgggctgcgggtgggcaacatccgcgccagggaacgcccgattcgggcaagggtccgggccaatcgtgttggacgatgtgcgatgctccgggcatgagagctacctatggagttgccctaataatgggtggctttcacataactgcggtcatcacgaggatgctggagtaatttgctcggctgcgcagagtaggagcacgcctaggcctgacactttgtcaacaatcactctgcccccaagtactgtgggatctgaatcaagtctgactctgcggctggtcaatggcagcgaccgctgtcagggaagggtagaggtgttgtacaggggatcctgggggacagtttgcgatgactcctgggataccaacgacgcaaacgtcgtctgtagacagctcggctgtggttgggctacttccgcccctggcaacgccagattcggacaaggctctggacctatagttctcgatgatgtccggtgcagcgggcatgaaagctacctctggtcgtgtcctcacaacggctggctctcccacaactgcggtcatcacgaagatgcgggagtgatatgctctgtgtctcaatcccggcctacccccagcccagacacctggcccacctctcacgcgagtacggcgggacccgaatccagcctggccttgaggctggtgaatggcggagatcggtgtcagggaagagtggaggtgctctaccggggttcatggggtaccgtttgtgacgattcttgggatacgagcgatgcgaatgtagtttgccggcagctgggctgtggttgggccacctccgctcccggaaacgccagattcggacaaggatccgggcctatagtgctggacgatgtccgttgcagcgggtatgaaagctacctctggtcttgtcctcacaacggatggcttagccataactgtcagcatagtgaagacgccggagtgatctgttcagctgctcactcgtggagcactccatcgccagataccctgccaaccattacactccctgccagtaccgtgggaagtgagtccagcctggccctccgactcgtgaatgggggagatcgttgccagggaagagttgaagtgctttatcagggcagttgggggacagtgtgcgacgactcttgggacacaaatgacgccaacgtcgtttgtcgtcagctggggtgcggctgggctatgagtgcacccggtaacgccagatttggacaggggtccgggcctatcgtccttgatgatgtccgctgttccggccacgaaagttacctctggagctgcccacataacgggtggctgtcccataattgcggtcacagcgaagacgccggagtcatctgtagcgccagtcagtcccgccctacaccttcaccagacacctggcctacgagccacgctagcaccgctggctcggaatcctccttggcactccgattggtgaacggtggagacagatgccaaggccgtgttgaggtgttgtatcggggatcctggggcaccgtgtgtgatgactattgggatactaatgatgcaaacgtcgtgtgtcggcagctggggtgtggatgggccatgtctgctccagggaatgcaaggtttggtcaggggtccggaccaattgtgcttgatgatgttcgatgttcaggacacgagtcctacctctggtcatgtccccataatggctggttgagccacaattgtgggcaccacgaggacgctggcgttatctgttcagctagccagtctcagcctaccccatcccctgatacatggccgacaagtcatgctagtaccgcaggtagcgagtcctctctggccttacggttggtgaacggcggagatagatgtcagggcagagtagaagtcctttatcggggtagctgggggacggtttgtgatgattactgggacaccaatgacgctaacgttgtgtgcaggcagttgggctgtggctgggcgacatctgccccaggaaatgcacgtttcgggcaggggtccgggcctatcgtcctggatgacgtacggtgcagtggtcatgaatcatacctatggtcatgcccacataatggatggctgtcacataactgcgggcatcacgaggatgctggggtgatttgttctgcaagtcagagtcagcccaccccctccccagatacatggcccacatctcacgcctcaactgcaggatcagagagcagtctcgccctcagactggtgaacggcggtgataggtgccaggggagagtggaggtgctgtaccggggttcatgggggacagtgtgtgatgactattgggataccaatgacgcaaacgtagtctgtaggcagctcggatgcgggtgggctacttccgctcccggaaacgcgcgttttggccagggttcgggaccaattgtcctggatgacgtgcggtgctccgggcacgagagctatctgtggtcttgcccccataatggatggctcagccataactgtggtcaccatgaggatgccggtgttatctgtagcgcttcccaatctcagcctaccccaagccccgatacgtggcccacgagtagggcctccacggcgggatccgaatccaccctggctctgagactcgtaaatggcggagatcgatgtcgtggcagggtcgaagtgctctatcagggctcctggggcaccgtatgcgacgactattgggacaccaatgacgccaacgtggtgtgccggcaactggggtgtggctgggccatgagtgcccctggtaacgcccaatttggccaaggctcgggtcccattgtattagatgatgtgagatgcagtggccacgagtcatacctgtggagttgccctcataacgggtggcttagtcataattgcggccatcatgaggatgctggagtgatctgtagcgcagctcagtcccagagcacgccccgtcctgacacatggctgaccactaacttgcccgcactgaccgttggcagcgaaagctccttggcccttaggcttgtcaacggaggcgatcggtgtcgcggacgggtcgaggtgttgtatcggggatcctgggggaccgtttgtgatgattcgtgggacacaaacgatgcaaacgtggtgtgtcggcagttgggctgtgggtgggcaatgagtgctcctggcaatgccaggtttggtcaaggcagcgggcctattgtcctggatgatgtgaggtgcagtgggaacgagagctatttatggtcttgcccccacaagggctggctcacccacaattgtggtcatcatgaggatgctggggtgatctgttctgccacacagattaactcgaccactactgattggtggcaccccactactaccaccaccgcaaggccatccagcaattgcggcggttttctcttttacgcttcagggaccttttcctccccaagctaccccgcatactatcctaacaacgcgaaatgcgtttgggagatagaggttaattctggataccggatcaacttgggattttccaaccttaaactggaggcacatcacaactgctcgtttgactatgtggagattttcgacggttccctgaatagctctttgctgctgggaaaaatctgcaacgacaccaggcagatttttacatcctcatataatcggatgaccattcatttccgcagcgatatctcctttcagaacacagggtttctggcatggtacaacagcttcccctccgacgctacacttcgtctcgtgaatctcaatagctcctatggcctgtgtgccggtagggttgagatttaccacggtggaacctggggtacggtgtgcgatgattcctggacaattcaggaagctgaagttgtgtgtcgccagctagggtgcgggagggctgtgagcgccctgggaaacgcctacttcggaagcgggtcaggacctataactctcgatgacgtagagtgttccggcaccgaaagcacattgtggcaatgtaggaaccgcggatggttctcacataactgtaaccatagagaggacgcaggggtgatttgcagtggaaatcatctgagtacaccagctccatttctgaacatcaccaggcccaacaccgactactcatgtggaggtttcctgagtcagccatcaggcgattttagtagtcctttttatcccggaaactatcctaacaatgcaaaatgcgtctgggacattgaggtgcagaacaattatagggtgaccgtgatctttagggatgtgcagctcgaggggggatgtaactatgactacatcgaggtgttcgacgggccatataggtcttctcccttaatcgctcgggtttgtgacggagcaagaggatcttttacgtcctcaagtaatttcatgagcattcgttttatcagtgatcacagcatcaccagacgcggtttccgggcagaatactactcatccccatctaatgattcaactaacctgttatgtctgcccaaccatatgcaggccagcgtgagcagaagttatttgcagtctctgggtttcagtgcgagcgatctggtaattagcacttggaatggctattatgagtgtcgcccacagattaccccaaatctggtcatttttaccataccctattcaggctgtggaacttttaaacaggctgataacgacacgatagattactcgaatttcttgaccgccgctgtgagtggcggtatcatcaaaaggaggaccgatcttaggattcacgtgagctgccgaatgctccagaacacatgggtggacacaatgtacatcgcaaacgacacgattcatgtggcaaataacactatacaggtggaggaagtgcagtatgggaacttcgacgtgaacatctcattctacaccagcagtagctttctctacccagtaacatctcggccatactacgtggatctcaaccaggatctgtatgttcaggccgaaattcttcactctgacgctgtcctgacactgtttgtggatacctgtgttgcatcaccctattccaatgacttcaccagccttacttacgatttgatccgtagcggctgcgtccgggacgacacctacggaccctactcctctccctccttgaggattgcccgatttcgcttccgagcgttccatttcctgaatcgttttccatcagtctatttgagatgcaaaatggtagtctgccgtgcttacgatccctcttcccgctgctatcggggttgcgtgctgaggtcgaagcgggatgtgggcagctatcaggagaaggtggatgtggtgcttggccctattcagctccagacaccgccaaggcgggaggaagagccacgcta

SEQ ID NO: 28337 - DNA, 5357 bp, Artificial Sequence
  Description of Artificial Sequence: Synthetic coding sequence
atgggaatttccactgtgattctcgagatgtgtctattgtggggccaggttttatccacagggggatggatccctcgaaccacagactacgcttcgctgatccctagtgaggtgcccctggacccaactgtcgccgaaggctcacctttcccttccgagagcacactggaatcgacagtggcagaaggtagcccaataagcttggagagcaccctggagtccaccgtggctgagggatctctcatccccagtgagtctaccctggagtcaaccgtcgctgagggcagcgattccgggctcgccctgaggctcgtaaacggcgacggaaggtgccagggtcgggtggagattttatacaggggctcatggggtaccgtttgtgatgactcttgggacaccaatgatgcgaatgtcgtctgtcgccagctcggttgcggctgggcaatgtctgccccaggcaatgcctggttcggccagggttcaggtcccattgccctagatgatgtgcggtgttccggccacgagtcttacctttggtcatgtccacataacgggtggctgtctcataattgcggccatggtgaagacgctggcgtcatatgcagcgcagcccaaccgcagtccacgttgaggcctgagtcttggccagttagaatctccccccctgtgccaactgagggtagtgaatcttctcttgctctcaggttagtgaacgggggagataggtgtcggggaagagtggaggtgctatatagaggctcttgggggacagtgtgcgatgactattgggacaccaatgacgctaacgtggtgtgtaggcaactgggatgcggttgggccatgtcagcacctgggaatgcccagtttggacagggaagtggtccaatcgtcctagatgacgtgagatgctccgggcacgaatcttacctctggtcctgtccacacaatgggtggctcactcataattgtgggcattcagaagacgcaggagtgatttgttctgcccctcagagtcgcccaaccccatcacccgatacttggcccacaagccacgcgtctactgccggacctgaaagctcccttgcgcttcgtctggtgaacggaggcgacagatgccagggcagggtggaggtgctgtaccgcggatcgtggggcacagtttgtgacgattcctgggatacctctgacgctaatgtagtgtgcaggcagttgggttgcggctgggctacaagcgctcctggaaacgcacgattcggacagggctccggcccaattgtgctggacgatgtgagatgtagtggatatgagtcttacctgtggtcttgtccacacaacgggtggctgtcccacaactgccaacattcagaggatgcaggcgtgatatgctctgccgcacacagctggagtacaccctcccctgataccctgccaactataactctgcctgcatccaccgtgggctctgagagttcactcgcgctgaggctggtgaatggaggagaccgctgtcagggcagggtggaggtgctttatcaggggtcatggggaacagtctgtgatgacagctgggataccaatgatgcaaatgtcgtctgcaggcagttagggtgcggttgggccatgtctgctcccggaaatgcgagatttgggcaaggttcagggccaattgtgctggacgacgttcgttgttctggccacgagtcttatttgtggtcctgtccacataacggatggctgagccacaattgcggccacagcgaggacgccggtgtaatttgttctgcatcccaaagccgcccaacaccgtcacccgacacttggcccacgtctcacgcgtctactgccggatcagaaagttcactagccctgagattggtgaacgggggagatcggtgtcaaggcagggtcgaggtcctgtatcgagggtcatgggggactgtatgtgatgactattgggataccaatgatgcgaatgtggtgtgcagacagctcgggtgtgggtgggctatgtctgctcctggaaacgcgaggtttggacaaggctccggcccaatcgtcctcgacgacgtgaggtgttccggacacgagtcttacttgtggagctgtccccataatggatggctgagtcacaattgcgggcaccacgaagacgccggagttatttgcagtgctagccaatcccaaccgactccaagcccggatacatggccaacctcgcatgcctcaacggcgggttctgagtccagcctggctctgaggctggtgaacggcggagatcgctgccagggtcgcgtggaggttctgtaccgcggttcttggggcaccgtctgtgatgactactgggacaccaacgatgccaatgtcgtttgcagacagctgggctgtgggtgggcaacctccgcccctggaaacgcgaggtttggtcagggctccggcccaattgtgctggatgatgtccgctgcagtgggcatgaatcatacctgtggtcttgtcctcacaatggctggttgtcccataattgtgggcaccacgaggacgctggagttatttgctctgcatcacagtcacagcctaccccaagcccagacacctggccaaccagtagagcatctacggcaggatctgaatctactcttgccctgcgcctggtcaatgggggtgatcggtgtcgaggaagagtagaggtgctgtatcagggttcttggggaactgtgtgcgatgattactgggatactaacgatgctaatgtggtctgcagacagctggggtgtggatgggctatgtcagccccaggtaacgcccagttcggtcaggggtcaggaccgatcgtgctggacgatgtcaggtgcagcggccatgaaagctacctgtggtcttgtccgcacaacggatggctttcacataattgcggccatcatgaagacgccggtgtcatttgcagcgctgcgcagtcacaatccacaccacggcctgacacatggctcacgactaacttgccagctctaaccgtcgggagtgagtcttctttggctttgagactggtgaatgggggtgatcgctgccggggtagggtcgaggtgctgtaccgtggctcatggggtaccgtttgcgacgactcctgggacaccaacgacgcaaatgtggtgtgtcgccagctaggttgcggttgggccatgagcgctccaggaaatgctcgattcggccagggttcaggtccaatagtgctcgatgatgttcggtgtagcgggaatgagtcctacctctggtcatgccctcacaagggatggctgactcacaattgtggccaccacgaagacgccggagtcatatgcagcgccacccagatcaattccaccaccacagactggtggcaccccaccaccactacgacagccaggcctagctcgaattgtgggggattcttattttacgcaagtgggactttttcgtcgccttcgtaccctgcatactatcccaacaacgctaaatgtgtgtgggaaatagaggtgaattcggggtacaggattaacctgggattttctaatcttaaactagaggcgcatcacaattgctcgttcgattatgttgagatctttgatggctccctgaacagctcacttttgttggggaagatttgcaatgatacgagacagattttcacatctagttacaacagaatgaccatccatttcagaagcgacatttcattccagaatacgggctttttagcttggtacaactcctttcccagcgacgcgacactaaggctggtaaacctcaactcatcttacggcctctgcgcaggacgcgttgagatctaccatggcggaacttggggcaccgtctgcgacgactcttggacaatccaggaggctgaagtcgtttgtaggcaactgggctgtgggagagccgtgtcagcacttggtaacgcctattttgggagtgggtcgggacctatcactctggacgacgttgaatgtagcggcaccgaatccacattgtggcagtgtcgtaaccggggttggttttcccataattgcaaccatcgcgaggacgccggagtgatctgctctgggaaccatttgagcactcccgctccctttctgaacattacaaggcctaatacggattactcttgcggcggtttcctatcccaaccttccggagactttagctctcccttctatcctggaaactacccgaacaatgcgaaatgtgtgtgggacatcgaagttcagaacaactatcgagtgactgttatctttcgcgacgtccagctcgagggcggttgtaactatgattacatagaagtgttcgacggcccataccggtcgtctcccctgattgcaagagtatgtgatggcgcaaggggcagctttacgagctcatcaaactttatgagcatccgcttcatatcagaccatagcattaccagacggggatttagggccgaatattactcctcaccgtccaatgatagcacaaacctgctctgcctgccgaatcatatgcaggcctccgtgtcccggtcctacttgcaaagtctcggcttcagcgcatccgacctggtgattagcacctggaacggctactatgaatgcaggccacagatcactcctaacctcgtgatcttcacaatcccctattccggttgcggcaccttcaaacaggctgataacgacactatcgactactcaaatttcctgacagctgcggtcagtggaggcatcatcaagagaaggactgacctgcgcatacacgtcagttgtcgaatgctgcagaacacatgggtagatacgatgtacattgcaaatgatacaatacacgtcgctaacaacacaatccaggtcgaagaggtgcagtatggcaatttcgacgtgaacatttccttctatacttcgtcctcgttcctctatcccgtgacctctagaccgtactacgtggacctgaatcaggatctgtacgtgcaagctgagatccttcactccgatgcggtgttgacccttttcgttgatacctgtgtggccagcccctatagtaatgactttacctcactgacatatgatctcataaggagcggctgtgtgagggatgacacctatggcccttattcatccccctcgttgagaattgccaggttcagattccgagcattccactttctgaatagattcccatccgtctacctgcgctgtaagatggtggtgtgccgcgcttacgacccctcaagtcgttgctatcggggttgcgttttgcgaagtaagcgggacgtgggcagctaccaggaaaaagttgacgttgtgttgggtcccattcagctgcaaacaccgcctagacgcgaggaggaaccccgtta

SEQ ID NO: 28338 - DNA, 7241 bp, Artificial Sequence
  Description of Artificial Sequence: Synthetic coding sequence
atgggtattagtacggtcatcctggaaatgtgtctgctgtggggccaggtactaagtacgggagggtggatccctcgcacaactgactatgcatctctaattccaagtgaggtccccttggaccccaccgttgccgaaggcagtcccttcccatccgagtcgaccctggagagtacggtagctgagggttcacctataagtctagaatctacgctggagagtacagtcgcagaggggtcccttatcccgagcgagtcaacgttggagtccaccgtcgccgaaggttctgacagtgggctggctctgaggctggtgaacggcgatggacgttgccagggtagggtggagatcctttatagaggctcttgggggacagtgtgcgacgattcctgggatactaacgacgcaaatgtggtttgccggcagctgggctgtggatgggccatgagcgccccaggaaacgcctggttcggacagggctctgggccaatcgctctggatgatgtgcgttgctccggccacgagtcttacttgtggtcctgtccccacaatggctggcttagtcataactgcggccacggtgaggacgctggcgtgatctgctctgctgctcagcctcagtccacactgaggcccgagtcctggcccgttaggatatcaccgccagtccctactgaggggtccgagtcttctcttgcactgaggcttgttaacgggggtgatcgatgccgtgggcgagtggaagtgctttatcgtggttcgtgggggaccgtctgtgacgactactgggacacaaacgacgccaacgtggtgtgccgtcagctggggtgcggatgggctatgtctgctcctgggaacgctcaattcggacaaggctctgggccaatcgtcctcgacgatgtgcggtgttccggacacgagtcttatttatggtcctgcccgcacaacgggtggctgacccacaactgtgggcattccgaggatgcaggagtgatttgctcagccccacagagtcggcctacccctagcccagacacatggcccaccagccatgccagcaccgcaggccctgagtcaagcctggctcttcgtctggtaaatgggggagaccggtgccagggcagagttgaggttttatacagaggttcatggggcacggtctgtgatgactcgtgggatactagtgacgcaaatgttgtgtgtcgccagctgggttgtggatgggctacgagtgcacctggaaacgcccgattcggacagggaagcggcccaattgttctcgatgacgttcggtgctccggatacgaatcatacctctggtcttgcccacataacgggtggctatcgcataattgtcagcactcagaagacgcaggcgtaatatgcagcgcagcacactcttggagcaccccatctccagacactctgccaactatcaccctgcccgcaagcaccgtcggttctgaaagcagtcttgcattgcggctagttaacgggggtgataggtgccagggacgtgttgaagtgctctatagaggctcatggggaacagtgtgcgacgatagttgggacactaacgacgctaatgtggtatgccgtcaactgggctgcggctgggccatgctggctcccggtaacgctagattcgggcagggctccggaccaatcgtgctagacgacgtccgttgcagtggtaatgaaagctacctctggtcctgcccacacaacggctggctgtcccacaactgcgggcatagcgaggacgccggagtaatttgcagcggccctgaaagcagccttgccctgcggctggtcaacggcggagaccggtgtcagggccgagtagaagtcctttatcgcggatcgtggggcaccgtttgtgatgactcttgggacaccaacgacgcaaatgtggtgtgccgccaattggggtgcggctgggctacttcagcgcctgggaacgctcgcttcggtcagggctctggaccaatcgtcttagacgatgttcgctgcagtggacatgaaagttatctgtggtcatgccctaataacgggtggctctcgcataactgtgggcatcatgaagatgccggagtaatttgctctgccgctcagtctcggagcactccacggcctgatacactgagcactatcacactgccgcctagcactgtcggctccgaaagttctctgacgttgcgcctggtaaatggtagcgaccggtgtcagggccgtgttgaagtgctctaccggggatcttggggcaccgtgtgcgacgactcgtgggacaccaacgatgcgaatgtggtgtgcagacagctggggtgtggttgggctacgtcagccccaggcaacgcacggttcggccagggttctggccctatcgtccttgatgacgtgcgatgctcaggacacgaatcatacctctggtcttgcccccataatgggtggctctcacataattgcggccatcacgaggacgccggagtcatctgcagcgtgagccagtctcggccaacccccagccccgacacatggcctacatcccacgcatccacggccggtcccgaaagctcactggcactccggttggtgaatggaggagacaggtgtcagggaagagtcgaggtgctgtatagagggtcatggggtaccgtgtgcgacgattcttgggacacaagcgacgctaatgtggtatgccgtcagctcggctgtggatgggctactagcgccccaggaaacgcaaggttcggtcagggcagcggtcctattgtgcttgatgacgtccggtgtagcgggtacgaatcctatctctggtcatgtccccataacggctggctgtcccataattgccagcatagcgaggatgcaggcgtgatctgcagcgccgctcactcgtggtctactccctcaccagacactctaccaaccataacattgcctgcatctacagtgggaagtgagagttcattggccctccgccttgttaacggcggagaccggtgccaagggcgagtggaggtgctctaccagggaagctgggggactgtatgcgacgacagctgggatacaaatgacgctaatgtcgtctgtcgccagctcggctgtggttgggcgatgtcagcccctggcaatgccagattcggtcaggggtccggacctatcgttcttgacgatgtcagatgcagtggtcacgaaagctatttatggtcatgcccacacaacggatggctaagtcataattgtgggcactctgaagacgccggagtgatttgctcagcctctcagagccgtccgacaccatctccagacacgtggccaacctcccacgcatccaccgccggaagtgaatcatcccttgcgctgcgattagtcaacgggggtgatagatgtcagggacgggtggaagtcctgtacagggggtcatgggggaccgtgtgcgacgattattgggacacaaatgatgccaatgtagtgtgtcgccagctgggttgcggctgggcaatgagtgcaccaggcaacgctcgcttcggacagggaagcgggccaattgtcttggacgatgtgcgttgcagcggccacgagagttatctgtggtcgtgtccacacaacggctggcttagccacaattgcgggcaccacgaagacgccggtgtcatctgctcagctagccagtcccagcctaccccatcccctgacacatggccaacatcacacgctagcaccgctggatccgaaagcagtctggccctgcgcctggtaaatggtggcgaccggtgtcaagggagagttgaagtgctttaccggggtagctgggggactgtgtgcgacgattattgggatacgaacgacgccaacgtggtgtgccggcagctcggttgcggatgggctacttccgcccctggcaatgcacggttcggacaggggagtggacccattgtgctggatgacgtccgctgttcaggacacgagagctatctgtggagctgtccccacaatggatggctatcccacaactgtggacatcacgaggatgccggagtcatttgttccgcatcacagagtcagccaaccccgtcacccgacacatggcccacaagccacgcctccaccgctggtagcgaatcgtcactcgcactacggttggtgaatgggggtgatcggtgccaagggagagtggaagtgctgtatcgtggaagctggggcacagtgtgcgacgactactgggatactaatgatgccaacgtggtgtgtaggcagctgggctgtggctgggcaacttccgcgccaggcaacgctcggtttggacagggtagtggccctatcgtactggatgatgtgcggtgctctgggcacgaatcttacctctggtcatgtccacacaacggctggttgtcccataattgtggccaccacgaggacgcaggtgtcatttgttctgcatctcagtcgcagcccactccctcccctgatacatggccaacaagccgggcatcgaccgccggtagcgaatctactctggcgttgcgacttgtgaacggtggagatcggtgccgtggtcgggtcgaagtcctgtaccaaggcagttggggcactgtttgtgatgattattgggacactaatgatgccaacgtcgtctgtcgccagctgggctgcggctgggccatgtccgcgccaggcaacgcccaattcggacagggttcaggccctatagtgttagacgacgtcaggtgtagcggccacgagagctatctctggtcttgtccacataacggctggctttcacataattgcggacaccacgaggacgcaggtgtgatctgttcagcagctcagtcccagagtacacctagacctgatacttggctgactactaatttacccgctttgaccgtgggttctgaaagtagcttggctcttcggctcgtgaacgggggtgacagatgcagagggcgtgttgaggtgctctaccggggaagctggggcaccgtgtgcgatgattcctgggatacaaacgacgccaatgtggtgtgtagacagttaggttgcggttgggcaatgagtgccccaggaaacgccagatttgggcaagggtcaggcccaatcgtgctggacgacgtccggtgcagcggaaatgagtcatacctgtggtcgtgcccccataagggatggttaactcataattgcggccaccacgaagatgcaggcgtgatctgctccgcaacgcagatcaatagtacaacaactgattggtggcaccctaccacgaccacgacagcccgtccatcatccaactgtgggggattcctgttttacgcctctggcaccttctctagtccttcgtacccagcgtattatccaaacaacgcgaagtgtgtttgggagattgaagttaattctggttatcgaatcaatctcggcttctctaaccttaaactggaagcacatcacaactgtagctttgattacgtggagatctttgacgggagtctgaacagctctctgctcctcgggaagatttgcaacgatacacgacagatcttcacgagttcctacaacaggatgaccatccacttcaggtcagacatatccttccagaacactggattcctggcttggtataatagctttccttccgatgctacactacgactggtgaacctcaactcctcttacgggctgtgtgcaggacgggttgagatctaccacggaggcacctggggcacggtctgtgatgactcttggactattcaagaggccgaggtcgtctgcaggcaattaggatgcgggagagccgtgtcagcactaggcaacgcctattttggaagcgggtccggacccattacgctggatgacgtggagtgtagtggcacagagtcaaccttgtggcaatgtcgtaacaggggctggttctctcacaattgcaaccatcgtgaagacgccggagtgatctgttctggcaaccacctaagcactcccgctcctttcctgaatatcactagacctaacactgattattcttgcggaggatttctctcccagccaagtggtgatttctcctccccattttacccaggaaactatcccaacaacgctaagtgcgtctgggacattgaggtgcaaaacaactacagagtgaccgtcatctttagagacgtgcagttagaaggtggctgtaactatgactacattgaagtgttcgacggaccatacaggtcatcccctttaatcgcgcgagtttgtgatggagcgagaggcagctttacgagctcaagcaattttatgtcaatccggtttatctcggatcactccattactaggagaggcttccgcgctgagtactactcctcaccatcaaacgattcaactaatctgctttgtcttccaaatcatatgcaggcatcagtctcccgctcctaccttcagtccctcggattttccgcttccgacctcgtcatttcaacctggaacggatattacgagtgtcgccctcagataacgcctaacctcgtgatcttcacaatcccatactccggctgtggcaccttcaagcaagcagacaacgacacaatcgactacagtaactttctcaccgcagctgtctccggcggaattataaaaaggcgaaccgacttaagaatacacgtcagctgtaggatgctccagaatacatgggtagataccatgtacattgcaaacgacacaatccacgtggctaacaacacaatccaggtggaagaggttcagtacgggaactttgatgtaaacattagtttctacacttccagctcttttctgtatcccgtcacatctcgcccttactacgtggacctcaaccaagacctgtatgttcaagccgaaatcctgcactctgatgctgtgttgacgctcttcgtggacacttgtgtcgctagcccgtacagcaatgattttactagtctgacgtatgacttaattcggtctggatgcgtgagggacgatacctatgggccatattcctccccttcattaagaatcgccagattccgcttcagggccttccactttctgaataggtttcccagtgtttatttgcggtgtaaaatggtggtgtgccgggcatatgacccatctagccgctgttatagggggtgtgtgctgaggtctaaaagagatgtgggctcgtaccaagagaaagtcgacgttgtactcggtcctatccagttgcagacccctccgaggcgcgaggaggaacctcggta

SEQ ID NO: 28339 - DNA, 7241 bp, Artificial Sequence
  Description of Artificial Sequence: Synthetic coding sequence
atgggaatctccactgtgattttggaaatgtgccttctgtggggacaggtgttgagcactggaggttggatcccacgtactacagactacgccagtttaatacccagcgaggttccattagaccccacagttgccgagggtagcccattccctagtgagtcgacgttggaaagtaccgtcgccgagggtagccccatatctctggagagtaccttggagagcaccgtggccgaaggctctctgatccctagcgagtcaacactagagtcgactgtcgcagaaggaagcgattcaggcctggcactgaggcttgtcaatggtgatggacgttgtcagggcagggttgaaattctttatagagggtcctggggcacagtgtgcgatgactcttgggacactaatgatgccaatgtcgtctgcaggcaactcggctgcgggtgggctatgtcggctccaggaaatgcatggtttggccaggggagcggaccgattgccctcgatgacgttcgctgtagtgggcatgaatcgtacttgtggtcctgccctcacaacggctggctgtcgcacaattgtggtcatggcgaggacgctggagtaatatgttccgccgctcagccccagtccacactgaggccagaaagctggcctgttagaatctccccaccagtcccaactgaggggtctgaatccagtcttgcccttcgcctcgtcaacgggggtgatcgatgtcgaggacgggtcgaggttctgtatcggggatcctggggaaccgtttgcgacgattactgggataccaacgacgcaaatgtggtgtgtaggcaactcggctgcgggtgggcgatgtccgcccctggaaacgcccagtttggtcaggggtccggtccgatagtgctggacgacgtgcgatgtagtgggcatgaatcctacttgtggagttgcccacataacggttggcttactcacaattgtggacattctgaagacgctggggtgatatgctcagcacctcaatcaagacctactcctagccctgatacatggccaactagtcacgcctccacggcaggccctgagagctctctagccctgagactggtcaatgggggagatcggtgtcagggcagggtggaagtgctttatcgcggtagctggggcacagtttgcgacgattcttgggatacctctgatgccaatgtagtttgtaggcagctcggatgcgggtgggctacatccgctcctggcaatgctcgatttggccaaggatcggggccaatcgtccttgacgatgtcagatgcagcggttacgaatcttacctgtggtcttgcccacataatggctggctctcccataattgccagcactctgaagatgctggcgttatttgctctgcagcacactcttggagtacaccctcccctgacaccctgccgactatcacactgcccgctagcaccgtcggatctgagtctagcctagctttaaggttagtcaacggtggggaccgttgtcaagggagggtggaggtgctgtacagagggtcctgggggaccgtttgtgatgactcatgggatacaaacgacgccaatgtagtctgccgccagctgggatgtggatgggccatgctcgctccaggaaacgcccgttttggccagggatctgggcctatcgtgctcgacgatgtccggtgttctggaaatgagagctacctatggtcttgccctcataacggatggctctcacataattgcggacatagtgaagacgctggggttatttgctcaggtccagaatcatccctggcccttcgtctggtaaacgggggagataggtgtcaaggtcgtgtcgaagtgctgtatagggggagctggggaacagtctgtgatgactcttgggatactaatgatgccaatgttgtctgtaggcaactgggctgtggctgggctacctctgcacccggtaatgcccgattcggtcaggggtccgggcctatcgttttggacgacgtgcgatgctcagggcacgaaagctatctttggagttgccccaacaacggatggctttctcacaattgtggccaccatgaagacgcaggagtcatctgcagtgcagcccagtcgaggagtacgcctcggcctgatacactcagcacaattacactgccccctagtactgtggggtccgaatcatctctgacgctgaggcttgttaatggatccgatcgctgtcagggtcgtgttgaggtcctttataggggctcctggggaaccgtgtgtgacgatagttgggataccaacgacgcaaacgtggtctgtagacaactggggtgcggatgggcaacttccgctccgggaaatgccaggtttggccagggatccggcccaatcgtgttggatgacgtaaggtgctccggacacgagagttatctctggtcctgcccacacaatggatggctgtcacacaactgcggtcatcatgaggacgcaggagttatctgtagcgttagccagtctaggcccactccatcccctgatacatggcccacgtcacacgccagtacagcaggcccagagtcaagcttagccctcaggcttgtaaatggaggagatagatgtcagggacgagttgaagtgctatatagagggtcttggggcactgtttgcgacgattcatgggatacttctgacgccaacgttgtatgtcgccagcttggttgtggctgggctactagcgccccaggaaatgccagattcggacaggggtccggccctatcgttctggacgacgtgcggtgtagcggctatgaatcatacctgtggtcatgtcctcacaacggctggctctctcacaattgccaacactcagaagatgcaggtgtaatatgtagtgccgctcatagttggtctactccctcacccgatacgctgcctaccatcaccctccctgcatcaaccgtcggaagtgagtcctctctcgcactgagactggttaacgggggtgataggtgccagggcagagtggaggttctctaccagggatcatggggcactgtctgcgatgattcttgggatactaacgacgctaatgtggtgtgccgccaattggggtgcgggtgggcaatgtcagctcccggtaacgccaggttcggccagggcagcggccctatcgtgctggatgatgtgcggtgtagtgggcatgaatcctatctctggtcatgtccccacaacggctggctgtcccacaactgcgggcactctgaagacgccggtgtcatttgttctgcttcccagtctaggccaacccctagtcctgatacatggccaacctctcacgcatcaacagccggttcagaaagtagccttgcacttaggctggtgaacgggggagatcgatgtcagggtagggtggaggtgctctataggggatcatggggcaccgtctgcgacgactactgggacactaatgatgcgaatgtcgtttgtagacagcttggctgcggatgggcgatgtccgcgcctggcaacgccagattcggccaggggtcgggacctattgtgctggacgatgttcgttgtagcggacacgaatcctacctctggtcctgtccccataacggttggctgtctcacaactgcggacaccatgaagacgcgggagtcatctgcagcgctagccagtcacagccgaccccgagccccgatacctggccaacctctcacgcttccaccgctggcagcgagagctccctcgcattacggctggtcaacggaggcgacaggtgtcagggacgcgtggaagtgttgtaccgtgggtcttgggggacggtttgtgacgactactgggataccaacgatgccaacgttgtgtgccgccagcttggatgtgggtgggccaccagcgccccaggaaacgccagatttggccaaggatccgggccaatcgtactggatgacgtgcgatgctccgggcatgagtcttacttgtggtcatgtccccacaatggatggctgtcccacaactgcggccaccacgaagatgcaggtgtaatttgctctgcatctcagagtcagcctacgccaagcccggatacatggcccacatctcatgccagcacggcaggcagcgaatcgtccttagcactgcggcttgtcaatgggggtgacagatgccagggcagagtggaggtgctctacagggggagctgggggacagtctgcgatgattattgggacaccaatgacgccaacgtggtctgcagacagctgggctgcggttgggctacttccgccccagggaatgctaggtttgggcaagggtccgggccaatagttctggacgacgtgcggtgctctggccacgaatcttatctttggtcctgcccccataatggatggctttcccataactgcggacaccacgaggacgccggagtaatttgttccgccagccagtctcaacctacccccagtccggatacctggccgacgtcaagagcctcaactgcagggtccgaatccactctggccctccgactggttaacgggggagatcggtgtagagggcgagtggaagtgctttaccaaggcagttgggggacggtgtgcgacgactactgggacactaacgacgctaatgtggtgtgccgacagctgggttgtggctgggcgatgagtgcccctggtaatgcgcaatttggccaggggagcgggccaatcgttctggacgacgtaagatgctccggtcatgagagttatctgtggtcttgcccccacaatggctggttaagccacaactgtggccatcatgaggacgcgggagttatctgctcagctgcgcagtcccaaagtacaccaaggcccgatacgtggcttacaaccaaccttccagcattaacagtgggctctgaatccagcttggccctaaggttagtgaatggaggggatagatgtcgagggagagtggaggtcttgtacagaggcagctgggggactgtatgcgacgactcgtgggatacgaacgatgctaatgttgtttgccgccagttaggatgcggctgggccatgagtgctcctggtaacgcacgatttggacagggaagtgggccaatcgtcttagacgatgtgaggtgttccggaaatgagagttacctctggtcatgtcctcacaaaggatggctgacccacaactgcggacaccacgaagacgccggagtcatctgttccgccacccagatcaatagtaccacgactgattggtggcatcccaccaccactactactgccaggcccagcagcaactgtggcggattcctcttctacgcttcgggaactttttcttctccctcatatcctgcctattatcctaataacgccaagtgtgtgtgggagatcgaagtgaacagcggctatcgcatcaatctgggcttttccaacctgaaattggaggcccatcataattgctccttcgactatgtggagattttcgatggctcactgaacagcagcttactcttggggaagatctgcaatgatacccgccaaatcttcacctccagctacaacagaatgactattcacttcaggtctgacatcagtttccagaacacaggattcttagcctggtataacagctttcctagcgatgcgacacttaggcttgtgaatttgaactcttcctacggcctgtgcgccggaagagtcgagatctaccatggtggaacttggggcactgtctgcgatgactcatggacaatccaggaggcagaggtggtttgtagacagctcggatgtggccgagctgtatccgctctgggcaatgcgtacttcggcagtggtagtgggcctatcacactagacgatgtggaatgctccgggacagagagtactctgtggcagtgccgcaacagggggtggtttagccataattgtaaccatagggaggatgccggagtgatttgctcgggaaatcacctgtccaccccagctccattcctcaacatcactcgtcccaacacagactattcgtgcggcggattcttgtcacagccttcaggagacttctcttctccgttctatccaggcaactatcctaataacgccaaatgcgtatgggacatcgaagtgcagaataactatcgtgttacagtgatctttagggatgtacaactggaaggtggttgtaactatgactacatcgaagtgttcgacggcccttacaggtccagtcccctgatagccagagtatgtgatggtgctagagggagcttcacgtcttcttctaacttcatgtctatccgtttcataagcgaccatagtataacgcgtagaggatttagagcagaatactattcatctccctctaacgacagtactaacctgctatgtctgccaaatcacatgcaagccagcgtgagtcgttcttacctacagtcgctgggctttagtgcttccgacctagtgatcagcacttggaacggctactatgaatgtaggccgcaaattacacccaatctggtgatttttacaattccttactcagggtgtggcaccttcaaacaggccgacaacgataccatagattactccaatttccttaccgccgcagtgagcggtggaattattaaacggagaacagacctcagaatccacgtttcctgtagaatgctccagaacacctgggttgataccatgtacatagccaacgataccatacatgtggccaataatacaattcaagtcgaagaggtccagtatggtaactttgatgttaacattagtttctacaccagctcgtcttttctgtaccccgtcacctccaggccctactatgtcgatctgaaccaggatctctacgtgcaggccgaaattctacacagcgatgcagtcttgacgctgttcgtcgacacgtgcgtggcaagcccgtactctaacgacttcacctctctgacgtacgacctgatccgctccggatgtgtgcgggacgacacctatggaccctatagctccccttcactcagaatcgctcgatttaggtttagggcatttcatttcctgaatcggtttccttccgtgtacctccgctgtaagatggtcgtctgtcgcgcatacgatccctctagtcggtgttataggggttgtgtgctaaggtcaaagcgagatgtaggctcttatcaggaaaaagtcgatgtcgtgcttggaccgatccagctgcagacacccccacgccgagaagaggagcctagata

SEQ ID NO: 28340 - DNA, 7211 bp, Artificial Sequence
  Description of Artificial Sequence: Synthetic coding sequence
atggggatcagcacagttatccttgaaatgtgccttctttggggccaggtcctgtctaccggagggtggattccacggaccaccgattacgccagcctcataccctcagaggtgccactggaccctacagtggccgagggatcccctttcccatctgagtcaactcttgaatctacggtcgccgaaggcagccctatctcactggagtcaaccttggagtccaccgtagctgaaggttctctgataccaagcgaatccacactggagtctacagtggccgaaggaagcgactccggattggctttgcgactcgtcaatggcgacggtcgctgccagggacgcgtggagattttgtaccggggttcctggggaaccgtttgcgacgacagctgggatacaaacgatgcaaatgtggtctgccgccaattaggctgtggatgggccatgtctgccccaggtaatgcctggttcggccaaggctcaggacccattgccctcgatgacgtgagatgttcaggccacgaaagttacctgtggtcatgcccccacaacggttggctgtcccataactgtgggcatggtgaagatgctggcgtgatctgttccgctgctcaaccacaatccaccctgcgccctgaatcctggcctgtccgaattagcccccctgtgcccaccgaggggagtgagtcctctctagccctgcggcttgtaaacgggggagaccgctgtcggggacgtgttgaggtactctatcgtggatcgtgggggactgtgtgtgatgactactgggacacgaacgatgcgaacgtggtgtgcaggcagctggggtgcggctgggccatgagcgcccctgggaacgctcagttcggccagggaagcgggcctattgtactcgacgatgtgcggtgctctggccacgaatcttatctgtggagctgcccacacaatggctggctgactcacaattgtggccattccgaggatgctggagtgatttgcagcgcccctcagagcagacctactccctctcccgatacatggcccactagtcacgcctctacggccggacccgagtcatccctagcgttgcgactcgtgaacgggggtgaccgatgccaggggcgtgtggaggtcctgtataggggatcttgggggacagtgtgcgatgattcctgggataccagcgatgctaatgtggtgtgtagacagcttggctgtggatgggctacttcagcaccaggcaatgcaaggtttggacaaggttctggccctatcgtgctcgacgacgtgcgatgttcgggctatgagtcgtatctgtggtcctgcccacataacggatggctgagtcataactgccagcactcagaggatgccggagtgatttgctctgacacattgcccactattacactgcccgcttcgacagttgggagtgagagttccctggcacttcggttggtgaacggaggtgataggtgccaaggaagggtggaggtgctatatcggggatcatggggtactgtgtgcgatgatagttgggatacaaacgatgcgaacgtggtttgcagacaactgggctgtggatgggctatgctcgccccagggaatgcaagattcgggcagggaagtggtccaatagtcctggacgacgtcagatgttctggcaacgagtcctatctctggagctgtccccacaatggctggctgagtcacaattgcggccacagtgaagacgcaggcgttatctgctctggaccagaatctagcctcgcattgcgactggtgaacggcggagaccggtgtcagggtcgggtcgaagtgttatatagagggtcttggggcacagtatgcgatgatagttgggacaccaacgacgccaacgtagtatgtcgccagttaggatgtggctgggccacaagcgccccaggcaatgccagattcggacaagggtccggccctatcgtgctcgacgacgtgcggtgtagcggtcatgagtcctatctgtggtcttgcccaaacaacggctggctcagccataattgcggacatcacgaagacgcaggagttatctgctcggccgcacagtctcgaagcactcccagacccgatacgctgagcacaatcactctgcctccctctaccgttggaagtgagagctccctaaccctgaggctagtgaacggatcagaccgctgccaggggcgagtggaagttctctaccgcggatcttggggaaccgtatgtgacgacagctgggacacgaacgatgccaacgttgtttgccgacaactcgggtgcgggtgggccacctcagcacctggaaatgccaggttcggacagggttctgggccaatagttctagatgatgtgcgttgcagcgggcatgaaagctatttatggagttgtccacacaacgggtggctgtcacataactgcggccatcatgaggacgctggtgtcatctgtagtgtctctcagagtagacctacaccctctcctgacacctggcccacaagccacgcctccacagctggaccagagagctccttggcactgcggttggttaatggcggtgatagatgccagggcagggtggaagttctctaccgagggtcttggggaactgtgtgcgacgatagctgggacactagtgacgcaaacgtggtttgccgtcagcttggttgcggctgggccacctcagcccctggaaacgccagatttgggcaaggctcgggtcctattgtgctcgacgacgtgcgatgctctgggtacgaatcctacctgtggtcttgtcctcacaatgggtggctgagccacaactgtcagcactctgaagacgcaggagtgatctgcagcgcagcacactcttggagcacaccctcaccagatacactgcctacgattacactacccgctagcaccgttggctccgagtcctctctcgcactaaggctggttaatggaggggaccggtgtcaaggccgagtggaggtactctaccaaggttcatggggcaccgtgtgtgatgattcatgggatacaaacgatgccaatgtcgtgtgccggcagctgggatgcggttgggctatgagcgctcccggaaacgcacgttttggccaagggtccggtccaatcgtcttagatgacgttaggtgcagtggccatgagagctacctttggagttgcccccacaatggctggctgagtcataattgtgggcatagtgaggatgccggagtaatttgttctgccagtcagagcagacccactcccagtcccgatacatggcctacctcacacgcttcaacagctggaagcgagagtagtctggcactacgcctggtgaacggcggagataggtgtcagggcagggttgaggttctctaccgcggatcttggggtaccgtttgtgacgactattgggacaccaacgacgcgaacgtggtgtgccgccagctgggatgtggatgggcgatgtcagcccctggcaatgcacgctttggacaagggtccggaccgatcgtgttagacgacgtccgctgctccggccatgagagctatctgtggagctgcccacataatggatggttgagtcacaattgtgggcaccacgaggacgccggagtgatttgttctgccagccagtcccagcccactccgtccccagacacgtggcctaccagtcacgcttccacagccggaagcgagtccagtctcgccctccgcctcgtgaacggcggagataggtgccagggtcgagtagaagttctctatcggggtagctggggaacagtttgcgatgactactgggatacgaatgatgcgaatgtagtgtgtcggcagctgggctgtggctgggctacgtccgcgccaggcaatgcgcgatttggacagggcagcgggcctatcgtcctcgatgacgtgaggtgcagcgggcatgagtcctacctttggagctgcccccacaatggctggttgagtcacaactgtggacaccatgaagacgccggtgtgatctgctcagctagtcaatctcagccgaccccttctccagacacttggcccacaagccatgcatccacagccggaagtgaatctagtctggccctgcggctggtgaacggtggcgacaggtgtcagggtagggtggaggtgttgtatcggggatcctggggcacagtatgtgacgattactgggacacaaacgatgccaacgtggtttgtcggcagctgggttgcgggtgggcaacaagcgccccaggtaatgcaaggttcgggcagggttctggaccgatcgtgctggatgacgttagatgttccggccacgaaagctacctttggagttgccctcataatggttggctcagccataattgcggccatcacgaggacgccggagtgatttgtagcgcaagtcagtcccagccgactcccagccccgacacttggcctacgagccgcgcaagcacagccggaagcgaatccaccctcgcgttacggttagtgaacggcggagatcgctgtcgaggcagggttgaggtgctctatcagggatcttggggcacggtttgcgatgactactgggatacaaacgatgctaatgtggtttgccgtcagcttggctgcggatgggcaatgagcgcccctggcaatgcccagttcggccaggggagtggaccgattgtgttagacgatgtccgctgttccggacacgaatcctatttatggtcctgtccgcacaacgggtggctgtcacacaactgcggccaccacgaagatgcgggtgttatctgttcagctgcacagagtcagagcactcccaggcccgatacttggctcactacaaatctccccgcattgactgtgggctcagagtccagtttagcactgcgcctggtcaacggcggtgaccggtgtcggggtcgtgtcgaagttctctatcggggttcatggggcaccgtgtgcgacgatagctgggatacgaacgatgcgaatgtagtgtgtcggcagctcggatgcggatgggcaatgtctgcaccaggcaacgcacgcttcggacaggggtctggtcccatcgtgctggatgacgttcgctgttccggcaacgaaagctacctgtggagttgccctcataagggatggttgacccacaactgcggacaccacgaggatgcaggggtgatctgctcggccacccagataaacagtactactactgattggtggcacccaacaacaactaccactgcgcgtccatcttccaactgcggaggctttctcttctatgctagtggcacattctccagtccctcttaccctgcttattatccgaataatgcgaaatgtgtctgggagatcgaagttaactccggttaccgcatcaatttgggtttttctaacctcaaattggaagcccaccacaattgcagctttgactatgtggaaattttcgatggcagtctcaactctagtctgctgctcggaaaaatttgcaatgatactcggcagatcttcactagttcgtataaccggatgactatccacttcaggtctgacatctcttttcagaataccgggttcctggcgtggtataactcctttccgtcagatgccacccttcgcctggtcaacctgaacagctcttatggcctgtgcgccggacgggtggaaatttatcacggcggaacgtgggggactgtgtgcgatgattcttggacgattcaggaagcagaagttgtgtgcagacaactcggttgcgggcgagccgtatccgccttgggaaacgcctactttggctccggcagtggacctataacccttgacgatgttgaatgctcgggcaccgaaagtacactatggcaatgccggaacagaggctggttctctcacaattgcaaccatcgggaagacgcaggcgtgatttgctccggcaaccacctgagcacacctgcaccctttctgaacatcacgcgccctaacacagattatagttgtgggggatttctgtcccaacccagtggggacttttcttccccattttacccgggaaattaccccaacaacgcaaaatgcgtgtgggacatcgaggttcagaacaactatagggtcaccgtcattttcagggacgtccaattagaggggggttgcaattatgattacattgaagttttcgacggtccttaccggagttctcctctcattgctcgggtgtgtgatggagcaagaggcagctttacttcgagctcaaattttatgtctatccggtttatatccgaccacagtatcacacggaggggcttccgcgcagagtattacagctctccatctaatgattccaccaatctattatgcctgccaaaccatatgcaagcgtccgtgtcaaggagttacctgcaatcgctgggattctccgcctccgacttggtcatctcaacttggaatggatactacgaatgccggccacagatcacacctaacctggtgatttttacaattccgtattccggctgtggaacatttaagcaagctgacaacgacactatcgactactccaatttcctgaccgctgctgtcagtgggggaattatcaaaaggaggactgacctcaggattcacgtcagttgtcggatgcttcagaatacctgggtggacacaatgtacattgcgaacgacaccatccacgttgccaacaataccatccaggtcgaggaggtccaatacggcaattttgacgtcaacatatctttctacacctcttccagctttctgtatcccgtcaccagcaggccatactatgtggatttgaatcaagatttgtatgttcaggctgagattctgcactccgacgcagtgctgacgctatttgttgacacttgcgtcgcctccccatactccaacgatttcacctctcttacgtacgacctgattcggagtgggtgcgtcagagacgatacctatggcccttactctagcccatccctgagaattgctcgatttcggtttcgggctttccatttcctcaacagattcccaagcgtgtatctaaggtgcaagatggtcgtctgcagggcctatgacccttcatctcgctgctatcggggttgcgtcctgagatctaagcgggacgtagggagctatcaggaaaaagtggacgtggtgctcggtcctatccaactgcagacacctcctaggcgggaagaggaacctcgata

SEQ ID NO: 28341 - DNA, 1680 bp, Artificial Sequence
  Description of Artificial Sequence: Synthetic coding sequence
atgacgatacacttcagatctgatatatcttttcaaaacacaggcttccttgcatggtacaactctttcccctcagatgcaactctcagacttgtgaatctgaactcgagctacggactgtgtgcgggaagggtggagatctatcatggtggtacttggggaaccgtttgtgacgactcatggacaattcaagaggccgaggtcgtgtgtcgacaacttggttgtggcagggccgtatctgctttgggtaatgcttactttggatccggttctggaccaatcaccctcgatgacgtggagtgtagcgggacagagtccaccctatggcagtgccggaatcgcggttggttcagtcataattgcaatcaccgtgaagacgcaggtgtcatatgctcagggaaccacttgagcacaccggcaccatttctgaatatcacccgccctaacactgattatagctgcggcggattcctaagccagccgagtggcgacttttcctctcccttctacccagggaattacccgaacaacgccaaatgcgtgtgggacattgaggtgcagaacaattaccgggtcactgtgatttttagggacgtgcagctcgagggaggatgcaactatgactatatagaagtgtttgacgggccttaccggagtagcccattgatcgctcgcgtttgtgatggtgctagaggaagcttcacatctagctcaaacttcatgagcatccgctttatctcagatcatagcattactagacggggattcagagcagaatattatagttccccctctaacgactcgaccaatctcctttgtcttcctaaccatatgcaagcatcagttagtagatcctatctgcagtccctcggattttcagcctcagatctggtaattagcacatggaatggctattacgagtgccgaccccagattacacccaaccttgtaatctttactataccctattcaggttgtggtacctttaagcaggctgacaacgacactatcgattatagcaacttcttgacggctgcagtttcaggcggaataattaagaggcgtacagatctgcgcatccatgtatcatgtaggatgttacagaacacttgggtggacaccatgtacatcgccaatgatacaattcacgtggcaaataataccatccaagtggaggaagtccagtatgggaattttgatgtgaacatttccttctatacctcaagctctttcctgtatcctgtcactagccggccttattacgtcgacttaaatcaagatctgtacgtgcaagccgaaatcttacattctgatgccgtgctgacgctctttgtcgatacatgcgttgcaagcccttactccaatgattttacctccctgacatacgatcttatacggtctggatgcgtcagggacgatacctacgggccttatagtagcccttcactgcgtatcgccagatttcgctttcgggcttttcacttccttaatcgatttccctcagtatacctgaggtgcaagatggtcgtttgcagggcatatgatcctagttccaggtgttatagaggttgtgtcttgagaagtaagcgggatgtaggctcctaccaggagaaagtggacgtcgttctcggaccaatccagcttcagaccccacctcgtagggaagaagagcccagatag

SEQ ID NO: 28342 - DNA, 3402 bp, Artificial Sequence
  Description of Artificial Sequence: Synthetic coding sequence
atgggtatctcgacagtgattcttgaaatgtgtctgctgtggggacaggttttgtccaccggtggctggattccacggactacagattatgcatcactgattccctctgaagtacctcttgatccaactgtggctgagggctcccccttcccaagcgaatcaaccctagaaagcacagtggccgaagggtcccctattagcttggagtcaaccttggagagcactgtggccgaaggttctctgatacccagcgagtcgaccctggaaagcacagtagccgaaggttcggatagcggactggccctccggcttgtgaacggagacgggcgttgtcagggaagagtagagatactctaccggggtagctggggcacagtttgtgatgattcttgggacacaaacgatgccaatgttgtctgtaggcagctcgggtgtggctgggctatgagcgctccaggcaatgcctggtttggacagggcagtggaccgattgcactggacgatgtgagatgcagtggacacgagagctacctgtggtcctgtccacataacggttggctatcacacaactgtggccatggcgaggacgctggtgtgatttgttccgctcctcagtcgaggcccaccccttccccagacacctggccaactagtcatgcatctactgctggctctgagagtagcctcgcactaaggctcgttaacggtggggatagatgccaaggtcgggtggaggtactgtaccgaggttcttgggggaccgtgtgcgatgactattgggacaccaacgatgccaatgtggtctgcaggcaactaggttgcggttgggccacatctgcacctggaaatgcgaggtttggtcagggctctggcccaattgtgcttgacgacgtgagatgttccggccatgaatcctacctatggtcgtgtcctcataacggctggctgagccataactgcgggcaccacgaagatgcaggtgtgatctgttccgcttctcagtcccagcccactcctagccctgatacatggcccacttctagggcatctacagccggatcggagtctactctggctttaaggctcgtaaatggcggtgatcgttgtagagggcgagttgaagtcctctaccaaggcagctggggtactgtgtgcgatgattactgggacacaaatgacgccaatgtcgtgtgtcggcagttgggctgcgggtgggcaatgtcagcccctgggaatgcacagtttggccagggatccggtcctatcgttcttgatgatgtgcgatgctcggggcatgagagttacctgtggagctgtccacacaatggatggctgtcccacaactgtggccaccatgaagacgccggagtgatctgctctgccacccagattaattctacgacgaccgattggtggcatcctactacaacaactaccgccaggccatcatccaactgcggtggctttctgttctacgcctcaggaaccttttcgagtcccagctaccctgcctactacccaaataacgccaagtgcgtttgggaaatcgaggtcaactctggatacagaattaacctcggctttagtaatttgaagctcgaagcccaccacaattgcagttttgattatgttgagatcttcgatggctccctgaattccagcctcttgttaggcaagatttgcaatgatacccggcagatatttacgtcctcttacaaccgaatgactattcattttaggagtgacatctctttccaaaacacaggctttctcgcatggtacaattctttcccgagtgacgccaccttaagactggttaacctgaactccagctacggattgtgtgcgggacgcgtggaaatctaccacggcggaacctggggtaccgtttgcgatgatagttggaccattcaggaagcggaggttgtgtgcaggcagctggggtgtggcagggcagtctcggccctgggtaatgcctacttcgggagtggaagcggacctatcactcttgacgacgttgaatgcagcggcacggagtcgaccctatggcaatgtcgcaatagaggttggttcagccacaattgcaaccatcgagaggatgctggcgttatatgctccggcaatcatctgtcaacaccagcccctttcctaaacatcacccggccaaatacagactatagctgtggtggctttctgtctcagccctccggagactttagctcccccttctacccgggaaactatcccaataatgcaaagtgcgtttgggacatcgaagtgcagaacaactacagagttaccgtgatcttccgagacgtgcagctcgaggggggttgcaattacgactacatagaggtcttcgatggcccttaccgtagctcacctcttatcgcaagagtgtgcgacggcgctaggggatcattcacatcatcgagcaatttcatgagtattaggttcatctcagatcattctatcactcggagaggctttcgcgcagagtactactcctctcctagcaacgattcgaccaacctgctctgtctacccaatcatatgcaggcatctgtatctcgaagctacctgcagagtctggggttctctgcgagcgacctggtcatcagcacctggaatggctactatgagtgccggccacagattacccctaacctcgtcatcttcacgatcccatacagcggatgcggaaccttcaaacaggctgataatgataccattgactattctaattttttgacagccgctgtgtccggaggcatcattaagagacgtacagatcttaggattcatgtaagttgtcgaatgctgcaaaacacatgggtggacacgatgtacatcgctaacgacactatccatgtggccaataacactatccaggtggaggaggtgcagtacggcaacttcgacgtgaacatctcattctacactagctcatcttttctgtaccctgtgacctcgcgcccttattatgttgacctcaatcaagacctgtacgtgcaggcagagattttgcacagcgatgctgtactgaccctgtttgtcgatacctgtgttgcctctccctactccaacgattttacgtctctgacatatgaccttatccggtcagggtgtgtcagagacgacacttatggaccttactctagtcctagtctgagaatcgctagattcagatttagggcctttcacttcctgaatagattcccctcagtttacttgagatgtaaaatggtcgtctgtagagcctacgaccccagctcaagatgctatcgtggatgtgtgttgcggagcaagagggatgttgggtcgtatcaggaaaaagtggatgtggtccttggtcccatccagttacagacccctcccagaagagaggaagagcccagatag

SEQ ID NO: 28343 - DNA, 7241 bp, Artificial Sequence
  Description of Artificial Sequence: Synthetic coding sequence
atggggatctccaccgttattctggaaatgtgtctgctctggggccaggtgctttcgactggcggatggatcccccgtacaaccgactacgcgagcctgataccttcagaggttccccttgacccaactgtcgccgaaggttcaccatttccatctgaaagcacattagagagtaccgtcgccgagggatctcccatatctcttgaatctacactggagtctaccgtcgcagagggctccctcattcccagcgagtcaactctcgaaagtactgtcgccgaagggtccgactcaggcctggccttaagactagtgaacggggatggacgctgtcagggccgtgtcgagatcctgtatagagggagttggggtactgtgtgcgacgacagctgggacactaatgacgccaacgtggtctgcaggcagctgggctgtgggtgggctatgagtgctcctggaaacgcctggtttggccagggctctgggcctatcgccctcgatgatgtccggtgcagcggacacgaaagctacctgtggtcatgcccccacaatgggtggctgtcccataactgtggccatggtgaggacgcaggcgtcatttgctccgccgctcagccccaaagcaccctcaggcccgaaagctggcccgtccgtatctcgccaccagtgccgaccgaagggagcgagagttctcttgctcttcgcctagtgaatggtggggaccgatgccggggaagggtggaggtgttgtacagagggtcctgggggacagtgtgcgatgattactgggacactaacgatgcaaatgtggtttgtagacagctcggctgtgggtgggctatgagcgcaccaggaaatgcccaatttggacagggttctggtcctatcgttctggacgacgtcagatgttctggccatgaatcttacctctggagttgtccacataacggatggctcacacacaactgtggccacagcgaagatgccggagtaatctgtagtgcccctcagagtcgcccaactccttcccctgatacctggcctacttcccacgcgtccactgctgggccagaatctagcctggccctgcggctcgttaacggtggggatcgctgtcagggacgcgtagaggtactgtaccggggtagctggggcacagtttgtgacgactcttgggatacaagcgatgccaatgtggtgtgtcgacaacttggatgcggatgggccacatcagctccgggtaacgcacgctttggccagggaagcggaccaattgttctggatgatgttcggtgttccggatacgagagctacctgtggagttgccctcacaacggctggttatcccataactgtcaacacagcgaggacgccggtgtgatatgctccgcagcccacagctggagcaccccctcacccgatactcttccaacgatcaccctgcctgcctccactgtgggctctgaaagtagcctggccctgaggctggtgaacggcggtgatcgatgccaaggtcgagtggaggtcctctatagaggttcatggggcaccgtatgtgacgactcatgggacactaatgacgccaacgttgtctgccgccagcttgggtgtggatgggctatgctcgccccagggaatgcccgattcgggcagggctccggtcctatcgttcttgatgatgtcagatgctcaggaaacgagtcctacctgtggtcatgtccacataacggttggctaagtcataactgcgggcactccgaggatgccggtgtcatttgttctggtcccgaaagctccctggccttgagactcgttaacgggggagataggtgtcaagggagggtggaggttctttacaggggctcgtggggcacagtctgtgacgactcctgggacaccaatgacgccaatgttgtatgtcgacagctgggatgcggttgggccactagtgcgccagggaacgctaggttcggccaggggtctggtcctatcgtgttagacgatgtcaggtgctccggccatgaatcgtacctatggtcctgccccaataatgggtggttatctcataactgcgggcatcacgaggacgccggagtcatttgttctgcggcacagtctcgaagcacaccacgacctgatactctgtctactataaccttacctccatcaaccgtgggatcggaaagttccctgacccttaggctggtgaatggtagcgataggtgtcaaggtagggtggaagtcctgtaccggggtagctggggtactgtgtgcgacgactcttgggatacgaatgatgccaacgtagtctgccgccagctcggatgtggatgggccacctcggctccaggcaatgcgcgattcggacaaggatccggacccattgtgttggacgacgttaggtgctccggccacgagtcctatttatggtcgtgcccccacaatgggtggctcagccacaattgtggacaccatgaggatgcgggagtaatttgctcggtgtcccagtcccgcccaaccccatctcctgatacctggccaacctctcacgcctctaccgcagggcctgaatcatcactggccctgcgtctcgttaacggaggcgataggtgccagggtagggttgaagttttgtacagagggagctgggggacggtgtgcgatgacagttgggatacttctgacgcaaatgttgtctgccgacagctcggctgcgggtgggctaccagtgctccagggaatgcccgattcggacaaggctcgggccctatagttttggatgatgtgcggtgcagcggctacgaatcttacctctggtcatgcccccacaatgggtggttgtctcataattgccagcattcagaggatgccggagtgatttgttcagcggcacattcctggtctacccccagccccgacacgctgcccactatcacactgccggcatctacagtggggtcagaatcttcactggcgctaagactagtcaacgggggagatcggtgccaggggagagtggaggtcctgtaccagggatcctgggggaccgtatgtgatgactcctgggatactaatgatgcgaacgtcgtctgccgccagctggggtgtgggtgggccatgtccgccccaggaaacgcgagattcggacaaggaagcggccctattgtgttggacgacgtgcgttgcagcgggcacgagagttacttatggagttgcccacacaatggatggctatctcacaattgcggacattccgaagacgcgggagtaatttgctctgcgagccagtctaggcctactcccagcccagatacctggccaacatcacatgcctccacagctggaagcgagagctccctggccctccgccttgttaatggcggagaccgatgccaagggagggtggaggtgctctatcgaggatcctgggggaccgtgtgcgatgactattgggacactaacgacgctaacgtcgtctgtaggcagctggggtgtggatgggctatgtccgcaccaggtaatgcgaggtttgggcaagggtccggaccgatcgtccttgacgatgtgcgatgtagtgggcacgaatcttatttgtggtcctgcccccataatggctggcttagccataattgtgggcaccatgaggacgcgggagtaatctgtagcgcttcccagtctcagcctactcctagcccagacacctggccaacgtcccacgcttccacagctggtagcgaatcctctctggctctgaggctagtaaatggaggggacagatgccaaggcagagtggaagtactgtacagggggtcatggggtacagtctgtgatgactattgggatacaaacgacgccaatgttgtgtgcaggcaactagggtgcgggtgggctacttccgctcctggtaacgcacgcttcggacaggggagcgggcctatcgtgctcgatgacgttaggtgctccgggcacgaatcctatctgtggtcttgcccccacaatggctggctgagccataattgcggccatcatgaggatgcaggggtaatttgctccgcctcccagtcccagcccaccccctctcccgatacctggcctacttctcatgctagcaccgctgggagtgagtcttcattggctctgcgcttggtgaatgggggagatagatgccaggggcgtgtcgaggtactttatagaggttcatggggtacagtctgcgacgattattgggatactaacgacgctaatgtcgtttgcagacagctcggatgcggttgggctacaagcgcccctggaaacgccaggttcggtcaggggtctggtcccatcgtccttgatgacgttagatgttcagggcatgagagctatctctggtcttgtccacataacgggtggttgagccacaattgcgggcatcacgaagacgccggtgtgatatgttctgcatcacaatcacagcccactcccagccctgacacctggcctacctcacgggcttccacagctggctctgagtccactcttgcattgcgactggtaaatggcggtgacaggtgtagggggagggtcgaagtcttgtaccagggctcctggggcactgtctgtgatgattattgggatacaaacgacgcaaacgttgtctgccgacagctcggctgcggatgggccatgagcgcccctggcaatgcccaatttggacagggctctggccctattgtcttggacgatgtaaggtgtagtggacacgagagctatttgtggtcctgtccacacaacgggtggctgtcacacaactgtgggcatcatgaagacgctggtgtgatctgtagcgccgcacagagccaatcaacgccaaggcccgatacctggttaaccacgaatctgcccgctttgaccgttgggtccgagagctctctggctcttcggttggtaaacgggggagataggtgtagagggcgtgtggaagttttgtatcgaggctcctggggtactgtgtgtgatgattcctgggacaccaacgacgctaatgtggtctgccgtcagctgggctgcgggtgggcgatgtccgccccaggaaacgcccgattcggtcagggcagcggaccaatcgtactcgacgatgtgcgctgtagcggtaatgagtcgtacctctggtcctgtccacacaaaggctggcttactcataattgcggacatcacgaagacgccggagtcatttgctccgctactcagattaacagcaccaccaccgactggtggcaccccactaccactactacagcaaggccttcttctaactgcgggggttttcttttctatgcctctggcacgttcagttcccccagctatcccgcatactaccctaacaacgccaagtgtgtatgggagatcgaggtgaacagtggatatcggattaacctgggcttcagtaacctaaagttggaggctcatcataactgtagttttgattacgtggagatctttgatggttccctaaattcatctctactgctggggaagatttgcaatgataccagacagatcttcacatcttcctataatcgcatgaccatacacttccgcagcgacatcagctttcagaacacggggttcctcgcatggtataatagcttcccttcagatgcaaccctgcgcttggtcaaccttaactcttcatatggattgtgcgccggtagagttgagatctaccatgggggaacctggggcacagtctgtgacgatagttggaccatacaggaagccgaagttgtatgtagacagctaggctgtggcagggctgtgtccgcccttggcaacgcgtatttcggttcaggatcaggtcccatcaccctggatgacgtggaatgctccggcactgagtcaacgctgtggcagtgtaggaatagaggatggtttagccataactgcaaccatagggaggatgctggcgtgatttgttctggcaaccatttgtcaactccagctccatttttgaacatcactaggcccaacacggattacagctgtggcggtttcctttctcagccatccggagatttcagttcccccttctaccccggaaactatcccaataatgcaaagtgcgtgtgggacatcgaggtgcagaataactaccgggtgaccgtgatattcagggatgtgcaactggaggggggatgtaattacgactacatcgaggtgttcgacggaccctaccgttcatctcctctcattgctcgggtatgcgacggagctagggggtcctttactagctcttccaattttatgtctattcgctttattagcgaccacagcataaccaggcggggtttcagggctgagtattacagcagcccgagtaatgactccacgaatctgctgtgtctgcccaatcatatgcaggctagcgtcagccggagttaccttcagtctttggggtttagtgcttcagatctcgtcatctcaacatggaacgggtactacgagtgcagaccccaaatcacaccaaatctcgtgattttcacaattccctattctggctgtggcactttcaagcaggccgataatgatactatcgactattcaaatttcctgaccgctgccgtgtctggaggcatcatcaagagaagaacggatctgagaatacacgtgagttgccgcatgcttcaaaatacctgggtggacaccatgtacatagcgaatgatacaattcacgtggcaaacaacactatccaggtcgaagaggttcaatacggtaatttcgatgtgaacatttctttctatacctctagttccttcctgtatccagtgacatcccggccatactacgtcgacctcaaccaggatctttatgtacaagctgaaatcttgcacagtgacgcagtcctgacgttattcgttgacacttgcgtcgccagcccctactcaaacgactttacctcattgacatacgatcttatccggagcggatgcgtgcgggatgatacatacgggccttatagctccccttcactcagaatcgccagattccggtttcgggcatttcatttcctgaatcggtttccttcagtctatctgcggtgtaaaatggtggtgtgcagagcttacgatccaagtagcaggtgctatagaggatgtgtactgcgcagcaaaagagatgtcggctcttaccaggagaaagtggacgtcgttcttggcccaattcagcttcaaacgcctccaagaagggaggaagaaccacgata

SEQ ID NO: 28344 - DNA, 7628 bp, Artificial Sequence
  Description of Artificial Sequence: Synthetic coding sequence
atgggtatttcaaccgtcattttggaaatgtgcctcttgtggggccaagttctctccaccgggggatggatccctaggacaacagattacgccagtctgattccctccgaagtgccgctcgaccctactgtggcggaaggctctcctttcccaagtgaaagtactctcgagtctacggtggctgagggcagccccatcagcctggagagtaccctggagtctacagtagcagagggtagcctgattccttccgaatccacattagagtccactgttgcagagggctccgactcaggcctggctctccgcctggtgaacggcgatggtagatgtcagggacgcgttgagatcctctacagaggttcatggggcactgtctgcgacgactcttgggacaccaacgacgcaaacgtggtctgtcggcagcttggatgcggatgggcaatgagcgcccctggaaatgcctggttcggtcaggggagcgggcctatcgcgctagatgatgtgcggtgtagcggacacgagagctatttgtggtcttgtcctcataatggatggctttcccataactgtggccacggtgaagatgcaggagtgatctgttccgcggctcaaccccagagcactttacggcctgagtcctggcccgtgagaattagcccaccagtgccaactgaaggatcggaatcgtccctcgcattgcgccttgtgaatggaggtgatcgctgtcgcggaagagttgaagtgctctatagggggtcctggggtaccgtctgcgatgattactgggataccaacgacgcaaatgtggtttgccgccaattaggatgtggatgggcaatgtccgctccgggaaacgctcagtttggccagggatctggcccaatagttttggacgacgtgagatgctctggccacgaaagttatctctggtcctgcccccacaacgggtggctgacacacaattgtggccacagcgaggacgccggagtgatttgctccgccccacagagcagacccaccccaagccccgatacctggcccacaagccacgcaagcaccgccggacccgagtcctccttagccctgagattagttaatggaggtgaccgctgtcagggtagggtcgaagttttgtaccgaggctcttgggggacggtttgtgacgactcgtgggatacgtctgatgcgaacgtggtatgcaggcagctgggatgcggatgggcaacaagcgctccaggtaatgcaaggtttggtcaaggttctggtcctatagtcctggatgacgtccgctgctcgggatacgagtcctacttatggagctgccctcacaatggctggctgagtcacaattgccagcactctgaggatgcgggagtaatttgctcggcagctcattcatggtcaacaccctcccccgacacactccctactatcacgctcccagccagcactgtcggctcagagtccagcctggctctccgtttggtgaacggaggcgataggtgtcagggacgcgtggaggtgctgtatcggggatcatggggaactgtgtgtgatgacagctgggatacgaacgacgcaaacgttgtttgtcgacagctaggctgtgggtgggctatgctcgcccctggtaatgcacgtttcggccagggatctggaccaatagtcctggatgacgtgcggtgctcaggaaatgagtcatacttgtggtcatgccctcataatgggtggctctcacacaattgtggacatagtgaggacgccggagtcatctgctctgggccagagagttccctcgccctgaggctggtcaacgggggagatagatgccagggcagggttgaagtgctctaccgcggttcttgggggacagtctgcgacgacagctgggatacaaacgatgctaacgtggtgtgccgccagctaggttgtgggtgggccaccagtgcccctggcaatgccagattcgggcagggcagcggcccaattgtgctcgatgacgtgcggtgttctggacacgagtcgtatctctggagctgtcctaataacggatggctaagccataactgtggacatcacgaggacgccggtgtgatctgtagcgctgcgcaaagcaggtcaactccaaggcctgacacactatccaccataaccctgccacctagtacagtcggctcagagagctccttaacacttcgtctcgtaaatggttctgatcgatgtcaagggagagtagaagtactgtaccggggttcatggggcaccgtttgtgatgactcctgggacaccaatgatgccaacgtggtttgcagacaattaggctgcggctgggcgaccagcgcgcctgggaacgctcggtttggccaggggagtggtcctattgttctcgacgacgtgcgttgttctgggcacgagtcttacctttggtcttgcccacacaacggatggctaagccataactgtggtcaccacgaagatgccggagtcatctgctcagtgtcacaatcgagaccgacgccaagccccgacacttggcccacctcccatgcctccactgctggtccggaatcttctctggcactgaggctcgtgaatggtggcgatagatgccaggggagggtggaggtcctctacagaggctcttggggaactgtatgcgacgattcgtgggatacttccgatgccaatgttgtttgccggcaactcggatgcgggtgggcaaccagcgcccctggcaacgcaagatttggccaggggtcgggccctatagtcctggacgacgttaggtgctctggctatgagtcatacttgtggagctgcccacataacggatggctgagccataattgccaacattcggaggatgcgggtgttatctgtagcgccgctcatagctggagcacaccctctccggataccttgcctacaattactctccctgcaagcacggttggaagcgagtccagtctggcattgcgcttggttaatggcggagaccggtgccagggccgagtggaggtgttgtatcaggggtcctggggaacagtgtgcgatgatagctgggacaccaatgatgctaatgtggtctgtcgacagctgggttgcggctgggctatgtctgctcccggaaacgctcgcttcggccaaggctcaggtcccattgtacttgatgacgtgagatgttccgggcatgagtcgtacctatggtcgtgccctcataacggctggctgtctcacaattgcgggcattccgaggacgccggtgtgatctgcagtgcctctcagagccgtcctaccccatcaccagatacctggccaacaagccatgccagcactgccggttcagagtccagccttgccctccggcttgtgaatggaggggacaggtgccagggtcgagtggaagtcctgtatcggggatcttggggaactgtgtgtgatgactattgggacactaacgacgctaatgtggtatgccgtcagttaggctgcggctgggcaatgtcagctcctgggaatgcgcgatttggccagggctccggcccaattgtgctggacgacgtgcgatgtagtggacatgagtcctacctctggtcgtgtcctcacaacggctggctgtcccacaattgtggacaccacgaagacgcaggcgtgatctgctccgcatcgcagtcccagccaacaccgagcccagatacttggcccacctcccatgccagcactgccggaagcgaaagctcgctcgccctgcgcctcgtgaatggaggggaccggtgccagggtcgggtggaagtgctgtatcgaggatcgtggggcactgtgtgtgatgattactgggacactaacgatgctaatgtggtgtgcaggcagttggggtgtggctgggccacatccgctcccggtaatgccagatttgggcagggttcaggcccaatcgttttggatgatgtgagatgctccggccatgaaagctacctatggagttgcccgcacaatgggtggctgtcacacaactgcggacaccacgaagatgcaggcgtgatctgctcagcatcccaaagccagcctacgcccagtcctgatacgtggccgacatctcacgccagtactgcgggaagcgagtctagcctggctctccgtctggtcaatggtggagacaggtgtcaaggccgtgtggaggtgctgtacagggggtcctggggaactgtctgcgacgactattgggacaccaatgacgcaaacgtggtgtgccgtcagttaggatgcggatgggccaccagcgcacctggcaatgccagatttggccaaggctctggcccaatcgtgctggatgacgtgcgttgctctggacacgaatcatacctgtggagttgtccccataatgggtggctgtcccacaactgtggccatcatgaagacgcaggtgttatttgttcagcctcccagagccagccaaccccctcacctgacacatggcccacatcacacgcaagcaccgccggttccgaatcttcccttgctttgcggctggtcaatgggggtgaccgctgccagggacgggtcgaggtcctatatagagggtcctgggggaccgtgtgcgatgattactgggataccaatgatgccaatgtggtgtgtaggcagctgggctgcgggtgggcaacttcggcaccagggaacgccaggttcggccaaggctccggccctattgtactggatgatgtcagatgctccggacatgagagctacctgtggtcttgtccacataacggttggttgtctcataactgtggacaccatgaggatgcgggagttatctgctcggctagccagtcacagcctacgccatccccggacacctggccaacttccagggcgtcaactgccggatcggagtccacattggctctacgcctcgtgaacggaggagacaggtgtcgaggcagggttgaggtactatatcagggctcctgggggaccgtgtgcgatgactattgggacaccaatgacgccaacgtggtgtgccggcagctgggatgcggatgggcaatgtcagccccaggcaatgcacagttcggacaggggtcaggacccatcgtgctggatgatgtgaggtgcagcgggcacgagtcatatttgtggtcgtgtccccacaacgggtggctgagtcataattgtggccatcacgaagacgccggagtgatttgtagcgcggctcagtcccagtctacccccaggcctgacacctggttgaccactaatctaccagccttgacagttggcagcgaatctagcctggctttgaggctcgtaaatggtggggaccgatgccggggaagggtagaggtcctctatagaggcagttggggtacagtatgcgacgacagttgggatacgaatgatgccaatgtggtgtgcaggcaactgggctgcggctgggcaatgtctgctcccggtaatgctcgctttggtcaaggctccggacctatcgtacttgacgacgttcgatgctctgggaatgagagttacctttggtcctgtccacacaaaggttggttaacacacaattgtggccaccacgaggacgccggagtgatctgttccgccacccagataaatagtacaaccactgattggtggcaccccacaactacaacaaccgccagaccatcctccaattgtggcggatttctgttctatgcaagtggaactttcagctccccatcatatccggcatattaccccaataacgctaaatgcgtgtgggaaatcgaagtgaacagcggctatcggatcaatctcggatttagcaacctgaagctggaagcacatcacaattgttcattcgactacgtcgagatatttgatgggagtctcaattcaagtctgctgttgggaaagatttgcaatgatacccgacagattttcacatcgtcatacaaccgtatgaccatccactttaggtcagacataagcttccagaacacaggtttcctggcctggtataactctttcccctccgacgctacactacggctcgtgaaccttaattcctcctatgggttatgtgccggtcgggtggagatttatcacgggggaacatggggcacggtctgcgatgactcatggactatccaggaggcagaggttgtgtgccgtcagcttggatgtggacgtgcagtttccgccttagggaatgcctatttcggctccggttccggcccaatcactcttgatgatgtcgagtgctctggtacagagtccacgctttggcagtgccggaaccgcggttggttctctcataattgtaatcaccgcgaggacgccggagtcatttgtagcggtaaccatctgtcaacacccgcaccctttttaaacatcacacgccctaatactgattactcttgcggaggctttctgtcccaaccatccggcgattttagcagtcctttttatccaggaaactacccaaacaatgctaaatgcgtctgggatatcgaggtgcagaataattaccgcgtgactgtcatcttcagggatgtccaacttgaaggagggtgcaattacgattatatagaggtgttcgatggaccataccggtcatccccactgatcgcccgagtgtgcgacggcgctagaggaagctttaccagcagctcaaattttatgtcaatccgattcatcagcgaccactctattactcgcagaggttttcgagctgagtactactctagcccctccaacgattcaacgaacctgttgtgccttccaaaccacatgcaggccagtgtatcccggagttatcttcagagtctaggcttctctgctagtgacttagttattagcacgtggaacgggtattatgaatgtcgtccccagatcactccgaatctggtcatctttactataccatattctgggtgcggtaccttcaagcaggcagataatgacacaatcgactactccaattttctgacagccgctgtttcaggcggaattattaaacggaggacagatctgaggatccatgtgtcttgtcgtatgctccagaacacatgggtagacactatgtatattgctaacgatactattcacgtagcgaataacacgatccaggtggaggaagtgcagtatggaaatttcgatgtgaatatcagtttctacacttccagctcctttttgtacccggtgacaagcaggccttattacgtcgacctgaatcaggacctttatgtgcaagctgagatcttgcactcagacgctgtcctgacacttttcgtggacacgtgcgtcgcgtccccttacagtaacgactttacgtcactgacttatgacctgattcggtctggctgcgtcagagacgacacgtatggtccatactcctcaccgtccctgaggattgcccgattcaggtttcgagccttccacttcctgaacagattccccagcgtctacttgcgctgtaagatggtggtgtgtcgggcttacgatccttctagcaggtgctacagagggtgcgtgcttaggagcaagcgcgatgttggatcttatcaagagaaagtggatgtcgtcttggggcctatccagttgcaaacacctccaagaagggaggaggagccacgtta

SEQ ID NO: 28345 - DNA, 7238 bp, Artificial Sequence
  Description of Artificial Sequence: Synthetic coding sequence
atgggtatctctacagttattctcgagatgtgccttctttggggccaagtcctttctacggggggttggatccccaggactacagactacgcctcgctaatccccagcgaagtgcccctcgacccgacagtcgctgaaggcagcccgttcccatcggaatcaacattggagagcaccgtggccgagggcagccccatctcgctcgagtccactttagaatctacagtggccgagggctcccttattcctagcgaatctaccctggagtccactgtcgccgaaggctctgacagcggactggccttaagacttgttaacggtgacgggaggtgccagggccgagtcgagatcctgtacagggggagttgggggacagtgtgcgacgatagctgggacaccaacgatgcaaatgtggtctgtagacaactgggctgcggatgggccatgtctgctccaggaaatgcctggttcggccaggggagcggccctatcgcactagacgacgtgcgctgttctggacatgagtcttacttgtggtcgtgccctcataatgggtggctcagtcacaactgtggccacggcgaggacgccggtgtcatatgctccgcggctcagccacagagcactctccggcctgaaagttggccagtgagaatttccccccctgtccctactgaaggaagcgagagtagcctggcgctgcgcctcgttaacggaggagacagatgccggggaagagtggaagtcttataccggggaagttggggaaccgtgtgcgatgattactgggatacaaacgacgccaacgtggtctgcaggcaattggggtgcggatgggccatgtctgctcctggtaacgcccagtttggtcagggatccggccctatagtgcttgacgacgtgagatgttcaggccatgaatcttatctctggtcttgtccccataatgggtggctaacacataactgcggccattcagaagatgccggagtgatctgcagcgcacctcagagtcggccaactcctagtcccgacacgtggccaacctcccacgcttccactgctggacccgagtcgtctctggctctgaggctagtcaatggcggtgatcgctgtcagggcagggtggaggtcctatacagaggcagctggggcacagtgtgcgacgattcctgggacacctcagatgcaaatgttgtgtgccgccagctggggtgtggttgggccacgagtgcccctggcaatgccagatttggacagggatctggccctattgtacttgacgatgtcagatgttctggctatgagtcttatctgtggtcttgcccgcataatgggtggttatctcacaactgtcagcattcggaggatgccggtgttatctgctctgccgctcacagttggtccacccctagcccagatactctgcccaccattactctgccggcttctacggtcgggtctgagagctccctggcactccgtctcgtcaacggcggtgatcggtgccaggggagggtggaggttctgtacagagggtcttggggtaccgtgtgcgacgactcctgggataccaatgacgccaatgtggtttgtcgacagctcgggtgcggttgggctatgctggctcctggaaacgctcgtttcggccaaggtagtggcccaatcgttctggatgatgtgaggtgcagtggcaatgagtcgtatttgtggagctgtccccataatggctggttgagtcacaactgcggccattccgaggacgctggggtgatctgcagtggtcccgagtcctccttggccctgaggctggtgaatggaggagaccgatgtcagggccgagtggaggtgctatataggggatcctggggcacagtgtgtgacgacagctgggataccaatgacgccaacgtggtttgtcgacagctgggctgtggatgggcgacttccgccccaggaaacgcacgtttcggtcaggggagtggacccattgtgctcgacgacgttcgttgctccggacacgagagttacctctggtcgtgcccgaataacggttggctcagccacaattgcggccatcatgaggacgccggtgtgatctgttccgccgctcagagtcggagcaccccccgaccggacacactcagcaccatcactctgccccctagcaccgtgggatctgaatcctcgctgacactgaggctggtgaacggatcagacaggtgtcagggtcgggtcgaagtcctgtaccgcggtagctggggaactgtatgcgacgatagctgggacacgaacgacgccaatgtggtgtgcaggcaactcggctgcgggtgggcaacgagcgcgccaggtaatgctcggttcggacaggggtctggacctatcgtgttggacgacgtacggtgctctgggcatgaatcttatctgtggtcttgtccccacaacggatggctgtcccacaactgtgggcaccatgaagatgccggtgtgatatgtagcgtgagccagagccgtcccacaccttccccggatacctggcctacgtctcatgcatctacagctggtcctgaatcatctttggccctgcgcctggttaacggaggggacaggtgccagggaagagttgaggtgctgtacagaggatcctggggaaccgtatgcgacgactcctgggacacatctgacgcaaatgtcgtatgtcgacagctcgggtgcgggtgggcaactagtgctcccggtaacgcccgatttggccagggatctggcccaatagtgctggacgatgtgcggtgcagtggatatgaaagttacttgtggtcttgtccccataacggctggcttagccacaattgtcaacactcagaggacgccggagtaatttgttcagccgctcactcttggagtacccccagcccagacaccctgcccacaattaccctgcctgcatccacggtcgggtcagagtcctctttggccctacgcctcgtcaatggtggagaccgctgtcagggcagagtcgaggtattgtaccagggctcatggggcacagtgtgtgacgactcatgggacaccaacgacgctaatgtggtttgccggcagcttggttgtggctgggccatgagcgcgcctgggaacgcaaggttcggccaaggaagcggccctatcgttttggatgatgtcagatgctcgggtcacgaatcatacctgtggtcttgtccacataacggctggctgagccataattgcggccactctgaggatgctggcgtgatctgctctgcctcacagagcaggcctacgcctagcccagatacttggcccacttcgcacgcatccaccgctggatccgagagctcgctggcccttagacttgttaatggcggagatagatgccagggacgagtcgaggttctgtataggggaagctggggaacggtgtgtgatgactactgggacacgaatgatgctaatgttgtatgtaggcagttagggtgcggatgggcaatgagcgctcccggaaatgcaaggtttggccaggggagcggtcccattgtgctagacgacgtgcggtgtagtggccatgaaagctacctttggtcatgcccccataacggatggttgtcccataactgcggacatcacgaagacgccggagtgatctgctctgcttcacagagtcagccaactccttccccagatacttggcccacatcgcatgctagcaccgctgggtctgaatcctcgctcgccctaagactggtcaatggtggggatcgctgccaggggcgtgtagaagttttatacagggggagctgggggaccgtatgcgacgattattgggacactaacgacgctaatgtcgtctgcagacagcttggatgtggctgggcaacttcggcccctggaaatgccaggttcggacaaggatctggcccaatagtgctggacgacgtgaggtgttccggacatgaaagctacttgtggtcctgcccacataatggctggctctctcacaattgcggccaccacgaagatgccggtgtaatttgtagcgctagtcagtcccagccgactccatcccctgatacatggccaacgtcccacgcaagcacagctggtagcgaatcaagtctggctttgcgcctagtgaatggaggtgaccgttgccaaggaagggtagaggtactgtaccggggaagctggggaaccgtctgtgacgactattgggacactaacgatgctaatgtggtgtgtcggcagctcggctgtgggtgggccacatcggcaccgggaaacgccaggttcgggcaaggctccggcccaattgtgcttgatgacgtgagatgctccggtcatgagtcctacctatggtcttgtcctcataatgggtggctgtcgcataattgtggacaccatgaggacgctggtgtcatctgtagcgcttcacagtctcagcccacaccctctcctgacacctggccaacaagtcgggcatctaccgctggttccgagagcacactggctctgaggctcgtcaatggcggagaccggtgccgtgggagagtggaagtgctgtatcaagggtcttggggaacagtctgtgacgactattgggacaccaacgatgctaatgtggtctgtcgtcagttgggatgcgggtgggctatgtccgcacctgggaacgcccagtttgggcagggatctgggccaatcgtgctggatgacgtgcgatgttcaggtcatgagtcctatctgtggtcatgccctcataacggttggttgagtcacaactgtggccatcacgaggatgctggggtgatatgctccgcggctcagagccaatctacgcctcgtcctgacacttggctgacgaccaacctgcccgcattaacagtaggcagcgaatcgagcctcgcccttcggctggtgaacggaggagaccgttgcagaggcagagtagaggtgttataccggggaagttggggcacagtatgcgacgacagctgggacactaatgacgctaatgttgtgtgtagacagctcggttgcgggtgggctatgagcgctcccggaaatgcccgttttggtcaaggctccggccctattgtgctggatgacgtcaggtgctccgggaatgaatcttacttatggagctgcccacataagggttggttgactcacaactgcggacaccacgaggacgctggggttatctgttcggccacccagatcaatagcaccactactgactggtggcaccccacaacaacgacaacagctaggccgtcaagtaactgtgggggtttcttgttctacgccagcgggaccttctccagcccatcatatccggcatattaccctaacaatgctaaatgcgtgtgggagatcgaggtgaacagcggctaccggattaacttaggattcagcaacctaaaactggaggcccaccacaattgctcctttgattatgtggaaatcttcgatggtagtctcaattcctccctcttgctggggaaaatatgcaacgacaccaggcaaatttttacgtcatcctataacaggatgacgatacatttcaggtccgacatctcctttcagaacacaggattcttggcttggtacaatagcttcccaagtgatgctaccctccgactggtgaatctgaactcatcatacggcctctgtgccggtcgggtcgaaatctaccatggaggcacttggggcactgtgtgcgacgacagttggacaattcaggaggctgaagtcgtctgtagacagctgggctgtggaagagcagtaagcgcccttggcaacgcttattttggcagcggatcaggcccaatcaccctagatgacgttgaatgctctgggacggagtctacactctggcagtgtcgcaatcgcggatggttcagtcataattgcaatcatagggaagatgctggagtcatatgtagtgggaaccacctgtccactcctgctccctttttaaacatcacccgaccaaataactactcatgtggcggttttctctcgcagcctagcggcgatttctcttctcccttttatcccggtaactaccccaacaacgccaagtgtgtgtgggatatcgaagtgcagaataattaccgcgtgacggtcatcttcagggacgtgcagctagagggagggtgcaactatgattacattgaagtgttcgacggaccgtatagaagctcccccctaattgcgagggtctgcgacggcgctcgcggatctttcacttcatcctcgaactttatgtctattcggttcattagcgatcattccattacacggaggggctttagggccgaatactattctagcccttcgaacgatagtactaacctgctgtgtttacccaatcatatgcaggcctctgtcagccggtcctatttacagtcccttggcttttccgccagtgacctcgtgataagcacttggaacggttattacgagtgcagacctcagattacgcctaatctggtgatctttacaatcccgtattctggatgtggtactttcaagcaggcggacaatgacaccatcgactatagcaatttcctgaccgcagcagttagtggcggaattattaaaaggagaacggacttacgtatccatgtgtcatgtaggatgctgcagaatacttgggttgacaccatgtacatagccaatgacaccattcacgtcgcaaataataccatccaggtggaggaagtgcagtacggcaacttcgatgtgaacatttccttctacacttcaagctcgttcttgtaccctgtaacgagcaggccctactacgtagacttgaaccaggacttgtacgttcaggcagaaattctgcactcagacgcggtattaaccttattcgttgatacgtgcgtggcaagcccctactctaatgatttcacttcactgacgtatgacttgattaggtcaggatgtgtacgggatgacacatacggcccatatagctctccatctttaaggattgcccgttttcgcttcagggcatttcatttcttgaaccgctttccctcagtgtatctcagatgcaaaatggtcgtgtgccgcgcttacgatcctagtagtaggtgttacaggggatgcgtactcagatccaaacgcgacgttggcagctatcaggagaaggttgatgtcgtccttggacctattcagctccagacaccccctagaagggaggaggagcctaggta

SEQ ID NO: 28346 - DNA, 7241 bp, Artificial Sequence
  Description of Artificial Sequence: Synthetic coding sequence
atgggtatttccaccgtaattctggaaatgtgtctgttgtgggggcaggtgctgtccaccgggggatggatccccaggaccactgactacgcatcactgattccttcagaggtccctctggaccccaccgttgcggagggatcccccttcccaagcgaatctactctcgagagtacggtggcagagggcagccccataagtttagaaagcacactggagagtaccgtcgctgaaggatctctgattccttcagaatcgaccctggagtcaactgtagctgagggatccgattccggccttgccttgcgactggtgaacggtgatggcagatgccagggacgcgttgagattctttaccggggttcctggggcaccgtgtgtgatgactcatgggacaccaacgacgccaacgtggtttgtcgccagttaggttgcggctgggccatgtcagcccctggcaacgcttggtttggacagggctcaggaccaatcgctcttgatgacgtccggtgtagcgggcatgagagttatctgtggtcctgtcctcataacggctggttgtcccataattgcggtcatggagaagatgctggcgtgatctgctccgcggcacagccccaaagtacgctcagacctgagtcctggccagtaagaatcagccccccagttcccaccgaagggagcgaaagctccctggccctgcgactggtaaatggtggcgataggtgcagaggccgagttgaggttctataccggggaagctggggtaccgtgtgtgatgattactgggatactaatgacgcaaatgtagtttgtcgccaacttgggtgcggctgggcaatgtccgctccaggcaacgcccagtttggccagggctcaggaccaatagtgttggacgacgtgaggtgcagcggccacgaatcctatttatggtcttgccctcataacggatggctgacacacaactgtggtcactctgaggacgctggagttatttgctccgcaccccagagccggcctacgccctccccagatacatggccaacctcacatgccagtacggctggtcctgaatcctctttagctttgcggctggtcaatggaggcgacaggtgccaagggcgagttgaggtgttatacagaggctcttggggcacagtatgtgacgatagttgggacacaagcgatgctaacgttgtatgcagacaactgggctgcgggtgggcaacttctgcccctggaaacgctagatttggacagggatccgggccaattgtgctggatgatgttcgctgtagtgggtatgagtcttatctttggtcctgtcctcacaatggctggctctcccataattgtcagcattcggaggacgccggagtgatctgttccgctgcccatagttggtccactcctagtccagatactctgcctacaatcactctgcccgcttccacagtgggcagtgagtcctccctggctctgcggttggttaatggaggcgacagatgccagggacgcgttgaggtgctttatcggggatcatgggggaccgtgtgtgatgattcatgggacactaatgacgctaatgtggtgtgtagacagttagggtgtggatgggcaatgcttgcccctggcaacgccagatttggacaagggagtgggccaatcgtgttggatgatgtcaggtgcagcggaaacgagtcgtatctgtggagttgcccccacaatggctggctgagtcacaactgtggacactctgaagatgcaggggtcatctgttccggccctgaatccagccttgccctgcgcctcgtgaacgggggagacaggtgtcagggtagggttgaagtgctgtaccgcggaagttggggaacagtgtgcgatgactcttgggacactaacgacgctaacgtcgtgtgcagacagttaggttgcggatgggctactagtgcaccagggaatgccagattcgggcaggggtccggaccgatcgtgctcgatgacgtgcgctgtagcgggcacgagtcctacctgtggagctgtcctaataacggctggctatcccacaactgtggtcaccatgaagatgctggcgttatttgctcagcagcacaatcaagaagcaccccgcgacctgacaccctttccaccatcacgctccctccttctaccgtgggcagcgagtcgagtttaaccctgcggctggtaaacgggagtgatcggtgtcaaggccgagtcgaagtactctaccggggatcctggggtacagtgtgcgacgatagctgggacaccaacgatgccaacgttgtatgtcgccagctgggttgcgggtgggccacatccgcccctgggaatgccaggtttggtcaaggctcaggcccaattgtgctggacgacgttagatgctccggccacgagtcttacctctggtcgtgcccccacaatggttggctcagccacaactgcggccatcacgaagatgcaggcgtcatatgctcggtgtcacaatcccgccctaccccctcacctgacacatggcccaccagtcacgcaagcactgcaggcccagaatccagtctagcactgaggcttgtgaacggcggtgacaggtgtcagggcagagttgaggttctctaccgagggtcttggggtacagtgtgcgatgatagctgggacacaagtgatgcgaacgtggtctgcagacagctcggctgcggatgggccacctcagcccctggcaacgctcgcttcggacaaggcagcgggcctatcgtgctggatgacgtgcggtgttccggttacgagagttacctatggtcctgtccacacaatggctggctgagccataattgccaacatagcgaagacgcaggcgtgatctgcagcgccgcacactcgtggtccaccccatctccagacacattgccgactattaccctcccagctagtaccgtgggcagtgagagctctttagctctgcggttggttaacggtggcgataggtgtcaagggcgagtggaagtcctctatcaaggcagctggggtacagtgtgcgatgactcttgggataccaacgacgccaacgtggtgtgccgccaattgggctgcggttgggccatgtcagcacccggtaacgcgaggttcgggcagggtagcggccctatcgtgctggacgacgtgagatgctcaggccatgagtcttacttgtggtcttgcccgcacaacggctggctatcccacaactgtgggcatagcgaagatgccggtgtgatttgcagcgcaagccagagtcgcccaaccccctctccggacacctggccgacatctcatgcctctaccgcaggcagtgagtcgagcctcgctttgcgactggtcaatggaggcgatagatgccaggggagggttgaggtcctatacaggggctcttggggaaccgtatgcgacgactattgggataccaacgatgccaacgtcgtgtgccggcagctgggatgtggatgggctatgtctgcaccaggtaacgccaggttcgggcagggttccggccctattgttctagacgatgttagatgctccgggcacgagagctatctctggtcatgtcctcacaacgggtggctgagccataactgtggccaccatgaggacgccggagtgatttgctcagcatctcagtcccagcctacaccgtcaccagatacttggcccacatctcacgcctcaacagcaggtagtgagagcagcctggcgctcaggcttgtcaatgggggagacagatgccagggcagagttgaagttctgtacagggggtcttgggggaccgtgtgtgacgactattgggacactaatgatgcaaatgtcgtgtgtcggcagcttgggtgcggttgggccacgagtgcaccaggcaatgctcgattcggtcaagggagcggacccatagtgttggatgacgtccgttgtagcgggcacgaatcttacctatggtcatgtccacataacggttggctaagccataactgtggtcatcacgaggacgccggagtaatttgttcggcaagtcagtctcagccaaccccaagccccgacacgtggcccactagtcacgcatcaactgctggcagtgagtcctctctggccctgcgcctggtaaacgggggagaccgctgccagggtagggtagaagtgctatataggggatcatggggtacggtgtgcgacgattattgggacacaaacgacgccaacgtcgtatgtcgacagttgggctgcgggtgggctacatctgctcccggaaacgccagattcggccaggggtcaggccctatagtgctggacgacgtgcgctgtagcgggcacgagtcttacctgtggagctgcccacacaacggatggctgagccataattgcggccaccacgaggacgcaggcgtcatatgtagtgcttcacagtctcaacctacaccttcccccgatacctggcctacttcccgcgcttctaccgccggttcggaaagcacacttgctctgcgattggttaatggaggggatcggtgtcgcggacgcgtggaggtcctctatcagggcagctggggcacggtttgtgatgactactgggacactaacgacgcgaacgttgtgtgccgacagctggggtgcggatgggcaatgagtgcgccaggaaatgcccagttcggacagggttcagggcctatcgtgttggacgacgtgcggtgctccgggcacgaaagttatctttggtcgtgccctcacaacggatggctgtcccacaactgtgggcaccatgaggacgctggtgtgatttgcagcgccgctcagagtcagagtacccctcggccagacacctggctaacaacaaatctacccgcactgacagtgggaagtgagagcagtctggccttgcggctggtcaatggcggtgaccgttgcaggggccgagtcgaggtgctgtacaggggatcttggggcacggtctgcgatgacagttgggataccaacgatgcaaacgttgtgtgccgccagcttggctgtgggtgggctatgtcggcccctggcaacgctaggtttggacagggctcagggccaatcgtgcttgatgacgtgcgctgctcagggaacgagtcatatctgtggagctgtccccacaaaggatggttgacccataattgtggacatcacgaggatgctggcgtgatctgctccgcaacgcagattaatagcacaaccacagattggtggcaccccactacaactaccacagccaggccgtccagcaattgtgggggtttcctgttctatgccagcggcacatttagcagtccatcctaccctgcctattatcctaataacgccaagtgcgtctgggaaatagaagttaatagcggatatcgaatcaatctcggattcagtaaccttaaactggaggctcaccacaattgcagcttcgattatgtcgaaatttttgatgggtcccttaattcctccctacttcttggcaaaatctgtaatgacactaggcaaatttttacttctagctacaacaggatgacaattcattttcgctctgatatcagtttccagaatacaggattcttggcctggtacaactctttccctagcgatgctactctgcggttggtgaatctgaactccagctacggcttgtgtgccggtagggtcgagatttatcatggaggaacctggggaaccgtgtgcgacgatagctggaccatccaggaggcagaggttgtgtgtaggcagctggggtgtgggagggccgtgagcgcactaggtaatgcgtatttcggctcgggctctgggcctattactctcgacgacgttgaatgttcagggaccgagtctaccctctggcagtgtcggaaccgcggatggttttcacacaactgtaatcaccgagaagatgcaggagtgatatgctcaggaaatcacctaagtactccggctcctttcctgaatattacacgccctaacactgattacagctgtggaggatttctgagccagcccagtggcgatttcagctcaccattttaccccggaaactatcctaataatgccaagtgcgtttgggatatcgaggttcaaaacaactatagagtcaccgtaatctttagggacgtgcagctcgaaggcggatgcaattatgactatatcgaagtgtttgatggtccctacagatcttcgcctctgatcgctagagtatgtgacggtgcacgcggaagctttaccagcagttcaaacttcatgtctatccggtttatctccgatcacagcattacccggcgtggcttcagagctgagtattatagttcacccagcaatgactccaccaacctgttgtgcttaccaaaccacatgcaggcatcagtaagccgttcatacctgcagagccttggattctcagcaagcgatttggttattagtacgtggaacggatattatgagtgcaggcctcagattacacccaaccttgtcatctttactatcccctactcaggatgcggaaccttcaagcaggccgacaacgacactatcgactacagtaactttctcaccgcggctgtcagtggtggcatcatcaagagaaggaccgacttgcggatccacgtgtcttgccggatgctgcagaatacctgggtggatacaatgtatatagctaacgatacgatccatgttgccaacaacacgattcaggtggaagaggtacagtatggcaatttcgacgtgaatatatccttttatacctcaagctccttcctgtatcctgtcacatctaggccgtattatgtcgatttgaatcaggatctgtatgtgcaggcggaaatactgcattctgacgccgtccttactctgttcgtggatacatgtgtggccagtccttactcgaacgatttcacctcactgacctacgatttaatccggagtggctgtgtcagagacgatacctatgggccttacagtagtccctctctgagaattgccagatttcgttttcgggcatttcacttcttaaatagattcccaagcgtgtacctgagatgcaagatggtggtgtgccgcgcttacgatccgtcaagccggtgttaccggggatgtgtgctcaggtctaagcgggatgtcggctcttatcaagaaaaggtcgacgtggtcctcggccctattcagctccagaccccccctaggagggaagaagagccacggta

SEQ ID NO: 28347 - DNA, 7212 bp, Artificial Sequence
  Description of Artificial Sequence: Synthetic coding sequence
atggggatttcaaccgttatactagagatgtgcctcctgtgggggcaggtgttaagtaccggagggtggattccgagaacaacagattacgccagcttgattcccagcgaggtgcctttggaccctacggtcgctgaaggaagcccgttccccagcgaatcgactctcgaaagtaccgtagccgaagggtcacctatctcactggagtcaactctcgagtccactgtcgcagagggatccctgatcccaagcgaatcaaccctcgagagcacagtagctgagggcagcgatagcgggctggcactgcggctggtgaacggagacgggaggtgccaggggcgagtggaaatactgtacaggggtagttggggcactgtatgtgacgacagctgggatactaacgacgctaacgtggtttgtaggcagctcgggtgtgggtgggcaatgagcgcaccaggaaacgcgtggtttgggcaggggtccggtccaatcgccctcgacgacgtccggtgtagcggacacgagtcttatctatggtcatgcccgcacaatggctggctttctcataactgtggtcacggcgaagatgcaggagtaatatgtagcgccgctcagccacagtccacactgcggcctgaatcctggcctgtgaggatctcccccccagtgccaacagaggggtctgaatccagcttggctctgcgtcttgttaacggaggcgaccgatgtcgagggcgtgttgaggtgttgtacagggggagctggggcacagtgtgcgatgactactgggatactaacgatgcaaatgtggtctgccgccagttggggtgcggttgggccatgagcgccccagggaatgcccaatttgggcagggttcagggccaatcgttttggatgacgtccgttgcagtggtcacgagagttacctttggagctgtccacataacgggtggctgacccacaattgtggacacagtgaagatgcgggagtgatctgcagtgcgccacagtctaggcccacgccttcccctgacacgtggcccacctctcacgcttctacagccggtcctgagagctccctcgcgcttcgcctggtgaatgggggagaccgatgccagggtagggttgaggtgttataccgaggatcttggggaacagtctgtgatgactcttgggacacatctgacgcaaatgttgtctgtcgacagttagggtgcgggtgggccacatctgctccgggaaatgcgaggtttggccaggggtctgggcctatcgtgcttgatgacgtccgttgcagcggctacgagagctatctgtggagttgcccccacaatggttggctgagccataactgtcaacatagtgaggatgctggcgtgatttgcagtgataccctccctacaataactcttccggcatcgacagtgggctcagagtcttctttggcattaagattagtgaacggcggtgatcgctgccagggcagggtcgaagttctttaccgcggatcttggggcacagtatgcgacgattcttgggacactaacgatgcaaatgtggtctgtcggcagctgggctgtgggtgggctatgctggcacctggaaacgctcggtttgggcaggggagcgggcctatagtacttgacgacgtccgttgctcaggaaatgagagctatctctggagttgccctcacaacggctggctttcccacaactgtggacactccgaggacgccggagtaatctgtagcggccctgagagctccctcgccctaagactggtgaatggcggagacagatgccaaggtagagttgaagtgctctatcggggtagctggggaaccgtttgcgatgactcttgggacaccaacgacgctaatgttgtgtgcaggcaactaggctgcgggtgggcaactagcgcgcctggcaatgctcgcttcggccagggtagcggaccgattgtcttagacgatgtcagatgctctggtcacgagagctatctatggtcatgtcctaataatggctggctgtctcacaattgtggacaccatgaggacgcaggagtgatctgttctgcagcgcagtctcgctccactccacgacccgacaccctctccacaataaccctgccaccctccacggttggttctgaatcctccctgaccctccggctggtcaatggctcagaccggtgccagggtcgggtggaagtgctctatcgtggcagctggggcactgtgtgtgacgattcttgggacactaatgacgcaaacgtcgtgtgcaggcagctgggatgtggatgggctacatccgcacccggtaacgcacgctttggccaaggctcaggtcccatcgtgctcgacgatgtgcgatgcagtggccacgagagttacctctggtcttgtcctcacaatgggtggctctcgcataactgcggccaccacgaagacgctggggtgatttgtagcgtgtcccaatcacggccaacaccttccccagatacatggcctactagtcatgccagtacggctggaccagagtcctcattagctctgcggctggtgaatgggggtgaccggtgtcagggaagagtagaagttctgtacagaggcagctggggtacggtatgcgacgattcttgggatactagtgacgcgaatgtcgtgtgtaggcaattgggatgcggctgggctaccagtgcccctggtaacgcccgttttggacagggaagtgggcctatcgtactggacgatgtgaggtgctcgggctacgagagctacctgtggagctgtcctcacaacggttggctatctcacaactgtcagcatagcgaagatgccggagtgatatgcagcgctgctcactcctggagcacgcccagccccgacaccttgcctaccatcaccctgcccgcttctaccgttggcagcgaatcttctctcgcactgaggctggtcaacggaggcgataggtgtcagggcagagtcgaggtactgtaccagggatcatggggaacggtttgcgacgacagctgggataccaacgatgccaatgtcgtctgtcggcaactgggctgtggctgggcaatgagcgcacccggaaacgcccgatttgggcaaggatccggaccaattgtgctagatgacgtgcgctgcagtggacatgagtcctatctctggtcctgtccacacaatgggtggctgtcacacaactgcggccactctgaggatgcgggagtgatttgttccgccagccagtccagacctacaccgagtccggacacttggccgacctcccacgcttctaccgccggttccgaaagttcactcgctttgcgattggttaatggcggtgatcggtgccaagggagagttgaggtcctctatcgcggaagctggggcacagtatgcgatgattactgggatacaaacgacgccaatgtggtttgcaggcagttagggtgcgggtgggctatgtctgcccctggcaacgcgagattcggacagggcagcggtcccattgtactggacgacgtgcgctgttccggccatgagtcgtacttgtggtcatgcccccacaacgggtggctctctcacaactgcggacatcatgaggatgccggtgtgatctgctcagcctcccagagccagcctacaccttcaccagacacatggccaacaagtcacgcttcaacagcaggttccgagtcctcactcgctttacggctggtgaacggaggggatcggtgccaaggaagagtagaagtgctctacaggggttcttggggcaccgtttgcgacgactactgggacaccaacgacgctaatgtcgtgtgtagacagctgggctgcggctgggccacatcagcgccaggcaacgcacgattcggccagggatccggtccgattgtgcttgacgatgttcgatgttccggccacgaatcctatctctggagctgcccacacaatggatggctgtctcataactgcggccaccatgaagacgccggagttatttgctcagcctcccagtctcagccgactcccagtcccgatacatggccaacttcccatgccagtactgctggctccgagtcatcactggctttacggctcgtcaacggaggagatcgttgccagggcagggtggaggtactctacaggggttcctgggggactgtgtgtgacgattactgggatactaacgacgccaacgtagtctgtcggcaactcggttgcggctgggctacgagcgcacctggcaatgccagattcgggcagggatctgggccaattgttctggacgatgtgagatgttcaggacatgaaagttacttatggtcttgcccccataacgggtggttaagccataactgcgggcatcacgaggacgctggggtcatatgcagtgcaagtcagtcccagccaactccaagcccggacacgtggcccactagcagggcttccactgctggaagtgaatctacccttgccctgcgacttgtgaatggcggtgatcggtgccggggacgcgtcgaagtgttgtatcagggaagctgggggacagtgtgcgatgattactgggacaccaatgacgctaatgtcgtgtgtcgacagctgggctgtggttgggccatgagtgccccaggcaatgcccagttcggtcagggctcaggtcctatcgtcctagatgacgttagatgctctggacatgagtcttacttatggtcatgcccgcacaatggatggttatcccacaactgcggccaccatgaagacgcaggcgttatctgtagtgccgctcaatcccagtccacaccccgaccggatacctggctcacaacgaatctacccgcattaacggttggaagcgaatcatctttggcattgcgcttggtcaacggcggagaccgctgccggggtcgcgtggaggtgttgtatagaggctcttggggaactgtgtgcgatgactcgtgggacaccaatgatgcaaatgtggtgtgcagacagttagggtgcggctgggccatgtccgccccagggaatgctcggttcgggcaggggagcgggccaattgttctcgacgacgtgcgatgctccggcaacgaatcctatctttggtcttgcccgcacaagggatggctcacccacaactgcggacaccacgaggatgctggagtgatttgctcggctactcagatcaattccacaactaccgattggtggcatccgacaacaactacaaccgccagaccttcttccaactgcgggggttttctattttacgcttctggtaccttttcttcacctagttatcctgcatactaccctaataatgccaaatgtgtgtgggaaatcgaggttaattccggctaccgaattaacctcgggttctcaaatctgaaattagaggcacatcacaattgctctttcgactacgtggagatcttcgatggttctctcaattcgagtctgctgttggggaaaatctgtaacgacactaggcagatcttcacgtcaagttataatagaatgacaatccacttccggtctgacatttcatttcaaaacaccggattcctcgcctggtataattcattcccttctgatgctacccttagactagtcaatcttaactctagttatggcctgtgtgctgggagagtggagatctatcatggagggacctgggggacagtgtgcgatgacagctggactatccaagaagcagaagttgtttgtaggcagcttgggtgcggcagggccgtgagtgccctcgggaatgcttacttcggatctggatcaggccctattaccctggacgacgttgagtgctcgggaaccgaatccacactttggcagtgcagaaacaggggatggttcagtcacaattgtaatcatcgtgaagatgctggggtgatatgtagtggcaatcacctgtcaacaccagcaccatttctgaatattacaaggcccaatacagactactcctgcggaggctttttgtcccaaccctcaggcgatttttccagtccattctatcccggaaactatcctaataacgccaaatgcgtttgggacatcgaggttcagaataattacagagtgaccgtgatctttcgggatgtccaactggaggggggttgcaattatgactatatcgaagtgttcgacgggccatatcggtcgagcccacttattgcccgtgtgtgtgatggcgcacggggaagcttcacatcaagctcaaacttcatgtctatacgcttcatatcagatcacagtattaccaggcgcggtttccgcgcagaatactattcaagcccgagcaacgactctactaacttactctgtctgccaaatcacatgcaggccagcgtctcaagatcttacctgcaaagcttgggtttttccgctagcgacctggttatctcaacatggaatgggtactacgagtgtcggcctcaaatcacccccaacctcgtgatttttacgataccctatagcggatgcggtacttttaagcaggccgataatgataccatcgactatagtaactttctgacggccgctgtgagcggcggaatcatcaagcgcaggactgaccttaggattcatgtcagttgtagaatgctccagaacacctgggtggacaccatgtacatcgcaaatgatacaattcatgtggcaaataataccatccaagtggaagaagtacagtacggtaatttcgatgtgaacatttccttttatacttcgagtagtttcctttatcctgtaacgtcacggccttattacgtagatcttaaccaagatctgtatgtgcaggccgaaatcttacatagtgacgccgtcctcacgctgtttgtggacacgtgtgttgccagtccttactccaacgactttaccagcctgacgtatgatctaatccgatccggatgtgtgagggacgacacctacgggccttattcctccccatccttgcgtatcgcgcgttttaggtttcgggcttttcacttccttaaccggtttccctcagtgtatttgagatgtaagatggttgtttgcagagcatatgacccttctagtagatgttatcgaggttgtgtgctccgttcaaagcgggatgtggggagttaccaggagaaagtggacgtcgttttggggcctatccagctacagactcccccaagacgggaagaagagccaaggtaa

SEQ ID NO: 28348 - DNA, 5357 bp, Artificial Sequence
  Description of Artificial Sequence: Synthetic coding sequence
atgggtatctcaactgtcatcttggaaatgtgccttctttgggggcaggtactttcaacaggtgggtggatccccaggacaacagactatgctagcctgattcctagcgaagtgccactcgacccgactgtggcagaaggttctccgtttccaagcgagtctactctggaaagtaccgtagcggaaggttctccgatctctctggagtctactctcgaatcaaccgtggcagaagggagcctcataccctcagagagtaccctggagtccacagtggcagagggctcagactctggtctcgcgctgcgtcttgtgaacggggacgggaggtgtcaggggcgtgtggaaattctttataggggctcttgggggaccgtgtgtgatgacagttgggatactaatgacgccaacgtggtgtgtagacaactgggctgtggatgggctatgtctgcccctggcaatgcatggttcggccaaggctcaggaccgatcgcgctagacgacgtgagatgtagtggccacgagtcctatctgtggtcctgcccccacaatggttggctctctcacaactgcggacatggcgaagacgccggagttatctgcagcgccgcacagccgcaatctaccctgcgccctgagagctggccggtcaggatttcgccccctgtccccacagaggggagcgaaagcagcctcgctctcaggctggtcaacggcggtgaccgatgtcggggacgcgtggaagtattataccgtgggagttggggtactgtgtgtgatgactactgggacacaaacgatgctaatgtggtatgccggcagcttggatgcggatgggccatgagcgcaccaggcaacgctcagttcggtcaaggatctggccctatagtcctcgacgacgttagatgtagcgggcacgaatcctacttgtggtcatgcccgcacaacggatggttgactcataactgtggacactcggaggacgctggcgtgatttgctcagcaccccaatcacgcccaacccccagccctgatacgtggcctactagtcacgctagtactgcaggacccgagtcatcactggcactccgactggttaatggcggtgatcgttgtcagggcagggtggaggtactgtacaggggatcctggggcactgtctgtgatgattcgtgggacacatccgacgccaatgttgtgtgcaggcagttggggtgcggatgggccacctccgccccaggcaatgccaggttcgggcagggatctggaccaattgtactggacgacgttcgatgtagcggttatgaatcatacctgtggagctgcccccacaacggctggctgagccacaactgtcagcatagcgaggatgctggggtgatctgcagcgccgcacacagctggagcacaccatctcctgacactctgcccaccattacgctccctgcctccaccgtgggtagcgaatcctctctggcactgagactcgtcaatggcggtgaccggtgccagggtcgggtggaggtcctctaccaggggtcctggggcaccgtttgcgacgactcctgggacaccaatgacgcaaatgtcgtgtgtagacaattaggatgcggctgggccatgtcagctcccggtaacgctcgtttcggtcagggtagtggccctattgtgctcgatgatgtcagatgctccgggcatgagagctatttatggagctgtcctcacaacggttggctgtcacacaattgtggccattctgaggatgccggtgtcatttgtagcgccagccagagtagacctacaccaagtccagacacttggccaacctcccatgcttccaccgcagggagtgaatcttctctggccctgcggctcgtgaatgggggtgatcggtgtcaggggagagtcgaggtgctctatagaggaagttgggggacagtgtgcgacgattattgggatacaaatgacgccaatgtggtgtgccgccagctgggttgtgggtgggctatgtccgctccgggaaatgcacgattcggtcagggcagcggacctattgtgttggatgatgtcaggtgttccggccacgaaagctacctgtggagctgtccccataatggatggcttagccacaattgtggccatcacgaggacgcaggcgttatttgctccgccagccagtcccaacccacaccttcgcccgacacatggcctactagtcacgcatctaccgcaggcagcgagtctagcttggctcttcgccttgtgaacggcggagatcgctgccaaggccgtgtcgaagtcctctaccgcggttcctgggggaccgtgtgcgatgattattgggatacaaatgatgcaaatgttgtgtgccggcagctggggtgcggatgggctacgtccgctcccggaaacgccaggttcggccaggggagcggcccaattgtcctagatgatgttagatgttctggacacgaatcttacctttggagttgccctcacaacggatggctctctcataactgcggccaccacgaagacgcaggcgtaatatgctcggccagtcagagccagccaaccccaagtcctgacacctggcccacatcaagagcctctacagctggcagcgaaagcaccctggccctgcgtttggtgaacggcggagacagatgtaggggccgagttgaggttctgtatcagggttcttggggaacagtatgtgatgactactgggataccaacgatgctaatgtagtctgcagacagcttgggtgcggctgggccatgtccgctcccggaaatgctcagttcggacaggggtcgggccctatcgtgctcgacgacgttcgctgctctggccacgagtcctacctgtggtcctgcccccacaacggctggctgagccataattgtggacaccacgaggatgctggcgtcatttgtagcgcagctcaatctcagtcaactcctcgtcccgacacgtggttgaccaccaatctgcctgcgctgacggtgggtagcgagtcgagtcttgcgctgcgtttggttaatgggggtgatcgctgtagagggcgtgtggaggtactctacagggggagttggggtacagtctgcgatgactcttgggatacgaacgatgctaatgtcgtatgtcgccagctcgggtgtggatgggccatgtccgctcccggtaatgcaagatttgggcaaggaagcgggcctattgtcctcgacgatgttcgctgctccggcaacgaatcctatctctggtcatgccctcacaaaggctggctgacccataattgcggccatcacgaagatgcgggagtcatttgttcagctacccagatcaacagcaccactacggattggtggcatccaacaaccaccaccacagccaggccttctagtaactgcgggggattcttgttttacgcgtccggtaccttttcctcaccctcttaccccgcttactatccaaacaacgctaagtgcgtttgggagatagaagtcaactcgggatatcggatcaatctgggcttttctaaccttaagctggaagcccaccataattgttcttttgactacgtagaaatctttgatggatcactaaactcaagtctgctactcggtaagatttgtaatgataccaggcaaatctttacgtcgtcgtacaatcgcatgactatccacttccggagtgacatcagctttcagaatacaggctttctagcatggtataactccttcccttctgatgcgacccttagactggtgaacctgaattcctcttatgggctgtgcgcaggcagagtggaaatttatcacggcggaacatggggcacggtatgtgatgacagctggacaattcaggaggcggaggtggtatgcaggcagttggggtgcgggcgtgctgtgagcgccctgggcaacgcatactttggaagcggttcaggtcccatcaccctggacgacgtagagtgtagcggaacagagtctacactgtggcagtgtaggaatagggggtggttttctcataattgtaatcacagggaggacgctggagtcatctgtagtggcaaccacctcagtacacccgctccgttcttaaacataactcggccaaacacggattatagctgcggaggtttcttgagccaaccttctggtgatttcagttcccctttctaccctggaaactatccaaacaacgcaaaatgcgtctgggacattgaagtgcagaataattaccgggtcacggtgattttcagggacgttcaacttgagggaggatgcaactatgattacatcgaagtgtttgacggtccttataggagttcacccttaatcgcccgtgtgtgcgacggtgcccgtggtagtttcacttccagctcgaacttcatgtcaatcagatttatctcagatcacagcattacaaggagaggattccgggctgagtattattcgtctccgtcgaatgacagcaccaacctcctctgcctgccaaatcatatgcaggcatccgtctctcgatcatacctgcagtctttaggctttagtgcctctgacttggttatttccacctggaatggatactatgaatgcaggcctcagattacaccgaacttagttattttcacaattccctactcaggttgtggaacatttaagcaagcagacaatgatacaatcgactatagcaacttcctcactgccgcagtctcaggaggcattattaagcggagaactgatctgagaattcacgttagctgccggatgctgcagaacacttgggtcgacactatgtacatcgccaacgacacaatccatgtggccaataacaccattcaggtggaggaggttcagtatggcaattttgatgtgaatatatcattttatacttcctcatccttcctttacccagtgacttcccggccatattatgtggatttaaaccaggacctctatgtccaagctgagatcctccattcagatgccgtattgaccctgttcgtagatacatgcgtggcttccccatacagcaatgacttcacatccctgacttatgacttaatacgaagcggttgcgtacgggacgatacttacggaccctacagctcaccttcattgcgtattgccagatttcggtttcgggctttccatttcctgaatcggttcccttctgtgtacctgagatgtaaaatggtggtctgcagagcctacgacccgtcgtccagatgctacagaggctgcgtgctgaggagcaaaagagatgtgggatcatatcaagaaaaagtggacgtggtgctcggcccaatccagcttcagaccccacccaggagggaagaagaacccaggta

SEQ ID NO: 28349 - DNA, 597 bp, Artificial Sequence
  Description of Artificial Sequence: Synthetic coding sequence
atggccgcagacatttcggaatcctccggagcggactgcaaaggcgacccacggaatagcgccaaactggacgcagactaccctctccgcgtgttatactgcggtgtatgttctctgccaactgaatattgtgagtacatgccagacgttgccaagtgtaggcagtggcttgaaaaaaatttccccaacgagttcgcaaagcttactgtggagaattcccctaagcaggaggccggaatatccgaggggcagggcactgccggagaggaagaagagaaaaagaagcagaagagaggcggacgcggtcagataaagcagaagaagaaaactgtgccgcaaaaagtcactattgcaaaaataccacgcgcaaagaagaagtacgtgaccagggtctgtggactggctacttttgagattgatcttaaagaagcccagcgcttcttcgcacagaaattttcatgcggcgcatccgtcaccggggaggatgagatcattattcagggcgacttcacggatgacatcattgatgtgattcaggaaaaatggcctgaggtggatgatgatagtattgaagacctgggcgaggtgaagaagtag

SEQ ID NO: 28350 - DNA, 1530 bp, Artificial Sequence
  Description of Artificial Sequence: Synthetic coding sequence
atggatcctccgcgtgcctcacacctctcacctcgtaagaagcgtccacgacagacaggagccctaatggctagcagcccacaagacattaagttccaggacctcgtggtgtttattctagagaagaagatggggaccactcggagagcttttcttatggagctggctcgtcggaaagggtttagagtcgagaatgaactgagtgactccgttacccacatcgtggccgaaaataattctggctcagacgtactggagtggctccaggcccagaaagtacaagttagctcacagcccgaacttctggatgtcagctggttgattgagtgcatccgtgcaggcaaaccagtggagatgactggtaagcatcagctcgtggtacgcagggattactctgattcaactaacccgggtccacctaagaccccaccgatagcggtccagaagatctcacaatacgcctgccagcgcagaacaaccctgaacaattgtaaccagatttttactgacgcatttgatattcttgcggagaattgtgagttccgcgagaacgaagattcatgcgtaacttttatgcgcgctgcgtccgtcctcaagtccttgccgtttaccatcatttccatgaaggacactgaaggaatcccttgcttaggttcgaaggtgaaagggatcatagaggaaattatcgaggacggggaatccagtgaagtgaaagccgtgctaaacgatgaacggtaccaatcattcaaactctttacctccgtctttggtgtgggcctgaaaacctccgaaaaatggtttagaatgggctttcgaaccctatcaaaagtgcggtccgacaagagtttaaaatttaccagaatgcagaaagcgggatttctgtactatgaagatctggtcagctgcgtgacacgcgcagaggccgaggccgttagcgtccttgtgaaagaagccgtgtgggccttccttcctgacgcctttgtgactatgactggtggttttcggcgagggaagaaaatgggacatgacgtcgatttcctgatcacaagccctggatccaccgaggacgaagagcaactgctgcagaaggtcatgaacctttgggaaaagaaaggcttgctcctgtactatgacttagtggagagtaccttcgagaaactgcgcctgccatcccgcaaggtggatgccctggaccactttcagaaatgctttctgatttttaaattgccacgtcagcgcgtggattccgatcaatctagctggcaggaagggaaaacctggaaagccattagggtggatctggttctctgcccgtacgagcgcagagccttcgctctgctgggatggacagggagcagacaattcgagcgggacctgcggaggtacgccacgcatgagagaaagatgatcctcgataaccacgccttatacgataagaccaaaagaatctttctgaaggctgagagtgaggaggagattttcgcacatctcggtttggactacattgaaccctgggaacggaatgcctag

SEQ ID NO: 28351 - DNA, 1527 bp, Artificial Sequence
  Description of Artificial Sequence: Synthetic coding sequence
atggatcctccccgagctagtcatctgtctcctagaaaaaaaagaccccgtcagaccggtgccctgatggcgtcttctccacaagacatcaaatttcaggatcttgttgtattcattttggagaaaaaaatgggcacaactagacgagcatttttgatggaactcgcccgacgtaagggattccgcgtggagaacgagctatcagattctgttacacacattgttgccgagaacaactcaggctcggacgttttagaatggctgcaggctcagaaggttcaggtgtcatcgcaaccggaactgttggacgtgagctggctgattgagtgcattcgtgccggaaaacctgttgagatgaccggtaaacaccaattagtagtaaggagggattatagcgatagcaccaacccaggaccaccaaagaccccacctatcgcggtccagaagataagccagtacgcgtgtcaaagaagaactactcttaataattgtaaccagatcttcacagatgctttcgatatccttgctgagaactgtgagttccgtgagaatgaagactcttgtgtgacatttatgcgggcagcctcagtgttaaaatcgctgcctttcaccattataagtatgaaagacaccgaaggcataccttgcttaggcagtaaagttaagggtatcattgaggagattatcgaagatggagagtctagcgaagttaaagcagtcttgaatgacgagaggtaccagtctttcaaattgtttacgagcgtgttcggcgtgggactcaagacctccgagaagtggtttagaatgggctttagaacgctgagtaaagtccggtctgacaaatcacttaaattcacgcgcatgcaaaaagcaggattcctctattacgaagacttggtcagctgtgtgacacgcgctgaggccgaggccgtgtccgtgctggttaaagaagctgtctgggccttcctccctgatgcgtttgtgacaatgacggggggattcaggaggggaaaaaaaatggggcacgacgtagactttctcatcacatctccaggctctaccgaggacgaggaacagctcctgcaaaaagtcatgaatctgtgggagaaaaagggtctgctgctttattatgatttggtggaaagcacattcgagaaactacgtctgccttctcgcaaagtcgacgccctggatcatttccagaaatgctttctgatctttaagctgcctcgccaacgggtcgattccgaccagtcatcctggcaggaagggaagacctggaaagccattagggtcgaccttgtgctctgtccctatgagaggagggcatttgcgctgttgggatggactggttccagattcgagcgagacctgcgaagatatgcaacccatgaaagaaagatgatcttagataatcacgcactctatgacaaaactaaacggatttttctgaaagcagaatccgaagaagaaatctttgcccatttaggcttggattacattgaaccttgggagcgcaacgcatag

SEQ ID NO: 28352 - DNA, 2544 bp, Artificial Sequence
  Description of Artificial Sequence: Synthetic coding sequence
atggaagccgctcggccttctggatcatggaatggggctctgtgtagactgctcctcctcaccctcgctatcctcatcttcgcctccgatgcctgcaagaacgtgacccttcatgttccaagtaaattagatgctgagaaacttgtgggcagggtcaacctcaaagagtgttttactgcggctaacttgattcacagttccgatccagactttcagatactggaagatggatccgtgtacacaaccaacacaatacttctctccagtgagaaaagaagctttactatactgctgtctaatacagagaatcaggagaagaaaaagatctttgtgttcctcgagcaccaaactaaagtactcaagaaaagacacacaaaagaaaaagtgcttaggcgggctaaaagacgctgggccccaataccatgctccatgctcgagaacagccttggcccattccctctttttctccagcaggttcagtcagacaccgctcagaactacactatctactactccatccggggaccaggcgttgaccaggagccaaggaatctgttttacgtggaaagggacactgggaacctgtattgcaccagacccgtagatcgtgaacaatatgagagcttcgaaattatcgcctttgcaactacccctgacggctacacacccgagttgcctttacctctaatcataaaaatagaggacgagaacgataattaccctatatttaccgaagagacctataccttcaccatatttgagaactgtcgggtcggcactaccgtgggccaggtctgcgccacggataaggacgaaccagatacaatgcacacaagactcaaatatagtatcatcggccaggttcctcctagcccgacattgttttcaatgcatcctaccacaggcgtcatcacaacgactagcagccagctggacagggaactcatcgacaaataccagctgaaaattaaggtgcaggacatggatggccaatacttcgggctgcagacaacctctacatgcatcatcaatatcgacgacgttaatgaccatctgcctacttttactagaacctcctatgtgacctctgttgaggagaatactgtcgatgtagagattttacgggtgacagtggaggacaaggatttggtgaatactgccaactggcgcgctaattacacaatcctgaaggggaacgaaaacggtaactttaaaattgtgacagacgccaaaacgaacgagggcgtactctgcgtagtgaaacccctcaattacgaggagaagcagcagatgattctgcagataggagttgtaaacgaagccccattcagcagggaagcatccccacgttccgcgatgtctactgctacagtcaccgtcaacgtcgaagaccaggatgaaggccctgaatgcaaccctccaattcagaccgtacggatgaaagagaatgccgaggttggcaccacctccaatggctacaaggcctatgacccagagacccgcagttcgtcaggaatcaggtacaagaaattaacggatccgacaggatgggtcacaatcgacgaaaatactgggtctataaaagtctttcgcagcctggacagagaggcagaaacgataaagaacggtatttacaacatcactgttctggcgtcagaccagggcggtcggacatgtacagggacccttgggataattttgcaggacgtcaacgacaattctccatttataccaaaaaagaccgtgatcatatgcaaaccaactatgagctcagccgagatcgtggccgtcgaccccgatgagcccatccacggcccacctttcgactttagcctggagtcctcaactagcgaggtccagaggatgtggcggctcaaggcaatcaacgataccgccgcacggctgagctatcaaaatgaccctcctttcggttcatatgtggttcccatcaccgtgagggatcgattgggcatgtccagcgtgaccagtttggacgtgacactctgtgactgcatcaccgaaaatgactgcactcatagggtcgatccacgaattggaggaggcggtgtacagcttggcaagtgggctatccttgcaattctcttaggcatcgcccttctgttctgtatactgtttacactggtttgtggagcctcagggacatccaaacaacccaaagtgattcctgatgacttagcacagcagaatctgatagtctcaaacaccgaggcccctggggatgataaagtttatagtgcaaacgggtttaccacgcagaccgttggagcttccgcccagggggtctgtggaaccgttggaagtggcatcaaaaacgggggacaagagactatcgagatggtgaagggtggtcaccagacctcagaatcatgtagaggagccggacaccaccatacactggattcttgtcgcggaggccataccgaggtcgacaactgtaggtatacttacagtgagtggcactcattcacgcaacctagactaggcgaagagagtataagagggcatacactgattaagaattag

SEQ ID NO: 28353 - DNA, 2706 bp, Artificial Sequence
  Description of Artificial Sequence: Synthetic coding sequence
atggaagctgctagaccttcgggatcttggaatggcgctttatgcagactgctgctactgacgctggctatcctgatttttgcctctgatgcatgcaaaaatgttacactgcacgtacccagcaaactggatgcagaaaaattagtcggaagggtgaatctgaaggagtgcttcaccgcagcgaatctgatccacagctctgacccagattttcagatactcgaggacggttctgtgtacacgacgaacaccatactgctgtcaagcgagaagcgctccttcactattctgctgagtaatacagagaaccaagaaaaaaaaaagatcttcgtgttcctcgagcaccagacgaaagtactcaagaaacggcacactaaagagaaagttctgaggagggctaagaggagatgggccccaatcccgtgttctatgcttgaaaatagtttgggacccttcccacttttcctgcagcaagtgcagagtgacacggcccaaaactacacgatttattactccatcagaggccctggcgtggaccaagaaccaagaaatctgttttacgtggagcgtgacacagggaacctctattgtactaggcccgttgacagggagcagtatgaaagctttgagatcatcgcctttgcaacgacccccgatgggtatactcctgagttacccctgcctctgattatcaagatcgaggatgagaacgacaactacccgatttttacagaagaaacctatacctttacaattttcgaaaactgccgagtcggtaccactgttggtcaagtgtgtgccaccgacaaggatgaacccgatacgatgcataccaggctcaaatatagtatcattggacaggtgccgcctagccccaccttattcagcatgcatccgacaacaggtgtgataaccactacgagcagccagctggatagagagcttatagataagtaccagctgaaaatcaaagtgcaggatatggacgggcaatactttggcctgcaaaccacctcaacctgcatcatcaatattgatgacgtcaacgatcatttaccgactttcacccggacttcctacgtcacaagcgtggaagaaaatacggtggatgtggaaattcttagggttaccgtcgaagacaaagatctagttaatactgccaactggcgggcaaattataccatactgaaaggtaatgagaacgggaacttcaagattgtcactgatgcaaagacaaacgaaggagtcctttgcgtggtaaaacctctgaattacgaggagaagcagcagatgatcttgcagatcggcgtcgtaaatgaagcccctttttctcgtgaagcttcccccaggtcagccatgtctaccgccactgtgacggtgaacgtagaagaccaggacgagggacccgagtgcaatccaccgattcagactgttaggatgaaggaaaatgccgaagtcggtaccacctccaacggttacaaggcgtacgaccccgagactcgctccagcagtggaataagatataagaaattaaccgaccccactgggtgggtaactatcgatgagaatacaggttcgatcaaggttttcagaagcctggaccgcgaggctgaaacaattaaaaacggcatttacaacatcaccgttttagcatctgatcaaggtggccgaacctgtacgggcaccctggggatcattctccaggacgtaaacgataactccccatttatccctaagaagactgttattatttgcaaaccaaccatgagtagtgccgagattgtggcggtcgaccctgacgagcccatccacggcccaccctttgacttctcactcgaaagcagcacatcagaagtccagcgcatgtggcgcctgaaagcaattaatgatacagccgcacggctttcatatcagaatgacccaccattcggaagctatgtcgtgcccatcactgtccgcgacaggcttggaatgtcaagtgtcaccagccttgacgtcacactctgtgactgtatcaccgaaaatgattgtacccatagagttgatccgcgtattggtggcggtggggtacagctggggaagtgggccatccttgctattctccttggcattgcgttactattctgcattctttttaccctggtctgtggcgcttccggtacctcaaagcaaccgaaggtcattcccgatgacctagcgcagcagaatctcattgtgtcgaacacagaggccccaggcgacgataaggtgtactctgccaatgggttcaccacccagacagtgggtgcaagcgcccagggtgtgtgcggcacagtagggtccggaattaagaacggaggccaggaaacaatcgaaatggttaagggtggtcaccagactagcgagtcttgccggggagccggacaccaccataccctggacagctgccggggaggacacactgaagttgataattgtcgttatacttactccgagtggcactcctttacacagcctagacttggtgagaaagtgtatctttgtaatcaagatgaaaatcacaaacacgctcaagactacgtactgacatacaactacgaggggagaggttccgtcgcgggatctgttggttgctgttctgagcgacaggaagaagacggtctggaattccttgacaatcttgaacccaaattcagaaccttagctgaagcctgcatgaagcggtag

SEQ ID NO: 28354 - DNA, 2745 bp, Artificial Sequence
  Description of Artificial Sequence: Synthetic coding sequence
atggaagcggcacggccttctggatcttggaatggggcactatgccgtttgctgctgctgaccctggctattctgatctttgcttctgatgcctgtaaaaacgtgacactgcatgtcccaagtaagctggatgcggagaagttagttggccgagtcaatctgaaagaatgctttacggctgccaatctgatccactcatccgacccagattttcagatccttgaggacggttccgtgtatactacaaataccattctcttgtcctccgagaagcgctcattcacaatcctgctcagcaacacagagaatcaagagaagaaaaagatttttgtgtttttggaacatcagacaaaaattagcctgctggtgccgtggctttgcttagtagccgaggtgctgaagaaacgacataccaaggaaaaggtcctgcggagggccaagcgccgttgggcgccaattccctgctcaatgctcgagaatagtcttggacctttcccactcttcctgcaacaggtgcaatccgacacagcccagaattatactatctattatagcatcagaggacctggagttgatcaggaacccagaaatctgttttacgtagaacgcgacactggcaatctgtactgtacccgtccagtggatcgggagcagtatgagtcgtttgaaatcatcgcctttgcgaccacgcccgatggatataccccagagctcccactaccattaataattaagattgaggatgagaatgacaattatccaatcttcaccgaggaaacatacactttcaccattttcgaaaactgccgcgtgggtacaaccgtggggcaggtgtgcgcaacagataaggatgagcctgatacaatgcatactcgcctgaagtatagcattattggacaagtcccaccttcacctaccctcttttctatgcatccaactactggcgttattacaacgacctcatctcagctggaccgcgaactgatcgacaagtaccagcttaaaattaaagttcaggatatggacggtcaatactttggactgcagacgacgagtacttgtatcattaatatagatgacgtcaatgatcaccttcctaccttcactagaacgtcatatgtgacctcagtggaggagaacactgtggatgtcgagattctgcgcgttaccgtggaagacaaagatctggtgaatactgccaactggcgtgccaattacacgatactcaagggcaatgagaacggcaatttcaagattgtgacagatgctaagacgaacgaaggcgttctgtgtgtggttaagccactgaactatgaagaaaagcagcagatgatcctgcagatcggcgtagtgaatgaggcaccattttcaagggaagcctctccacggtccgctatgtccactgcgacagtgaccgtcaatgttgaggaccaggacgaaggacccgaatgtaatcctcccatacagaccgtgcgaatgaaggaaaatgccgaggttggcaccacatccaacgggtataaagcgtatgaccccgagacccgcagctcttccggtattcggtacaaaaagctgacagacccaacaggttgggtcactatcgatgagaataccggcagcatcaaggtctttagatctctagatagagaggctgagactatcaagaacgggatctataacatcactgtcctggcaagcgaccagggcggaagaacatgtactggcactctggggattattttgcaggacgttaacgataatagcccgtttattcctaaaaaaacagtgattatatgcaaacccaccatgtcctcagctgagattgttgcagtagaccctgatgagcctatccatgggccaccattcgatttctctctggagagttccacttctgaggtccagcgcatgtggcggttgaaagctatcaatgataccgctgctcgcctgagttatcagaatgaccctcctttcggcagctacgtggtaccgatcacagtacgggaccgcctgggaatgtcaagtgtgaccagcctggacgtgaccctttgtgactgcatcacagagaatgattgtacccatcgggtggacccgcgaatcgggggaggtggcgttcagctggggaagtgggccatcttggccattctgctgggtattgccctcctcttttgtatcttattcactcttgtatgcggtgcctccggaacatcgaagcagcctaaagttatccctgatgatttggcccaacagaatttgatagtcagcaacactgaggcccctggcgacgataaagtgtactctgccaatggattcaccactcagacagtgggagcttcagctcagggtgtgtgcggtaccgtcggctctgggattaagaacgggggacaggaaaccatcgaaatggtaaagggtgggcaccagacttcagaatcttgcagaggcgctggtcaccatcataccttggattcctgtcggggaggacacacggaagtggacaattgtcgatacacctatagtgagtggcactcttttacgcaacctcgactgggagagaaggtatacctatgtaaccaggacgagaaccataaacacgctcaggattacgtgttgacttataattatgaaggaaggggtagtgtggcagggagtgtggggtgttgctctgagcggcaggaagaagatggcctggagtttctcgataatttggagcccaagtttaggactctggcagaggcatgtatgaagaggtag

SEQ ID NO: 28355 - DNA, 2004 bp, Artificial Sequence
  Description of Artificial Sequence: Synthetic coding sequence
atgaagatgatcactacccagtttctccaaaagaagctaattctgctgcaatttctgaagattgccgagtgggggacgacagttggccaggtgtgcgccacagataaagatgaacccgacacaatgcataccagattgaagtattccatcatcggacaggtacccccatctcccacccttttctcaatgcacccaacaacaggagtcataacaactacctcttcccagctcgaccgtgagctgatcgacaagtaccagttgaaaatcaaggtccaggacatggacggccagtacttcggcctacagaccacatccacctgcatcatcaatatcgatgacgttaatgaccatctgcccacctttacacgcacatcatacgtgacgtcggttgaggagaatactgttgacgtcgagattctgcgggtaactgtggaagacaaagatctagtaaacacagccaactggcgcgcaaattatacaatcctgaagggaaatgaaaatggtaattttaaaattgtcaccgatgctaagacgaatgaaggggtactgtgcgtggtgaagccgctaaactatgaagagaaacagcagatgattttgcaaatcggcgtcgtaaatgaggcacccttctctcgggaggcctcacccagaagtgcaatgagtacagctactgtgaccgttaacgttgaagaccaagacgaggggcctgagtgtaacccgccaatccagacggtccgcatgaaggagaacgcagaggtggggaccacatcaaatggatataaagcctacgaccctgagacacgctcaagctctggcatccgatataaaaaattaaccgacccaacgggctgggtgaccatagacgagaataccggttccattaaggtgttccgatctttggacagggaagccgagactatcaagaacgggatttataacatcacagtcctcgcctccgaccaggggggacggacatgcactgggacgttgggaatcattctacaggacgtgaacgacaactctccattcatccccaaaaagactgtgatcatctgtaagccgaccatgtcctccgctgagattgtcgctgtagatcctgatgaacccatccacgggccaccattcgatttttctctggagagcagtaccagtgaagtgcaaagaatgtggaggcttaaggccattaatgacacggctgctaggctgagctaccaaaatgaccccccatttggctcttatgttgtgccaattaccgtgcgagataggttagggatgagctcggtcacctctctggatgtcaccctctgtgattgcatcacagagaacgactgtacgcatagggtggaccccagaattgggggaggaggagtgcagctgggtaagtgggcaattttagcgatactgctgggcatcgcacttctcttttgtatactattcacactcgtgtgtggcgctagtggaacctccaagcagcctaaggtcattcccgatgatctggcccagcagaaccttatcgtatcaaacacagaagctcccggtgacgataaagtatactctgccaatggcttcacaactcagacagttggtgcctccgcacaaggagtgtgtgggaccgttggaagcggaattaagaatggagggcaagagaccattgaaatggttaagggaggtcatcaaactagcgagagctgccgcggtgccggtcaccaccatacgctggattcgtgcaggggaggacatacagaggtggataactgtagatacacttacagtgagtggcatagctttacccagcccaggctgggcgagaaagtttacctttgcaaccaagatgagaatcacaaacatgcccaggattatgtattgacatacaactacgaagggcgaggctccgttgccggaagcgtgggctgttgtagcgagaggcaggaagaagatggccttgagttcctagataatcttgagcccaagtttcggactctggcagaggcatgtatgaagagatag

SEQ ID NO: 28356 - DNA, 3000 bp, Artificial Sequence
  Description of Artificial Sequence: Synthetic coding sequence
atgatggggttgtttcctaggactaccggcgctcttgctatatttgtggtggtcatattggttcatggggaattgagaatcgaaaccaaggggcagtatgatgaggaggagatgaccatgcagcaggccaagcggaggcaaaagagagaatgggtcaagttcgcgaaaccatgtcgagagggtgaggacaacagcaagagaaatcccatagccaagattacatctgattatcaggccactcaaaaaattacttaccggattagcggcgtcgggatcgaccaacccccattcggcatatttgttgtcgataagaacacaggggatatcaacattaccgcgattgttgaccgcgaagagaccccgagcttcctgattacatgtcgcgcactcaatgcacagggcttggatgtcgagaagccactgattctcactgtaaagatcttggatatcaacgacaaccccccagtgttctcacagcagatctttatgggcgagatcgaggagaattcagcgtctaattccctcgtgatgatcctaaacgcaacagacgcagatgagcctaaccacctgaacagtaaaatagctttcaagatcgtgagccaggagccagccggaactccgatgtttcttctgagtcgtaacactggcgaggtgcgcactctcactaactcactcgacagagaacaggctagctcttatcggctggtggtttccggcgctgataaggacggtgaggggttgagcacccaatgtgaatgtaacatcaaagtgaaggacgtcaacgacaatttccccatgttcagagattctcagtactccgctagaatcgaagaaaatattctgagctccgaactcctgagatttcaggtaaccgaccttgacgaagaatacacagataattggctggctgtgtacttctttacttcaggtaacgaagggaattggttcgagatacagaccgacccccgtaccaatgaagggattctgaaagtggtcaaggcgctggattacgaacagctccagtctgtaaagctgagtattgcagtgaagaacaaagcagaattccaccagagcgtgatttcacggtacagagtgcagtcgacaccagtcaccattcaggtcatcaacgttagagagggtatagctttcaggcctgcttccaaaacctttacagttcagaaaggcatatcctccaagaaactggtggattatatcctcgggacataccaagccattgacgaggacactaacaaggccgcttccaacgtgaaatatgttatgggacggaatgacggaggctatttaatgattgacagtaaaacggcagagatcaagtttgtgaaaaacatgaatcgtgactcaacattcatagtcaataagacgataacggcagaggttctggccatcgatgaatacacaggaaagacgtctaccgggacagtttacgttagggtccctgactttaacgacaattgtcctaccgctgtgctggagaaagacgctgtgtgtagtagcagccctagtgtcgtcgtatctgcaaggacactgaataatcggtatactgggccatacacctttgcactcgaggatcaacccgtcaagcttcccgctgtttggtcaatcacaaccttaaacgccacctcggcactgttgagggcacaagaacagattccgccaggagtgtaccacataagtctcgtactgacagatagccagaataaccggtgcgaaatgccacggtctctgactctcgaggtgtgtcagtgcgacaacagaggaatctgtgggacctcctatccaacaactagtcccggtaccaggtatgggcgtccacactccggaaggctggggcctgccgcaatcggattgttgctgctgggcctactgcttttgctgctcgcccctctgctgttgctgacctgcgactgtggcgctgggtccacggggggagtgacaggtggcttcatccccgtccctgatggaagcgagggcacaattcaccagtgggggatagaaggcgctcaccctgaagataaggagatcacgaacatctgcgtgcccccagtgaccgcaaacggagcggacttcatggagagcagcgaagtctgcaccaacacttacgccagaggcaccgctgtggaaggcacatcaggcatggaaatgacgacaaaattaggagccgctaccgagagcggaggggcagcaggattcgccaccggaaccgttagtggcgctgctagtggattcggggcagctacaggcgttggcatttgtagtagtggacagtcaggcaccatgcgtactagacactccactgggggtactaataaagactatgctgacggagctatctccatgaattttctggattcctacttcagccagaaggcctttgcctgtgccgaggaggacgacgggcaggaagccaacgactgcctgctaatatatgacaacgagggggctgacgctaccgggagccccgtgggatccgtgggctgttgctcttttatcgccgatgacctggatgactcctttttggacagcctgggacctaagtttaaaaagcttgcagaaattagtctcggcgtggacggagaaggaaaggaggtgcagcccccatcgaaggattccggatacggtatagagtcgtgcggacacccaattgaggtccagcaaaccggctttgtaaagtgtcaaacactgagtggatcacagggcgcttccgctctctcgacctccggaagtgtgcaaccggctgtctctatccccgatccactgcaacatgggaattatctggtgacagagacatactcagcgtctggctccctggtgcaaccttctaccgccggttttgaccctcttctgacgcagaacgtgattgtgaccgagcgggtgatctgtcccatctcaagcgtcccaggtaatcttgcagggcctacacagctccgaggttctcacaccatgctctgtaccgaggatccctgtagtcggctgatctag

SEQ ID NO: 28357 - DNA, 8615 bp, Artificial Sequence
  Description of Artificial Sequence: Synthetic coding sequence
atgtcatgcaatggagggtcccaccccaggatcaatactttgggccgtatgatccgggcagagtcaggccctgatttgcgatatgaggtgacttcaggcggagggggaacttccagaatgtattacagcaggcggggtgtaataaccgatcagaattctgacggatattgtcaaactgggaccatgagcaggcaccagaatcagaacactatccaggaactcctgcagaattgttcagactgcctaatgcgcgcagaactgatagttcagcccgaactgaaatatggagatggcattcagttaacacgcagtcgagagctggacgagtgttttgcacaggcaaacgatcagatggagattctggacagtctgatacgcgagatgaggcaaatggggcagccgtgcgacgcgtaccagaagcggttactccagctgcaggaacaaatgcgcgctctgtacaaggcgatttctgtgccacgggtgagacgggcttcttccaagggtgggggaggttatacatgtcagtcaggatccggttgggacgagttcacaaagcatgttacttctgaatgcttggggtggatgagacagcaaagagcagagatggacatggtggcctggggtgtcgatttggcttccgtggagcaacatattaactcccaccggggaatacataattcgatcggcgattacagatggcagttagataaaatcaaggcggacctaagagaaaaaagtgccatctaccagctcgaagaggaatatgagaatctgctgaaggccagctttgagaggatggatcacctgagacaactgcagaacataattcaggccacctcccgggagataatgtggatcaacgactgcgaggaggaagagctgctttatgattggtctgacaagaatacaaatattgcgcaaaagcaggaagctttcagcatccgtatgtctcagctcgaagttaaggaaaaggagctgaacaagttgaaacaggagagcgaccagcttgtacttaatcagcatcccgctagtgacaaaattgaagcatatatggataccttgcagacccaatggtcatggattctccagatcaccaaatgcatagacgtccacctaaaggagaacgccgcttattttcagttcttcgaggaggcacaatccaccgaggcctatctgaaaggcctgcaggatagcataagaaaaaaatacccatgcgataagaatatgcctctgcaacatctgctggagcagattaaggagctggagaaagaaagagagaagatcctggaatacaagcgccaggtccaaaatctcgtcaataaaagcaaaaagatcgtacagctgaagccaaggaatcctgactatcggagcaataaacccatcatactgagggccctgtgtgattataagcaggaccagaagatcgtgcacaaaggagacgagtgtattctcaaagataataacgagcggtcaaaatggtacgtcaccggtccaggcggagtcgacatgcttgtcccatcggtgggcttgatcatccctcccccaaacccgctggccgttgacttgtcctgtaagatcgagcagtactacgaagccattctagccttgtggaaccagctctatattaacatgaaatccttagtctcctggcactattgtatgattgatattgaaaaaattagagcaatgaccattgccaagctcaagaccatgcggcaggaggactatatgaagacaattgctgatctcgagcttcattaccaagagtttattagaaactcacaaggttcggaaatgtttggggatgacgacaaaaggaagatccagtcacagttcactgacgctcagaagcactatcagaccctggtcatacagctcccaggttacccacaacaccaaaccgtaacaaccactgagataacccaccatggtacctgtcaggatgttaaccataataaagtgatcgaaaccaaccgcgaaaacgacaaacaggaaacctggatgctgatggaacttcagaaaatccgacgacagattgaacactgtgaagggaggatgacactgaaaaatctgccccttgctgaccaaggcagcagtcatcatattacggtgaaaatcaacgagctgaaatccgtacagaacgactcgcaggccatcgcagaggtgttaaatcagttaaaagacatgctggccaattttaggggcagtgaaaagtactgttatctgcagaatgaagtgttcggactttttcaaaaactggagaatataaatggagttaccgatgggtatctgaacagcctgtgtacagtccgtgctctgcttcaagctatattgcagacggaagacatgctgaaggtgtatgaagcccgtctgaccgaggaagagacagtatgcctggatctcgacaaagtggaggcttaccgctgtggcctgaagaaaattaagaatgacctaaacctcaagaagtctcttcttgcaacgatgaaaactgaactccaaaaagctcagcagatccactcacagacgagtcagcagtaccctctgtatgaccttgacttaggcaagttcggcgagaaggtgacgcagctgacggaccgctggcagcgtatcgacaagcagatcgacttccgcctgtgggacctcgaaaaacagattaagcagctcaggaactaccgagacaactaccaggccttttgtaaatggctctatgacgccaagagacgccaagattcactggaatccatgaagttcggtgactccaacactgtgatgcgattccttaacgagcaaaaaaatctgcatagcgagatttcaggtaagagagacaagagcgaggaagtccaaaaaattgctgagctgtgcgccaacagcattaaggactacgaattacaactggcttcctacacctctggtctcgaaaccttgctgaatatccctataaagcgaactatgattcagagtcctagtggtgtcatcctccaggaggcagccgatgtgcatgctaggtatatagagctcctcacccgcagcggcgactactataggttcctttctgagatgttaaaaagcctggaagatttgaagttaaagaacacgaagattgaggtattagaagaagagctgagactggctcgtgacgctaatagtgaaaattgtaacaagaacaaatttcttgatcagaacttacagaagtaccaggctgagtgcagccagttcaaagctaagctggcatctctcgaggagttgaagagacaggccgaattggatgggaagtcggccaagcaaaaccttgacaagtgttacggacagattaaggaactcaacgaaaagattacacgcttgacatacgagattgaagatgaaaaaaggcgtaggaaatcagtcgaggaccggttcgatcagcagaaaaacgattacgaccaactccagaaagccaggcaatgtgaaaaggagaacctcggatggcaaaaactcgaatcagagaaggctattaaagagaaggagtacgaaatcgagcggctccgcgtgttgttgcaggaagaggggacccgtaagcgagaatatgagaacgagctggctaaggtgcgaaaccattacaatgaagagatgagtaacctgaggaacaaatatgaaaccgaaattaacattaccaagaccacaattaaagagatctcaatgcagaaggaagacgatagtaagaacctgagaaaccaactcgataggctctcgagagaaaacagggacctcaaggacgagattgtgaggttgaatgactccatcctgcaggctacagaacagcgcagaagagccgaagagaacgctcttcagcaaaaggcctgtggcagcgaaattatgcagaaaaagcagcacctggaaattgagttgaaacaggtcatgcagcaacggagcgaagacaatgctcgtcacaaacagagcttggaggaagccgctaaaacaattcaggataagaacaaggagattgagagacttaaggcggaatttcaagaggaggctaagaggaggtgggagtacgagaacgagctgtccaaggtgagaaataattacgatgaagaaataattagtcttaaaaatcaattcgagactgagatcaatatcactaagaccaccatacatcagttaactatgcagaaggaggaggacaccagtggatacagagcccagattgataatctgacaagggagaacagatccctgagtgaagaaatcaaaagactcaagaacacactgacccagaccactgagaacctccgcagagtggaggaagacatccagcagcagaaggccacaggctccgaggtgagccagcgaaaacagcagctggaggttgaattacgtcaagttacccagatgcgaaccgaggaaagcgtgagatacaagcagagtctggacgacgctgccaaaacgattcaggacaaaaataaggagattgaacgcctaaagcagctgattgacaaggagacgaatgatagaaagtgtctcgaagacgagaacgccaggctgcagagggtgcagtatgaccttcagaaagcgaactcttctgccaccgaaacaatcaacaaacttaaagtccaggagcaagaactgacccgacttaggattgactatgaaagagtgtctcaggagcgtacggtgaaggaccaggatattacaaggttccagaacagtctgaaggagctgcagcttcaaaaacagaaagtggaggaagaactgaacagattaaaacgcaccgcatccgaagactcttgcaaaaggaagaaacttgaggaagaactggaagggatgcggaggtccttaaaggagcaggcaatcaagataaccaatttgactcagcagctcgagcaggcatcgatagtcaaaaagcgcagcgaagacgatctgcgccagcagcgcgatgtgctggacgggcacttgcgggaaaagcagcggactcaagaagaactgaggaggttatcaagcgaggtggaggccttacggcgtcagctccttcaggagcaggaatcagtgaagcaggcccatctgcgcaatgagcacttccaaaaggctatagaggacaagtcaagaagtctgaatgagagtaagatcgagatcgaaaggctccagagtctgactgagaacctcacaaaggagcacttaatgctcgaggaggaacttcggaatctgcgcttggaatacgacgacctccggagaggccgatccgaagccgatagcgataagaatgccacgatactggagctgaggagccagcttcagatctctaataaccgcactcttgagctgcagggcctgatcaatgatctccagagggaaagagaaaacctcagacaagaaatcgagaagtttcagaagcaggcgcttgaggccagcaaccgcattcaggaatcaaagaatcagtgtacgcaggtcgtgcaggaaagagaatctctgctggtcaagataaaggtgttggagcaggacaaagccaggctgcaacggctggaagacgaactaaacagggctaaaagtactcttgaggcagagactcgggtgaaacaaagacttgaatgcgaaaaacagcagattcagaacgacttgaatcagtggaagacgcaatactcccggaaagaggaggccatccggaaaatcgagagcgagagagagaagtcagaacgggagaaaaactctctgagatctgagatcgagaggctgcaggccgaaatcaaacgcatagaggaacgttgccgacgcaaacttgaagattccaccagggaaactcagagccagttagaaactgaaagaagtagatatcagcgggagattgataagttgcggcagcgcccatatgggagtcacagggaaacccagaccgagtgtgagtggacagtggacacctctaaactcgtcttcgacggcctgcgcaaaaaagtgactgctatgcaactctatgaatgccaactgattgacaagactactctcgataagctactaaaaggtaagaagtcggtagaggaggtggcctctgaaatacagccatttctcagaggggctggctcaatcgccggtgcctcggctagccccaaggagaaatactcactcgtggaagctaaaagaaagaagctgatcagtcccgagagtacggtgatgctgctggaagctcaagcggcaaccggcggaattatcgaccctcaccgcaacgagaagttgactgtcgactctgctatcgcgagggacttgatcgattttgacgataggcagcagatatacgcagcagagaaggctataacaggatttgatgatcccttcagcggtaaaactgtaagcgtgagcgaagcaatcaaaaagaatctgattgacagagagaccgggatgaggcttttggaggctcagatagcatcgggaggagtggtggatccggtgaatagcgtgttcttacccaaagatgtggctctagctagggggctgatcgaccgggatctgtacaggtccctgaatgacccaagggactcccagaaaaatttcgtggatcctgtaacaaaaaagaaggtgagttatgtgcagttaaaggaaaggtgtaggattgaacctcacaccggtttgttgttgctgagcgttcagaaaaggagcatgtctttccaagggatacggcagccagtcaccgtcaccgagctggtggatagcggcatcctgcgaccttccactgttaatgaactcgagtccggacagatctcttacgacgaagtgggagagaggatcaaagactttctccaaggctcctcatgcatcgcaggtatctataatgaaactacgaaacaaaagctggggatctacgaggctatgaagattggcctggtacggccaggcactgccttggaactgctagaagctcaggcagccacaggtttcattgtagacccagtgtctaacttgcgccttcctgtcgaagaagcatacaaaaggggcctcgttgggatcgaattcaaggaaaaattgctctctgcagaacgagctgtcactggttacaatgatcctgaaaccgggaacataataagtctgttccaggcaatgaataaggagctcatcgagaaaggccacggaatcagattactggaagcccagatcgccaccgggggaattatcgacccaaaggagtcccacaggctccctgtagacattgcttacaaacggggttatttcaatgaggaactgtctgaaattctatcagatccctccgacgacactaaggggtttttcgatccgaacaccgaagagaacctcacatatctccagctaaaggagcgttgcataaaggacgaagagactgggttgtgtcttctgccattgaaagaaaaaaagaagcaggtacagactagccagaagaatacactcaggaagagacgggtcgtgatcgtcgaccccgagactaacaaggagatgtcggtccaggaggcttataagaaaggcttgatcgactacgagacgttcaaggaactgtgtgagcaggagtgcgaatgggaggaaatcactataacaggcagtgacggctcaacccgggtggtcttagttgaccgaaagacgggttcccaatacgacatccaggatgcaattgataagggcctggttgaccggaagttcttcgatcagtatcgttctggcagcctgtccctcacccaattcgcagacatgatcagtctgaagaatggcgtgggcacttcttcctcgatgggtagtggcgtgagtgatgacgtcttttcctcaagccgtcacgagtccgtatccaaaatctcaacgatatcatccgtgaggaatctaaccattagatctagttcattctcagacacacttgaagaaagctcccccattgccgctattttcgacaccgagaacctggagaaaatctccattactgagggaatcgaacggggaatcgtcgactccatcactggccagcgcttgttggaggcacaagcttgtactggagggataattcaccccactaccggacaaaaactgtcgcttcaggatgctgtctcccagggcgtaatcgatcaggatatggccactcggttgaagcccgcacagaaggcctttattgggtttgagggagttaagggtaagaaaaagatgtcagcagccgaagccgtgaaggaaaaatggctcccatacgaggccggtcagaggttcctggagttccagtatctcactggaggcctggtggaccccgaggtgcatggcaggattagcaccgaggaagccatccgcaagggattcatagatggacgagccgctcaaaggctgcaagacacatcctcttacgctaagatccttacctgcccgaagaccaagcttaagatctcctataaggatgccatcaaccggtctatggtggaggacataacaggcctgaggctgttggaagccgcatcagtctcatcaaagggactccccagcccttataatatgtccagtgcgcctggtagtcgaagcggttctagatccggctctagatccggttctaggagcggttcaagatctggatctaggaggggaagctttgatgctactggaaattctagttacagttactcatacagcttcagttccagcagcatcggacatta

SEQ ID NO: 28358 - DNA, 2862 bp, Artificial Sequence
  Description of Artificial Sequence: Synthetic coding sequence
cagcaacagcgcgctgagatggacatggtagcctggggggtcgatttggcaagcgtggaacagcatattaacagtcacaggggaattcacaatagcattggggactatcggtggcagcttgataagattaaggccgatcttagagaaaaaagcgcgatttaccaactggaggaggagtacgaaaatctactgaaagcctcttttgagcgtatggatcatctgcgccagttacaaaatatcatacaggcgactagtagggagatcatgtggattaacgattgtgaagaggaagagctgctatatgactggagtgacaaaaacacgaacattgcccagaaacaggaggcattctccattagaatgtcacagcttgaagtgaaggagaaagaactcaacaaactcaagcaggagtctgaccaactcgtgctgaaccagcatcccgcttcagataagattgaagcatatatggataccctgcagacgcagtggagctggatcttgcagatcaccaagtgtatcgacgtacatctgaaggagaacgctgcttacttccagtttttcgaagaggcgcagagcactgaggcctatctgaaagggctgcaggactccatccgtaagaagtacccttgtgataagaacatgccgctacaacatttactcgagcaaatcaaagaattggagaaggagagagaaaagattttagaatacaagcgacaggtccagaacttggttaacaaatcaaagaaaattgtacagctgaaacctcgcaaccctgactaccggtcaaacaagccaatcatcctgagggccctctgcgactataagcaggatcagaagatcgttcacaaaggtgatgaatgcattctcaaagacaataacgagcgctctaagtggtatgtgacgggaccaggaggagttgacatgctcgtgcccagcgtgggtctcatcatacctccacccaaccctctggctgtggatctctcctgcaaaatcgagcaatactatgaagctattctggcactgtggaaccagttatacatcaatatgaagtccctggtttcatggcattattgtatgatcgatatcgaaaaaatccgggcaatgacaattgccaaactgaaaacaatgaggcaggaggactatatgaaaacaatagccgatctagaactgcattatcaggaattcattcgtaatagccaaggtagcgagatgtttggggatgacgacaagaggaagattcagtcacagttcacggacgcccaaaagcactatcagacacttgtgattcagcttcccggttatccacagcatcagaccgtcaccacaactgagattacacaccacggaacttgtcaagatgttaatcacaacaaggtcattgagacaaaccgggagaatgacaagcaggagacctggatgttaatggagctgcagaagatccggagacagattgaacactgtgaaggcagaatgaccctcaaaaatcttcccctcgccgatcagggtagctcccaccacataaccgtgaagataaatgagctgaagtccgtccaaaacgactcacaagccatcgcggaggttctgaaccagctgaaagatatgctggccaatttcaggggcagtgagaagtactgctacttgcagaacgaggtcttcggcctttttcagaagctggaaaacatcaatggggtcaccgacggatacctgaactcgttgtgtaccgttcgcgctttacttcaggctattctgcagaccgaggacatgctcaaagtctatgaggccaggctcaccgaggaggagactgtctgcctggacctggacaaagtggaggcgtacaggtgcgggctgaagaagattaagaacgatctcaatttgaaaaagtctcttcttgccaccatgaagacggaactgcagaaggcacagcagatccattctcagacaagtcaacagtaccctttgtacgacctagacctgggtaagtttggagagaaggtgactcagctgacagataggtggcagcggatcgacaagcagattgatttcaggctgtgggaccttgagaagcagataaagcagcttcgtaattaccgcgataactaccaagctttttgtaagtggttgtatgatgctaagaggcggcaggacagtctagaaagcatgaaatttggcgactccaacacagttatgcgcttcctgaatgaacagaaaaatctgcacagcgagatcagtgggaagcgggataaatccgaagaagtgcagaaaatcgccgagctctgcgccaactctattaaggattatgagctccagctggcctcttacacgagtggactagaaacattgcttaatattcccattaagcgcacgatgattcagagcccaagcggggttattctgcaggaggcggctgatgtacatgcccgttacattgaactgctcacaagaagtggggattattaccgcttcctgtccgagatgttgaaaagcttagaagatcttaagttgaagaatacaaagatcgaagtgctcgaggaggagctgcgcctggctagggacgcaaattcggaaaactgcaacaagaacaagtttctggatcagaacttgcaaaagtatcaggcagaatgctctcaattcaaagctaagcttgcgtctctggaagaattgaagcgtcaagcggaactcgatggtaagtcagcgaagcagaacttggataagtgctatgggcagattaaggagctcaatgagaaaatcacgcgtctgacatacgaaatcgaggatgaaaagcgacggaggaagtcagtggaggatcggttcgatcaacagaagaacgactatgaccagctgcaaaaagctcggcagtgttag

SEQ ID NO: 28359 - DNA, 6818 bp, Artificial Sequence
  Description of Artificial Sequence: Synthetic coding sequence
atgagctgcaatgggggtagtcacccaaggattaacacactgggcaggatgattcgggctgaatcaggacctgacctgagatatgaagtgacatccgggggaggcggaacctcgagaatgtactattccaggcggggtgtgattactgaccagaacagcgacgggtactgccaaaccggtaccatgtctagacaccaaaaccaaaataccattcaggagctgctgcagaattgctcagactgccttatgcgcgctgaactcattgtccaaccggagcttaaatacggtgatggaatccaactgactagaagcagggaactggatgaatgttttgctcaagccaacgatcagatggagattctggacagcttgatccgggagatgcggcagatggggcaaccttgcgatgcttaccaaaagaggttactgcagcttcaggaacagatgcgggcactctacaaggcgatcagcgtgccacgagttaggcgagcctcctcaaagggtgggggaggatacacctgccagagcggcagcggttgggatgaattcacaaaacacgtcacatcagagtgtctcgggtggatgcgtcagcagcgcgctgaaatggatatggtcgcgtggggcgtggacctggcaagtgtcgagcagcacatcaactcacaccggggtattcataactccataggagactacagatggcagctcgataaaatcaaggccgatctgcgcgagaagagtgccatttaccagctcgaggaggagtacgagaatttactcaaggcttcgtttgaaaggatggaccatctgaggcagctccaaaacataatccaagctacgtcccgcgagattatgtggattaacgactgcgaagaggaagagctgctgtatgactggtcagataagaataccaatattgcccagaagcaagaggcattcagcatccgaatgtcccagctcgaggtgaaagaaaaggagctgaacaagcttaagcaggaaagcgatcagctcgtgctaaaccagcatcccgcatcggataaaatagaagcatatatggacaccctgcagactcagtggtcgtggatactgcagattaccaagtgtatcgatgttcaccttaaggagaacgcagcatacttccaatttttcgaagaggctcaaagtacagaggcttatttgaaaggacttcaagactcgatacgaaagaagtacccttgcgacaaaaatatgcccctgcagcacttgcttgagcaaattaaggagctggaaaaagagagggagaaaattctcgaatataagcgccaagtgcaaaatttagtgaataaatccaagaaaattgtacagctgaagccaagaaatcccgattaccgctcaaacaaacctattatactacgcgctttgtgcgattacaagcaagaccagaagatcgtgcataagggagacgagtgcatactcaaggacaacaacgaaaggtcaaaatggtatgttacaggccctgggggtgtggacatgctcgtgcctagcgtgggcctgatcatcccccctccgaaccccctggccgtcgacctctcttgtaagatcgagcagtattatgaggccatcttggctctgtggaaccagctgtacattaacatgaagagcttagtttcttggcactactgcatgatagatattgagaaaatccgagctatgacaatcgcgaagctgaagaccatgcggcaggaagactacatgaagaccattgctgatctcgaattgcattaccaagagtttattagaaattcccagggaagcgagatgtttggagacgatgataagcgcaagattcagagtcagttcaccgatgcacagaagcactatcagacactggtgatacagttgccaggctacccccagcaccagaccgttacaactactgaaattacccaccatggaacctgccaggatgtcaatcataataaggtgatcgagaccaaccgcgagaacgacaaacaggagacctggatgctgatggagctgcaaaaaatccgtcggcaaatcgagcattgtgaggggaggatgacgctgaagaacctccctctggccgatcaagggtccagccaccatattactgtcaaaattaacgagctcaaatctgtgcagaatgactctcaggctatcgcggaggttttgaaccagctgaaagatatgcttgcgaattttagagggtctgaaaagtactgctatctgcagaacgaggtatttggcctttttcagaagctggagaacataaacggagtcacggatggctacctgaacagcttgtgcactgtcagggcgcttttgcaggccatcctgcagacggaagacatgttaaaggtctatgaggcgagacttaccgaggaggagacagtttgtctggatctggataaggtggaagcctatagatgcggcctgaagaaaataaagaacgacctaaatctcaagaaatcactcttagccaccatgaagaccgagctgcagaaagctcaacagatccatagccaaactagccaacagtatccactgtatgacctggatctgggtaagtttggcgaaaaggtaacccagttaaccgacaggtggcaacgcatcgataagcagatcgactttcgactgtgggacctcgaaaaacagatcaaacagctgcggaactacagagataactaccaggctttttgtaagtggctttatgacgctaagagacggcaggattctctcgaaagtatgaagttcggagatagcaacaccgtgatgaggttcttaaatgagcaaaagaacctccactctgagatttccggcaagcgcgacaagtctgaagaggtgcagaagatcgccgaactctgtgctaatagcattaaggattatgagctgcagctggcttcttacacgtccggcctggagaccctgctaaatatccccattaagaggactatgatacaaagccccagtggagtcatccttcaggaggccgcagacgtccatgccagatatattgagctactcactaggtcaggagactactacaggtttctaagtgagatgcttaagtctctagaggatctgaagctgaaaaacacaaaaatcgaggtgctggaggaagagctccggctggccagagatgcgaatagcgagaattgcaataagaacaaattcctggaccaaaacctccaaaaatatcaagccgagtgtagtcagtttaaagctaagctggcgtctctagaggaattaaagcgccaagctgaactggatggaaagtccgctaagcagaatctggacaaatgttacggacagatcaaagagctgaatgaaaagatcacccgtcttacgtacgaaattgaagacgagaaacgtcggaggaagagcgtggaggacagattcgatcagcagaagaacgattacgaccagctgcagaaggcccgacagtgcgagaaggaaaatctgggctggcagaagctagagtctgaaaaagctataaaggagaaggagtacgagatcgagcggctccgggtactgttgcaggaggaaggtacacggaagagagaatatgaaaatgagctggccaaagccagcaatcgtatccaggaatctaagaatcaatgcacccaggtcgttcaggaacgggagagccttctggtaaaaattaaggtgctggagcaagataaggcacggctgcagagactggaggacgaactgaacagagcaaagtccacgttggaggccgagacacgcgtcaagcagcgcttagagtgtgagaagcagcagattcaaaatgatctgaaccaatggaagacacaatatagcaggaaggaggaagctattcggaagattgaatctgaacgcgaaaagagtgagcgagagaagaattcattgagaagtgagatcgagaggttgcaagccgaaatcaaaagaatagaagaacgttgccgcaggaagttggaagacagcacccgcgagacccagtcccaactggaaaccgaaaggagtaggtaccagagagagatcgacaagttaagacagcgtccttacggatctcaccgagaaacccagaccgagtgcgagtggacagttgatacaagtaaacttgtgtttgatggcctgagaaaaaaagtgacagctatgcaactttacgagtgtcagctcatagataaaactaccctggataagcttctcaaagggaagaagtctgtcgaagaggtggcctctgagattcagccatttctgcgcggagctggttccatcgccggagcatctgcgtcaccgaaggagaagtacagtttagtagaagccaaaagaaagaaacttatctcccctgaatccaccgttatgctcctggaagctcaggctgccacgggtggcatcatagatccgcaccgaaatgagaagctgactgttgatagcgccatcgctagggatctgatcgacttcgacgatcgccagcagatctacgctgcagaaaaggcgatcacgggcttcgatgacccattcagcggaaagacagtgtctgtgtccgaggccataaagaaaaacctcatcgatcgcgagactggaatgagattactggaggctcagattgcatctggaggtgttgttgatcccgtgaactccgtctttctccctaaggacgtcgctttagctagaggtctcatcgatcgcgatctgtaccgaagcctgaacgatcctagagactcgcagaagaactttgtagaccccgtgacaaaaaaaaaggtgtcatatgtgcagttgaaggaaaggtgccggatcgagccccacaccggactgttgctgctgagcgtgcagaagaggagcatgtccttccagggtatccggcagcccgtcactgtgacagagcttgtcgacagcggcattctgagaccatccaccgtaaatgagctggaatcggggcagatctcatacgatgaggtgggggagcgcatcaaggactttctccaggggagttcgtgcatcgctggaatctacaacgagacgacaaaacagaagttgggaatatatgaagcgatgaagatcgggctcgtcagacccggtaccgctctggaactgctggaggcccaggccgcaaccggttttattgtcgatccggtatctaatttaagattgccagttgaagaagcctataaaagggggctcgtgggcattgaatttaaggagaagctccttagcgctgaaagggcagtgactgggtacaacgaccccgaaactgggaatatcatctctctctttcaggctatgaataaagagctcatagagaagggtcacggcatcagactcctggaggcgcaaatcgccacaggcggtatcatcgaccctaaagaaagccacaggctcccggtagacatagcctacaaaagaggctatttcaatgaggagctgtccgagattctcagcgacccctcagacgacacgaaggggttcttcgaccccaacaccgaggaaaacctgacttatctacagctcaaagaacgttgcattaaggacgaagaaacaggcctctgcttgctgcctcttaaagagaaaaagaagcaagtgcagacttctcagaagaatacacttcggaaaagaagagttgtgattgtcgaccctgagacaaacaaagaaatgtccgtgcaggaagcctataaaaagggactgatagattacgaaactttcaaagagctttgtgagcaggaatgtgagtgggaggagatcacaatcaccggttccgacggcagtacacgggtggtactggtcgataggaagacggggtcccaatatgatattcaggatgccatcgacaaaggactggtggatcgcaagttcttcgaccagtaccggagtggaagtttatctctcactcagtttgccgacatgataagtttgaagaacggcgtggggacctcttcatctatggggtccggagtgagtgacgacgtattttcctcatcaagacacgagtctgtttctaagatttcaactatctcgagcgtgagaaatctgaccatcaggtcctcctctttttcagacacgctagaggagagttctccgattgccgcaatttttgacacagagaatcttgaaaaaatctctatcaccgagggcatagaacgcggaattgtcgattccatcaccggtcaaagactgctcgaggcccaggcctgtacgggcggtatcatccaccccaccactggacagaagctgagcctccaggatgcggtgtcacagggtgtcatcgaccaggacatggctacccgactgaaacccgctcagaaagccttcatcggatttgaaggcgtgaaggggaaaaaaaagatgtcagccgctgaggccgttaaggagaagtggctgccatacgaggccggacagagatttctggaattccaatatctgaccggagggctggtggacccggaggtgcatgggaggattagcacagaggaagctatccgcaagggcttcattgacggcagagcagctcagcggctacaggacaccagctcctacgcaaagattttgacgtgtcctaaaaccaagctcaaaatctcatataaagatgccattaatcgcagcatggttgaagatatcaccggactcaggttgcttgaggcagctagcgtgtcatcgaaaggtctgcctagtccgtataacatgtctagcgctcccggaagtcgatcagggagtaggagcggatcaaggagcggaagcaggtccgggagccggtctggaagtcggaggggcagcttcgacgctaccggaaattcctcatattcttacagctacagcttttctagtagcagcattgggcatta

SEQ ID NO: 28360 - DNA, 507 bp, Artificial Sequence
  Description of Artificial Sequence: Synthetic coding sequence
atggagcctccgaacctgtaccctgtgaaactctatgtctacgatctctccaagggcctcgcccgacgtctctcgcctattatgcttggcaagcagttggaggggatatggcacacgtcaatcgtggttcacaaagacgagttcttcttcggttcaggcggaattagtagttgcccccctggaggaactcttctgggccctcctgacagcgtggtagacgtgggaagcacagaagtgaccgaagagattttcctggagtatttgagctcactaggggagagtctgtttcggggtgaagcttacaatctttttgaacataactgcaataccttctctaacgaagttgcgcaattcctcacaggacgaaagatccctagttacataaccgatctgccttctgaagtcctctccacccccttcgggcaggcgctgaggcctcttttagactcaattcagatccaaccacctggcggttctagtgtcggcagaccgaacgggcagtcctag

SEQ ID NO: 28361 - DNA, 561 bp, Artificial Sequence
  Description of Artificial Sequence: Synthetic coding sequence
atgaaatccgatttttactttcaaaagtccgagccacactcactgtcctcagaagcactcatgcgaagagccgtgagcctggtcaccgattcgacttcgacgtttttgtctcagactacctatgctctgatcgaggccataacagagtacacaaaagccgtgtacaccttaacaagtctgtatcgtcagtacacatcactgctcggtaaaatgaattcagaggaggaggacgaagtctggcaggtcataatcggcgcacgagccgagatgaccagtaagcaccaggagtatctgaaactggaaacgacatggatgacagccgtgggtctttctgaaatggccgcagaggcagcctaccagaccggtgcggatcaggcctcaatcactgcccgaaaccacatccagcttgtgaagttgcaagtggaggaagtacaccagctgtcccgcaaggcggagaccaaactcgccgaggcacagattgaagaactcaggcagaaaacacaggaggagggggaggaacgtgcagaaagtgagcaggaggcctacctgcgagaagattag

SEQ ID NO: 28362 - DNA, 588 bp, Artificial Sequence
  Description of Artificial Sequence: Synthetic coding sequence
atggccgcactcaaaagctggctgagtaggtctgtgacgtcattctttaggtacagacagtgtctgtgtgtgccggtggtggcaaattttaaaaagaggtgcttctccgagttaatccggccttggcataaaactgtgacaatcggattcggtgttacattatgtgctgtcccgattgcgcaggccgtctacactctcacttctctttacaggcagtatacttccctcctgggaaagatgaattcagaggaggaagatgaagtgtggcaagtcattattggggctagggcagagatgactagtaagcaccaagagtacctcaaactggagaccacatggatgacagctgtgggcttaagtgagatggccgctgaggccgcataccagaccggagctgatcaggcttccatcactgctagaaaccatatccagctggtcaaactccaagttgaagaggttcaccagctctccagaaaggccgagactaagctagcagaagcgcagattgaggagcttagacagaaaacccaggaggaaggggaagaaagggccgagtctgagcaagaggcttatcttcgcgaggactag

SEQ ID NO: 28363 - DNA, 588 bp, Artificial Sequence
  Description of Artificial Sequence: Synthetic coding sequence
atggctgccctaaagtcctggctgtctagatctgtaacaagcttctttcgctatagacagtgcctttgtgtgcccgtggtggccaacttcaaaaagcgctgcttctccgagcttattaggccctggcacaagaccgttactattggcttcggagtgactttatgcgccgtccctattgcacaggcagtttacacgttgaccagcctgtatcggcagtacacaagccttctgggaaaaatgaatagcgaagaggaggatgaagtctggcaggtgatcattggtgcaagggcagagatgacaagtaaacaccaggagtacttgaagctcgagaccacatggatgactgccgtgggcttgagtgaaatggccgcagaagccgcatatcagaccggggcagatcaggcgagcatcaccgcccgaaaccacatccagcttgttaagctacaggtcgaggaggttcatcaactgagccgtaaagcagaaacaaagctcgcagaagctcagattgaggaactgcggcaaaaaacccaagaagagggcgaggagcgggcagaatctgagcaggaagcttatctgcgggaagactag

SEQ ID NO: 28364 - DNA, 720 bp, Artificial Sequence
  Description of Artificial Sequence: Synthetic coding sequence
atggccgcacttaaaagttggctttctaggtcagtcacgagtttttttagatacaggcagtgcttgtgcgtgcctgttgtggcaaattttaaaaagcgctgttttagtgagctgattaggccctggcataaaaccgtaacaatcgggttcggggtgactctctgcgcagttccaatagcccagaagagcgagcctcattcgctgtcatctgaggctctgatgcgacgggctgtgtctctggtcactgactccaccagtaccttcctgtcccagactacatatgcactgatagaagctattacagagtataccaaggcagtgtacaccctgacgtctctgtatcggcagtacacatcactgctaggcaaaatgaacagtgaggaagaagacgaggtgtggcaggtgattattggtgcccgtgcggaaatgacatctaagcatcaggaatacctgaaattggagaccacatggatgacagctgtgggtctcagcgaaatggcagccgaggcggcttaccaaactggtgcagatcaagcaagtatcacagcaagaaatcacatccagctggtcaagttgcaggtagaagaagtgcaccagctctctcggaaagcagagaccaagctggcggaggcacagattgaagagctcagacaaaagactcaggaagaaggagaagaacgagcggagtctgaacaagaagcatacctacgcgaagactag

SEQ ID NO: 28365 - DNA, 561 bp, Artificial Sequence
  Description of Artificial Sequence: Synthetic coding sequence
atgaagtccgacttctactttcagaaatcagaaccccactccctcagctcagaggctctgatgagacgggctgtaagcttggtcactgattcaactagcacgtttttatcccaaacaacttacgcattgatcgaagccataaccgaatacactaaggcagtgtacacactgacttcactgtatagacagtacaccagccttttaggcaagatgaattctgaagaggaagacgaagtgtggcaggtgatcatcggagcccgagctgagatgacatcgaagcaccaggagtatttgaaattggagactacttggatgaccgcggtgggcctgtctgagatggccgctgaggcagcttaccaaacaggtgcagaccaggcttctataacggctcggaaccacatccagttggtgaaactgcaggtggaggaagtccatcagctgtctcgtaaggcagagacgaaacttgccgaagcccaaattgaagaactgaggcaaaagacccaagaggagggtgaggagcgggcagaatcggaacaggaagcatatcttagagaggattag

SEQ ID NO: 28366 - DNA, 3822 bp, Artificial Sequence
  Description of Artificial Sequence: Synthetic coding sequence
atggagccacctgggggatcattaggaccagggaggggcactcgagataagaagaaaggcagatctccagatgagctcccatcagcagggggagacggaggcaaaagtaaaaaattcaccttgaagcgactgatggccgacgagctggaaaggttcacctcaatgcggataaagaaagaaaaggagaagcccaactccgctcaccgcaacagttctgcgagctatggggacgatccgactgcccaatcattgcaggatgtttccgatgagcaggtcctggtgctgttcgaacagatgctcctagacatgaacctaaacgaagaaaagcaacagccgctgcgggagaaggatattataatcaaaagagagatggtgtcccaatacttatacacgtcaaaggccggaatgtcacagaaagagagcagcaagagcgcgatgatgtatatccaggaactgcgcagcggactgcgcgacatgcccctgttatcttgcttggagtctttgcgagtgagtctgaataataaccccgtcagctgggttcagacctttggggcagaagggctagcatctctcctagacatcttaaagcgcctgcatgacgagaaagaggaaaccgcaggctcttatgattctcgaaacaagcacgaaatcatccggtgcctgaaagccttcatgaataacaagttcgggattaagactatgctggaaacagaggagggcattctgctgttagtaagggccatggatcctgccgtaccaaacatgatgattgacgccgcaaaactgctttccgccctatgtattctaccgcaacccgaggacatgaatgagcgcgttctggaagctatgacggaacgcgctgaaatggacgaagtggagcgattccagcccctgctggatgggcttaaatcaggaaccaccatagcactgaaggtgggctgcttgcagttgattaacgccctgataacgcccgctgaggagctggatttcagggtccatatccgctctgagttgatgcgcttggggctgcaccaggtcctgcaggacctgagggagattgaaaacgaagacatgagagtacaattgaatgtgttcgatgaacaaggggaggaagacagctacgacctgaagggtagacttgatgacatccgcatggagatggacgacttcaacgaggtgtttcaaatcctgctcaacaccgtcaaggattctaaggctgagccacacttcctatcgattctgcagcacctcctgcttgtacgaaacgattatgaggccaggccacagtactataagctgattgaggaatgtatttctcagattgttttgcacaagaacggggctgatccggattttaaatgccggcacctccaaatcgagatcgaaggactgatcgaccagatgatcgataagaccaaagtcgagaagagcgaggctaaggccgcagaattagaaaaaaaactcgatagtgaactgacagcaaggcatgagttgcaggtagagatgaaaaaaatggagagcgactttgagcagaaactgcaggatctgcagggagagaaagacgctctccattctgaaaaacagcagatcgctacggagaagcaggacctggaagctgaagtgtctcaactgaccggagaggtggccaagcttacaaaggagctggaggacgcaaagaaggagatggccagtcttagtgccgctgctattaccgtccccccttcagtcccatctagagcccctgtccccccagccccaccccttcctggggacagcggcacgatcataccccctcccccagcgcctggcgactctactactcccccacctccgccaccacccccaccacctcctccccctctgccagggggagtgtgcatctcatctccgccatcattaccagggggtacagccatctctccaccccctccactctccggggacgccactatccctcccccaccgcctctccccgaaggtgtcggaatcccatcgccgtctagtcttcccggaggaaccgctattccccctccccctccactccctgggtccgccaggatccctcccccacctcctcccctgcctggttctgccggaattcccccaccaccgccacctcttcctggggaggctggaatgcctccaccccctccacctttaccaggtggccctggaattcctccacctcctccattcccaggtgggcctggcatcccccctcctcccccagggatgggaatgcctcctccacctccatttggtttcggggtgcctgccgcaccagtgctcccatttgggctcacaccgaagaagctgtacaagcccgaagtccagcttaggcgcccaaattggagtaaattggtcgcagaggatttgagccaggactgcttttggacaaaagtgaaagaggacaggttcgaaaataatgaacttttcgcgaagttgacactgactttcagcgctcagaccaaacgcacaaaaaaggccaagaaagatcaggaaggaggtgaggaaaagaaaagcgtacagaagaaaaaggtgaaagaactcaaggtcttggattctaagaccgcacaaaatttaagcatcttcctgggttcctttcgaatgccttatcaggaaatcaaaaacgtcattttagaggttaacgaagcagtcctgacagagtccatgatccagaatctcattaagcagatgccggaaccagagcagctcaagatgctgtctgagctcaaggacgagtacgatgatctggctgagtctgaacagtttggcgtggtgatggggacggtcccaaggctcaggccccgactgaacgcaattctgttcaaactgcaattcagcgagcaggtcgaaaatattaaacctgaaatcgtcagtgtgacggccgcatgcgaggagctgcgcaaatctgagtcttttagcaaccttctggagataacgctcctggtcggcaattacatgaacgctgggtctaggaacgctggcgcatttggattcaacatatctttcctgtgcaagcttcgcgatacaaaatctacagatcagaagatgaccctcttacactttttggccgagctgtgtgagaacgactatcctgacgtgctcaaattccccgacgagcttgcacatgtcgaaaaagcctcgcgtgtgagcgcagagaatctgcagaaaaacctcgaccagatgaagaagcagatttcagacgtggagagagatgttcagaatttccctgccgcaaccgacgagaaagacaaattcgttgagaagatgaccatttttgtaaaagatgcccaggaacagtataataagctgaggatgatgcactccaatatggagaccttgtataaggagctgggcgaatatttcctgtttgatcctaaaaaactttccgtggaggagttcttcatggatctgcataacttcaggaatatgtttcttcaggcagtaaaggaaaatcaaaaaagacgcgaaacagaggagaagatgagacgagctaagctggccaaggagaaggccgaaaaggaacgactggaaaaacagcagaagcgtgaacagctgatcgacatgaacgcggagggagacgagactggcgtgatggatagtctgttggaagctctccagtccggtgctgccttccgaagaaaaagaggcccaaggcaggcaaaccggaaagccggatgcgccgttacgtctttactggcgtccgagctcactaaggacgatgctatggccgctgtgccagctaaggtgtccaagaacagcgagaccttcccaactatcttggaagaggccaaggaactggtgggcagagccagttag

SEQ ID NO: 28367 - DNA, 3810 bp, Artificial Sequence
  Description of Artificial Sequence: Synthetic coding sequence
atggagccccctgggggaagcttaggtcccggtcgcggaacacgcgataagaagaagggaagaagcccagacgagctcccttccgctggcggtgacggaggcaaatcaaaaaaatttaccctgaagcgacttatggctgacgagcttgagaggtttaccagtatgagaattaagaaagaaaaggagaagcccaatagcgcacacaggaacagtagcgctagctatggagatgatcccacagctcaaagcctgcaggacgtctcggatgagcaggtgctagttctgtttgaacaaatgctgctagatatgaatctgaacgaggagaaacagcagcctctgagggagaaagacataattatcaaaagggagatggtgtctcaatacctatatacttctaaggccggtatgtcccagaaagagtcaagcaaaagtgccatgatgtatatccaggagctgcgcagtggattgcgggacatgccccttctctcatgtttggagagccttcgagtgtcactgaacaataaccccgtttcatgggtacaaacctttggtgccgaaggattggcaagcttgcttgatatcctgaaacggttacacgacgaaaaagaggagaccgctgggtcatacgattctcggaataagcacgagataatccgatgcctcaaagcgttcatgaataacaagttcggcatcaaaacaatgctggaaaccgaagaaggtatcctgctgctcgtgagggcaatggacccagccgtgccaaacatgatgattgacgcagcgaagttgctaagcgccttgtgcatcttgccccagccagaggatatgaatgagcgagttctcgaggccatgacggagagggctgagatggacgaggtagagagattccaacccctgctagatggtttaaagtccggcacaacaatcgccctgaaggttggatgcctgcagcttatcaacgccctgataacacctgccgaggaactggattttcgcgtccacatcaggtctgagctaatgagactcggtctgcaccaggtgttgcaagatttgcgagaaatcgagaacgaggatatgcgcgttcagctcaatgtgtttgatgagcagggtgaagaagattcttatgatctcaagggacgactggatgacatccgcatggaaatggacgactttaatgaagtcttccaaatcctgctgaacacagtgaaggacagcaaggctgagcctcacttcctaagtatattgcagcatctgctgctggtgcgcaatgactatgaggcacgcccacagtactataaattgatcgaagagtgtatcagtcaaattgttctccacaagaatggggcagatccagatttcaaatgtcgccacctccagatagagatagagggcttgatcgaccagatgatcgacaagaccaaggtggagaaatctgaggctaaagctgccgagctagaaaaaaagttggatagtgaactgacagcccgacacgagttgcaggtggagatgaaaaagatggagagcgactttgagcaaaagctgcaggatctgcagggagaaaaggacgccttacacagcgaaaaacagcagatcgcaaccgagaaacaagatttggaggcagaggtcagtcaactgaccggtgaagtggctaagctcaccaaagagctggaagacgcaaagaaggagatggccagcctcagcgccgctgccatcactgtcccaccctccgtgccctctagggcgccagttccccctgccccacctcttccaggcgattcaggcacaatcatcccaccgcctccagctccaggagactccacgacccccccaccaccaccacctccacctcctcccccacctcctcttcccggaggcgtgtgcatcagttcacccccaagcctgcccggaggaactgcgatctccccacctcctcccctttccggcgatgcaaccattcctccccctccacctctccctgaaggcgtgggcatcccttccccttcatcactcccaggcggtactgcaataccccctccgccaccactgcccggttctgccaggattccccctccacccccaccgcttcccggatcagccggtatcccccctcctcccccacctctgcccggagaggctggcatgcctcctcctccccctccattgccaggtggaccaggcattcctccacccccaccctttcccggaggaccaggcataccccctccgccaccaggaatgggaatgccaccaccaccgccttttggatttggcgtaccagcagccccagtcctgccctttgggctgaccccaaagaagttatacaagccagaagtccagctccgtcggccaaactggtccaagttagttgccgaggacctgtcccaggactgtttttggacaaaggtcaaggaggatcggttcgagaataacgagctgttcgccaagctcaccctgacgttctcggcacagaccaagacaaagaaagaccaggagggtggggaagagaagaagtctgtacagaagaaaaaggtgaaggaattaaaagttttggactcaaaaactgcgcaaaatctctcaatctttcttgggagttttcgtatgccttaccaagaaattaaaaatgtgatcctggaggtgaatgaagccgtgttaaccgagagcatgattcaaaatctgataaagcagatgcccgagccagaacaacttaaaatgctgtcggagctaaaggacgagtatgacgacttggctgaatcagagcagttcggcgtggtgatgggaacagtaccccgtctcaggccaagattgaacgcaatcctcttcaagctgcagttctcggaacaggtcgaaaacattaagcctgagattgtctcagttacagcggcatgtgaggaactgcggaaatcggagagtttttccaacctactggagattacgcttctggttggtaactacatgaacgctggaagtcgtaacgcaggtgctttcggctttaacatcagcttcctctgcaagctacgggatacgaagagtacagatcagaagatgaccctgctgcattttctggctgaattgtgtgagaatgattaccctgatgtgttaaagtttcccgatgagcttgcccatgtggaaaaagctagtagggtcagcgccgaaaaccttcagaagaatctggatcagatgaaaaaacaaatcagcgacgtcgagagagatgtgcagaattttcccgcagccaccgatgagaaagataagttcgtggagaagatgacttcgtttgtcaaggatgcacaggaacagtacaataaacttcggatgatgcactcgaacatggaaacactgtataaagaacttggcgagtactttcttttcgatccaaagaagctctcagtggaggagttctttatggatctacacaacttcaggaacatgttcctccaagcggtaaaagagaatcagaagcgtcgtgagactgaggagaagatgcgacgcgcaaaactggcgaaagagaaagccgaaaaagaaagactggaaaaacagcagaagcgagagcagcttatagatatgaatgccgaaggagacgaaactggcgttatggatagtctcctggaagccttacagtcgggagcagctttcagacggaaaaggggcccaagacaggccaacagaaaggcaggctgcgctgtcacctcactattggcctctgaactgactaaagacgacgcaatggcagctgtgcctgctaaggtgtccaagaatagtgagacattccctacaatattggaggaggctaaagaacttgtcggacgcgcttcctag

SEQ ID NO: 28368 - DNA, 3792 bp, Artificial Sequence
  Description of Artificial Sequence: Synthetic coding sequence
atggagccccctggcggttccctcgggccagggaggggaacacgggataagaaaaaaggtcgctcacctgacgaactcccatctgcgggaggggacggcggaaagtccaagaaatttctcgagcgctttacgtcgatgaggattaaaaaagaaaaagagaagcctaactcagcgcatcgcaacagcagcgcgagttatggcgacgatcctaccgcccagagcctccaggacgtcagcgacgagcaagtgctcgtgctcttcgaacagatgctgctggatatgaatctcaatgaagagaaacagcaaccgctgcgcgagaaagacatcataatcaagcgcgagatggtctcccagtacctgtatacttccaaggcagggatgtctcagaaagagtcatcaaagtcagctatgatgtacatacaggagctcaggtccggtctaagggacatgcccctgctctcttgcctggagagtctccgtgtatcgctgaataacaacccagtgagttgggttcagacctttggggcagagggcctcgccagtctgctggatatcctaaagcgcttgcacgatgagaaggaggagacagccggaagttacgacagccggaacaagcacgagatcatccggtgtctcaaagcgtttatgaacaataaattcggaatcaagaccatgctcgagactgaggaagggatccttctactggttcgcgctatggatccagctgtcccaaatatgatgatcgacgctgccaagcttctttctgctctttgtatcctgccacagccagaggacatgaatgagcgcgtgctcgaggccatgaccgaaagggccgaaatggacgaagtggagcgattccaacctctcctagacggactcaagagcggaactacaatcgctttgaaggtgggctgccttcagctgataaatgctttgattaccccagccgaggagttggacttccgggttcacattaggagcgagttgatgcgacttggattgcatcaggtactgcaggacttgcgagagattgagaatgaagatatgcgggtccagctgaatgtcttcgatgagcagggtgaggaggactcctatgacttgaagggcaggctggacgatatcagaatggaaatggacgacttcaatgaggtgtttcaaattcttcttaacacagtgaaagatagcaaagccgagccccactttcttagcatacttcaacatctacttctcgtgcgtaatgactacgaagccagacctcagtactacaaactgattgaggagtgtatctctcagatcgtccttcacaagaatggagccgacccggactttaaatgcaggcacttgcagatagaaatcgagggacttattgatcagatgatcgacaagactaaagtagagaaatcggaagccaaagccgctgaactcgagaaaaagttagacagtgagttgactgcgagacatgagctgcaagtagaaatgaaaaagatggagtcagattttgaacagaagctgcaggatctgcagggtgaaaaagacgcattgcacagcgaaaagcagcagatcgcaacagagaagcaggatcttgaagccgaggtatcacagttgaccggggaagtcgcaaaactgacaaaagagctggaggacgctaagaaagagatggccagcctttcagctgccgctatcactgttcctccttctgtgcctagtcgtgctcccgtacccccagcacccccacttcctggcgacagcggcacaatcattcccccaccccctgcccctggggatagcaccactccccctcctccaccccctccgcctcccccaccacctccactgcccggtggggtgtgtattagcagcccccctagtctgcctggtggaaccgctatttctccgccaccacctttatctggtgacgcaaccatcccacctccccctcccttacctgaaggggtcggcatccccagcccgagctcgctccccggtggtaccgctattccacctcccccaccgctgcccggttctgctcggatccccccacctccgcctcccctcccaggctccgccggaatcccgccacctcctccaccattgcctggcgaggcgggtatgccccctcctccaccacccctgccagggggtccaggaatcccaccaccccctcctttcccaggcggacctggaatccccccaccaccacccggtatggggatgcctccaccccctccctttggcttcggggtcccagctgctcccgtcctgcccttcgggctgactccaaagaaactgtacaaacccgaggtgcagttgcgccgtcctaattggtccaaacttgtggccgaagacctgtcccaggattgtttctggacgaaggtcaaagaggacagattcgaaaacaacgagctctttgcaaaactcaccctgactttcagcgctcagacaaagacgagcaaagccaaaaaagaccaagagggtggggaggagaagaagtccgtccaaaagaagaaagtcaaggagctgaaagttctagactccaagacagctcagaacctttccatcttccttgggagcttcaggatgccatatcaagagatcaagaacgtgatcctcgaggtgaatgaagccgtgctgacagagagtatgattcagaacctgattaaacagatgccagaacctgaacagttgaagatgctgtcagagttaaaagacgagtacgatgacctggcagagtccgagcagttcggtgtggtgatgggaaccgtcccgagacttcggccaaggttgaacgcaatcctgttcaagctccaattctctgagcaggtggaaaacatcaagcctgagattgtatctgtcacagccgcttgtgaagagctaaggaagtccgaatctttctcaaacctcctggagatcacactgctggtcgggaattacatgaatgccggatcacggaatgctggcgcttttgggtttaacatttctttcctgtgtaagcttcgagacactaaaagcacagaccagaagatgactttattacacttcctcgccgaactatgcgagaatgattacccagatgtccttaaatttcccgacgaattggctcatgtggagaaggctagcagagtgagcgccgagaatctgcagaagaacctggatcaaatgaagaagcaaatttcggacgtcgaacgggacgttcagaattttccagctgccactgacgaaaaggacaagtttgtggaaaaaatgacttcatttgtgaaggacgcacaggagcagtacaacaagctgagaatgatgcattccaacatggagacactctataaggagctcggcgaatattttctatttgacccgaagaaactgtctgtggaggagttcttcatggacctgcataatttccgtaacatgttcctccaggctgtaaaagagaatcaaaaacgccgtgagactgaggagaagatgagacgggctaaactcgctaaggagaaagccgaaaaagagcggctggagaagcagcaaaagcgcgaacagttgatcgacatgaacgctgaaggtgatgagacgggggtgatggattccctgctggaggcactccaaagcggcgcagccttccggcgaaagagaggccctaggcaagccaatcgcaaggcgggttgcgctgtgaccagcctcctggcatctgaattgacaaaagatgacgccatggcggcagtgcccgcaaaagtgtccaagaacagcgagacttttcccacgatattagaggaggctaaagaactcgtgggcagagcctcctag

SEQ ID NO: 28369 - DNA, 3819 bp, Artificial Sequence
  Description of Artificial Sequence: Synthetic coding sequence
atggaaccgccaggcggtagccttggacccggtagggggactagagacaagaagaaggggaggagtcctgacgaactcccaagcgctggcggagatggcggaaagagcaaaaagtttacccttaaacggctaatggccgacgaactcgagcgcttcactagcatgcggattaagaaggagaaagagaaacctaactccgctcaccgtaattcctcagcttcctacggtgatgatcccacagcccaatctcttcaagacgtgtcagacgaacaggttttggtgttgttcgaacaaatgctgcttgatatgaatctgaacgaggaaaagcagcagcccctccgcgagaaagacatcataattaaacgtgaaatggtcagccagtacttatatacatcgaaggctggaatgtctcaaaaggagagctcaaaatctgccatgatgtacatccaggagttacggagcggtctaagagacatgcctctcctttcctgtctggaatccctgcgtgtgagcctaaataataacccggtctcgtgggttcagacattcggcgcagaggggctggcctcactgttggatatcttgaagcgactgcatgacgagaaggaggagacagccggttcctatgatagcaggaacaaacacgaaattattaggtgccttaaggcgttcatgaacaacaagtttggaatcaagacaatgctggaaacagaggagggtatcctcctcctcgtcagagccatggatcctgctgtgccaaacatgatgatagacgccgctaagctactctcagcgctctgtatcctcccacagccagaggacatgaacgaacgcgtcctcgaggctatgaccgaacgtgccgagatggatgaggtggagaggttccagcctctactggatgggctgaaaagcggtaccaccatcgctctgaaagtggggtgcctacagctaatcaatgccctcataacgcccgcagaagagctggactttcgcgtccacatcagaagtgagcttatgcgtctcgggctgcatcaagtccttcaggacctgagagagatcgagaacgaggatatgagagtccagttgaacgtctttgatgagcagggcgaggaagacagctacgacttgaagggcagactagatgatatccggatggagatggacgattttaacgaggtctttcagatactgttgaataccgtgaaggactcgaaagccgaaccacactttctgagtatcctgcagcatttgttgctggtccgaaatgactatgaagccaggcctcagtactacaagcttatagaagagtgcatatctcaaatcgtgttgcacaagaacggagcagacccagattttaaatgtcgccacctccaaattgaaatcgaaggcctcatcgatcagatgatcgataaaacaaaggtggagaaatccgaagccaaagccgctgaactggagaagaagctcgattccgagctgaccgccaggcacgagttgcaggtggagatgaagaaaatggagagcgatttcgaacagaagctacaggacctgcagggtgagaaagatgcactgcactcagaaaagcagcagatcgctactgagaagcaagacttagaagccgaagttagccagctgacgggggaagtcgccaagttgacaaaggagctcgaggacgcaaagaaggagatggccagcctatcagctgcagctattaccgtgcccccttctgttccctcacgagctcctgtgccaccggcaccacctctccccggtgatagcgggaccataatacccccaccccctgccccaggcgattcaactacaccacccccacctcccccacccccacccccaccccctcctctgcccggaggcgtatgtatttcttctcccccatctttgcctggagggactgcaatttcccctccaccacctttgtctggagatgccactattccaccccctcctcccctcccagagggagttgggattccctcacctagctccttgccagggggtacagctattcctccgcctccaccactccctgggtcagctcggattcccccaccaccccctccactgccagggtcggccggtatccctccccctcctccccctctgcccggagaagcaggaatgcccccacctccccctccactgccaggtgggcctgggatcccgccaccacctcctttccccggtggacctggaattccacccccacctccaggcatgggcatgcctccccctccacctttcggatttggcgtgccagcagctccagtgcttccttttggacttactcccaagaaactgtataagcccgaagtgcaattgcgtcgcccaaactggagcaaactggtggccgaggacctgtcccaggactgcttttggaccaaagtgaaagaagatcggttcgaaaacaacgagctcttcgcgaagctaaccctgacattctcagcccagaccaagacttctaaagcaaagaaagatcaggagggaggcgaagagaagaaaagcgttcagaaaaagaaggttaaggagcttaaggtgcttgactcaaaaacagcgcagaacctgtccattttccttggcagttttcgtatgccatatcaagaaattaagaacgtgatacttgaggtaaatgaggctgtgctgactgagtcaatgatccaaaatctgatcaaacagatgccagagcctgagcagctcaaaatgctatctgagctgaaggacgaatatgacgacctggcagagagtgaacaattcggcgttgtaatgggaaccgtacctaggctgaggccccgactcaacgcaatactcttcaagctccagttttctgagcaggtggagaacatcaaacccgaaattgtgagcgttacagcagcctgcgaggagctccgaaaaagcgagtccttcagtaaccttttagagatcacactgctggtcgggaactatatgaacgctgggtcaagaaatgcgggtgctttcggctttaatatcagttttctctgcaagctgcgtgataccaagtccactgatcagaagatgactctcctgcactttctcgccgagctgtgcgagaacgattaccccgatgtgctgaaatttcccgatgaattggcccatgtagagaaagcctcacgggtgagcgctgagaaccttcagaaaaacctggatcagatgaagaagcagattagtgacgttgaacgagacgtccaaaatttcccggctgcaaccgatgagaaggacaagtttgtcgagaaaatgacaagctttgtcaaggacgcacaggaacagtacaataaactgcgtatgatgcacagtaatatggagactttatacaaggagctgggtgagtacttcctatttgaccctaaaaagctgtctgtcgaggaattcttcatggacctgcacaattttcggaacatgttcctgcaggcggtcaaagaaaaccaaaaacggagggaaactgaggagaagatgaggcgcgcaaaattggccaaggaaaaagcggagaaggaaaggctagaaaagcagcaaaagagagagcaactgattgacatgaatgcagagggcgatgaaaccggagttatggatagcctgctcgaggccctccagtcaggggctgcattccggagaaagcggggacctaggcaagcaaatagaaaagctggttgtgcggtgacgtctctgctggcctcagagctcaccaaggatgacgctatggcggctgtgccagctaaggtgtcaaagaattctgagacatttccgaccatactggaggaggcgaaggaactggtagggcgagctagctag

SEQ ID NO: 28370 - DNA, 3747 bp, Artificial Sequence
  Description of Artificial Sequence: Synthetic coding sequence
atggaacctcccggaggcagcttggggcctgggaggggcacccgtgacaagaagaaaggaaggtccccagatgagttgcctagcgcaggtggggacggcggaaagtcaaagaaattcctggagagattcacatctatgcgtatcaagaaggagaaagagaagcctaacagtgcacacaggaactcttctgccagttacggagacgaccccacagctcagtccttgcaagatgtgtccgacgaacaggtgctggtcttatttgagcaaatgcttctggacatgaatttaaacgaagagaagcagcagcccctgagggagaaggacattatcattaagcgggagatggtatctcagtatctatacacatcgaaggcaggaatgtctcagaaggagtcatctaagagcgccatgatgtacattcaagaactcaggtctggcctgcgagatatgcccttgctctcgtgtttagaaagcctgagggtctctcttaataataacccagtctcatgggtccagacctttggggcagaaggcttagccagcctgctggacatcctgaagaggcttcatgacgagaaagaagagacagccggaagttatgactcaagaaataagcacgagattataagatgcctgaaggcatttatgaacaacaaatttggcatcaaaactatgcttgagactgaagagggaatactcctgcttgtccgcgctatggaccctgcagtacctaatatgatgattgacgctgctaagcttctgagcgcactctgcatacttccacagccagaagacatgaacgagcgcgttctagaagctatgaccgagcgggctgagatggacgaggtagagaggttccagccccttttagacggtttaaagtctggcacgaccattgccttaaaagtagggtgccttcagctgattaacgctctcattactccagccgaggaactcgatttccgagttcatatcagaagcgagcttatgaggttggggctccatcaagtgttgcaggatctgcgggagattgaaaacgaggacatgcgggttcaattgaatgtgttcgacgagcagggggaggaggacagttatgaccttaaggggaggctagacgacattagaatggagatggacgactttaatgaggtatttcagatcctgcttaacacagttaaggattctaaggcagagccccacttcctgagtatcttgcaacatctcctgctcgttagaaacgattatgaagcgagacctcaatactacaagctaattgaggaatgcatctcgcaaattgtgctgcacaagaacggtgcggatccggatttcaagtgtagacatctgcagatcgaaatcgagggacttatcgatcaaatgatcgataagactaaggtagagaagtccgaagcgaaggccgctgaactggagaaaaaactagactccgaactgacagccagacatgagctgcaagtggagatgaagaagatggagtccgacttcgaacaaaagcttcaggacctgcagggagagaaagacgcccttcatagcgaaaaacagcaaatagctactgagaaacaggacctggaggccgaggtgtcccagctcacaggtgaagtcgcgaaattaacaaaggagttagaggatgcgaagaaggaaatggcgagtctttctgcggcagcgatcactgtgcccccatctgtgccaagtcgagctccagtaccacctgctcccccactgcccggtgatagcgggactataatcccaccaccgcctgcacccggagattctaccaccccaccaccacccccaccgccaccccctccccctccacccttgcctgggggtaccgcaattagcccaccaccccctctgtctggagatgctaccatccccccacccccaccgctacctgagggggtcggaattccgtctccatccagcctgcccggtggaaccgccataccacctcctccacctcttccgggtagtgcccgtatcccacctccaccacctcccctgccgggtagcgccggtattccaccccctccacctcccctcccaggcgaagctggtatgccgccaccacctccccctttgccaggcggacccggaatcccccctccaccgccatttccagggggaccaggtatacctcctccacctccaggaatgggtatgccacccccaccacctttcggatttggcgtcccagccgcaccagtgctcccatttggtttgactcctaagaagctttataaacctgaagtgcagcttcggaggcccaattggtccaaactcgtcgccgaggacttgtctcaagactgtttttggacaaaagtcaaagaagatcgattcgagaataatgagctgttcgccaagctcacgctgacatttagcgcccaaacgaagaccaagaaggatcaggaggggggagaagaaaaaaaatcggtgcagaaaaaaaaggttaaggagttaaaagtcctagacagtaagaccgcccagaatctgtccatcttcctgggcagttttagaatgccatatcaggagataaaaaacgtgatcctggaagtgaacgaggctgtcctgacggagtccatgatacagaacttgatcaagcaaatgcccgagcctgagcaactcaaaatgcttagcgagctgaaggacgagtatgacgacttggccgaaagcgaacaattcggcgtggtgatgggcactgtaccgagattgcggcctaggttaaacgccattttattcaagctgcaattttctgagcaggtagagaatattaagcctgagattgtgtcagttaccgctgcctgcgaggaactaagaaagtctgagagcttttctaatctgttagagatcacattacttgtagggaattatatgaacgctggcagccggaacgccggagcctttggcttcaacatcagctttctgtgcaaactccgtgacactaaatctacagatcagaagatgactttgttacactttcttgctgaattgtgtgagaacgattaccccgatgtgcttaaattccccgacgaactggcacacgtggaaaaggcctccagggtgtcagccgagaatctgcagaagaacctcgaccaaatgaagaaacagatctcagatgtagaacgggacgtgcaaaacttcccagcagccaccgacgagaaggacaaattcgtcgaaaaaatgacaatttttgtgaaggacgcgcaggaacagtacaataagcttaggatgatgcactcaaacatggagacgctgtacaaggaactgggagaatactttttgttcgatccaaagaaacttagtgtagaggaatttttcatggacttgcacaatttcagaaacatgtttctgcaggctgtcaaggaaaatcaaaagcgcagagaaacagaagaaaagatgcggagagccaagctcgcaaaagagaaagccgagaaggagaggctggagaaacagcagaagagagaacagctgatagatatgaatgccgaaggcgacgagacaggcgtgatggactctctgttggaggctcttcaatcaggggctgcgttccgccgaaagaggggacctcggcaggcaaaccgaaaggctgggtgtgctgtcacttctctcctggcaagcgagctgacaaaagatgacgctatggcagcggtgcctgcaaaagtgtccaagaacagtgaaacattccccactattctcgaagaggctaaggagttagtgggacgcgcaagctag

SEQ ID NO: 28371 - DNA, 3795 bp, Artificial Sequence
  Description of Artificial Sequence: Synthetic coding sequence
atggagcccccaggcggatccctgggccctggacgtggaacacgagataagaagaagggtagaagccctgatgaactcccttccgctggtggagatgggggtaaatccaaaaagttcttggaacggttcacatctatgcgaatcaaaaaggagaaagagaaaccgaattccgctcatcgcaactcctcggccagttacggtgatgacccgacagcccaaagtctccaagacgtctcagacgagcaggtgctggtcctgtttgaacagatgctgctggacatgaacctgaatgaagaaaaacagcaaccactgcgggaaaaagatatcatcataaaaagagagatggtgtctcagtatctgtatacatcaaaagctggtatgagtcaaaaggagagtagcaaaagcgccatgatgtacatacaggagcttcgttctggtcttcgcgatatgccactattaagttgtctggaaagtcttcgcgtgagtctcaataacaaccctgtgtcatgggtgcagactttcggggctgagggcttagctagcctgctcgacatcctgaagagactccacgatgagaaggaggagactgccggtagttacgattccagaaataaacatgaaatcattaggtgcctgaaagcttttatgaacaacaagttcgggataaaaactatgcttgagacggaagaaggcatcctgctgctggtaagagctatggatccagcagtgcccaatatgatgattgatgccgctaaactattaagcgccctctgcatcctgccccaacccgaagacatgaacgagagggtccttgaggcaatgacagaacgagctgagatggacgaggtcgagagattccagccgcttttagacggtctgaaatcgggcaccacgatcgccctgaaagtcggttgccttcagctgatcaatgcactgattacgcctgcagaggagctggattttcgggtccatattagatctgagctcatgcggctcgggctccaccaggtgctgcaagacctcagggagattgaaaatgaggatatgcgggtgcagttgaatgtttttgatgagcagggcgaggaggactcctacgacctgaagggaaggttagacgacatccgcatggagatggatgatttcaacgaggtgttccagatcctgcttaacactgtgaaagactctaaggctgaaccccactttttatctatattgcagcacctgctgctggtgcgtaatgactatgaagcccgtcctcagtattacaagctgattgaagagtgtatttcacagattgtgctccacaaaaacggtgcagaccctgatttcaagtgtcgccatctgcagattgagatcgaaggcttgatcgaccagatgatcgacaaaaccaaggtggagaagtccgaagcgaaggccgctgagcttgagaagaaactggacagcgaactcaccgcacgtcatgagctccaggtggagatgaagaagatggagagtgattttgagcagaagcttcaggacctgcagggcgagaaggacgctctgcattcggaaaagcagcaaatagccacagaaaaacaggacctcgaggcggaagtatcacagttaaccggcgaggtcgctaaattgactaaggagctggaggatgctaagaaggagatggcatcactgagcgccgcagcaattaccgttcctcctagtgtcccatcccgcgcaccagtacctcctgcccctcccctgcccggagactccgggactataatccctccacctcctgcgcctggcgattcaacgacacctcctccacctccccctcctcctccccctcccccacccttacccggaggggtgtgtatcagcagtcctccctccctgcccggagggaccgccatctcaccacctccacccctgagtggcgatgccaccattccccctcccccaccactccccgaaggagtgggaattccatcgccctcgagtttacctgggggtactgccataccacctccaccccctcttcccggatctgccagaatccctccccctcccccacctttgcccggatctgcgggaattccccctcctccacctccattgccaggcgaggccggtatgcccccaccacctcccccactgccaggaggcccagggatcccaccacctccacccttccctgggggacctggcattcctccgccacctcccggaatgggcatgcctccgccacccccattcggcttcggagtgccagcggctccagttctgccatttggcttaacaccgaaaaagttgtataaaccagaggtgcagctcaggcgcccaaattggagtaagcttgtagctgaagatctgagccaggattgtttctggacgaaggtgaaagaggaccgctttgaaaacaacgaattgttcgccaagttaacattaacattttctgcccaaactaagcgaaccaagaaggccaaaaaggatcaggagggcggtgaagagaagaagtccgtgcagaaaaagaaggtgaaggaactaaaagtactagattctaaaacagcacaaaacctatcgatctttttaggttctttccgaatgccttaccaggagattaagaatgttatcttagaggtgaatgaggccgttctcactgagtccatgatacagaacctgattaaacagatgcccgagccagaacagctgaaaatgcttagtgaactgaaagatgaatatgatgacttggctgagtctgagcagttcggtgtggtcatgggaacagttcccagactgcgaccaaggctgaatgccatcctgttcaagctgcaattttccgaacaggtggaaaatatcaagcccgaaatcgtcagtgtaaccgctgcctgcgaggaactcagaaagtccgaaagtttcagcaacctattggagatcacactgttggttggtaattatatgaatgcgggtagccggaatgctggggcatttggctttaacatatcctttttatgcaaactccgggacaccaagtcaaccgaccagaagatgacactcctgcactttctggcagagttgtgcgagaatgactatcccgatgtgctcaaatttccggatgagctagcgcatgtggagaaggcaagcagggtgtccgctgagaatctgcagaagaatctcgatcagatgaagaagcaaatctccgacgtggagcgagacgtgcaaaacttccccgctgccaccgacgaaaaagataagttcgtagaaaagatgactatctttgtgaaagatgctcaggagcagtacaacaaactgagaatgatgcactcaaacatggagacactctacaaggagctgggagagtactttctgtttgatcctaagaaactctccgtggaggagttcttcatggacctccataattttaggaatatgttcctgcaagcagttaaggaaaatcagaagcgacgagagacggaggagaagatgagacgggcaaagctggcgaaggagaaagccgagaaagagcgactggaaaagcagcagaagcgggaacaattaatcgatatgaatgccgaaggcgacgagacaggtgtgatggattctctgctggaggctttacagtcaggcgcagcctttaggaggaagcgtggaccaaggcaagccaatcggaaagctgggtgcgccgtcacatccctgctagcgtccgagctcaccaaggatgatgcaatggccgcagtgccagccaaagtgtctaaaaattcagagacattcccaaccattctcgaggaagcaaaagaattagtcggccgtgctagctag

SEQ ID NO: 28372 - DNA, 855 bp, Artificial Sequence
  Description of Artificial Sequence: Synthetic coding sequence
atggcctctttatcagctgccgcaatcacagtccctccttctgtacctagccgggctcctgtgccacctgcaccacccctcccaggggactcaggcactatcattcccccaccgccagcaccgggagactccacgacccctcctcctccacctccccctccaccaccaccaccccctctgccaggcggtgtgtgcatcagcagcccaccctcattgcccggtggcacagcaatctccccacctcctccactgagtggcgacgccacaattcctccaccaccgccactccctgagggtgttggaattcccagcccgagctccttgccaggaggtacggccattccacccccaccccctcttcctggatctgccagaattcctcctcctccccctccactccctgggagcgcaggcattccaccccctcctcccccattgccaggagaagccggaatgccccctcccccaccacctctgcctggtggacccggtatccccccacctcccccttttcccggaggccctggaatccctcctccacctccaggaatgggcatgccgcctcctccaccctttggctttggcgttccggctgcgccagtactaccttttggcttgacccctaagaaactgtataagcctgaagtccaactgcgaaggccgaactggagcaaattagttgctgaagatctgtcccaggactgcttctggacaaaagtgaaagaagacagattcgagaataacgagctctttgcgaaactgactttgacatttagtgcccagacgaagtcagagaaagcaaagaaggatcaggagggaggggaggagaagaagagtgtgcagaaaaaaaagtag

SEQ ID NO: 28373 - DNA, 513 bp, Artificial Sequence
  Description of Artificial Sequence: Synthetic coding sequence
atgtactgccagttcgccagttttcagtacacctgtcaaccctgtcggggtcagagaatgctgtgcactagggacagcgaatgctgcggagatcagctgtgcgtgtggggccactgtactaagatggccactcggggaagcaatggaacaatttgcgataatcaaagggactgtcagccgggtctgtgttgcgctttccaacggggtctgctgtttccagtgtgcacaccacttccggtggagggcgaactgtgccatgatcccgcttcacgactgctcgatctcattacatgggaactagaacccgatggcgcacttgatcgatgcccatgtgccagcggcttattgtgccagccccactctcacagtcttgtgtatgtctgtaagcctactttcgttggctctcgagatcaggacggagagattctcttgccaagagaagttccggacgagtatctagcggcatcttggcggaggtgcgcccgatcttggcgtacatggcgtggagcttag

SEQ ID NO: 28374 - DNA, 1053 bp, Artificial Sequence
  Description of Artificial Sequence: Synthetic coding sequence
atgcaacgacttggagcaaccctgctatgcttactgcttgcggctgctgttccaaccgctcctgctcctgcaccgactgccacatctgcccctgtcaagcccggaccggctctgagctacccccaagaggaggctacactgaatgagatgttccgggaggtagaagagcttatggaggatacacagcacaaactgcgtagtgcagtcgaagagatggaggccgaggaagccgctgcaaaggccagttcagaggttaacctcgcaaatctgcccccaagctatcataatgaaacaaacacagacactaaggttgggaacaatactatacatgttcaccgggagatccataagattaccaacaatcagacagggcagatggtgttctcagaaaccgtgattacctcagtcggagacgaagaggggagaagaagtcatgaatgcatcattgacgaggattgtgggcctagtatgtactgccagtttgccagctttcaatatacatgtcagccttgccgaggccagagaatgctttgcacccgcgacagcgaatgttgcggggatcagctgtgcgtgtggggtcactgcaccaagatggcaactagaggatccaacgggacaatatgtgacaaccaacgtgattgccagcccggtctttgttgtgcgtttcagcggggactgctgtttcccgtttgtacaccgctgccagtcgagggagaattatgtcacgatccggcatctaggctcctcgacctcatcacttgggagttggagccggacggagctctggaccgctgtccctgtgcgtccgggttgctgtgccaaccccactcgcatagcctggtttatgtctgcaaacccaccttcgtggggtcaagggaccaggatggggaaatactcctccccagagaagtccccgatgaatacgaagtcggttcattcatggaggaagtgagacaggagttagaggaccttgaacgctcactgaccgaggagatggccctgcgggagcccgcagcagctgccgcagcactgcttggaggtgaagaaatctag

SEQ ID NO: 28375 - DNA, 882 bp, Artificial Sequence
  Description of Artificial Sequence: Synthetic coding sequence
atggaggatacacagcacaagttacgcagtgctgttgaagaaatggaggctgaggaggcagccgcaaaggcatcaagcgaagtcaacctggctaatctgccaccctcatatcacaacgaaacaaacactgacacaaaagtgggtaacaataccatccacgtgcaccgtgagattcataagattacaaacaatcagaccggacagatggtcttctccgaaaccgtaataacaagcgtcggtgacgaagagggtcggaggtcgcatgagtgcatcatcgacgaggattgcgggccttccatgtactgccagttcgcctcctttcagtacacgtgtcagccttgccggggacaacgtatgttgtgcacgcgagatagtgagtgttgtggggatcagctctgcgtgtggggccattgcacgaaaatggctacccgcggatcaaatggcacaatttgcgataaccagcgagattgccagccaggcctttgctgcgcgtttcagcgcggtcttttgtttcccgtttgcacccccctgcccgtggagggcgaactttgccacgatccggcatcacggctgcttgatctcattacatgggaattggagccagatggggctctagatcggtgcccctgcgccagtggcctcctgtgccagccacactcccacagcttggtgtacgtgtgcaagcccacctttgtggggtctcgcgaccaagatggggaaatcctcctgcctagggaggtgcccgacgaatatgaggtcggttcatttatggaggaagtgcgacaagagctggaggacctcgagcgctctctgacggaagaaatggccctgcgagaaccggcagcagccgctgcggctctgctgggaggcgaagaaatctag

SEQ ID NO: 28376 - DNA, 1053 bp, Artificial Sequence
  Description of Artificial Sequence: Synthetic coding sequence
atgcaaaggctcggggcaacattactctgcctccttcttgctgctgcagtccccactgctcctgcccctgcccctaccgccacaagcgccccagtgaagcccggacctgctttatcttatccacaggaggaggcaacactcaacgagatgtttcgagaggtagaagaattgatggaggatacccaacataaattgagatcggcagtcgaggagatggaggccgaggaagcagcagcaaaagcctcatccgaagtcaacctggccaatcttccgccaagttaccacaatgagaccaacacagacactaaagtgggcaataatacaatccacgtgcaccgcgaaatccataagataacgaacaatcagaccgggcaaatggtcttttccgaaaccgtgattacatcagtaggcgatgaagaggggagacggtcccacgagtgtatcatcgatgaagactgcggcccatctatgtattgccagtttgcgtcttttcagtatacctgccaaccctgccgtggacagagaatgctgtgtactcgggatagcgagtgctgcggcgaccagttgtgtgtgtgggggcactgcactaagatggccactaggggtagcaacggaactatctgcgataaccagcgggattgccagccaggcttatgctgtgccttccagcgtggcctgctgtttcctgtgtgtaccccattgcctgtggagggtgagttgtgccacgatcctgcatctcggttgctggatctcataacctgggagctggagcctgacggtgctttggacagatgcccatgtgctagtggcctgctgtgtcagcctcacagtcacagcctagtctatgtgtgcaagcccacctttgtgggctcgagagaccaggacggtgaaattctgttacccagggaggtgccggatgaatacgaagttggctctttcatggaagaggtgaggcaagagctggaagatcttgagcgatctttgaccgaggagatggccctccgcgagccagctgccgcagctgcggcacttctcggaggggaagaaatttag

SEQ ID NO: 28377 - DNA, 969 bp, Artificial Sequence
  Description of Artificial Sequence: Synthetic coding sequence
atgcagagacttggggcaactttgctgtgtttgctactggccgcagccgtcccaactgcaccagcccctgcgccaacagctacctccgcacccgttaaacctggtcctgcactgagttacccccaggaggaagccacccttaatgaaatgttcagggaggttgaggagctgatggaagatacccagcacaagctccggagcgcagtggaggaaatggaagctgaggaagccgcagctaaggcatcctcggaggtaaacctggccaaccttcccccatcctaccacaacgaaaccaatacggatacgaaagtaggcaacaacacaatacatgttcaccgggagatccacaaggagtgcatcatcgacgaagattgcggcccttctatgtattgccaatttgcaagcttccagtacacatgtcagccgtgcagagggcagcgcatgctgtgcacccgcgattctgaatgctgcggagaccagctttgcgtctgggggcattgtaccaaaatggccacccggggatccaatggcacaatctgtgacaaccagagagactgccaaccaggattatgctgtgcattccagagagggctcttgttccctgtatgtacccctctcccagtggaaggcgaattgtgccacgaccccgctagcaggctgctggacctaatcacatgggaactggagcctgatggagctctagacagatgtccatgcgcatcaggcctgctgtgccaacctcattcccactccctcgtgtatgtatgcaagccgactttcgttggaagtagggaccaggacggcgagatcctcctgcctagggaggtccccgacgaatacgaggttggaagcttcatggaagaggtcaggcaggagctggaggacctagagcgcagcctgaccgaagaaatggctctgagagagcctgccgcagcagccgctgctctcctcggaggtgaagaaatctag

SEQ ID NO: 28378 - DNA, 708 bp, Artificial Sequence
  Description of Artificial Sequence: Synthetic coding sequence
atgcagcgactcggggcaacactgctgtgcctcctgctagcagcagctgtgcctacagcacctgccccagctccgacagcaaccagcgcacctgtaaaacccggtcccgcactgagttatccccaggaggaggccaccctgaacgagatgtttcgggaggtagaggagttgatggaagatacacagcataaactgagatcagctgtcgaagagatggaggctgaagaggcggcagccaaagcatcctcagaagtgaaccttgccaacctgccaccaagttaccataacgagactaatacagataccaaagttggcaacaacacaatccacgtgcaccgggagatccataagatcacaaacaatcagactggacagatggtgtttagtgagaccgtaataacaagcgtaggtgatgaggagggacggcgaagccacgagtgtattatcgatgaggactgtggaccttcgatgtactgccagttcgctagttttcaatacacctgccagccttgtcgcggacagaggatgctctgtactcgggacagtgaatgttgtggagatcaattgtgcgtgtgggggcattgtacgaagatggccacccggggatctaatgggacaatctgcgataaccaacgggactgccaacctgggctgtgttgcgcattccaacggggactgctatttccagtctgcactcccctgccatag

SEQ ID NO: 28379 - DNA, 2301 bp, Artificial Sequence
  Description of Artificial Sequence: Synthetic coding sequence
atgaagaccccatggaaggtgctcctggggctgctgggcgctgcggctttggtgactatcattactgtccctgtggtactccttaacaagggaacagatgatgctacagctgactctcgcaagacatatacgctgactgactacttgaagaatacatacaggctgaagctttattctctacgatggattagtgaccacgaatatctctataagcaagagaataatatcctagtgtttaatgcagaatatggcaatagtagtgtcttcctggaaaacagtacatttgacgaattcggacacagcatcaacgattactcaatatcccccgatggccaatttatcttgctcgaatacaactacgttaagcagtggcgacatagctacactgcatcgtacgacatctatgatttaaataagcgacagctgataacagaagaacggatacccaataacacccagtgggtcacctggtctccagtgggccataaactggcttacgtctggaataacgatatctacgtgaagatcgagcctaatctgcctagttatagaattacctggacaggaaaagaagacatcatctacaatgggatcaccgattgggtgtacgaagaggaggtgttcagcgcatattcagctttgtggtggtcaccgaacgggacatttctggcttatgctcaattcaatgacacagaggttccgttgattgaatactcattttacagtgatgaatctctgcagtacccgaagacagtgcgtgtcccctatcctaaggctggcgctgtaaacccgaccgtaaaattcttcgtcgtcaacacagattctctgtcatcagtaactaatgctacttccatccagatcacagcgccagcttccatgttaattggcgatcactatctttgtgatgttacttgggccactcaagagcgcatctctctccagtggctgaggcggattcagaactatagtgttatggatatctgtgattatgacgagagttccggcaggtggaactgcctggtggccagacagcacattgagatgagcacaacgggttgggtaggacgatttaggccctcggagcctcacttcaccttagacggcaactcattttacaagattatatccaatgaggagggttaccgacacatttgctattttcagatagacaagaaggactgcacttttatcacgaagggaacatgggaggttataggcattgaggccctgacttctgattacctgtattacatttcaaatgagtataaaggcatgccaggcggaagaaatttatataaaattcagctgtccgattacaccaaagtcacttgtttgtcatgtgagctcaacccagaacggtgccagtattactccgtcagcttcagtaaagaggcaaagtattaccagctgcgctgctccggcccagggctcccactttacaccctgcatagtagtgtcaatgacaagggactcagagtgcttgaggacaacagcgccctcgataagatgttgcaaaacgtacagatgccatctaagaagctcgactttataatcctgaatgagaccaaattctggtaccaaatgatcctgcccccacatttcgataaaagcaagaagtaccctctgctgctcgacgtgtatgcaggcccatgctcccagaaggccgataccgtgttcagacttaattgggcaacttacttagcatctaccgagaacatcattgtggcatcttttgatgggagaggatcgggctaccagggggacaagataatgcacgcaatcaacaggcggctgggcacgttcgaagtggaggaccagatcgaggccgcaaggcagttctctaagatgggctttgtagacaacaagcgtattgcgatctgggggtggtcttacgggggttacgtcactagcatggtcctaggcagcgggagtggggtctttaaatgcgggatcgcggtggccccagtgagccgctgggagtactacgacagcgtttatactgagaggtatatggggcttccgactcccgaagacaacctggatcactatagaaactctaccgtcatgtcaagggccgagaatttcaagcaggtagagtatctgcttattcacggcacggcagacgataacgtgcatttccagcagagtgctcagatcagcaaggccttggtcgatgttggagtcgatttccaagcgatgtggtacacagacgaggaccacggcatcgcaagtagcacggcgcaccagcatatttatacccacatgagccacttcatcaaacaatgtttcagcctcccctag

SEQ ID NO: 28380 - DNA, 645 bp, Artificial Sequence
  Description of Artificial Sequence: Synthetic coding sequence
atgaatgtcttcagaatcctcggggacctgagccacctcttagcaatgatcctccttttagggaagatttggcgcagtaagtgctgtaaaggaataagcggaaagagtcaaatcctgtttgctctggtctttacaacacgctatctggatttgtttaccaactttatttccatctataataccgtaatgaaggtcgtatttctgctctgcgcctacgtcacggtgtacatgatatatggcaagtttaggaaaacttttgatagcgagaatgacactttcaggctcgaatttctgctagtcccagtcattggactgtcatttctggagaactatagctttacgctattggagatcttgtggactttttcaatttacctagaatccgtcgcaattctgccacaactgtttatgatttctaaaactggggaggctgaaacaattaccactcattacctattctttctgggactgtaccgggcactgtatttggcgaattggatacgcagatatcagacagagaatttttacgaccagatcgcagtagtatctggcgtggtccagacaatattctattgcgacttcttttacctgtatgtgacaaaggtgcttaaaggcaagaagctgtcccttcctatgcctatctag

SEQ ID NO: 28381 - DNA, 498 bp, Artificial Sequence
  Description of Artificial Sequence: Synthetic coding sequence
atgaaggaggatcaggtcgtggccgaggagcctggcttccaggacgaggaagagtccctttttcaggacatcgacctactgcagaaacacggtatcaatgtggccgatataaagaagttaaagtccgtggggatctgcacaattaagggaatccagatgaccactagaagagcattgtgcaatgtgaaaggcttatcagaagcgaaggtcgataagatcaaggaggctgctaataagctgatcgaaccgggttttctgaccgcttttgagtacagtgaaaagcgaaaaatggtgtttcatataaccacaggaagtcaggaatttgacaaactcctggggggaggcatcgagtctatggctatcacggaagccttcggtgaatttaggacagggaagacccagctgtcgcacactttatgtgtgactgcccagttaccaggcgctggcggatacccaggtggaaaaatcatattcatcgatactgaaaatacgctttag

SEQ ID NO: 28382 - DNA, 420 bp, Artificial Sequence
  Description of Artificial Sequence: Synthetic coding sequence
atgaaggaggaccaggtcgtggctgaagaacctggcttccaagacgaagaggagtctttgtttcaagatatcgacttgctgcagaagcatggtataaatgtggcagacatcaagaaactgaagtcagtggggatttgcactatcaaaggcatccagatgaccacaaggagggctctgtgtaacgttaagggtcttagcgaggccaaagtcgacaaaattaaagaggctgctaataaactgatcgagcccggattcttaaccgcctttgagtattccgagaagagaaaaatggtctttcacatcacaaccgggtcacaagaatttgacaagttactcggcggaggtatagagtccatggccattaccgaagcttttggggaattcaggaccggaaaaacacagctgtcacataccctttag

SEQ ID NO: 28383 - DNA, 858 bp, Artificial Sequence
  Description of Artificial Sequence: Synthetic coding sequence
atgaaggaggaccaggttgtagcagaggagcctggattccaagatgaggaagagtctctgttccaagatatcgatctgctccagaagcacggtattaacgtagctgacattaaaaaactgaaatccgtcgggatctgcactatcaaaggaatccagatgaccactcggagagctctctgcaatgtaaagggtctgagcgaggcaaaggtggataagatcaaagaagcggctaacaaacttatcgagcctggattcctcacagccttcgagtactctgaaaagagaaaaatggtgttccatatcactactggatcccaggaattcgataaactactgggaggcggtatagagtctatggcaattaccgaggcattcggggaatttaggacaggcaaaacacaactgtcccacacactctgcggcgagcaccaaatggagctcctggattacgtcgccgctaaattccatgaagaggccggtattttcaaacttctcatcatcgattctattatggctttgtttagagtggacttctcgggacgtggagagcttgcagagcgccaacagaagctggcacaaatgctctccagactgcagaaaatttcagaggaatacaatgtagcggtgtttgtgacaaaccagatgactgctgaccctggcgctacaatgacatttcaggctgaccccaagaagccaatcggcggtcacatcttagcacacgcttctaccacgaggatcagcttgcgtaaaggaaggggagaactgagaatagccaagatttatgattctcccgagatgccagagaatgaggccacgttcgccatcacagctggtggaatcggtgacgccaaagagtag

SEQ ID NO: 28384 - DNA, 612 bp, Artificial Sequence
  Description of Artificial Sequence: Synthetic coding sequence
atgaaggaggatcaggttgttgcggaagagcccggattccaggatgaggaggagtctctgtttcaggacatcgatcttctgcagaagcatggcatcaatgtggccgacatcaaaaagctcaagagcgtcggcatctgtactattaaagggattcaaatgactacccgtcgtgccctgtgtaatgtgaaaggactttccgaggccaaggtggataaaatcaaggaggctgccaacaagctcatcgaaccaggctttctgaccgcctttgagtactcggagaagagaaaaatggttttccacatcaccaccggcagtcaggagttcgataagttactaggaggcggaattgagtctatggccataacagaggccttcggggagtttcgcacgggcaaaacgcaactgtcacacacactttgtggcgagcatcagatggagctgctggactatgtagcagccaagtttcacgaagaggccggaatattcaagcttttaatcatcgacagtatcatggccctctttagagtggatttctcggggaggggtgagctggccgagcgccaacagaagctggcccagatgctgtcacgcctccagaagataagcgaatag

SEQ ID NO: 28385 - DNA, 1599 bp, Artificial Sequence
  Description of Artificial Sequence: Synthetic coding sequence
atgaacggggtgttgatccctcacacaccaatcgctgtggatttctggagcctgaggagagccggaaccgcgcgacttttttttttatcccatatgcattcagaccacactgtgggactaagcagcacctgggccaggcctctctattgcagtccgatcacggcgcacttgctgcataggcacctgcaagtgagcaaacagtggatccaagctctggaagttggcgagtcacatgtgcttcccctggatgagatcggccaggagaccatgaccgtaacactgttggacgcaaatcactgcccaggctcagtgatgttcctttttgaaggctacttcggtactatcctctatactggagactttcgatatactccaagcatgctgaaggaacctgcgctgacactgggaaaacagatccataccttgtatctcgacaacactaattgtaatcctgcattggtcctgcctagccggcaggaggccgcacaccagattgtgcagcttattagaaaacatccgcaacataacataaaaattggtctgtatagcctcggcaaagaatccttactcgagcagctcgctctcgagtttcagacatgggtggtactctcaccaagaaggctggagctggtgcagctattgggtctagcggacgtgttcaccgtggaggagaaagccggacgcatccacgccgtggaccacatggagatctgccattccaacatgctgcgctggaaccagacccatccaacaatcgccatcctgccaacatcgcgaaagatccattcttcccatccagacatccacgtgataccttattccgaccactcatcctacagcgagctgcgcgcattcgtagccgcattaaaaccttgtcaggtggtgcccatcgtgagcaggcgtccttgcgggggattccaagattcactctccccacggatttcagtgcccctcatcccagattcagtgcaacaatacatgtccagctccagtcgcaaaccttccctgctctggcttctggagcgaagactgaagagacccagaacacaaggggttgtgttcgagtcccctgaggaaagcgcagatcagtctcaggccgatagggacagtaagaaggctaaaaaggagaaattgtctccttggccagcggacctagaaaagcagcccagccaccatcccctccgaatcaaaaaacagctcttcccagacttgtactccaaggagtggaataaagcggtaccattctgtgagtcacaaaagcgggtcaccatgctaactgcgccactcggattttcagttcacctgcggagcacagacgaggagttcatcagtcaaaagacccgagaagagattggtctcggcagtccattagtgcccatgggcgacgacgatggtgggcctgaggctacgggcaatcagagtgcatggatgggacatggtagtcccctgtcacactccagcaagggtactccgctattggctacggaattccgaggcttggcactgaagtatctgctgacaccagtgaacttctttcaggccggatatagctctcgacggtttgaccagcaggtcgagaagtaccataaaccatgctag

SEQ ID NO: 28386 - DNA, 1734 bp, Artificial Sequence
  Description of Artificial Sequence: Synthetic coding sequence
atgaaacatcaggagaggtttttattccaaggcaacaatggaactgttttgtatactggagatttcaggctggctcaaggggaggccgcacgaatggaactgctgcacagtgggggacgcgttaaggacatccaaagtgtgtacttggacactaccttttgcgacccacggttctatcagattcccagtagggaagagtgcttgtcgggtgtcctagaattggtgaggagctggatcactcgcagcccatatcatgtggtgtggctaaattgtaaagccgcatacgggtatgaatacctattcacaaacctttccgaggaactcggcgtccaggtgcacgtaaacaagcttgacatgttccgcaatatgcctgaaatccttcaccaccttaccaccgatagaaacacgcagatacacgcgtgccggcatcctaaggcagaagaatatttccagtggtcgaagctgccatgtggaattacatcacgaaatcgcattcctctgcacattatcagcatcaagccctctaccatgtggtttggggagcgaagccgcaaaacgaacgtgattgtgcggaccggggagtctagctaccgcgcatgttttagctttcactcctcctacagcgagatcaaggattttctgtcatacctgtgtcccgtgaacgcttatcccaacgtgatccctgtgggtactaccatggacaaggtggtggaaatcctgaaacctctgtgcagaagctctcagtctacagaacctaaatacaagcccctgggaaagcttaagagggccagaacagtgcaccgcgacagcgaagaggaggatgattatcttttcgatgacccgttgcccatcccactgcgtcataaggtgccgtaccccgagacattccatcccgaagtgttttccatgaccgctgtctccgaaaagcagcccgagaaacttagacagacacccggatgttgcagggccgagtgcatgcagagctctcggtttactaactttgttgattgtgaagagagcaactccgaatcagaggaagaagtgggcatccctgcctcgcttcagggggatctggggtccgtcctgcatctgcagaaagcagatggagatgtgccgcagtgggaggtattcttcaagcgcaatgacgagattacggatgagtcccttgagaatttcccatcttccacggtggccggtgggtcacagagccctaagctattctctgatagtgatggtgaatccacacacatttcctctcagaactcctcacagagcactcatattacagagcagggaagccaaggttgggattcccaaagcgacactgtgctgctgagcagccaagagaggaactcaggggatatcacgtccttagataaggccgactaccggccaactataaaggagaatatacccgcatcgctcatggaacagaatgtcatttgcccaaaggatacctactctgatctcaaatcacgggataaagacgtaacaattgtgccaagtacaggcgagccaactaccctgagttcagaaacacatatccctgaggaaaaatcacttcttaatttaagcactaatgctgacagccagtcgtcatcggattttgaagtgccatctacccctgaggcggaactgcctaagagggagcatttgcagtacctgtatgagaagctggcaactggcgaatcaattgcggtcaagaaaaggaagtgtagtctcctggacacctag

SEQ ID NO: 28387 - DNA, 255 bp, Artificial Sequence
  Description of Artificial Sequence: Synthetic coding sequence
atgtttctattccaagggaacaacggcacagtgctgtacacgggagacttcaggctggcccagggggaggccgcaaggatggagctcctgcactctggcggaagagtgaaggatatccagtccgtgtacctggacaccaccttctgcgatcctaggttctatcaaatccctagcagagaggagtgtctgagtggtgtacttgaactcgttcggtcctggattaccaggagcccgtaccacgttgtgtggctgtag

SEQ ID NO: 28388 - DNA, 1038 bp, Artificial Sequence
  Description of Artificial Sequence: Synthetic coding sequence
atggataaggtggtggagattctcaaacccttatgtaggagtagtcaatccaccgaaccgaaatataagcccctcggcaagttaaagcgtgcacggaccgtccaccgtgattccgaggaagaagatgattacctgttcgatgatccactgcctataccgctacgccataaggtcccatatcctgagacttttcaccctgaggtgttttccatgacggccgtgtcagaaaagcagccagagaagctccgccaaacaccaggatgttgcagagctgagtgtatgcagtcatcccggtttacaaattttgtagattgcgaagaatccaactctgagtccgaggaagaggttggcattcctgcatctctacagggcgatcttggaagtgtactccatctgcagaaggctgatggcgatgttcctcaatgggaggtgtttttcaagagaaacgacgaaattactgacgagtcattggaaaacttcccatcaagcaccgtggccggtggcagtcagtccccaaagctttttagcgactcagatggggagagtacacatataagcagccagaacagttctcagtctacgcatatcacagagcaagggtcccagggctgggattctcaaagtgatacagtcttgctgagctcacaggaaagaaatagcggcgacattacttcgttggataaagccgattaccgcccaacgatcaaggaaaacataccagcctccctaatggagcaaaatgttatttgcccaaaggacacatacagtgacctaaaatcaagagataaagacgtgaccatcgtgccttcaacaggtgagccgactacactgagtagtgaaacccatattcctgaggaaaaatcgttgttgaacctcagcacaaatgcggactctcagtcatcttctgacttcgaggtcccaagtactccagaggccgagttgcctaaacgcgagcacctgcagtacctgtacgagaaactggccacgggtgagagcatcgccgtgaagaaaagaaaatgtagtctgctggatacttag

SEQ ID NO: 28389 - DNA, 1734 bp, Artificial Sequence
  Description of Artificial Sequence: Synthetic coding sequence
atgaagcaccaggaaagatttctctttcagggaaataatggcaccgtgctgtatactggagacttccgtctggcacagggcgaagcagcaagaatggaactcctgcactcaggcggacgcgtgaaagatatacaatcagtttatcttgataccactttctgcgaccccaggttttatcagataccgagcagagaggagtgcttgtcgggcgtccttgagctcgtgaggagttggattaccaggagcccataccacgttgtgtggctgaattgcaaagccgcttacggatacgagtatctctttaccaacttaagcgaggagttgggcgttcaggtccatgttaataagctcgatatgttccggaacatgcctgagatactgcaccacctcaccacggacaggaatacccagatccatgcttgtcggcaccctaaggcagaagagtattttcagtggagcaaactgccctgcggcatcactagccgcaatagaattccgctgcatatcatatctataaagccttcgactatgtggtttggggaacgctcacgcaagaccaacgtgatcgtccgaacaggcgagtcgagttatagagcttgtttcagtttccactcaagctattcggaaataaaagattttctttcatatctgtgccctgtgaatgcttacccaaatgtgatccctgtgggaactacaatggataaggtggttgagatccttaaacccctctgtcgcagcagtcagagcaccgagcctaaatacaaacctctgggcaagctcaaaagggcacggacggtgcacagggacagcgaggaggaggacgattacctattcgatgaccccttgcccataccactacgtcataaagttccataccccgaaacttttcatccggaagtcttcagcatgacggcggtctcagagaaacagcccgagaaattgaggcagacacccggatgctgtcgcgcagaatgtatgcaatctagcagattcaccaatttcgtggattgtgaggaaagcaactcagaatccgaagaggaggtggggatcccggcatcattacaaggagacttggggtccgtgttgcatctccaaaaggccgatggagacgtgccccagtgggaggtgttttttaagcgaaacgacgaaataaccgatgagtctctggagaatttcccgtcaagtacagttgcaggcggatctcagtcaccaaaattattttctgatagtgacggcgaatcaacacatatcagcagccaaaactccagccagagcactcacatcactgaacaagggtcccaaggatgggatagtcagagcgacaccgtgctgctgagctctcaggagcggaacagtggggacatcacaagtctcgataaagccgactaccggccaacaattaaagaaaatatccccgcttccctgatggagcagaacgtcatctgccccaaggatacctatagtgacctcaaatcccgagataaggacgtgactatcgtccctagcaccggcgaacctaccacattaagcagtgaaacccatattcccgaggagaaatctctgctgaacttgagcactaacgccgattcacagtcgagctcggactttgaagtcccctccacaccggaggcagaactacctaaacgagagcacctgcagtacctatatgagaagctcgctaccggcgagagcatcgctgtgaagaaacgaaaatgtagccttctagatacctag

SEQ ID NO: 28390 - DNA, 1734 bp, Artificial Sequence
  Description of Artificial Sequence: Synthetic coding sequence
atgaagcatcaagagaggtttctttttcagggaaacaatggcacagtactctatacaggcgacttccgcctggcccagggtgaggcagcaagaatggagctgttgcattctgggggacgggtgaaggatattcagagtgtctacctcgatacaacattctgcgatcccagattctatcagatcccgtcccgggaagagtgtctttccggcgtgctggagctcgtgaggagttggatcacccggagtccctatcatgtcgtgtggctaaactgtaaggctgcctacggctacgagtacttattcactaacctgtccgaggagctgggcgtccaggtgcatgtcaataagctggatatgttcaggaatatgcctgagattctacaccaccttaccacagaccgcaacactcagatccacgcttgcagacaccccaaagccgaggagtattttcagtggtctaaattgccatgcggcattacaagtaggaacagaattccattacatattatctcgatcaaacccagtactatgtggttcggcgaaaggagtcgcaagacaaatgtgattgtgaggaccggagagtcttcctacagagcctgctttagcttccatagttcgtattccgagatcaaagactttctgtcgtacctgtgtcccgtgaatgcctacccaaacgtgattcctgtcgggacaacaatggataaagtcgtggaaatcttgaaaccattgtgccggtccagtcagtccactgagcctaaatataagccactgggcaagctaaagagagccaggactgtgcaccgcgattccgaggaagaagatgactacctttttgacgatcctctgcctatcccactgaggcacaaggtgccttatcctgagacctttcatcctgaagtcttttctatgaccgcagtatcagaaaagcagccggaaaaactgcggcagacccctggatgttgccgagcagagtgcatgcagagtagtagatttacaaactttgtcgattgtgaagaatccaactccgaaagtgaagaagaggtaggcatccctgcctcactccagggcgatcttgggtctgtactgcatcttcaaaaggcagatggggatgtgccccaatgggaggtgttttttaaacgcaacgacgaaatcactgacgagtcacttgaaaacttcccaagcagtaccgtcgccggtggtagtcaatctcctaagctttttagtgactcggacggtgaatccacccacatctcctcccagaattcatctcagtctacccacatcacagagcagggcagccagggttgggactcgcaaagcgacactgtgctgctcagttctcaagagcgaaattctggcgatattacatcattagataaagccgattatcggccaaccattaaggagaacattcccgcatctcttatggagcagaatgtcatctgccccaaggatacgtatagcgacctgaagtcccgagataaggatgtcacaatcgttcccagcacaggggagcccactacgctgtctagcgagacccacatacctgaagagaaatccctgctcaatctatccactaacgcagactcgcagagctcttcagattttgaggtcccatccacgcccgaggctgagttgcccaagcgcgagcacctgcagtatctatatgaaaaactcgctacaggcgagagcattgcagtgaaaaagcggaagtgctctctgctcgatacctag

SEQ ID NO: 28391 - DNA, 1719 bp, Artificial Sequence
  Description of Artificial Sequence: Synthetic coding sequence
atgtttctctttcagggaaacaacggcacggtcctgtataccggtgactttaggctggcccaaggagaggccgctcgcatggaattactgcattcaggaggtcgcgtcaaagacatccagtctgtttacctagatacaacgttctgtgatccaagattttaccagatcccctctcgagaggagtgtcttagcggcgtgctagagctggttcgaagttggatcacccgatctccataccatgttgtgtggctcaattgtaaggccgcatacgggtatgagtacttatttacaaatctgtcagaggagctgggtgtgcaggtccacgtgaacaagctcgacatgttccgaaacatgcctgagatcttgcatcatctcaccaccgatagaaatacccaaatccacgcttgtcgacaccccaaggccgaagagtactttcaatggtccaagctgccttgcggcataacctctcgaaataggatacctctccacatcatcagcattaaaccctcaaccatgtggtttggggagcgtagcagaaagaccaatgtgatagttcggactggtgaaagttcctatcgggcatgtttcagctttcacagcagttacagtgagataaaggattttctctcatatttgtgtccggtcaatgcataccccaatgtgattccagttgggacaacaatggataaggtggtagagattctgaaacccctgtgtagaagcagccaaagcactgaacccaagtataaacctcttggaaagctgaagcgcgctcgcaccgtgcacagagattccgaagaagaagacgattatcttttcgacgatccattaccaattccgttgaggcacaaggtgccgtaccctgaaacttttcatcccgaagtcttcagcatgaccgctgtctccgagaagcaacccgagaaactcaggcaaactcccggatgttgccgagccgaatgcatgcagtcaagcagatttactaacttcgtggactgcgaggagagtaactcggagagcgaggaggaagtcggcatcccagcctccctgcagggcgacctgggaagcgtgctgcacttgcaaaaagctgacggcgacgtaccccagtgggaggtgttcttcaagagaaacgatgagattacggacgagtcccttgaaaacttcccgtcctctaccgtggccggaggctcccagtccccgaagctcttttctgactctgatggcgagtccactcacatcagctcgcagaactcctcccagagtacccatattaccgagcagggctcacagggctgggactcccaaagtgacactgtcttgcttagctcgcaagagcgaaactctggcgatattacatctctcgacaaagccgactaccgccctaccattaaggagaacattcctgcaagtttaatggaacagaatgtgatttgcccgaaggatacttattcagatttgaaaagtcgtgacaaggatgtgactattgtccctagcacaggcgaaccgacgacactatcaagcgaaactcatatccctgaagaaaagtcactcctgaaccttagcactaatgctgactcccagagtagtagtgattttgaggtcccaagcactcccgaggcggaactccccaagcgggaacatttgcagtacctctacgaaaaactggctaccggcgagtccatcgccgtcaaaaagagaaaatgctcactcctggatacttag

SEQ ID NO: 28392 - DNA, 1719 bp, Artificial Sequence
  Description of Artificial Sequence: Synthetic coding sequence
atgttcttatttcagggcaacaatggcactgtgctgtataccggggatttcaggctcgcccagggagaagctgcccgtatggaactattacatagcggcggaagagtgaaggatatccagagtgtgtacctggacaccactttttgcgacccccgtttctaccaaatcccatctcgggaggagtgcctctctggtgtcttggaactcgtgcgatcctggataactcgaagtccctatcatgtggtgtggcttaattgtaaggcagcttacggatatgaatacttgttcaccaatctcagcgaagagctgggggttcaagtgcatgttaacaagctcgacatgtttcggaacatgcccgaaatcctccaccacctcaccactgacagaaacacgcagattcacgcctgccgacatcctaaagctgaagagtatttccagtggtccaaactgccctgcggtataaccagtagaaaccggatccctcttcacattatatccattaaaccgagcacaatgtggtttggcgagcgcagtcggaagactaatgtgatagtgaggaccggggaaagctcataccgggcatgcttcagttttcattcttcctattctgagatcaaggacttcttaagctacctgtgtcctgtcaacgcgtacccaaatgtgattcccgtgggcaccactatggataaggtggttgagattctgaaacccctgtgcaggtcaagccagagcaccgagccaaaatacaagccgctaggcaagctaaaacgcgcacggactgtccaccgggactccgaagaagaagacgactacctcttcgatgatcctctgcctattccactccggcataaggtgccgtacccagagacgtttcacccagaggtctttagcatgacagccgtcagcgagaaacagccagagaagctcagacagacgcctggttgttgtagagccgagtgcatgcaaagctccaggtttaccaacttcgtggattgtgaagaaagtaattcagagagcgaagaggaggtggggatcccggctagtctccagggggatctgggtagtgttctgcacctacagaaagctgatggcgatgtgccacagtgggaagtgttcttcaagcgaaacgacgagattactgacgaaagcctcgaaaattttccctctagcaccgttgctggcggaagtcagtcaccgaaactgttctccgatagcgatggggagagcacccatatttccagccagaactcctcccaatctacacacataacagaacaaggatcacagggatgggactcccagtctgacactgtgctcttgtcctcacaggagaggaattccggtgacatcaccagtttagacaaggctgactatagaccgacaattaaggagaacataccagctagcctcatggagcagaacgttatctgtcccaaagatacgtactctgatctgaagtcaagggataaagacgtgactatcgtgcctagcacaggggaaccgacaacgttgtcctcagaaacccatatccccgaggagaagtccctgctgaatctatctaccaatgccgactcccaatccagtagtgacttcgaggttcccagcactccagaagccgaactcccaaaaagggaacacctgcaatatctctatgagaaactggccactggtgagtctattgccgtaaagaaaagaaaatgtagcctcttggatacctag

SEQ ID NO: 28393 - DNA, 1719 bp, Artificial Sequence
  Description of Artificial Sequence: Synthetic coding sequence
atgttcctgttccagggtaacaatgggactgtcctatacacaggggacttcagattggcccagggagaggctgccagaatggaactgttgcactcaggaggcagggtcaaggatattcagagcgtgtacctagatacaaccttctgtgaccccaggttttaccagatcccaagcagagaagaatgcttatcaggggtcctcgagctcgtcaggtcttggatcacacggtcaccataccatgtggtttggctgaactgtaaagctgcttatggctacgaatacttattcaccaatctctccgaagagctgggcgtgcaggtccacgttaacaagcttgatatgttccgcaacatgcctgagatcctgcaccatttgacaaccgatcgcaatactcagatacacgcttgtaggcaccccaaagctgaggagtatttccaatggtcaaaactgccgtgtggaattacctcaagaaacaggattcccctccatatcattagtatcaaaccatccaccatgtggtttggggagcgcagtagaaagactaacgtcattgttcgaacgggtgaatccagctatcgggcttgcttctccttccattcttcttacagcgagatcaaagattttttgtcctatctgtgtcccgttaatgcgtaccctaacgttattcccgtcggcactaccatggataaagtcgtcgaaatccttaagcctctgtgtagatcaagccagagcacagagccgaaatacaagccgctcggtaaactgaagcgcgctcggactgtccatagggactccgaagaagaagacgattatctgttcgatgatcccttgcctattccactgagacacaaagtcccttaccccgagacctttcatcctgaggtttttagtatgacggccgtgagcgaaaagcagccagaaaagctcaggcagacaccaggctgttgccgtgcagagtgtatgcagtcttcacgctttaccaacttcgtggactgcgaagagtcaaattctgagtccgaagaggaggtaggtatccccgcatcactgcagggcgacttgggaagtgttctgcaccttcagaaagcggatggtgacgtcccacagtgggaagtcttcttcaagagaaatgacgagatcacagatgaatcactcgaaaactttccaagctccacggtggccggaggctctcaatctccaaagctgtttagtgacagcgacggggagtctacccatatctctagtcagaactcaagccagtccacacatattacagagcaaggctcacagggctgggactcacagagtgatacagtactgctctcttcccaggaaagaaactccggcgatatcacatcattagacaaggcagactatagacctaccatcaaggagaacattcccgcatcattaatggagcaaaacgtcatctgtccaaaggacacgtattctgatttaaagtcccgcgataaggatgtgaccattgttcctagtacgggagagcctacgaccctctcctcagagactcatattccagaggagaagagcctgctcaacttgtctacaaatgctgatagccagtcaagctccgactttgaggtcccttccactcccgaggcagagctgcccaaaagagaacacttacagtacctttacgagaaattagctaccggagaaagcatcgccgtaaaaaaaagaaagtgtagcttgttagatacctag

SEQ ID NO: 28394 - DNA, 2079 bp, Artificial Sequence
  Description of Artificial Sequence: Synthetic coding sequence
atgtcttcgttcgaaggccagatggccgagtatccgactatcagcattgacaggttcgaccgtgaaaacctgcgagccagagcttattttctttcccactgtcacaaggatcatatgaagggcttaagagcgcctaccttgaagagacgactcgaatgctcactaaaagtttacctatactgctctcctgtgactaaggagttgttgctaaccagcccaaagtatcgtttttggaagaagcgcattataagtatagaaatcgaaacccccacacagatcagcctggtcgacgaggcctccggggaaaaagaggagattgtagtgacacttttaccagccggacattgccctggctcagtcatgttcctgtttcagggcaacaacgggactgtgttgtatacaggagatttcaggctcgcccagggcgaggcagcgagaatggagctactgcacagtggcggtcgtgtgaaagatatccagtcagtgtacctggataccacattttgcgacccgcgattctatcaaatccccagccgcgaagagtgtctgagtggggtcctggagttggtgaggtcttggatcacaaggtctccataccatgtcgtttggctgaactgcaaagccgcttacggctacgaatacttatttactaatctaagcgaagaactgggggtgcaagtgcacgtgaacaagctggatatgtttaggaacatgcctgagatcctccaccatctgactactgaccgcaacacccaaattcacgcatgtagacacccaaaagcggaggagtattttcagtggtccaaactgccttgcggcattaccagccggaaccgcatcccgctgcatatcatctctataaaacccagcactatgtggtttggggaacggagcagaaagaccaatgttatcgttcgaaccggtgagtcatcttatcgcgcatgcttttctttccactcatcttattctgagataaaagactttttgtcgtacctgtgtccggtgaacgcgtacccaaacgttatccctgtggggacaactatggacaaagtggtcgaaattttgaagccgttgtgtaggtcatcacaatccacggaacccaaatataagccactcggtaaactgaagcgtgcgaggaccgtgcacagggactccgaagaggaagatgactacttattcgacgaccccttgcccatacccctgcggcacaaggtgccctatcccgagacctttcatcctgaggtattctcaatgactgccgtctcggaaaaacagccagagaagctgcgtcagacccccggttgctgccgtgccgagtgcatgcagtcctccagattcaccaacttcgttgactgtgaagaatccaactccgaatctgaagaggaagtgggcatccccgcatccctgcagggagatctcggaagtgtgctccacttgcagaaagctgatggagatgtgccccaatgggaagtattttttaaaaggaatgacgaaataactgacgagtccctggaaaactttccttcttccacagtggctggcggttctcaaagcccgaaacttttcagcgacagcgatggcgagagcacccatatcagtagccaaaattcttcccagtccactcacattacggagcagggaagccagggatgggattctcaatctgacacagtgctgttgtcaagtcaggagcgaaattccggagacattacatcgctggataaagccgattaccgccctacaatcaaggaaaatattcctgcatccctgatggaacagaacgtgatctgtccgaaagacacatattccgacctcaagtcccgcgacaaagacgtgaccattgtgcccagcactggggaacctacgaccctcagttcagagacacacataccagaggagaagtctcttcttaatttgagtactaatgctgactctcagtctagcagtgactttgaagttcctagtacccctgaagcggaacttcccaaacgggaacatctccagtacctgtacgaaaaactggctaccggggagtctatcgccgtgaagaaaagaaaatgctcgctgctggatacttag

SEQ ID NO: 28395 - DNA, 1305 bp, Artificial Sequence
  Description of Artificial Sequence: Synthetic coding sequence
atgtcctcctttgaaggccagatggctgagtatcctaccatcagtatcgataggtttgatcgcgagaacctacgcgcaagggcctactttttaagccattgtcataaggaccacatgaaagggttgcgggctcctacgttaaagcgaagattggagtgttcactgaaggtctacctgtattgctctccagtgaccaaggaactcctgttaacctcaccaaagtacaggttttggaaaaaaagaataatttcaatcgagattgagacgcctacccagatctctctggttgacgaggcctctggggagaaagaggagatcgttgttactttgctgcctgccggacactgtcccggatctgtgatgttcttgttccagggcaacaatgggacagttctgtatacaggcgattttcgactggcccagggagaagcagccaggatggagttgcttcacagtggaggtcgcgtgaaggatatccaatcagtttatctcgataccaccttctgtgaccccaggttctaccagatccccagtagagaagagtgcctgtcaggcgtgctcgaactggtcagaagttggatcacaagatctccataccacgtagtgtggctaaattgcaaggccgcatacggatacgaatacctgttcaccaatctgagcgaagagctcggtgtgcaagttcatgtaaacaagctggacatgttcagaaacatgccagagatactccatcacctgaccaccgataggaatacacagatccacgcttgcaggcatccaaaggccgaggagtactttcagtggtccaaactgccctgtggcatcacttcaagaaacagaattcctctccacatcatctcaattaaaccatctaccatgtggtttggagaaaggtcaaggaagaccaacgtaatcgtgcggactggcgagtcctcttacagagcttgcttttcatttcatagtagttatagtgagatcaaggactttctgtcctacctctgccctgtaaacgcttacccaaatgtaataccagttggcacaacaatggacaaagtggtcgagattttaaagcctctgtgtcggagctcacagtcaaccgagccaaagtataagcctttgggaaaacttaaaagggcccgtacggtgcaccgcgattccggatcgcattctgtgacacaggctcgcatgagatggtgtcatcacgacagtctgtaccccttaacccccggtattaagagatctagctgtctgtccctcctgacctcctggatcaccggagcataccgacatgcacagctgatgatttag

SEQ ID NO: 28396 - DNA, 1719 bp, Artificial Sequence
  Description of Artificial Sequence: Synthetic coding sequence
atgtttctgttccaggggaataacgggaccgtgttgtataccggagatttccgattggctcaaggcgaggcggctcgcatggagctcctgcactccgggggtcgggtgaaagacattcaaagcgtgtacctggacactaccttttgtgacccacgattctaccagattccctccagggaagagtgtctgtccggggtgctcgagctcgtgcgctcctggatcaccaggagtccataccatgtcgtctggctgaactgcaaggccgcttacgggtacgaatatctgttcaccaatttaagtgaggaactcggcgttcaggtacacgtcaacaaactggacatgtttagaaatatgcccgaaattctccaccatttgactaccgacagaaatactcagatccatgcctgtcgtcaccccaaggccgaagaatactttcagtggagtaagctgccatgtggaattacatccaggaatcgtataccattacatatcatttcaattaagcctagcactatgtggttcggggaacgcagtcgaaagaccaatgtgatagtgcgcactggagagtcatcatatagggcttgcttctccttccactcatcttacagtgagataaaggactttttatcctacctttgcccagtgaacgcctatccaaacgtgatacctgtcggcacaacaatggacaaagtggtcgagatactgaagccactctgccgttcctcacagagcactgagcctaagtataagcccctaggcaagctaaagagggcaagaaccgtccatagagactctgaggaagaagacgattatcttttcgacgaccccttacccattccccttaggcacaaagtgccttatccagagactttccaccctgaggtgttttcgatgaccgctgtgtctgaaaaacagccagagaagttgcggcagaccccaggctgttgccgggcagaatgcatgcaatcctctcgtttcacgaattttgtagactgcgaggagtccaactcagaaagcgaggaagaagttggaattcctgcttccctccagggagatcttggatccgtcctgcacctccaaaaagcagacggcgacgtgcctcagtgggaggtgtttttcaagcgcaatgatgagatcaccgacgagagcctggaaaatttccccagttcaacagtggctggaggctcgcagtctcccaagctgttctccgactctgatggcgagtccacacacatcagcagtcagaactcctcccagagcactcacatcacagagcaaggctctcagggttgggactcccagagcgacacagttctgcttagttctcaggaaagaaactcaggggatatcacaagccttgataaggccgactatagaccaacgattaaggagaacatcccagcaagtctcatggagcaaaatgtaatctgtcctaaagacacctacagcgacctgaagtctagggacaaagacgtgactatcgtccccagtaccggcgaaccaacaactctgagtagcgagacccacatacccgaagaaaagtctctgctgaatctctcaacgaatgccgactcgcaatccagctcagattttgaagtacccagcaccccagaagccgaactgcccaagagagaacatttacagtatctgtacgagaaactggcgactggagagagtattgccgtgaagaagcggaagtgctccttgcttgacacctag

SEQ ID NO: 28397 - DNA, 354 bp, Artificial Sequence
  Description of Artificial Sequence: Synthetic coding sequence
atggagctactacattctggaggcagggtgaaagacattcagagcgtgtatctggatacgacattctgcgaccccagattttatcagatcccttcccgggaggagtgcctgagtggagttcttgaactggtgcggtcatggattacacggtcaccatatcacgtggtctggctgaactgcaaagccgcttacggctatgagtatttgtttacaaacctatctgaagagttaggggtgcaggtccacgtcaataagctggacatgttcagaaacatgcctgagattctacaccaccttaccaccgatcgcaacacgcagattcacgcctgcagacacccgaaggcggaagagtag

SEQ ID NO: 28398 - DNA, 1719 bp, Artificial Sequence
  Description of Artificial Sequence: Synthetic coding sequence
atgtttctcttccaaggcaataacggcaccgtgctgtacacaggtgattttcgcctggcccaaggagaggctgctagaatggagctcctgcatagcggaggtcgcgtcaaggatatacagtccgtctacttagacaccactttttgcgatccaagattctatcagatccctagtagggaggagtgcctctcgggagtccttgagttagtccgctcctggattacaagatcgccttaccacgttgtgtggttaaattgcaaggcagcttacggctatgaatatctgtttacaaatctgagcgaggaactcggggtccaggtgcatgtaaataagttggatatgtttcggaacatgccggagattctgcaccacctgaccacagaccgcaatactcagatccacgcatgtcggcaccctaaggccgaagagtacttccagtggtcaaaactgccctgcggcatcacttcccggaatcggatccctctgcatattatatccataaagcccagcaccatgtggttcggagagcgctctcgtaagactaatgtgatcgtccgaacaggagagtcctcctaccgagcttgtttttcctttcattcctcttattctgaaataaaagatttcctgtcctatttgtgtcccgttaatgcctatccaaatgtgattccagtcgggaccacaatggataaagtggtagaaattctgaagcctttatgcaggtcttcgcaaagcacagaacccaaatataagccactgggtaagctgaaacgggcacgcacagttcatcgggacagcgaggaggaggatgactacctgttcgacgatcctctgcccatcccccttaggcacaaagtgccatacccagagacgttccacccggaggtcttctcaatgacggcagtgagcgagaaacagccggagaaactgcggcagacgcctgggtgttgtcgggcagagtgcatgcaaagttcccgcttcacaaattttgtggattgtgaggagagcaactccgagagcgaagaggaagtggggataccagcgagtctgcaaggggacctgggcagtgtgttacatctgcaaaaggcggatggcgatgtgccccagtgggaggtgttcttcaagcgcaatgatgagatcactgatgagagtctggagaactttccaagctcaaccgttgctggaggtagccagtcacctaagctcttctccgattctgatggggagagcacacacatctcttcgcagaattccagccagtcgactcatatcactgaacaaggttctcagggctgggatagtcagtccgataccgttctcttaagtagccaagaaagaaattcaggagacattacatccctagataaggctgactatcgaccgacaatcaaagagaatatccccgcatccttgatggaacagaacgtgatctgccctaaggacacttacagcgaccttaagtctcgcgacaaggatgtgactattgttccttctactggagagccaacgactctttcgtccgaaacacacatccctgaggagaaaagcctgcttaacctatctaccaacgccgatagccagtcctccagcgattttgaagtgccaagcacccccgaggcagaactgcctaagcgggaacatctgcagtacctttacgaaaaactggcgactggagaatcaattgcagtaaagaaaaggaagtgctccctgttagacacttag

SEQ ID NO: 28399 - DNA, 174 bp, Artificial Sequence
  Description of Artificial Sequence: Synthetic coding sequence
atgaaacaccaggagcgattcctgttccagggaaacaacggaaccgtgttgtacacgggagacttccggttggcccagggcgaagctgcccgaatggagttgcttcacagtggtggccgagtcaaggacattcagagtgtgtatcttgacacaaccttttgtgatccgaggtag

SEQ ID NO: 28400 - DNA, 807 bp, Artificial Sequence
  Description of Artificial Sequence: Synthetic coding sequence
atggaagtgactggtgatgcaggggtgcccgaatcaggcgaaattaggacactgaaaccatgcttactgaggcgaaactattccagagagcagcatggggttgccgctagttgcctggaggatttgcggtcaaaagcctgcgacatcctcgccattgacaagtccctgacaccggtgacgctggtactggccgaagatggcactattgtggatgatgacgattacttcctgtgcttgcccagcaataccaaattcgtggccctggctagcaacgaaaagtgggcctataacaacagtgatggtggcactgcctggatttcccaggaaagttttgacgtcgacgagaccgattcaggagcagggttaaagtggaaaaacgtcgcgaggcagttaaaagaggatttaagttcgatcattctgctcagcgaggaggatcttcagatgctggtggatgcaccctgctcagaccttgcccaggagcttaggcaaagttgtgccacagtccagaggctccaacatacgctccaacaggtcctcgaccaacgcgaagaagtgaggcagtccaagcaactgctgcaactgtatctccaggctcttgaaaaggagggctctctcctgagcaagcaggaggagtcaaaggccgcattcggggaggaggtagacgcagtcgacactgggataagtcgggaaacctcctccgacgtggcactagcgtctcacattctgacagccctgcgcgaaaagcaagcacctgagctgtccctgagctcacaagacctggaagtaggaggaaaccagggccattag

SEQ ID NO: 28401 - DNA, 996 bp, Artificial Sequence
  Description of Artificial Sequence: Synthetic coding sequence
atggaggtgactggggatgccggtgtgccagagagtggggaaatccgcacgttgaagccttgtctgctacggcgaaactacagcagagagcaacacggtgtggcagcatcatgtctagaggacctgagaagcaaagcttgtgacatcctggctatcgataaaagtctcactcccgtaacactggtactggccgaggatggaactatagtggacgacgatgactatttcctctgcctgcccagcaacaccaagttcgtggccctcgccagcaatgaaaagtgggcctataacaattctgacgggggtactgcgtggatctcccaggagtcctttgacgttgatgagacagactcgggcgctggccttaaatggaaaaacgtggctcgccaactgaaggaagatctgagtagcatcatactcctgtccgaggaggatttgcagatgctcgtggatgccccttgcagcgatctggcccaagaactcagacagtcctgcgcgactgtccagaggctccaacacacccttcaacaggttctggatcagcgagaggaggttcggcaatccaaacagttgctgcaactctacctgcaggccctggagaaagagggcagcctgctttcaaaacaggaagagtctaaggctgccttcggcgaagaggttgatgccgtagacaccggcatatcacgggagacatccagtgacgtggctcttgcttcccacatactgacggctctacgagagaaacaggcccctgaactgtctctctcgtctcaagacctggagttggtgacaaaagaggaccccaaggctctggctgtagctcttaactgggatattaaaaagaccgaaacagtgcaggaggcctgtgagagggagctggccctgaggctgcagcagacgcaaagcctgcatagtctgcgaagcatatctgcgtctaaggcctctcctcccggtgatcttcagaaccctaagagggctcgccaagaccccacatag

SEQ ID NO: 28402 - DNA, 510 bp, Artificial Sequence
  Description of Artificial Sequence: Synthetic coding sequence
atggcagctgaatctctgcccttctccttcgggacactgagttcctgggaattagaggcctggtacgaagacttgcaggaagtgctgtccagcgacgagaacggcggaacctatgtgagtcctcccggtaacgaggaggaggagagtaaaatattcaccactcttgaccccgcttctctggcttggctgacagaggaggaacccgagccagccgaggtgacatcaacctcccagagcccacacagtccagactcgagtcagtcctcactggctcaggaggaagaggaggaggaccagggcagaacccgcaagaggaagcaatctggccatagccccgcacgcgcagggaagcagcgtatgaaagagaaggagcaggaaaacgagcgaaaggtcgcacagctggctgaggagaatgagcgcctaaagcaggagattgaaaggctgaccagagaggtggaggcaactcgcagggccctcatcgaccgcatggtgaacctacatcaggcgtag

SEQ ID NO: 28403 - DNA, 510 bp, Artificial Sequence
  Description of Artificial Sequence: Synthetic coding sequence
atggctgccgaatcactgcccttctcattcggaactctgagtagctgggaactggaagcctggtacgaggacttgcaggaggtcctgtcttcagacgaaaatggcggtacctatgtcagtccccctggaaacgaggaggaagagtccaagatcttcacaacattggacccagcaagtctcgcttggctgacagaggaggagcccgagcccgctgaggttacatccacttcgcagtctccccactcccctgacagcagccaatctagcttagctcaggaagaggaggaagaagatcaggggcgtacaaggaaacgcaagcagagcggccattctcctgccagggcaggaaagcaacgaatgaaggaaaaagaacaagaaaacgaaaggaaggtggcgcagcttgcagaggaaaacgagcgattaaagcaagagatcgagcgactgaccagagaagtggaggctacaaggcgggcactgattgatcgaatggtgaacttgcaccaggcctag

SEQ ID NO: 28404 - DNA, 438 bp, Artificial Sequence
  Description of Artificial Sequence: Synthetic coding sequence
atggaactcgtgcctgctactccacactacccggcagatgtgctgtttcagacagacccaaccgccgagatggcggctgaatcattaccttttagctttggcacactgagtagttgggagttggaagcatggtatgaggacctgcaagaggtactcagctctgacgaaaacgggggtacttacgtgagcccacctggcaatgaagaggaagagtccaaaatctttacaactctggaccccgcatcgctggcttggttgactgaggaagaacctgaacccgcagaagtgaccagtactagccaaagcccacactctcccgactcctcgcagtctagtctggcacaggaagaggaagaggaggaccagggtagaaccagaaaaaggaagcagtcaggacacagccctgcaagggccggaaagcagagaatgaaagaatag

SEQ ID NO: 28405 - DNA, 579 bp, Artificial Sequence
  Description of Artificial Sequence: Synthetic coding sequence
atggaattggtgccagccacgcctcactatcctgccgacgtgttatttcaaaccgaccctactgctgaaatggctgctgaaagtttacccttttcgttcggcaccctctcttcatgggaacttgaagcctggtacgaggacctgcaagaagttctctcttctgatgagaatggtggaacttacgtgtctcctcccggtaatgaggaagaggagtccaagatcttcactacccttgaccccgcttctttggcctggctgaccgaggaggaaccagagcccgctgaagtgacatctacctcacagagcccccattccccagactcctctcagtcatctctggcccaggaagaagaggaagaggatcagggcaggacccgcaagaggaaacagtctggacactccccagctcgcgcaggtaaacagaggatgaaggagaaggaacaagagaacgagcggaaggtcgcccagctggctgaagagaacgaacgcttaaaacaggaaatagagcgcctgactcgggaagttgaggctacccggcgtgctctgattgaccgtatggttaatctgcaccaagcctag

SEQ ID NO: 28406 - DNA, 579 bp, Artificial Sequence
  Description of Artificial Sequence: Synthetic coding sequence
atggagctagtgcctgcaaccccacactatcccgctgatgtccttttccagaccgatcctacagccgagatggcagcagaatcccttccatttagtttcggcacactttcatcctgggaattggaggcttggtacgaagatttacaggaggtcctgtcttctgatgagaatggcggaacttacgtctcacctccaggtaatgaggaagaggagtctaagatttttacaactctggaccctgcaagcctcgcatggctgaccgaggaagaaccagagccagcagaggtcacatcaacaagccagtctccccacagcccagactcctctcagtcctcgctcgcccaagaagaagaggaggaggatcagggacgcaccagaaaaagaaagcagtcgggacactctccagctcgcgctggcaagcagaggatgaaggagaaagagcaagaaaacgagcgaaaggtggcccagctagctgaagaaaatgaacgcctaaagcaggaaattgaacgcctgacaagggaagtggaagctacgcggcgtgccttgattgaccggatggtcaacctccaccaggcttag

SEQ ID NO: 28407 - DNA, 864 bp, Artificial Sequence
  Description of Artificial Sequence: Synthetic coding sequence
atggcctccctggaggtgagcagatctccaaggcgcagccgccgtgagctcgaagtgaggtctccacgacagaacaaatatagcgtgctgctaccgacatataacgagcgggaaaatctgcccctaatagtttggctgctcgtgaaatccttctctgaatccggcattaattatgaaattattataatagacgacggatctccagacgggacaagagatgtcgctgagcagctagagaaaatttacggctctgataggattttgttaaggccaagagagaagaagctgggtcttggaacagcctacattcatggcatgaagcacgctacaggcaattacattatcattatggacgccgaccttagtcatcacccaaagttcatcccggaattcatccgtaaacagaaagaaggcaacttcgatatcgtgtctggcaccagatataagggcaatggtggcgtctacggctgggaccttaaaagaaagatcatcagtgacggcgtcctcccttgttgccctggctggtctctcctaggatccagtgatcccgctatcctggccagttgggactactcccggggtgccaatttccttacccagatcctgctgcgtcctggagcttctgatctcacaggtagctttagattgtaccgaaaggaggtactggagaaacttattgaaaaatgtgtctcaaagggctacgttttccagatggagatgattgttagggcaagacagctgaactacacaatcggtgaggtgccaatctcttttgtggacagagtgtatggagaatcaaagcttgggggtaacgaaatcgtctcctttcttaaaggactgttgactttatttgcaacaacatag

SEQ ID NO: 28408 - DNA, 768 bp, Artificial Sequence
  Description of Artificial Sequence: Synthetic coding sequence
atggcctccttagaggtgtccagatcgccacgacggtcccgccgtgagctggaagtacgctcccccagacaaaataaatatagtgtcttactgccgacctataacgagcgggaaaacttgcctcttatcgtttggctgctggtgaagagtttctctgaatctggcattaattacgagattataataatcgatgacgggagtcctgacgggacccgtgatgtggccgagcagctcgagaagatttacggatctgataggatactcctgcgccctagagagaaaaagttggggttgggcactgcctacatacacggtatgaagcatgcgaccgggaactacattatcattatggatgcggacctctcacaccaccccaagttcattccagagttcatctccgacggcgtccttccttgttgtccaggctggtctctgttgggcagttccgaccctgctattctagcctcctgggattactcaaggggcgcaaactttctgacacagatacttctacgtcccggagcgtccgacctcaccggaagtttccggttataccggaaggaggttctggagaagctgattgaaaaatgtgtttccaagggctacgtttttcagatggagatgattgtgcgggcaagacagttgaattacactataggcgaagtgcctatttcattcgtggaccgcgtttacggggagagtaagctgggcggtaacgaaattgtctcatttctgaagggcctgctgacactcttcgcaaccacttag

SEQ ID NO: 28409 - DNA, 888 bp, Artificial Sequence
  Description of Artificial Sequence: Synthetic coding sequence
taggcaagtctggaagtctccaggtctcctcgaaggtcacgcagagagttagaggtgcgatccccacgacagaacaaatattcagtgctgctgcctacctacaacgagagagaaaacttgccacttatagtttggctgttggtgaaatcctttagcgagtcaggcattaactatgagatcatcatcatcgatgacgggtctcctgatgggactcgggacgttgctgagcaactggagaagatctacggtagcgataggatcctcctgaggccaagggaaaagaaactggggcttggcactgcttatatccatggtatgaagcacgctacgggcaattatattattataatggacgccgatttgagccaccaccctaagttcattcctgaatttatcaggaaacagaaggaagggaatttcgacatcgtgtccggaacccgctataaggggaacggcggagtctacgggtgggatctgaaaagaaagatcatttccgacggtgtcttgccttgctgtccgggatggtcattgctggggtcaagtgaccccgcaattctggctagctgggattataggtgtgagcctcctaggctggctagccggggtgcaaacttcttgacccaaatcctgttgaggcccggagcaagtgatctcacagggtccttcaggttatacaggaaagaggtcctcgaaaagctcatcgagaagtgcgtttctaaagggtacgtctttcagatggagatgatcgtgcgggctagacaactgaattatacaatcggagaagtacccatttcgtttgtggaccgcgtgtatggggaatcgaagctgggtggaaacgagatcgtgtcattccttaagggtcttctgacactgtttgccacaacttag

SEQ ID NO: 28410 - DNA, 783 bp, Artificial Sequence
  Description of Artificial Sequence: Synthetic coding sequence
atggcctcactggaggtctcccggtcaccaagacggtcccggagagaactcgaagttcggagtcctaggcagaacaagtattccgtgcttttgcccacatacaacgaacgagaaaacttgcccctgattgtatggttgcttgtgaagagcttcagtgagtcagggataaattacgaaataatcattattgatgacgggtcccctgatgggacccgcgacgtcgccgagcaactggagaaaatttatggatcagatagaatcctgttacgcccaagagagaaaaagttgggcctggggaccgcctacatacatgggatgaaacatgccacaggaaattacattatcataatggatgccgacctttctcaccatcctaaatttattcccgaatttatccgaaagcaaaaagaaggaaacttcgacattgtatctggaacgcgctataagggcaacggtggtgtttacggatgggatctgaaaagaaagatcataagccgcggagccaacttcctgacccaaattctgctgagacctggagcttctgacttgaccggcagcttccgtttataccggaaggaagtgctggagaagctgatcgaaaaatgtgtttctaagggatacgtgtttcagatggagatgattgtgcgcgcacggcagctgaattacaccatcggggaagtgccaatctcttttgtagaccgggtatacggggagtcaaaattgggaggaaacgagatcgtcagctttctgaaaggattgctcacgctgttcgccacaacttag

SEQ ID NO: 28411 - DNA, 666 bp, Artificial Sequence
  Description of Artificial Sequence: Synthetic coding sequence
atggccagcctggaggtgtccagatcaccacgcaggtccaggcgggagctggaggtgcggtcccccaggcaaaataaatattcagtgctgctgcccacatataacgagcgcgagaaccttccattgattgtttggctgctcgtgaaatcattcagcgaatccggcattaactacgaaatcataatcattgatgatggtagccccgacggcactcgggacgtggctgagcagctggagaaaatctatggcagcgaccgcatcctgctgcgacctcgcgagaaaaagctcgggctgggcacagcgtacattcatggcatgaagcatgctaccggcaattacataattatcatggacgctgacttgtcccatcacccgaagtttattcctgaattcatcagcgacggagtcctcccatgttgccccggatggagtttgctcggcagctcggaccctgctatcctggcgtcgtgggattatagccggggagctaatttccttacccagatacttctgaggccaggggcttctgacttaacaggctcctttcgcctctatagaaaagaggtcctagaaaagctcattgaaaagtgtgtgtccaagggttatgtgtttcaaatggaaatgatagtgagggcacgccagctcaattatacaataggcgaatag

SEQ ID NO: 28412 - DNA, 888 bp, Artificial Sequence
  Description of Artificial Sequence: Synthetic coding sequence
atggccagtctggaagtttccaggagtcccagaagatctaggcgagagctcgaggtgaggagtccaagacagaacaagtattccgtccttttgccaacctacaacgagagggagaatctgcccctgatcgtatggttactagtgaaaagcttctccgagagtggcatcaactatgagattattattatagatgatggcagtcctgacgggactagggatgtggccgagcagttggagaagatctacgggtcagataggatcttgttgcgacccagagagaagaagctaggcctaggtactgcatatatccatggcatgaagcatgcaacaggcaattacattatcataatggatgcagacctgtcccaccaccccaaatttatccccgagttcatacgtaaacaaaaggagggcaacttcgacatagtgtccggtaccagatataaaggaaacgggggagtatacggatgggatctcaagaggaagattatctctgacggcgttctcccgtgttgtcccggatggagtctgctcggatcaagtgatcctgcgattctggcctcatgggactataggtgtgaacctccccgacttgcaagcaggggtgccaatttcttgacccagatactactgcgcccaggagctagcgacttgactggctctttcaggctctaccgtaaagaagtgctggaaaagctgatagagaagtgcgtctcaaagggatacgtgttccagatggagatgatagtcagggctaggcaactaaactataccatcggtgaggtgcccatctcttttgtggacagggtctatggcgagagtaagctcgggggtaacgagatcgtttcttttctgaagggcctgctgaccctattcgccaccacatag

SEQ ID NO: 28413 - DNA, 1332 bp, Artificial Sequence
  Description of Artificial Sequence: Synthetic coding sequence
atgagaaggcaggtcatggcagccctggtagtgagtggcgcagccgagcaaggaggacgtgacggaccaggcagaggacgagccccacgcggaagggtcgccaatcagatcccgcctgagatcttgaagaaccctcagcttcaggctgcgatcagagttctacctagtaattacaatttcgaaatccccaagacaatctggcggattcagcaggctcaggctaaaaaagttgcactccagatgcccgagggattactcctgtttgcctgtactatcgtggacatactggagcgcttcacggaagctgaagttatggtaatgggagacgtgacctatggggcatgttgcgtggacgattttactgctcgcgcactgggggctgatttcttggttcactacgggcactcgtgcctgatcccaatggatacgtcagctcaggattttagagttttatatgtcttcgttgacattaggattgataccacccaccttctcgacagcttaaggctgacattcccccctgcaacagctctggcactggtaagcactattcagtttgtctcgaccctgcaggcagccgcacaggagctaaaagctgaatacagggtaagcgtgccccagtgtaaaccattgtccccaggagaaattctcggctgcacatcacctcgattgagcaaagaggtggaagccgtagtctacttaggtgatggcaggttccatctcgagtccgtgatgatcgctaacccaaatgttcctgcttacagatatgacccatattccaaggtcttgtcccgggagcactacgaccaccaacggatgcaggctgccaggcaagaggccattgctaccgccaggtcagccaagagttgggggcttatcctgggcactttgggccgtcaggggtcccctaagatcctggagcatctggagagccggttgcgcgctcttggcctgtctttcgttcggttgctgctgagcgaaatattcccatctaagctgtctctattaccagaggtagacgtctgggtccaggtcgcgtgcccacggctgagcatagactgggggaccgcttttcctaagccactgttgaccccctatgaggccgcagtggccctccgagatatctcctggcaacagccttacccaatggacttctatgcaggttcttccctgggtccttggaccgtcaatcacgggcaggaccgaaggccccatgcacctggaagacccgcaaggggaaaagtgcaggaagggagcgcaaggccaccaagtgctgtggcgtgtgaagactgcagctgcagagatgaaaaagtggctccactggccccatag

SEQ ID NO: 28414 - DNA, 1146 bp, Artificial Sequence
  Description of Artificial Sequence: Synthetic coding sequence
atgattgacacgctgcgcccagtgcccttcgccagcgagatggccatctctaaaactgtcgcgtggctgaatgagcagctcgaactgggaaatgagaggctgttactaatggattgtcgccctcaggagctttacgagtcaagtcatattgaatcggctattaacgtggccatccctggcattatgcttcgccgactgcaaaaaggtaacttaccagttcgcgctctctttaccagaggtgaggaccgggacaggttcacgcggaggtgtggaaccgatacggtcgtcctgtatgatgagagcagtagcgattggaacgagaacacagggggtgagagtgtacttggtctgctgctcaaaaaattgaaggacgaagggtgtagagccttttacctggagggcggatttagcaagtttcaggccgagttttccctacattgtgagacgaacctcgacggatcatgtagtagtagttccccacctttaccagtgctggggctgggcggtctccgaatttctagcgatagtagctccgacatcgaatctgacctggatcgagacccgaactccgccactgactccgacggctccccactcagcaatagtcagccaagcttcccggtggagattctgccattcttgtacctcggttgcgccaaagacagcaccaaccttgatgttctggaagaattcggaattaagtacatcctcaatgtgacccccaacctgccaaacctgtttgagaacgccggagaatttaaatacaagcaaataccaatttctgatcattggtctcaaaacctgtcgcaattcttcccagaagccattagctttatagacgaagcacgaggcaagaactgcggagtgcttgtgcactgtcttgcgggaatcagtcggtctgtaaccgtgaccgtcgcatacttgatgcagaaattgaacctgagcatgaacgacgcctatgatatcgtcaagatgaaaaaatcaaatatctcacctaattttaattttatgggacagctgctcgactttgaaagaactcttggcctctcctctccttgtgataaccgggttcctgcccaacagttgtacttcaccacccccagtaatcagaacgtttaccaagtggactcgctccaatccacgtag

SEQ ID NO: 28415 - DNA, 708 bp, Artificial Sequence
  Description of Artificial Sequence: Synthetic coding sequence
atgatcgacactcttcgtcccgttccttttgctagcgagatggctatttccaagaccgttgcttggctcaacgagcagcttgagctcggtaacgaacgcctgctcctgatggactgtcgtcctcaggagctttatgaaagtagccatattgagtccgctataaacgtggctattccaggcatcatgttaagaagactccagaagggaaacctgcccgttcgggctctgtttacaagaggggaagaccgcgataggttcacccgacgttgcggcacagatacagtggtactgtatgacgaatcctccagcgactggaacgagaacaccggcggagaatccgtgttaggactgcttctgaagaagcttaaagacgaaggctgtcgcgcattttacctggaagacgaagcaaggggcaagaattgtggggtgctagtccattgtctggcgggtatctcacgttctgtgaccgtgaccgtggcatatctgatgcagaagctgaatttatctatgaacgatgcctacgacatagtgaagatgaaaaagagcaacataagccctaatttcaatttcatggggcagctcctagatttcgagcgtacactgggactgtcgtcgccttgcgataaccgcgtgcctgcccaacagctgtactttactacgccctctaaccaaaacgtgtaccaagtggatagcttgcagtctacctag

SEQ ID NO: 28416 - DNA, 354 bp, Artificial Sequence
  Description of Artificial Sequence: Synthetic coding sequence
atgatcgatacacttagacccgtcccttttgcgagcgagatggcaatttccaagaccgtagcttggctgaatgaacagctggagcttgggaacgagagactcctcctgatggactgccgcccacaggagctgtatgaatctagccacatagaaagcgcaatcaatgtagctatccctgggatcatgctgagacgattgcagaagggcaatctccccgtgcgcgcactgttcacaaggggggaggaccgagatagatttactcgtcgatgtggcaccgacacagtggtgttgtatgacgaaagctcttccgactggaacgagaatactggcggagagtctgtactggggctatag

SEQ ID NO: 28417 - DNA, 1545 bp, Artificial Sequence
  Description of Artificial Sequence: Synthetic coding sequence
atggcagatgcagaggtcattatcctgccaaaaaagcataaaaagaaaaaggagcgtaaatccctcccagaagaggacgtggctgagatccaacatgctgaggaattcttaatcaaaccagagagcaaggtggccaagctggacacctcccagtggccactcctgctaaaaaatttcgacaaactgaatgtacggaccacgcactacacccctttggcctgcgggtcgaaccccctgaagagggagataggagactatataaggaccggctttatcaatctggataagccatcaaacccatcctctcatgaggttgtggcctggatcaggcgcatcttgcgcgtggagaagactggccatagcggcacattggaccctaaggtgaccggctgtctgatagtgtgcattgagagagctacccgactagtcaagagccagcagtcggccggaaaagagtacgttggtatcgttcgtctccataatgccatagaggggggaacacagcttagcagggccctggagaccctgaccggagccctgttccagcgcccaccccttatagctgccgtgaagcgacagctgagagtgcgcaccatctacgagagcaaaatgattgagtatgatcctgagcgaagacttggcatcttctgggtatcatgcgaggcgggaacatatatccggacactatgcgttcacttgggtctgcttctcggtgtggggggacagatgcaggagctgcgccgagtgcgctctggggtcatgtccgagaaagatcacatggtcacaatgcacgacgtgctggatgctcagtggctttacgataaccataaagatgagtcctatctgcgaagggtggtgtatcctctcgagaagctcctgacgtcacataagaggcttgtgatgaaggactccgcggtgaacgctatctgttacggggctaagatcatgctccctggagtgcttcgatacgaggacggcattgaggtcaaccaagaaatcgtcgtgattaccacaaaaggtgaagccatctgcatggcaattgcgctcatgaccaccgctgtcataagcacgtgcgatcacgggattgtggccaagatcaagagggtcattatggaaagggacacctaccctaggaagtggggcctgggtcctaaggcctctcagaagaagcttatgataaaacagggactgctggacaagcacggtaagcctacggacagcacgcctgccacctggaaacaggaatacgtggactactctgaatctgcaaaaaaagaggtggtggcagaagtggtaaaggccccacaggttgtggcagaggctgctaagactgccaaacgaaagcgcgaaagcgagtcggaaagcgacgaaacgcccccagcagcgccacagttgatcaagaaagaaaaaaaaaagagcaagaaggataaaaaagcaaaggcgggtcttgaaagcggggcagagccgggagacggggatagtgatacgacaaagaaaaaaaagaagaaaaaaaaggcaaaggaggtggagttggtgagcgagtag

SEQ ID NO: 28418 - DNA, 7245 bp, Artificial Sequence
  Description of Artificial Sequence: Synthetic coding sequence
atggcggaaaacgttgtggagcctggacccccttccgcaaagagaccaaaattgagtagtccagcactgagtgccagtgcgtctgacgggacagactttggctccttgttcgatttagaacatgacctgcctgatgaactgatcaactcgacggagctgggactaacgaatggcggagatatcaatcaactgcagacatccctgggcatggtccaggatgctgcttcaaagcataaacagctgtcagagctgttgagatcgggctctagcccaaacctaaatatgggggtgggtggcccagggcaggttatggcctcgcaggctcagcagtcatctcctggcctgggactgatcaacagtatggtgaagagcccaatgacacaggccggactaacatcccctaatatgggcatggggacctctggaccaaaccaggggcctacgcagagcacagggatgatgaacagtcccgtgaaccaaccagccatgggaatgaataccggcatgaacgcaggtatgaacccaggaatgcttgcagccggaaacggacagggtatcatgccaaaccaagtcatgaacggatccattggcgctggaagaggacgacagaacatgcagtaccccaaccccggaatggggagcgcaggaaacttgctgaccgagccactacagcagggctcaccgcagatgggcggtcagacagggttgcgaggccctcagcctctgaagatgggaatgatgaacaatccaaacccttatgggagcccgtacactcaaaacccgggtcaacagatcggggcttccggtttgggtcttcagattcagaccaaaactgtcctctcaaataacctgtcaccttttgccatggacaaaaaagctgttcctgggggtggtatgcctaatatgggccagcagccagctccccaggtccagcagcctggactcgtcactccagttgcccagggtatggggtcaggcgctcacacggcagacccagaaaagcggaaattaatccagcagcaactggtcctgcttctgcatgcgcataaatgtcagaggagagagcaggccaatggcgaggtcaggcagtgcaatttacctcactgccgtaccatgaagaacgtgctgaatcacatgacgcattgccagtccgggaagtcatgccaggtggcccactgtgcttcatctcgacagatcatatcccattggaagaactgtacgcgacacgattgtcccgtttgcctgccactgaaaaatgctggcgataaacgaaaccagcagcccatcttaacgggcgcacctgttggactcggcaatccttcctcactgggtgttggtcagcagagcgccccaaatttgtctaccgtgagccagattgaccccagctcgattgagagggcgtatgccgctctaggcctgccttaccaagtgaaccaaatgcctacacagccacaggtccaggcaaaaaaccagcagaaccagcagccaggacagtctcctcagggcatgcgccctatgtccaacatgtcagccagccccatgggagtgaatggaggagtgggggtccagactccatcccttctgtctgattcaatgctacacagtgctattaattcccagaacccaatgatgagtgaaaacgcatcagtgccaagcctgggcccaatgccgactgctgcacagccatccacaaccggcatacgtaaacagtggcatgaagacattactcaggatttgcgcaatcacctggtccacaagctcgtccaggctatattcccgacaccggacccggcagcacttaaggaccgccgaatggaaaatctggtggcctacgctcggaaagtggagggtgacatgtatgaatccgctaataatcgagcagaatactatcatctccttgccgagaaaatttacaaaatccaaaaagaactagaagaaaaaagaaggactagactgcagaaacaaaacatgctccccaatgctgccggtatggtcccagtgagcatgaatcctggcccaaatatgggacagccacagccaggaatgacttctaacgggccattacctgatcccagcatgatccgaggtagcgtccctaaccagatgatgccaagaataacacctcaatcaggcctgaatcaattcggtcaaatgtctatggcccagccacctattgtgccacggcagacaccccctctgcagcatcacgggcaactcgctcagcctggtgccctgaaccctcccatgggctacggccctagaatgcagcagccaagcaatcagggccaattcctgccacaaacacaattcccaagccagggtatgaacgtcacgaacatccctctggcaccttccagtggacaggcgccagtgtcacaagcacagatgtcaagcagcagctgccctgttaacagccctatcatgccaccaggctcccaaggttcacatatacactgcccacagcttccacaacctgcactccaccaaaactcaccctcacccgtgccctcacggacccccactccccatcatactccgcctagcatcggggctcagcaaccacccgcaacgacaatccccgcacccgtccctaccccaccagcaatgcctcctgggcctcagagtcaggccctgcatccaccgccacgccagacacctacacctcccaccacacagcttccccagcaggtccagccctcactaccggctgcccctagtgcagatcagccccagcaacagcccagatctcaacagtctacagcggcttccgtccctaccccaacagctcccttgctcccaccacagcctgccacccccctttcccagcccgcagtgagcatagagggccaggtgagcaacccccctagcacctcaagcacagaagttaacagccaggcaatcgcagagaaacagccgagtcaagaggtaaaaatggaggcaaaaatggaagtcgatcagcccgaacccgctgacactcagcccgaggacatctcagaaagcaaagttgaggactgtaagatggagagcacggagacagaggaacggagtacagagctgaaaacagaaattaaagaagaggaggaccagccttctacgtccgccactcaatcgtccccagcaccgggacagtcaaaaaaaaagatctttaagccagaagaactgcgccaggccttaatgcccacactggaggccctgtaccgccaggatcccgagagcctgcctttccggcagcccgtggatcctcagcttctcggcattcccgattattttgatatcgtcaagtcgcctatggatttaagcacaataaagcgcaaactggataccggacagtaccaggaaccctggcagtatgtggacgacatttggctgatgtttaacaacgcctggctctacaatcggaagacaagcagagtctacaaatattgcagcaagttgagtgaggtatttgagcaagagattgaccctgtgatgcaatctctgggttattgctgcgggaggaagttagagttctctccacagactctgtgttgttacgggaaacagctctgtacgatccccagggacgcaacctactacagctaccagaacaggtatcacttctgcgaaaagtgctttaacgagattcagggcgagagtgtctctctgggcgacgatccctcccagcctcagaccacaatcaacaaggagcagttcagcaagagaaagaatgatacactggaccctgaactcttcgtggagtgcactgaatgtggaagaaaaatgcaccagatatgcgtcctgcatcatgaaattatttggccagctggcttcgtttgtgacggctgtctgaaaaagtctgcgagaacacggaaagaaaacaagttctccgcgaaacggttgccctcgacaaggcttggcacttttctcgaaaatagagtcaacgactttcttcggagacagaaccatcctgagagcggtgaggtaacagtgagagtcgtacacgccagcgataagaccgtcgaagtcaaacctggaatgaaagctagatttgttgattctggggagatggctgagtcttttccctacaggacgaaggctctttttgccttcgaggaaatcgatggcgtggacctctgcttcttcggcatgcacgttcaggagtacgggagcgactgccctcccccaaaccagcggcgagtctacattagctatctggatagcgtacatttctttagaccgaagtgtcttcggactgctgtgtatcacgaaatactgataggctaccttgagtacgtgaagaagttaggctacaccacaggacatatttgggcctgtcctccttctgagggcgatgactacatctttcactgtcacccacctgaccagaaaatcccaaaacccaagcgcctccaggagtggtataaaaagatgctggataaagccgtcagcgaaaggatcgtccatgactataaagatattttcaaacaggcaaccgaggaccggctgacctcagctaaggagctgccttactttgagggcgatttttggccgaacgtactcgaagagagcattaaagagctggagcaagaagaagaagaacgcaaacgcgaagagaatacctctaacgagagtactgacgttactaaaggtgacagtaaaaatgctaaaaaaaaaaataacaaaaaaacctcaaaaaacaagagctccctatcgcgtggtaacaaaaaaaaacccggaatgccgaacgtgtcaaatgatctgtctcagaagctgtatgctacgatggaaaagcacaaagaagtgtttttcgttattcgattaatcgctggccctgccgctaactccttgcctccaatagtggacccagatccacttattccttgtgatctcatggatggaagagatgcctttctgactctggctcgcgacaagcacttggagttctccagccttagacgggcacagtggtccacaatgtgtatgttagtcgagctgcacacacagtcccaggatagattcgtctatacttgcaacgagtgcaaacatcatgtcgagactagatggcattgcacggtctgtgaggactatgatctgtgtattacatgttacaacaccaaaaaccacgaccacaagatggagaagctgggattgggcctggacgatgagtccaataaccagcaggcagccgcaacccaatcgcccggtgactctcgacgactctcaatccaaaggtgcatacaatctttggtgcacgcctgtcagtgtcgcaatgccaactgcagcctgccgagttgtcagaaaatgaagcgggtggttcaacacacaaagggctgcaaacggaaaactaacggaggatgcccgatatgtaagcagctcatcgccttgtgttgctaccacgctaagcactgtcaggagaacaagtgtcctgttcccttctgcctgaatatcaaacagaagttgaggcagcagcaactgcagcatcgcttgcaacaagctcagatgctaaggcgacgcatggcatcaatgcaaaggaccggtgttgtcggccagcagcaggggctgccatcccctaccccagcaactcccacgacgcctactgggcagcagcccacaacccctcagacaccacagcctactagccagccacagcccacgcctcctaactccatgcctccttatctgccccgtacacaggctgcaggtcctgtgagtcaaggaaaggccgctggccaggtaaccccccctacccctcctcagaccgcccagccaccgctccccggacctcctccagccgctgtcgagatggccatgcagatccagcgggctgccgaaactcaacgccagatggcccacgtgcagatattccaacgcccaatacagcaccaaatgccccctatgaccccgatggcccctatggggatgaacccaccccctatgacacgcggaccttccgggcacctggaacccggaatggggcctaccggcatgcaacagcagccaccatggtctcagggcggtctccctcagccccaacagctgcagagcgggatgccgcgacctgccatgatgtctgtagcgcagcacgggcagcccctgaacatggcaccgcaaccgggtctcgggcaggtcggtatcagccccctgaagccgggaaccgtgtcgcagcaagccctccagaacctgttgaggactctcagatccccaagtagccccctccagcaacaacaggtcttatcaatactgcatgcaaatcctcagctgctggccgcattcatcaaacagcgggcagcaaagtatgctaactctaatccccagcccatccccggtcagcccggtatgccccaggggcaaccaggacttcaacccccaacgatgccaggccaacagggcgtgcatagcaaccccgctatgcagaatatgaaccccatgcaagccggtgtgcaacgtgccggtctcccccagcagcagccacaacagcaactgcaacccccaatgggaggaatgtctccgcaggctcaacagatgaacatgaatcacaatactatgccatcccagttcagagatatcctccgaagacagcagatgatgcaacagcagcagcagcaaggagccggacccggaatcgggcctggtatggcaaatcataatcagttccaacagccacagggggtgggctatccccctcagcagcagcaacggatgcagcatcacatgcagcaaatgcagcagggtaacatgggtcagataggtcagttgcctcaggcccttggcgctgaggccggagccagcctccaggcgtaccaacaaaggctgttgcaacagcagatgggtagtcccgttcagccaaatcccatgtcccctcagcagcacatgctccccaaccaggcccagtccccccacctgcaaggtcaacagatcccaaacagtctctctaaccaagtgcgctctccccaacccgtgcctagcccaaggcctcagtctcagccgccacacagcagccccagtccgagaatgcagccacagccgagcccgcaccatgtgtccccccagacgtcgagcccgcacccgggtctggtggcagcccaggccaaccccatggagcaggggcacttcgcctcccctgatcagaattccatgctgagccagctagcctctaacccaggaatggctaatcttcacggagcttctgcaaccgacttaggcctctctaccgataatagcgacttgaacagcaatctgagccagtctactctggatattcactat

SEQ ID NO: 28419 - DNA, 1314 bp, Artificial Sequence
  Description of Artificial Sequence: Synthetic coding sequence
atggcattggccggtgcacctgccggtggcccttgcgcccctgcgctggaagccctacttggagcaggcgctcttcgcctgttagattccagccagatcgttattatatctgctgcccaggatgcgagtgccccaccagcgccaaccgggcctgccgctcctgcagccggaccctgcgaccccgacttgcttctgttcgctacaccgcaagccccacggccaacgccgagcgcccctagacctgcactgggtcgtccacccgtaaaaaggagattagacctagagacagaccaccaatacctggctgaaagctccggacctgcccgaggtcgaggtcggcatcccggtaaaggggtcaaaagtccaggcgagaagtcaagatatgaaacttccctcaatctcaccactaagcggttcctggagctgttgtcccattctgcagacggcgtggtggatcttaactgggccgcagaggtcttgaaagttcagaagaggagaatctatgacataacaaatgtgcttgagggaattcaactgatcgcaaagaagtcaaaaaatcatattcagtggcttggctcacacaccactgtcggtgtaggcggtaggctggagggcctgactcaggatctccggcagctccaggaatctgaacagcagcttgaccacctgatgaacatttgtaccactcagcttcggctgctgtcggaggatacagactctcagcgccttgcatacgtgacttgtcaagatctccgatccatagccgacccagctgagcagatggtcatggtaatcaaggcacccccagaaacacagctgcaagcagtcgattccagcgagaattttcagatcagtttaaagtcaaaacagggcccaatcgatgtgttcctgtgccccgaagagactgttggagggatcagcccagggaaaactccttcccaggaagtaaccagtgaagaggaaaatagggcaacggattccgccacaatcgtgtcaccccctccaagttcccccccttcctccctcacaaccgatccttcacagagtctgttgagcctcgagcaggaacccctgttgagtaggatgggatctctgcgagcgccagtggacgaagaccgattgtctccattagtggcagcggattctcttctggagcatgtacgagaagatttctcaggtcttctccccgaagagtttatcagtctgtccccaccacacgaagcactcgattatcattttggacttgaggaaggtgagggtatccgtgatttattcgactgcgacttcggggatctgaccccccttgacttttag

SEQ ID NO: 28420 - DNA, 1242 bp, Artificial Sequence
  Description of Artificial Sequence: Synthetic coding sequence
atggcagaggcgggaccacaggcccctcccccacctggaacccccagcaggcacgagaagtccctaggactgcttactaccaagtttgtgagccttctccaagaggcaaaagacggagtgctcgacctgaagctggccgcagacacactcgccgtgcgccagaaacgccgtatttatgatattactaatgtgttagagggcatcggcctgatagagaagaaaagcaaaaatagcattcaatggaagggggttggaccagggtgtaacacccgtgagattgccgataagctcatcgagctgaaagccgaaattgaagagttacaacagcgggaacaggagctggaccagcataaggtttgggtgcaacaaagtattcgcaatgtgacggaagacgtgcagaactcttgcctagcttatgtaactcatgaagacatctgtcgctgtttcgcgggtgatacactgctcgccatcagagccccatctgggaccagccttgaggtgccaattccagaagggctgaatgggcagaaaaaatatcagatccacctgaaatctgtctcaggacctatcgaggtgctgcttgttaataaggaggcctggagttctccccctgtggccgtgcctgtgcccccaccagaagatctgctgcagtccccctcagccgtctctaccccaccgcctttgccaaagcccgctcttgcccagtcacaagaagcttcaaggcctaatagcccacagttaactccaactgccgtccctgggagtgcggaggtccaggggatggcaggcccagcagctgagattacggtttctggcggaccgggaactgactctaaagatagcggtgagttgtcaagcctgcctcttggccctaccacacttgacaccaggcctctccagtcctcagccctgcttgacagcagctctagctcttcctcctcaagtagttcgagtagtaatagcaactcttcatcgtcatctggaccaaacccgagtacaagtttcgaacccatcaaagctgacccgacaggtgtgctcgagttgcctaaggaattaagtgagatattcgatccaaccagggagtgtatgagttcggaactcctagaggagcttatgtcatccgaagtgttcgctccactcctgcgactttcacctccccctggggatcacgattatatctacaatctagatgaatccgagggggtgtgtgatttattcgatgtacctgtacttaatctgtag

SEQ ID NO: 28421 - DNA, 1164 bp, Artificial Sequence
  Description of Artificial Sequence: Synthetic coding sequence
atgacaggaaagctggccgagaagttacctgtcacaatgagttcactgctgaaccagctcccagataacctctaccctgaagagatccctagcgcactcaacctgttctcagggtcctccgacagtgtcgtccactacaatcagatggcgactgagaacgttatggacatcggcttaaccaatgagaagccaaatccagaactgtcctactccggtagcttccagcctgcaccagggaataagactgtaacttatttgggaaagtttgccttcgactccccgagcaattggtgccaggacaacatcataagccttatgtccgccggtattcttggagtgccacccgctagcggcgcacttagcacacaaacatcgactgcatctatggtgcaacctccgcagggtgacgtggaggccatgtacccagctctgcccccttactcaaactgcggagacctgtacagcgagccagtttctttccacgacccacagggcaaccccggactggcatactcccctcaggattaccaatcagcaaagcccgcacttgacagcaacctctttcccatgatcccggactataacctgtatcaccaccccaatgatatggggtctatacccgagcacaagccttttcagggaatggatccgatccgggttaaccccccaccaattactccattggaaacaataaaagcgttcaaagacaagcaaatacatcctgggttcggtagcttgcctcagcccccactgactcttaaaccaatcagacctcgtaagtaccccaaccgcccatccaagacaccactgcacgagcggcctcacgcatgcccagcggagggatgtgaccgtcggttctccaggtccgatgagctgacgcggcatttgcgtatccacaccggacacaaaccattccaatgccgaatttgcatgaggtccttttctcgatccgaccatctcacaacccatatcagaacccacaccggcgagaagccatttgcttgtgaattttgcgggcgaaagttcgccagatccgacgagcgcaagaggcacgccaaaattcatctcaaacagaaggagaagaaagcagagaagggtggtgcgccaagcgcctcctcagcaccccctgtttccttagctcctgtggtgaccacgtgcgcctag

SEQ ID NO: 28422 - DNA, 687 bp, Artificial Sequence
  Description of Artificial Sequence: Synthetic coding sequence
atggacatcggacttaccaacgaaaagcctaaccccgaacttagttattcaggaagtttccagccagccccagggaataagactgtcactatgatccccgattacaacttgtaccaccatccaaacgacatgggcagcattccagaacacaagccctttcagggaatggatcctatccgcgtgaaccctccaccaatcacacctcttgaaacgatcaaggctttcaaagataagcagattcatcccggatttgggtctcttccacagcccccactgaccttgaaacctattaggcccaggaagtaccccaatcgtccctccaagactcccctgcacgagcgtccccacgcttgcccagctgagggctgcgatagacggttctcccgctcagatgagctgactcgccatctgcgcattcatacagggcataaacccttccagtgtaggatttgcatgcgcagcttctccaggtctgatcatctgaccacgcacatcaggacccacaccggggagaaaccatttgcctgcgagttctgcgggaggaaattcgcccgatcagacgaacgtaagaggcatgcaaaaatacacctgaagcaaaaggagaagaaggcggagaaaggcggtgctccctccgcttctagcgctcctcctgtgagtttggcacccgttgttacaacctgtgcctag

SEQ ID NO: 28423 - DNA, 1050 bp, Artificial Sequence
  Description of Artificial Sequence: Synthetic coding sequence
atggagccctgtgctgcctggtccccccgtggaggcagggaaaacgttatggacatcggtctgactaatgaaaagccaaaccctgagctttcgtattctggatcgtttcaacctgcacccggtaacaaaactgtcacctacttgggaaagtttgcattcgactctccctcaaactggtgccaggacaatataatcagtctcatgtccgcagggatcctcggcgtgcctcctgccagtggagccctttccacccagacctctactgcgagtatggtgcagccccctcagggcgacgtcgaggctatgtatccagccctgcccccttattcgaattgtggggacttgtactctgaacctgttagcttccacgacccccagggaaacccaggtttggcctactccccccaggattaccagagcgctaagcctgcccttgactcgaatctgttcccaatgatcccagactataatctttaccaccaccccaacgatatgggcagcataccagagcataaacccttccagggcatggatcctataagggtgaacccgcctccaatcacacccttggagacaatcaaggccttcaaggacaaacaaatccatccaggcttcggctctctgccgcagccccctctgactctgaaacccatcaggccccgtaaataccctaatcgcccatcgaaaactcctctgcacgagcggccacacgcttgtcccgctgagggctgcgaccgcagattcagtcggtcggatgagctcactaggcacctgagaattcatacaggtcacaaacctttccagtgcaggatttgcatgcgaagcttcagtaggtccgaccatcttaccacacatattcggacacacacaggcgaaaaaccttttgcctgcgaattctgtgggaggaagttcgccaggtccgatgaacggaaacgccacgccaagatccacctgaagcagaaggagaagaaagccgagaagggtggtgccccaagtgctagctctgcaccccctgtcagcctggcccctgtggtgaccacatgtgcctag

SEQ ID NO: 28424 - DNA, 3696 bp, Artificial Sequence
  Description of Artificial Sequence: Synthetic coding sequence
atggcttcagtatggaagcggctccaacgggttggaaaacacgccagcaaattccaattcgtggcctcataccaggaacttatggttgagtgtacaaaaaaatggcagccggataagctggttgtcgtttggaccaggaggtctcggaggaaaagtagcaaggcccacagttggcaacccggtattaagaatccctaccgtggcgtggtcgtgtggcctgtgcctgagaacatcgaaattacggtgactttgtttaaggatccgcacgctgaggaattcgaggacaaagaatggacctttgtgatcgagaatgaaagccctagcggtcggagaaaagctttggccacctcatccattaacatgaagcagtatgcgtccccgatgcccacacagaccgatgtgaagctgaagtttaagcccctctctaaaaaggtcgtatctgctgctcttcagttcagtttgagctgcatctttttgagagagggcaaggctaccgacgaggatatgcagtccttagcctcccttatgtccatgaagcaggcggatatcggaaacctggatgattttgaggaggacaatgaggacgacgatgaaaatcgcgtgaaccaggaggagaaggctgcaaaaatcacagaaatagtgaaccaattaaacgctttatcttcactagatgaggatcaggacgactgcatcaaacaggcaaacatgagaagcgctaagagtgctagctcctcagaggagttgattaacaaattaaactttctggacgaagctgagaaggacctcgcaacagtcaactctaaccccttcgatgaccctgacgccgcagagctgaaccctttcggggatcctgatagcgaggaacccatcacagaaactgcctccccgaggaagactgaggacagcttctataacaatagttacaatcctttcaaggaggtccagaccccacagtatctaaaccccttcgacgagcctgaggctttcgtgaccatcaaggatagtccccctcaatccaccaaaaggaagaatattcgccctgtggatatgtccaaatatctgtacgcagattctagcaaaacggaggaggaagaattagacgaaagtaaccctttctatgaacctaaatccacccctcccccaaataacttggtgaatcctgtacaggaactggagactgaacgcagggtgaaaaggaaggctcccgctccccctgtgctctcccccaagacgggggtgctgaacgagaacaccgtgagtgccggtaaggatctgtctacctcgcccaagccctctcccataccctcccctgtcttggggagaaaaccaaatgcgtcacagagcttgcttgtttggtgtaaagaggtaacaaagaattatcgaggggtcaaaataaccaattttacgacctcctggcggaacggactcagtttttgtgcaattctgcaccattttaggccagatctcattgactataagagcttaaaccctcaggacatcaaagaaaataataagaaggcctacgacggctttgcctcaattgggatttctaggctgctcgagcccagcgacatggtgctccttgccatccccgataaattaaccgttatgacatacctgtaccaaatcagggctcattttagcggccaagaactgaacgtcgtgcaaattgaagaaaattcttctaagagcacatataaggtaggaaattacgagacagatacaaacagctctgtggatcaagaaaaattctacgccgagctatcagacctgaagcgggagcccgaactgcagcagcctatttcgggcgcagtggactttcttagccaggatgattccgttttcgttaatgatagcggggtaggagagtctgagagtgaacatcagactccagacgatcacctttcaccaagtaccgccagcccatattgcagacggactaaaagcgacaccgaaccacaaaagagccagcaatcctccgggagaaccagtgggagcgatgaccctggcatctgtagtaatactgattctacgcaggcacaagtgcttctcggcaagaagcgattgttgaaggccgagactctagaactcagtgatttatacgtcagcgacaagaaaaaagacatgagtccccctttcatttgtgaagagacggacgaacaaaagctgcagaccctggatattggaagcaatctcgaaaaggaaaaactcgaaaatagccgcagccttgagtgtcgtagcgatcctgaatcacccatcaagaagactagtctgtcacctactagcaagctcgggtactcttacagccgcgatttggatctggctaagaagaaacatgcctcactgcgccaaacagaaagcgaccccgacgccgacaggactactctgaatcacgccgatcattcaagcaagattgtacagcataggctgctgagccggcaggaagaacttaaggaaagggccagagtcttgctggagcaggctagaagggatgctgcccttaaggctgggaataagcacaatacgaacacggcgaccccattctgtaacaggcaactgagcgatcagcaggacgaggaaagaaggaggcagctccgggagcgagcacgccagctgatcgcagaggcacgctcaggcgtgaagatgagcgaactccctagctatggggaaatggccgctgaaaaattgaaagagagatctaaagcctccggggatgagaacgacaatattgaaattgatacaaacgaagagatccctgaaggcttcgtggtaggcggtggcgatgaactcacaaacctggagaacgatctggacacccctgagcagaacagcaaattggtggacctgaaactcaagaagctgctggaagtgcagccccaggttgccaatagcccctcaagtgctgcccagaaggccgtgacagagagctccgaacaggatatgaaatccggcacggaggatctgagaactgagaggcttcagaagactacagaaaggttccggaatcctgtggtgttctctaaggattccaccgtccgcaaaactcagctccagagcttttcacagtacatcgaaaacagaccggaaatgaagcgtcagcggagtatccaagaggacaccaagaaggggaacgaagagaaggcggctattaccgaaacacaaaggaaaccctctgaggatgaggtgctgaataaggggtttaaggataccagccagtatgttgtgggcgaactggctgcgctggaaaacgagcagaagcagatagacactagggcggcactggtggagaaacggctccgctatttgatggacaccggcaggaatacagaggaagaagaagctatgatgcaagaatggttcatgcttgtgaataaaaaaaatgccctgatccgtcgtatgaaccagctgagtctgttagaaaaagaacatgacctcgagcgaaggtatgagctgttaaacagagagctgagggccatgttggcaatagaggattggcagaagaccgaggctcagaagcgccgagagcaacttctgctggacgaattggtggccttggtcaataaacgcgatgccctggtgagggacctcgacgcacaggaaaaacaggctgaagaggaggacgaacatcttgagagaacgcttgaacaaaataagggaaaaatggccaagaaggaggaaaagtgtgttctccagtag

SEQ ID NO: 28425 - DNA, 3591 bp, Artificial Sequence
  Description of Artificial Sequence: Synthetic coding sequence
atggcttccgtctggaaaaggctgcagcgggtcgggaagcatgcgtctaagttccagttcgtagcgagctaccaggagctcatggttgaatgcacgaaaaagtggcaacccgataaactggtggtggtatggacgaggaggtccaggcgcaagtcatctaaggcccactcgtggcagccgggtattaaaaacccctataggggggtggtggtgtggccggtgccagagaatatcgaaataacggtgaccctgtttaaagacccacatgcagaagagtttgaagataaggaatggacctttgtgattgaaaacgaatctccttcaggcagacggaaggcccttgcaaccagctccattaatatgaagcagtacgccagtcccatgccaacacagacagatgttaaactcaagtttaagcctctctccaaaaaagtggtgtcagctgcactgcagttcagcctgtcttgcatcttcctgcgcgaggggaaagccactgatgaggatatgcaaagcctggcctccctgatgagcatgaagcaggcagacattggaaatctcgatgatttcgaggaagacaatgaagacgatgacgaaaatagggtcaatcaggaggaaaaagccgcaaaaattaccgaactgatcaataagttgaactttctagacgaagctgaaaaggatcttgctacagtgaacagtaatccttttgacgatcctgatgccgctgaacttaatccgtttggggaccctgatagtgaagagcctattactgaaaccgcgtcgcctcggaaaacagaggacagtttctacaacaattcatataacccttttaaggaagttcagactccccagtacttgaacccttttgatgagcccgaagcctttgttaccattaaagacagcccccctcaaagcacaaaacgcaaaaacattcggcctgtcgacatgtctaaatatttgtatgccgactcgtctaaaacagaggaagaagagctggatgagtcaaacccattctacgagccaaagagcacgcccccaccaaacaatctggtgaatcctgtccaggaactggagacggagcgcagggtcaaacggaaagccccagctccgccagtgctaagccccaagaccggcgtgcttaacgagaataccgtgagcgccggaaaggacctgtccacatctcccaaaccgagccccattccctctccggtgctgggcagaaaaccaaatgcaagtcagtcactgctggtgtggtgcaaggaagtgaccaagaattacagaggagttaagatcacaaatttcactaccagctggagaaacggcctgtctttctgtgccatcctgcatcattttcgcccagacctcatcgactataagtcactgaatccacaggatattaaggaaaataataaaaaggcctacgacggcttcgcctccattggaatcagcagattactggaaccctctgacatggttctcctggcaatacccgacaaattgaccgttatgacgtatctgtaccagataagggcccacttcagcggccaagaactgaatgtggttcaaattgaggaaaactccagtaagtcgacctataaggtgggcaactacgagaccgacaccaacagttccgtggatcaggagaaattttacgccgagctgtcggatctgaagagagagccagaactgcagcagcctatatccggggctgttgactttctgtcccaagatgactctgtatttgtcaatgactcaggggttggcgagagtgagtcggagcatcagacccccgacgatcacctgagtccaagtaccgccagcccctactgtcgtagaactaaaagcgatactgaaccccaaaagagtcagcagtcctccggacgcacaagcgggtcagacgatcccggaatttgctccaacactgactccacccaggcccaggtgcttctgggtaagaagaggctgctgaaagcagaaaccctggaactgtcagacctgtacgtgagcgataaaaagaaggacatgagtcccccatttatttgcgaagagacagacgaacaaaagctgcagaccctcgacattggctccaacttggagaaggaaaagcttgagaacagccgatcgctggagtgccgaagcgacccagaatccccaatcaaaaaaaccagtctgagccccacgagcaaacttggctacagttattcaagagatttagacctggccaaaaagaaacatgcttctctgcggcagaccgaatctgaccctgacgctgatcggactacattgaatcatgccgaccacagctccaaaatcgtgcagcatcgactgctttcaagacaggaagaactgaaagagagagcacgggttctgttagagcaggctcgacgggacgctgcactgaaggcaggaaacaaacacaataccaataccgccactccattctgtaatcgtcagctgtcagatcaacaagacgaagagcgtagaagacagctgcgtgagcgggcaaggcagttaattgcagaggctaggagtggtgtcaagatgtcagaactgccttcttacggcgaaatggccgctgaaaagctaaaagaaagatccaaggcgagcggggatgaaaacgacaatattgagattgataccaacgaagaaatccctgaggggtttgtcgtggggggtggcgatgaattgactaatcttgaaaacgacctggatactcctgaacagaatagcaagctggttgatctgaagttaaaaaagctcctcgaagtgcagccccaagtggccaattctcccagtagcgcagcgcaaaaagcagtcaccgaaagctccgaacaggacatgaaaagcggcacagaggatcttaggactgagcgtctgcagaaaacgacagaaagattccgtaaccccgttgttttctctaaagatagcactgtccggaaaacacagctgcagtccttcagccagtatatagaaaataggcctgagatgaagcgacagcggtcaattcaggaggatacaaaaaaaggaaatgaagagaaggccgcaatcacagagacgcagcggaagccatcagaggatgaagtgcttaacaaagggttcaaggatacttcccagtacgtcgttggcgagctggctgccttagaaaacgagcagaaacaaattgataccagagcagccttggtagaaaaacggctccgctatttgatggatacagggaggaatacagaagaagaagaagccatgatgcaggagtggtttatgctggtgaataagaagaacgctctcatcagacgaatgaatcagctctccctcctcgaaaaggaacatgatctggagagaaggtatgagctcctcaaccgggagttacgggcaatgttggccatcgaggactggcagaaaaccgaggcacaaaaaagacgcgaacagctcttactggacgagctggtagcattagtgaacaagcgcgatgccttggtgcgcgacctcgatgctcaggagaagcaggccgaagaggaagacgaacaccttgagcgaacactcgagcagaataaaggaaagatggccaaaaaggaagagaaatgcgtactccagtag

SEQ ID NO: 28426 - DNA, 3483 bp, Artificial Sequence
  Description of Artificial Sequence: Synthetic coding sequence
atggcttccgtctggaagaggcttcaacgcgtcgggaaacatgcctccaagtttcagtttgtggcctcctaccaagaattgatggtagaatgtacaaagaaatggcagcccgataaactggtagtggtctggaccaggcgtagtcgcaggaagtcttccaaagcccactcttggcagcccggtatcaaaaacccctacaggggagtagtggtctggcccgtgccggagaacatagagatcactgtgacgctgtttaaggatccccacgctgaagagtttgaggacaaagagtggacgttcgttattgagaatgagagtcctagtggtcgcagaaaggctctggccacctctagcatcaatatgaaacagtatgcgtcacctatgccgacccagaccgatgtcaaactgaaattcaagcccctgtctaagaaggtagtcagcgctgcactccagtttagtctcagttgtatctttctgcgtgaaggaaaagctactgacgaggacatgcaatctctagcctccctaatgagcatgaaacaggccgatattggcaacctggacgatttcgaggaagacaacgaagacgatgacgaaaatcgggtgaaccaagaagaaaaagctgcaaagatcactgagcttataaacaagcttaacttcctcgacgaagctgaaaaagatcttgcaacagtcaactctaatccgttcgatgacccagacgcagctgaactcaacccgttcggggaccccgacagcgaggaaccaattacggagacagcctccccacgaaaaactgaggatagcttctataacaatagttacaatcccttcaaagaggttcagacaccccaatatttgaatcctttcgatgaaccggaagcttttgtgacgattaaagactctcccccacagagtacaaagcgcaaaaatatacggccagtggacatgtccaaatacctgtacgctgatagttcgaaaaccgaggaagaggagttggatgaaagcaaccctttctacgagccaaagagcactccgcctcccaacaacctcgtgaaccctgtgcaggaactcgaaacagaacggagagtgaagagaaaggccccagcaccacctgtcctcagtcctaaaacgggcgtgctgaacgagaacaccgtatctgctgggaaagaccttagcacgagccccaaacccagcccaatcccatcccctgtactcggcagaaagcctaacgccagccagagtctgcttgtctggtgtaaagaggtgaccaagaattataggggtgtgaagatcacaaactttacaacatcctggaggaatggactctccttctgcgccatcctgcaccacttcagacccgacctgatcgactacaagtcccttaacccccaggatataaaagaaaataacaaaaaggcttatgacggatttgcctcaatcggtatatcgagactcttggaaccttcagatatggtcctgctcgccataccagataagctaacagtgatgacatatctgtaccagatccgggcacacttctctggtcaggaactcaacgttgttcagattgaggagaacagctctaagtccacatataaggtcggtaactacgagacagatactaacagcagtgtagatcaggagaagttctatgcggagctgtcagaccttaaaagagagcccgaactgcagcagcctattagtggggctgtagactttctgtcacaagacgattcagtgttcgtaaacgactccggggttggggagagcgagagcgagcaccagacgccagacgaccatctctcgcctagtaccgcgagcccatattgccgaaggaccaaatctgacacagagccccagaagtctcaacagtcgagtggcaggacatctggcagtgacgatccaggcatttgtagcaatacagactcgactcaggcccaggtcctattgggaaaaaaacggttgctaaaagcagaaaccctggagctatctgacttgtacgttagcgataaaaaaaaagatatgagccctcccttcatttgcgaagaaaccgatgaacaaaaacttcaaactttggatataggcagcaacctggaaaaggaaaagctggaaaacagtcgttctctcgagtgcagatctgatcccgaatctccaatcaaaaaaacaagcctgtctcccacctcgaagctcgggtatagctattctagagatctcgatctggcaaaaaagaaacacgcctctttgaggcagaccgagagtgaccccgacgctgatagaacaacgcttaatcacgccgatcactcttccaagattgtgcaacacaggctgctatcaagacaggaagaactgaaggaaagagcacgggtattgctggaacaggcacgacgcgacgcggctctcaaggccggaaacaagcacaacacgaatacggccacccccttctgtaaccgccagttgtcagaccagcaagatgaggagaggcgtcgtcagctgcgcgagcgagccaggcaactgatcgccgaggctcggtccggcgtgaaaatgtccgaacttccaagctacggagaaatggctgcagaaaagctgaaggagcgcagtaaggcctcaggggagcaaaatagcaagctagttgacttaaaactcaagaagctcctagaagtgcaaccacaagtggccaattccccttctagcgccgctcagaaggctgtaacggaatcctccgagcaagacatgaagtctggcactgaagatttgcgcacagagaggcttcaaaaaactaccgagcgtttcagaaatcccgtcgtctttagtaaggattccactgtccgcaagacacagcttcagtccttttctcagtatattgagaaccggccagagatgaagcgtcagagatctatacaggaagacactaaaaaaggaaacgaggagaaggccgcaattacagagactcagagaaagcccagcgaagatgaggtcttaaataagggtttcaaagatacttcccagtacgttgtgggcgagctcgcagcactggagaatgagcagaagcagattgacactcgagccgcacttgtggaaaagcgcctgaggtacctcatggacactggcagaaacaccgaggaagaggaagctatgatgcaggagtggttcatgcttgtgaataagaagaatgctctgatccgcagaatgaaccagctgtccctgctggaaaaagagcatgacttggagcggagatacgagttattgaatcgggagctgcgcgctatgctagccatcgaagactggcagaaaaccgaagcccagaaacgtagagagcagttgttgcttgatgaactggtggcgctagtgaacaagagagatgccctggttcgagatttggacgcccaagagaagcaggctgaggaggaggacgagcatttagagcgcacccttgagcagaataagggtaagatggccaagaaggaggagaagtgcgttctgcagtag

SEQ ID NO: 28427 - DNA, 3591 bp, Artificial Sequence
  Description of Artificial Sequence: Synthetic coding sequence
atggctagtgtgtggaagcggctccagcgggtgggaaaacatgcctctaaatttcagtttgtggcctcttaccaggaattgatggtagagtgcactaagaaatggcagcctgacaaattagtcgtggtctggactcggagatcccgcagaaaatcctctaaggctcactcctggcaacctggcatcaaaaatccataccggggtgttgtcgtttggcctgtgcccgaaaacatagagatcaccgtcaccctgttcaaagacccacatgctgaggagttcgaggataaggagtggacttttgtgatcgaaaacgaaagcccttccgggcgaagaaaggcactggccacttcaagtatcaacatgaagcagtatgcgtcgcctatgccgacgcagactgatgtcaagctcaaatttaaaccacttagtaagaaggtggtgtcagctgcgctgcagttttcgctctcttgcatatttctgcgcgaaggtaaggccacagacgaggacatgcagagcctcgcgagcctgatgtccatgaagcaggccgacatcggaaacctcgacgacttcgaggaggacaacgaggacgatgatgagaatagagtcaatcaggaagaaaaggccgctaaaatcaccgagctaatcaacaaacttaatttcctggatgaagcagagaaggacctcgcaaccgttaactctaacccattcgacgatccagatgcggctgaactgaatccgttcggggaccctgattccgaagagcctataacagagacagccagtcctaggaaaaccgaagactctttctacaacaatagttataacccgttcaaagaggtccagactccacagtacctgaatcccttcgatgaacctgaggctttcgttaccataaaggacagtccccctcagtccacgaaacgcaagaacatcaggcccgtcgacatgagtaagtatttgtacgctgactcttctaaaaccgaagaagaggaactggatgaatccaaccctttctacgagccaaagagcacgccgccacccaacaacctcgtgaatcctgtccaggagttggagaccgagcgaagagtgaagcgcaaggctcctgcgcctcccgttttgagccctaagaccggcgtgctgaacgagaacacagtctccgccggaaaggacctgtcaacaagtccaaaaccatcccccattccttctcccgtcctcggcagaaagccaaatgcatcacaaagcctgctcgtgtggtgcaaggaagtcactaaaaattataggggcgtgaagattactaactttaccacgagctggcgaaacggactatccttttgtgctattcttcaccattttaggcctgatttaattgactataaaagtttaaaccctcaggacatcaaggagaataataagaaagcctacgatggcttcgctagcattggtatttcccgcctgctggagcctagcgatatggtcttactcgcgattcctgacaagctgaccgttatgacctacttatatcagatccgtgcacacttttctggccaggagctgaatgtggtgcagatagaagaaaactcatctaaaagtacatataaagtggggaattatgagaccgatacaaactccagcgtcgaccaagaaaagttttacgcggaactgtcagacctgaagcgcgaacccgaactgcaacagcccatctccggcgcagttgactttctgtcacaggacgattcagttttcgtgaatgactctggcgttggagagtcggaatcagagcaccagacccctgatgatcatctctctccctcgacagccagcccatactgtcggcgtaccaagtccgatacggaaccccaaaagtctcagcagagttccggccgaacaagcggctccgacgatcctggcatctgtagtaataccgactccactcaggcccaggtcctgctaggcaaaaagcggctgttgaaggccgagactctggaattatctgatttgtatgtctcggataagaagaaggacatgtctcctccctttatttgcgaggagaccgatgaacagaagctgcagaccctagacataggctctaacctcgagaaggagaagctggaaaactcaaggagtttagaatgccggagtgatcccgaaagcccgatcaagaagacaagcctgtcacccactagcaaactggggtattcgtattcaagggacttggatctggccaaaaagaagcacgctagccttagacaaactgagtcagaccccgacgccgatcgaactacactgaatcacgcggaccactcctcaaaaattgtccaacaccggctcctgagtcgccaggaagagctcaaagaacgagcacgggtgctgctagagcaagccagacgtgatgccgctctcaaagccggtaacaagcacaacaccaacacagctactcctttctgcaatagacagttgtctgatcagcaggacgaggagcgccgaaggcagctacgggagagggctaggcagctgattgccgaggcaagatctggagtgaaaatgagcgagttgccgagctacggagagatggccgcagagaaacttaaagaaagatcaaaagccagtggcgacgagaatgacaacattgagatagataccaatgaggaaatccccgaagggttcgttgtgggcggaggtgatgagttaactaatctggaaaacgacctggacacacccgagcagaatagtaaacttgtggacttgaaactgaaaaaattactcgaagtgcagcctcaggtggctaactccccctcttctgccgcacagaaggccgtaacggaatctagtgagcaggatatgaagtctggcactgaggacctacgcacagagagactgcagaaaacaactgagcgattcagaaaccccgtggtgttctctaaggattcgactgtgagaaaaacacaactgcagtcgttctcccagtatatcgaaaaccgccctgagatgaaacggcagcgtagtatccaggaagacacaaaaaagggaaatgaagagaaggccgctattaccgagactcagcggaagccaagtgaggatgaggtcctcaataaggggttcaaggatactagccaatatgtcgtcggcgagcttgccgctctcgagaatgaacagaagcaaatcgatacgcgagcggcacttgttgagaaacgattgagatacctcatggacacaggcaggaacaccgaagaggaggaagctatgatgcaagagtggttcatgctagttaacaagaaaaacgctctgatccgcagaatgaatcaactgagccttctcgagaaagaacacgacctggagagacggtacgaactgctgaaccgcgaacttagagcaatgctcgctattgaggattggcaaaaaactgaggcacaaaagagaagagagcagttacttctggacgagctggttgccctggtcaacaaaagagacgctcttgtgcgcgacttggatgctcaggaaaagcaagcggaagaagaagacgagcatctcgaacggacacttgagcagaacaaggggaagatggccaagaaggaggaaaaatgcgtgctgcagtag

SEQ ID NO: 28428 - DNA, 933 bp, Artificial Sequence
  Description of Artificial Sequence: Synthetic coding sequence
atggccagcgtgtggaagcgtttgcagcgcgtgggcaagcatgccagcaaattccagtttgtggcctcataccaggaattgatggttgagtgcactaaaaagtggcagccggataagctagtggtggtttggacaagacgctcacgacgcaagtcatccaaggcacactcctggcagcctgggattaaaaacccttatcggggagtagttgtctggccagttccggagaatattgagatcactgtgacactgttcaaggatccccatgccgaggaatttgaagataaagaatggacttttgtcatcgaaaacgagagcccctccggaagacggaaagcgctggccacttcgtccattaatatgaagcagtacgctagccccatgccaacccagaccgatgtgaagcttaagttcaaaccattaagcaaaaaagttgtgagcgctgcactccagttttctctcagttgcatcttcctgagggagggcaaagcaaccgacgaggatatgcagtcacttgcaagcttgatgtcaatgaaacaggccgatattggcaacctggacgactttgaggaggataacgaggacgacgatgagaatagagtgaaccaggaagagaaggctgccaagattactgagctcattaacaaacttaattttctagacgaagcggagaaagacctcgccaccgtgaactccaatcccttcgacgatcccgacgccgcagagttgaatccctttggcgatcccgactcagaggagcctatcaccgagaccgcttcgccccgtaagaccgaggatagcttttataacaattcatacaatccttttaaagaagtgcaaactccccagtatctcaatcccttcgacgaaccagaggcatttgttaccatcaaggattcaccacctcagagtacaaaaaggaaaaatatctag

SEQ ID NO: 28429 - DNA, 234 bp, Artificial Sequence
  Description of Artificial Sequence: Synthetic coding sequence
atggcatctgtttggaagaggttgcagcgagttgggaagcatgcaagtaagtttcagtttgtggctagttatcaggagctaatggtcgagtgtaccaagaaatggcagccggataagctcgtggtggtctggactcggcgaagtcgcagaaaatcatcaaaggcgcatagctggcagccaggaatcaaaaatccctaccgaggcgtggtcgtttggccagtccctgaaaattag

SEQ ID NO: 28430 - DNA, 3483 bp, Artificial Sequence
  Description of Artificial Sequence: Synthetic coding sequence
atggccagtgtctggaagagactgcagcgggtgggcaagcacgcttccaaatttcagtttgtggcttcataccaggaacttatggttgaatgtacaaagaaatggcagcccgataagcttgtggtggtgtggaccaggaggagccggcgtaagtcctctaaagctcattcctggcaaccaggaatcaaaaatccgtacagaggagtcgttgtctggccggttccagaaaatatcgagataactgtgaccctgtttaaggatccccacgcagaggaatttgaggacaaagagtggacattcgtaattgagaatgaatctccatccggcaggcggaaggctctcgctacatccagcattaatatgaagcagtacgccagccccatgcccactcagaccgatgtgaagttaaaatttaaaccgctttccaaaaaggtagtctctgccgctctgcagttcagtctgtcctgcatcttcctgagggaagggaaggccaccgacgaggacatgcagtctcttgcgtccctgatgagcatgaagcaagcagacatagggaacctcgacgatttcgaggaggacaacgaagatgacgacgagaacagagtgaaccaagaggagaaggcagctaagattaccgagctgataaataagcttaactttctggacgaagcagaaaaggatcttgctactgtcaattctaatcccttcgacgatccagatgcggcagagctcaatccattcggcgatcccgattccgaggagcccattactgaaacagcgtctccgaggaagactgaggacagcttctataacaacagctacaacccttttaaagaggtccagacgccacagtacctgaatcccttcgacgagccagaggctttcgtgaccattaaagacagccctccccagtcgaccaagagaaaaaacattaggcccgtcgatatgtcaaagtacttgtacgctgactctagcaaaaccgaagaggaggaactggatgaatccaatcctttttacgagcccaagtccacacccccaccaaataatcttgttaatcccgtgcaagagctggaaacagaacggagggtgaagcgcaaagctcctgcgcctcccgtgctgtctcctaagaccggtgtgctcaacgagaatacagtgtccgccggaaaagatctaagcacatccccaaagccatcacccatcccatccccagtcctgggcagaaagcctaatgccagtcagtctctcctcgtgtggtgcaaggaggtcaccaagaattaccgaggagttaaaattaccaatttcactaccagctggcgaaacgggttaagcttttgcgcaatcctccaccacttccggccagatctcatcgattacaaatccttgaatcctcaggacatcaaggagaataacaagaaagcctacgacggattcgcaagtataggcatttccagactgttggaaccttcagacatggttcttctggcaatcccagacaaacttaccgtgatgacttacctgtaccagattagggcgcacttctctggccaggaactaaacgttgtgcagatcgaggaaaattcctcaaaatctacatacaaggtgggcaactatgagactgatacaaatagttcagttgaccaagaaaagttttatgctgaattaagtgaccttaagagagagcccgagctccaacagcctattagcggggctgtggacttcttgtcccaggatgattctgtctttgtgaacgattcgggagtaggcgagagcgaaagtgagcatcagacacccgatgaccacctcagtccctcgacagccagcccttactgccgccgaacaaaatctgataccgaaccacaaaaatcgcagcagagtagcggcaggacttccggtagcgatgatcccggaatctgtagcaacaccgacagtacccaggcccaggtactgttgggtaagaaacgtctattaaaggcagaaacactggaactctcagatctgtacgtgagcgacaaaaagaaagatatgagccccccttttatctgcgaagagaccgatgagcagaaacttcagacactggatatcggcagtaacctcgagaaagagaaactggaaaattcgcgttctctggagtgccggagtgaccctgagagccctattaaaaagacctcccttagcccaacctctaagctgggttatagttattcaagagacctggatcttgctaagaaaaaacatgctagcctcagacagacggaatccgatcccgacgccgatcgaacaaccttaaaccatgccgatcacagcagcaagattgtgcagcatcgcctcctgtcccgccaggaggagcttaaagagcgcgctcgcgtgctgttagagcaggcacggcgagatgccgctctgaaagctggcaataagcataatacaaatactgcaaccccattctgcaatagacagctgtcagaccaacaggacgaagagagaaggcgtcagctcagggaacgagcacgtcagctcatcgctgaagcacgctctggcgtcaagatgtctgagctcccgtcttatggagagatggccgcagagaaacttaaagagagatctaaggcttctggggaacagaactccaaacttgttgatcttaaactcaagaaactgctcgaagtgcaacctcaggtggccaacagcccatcttcggccgcacagaaggctgtgacagaatcttcagaacaagacatgaagtctggaacagaagacctgcggaccgagcggttgcaaaagaccaccgaacggtttagaaatcctgttgtattctccaaggacagtacagtcaggaagactcagctgcaaagtttcagccagtacattgagaaccgaccagagatgaaacgtcaacggagcattcaggaagacactaaaaaaggaaatgaggagaaggctgcaattactgaaacacagaggaagccaagtgaagacgaagtgctgaataaaggttttaaagatacctcccagtatgttgtcggggagctagcagccctcgaaaatgaacaaaaacaaatagatactcgcgcagctcttgtggagaagcggctaagatacttgatggatacaggcaggaacacagaagaggaggaagccatgatgcaggaatggttcatgctcgtgaataagaaaaacgccctgatacggaggatgaaccagctgtccctgctggagaaagagcatgatctagagcggagatacgagctgttgaaccgcgagctgagagccatgctcgctatcgaagattggcagaaaactgaggcacagaagaggagggaacagctcttgttggacgaactggtggctctcgtgaacaaaagagatgcactggtcagagatcttgacgcacaggaaaagcaggccgaggaggaggatgagcacctggagcgcacattggagcagaataaagggaagatggctaaaaaggaagaaaagtgcgttcttcagtag

SEQ ID NO: 28431 - DNA, 609 bp, Artificial Sequence
  Description of Artificial Sequence: Synthetic coding sequence
atgaagcgacagcggtctatccaggaagacacgaaaaaaggcaatgaggaaaaggccgcaatcaccgaaacccagagaaaacccagcgaggacgaagtgcttaataaaggcttcaaagatacatctcaatatgtcgtcggggagctggctgcgttagagaacgaacaaaaacagatcgatacacgcgctgccctggtcgagaaacgcctccggtacctcatggataccgggaggaacacggaggaagaggaggcaatgatgcaggagtggttcatgctggttaataagaagaacgctctcattaggaggatgaaccaactgtcacttttagaaaaggagcacgatttggagcgacgctatgagctgttaaaccgagagttacgggcaatgctcgcgattgaagattggcagaaaactgaagcgcagaagaggcgggagcagctgcttctggacgagctcgtcgctctggtaaacaagcgcgacgccctcgtgcgggaccttgatgcccaggaaaaacaggccgaagaagaggacgagcacctggaacgtacgctcgaacagaacaagggaaaaatggcgaagaaggaagagaagtgtgttctccagtag

SEQ ID NO: 28432 - DNA, 1287 bp, Artificial Sequence
  Description of Artificial Sequence: Synthetic coding sequence
atggacccctccgtaactctgtggcagtttctgctccagctactgcgagagcaaggcaatggccacatcatctcgtggacctctagagatgggggagagtttaaactggtcgatgcagaagaggtggctcgtctctgggggctgcgcaaaaataagacgaacatgaattacgacaagctgtcccgtgccctaagatactactatgacaaaaacattatccggaaggtgtcaggacagaaatttgtgtacaaatttgttagttacccagaagtggctggttgtagcacggaggactgtccgcctcaacccgaggtctccgtgaccagcacaatgccaaatgtcgccccagccgctatccatgcagccccaggggatacggtgagcggtaagcccggtactcctaaaggtgccggaatggccggacctggaggtctcgctcggtcatcacgtaatgaatatatgcgatctgggctgtactccacctttacaatccagagtttgcagcctcaaccgccaccacacccaagacccgctgtcgtgttgcccagcgctgcccctgcaggtgcagccgctccccctagtgggagtagaagcaccagcccttctcctctagaggcttgcctggaggcagaagaggctgggttgccactgcaggtaatcttgacaccccctgaagcccctaacttgaagtctgaggagctgaacgtagagcccggactagggagagcattgccacccgaagtcaaagtggagggccctaaagaagaactggaagtcgctggtgagaggggatttgtccccgaaacaaccaaagcggaacctgaggtccccccacaagagggggtgccggctagactgccagcagtggtcatggacacggcagggcaggcgggagggcacgcagcttcgtccccggagatctcacagcctcagaagggcagaaagcccagggacctggagctccctctcagcccctcgctgctaggcggtcctggaccagagcgaactcctggttctggctccggctcaggcttgcaggctccaggtccagccttaactccctccctgctgcccacccacactcttaccccagttcttctaacgccttccagcttgcctcctagtattcatttctggtctaccctgtcccctattgcaccacggtcaccagcaaagcttagtttccagtttccctctagcggctcggcgcaagtccatattccctctattagcgtggatggcctttcgacccctgtggttctgtccccagggcctcaaaagccctag

SEQ ID NO: 28433 - DNA, 288 bp, Artificial Sequence
  Description of Artificial Sequence: Synthetic coding sequence
atggaccctagtgtcacactgtggcaatttcttctccagctcctacgtgagcagggtaatggccacatcatatcctggacatccagagatggtggcgaattcaagctggtcgacgcagaagaggttgctaggctgtggggtctgcgcaaaaataaaaccaatatgaactacgataaattgagtagggccctgcggtattactatgacaagaacatcattcgaaaagtgtctgggcagaaatttgtatataagttcgtcagctaccctgagagtcactgtgcaccgtag

SEQ ID NO: 28434 - DNA, 1287 bp, Artificial Sequence
  Description of Artificial Sequence: Synthetic coding sequence
atggacccaagtgtgacattgtggcagttcctgttgcaattgttgcgggagcagggtaatggccacatcatctcttggacctccagagacggcggagagttcaaactcgtagatgctgaggaggtcgcaagactgtggggtcttcgaaaaaataagaccaacatgaactatgacaaacttagtcgcgctttgcgctactattatgacaagaacatcatccgcaaggttagcggacaaaaattcgtatacaaatttgtgagttacccagaggtggccggatgcagtactgaagactgccctccacagccggaggtttccgttaccagtacgatgcccaacgtggcccctgcagccatacatgccgcaccaggcgatactgtctcggggaagcctggcacacctaaaggggcagggatggctggtccaggaggactggctcggagttcacggaatgagtatatgcgcagcgggttgtactccacattcactatacagtctcttcaaccacagccgcctccacatcccaggcctgcggttgtactgcctagcgctgctccagccggtgctgcagccccaccgagtgggtcccggagcacctccccatcacctcttgaggcttgtttggaggctgaggaagctggactgcctctgcaagtaatactcacaccaccggaagcccctaatcttaagagcgaggaattgaacgttgagccgggtttgggtcgagccttgcctcccgaggtgaaggtcgagggacctaaggaggagctagaggtggcaggggagagaggctttgtgcccgagaccacgaaggctgagccagaggtcccaccgcaagagggggtaccagccagactccccgctgtggtcatggacacagctggacaggccggaggacacgctgcatcaagtcccgagatctcccagccgcagaaaggtcgtaagcccagggacctggagttgcctctgtcacctagtctgttgggcggtcccggacccgagcgcacccccggaagcggaagcgggtcaggactgcaggccccagggcctgccttgactccttccctcttgccgactcatacactcacccccgttctgctgaccccttcgagcctacccccatctatacatttctggagcactctctctcccatagcccctcgcagcccagctaagttatccttccagtttcccagcagtggatcagcgcaggtccacattccctcaatcagtgttgacggactgagcacaccagtcgtgttgtcacctggccctcagaagccttag

SEQ ID NO: 28435 - DNA, 366 bp, Artificial Sequence
  Description of Artificial Sequence: Synthetic coding sequence
atggatacggcaggacaagctggcggtcacgcagcaagttctccggagatctcgcagccccagaagggcaggaagcctcgcgatctggaactacccctgtctccatccctattgggaggcccaggaccggagcggacccctgcactgttacctacacatactcttacccccgtattgttgaccccctcgtcactgccaccctccattcacttctggagcacactgagccccatcgcccctagatctccagctaagcttagtttccagttcccgtcttccggatctgcacaggtgcacatacctagcatttccgtggatggattgagcaccccagtcgtgttgtcgcctgggcctcagaaaccatag

SEQ ID NO: 28436 - DNA, 1713 bp, Artificial Sequence
  Description of Artificial Sequence: Synthetic coding sequence
atgagcgagcagagtatttgccaggcccgtgccgctgtgatggtctatgacgacgctaataagaaatgggtgcctgctggagggtctacaggattctcaagggtgcacatataccaccatactggtaataacacctttcgcgtcgtggggaggaaaattcaagatcaccaggtcgttattaattgcgccatccccaaggggctgaagtataatcaagcgactcagacctttcaccagtggcgagatgccagacaagtgtacggattgaacttcggcagtaaggaggacgcaaatgtctttgcttccgccatgatgcacgcgctggaggtgttaaacagccaggagaccggaccaaccctcccgagacagaatagccagctgcctgctcaggtccagaatgggccaagtcaggaggagctggaaatacagcggcgacagctgcaagagcaacagcgccagaaggaactggagcgcgaacggttagagagggagagaatggaaagagaacgtctggagcgcgaacggctggaacgagagagattggaaagagaaagactcgagcaagaacagctggagagagaaagacaggagagagagagacaggagcgtttagagcgccaggagcgactggagcgccaggaaaggctggagaggcaggagcgactcgaccgtgaaaggcaggagaggcaggagagagagcgactggagaggctcgagcgagaaagacaggaaagagaaagacaggagcagctagaacgcgagcagcttgagtgggagagagaaagacggattagtagcgcagccgctccagcttctgttgaaacaccactcaatagcgtactgggcgactcatcagcctccgaacccggactgcaagccgcaagtcaaccagcagagactccctctcaacagggcatcgtgcttggccctctggcgccaccgccacccccacctctaccaccgggacctgctcaggcctccgttgcccttccaccaccccctgggccacctccccctccaccattaccctctaccggccctcctccccctccccctccaccaccgttgcccaaccaggtgccaccccctcccccaccccctcctgccccacctctgcccgcaagcggttttttcctggcgtctatgagtgaagacaataggccgctgacaggactggctgccgcaatcgctggcgcaaaattgcggaaggtcagtaggatggaggatacctcctttccatcaggcggtaacgctatcggcgtcaattccgctagttcaaagacagacactgggagaggcaatggtccgttaccattgggcggtagcggactgatggaggaaatgtcagccctgctggcccgtcgtcgcagaatcgccgagaagggcagcactattgaaaccgagcagaaggaagacaaaggggaagatagcgagcccgtaacctccaaggcatcctccaccagcaccccagaaccgacacgcaaaccttgggaacgtactaatactatgaatggaagcaaatcccctgtgattagccggcctaagtctacaccactcagccagcctagcgcgaatggcgttcagactgaggggctggactatgataggctcaaacaggacatacttgatgaaatgaggaaggaactgacgaaactgaaagaagaattgattgacgcaatccgacaggagttatccaagtcaaacaccgcatag

SEQ ID NO: 28437 - DNA, 1776 bp, Artificial Sequence
  Description of Artificial Sequence: Synthetic coding sequence
atgtctgaacagagtatctgccaggccagagccgcagttatggtgtacgatgatgctaataaaaaatgggtacccgctggcggaagtaccggattttctcgcgtccatatctaccaccacaccggcaacaataccttccgggtcgttgggagaaagatccaagaccaccaggtggtgatcaattgtgccatcccaaaaggcttaaaatataaccaggcaacacaaacatttcaccagtggagagatgcacgacaggtgtacggtctgaattttgggtccaaggaggacgcaaacgtgttcgcttcagcaatgatgcacgccttggaagtgttgaattctcaggagacaggcccaactttgccaaggcaaaactctcagctccccgctcaagttcagaatgggccaagccaagaagaattggagattcaacggaggcagctccaggagcaacagcggcaaaaagagctggagcgggagagattggaacgggaaagaatggagagagaacgactcgagagagaaagactcgagcgagaacgcttggagcgggagcgtctggaacaggaacaactggagcgtgagcgacaggagcgggagcggcaggagagactagagcgccaggaacgcctagaacgacaggaacgactggaaaggcaggagcgcttggatagggagcggcaggaacgccaggaaagagagcggctcgagaggctcgaacgcgagcggcaggagagggagaggcaggagcagctagaaagagagcaactggagtgggaaagagaacgaaggatatcctctgctgccgctcctgcttctgtagaaacaccactgaattccgtgctgggtgactcctctgcttccgaaccaggacttcaggcagcgagccaaccagccgagacaccgtcccagcaaggcattgtgttggggcctctcgcccctccccctcctcctcctttgcccccaggacccgctcaggcctctgtcgccctgccgcctcctccaggacctcccccacccccaccacttcccagtactggtccaccacccccaccgccaccccctccgctgcctaaccaagtgccccctcctcccccaccaccccctgcccctccccttccagcgtccggcttctttttggcgtcaatgagcgaagataatcgcccactaacagggctggccgcagccatcgccggtgccaagctccggaaggtgtcacggatggaggatacctctttcccatctggcggtaatgctatcggcgttaattcggccagcagcaaaactgacaccggtagagggaacggcccactaccgctcggcggaagcggtctaatggaggaaatgtctgccctgctggccaggcgccgaagaattgccgagaaggggtccacaatcgagacagagcagaaagaggacaaaggagaggatagtgaacccgtaacctctaaagcgtcgtccacaagcacgccagagccaacgcggaagccctgggagagaacgaatacaatgaacggaagcaagtcaccagtcatcagtaggagagattcacctcgaaagaatcaaatcgtttttgacaatcggtcctatgattccctgcaccggcctaagtccactccacttagccagccctcagcaaacggagttcagaccgaggggctggactacgaccggctgaagcaggacattctggatgaaatgcgcaaggaactgactaagcttaaggaggaacttatagatgctataagacaggagctcagtaagtcaaacacggcctag

SEQ ID NO: 28438 - DNA, 1599 bp, Artificial Sequence
  Description of Artificial Sequence: Synthetic coding sequence
agcgagcaaagcatctgccaagcccgagccgctgttatggtgtatgatgatgccaacaagaaatgggtgcctgcgggaggaagcacagggttctctagggtgcacatttaccatcacacgggcaataacacttttagggtagtggggaggaagatccaggatcatcaggtagttataaactgtgctatcccgaaggggcttaagtacaatcaggccacacagaccttccatcagtggagggacgctcggcaggtgtacggactgaacttcggttctaaggaggacgccaatgtttttgcttccgctatgatgcacgctctcgaagtgctgaattctcaggagacaggaccgaccctgcccagacagaactctcagctcccggctcaggtgcagaatggtccttcacaagaggaactcgagatccagcgacgccagttgcaggaacagcagagacagaaagaattggagcgcgagcgcctggaacgcgagcgtatggagagagagaggctggagcgggaacgtctcgaaagggagcgcctggaacgcgaacgtctggagcaggagcagttggagcgggagcggcaggaacgggagcgccaggaacgactggagagacaggaaaggctggaacggcaggagaggttggagcgacaggagcggctggacagggagcgccaggagcgacaggaaagagagcgtcttgagcgtctggaaagagagcgtcaggaacgggagagacaggagcaacttgagcgggagcagcttgagtgggagcgtgaaagaagaatctccagcgctgggatagtgttggggccactggcgccacccccaccaccacccctgccacccggtccagcccaagctagcgtcgctctgccaccaccaccagggcctccccctcctcctcctttaccgagtaccgggccaccacctccacctccccctccaccgctcccgaaccaggtccctccccctcccccacctccgccagccccaccgctacccgcatcaggcttcttcctcgccagcatgagtgaggacaaccgccctttaacagggctcgcggctgcgatcgcgggagcaaaactgagaaaagtatcacgcatggaggataccagcttcccctccggcggtaatgccattggagttaactcagcaagctccaagactgacaccggcaggggcaatggccctctgcccttagggggttcaggcttgatggaagaaatgagcgccctgctagcgagacgtcggaggatagcagagaaagggagtactatcgagacggagcaaaaagaagacaaaggtgaggacagcgagccagtcacatcaaaggcctcctcaacatccacacccgaaccgacgcgcaagccctgggagaggactaacacaatgaacggcagcaaatctccagtaattagtcggccaaaatccacacccttgtcccagccttcagcaaatggtgtgcaaacagaagggctggactacgaccgattgaagcaagatatcttggatgagatgcgaaaagaactgaccaaattgaaagaagagttgatcgacgccataagacaggagttgtccaaatccaacactgcatag

SEQ ID NO: 28439 - DNA, 1878 bp, Artificial Sequence
  Description of Artificial Sequence: Synthetic coding sequence
atggatagaggcactctccccctggccgtcgctttgctcttagcctcgtgttcgctcagcccaacttccctcgccgaaactgtccactgcgacttgcagccggtgggccctgagagaggcgaggttacatacaccacctcccaggtctctaaaggatgcgtcgcgcaggcccctaacgctatccttgaagtgcatgtgttgttcttagaattccccaccggaccttcccaattagaactaactctccaagcatctaaacagaacgggacatggccaagggaagttctactggtgttgtcggtgaactcctctgtgtttttgcacctgcaggcgctgggcataccattgcatttggcctacaactcgtccctggttacttttcaagagcctcccggagtcaacactacagagttgccgtcatttccaaagacacagatcttagagtgggctgcggagcgcggaccaattacatctgctgccgagctaaatgatccccagtcaattctgctcaggctcgggcaagcacagggatcactctccttctgtatgcttgaggcttctcaagatatgggtcggaccttggagtggcggcctaggacccctgcgctggtgcgtgggtgtcatcttgagggcgtggctggccataaggaagcgcatatccttcgcgtgcttccgggacatagtgctgggccacggaccgtaaccgtgaaggtggaattgagctgcgccccaggagatctggatgccgtcttgattctccaaggcccaccgtatgtgtcatggctgatcgatgctaaccacaatatgcagatctggacaactggcgagtacagtttcaagatctttcccgagaagaatatccgaggttttaagctcccagatactcctcagggcctcctaggtgaagcgagaatgctgaacgcatctatagtggcctccttcgttgagctccccttggcctcaattgtttccttacacgccagtagctgcgggggacgactccaaacaagtcccgcaccgatccagacaacacccccaaaggatacctgtagccctgaacttttgatgtctctgatccagaccaagtgcgccgatgatgcaatgactcttgttctgaaaaaggagctcgtggcacacctcaagtgtactatcactgggttgacattttgggatcctagctgcgaggctgaggatcgcggagacaaattcgtgctgcgttctgcctatagctcctgcgggatgcaggtttctgcatccatgattagcaacgaagcagtagtcaatattctatcaagcagctctcctcagagaaaaaaggtgcattgtctgaacatggattcccttagcttccagctgggtctttacctgtcaccccatttcctgcaagcgagcaacaccatcgaacctggacagcagtcctttgttcaggtgcgtgtcagccctagtgttagcgagttcttgctacagctggattcctgccacctcgatttagggcctgagggcggaaccgtggagctgatccaagggagggctgccaagggaaactgcgtgagcctactgagtccctccccggaaggagatcccagattctcttttctactgcacttctacaccgttcccatcccaaaaaccggcaccctcagctgtactgtcgctcttcgtccaaaaactggaagtcaagaccaggaggttcaccggactgtcttcatgcgtctcaacattatttctccggatttgagtggctgtaccagcaaagggctcgtgctgcctgcggtgctcggcattacttttggtgccttcctgatcggagcactccttaccgcggctctgtggtacatctacagtcatactagggaatatccccgtcccccacagtag

SEQ ID NO: 28440 - DNA, 1977 bp, Artificial Sequence
  Description of Artificial Sequence: Synthetic coding sequence
atggacaggggtactcttccactcgcagtggccctactgttagcatcgtgtagcctgtccccgacttccctggctgagaccgttcattgtgacttacaacctgtgggtccggaaaggggggaagtgacttatactacatcccaggtgagcaaaggttgtgtggctcaggctccaaacgctattctggaggtgcatgttctgtttctggagtttcctaccggacccagccagcttgaactgactctgcaagcatcaaaacagaacggaacctggcctcgtgaggtgctcctcgtcctaagcgtaaattctagcgtgttcttacacctacaagcgctggggatccctctgcacctcgcatataatagcagcctagtcacatttcaggaacctcccggtgtgaacacgacagagctccctagctttcctaagacacagattttagagtgggcagcagaaagaggacctatcaccagcgcggcagaactgaatgacccccaatcgatcctgttacgcctgggtcaagcgcagggctcactgtcgttttgtatgctcgaagcaagccaagatatgggaaggactctggagtggcgaccacggactcccgctttggtccggggatgtcacctggagggagtcgccggtcataaggaagcacacatcctgcgcgtcctgcccggtcactcggctggtcctaggactgtcaccgtaaaggtggaattgagttgtgcaccaggagacctggatgcagtgctgatcttacaggggccaccctacgtttcatggcttatagatgccaaccacaatatgcaaatctggactaccggcgagtatagctttaagatctttcccgagaagaacatccgaggattcaagctgcctgacaccccacagggactgctaggcgaggccagaatgctgaacgcaagcatcgtggcctccttcgtggagctcccactggcaagcatagtgagcttgcatgcaagttcctgtggaggccgtctgcagacaagtcctgccccaatacaaactactccacctaaagatacatgtagccccgagctgttgatgagcctgattcagactaaatgtgctgacgatgcaatgaccctggttctcaagaaagagcttgtggctcaccttaaatgcacgatcaccggattgacattctgggacccaagttgtgaggctgaagatcggggtgacaaatttgtgcttaggagcgcatactcatcttgtggaatgcaagtatcggcttccatgatctcaaacgaggccgtggtgaacattctcagttcttcatcaccacagaggaagaaagttcattgtctgaacatggatagtttatcatttcagctgggcctttatctctcaccccactttctgcaggcttctaacactatcgaaccaggacagcagagctttgttcaagttagagtgtcccctagcgtgtccgaattcctgcttcagctggattcctgccacctcgatctgggacctgagggcggtaccgtggagctgatacagggcagggccgctaaagggaactgtgtttcccttctgagcccctccccagagggcgacccccgattcagttttttgctacacttctatacagttccaatccctaaaacagggaccctgagttgtaccgtagcactccgacccaaaactggatcccaggatcaggaggtacacaggacggtctttatgcgactaaacatcatatcacctgacctttccggttgcacgtcaaagggactcgttctgcctgctgtcctcgggataacattcggtgccttcctgattggggctctgctcaccgccgctttgtggtatatctacagccacactcgctctccaagtaaacgcgagccagtcgtcgccgtagctgccccagcttccagtgagtcctcctctacgaaccatagcatcggatcgacacagagcacaccctgttccacatcttccatggcctag

SEQ ID NO: 28441 - DNA, 1977 bp, Artificial Sequence
  Description of Artificial Sequence: Synthetic coding sequence
atggacagagggacacttcctcttgccgtggccttattactcgcctcctgctcgctgtctccgacttcactggcagagactgtgcactgcgacttacagcctgtaggacccgaacgcggagaagtgacctacactacctcacaagtgagcaagggttgcgtcgcccaagcaccaaatgcgattcttgaggttcatgtactctttctggagtttccaacgggaccttctcaactggagctcacactccaggctagtaagcagaacgggacttggcccagagaagtcttattggtcctgtccgttaactcaagcgtgtttctgcacttgcaggctttgggtatacctctccatttagcctacaatagctccctcgtaacattccaggaaccgccaggcgttaacacgactgaacttccatctttccccaaaacacagatcctcgagtgggcggctgagagagggcctattaccagcgcagcggagctgaacgatccgcagagcattctactcaggctggggcaggcacagggatctttgagcttctgtatgcttgaggcaagccaggacatgggtcgcaccctcgagtggcggcctaggacaccggctcttgtaagaggttgtcacctcgagggggtggccggtcacaaagaggcccatattttgcgggtactgccaggtcattccgccggacccagaacagtcacagttaaagtggagctttcttgcgctcctggcgatctggatgcagtgctgattctccaaggacccccttacgtgagctggcttatcgatgcgaatcacaacatgcagatctggaccactggggagtactccttcaagattttcccagaaaaaaatatcagaggattcaagctcccagatacccctcagggcctgttgggggaagccagaatgctgaatgcctctattgtggctagttttgtggagctgccactggcctccattgtttccctgcacgcctcttcctgcgggggacgtctgcagacttcaccagcgcctattcagaccaccccgcctaaagatacatgttccccggagctgctcatgtctcttatccaaaccaaatgcgctgacgacgcaatgaccctggtgcttaagaaagagttagtagctcacctcaagtgcacaattactggcctgaccttctgggatcccagttgtgaggccgaagaccgcggtgataaatttgtgttaagaagtgcttactcaagttgtggcatgcaggtgtcagcctctatgatatccaatgaagcagtggtcaatatcctttcttcatcctctcctcagaggaagaaagtccactgcctaaacatggatagtctgtccttccaactcggactgtacctttctcctcattttttacaggctagcaatactattgaacctgggcagcagagctttgtccaagttagagtgagcccttccgtgtctgaattcctgctccagctcgactcctgccatctcgacctgggaccagaagggggtactgtggaattaattcagggcagagccgcaaaaggaaactgtgtcagcctactgtccccctctcctgagggtgatccgaggtttagttttctactgcacttctatactgtcccgatccccaagacaggcactttgagctgcactgtcgctctgaggcctaagacaggaagtcaggatcaagaggtccatcgtaccgtgttcatgcgactcaacatcatcagtccggatctgtccggatgcacaagtaagggattagttcttcctgccgtgctcggcatcacctttggtgcattcctgattggtgccctgctgacagcagccctgtggtacatctacagccacacacggagccctagtaaaagggaacctgtcgtcgcggttgcagcgcctgccagcagcgaatcctcctccaccaaccacagtattggaagtacccaaagcactccttgtagcacctcatcaatggcttag

SEQ ID NO: 28442 - DNA, 1431 bp, Artificial Sequence
  Description of Artificial Sequence: Synthetic coding sequence
atgctcgaggccagtcaggacatgggcaggacactggagtggaggcccaggacccccgcactcgtgcgaggatgtcatttggagggagtcgcaggccacaaagaggcccacatacttcgcgtcctacccggtcattcggctggcccacgcactgtcactgtcaaagtggagctcagctgtgcccctggagacctggatgcagttttgatcttgcagggacccccttacgtgtcgtggttgatcgatgctaatcacaacatgcagatctggactacaggcgaatattccttcaaaatctttcccgagaaaaatatcagaggtttcaaactgccagacacgccccagggcctgctcggggaagctcggatgttgaacgcaagcatcgttgcttcatttgtagaactccccttagccagcatcgtcagcctgcacgcctctagttgtgggggacgcctacagactagtcccgcaccaatccagaccactccaccaaaagacacatgttcccccgagctgctcatgtcgctcattcagacgaagtgtgcagacgacgccatgaccctagtgctgaagaaagagctcgtggctcatttgaagtgcaccataaccggcctgaccttctgggatccttcctgcgaggccgaagacaggggcgacaagttcgttctgaggagcgcatattcctcctgcggcatgcaagtctcggcttctatgatttctaacgaggcagtcgtgaacatactgtcttcgtctagcccccagcgcaagaaagtccactgtcttaacatggattctctgtccttccagctggggctttacctctctccacacttcctgcaggcatccaataccatagagccgggacagcaatcgtttgtgcaggtgcgggtgtccccttccgtcagcgaattcctgttacagctcgactcctgtcacctggacctcgggcctgaaggaggcacagtcgagctcattcaaggtcgcgctgccaaaggtaattgtgtgtctctgctctctccgtctcctgagggagaccccagattttcgtttctcctgcatttctataccgtaccaattccaaaaaccgggacattgtcctgcaccgtcgccctcagacccaagactggcagccaggatcaagaagtccatagaacagtcttcatgcgcctgaacatcatatcgccagatctgtctggatgcacatccaaaggcttggtcctccccgcagtgctgggcattacatttggtgcgttcctgatcggtgctctcctcacagcagctttatggtacatttactcacacacccgcagccccagtaagagggaacctgtggtcgcagtagcagccccagcttcctcagagtcatccagcaccaaccattctattgggtctacgcaaagcaccccatgtagcaccagtagtatggcttag

SEQ ID NO: 28443 - DNA, 639 bp, Artificial Sequence
  Description of Artificial Sequence: Synthetic coding sequence
atggattatctgctgatgatattctcgctcctcttcgtggcatgccagggcgcacccgagactgcagtgctgggagcagaactatcagccgtcggcgaaaacggcggagagaaacctaccccttcgccgccttggcggctgcgcaggtcaaaaagatgctcctgctcatcgctgatggataaggagtgcgtttatttctgccatctagatattatctgggtgaatacccccgaacatgttgtgccctacggtcttgggtccccacgatcaaaaagggcgctcgagaaccttcttccaaccaaggcaaccgacagggaaaatcgatgtcaatgtgccagtcaaaaggacaagaagtgctggaacttctgccaagctggtaaagagctcagggccgaggatatcatggagaaggactggaacaaccataaaaagggaaaggactgcagcaagctgggtaagaagtgcatctaccagcaacttgtgcgaggcaggaaaatcaggcgaagcagcgaagaacatctacgacagacacggagcgaaacaatgcgtaactcggttaagagcagtttccacgaccccaagctgaaaggcaagccttcacgcgagcgctatgtcactcataacagagctcactggtag

SEQ ID NO: 28444 - DNA, 1329 bp, Artificial Sequence
  Description of Artificial Sequence: Synthetic coding sequence
atgcagcccccaccaagcctgtgcggcagggctctggtcgcacttgtactggcctgtggtctgtcccgtatctggggggaggaacgcggttttccaccggacagagccactcccctgctgcaaactgcagaaatcatgactccccctactaagaccctttggcctaaaggctccaacgcttctctcgctcgatccctggcccctgccgaggtgcctaaaggcgacagaaccgccggatcccctccgagaactatatctcccccaccatgtcagggcccaattgagattaaagagacgttcaaatatatcaacaccgtggttagctgcctggtcttcgtcctcggcatcattggcaactctacactattgcggatcatatataaaaataaatgtatgaggaacggaccgaacatcctcatagcgagcctcgctcttggggacctgttgcacattgtgatagacatccctataaacgtatacaagctgctagcggaagattggcctttcggggcagaaatgtgtaagctggtcccattcatccagaaagcatctgtagggataactgtactctccctatgtgctctctccatagatagatatagggccgttgcttcctggtcccggatcaaggggattggcgtgccgaaatggaccgcagtcgagatcgtgctcatctgggtggtctcagtagtgctagcagtgccggaagctattggcttcgatattatcaccatggattataagggatcgtacctgagaatttgtctgcttcatcccgtgcagaagacagcgttcatgcagttctataagacggccaaagactggtggctgttcagcttctacttttgtctgccactcgccatcacagcttttttctatacgctgatgacgtgcgaaatgcttagaaaaaaatctgggatgcagatcgctctgaacgatcacctgaagcagcggagagaggttgcgaagacagtgttctgtctggtgctggttttcgcactgtgttggctgccactccacctaagtagaattttaaaactgacactctacaaccagaatgaccctaataggtgtgagctgctgagctttctcctcgttctcgactacattggaatcaatatggctagcctgaattcgtgcatcaaccctatagccctgtacctggtcagcaaacggttcaaaaattgcttcaaatcttgcctctgttgttggtgccaatcattcgaagaaaagcagtctctggaagagaaacagagctgcttgaagttcaaggctaatgaccatggttatgacaatttccgttcgtcgaataagtattcttccagctag

SEQ ID NO: 28445 - DNA, 1599 bp, Artificial Sequence
  Description of Artificial Sequence: Synthetic coding sequence
atgaacaagtctacctgtttgatggccgctgagacaccctccaaaagatggcggctccattgcctcgcattttcccaaagattcgtcagggccggtcccgcatgcagctcgagagaggcctgctcttcaccaagggccggatggaatcctgccggattcagactccccggacggtggtcaccattcgtggccctgcacttagtgtgccagatacgggaggccctcaagcttcgatccggccataggaccccctccggtgcagggtccagcatgcagcctcctccttcactatgcggcagagccctcgttgcgctggtgcttgcctgcggtttgtcaaggatctggggcgaagaacggggatttcctccggatagggctaccccactcttgcagacagccgagatcatgacccccccaactaagacactgtggcctaagggatctaatgcctcactcgctagatcacttgccccagcagaagtacccaagggggacaggaccgcgggttccccacccaggaccatttcgcctcctccctgccaaggcccaattgagattaaagagacttttaagtacatcaacacagtagtgagctgtttggtgttcgtgctcggtattattggcaattccacattgctgcgcatcatctacaagaataagtgcatgagaaacggcccaaacattcttatcgcgtcccttgcgttaggcgatctcttacacatcgtcatcgacatcccgatcaatgtgtacaaactgctcgccgaggactggccatttggggctgagatgtgtaagctggtgccttttattcagaaagcctctgtgggcattactgtgctctccttatgtgccttgtctattgatcggtaccgggctgtcgctagctggagtcgcatcaaaggaataggagtacctaaatggactgcagtggagatcgtcctgatctgggtcgtctctgtagtgctagccgtgccggaagcgatcggcttcgacattattacaatggattacaagggctcttacctccggatctgtctactgcacccagtgcagaaaacggctttcatgcagttttacaagactgccaaagattggtggctgttctcattttatttctgtctgccactggcgatcaccgccttcttctacactctaatgacatgtgagatgctgcggaagaagtccggcatgcagatagcccttaatgatcacttgaaacagcgtagggaagtggcaaaaacagtcttctgcctggtgcttgtgttcgccctatgttggctccccctccacctcagcagaatccttaaactcacactatataaccagaatgatccgaacaggtgcgagctgttgagttttctgctggtactggactatatcggcatcaacatggccagtctgaattcttgcatcaatcctatcgccctttatcttgtgagtaagcggttcaagaactgcttcaaatcctgcctctgctgctggtgtcagagctttgaagagaagcagtcactggaagaaaagcaaagttgcctcaaattcaaggcaaacgatcacggttacgataatttccgaagtagtaacaagtactcctcttcgtag

SEQ ID NO: 28446 - DNA, 1311 bp, Artificial Sequence
  Description of Artificial Sequence: Synthetic coding sequence
atgcagccaccccctagtttgtgcggcagagcccttgtcgccttagtgctcgcctgcggtctgtctcggatctggggagaagagaggggattccctccagatcgagccacccctcttctgcagaccgccgagattatgactcctccgacgaaaacactgtggcctaaaggctctaacgcctcactagccaggtccctggcccctgccgaagttccaaaaggggatcgaactgcagggtctcctcccaggacaattagcccacccccttgtcaggggcctatcgagatcaaagaaaccttcaagtacattaataccgtggtttcttgtctggtgtttgtgctcggcattatcgggaactccaccttactgcgaataatctataagaacaaatgcatgcgcaatggacctaacatcctgattgctagtctcgctctgggagacctccttcacatagttatcgatattccgattaacgtgtataagctgctcgctgaggattggccgtttggcgctgaaatgtgcaagctcgttcccttcatccagaaagcttccgttggaatcaccgttttgtcactgtgtgccctcagcatagaccgctatcgtgctgtggcctcttggtctaggattaaggggatcggagtgcccaagtggaccgccgtcgaaatagtgctgatctgggttgtgtctgttgtgctggccgtgccagaggcaattggatttgacattataacaatggactataaggggagttacttgcggatctgcctgttgcaccccgtgcagaaaaccgcctttatgcagttctacaaaaccgccaaggactggtggctcttcagcttttatttctgcctcccgctggccattaccgcttttttttatacactgatgacgtgcgagatgctacggaaaaagagtgggatgcagatcgccctgaacgatcacctgaaacagcgacgggaggtggctaagacagtattttgcctggtgctggtattcgctctgtgttggcttcctttgcatctttctagaatcctgaagctgaccttgtacaaccagaacgatccaaatagatgtgaactattaagcttcctgctggtcctggactacattgggatcaatatggcttcattgaacagttgtataaaccctattgctctgtacctggtgtccaagcggtttaagaattgtttcaaggcgggaccacacgttgggaataaacttgtaatgctattttccgttaacatagagtgtgacggaacagtgaatcaaaatccaaccatgtggccggagaggaaatccaataataattag

SEQ ID NO: 28447 - DNA, 2787 bp, Artificial Sequence
  Description of Artificial Sequence: Synthetic coding sequence
atggcccttcgccgactgggtgctgccctcttactcctacccctgctggcagcagtcgaggagactctcatggattcaactactgccaccgccgagctgggatggatggtgcatcccccttcagggtgggaggaagtatcgggatacgatgagaatatgaacaccatacggacataccaggtgtgtaacgtgtttgagtcttcacagaacaattggctcaggaccaaattcatccgcagaaggggggctcatcgcatccatgtcgagatgaaatttagcgtccgcgactgttccagcataccatcagttcctgggtcatgtaaggagacctttaatttgtattattacgaggccgactttgacagtgccaccaagacattcccaaactggatggaaaatccgtgggtcaaagtcgacacaattgctgccgacgagtcctttagccaggtggaccttggagggagagtgatgaaaattaataccgaagtccgcagcttcgggccagtgtctcggtccggcttctatcttgccttccaggattacggtggctgtatgtcgttaattgcagtcagagtgttctacaggaagtgcccgcgaatcatccaaaatggcgctatctttcaggagacactgtctggtgccgaatccacttctctggtggctgcacgaggctcatgcattgctaatgccgaagaggtggacgttcctattaagttatattgtaacggcgatggcgagtggctcgtgccaattgggcgatgcatgtgcaaagcaggtttcgaggcagtagaaaatggtacagtgtgtagaggctgtccttctggaacgttcaaagctaaccagggtgatgaagcgtgtactcactgtcctattaacagcagaaccaccagtgagggtgcaacgaattgcgtgtgccggaacggctactatcgggctgacctggatcctttggacatgccttgtaccaccatcccaagcgcccctcaggctgtgatcagctccgtgaacgaaacctccctcatgctcgagtggactcccccacgggacagcggcggaagggaagacttggtctacaatatcatctgtaagagttgcggttctggcagaggagcttgtacccggtgcggagataatgtgcagtatgcccctagacagttgggacttacagaacctcgcatttacataagcgacctgcttgctcacacacaatatactttcgaaattcaggctgtgaacggagtaacggaccagtctccctttagtccccaatttgcctctgtgaacatcaccactaatcaagccgctcccagcgctgtttctatcatgcaccaggtgtcaagaacagtagatagtatcaccctgtcctggagtcagcctgaccagcccaacggcgtgatcctggattacgaactgcaatactacgaaaaggagctcagtgagtacaatgcaacagcaataaagtcgcccacgaataccgtcactgttcaagggctgaaagcaggcgcaatttatgtgttccaggtgcgggctcggactgtggctgggtatgggaggtattctggcaaaatgtatttccaaacaatgacggaggttacacctggtatgaaaatctacatagaccctttcacgtatgaggaccccaatgaggccgtcagggaatttgccaaagaaattgatatctcatgtgttaagattgaacaggttatcggcgcaggggagttcggtgaggtgtgtagcggtcacctgaaactcccaggtaaacgggaaatcttcgtagccatcaagacactgaaaagtggatacacagagaaacagaggcgggatttcttgtcagaggctagcatcatggggcaatttgaccatccaaacgttatccacctggagggggtcgtgaccaaatctacgcctgtgatgattatcaccgaattcatggagaatgggtcattagacagtttcctgaggcaaaacgacgggcagttcactgtcatccaactcgtcgggatgttacgcggaatcgccgctggcatgaaatatcttgctgatatgaactacgtccacagggacctggcagccaggaatatactggtgaattcaaacttagtgtgtaaggtgtccgacttcggcctgtccaggttcctagaagacgacacgtctgatcccacatataccagcgcattaggcggtaagatccctatacgctggactgctcctgaggcaatacagtacagaaagttcaccagcgcatcagacgtctggagttatggcatcgtcatgtgggaagtaatgtcatatggcgaacgtccctattgggacatgactaatcaggatgtaatcaacgccatcgaacaggactataggctgcctccgccaatggattgcccttctgcactgcatcagctcatgctagattgttggcagaaagaccgaaaccatcgacccaagttcggtcagatcgttaatacgctggacaagatgatacgtaaccctaatagcctcaaggccatggccccactgagttccgggattaatcttcctctgctggacagaaccatccccgattatacatcttttaatactgtggacgagtggctggaagcaattaagatgggtcaatacaaggaatcgttcgccaatgctggcttcacaagcttcgatgtggtgagccagatgatgatggaggatatcctgcgggtgggggtgaccctggccggacaccagaaaaagatacttaactctattcaggtcatgcgcgcacaaatgaaccagattcaatcagtggaagtctag

SEQ ID NO: 28448 - DNA, 2841 bp, Artificial Sequence
  Description of Artificial Sequence: Synthetic coding sequence
atgtgggttcctgtgcttgccctccccgtttgtacttacgccgagaccctaatggacagcacaacagcgaccgccgaactaggttggatggttcacccaccaagcggctgggaagaggtgagtgggtacgatgagaacatgaatactatccgcacataccaagtgtgtaatgtgttcgagtcctcacagaataactggctgcgcaccaagtttattcgcaggcgcggagcacataggattcatgtcgagatgaagtttagcgtgcgagactgttcatccatacccagtgtgcctgggagttgtaaagaaactttcaacctttactactacgaggcagatttcgatagtgctaccaaaactttccctaattggatggaaaacccctgggtcaaggtggataccatcgccgcagatgaatcgttttcccaagtggatttgggaggtcgcgtgatgaaaatcaatacagaagttagaagtttcgggcctgtgagtcgctctggattctatctggcctttcaggattatgggggatgtatgtctcttatcgctgtgcgggtgttctaccgtaagtgcccgagaataatacaaaatggggctatctttcaggagaccttgtccggggcagagagcacttcactggtggcagcgaggggttcttgtatcgccaacgcagaggaggtggatgtgccaatcaaactctactgtaatggcgatggagaatggctcgtgccaattgggaggtgcatgtgcaaggcgggttttgaagcagtggagaacggcacggtatgccgcggatgtccgtccgggacattcaaggccaatcagggggacgaggcctgtacccattgccccatcaactcaagaaccactagtgagggcgcaaccaattgcgtgtgtaggaatgggtactatcgggcagacctggatcctttggacatgccttgcaccaccatcccttctgcccctcaggccgtcatttcaagtgttaatgagacttccctgatgttggagtggacccctcctagggactccggaggaagggaggatcttgtgtacaacataatctgcaagtcctgcggtagtggcagaggagcttgtacacgttgcggagataacgtccaatacgcacccaggcagttaggactgacagagccacgtatatatatctcagacctgttagcgcacacccagtacacttttgagatccaagccgtgaacggagtaacggatcagtctcccttcagcccccagttcgcctctgtgaacatcaccacaaatcaagccgctccctccgcagtgtcgattatgcatcaggtctcacgcacagtggactcaatcacattgtcctggagtcaacctgatcagcctaacggagtgatcctagactacgagcttcaatactacgagaagcaggagctgagtgagtacaatgctacagccatcaagtcacctacgaacaccgtgacggttcagggactgaaagccggagccatatacgtttttcaggtgcgggctcgaaccgtggccggttacgggaggtactcaggcaagatgtacttccaaaccatgactgaggcagagtatcagacatctatacaggagaagcttccgctgattattggaagctctgctgcaggcctggtctttttaattgccgtagtggttatcgctatcgtgtgtaataggcggggattcgagcgagccgactccgaatacacagataaactgcagcattatactagcggccatatgacccctggtatgaagatatacattgaccctttcacttacgaggatcccaatgaggcggttagagagtttgcaaaggaaatagacatttcttgcgtcaaaattgagcaagtgattggagcgggagaatttggagaagtgtgctctggccacttgaaacttccaggcaagcgcgagattttcgtggcaataaaaactcttaaaagtggatacaccgagaaacagaggcgggacttcctgtccgaggcatctattatgggccagtttgatcaccctaacgtaatacacctcgagggcgtggtgaccaaaagcaccccggtcatgataataacagagttcatggagaatggatcccttgactcctttctgagacagaacgatggtcaattcactgtgatccagctggtgggcatgctgcggggtatagcagcaggaatgaagtatcttgcagacatgaattatgtccatcgggacctggctgcccgaaatattctggtgaactccaatctggtttgtaaggtcagtgattttggtctgagtcgatttctcgaggatgatacaagcgaccccacatacacttcggctttaggcggaaaaatacccatccggtggaccgcgccagaggccatacagtaccgcaagttcacatctgcctccgatgtgtggtcatacggtatcgttatgtgggaggtcatgtcttatggcgaacgcccatactgggacatgactaaccaagacgtcattaacgcaatagaacaagactacagactgcccccacccatggactgcccctctgccctgcaccagctcatgttggactgctggcagaaagataggaaccaccgcccaaagtttgggcaaatagtgaacacattggacaaaatgattagaaatcccaattcgctaaaggcaatggctccactctcttcgggaataaatcttcccttgcttgataggaccataccggactacacctccttcaatacagtggacgaatggctggaagcaatcaagatgggccagtataaagagagcttcgctaatgcagggttcacctcattcgatgtcgtgtcacagatgatgatggaatag

SEQ ID NO: 28449 - DNA, 2961 bp, Artificial Sequence
  Description of Artificial Sequence: Synthetic coding sequence
atggctttacgccgactcggcgcagctctgctgcttctgccgctgttggcagccgtggaagaaacgcttatggattctaccactgctactgccgagctgggctggatggttcaccccccttccggatgggaggaagtgtccggatatgatgaaaatatgaacacaattcgcacctaccaggtttgcaacgtgttcgaatcttcgcagaacaattggctgcgcacgaaattcatacgacgacgaggagcccacagaattcatgtagagatgaagttttccgtgagggactgttccagcatcccatcggtgccgggaagctgtaaggagacctttaacctgtactattatgaagccgatttcgatagtgctaccaagacattcccaaactggatggaaaacccttgggtcaaggtcgatactatcgctgccgatgagtctttcagccaggtggacctgggcggacgagtgatgaagatcaacacagaagtccgatcatttggcccagtatctagaagtggcttctacctggccttccaggattacgggggatgtatgtcacttatcgccgtccgcgtgttctacaggaaatgcccacgtatcattcaaaatggcgctattttccaggagactctgagcggggctgaatccacctcccttgtcgctgcccgaggttcttgcatcgccaatgccgaagaggttgatgtgccaataaaactctattgcaatggcgatggcgagtggctcgtgccaatcgggagatgcatgtgcaaggcaggcttcgaggccgttgagaacggcaccgtttgccgcggatgcccgtcaggaacattcaaagcgaaccaaggagacgaggcctgcacccactgcccaatcaattcccggacaacaagcgaaggtgctactaattgcgtgtgcagaaacggttactatcgggcagacctagaccctctcgatatgccctgtacaaccatacccagcgcacctcaagcagtgatttccagcgtcaacgaaacttctctgatgttggagtggacacccccacgcgattcaggcggtcgcgaggacctggtgtacaacataatatgtaaatcctgtggctctggaagaggggcatgtaccaggtgtggcgacaatgtgcaatacgctccccgacagcttggactgactgagccacggatctacatctccgacttgctggcacatacacagtacacgttcgagatccaggcggttaacggcgtcacggatcagagcccattttcccctcagttcgcatccgttaatataaccacgaatcaggccgcaccaagtgcagtatctatcatgcatcaagtctctaggaccgtagacagtatcacactaagctggtcccaacccgaccagcctaatggcgtgattctcgattatgaactccaatattatgagaaggaattgagcgaatacaatgccaccgctatcaagtcccccactaataccgtcaccgtccagggcctgaaggcgggtgcaatatacgtatttcaggtgagggcacgcactgtggccggatacgggagatatagcggcaagatgtactttcagacgatgactgaagctgaatatcagacgtctattcaagagaagctgcctctgatcattgggtcctctgccgcaggacttgtcttcctgatcgccgttgtggtcatagccattgtctgcaaccgccgtgggttcgagcgcgcagacagcgaatatactgataaactgcagcattatacatcaggccacatgacacctggaatgaaaatatatatagacccatttacatatgaagatcctaacgaggcggtccgagagttcgctaaggagatcgacatctcttgtgtcaagatcgagcaggttattggagccggagaatttggagaggtgtgttcaggccaccttaagctgccaggaaagcgggagatcttcgtcgccatcaagactctcaagagtggatatacagagaagcagcgcagggactttctgagtgaggcaagcataatgggacagtttgatcaccctaatgtgattcatctggagggcgtggtgaccaagtctacgccagtcatgattataactgaatttatggagaacggatcactcgattcctttcttagacagaacgatggacagtttaccgtcattcagctggtgggcatgctgcgtggcattgctgcaggtatgaagtacctggccgatatgaactatgtccatcgggacctggccgcacgaaatatcctggtgaacagcaatttggtgtgcaaagtgtcggattttgggttgagccggtttctggaggacgacacctctgatcccacgtacactagcgccctgggaggcaaaattccaattcgctggaccgcccctgaggcaatacagtaccgaaaatttacctccgcctctgacgtgtggtcttacgggatcgttatgtgggaggtcatgtcctatggggaacggccttattgggacatgactaatcaggacgtcatcaatgccatcgaacaggactatcggctgcccccaccaatggattgcccatctgctctccaccagctaatgttagactgctggcagaaggatcgaaatcaccggcctaaatttggtcagattgtgaatactttagataagatgatccggaaccctaactctcttaaggctatggcacctctctcaagcggcattaatctaccactcctggacagaaccattcccgattataccagcttcaataccgtcgacgaatggctggaggctattaaaatgggccagtacaaggaaagttttgctaatgcagggtttacttcttttgacgtcgtgtctcaaatgatgatggaagacatcctgagagtgggcgttactttagctggacatcaaaagaagatcctaaactccatccaggtcatgcgagcgcagatgaaccagatacagtcagtggaggtgtag

SEQ ID NO: 28450 - DNA, 2964 bp, Artificial Sequence
  Description of Artificial Sequence: Synthetic coding sequence
atggcccttcggagactaggggctgctctcttactcctacctctgcttgccgctgtagaggagacactgatggactccaccaccgctactgccgaactggggtggatggtgcaccctccctctggatgggaagaggtgagcgggtatgacgagaatatgaataccatcaggacgtaccaggtgtgcaacgtctttgaatctagccagaataactggctgcggaccaaattcattcgcagaagaggcgctcatcggattcacgtagagatgaaatttagcgtcagagattgctcatccattccatccgtgcccggatcttgtaaggagacattcaatctgtactactatgaagctgacttcgattctgccacgaagacctttcccaattggatggagaacccatgggtcaaggtcgacactatcgcagctgacgaatcctttagccaggtagatttagggggtcgcgtgatgaaaatcaacaccgaggtcaggtcttttggccctgtatccagatcaggtttctatctggccttccaggactatggcggttgcatgagtcttattgccgtgcgcgtgttttaccgcaaatgccccagaatcatccagaacggtgccatatttcaagagaccttgagcggcgcagagagtactagcttggttgctgcccgaggatcctgtatcgccaatgctgaggaggtcgacgtccccatcaagttatattgcaacggggatggagaatggctggttcctattggccgatgtatgtgcaaagcgggtttcgaggccgtggaaaacggcacagtgtgtcgaggttgcccaagtgggacgtttaaagcgaatcagggtgacgaagcctgcactcactgtcccataaatagccggactacatcagagggcgctaccaactgtgtctgtaggaacggctactatcgggcagacctagatccattagatatgccctgcaccacgatcccaagcgcaccccaggctgtcatatcatcggtgaatgagacatcactgatgctcgaatggacacctccacgcgacagcgggggaagagaggatctcgtgtacaacatcatatgcaagagctgcgggtctggaaggggtgcctgtactcgatgcggcgacaatgtgcaatacgcccctcgccagttgggcttgactgagcctagaatttacatcagcgatcttcttgctcacacacagtacaccttcgagatccaagcggtaaatggggtcactgatcagtcccccttctccccccagttcgcttcagtaaatattaccaccaatcaggctgcaccatcagctgtgagtatcatgcaccaggtgtcaagaaccgtagattctattacattatcatggagtcagccagaccagcccaacggcgtgattctggattacgagctccagtactacgagaaggaactgtccgagtataatgcaactgctatcaagagccccacgaacaccgtaacggttcagggcctgaaagccggtgcaatatatgtctttcaggtgcgagccaggaccgtagctggatatgggagatatagcggtaagatgtactttcaaactatgactgaggctgaatatcagacctctattcaggagaagctacccttgattatcggcagtagtgcggctggactcgtttttctaatcgccgtcgtggtaatcgccattgtgtgtaataggcgcagggggttcgaacgcgctgactctgagtataccgacaagctccagcactacacttctggccacatgacaccaggaatgaagatttacattgacccattcacctatgaggatcctaacgaagcagtcagagaatttgctaaagagatagacatttcatgcgtgaagattgagcaggtgattggagccggtgaatttggcgaagtgtgtagcggccacctgaaactgcccggtaaacgagagatatttgtcgccatcaagacattgaagtcaggttacacagaaaagcagcgacgtgatttcctcagtgaggcttccataatgggccaattcgatcacccaaatgttatccacctcgaaggggtggtcactaaaagcacgcctgtgatgatcattaccgagttcatggaaaacggcagcttggattcttttctgagacagaatgacggtcaattcaccgtcatccaattggtcggaatgctccgcggtatcgccgctggaatgaaatacctggctgacatgaactatgtgcacagggatctcgccgcacggaacatcctggttaacagcaacctagtatgcaaggtgagcgacttcggcctgagccggttcctagaggacgacactagtgatccaacttacactagcgcacttggtggcaagatacctatcaggtggaccgccccagaagcaattcagtatagaaaattcacctcggccagcgacgtttggtcctacggtatcgtcatgtgggaagttatgagttacggagagcggccatattgggatatgaccaatcaggacgtgatcaatgccattgagcaggactaccgattgcctccgcctatggactgtccatccgcattacaccagctgatgctcgactgctggcaaaaggaccgcaaccatcggccaaagttcggccagatcgtaaataccctggataagatgattcgcaacccaaacagtttgaaggccatggccccactatctagcggcattaacctgcccctgctggatcgcaccatccctgactataccagcttcaacaccgtggacgaatggcttgaagctatcaagatgggacagtacaaagaaagcttcgccaatgcaggctttacgtccttcgacgtagtgagtcagatgatgatggaagacatcctacgggtcggtgtcactctggccggacaccaaaagaaaattctcaatagcattcaggtgatgagggcccagatgaaccagatacagagtgtcgaggtgtag

SEQ ID NO: 28451 - DNA, 3168 bp, Artificial Sequence
  Description of Artificial Sequence: Synthetic coding sequence
atggcgttaaggcggcttggtgctgccctgctgttactccctttacttgcggcagtagaagagactctgatggacagcacaacagccacggccgaactcggatggatggtgcaccccccatccgggtgggaagaggtgagtggctacgacgagaatatgaacacaattcgtacctatcaggtgtgtaacgtttttgaaagttctcagaataactggctgcggacgaaatttattagacgtcgaggcgctcatcgcatccatgttgagatgaaattcagtgtcagagactgctcgtctattccttccgtgcccggatcgtgcaaggagacattcaatctgtattattacgaagccgactttgattcagctactaaaacttttcccaactggatggagaacccctgggttaaggttgatactatagctgctgacgaatctttttcccaggtcgatttgggcggtagggtaatgaagatcaacaccgaagtgcggtcgttcgggcctgtctctcgctctgggttttatctggcgtttcaggactacggaggatgcatgtctcttatagccgtgagagtattctatcgcaaatgcccccgtatcatccaaaacggagccatctttcaagagaccctatctggagctgagtcaacctctttggtcgccgctaggggctcttgcattgctaatgcggaagaagttgatgtccctataaaattatactgcaacggcgacggtgagtggctggtgcccattggccgttgtatgtgcaaagctggatttgaggctgtggagaacggcaccgtgtgtagggggtgtccatccggtacgtttaaggccaaccagggggacgaggcatgcacacattgtcccataaattccagaacaaccagtgaaggagctaccaactgtgtgtgcaggaatggttattacagagcagatctggatccactggatatgccatgtactaccattccatcagcgcctcaggctgttatttcttccgtcaatgagacctcactgatgctggaatggacacccccaagggactccggtggacgagaggacctcgtgtacaacataatctgcaaatcctgtggaagcgggcgaggcgcttgtacgagatgcggcgacaatgttcagtatgctcctcgtcaactaggcttgactgagcctagaatttatataagtgacctcttagctcatacccagtacacgttcgagatccaggctgtgaacggggtgacggaccagtcccccttctctcctcagttcgcttcggtcaacatcacaaccaaccaagctgctccttccgctgtgagcattatgcaccaagtctctagaacggtggatagcataactctctcctggtcacaaccagatcagcccaatggtgttatccttgactatgaactgcagtattatgaaaaggaattatcggagtataatgcaactgcgatcaagtcaccaaccaacacagtcaccgtccagggcttaaaggcaggagcaatctatgtgtttcaggtgcgagccagaaccgtcgccggatatggcagatactccggaaagatgtactttcagactatgacagaagctgaataccagacttcaattcaggagaagcttccattgataattggcagtagcgcagccggactggtctttcttattgccgtcgtggttattgcgatcgtgtgtaataggcgcggattcgaaagagcggattcagaatacacagacaaacttcagcattacacatcgggtcatatgacaccaggcatgaagatttatatcgacccattcacgtacgaggatccaaacgaggccgtgagggagtttgccaaagaaattgacatctcatgtgtgaagatcgagcaagttataggcgcaggagaatttggcgaggtttgttccggtcacctgaagttgccaggcaagcgggaaatctttgtggcaataaaaacgctgaagtccggctatacggagaaacagcgtcgggatttcctttcagaggcctcaattatgggccagtttgatcaccctaacgtcattcatctggagggagtggtaaccaaatcaaccccagtgatgataatcacagagtttatggagaacgggagcctcgattccttcttgagacagaacgacgggcagttcacagtcatacagctcgtgggaatgttgcgaggaatcgctgccggaatgaaatatctcgccgacatgaactatgttcatcgcgacctcgccgcacgcaacatcctggttaatagcaatctggtgtgtaaggtgagcgattttggactgtcgcgcttcctcgaggatgacacatctgacccgacctatacaagcgctcttgggggaaaaatcccaatcagatggaccgctccggaggctatccagtacaggaagtttacaagtgcaagcgatgtttggagctacggtattgtgatgtgggaggttatgagttacggcgagcggccatactgggacatgacgaaccaggacgtgatcaatgcaatagaacaggactatcgactgcccccacccatggactgccccagcgctttgcatcagcttatgctggactgttggcagaaagatcggaaccaccggcctaagttcgggcaaatcgtgaacacattggacaagatgattcgaaacccaaatagtttaaaggcaatggccccattgtccagtgggattaatctacctttgttggacaggactatccccgattacacaagttttaacaccgtggacgaatggctagaggccataaaaatgggccagtacaaagaaagttttgccaacgctggatttacttcctttgatgtggtgtcacagatgatgatggaagacattctcagggttggcgtgactttggcaggccaccaaaagaaaatcttaaacagcatccaggtcatgagggcccagatgaaccagatacagtctgtggagggccagccattagctaggcgaccaagagctaccggtagaacaaagaggtgccagcccagggacgtgactaagaagacctgcaactcaaatgacggtaagaaaaaaggtatgggcaaaaagaaaaccgaccctggccgagggcgagagattcagggtatcttctttaaggaggactcccacaaggagtctaacgattgcagctgtgggggatag

SEQ ID NO: 28452 - DNA, 1449 bp, Artificial Sequence
  Description of Artificial Sequence: Synthetic coding sequence
atggcactacgaaggttgggagccgcactcctcctgctgccgctgctcgcagcagtcgaggagacactcatggactccaccaccgcaacagccgagttgggctggatggtgcatccacctagcgggtgggaagaagtatccggatatgacgagaatatgaacaccattaggacgtatcaggtttgcaatgtctttgagagtagtcagaataattggctgagaacgaagttcatacgtcgaaggggcgctcaccgaattcatgtcgaaatgaagttcagcgtgcgcgattgttcaagcatccctagtgtgcccggtagttgcaaagaaactttcaacctgtattattatgaggctgacttcgactctgctacaaaaacctttcctaactggatggaaaacccatgggttaaggtcgacaccattgccgctgacgagtctttcagccaggtcgacctgggcggaagggttatgaagatcaatacagaggtcaggagcttcggacccgtgagcaggtccggcttctatctcgcttttcaggactacggagggtgcatgtctctgatcgccgtgcgtgtgttttatagaaaatgccccagaattatacagaacggggctatctttcaggagaccctgagcggcgcagagagcacctctctggtggctgcgcgagggtcatgtattgccaatgctgaagaggtcgacgtgccaattaaactgtactgcaacggtgatggcgagtggctggtgcccatcggcaggtgcatgtgtaaagccggattcgaggccgtggagaacggtacagtctgccggggttgtcccagtgggacattcaaggctaatcagggagacgaggcttgtacgcattgcccgatcaattccagaacgacatcagagggagcgactaactgcgtttgcagaaatggctattaccgggcagacctcgatccactggacatgccttgtacaacaatccctagcgcgccacaggcggtcatctcgagcgtgaatgagacatctttgatgctggagtggactccccctagggactccgggggacgggaagacctcgtttataatataatctgcaaatcctgcggcagtggacgcggtgcgtgcacaaggtgcggcgacaacgtgcagtacgccccacgccagctagggttgaccgaaccacggatttacatttcagacctgctcgcacatactcagtacacctttgagatccaggctgtgaatggcgttacagaccagtcccctttctctcctcagttcgcatcggtgaacattacaaccaaccaggcagccccatccgctgtgtccattatgcaccaggtgtcccgcaccgtcgacagcattactctgagttggtcgcaaccggaccagcctaacggtgttattctagactacgagttacagtactatgaaaaaatgaaaacacagcggagctag

SEQ ID NO: 28453 - DNA, 2964 bp, Artificial Sequence
  Description of Artificial Sequence: Synthetic coding sequence
atggagttaagagtcctgttgtgttgggcatctttggcagcagccctggaggaaactctcctgaataccaagctggaaacagctgatctaaagtgggtgacatttcctcaggtggatggacagtgggaggagctctccgggctggatgaagaacagcattccgttcggacctacgaagtatgtgatgtccagcgcgcaccgggacaggcacattggcttagaaccggttgggtgccgaggcggggagccgtccatgtgtacgcaacattgaggttcaccatgctggaatgcctctctctgcctcgggctggcagaagctgtaaggagacctttactgtcttttattatgaatccgacgccgacacagcaactgccctgacccccgcttggatggagaacccgtacatcaaagtcgacactgtcgcagctgaacatttgactcgaaaacgacccggagccgaggccaccggaaaagtgaacgtgaaaactctccggctgggcccactctccaaggccggattctacttagcgtttcaggaccagggagcgtgcatggctttactctcgcttcatctgttctataaaaaatgtgcccagcttacggtcaaccttacccgtttccccgagacagtacccagagagctggttgtgccggtcgccggaagttgcgtggtggacgccgtcccggctcccggtccctcgccgagtttatactgcagagaggacgggcagtgggcagagcaaccagtgactgggtgttcatgtgccccaggcttcgaagccgctgaaggcaacaccaagtgccgggcttgtgctcagggcacctttaaacctctctctggtgaagggagttgccagccctgtcccgctaacagccactccaataccatcggaagtgcagtctgtcaatgcagggtgggttattttagggccaggaccgaccccagaggcgcaccttgcactactcctccgtccgctccaagatctgtagttagtcgactcaacggaagttctctccacctggaatggagcgcaccactcgaatctggaggaagagaggacctcacttatgctctccggtgccgcgaatgtaggcccggtggctcctgtgcaccttgtggtggagatctcacatttgaccctgggcctcgcgatcttgtcgagccttgggtagtcgtgagaggtctgagaccagactttacatacacttttgaggtgaccgctttgaatggagtaagcagcctggcgaccggtccggtgccctttgagccggtgaacgtcactacagaccgggaggtccccccagccgtttccgatatccgcgtcactaggagctctccttcctcattgtctctcgcctgggccgtaccccgagccccttctggcgcagtccttgattacgaggtcaaataccatgagaagggggctgagggacctagctctgtgaggttcttgaaaacatccgagaacagagcagagctgaggggcctgaagcggggtgcgagttaccttgtacaagtgcgcgcacgctcagaggcaggatacggaccttttgggcaggagcaccactcccaaacacagttggatgaaagtgaaggctggcgggaacagctcgcactcatagcaggtacggcggtggtgggcgtcgtgctcgttctcgttgtaatcgtggtcgctgtgttgtgcctgcgcaagcagagcaatggccgagaagctgaatactctgacaagcacggacagtatttgataggccatgggactaaggtgtacattgacccatttacctacgaagaccctaacgaggctgtgcgggagtttgccaaggagatagatgtatcttatgttaagatagaggaagtcatcggagccggagaatttggcgaagtatgtcgcggaaggcttaaggcccctgggaagaaagaatcttgtgtggctatcaaaacattgaaaggcggttacacagaacgtcagcggagagagtttctgtccgaggcctccataatggggcagttcgaacaccctaacatcatcaggctagagggcgttgtgacaaatagcatgcccgtcatgatcctcaccgaattcatggaaaacggggctcttgactcattccttcggttgaacgacggccaatttaccgttattcagctcgtcggtatgctgcggggaatcgcaagcggtatgagatatctggcggaaatgtcttacgtacatcgggacttggctgcccgtaacatccttgtcaactcaaacttagtgtgcaaggtttcagacttcggcttgtctcgcttcctcgaagaaaacagctccgaccccacatacacctctagcctggggggtaagatacccattcgatggacagctccggaagctattgcgttcaggaagtttactagcgcttccgatgcgtggtcgtatgggatcgtcatgtgggaagtcatgtcttttggagagaggccatattgggatatgagtaatcaggatgtaattaatgcgatcgaacaggattatcggctgccaccgcctcccgactgcccaacctcccttcaccagctgatgctggactgttggcagaaagataggaacgctcgtcccagattcccccaggttgtcagtgccttggacaaaatgatccgtaatcctgcctccctcaaaattgtggcacgggagaacggaggcgctagccatccgctgcttgaccaaaggcagccacattatagcgcatttggctcggtcggcgaatggttacgtgctattaaaatgggccgttacgaagagagcttcgccgcagcagggttcgggtcttttgaattggttagtcagatctcagccgaggacctcttaaggatcggcgtgactctcgcgggtcaccagaagaagattcttgcctcagttcaacatatgaaatcccaagctaaacccggtacgccaggcggaacaggcggtcccgcaccacagtactag

SEQ ID NO: 28454 - DNA, 2808 bp, Artificial Sequence
  Description of Artificial Sequence: Synthetic coding sequence
atggagctgagagtgctgctctgctgggcgagcctggccgctgcattggaagagacgctgcttaacacaaaactggagaccgccgatctgaagtgggtgacattccctcaggtggacggccagtgggaggaactctctggcctggacgaggaacagcacagtgtgaggacctacgaggtgtgtgacgtgcagagggctccaggccaggctcattggcttcgaaccggctgggtgcccaggagaggtgctgtgcatgtgtacgccaccctcaggtttactatgctggagtgcttgtccctgccccgagccggacgctcatgtaaggaaactttcacagtgttttactacgaatccgacgccgatactgccacggcgctgactcctgcctggatggaaaatccttacataaaggtcgacaccgtggccgctgagcacctgactcggaagcggcctggcgctgaggcaaccggtaaggtcaacgtcaaaacattacgtctcgggccactgagtaaggctggcttctatctggcattccaggaccagggcgcttgcatggctctcttaagtctgcatctgttttacaagaagtgcgcccagttaaccgtgaatttgacacgttttccagagacagttccccgagagctcgtcgtgcctgtggccggttcttgcgtcgttgatgccgtgccagcccctgggccttccccctccctgtactgccgggaggatgggcagtgggccgagcagccagtaactgggtgtagttgtgcaccgggttttgaagctgcagaagggaacacaaagtgccgggcttgtgcccagggcacctttaaaccccttagcggagagggcagctgccagccctgcccagccaactcgcattccaataccattggtagtgccgtgtgccagtgcagagtcggctatttccgggctagaactgatcctaggggagccccatgtaccactccccctagcgcccctcgctcggttgtgtctcgcttaaacgggtcatccctgcacctggagtggtccgcccctctggagtccgggggacgtgaggacctcacctacgccttacgatgccgtgaatgccggccaggtggcagctgcgccccttgtggtggagacttaacatttgatcctgggccacgagacctggtcgaaccttgggttgtggtcagggggctacgccctgacttcacatacacctttgaagtgacagcactgaacggcgtgtcgagcctcgccacaggacccgtgccattcgaacctgtaaacgtgacgaccgacagagaggttccacccgcagtgagtgacatccgcgtgacccggagctctcccagctctctgtctttggcgtgggctgttcctagggctccttcaggcgctgtcttagactatgaggtcaaatatcatgaaaagggagccgaagggcctagttccgtccggtttctgaagacttcagaaaacagggccgagctgcggggtctcaagcgcggagcctcatacctcgtgcaggttcgagctagatctgaagccggttatggcccattcggacaggagcaccatagccagactcagctggatgagagcgagggatggagggagcagttagcgctcatcgcgggtacggccgtagtgggagtggtactggtgctggtcgttatagtcgtggccgtgctttgtttgcgcaagcagtcgaatggtcgtgaggcagaatacagcgataagcacggccagtacttaatcggacacggtaccaaggtctatattgacccattcacatacgaggacccaaatgaggcagtgcgggagtttgccaaagaaattgacgtgtcctatgtgaaaatagaggaggtaatcggcgcaggtgaattcggcgaagtctgcaggggtaggcttaaggcccctggcaagaaggaatcatgtgtcgccattaaaactcttaaaggtggatacacagagagacagaggcgtgaatttttgtctgaagcaagtattatgggccaattcgagcatccaaacattataagactggaaggggtagtgaccaattccatgcctgtgatgattctgactgagtttatggaaaatggagcccttgactcctttctgaggctgaacgatggccagtttaccgtcattcagcttgtcggaatgctccggggaatagcctccggcatgcgatatctggccgagatgagctatgtgcatagagaccttgccgctagaaatatcctggtgaattcaaacctggtctgcaaggtttctgactttggtctgagccgattcctcgaggaaaacagcagcgatcccacttacacgtcatccctgggcggtaagataccaatcaggtggaccgcccctgaagctatcgccttcagaaaatttacctccgcaagcgatgcgtggtcctacggcattgtcatgtgggaagtgatgtcttttggagaaagaccttactgggacatgtccaaccaggatgtcatcaacgcgatcgagcaggactaccggctgcctcccccaccagactgcccaacatcacttcatcagcttatgttagattgctggcaaaaagatcggaacgctagacctcgttttccgcaagtggtctctgctcttgataaaatgatcagaaaccccgcttccctgaaaatcgtggcccgtgaaaatgggggagaccttctgaggatcggcgtcaccctggcaggacatcagaaaaagatattggcctctgtccagcacatgaaatcccaggcaaaacctggcacccccggtgggactgggggtcccgctccgcagtactag

SEQ ID NO: 28455 - DNA, 552 bp, Artificial Sequence
  Description of Artificial Sequence: Synthetic coding sequence
atggagttcctgtgggcaccactgctgggactttgctgctccctggctgccgctgatcgccacaccgttttctggaacagttccaatccaaagttcaggaatgaggattacaccatccatgtacaactgaacgattatgtggacatcatttgtccacactacgaagatcatagtgtagccgatgctgcaatggaacagtacatcttatatctggtggagcacgaggaatatcagttgtgccaacctcaaagcaaggatcaggttagatggcagtgtaacaggcccagtgcaaagcacgggccagagaagctgagcgagaagttccaaaggtttactccttttacactgggcaaggagttcaaagagggtcattcgtattactacatttcccattcacctcaggcccacgataatccacaggaaaagagactggccgcagatgaccctgaagtgagggtgcttcacagcatagggcatagcgccgctccgcgtctctttcctctcgcatggactgtcctgctcctgccactgctgctgctccagacaccttag

SEQ ID NO: 28456 - DNA, 618 bp, Artificial Sequence
  Description of Artificial Sequence: Synthetic coding sequence
atggaattcctctgggcccctctcctgggcctgtgctgcagcctggccgcagcagaccgccacactgtgttctggaattctagcaatcccaagtttagaaatgaagactacaccatccacgtgcaattgaatgactacgtggatattatatgtccccattatgaagaccacagtgtggctgatgccgctatggagcaatacatcctgtacctcgtggaacatgaggaataccagttatgccaaccacagtcgaaagaccaggttcggtggcaatgcaatcggccaagtgctaagcatggtcctgaaaaattgtcagaaaagttccagagattcacgccctttacccttggtaaagagtttaaggagggccactcctactactatatctcgaagcccatacaccagcacgaagatcggtgcctacgcctgaaagtgaccgtatccggaaaaatcacccacagtcctcaggcccatgacaatccccaagaaaagcgattggccgcagatgacccagaagtcagagttcttcattctataggccacagcgccgcacctcggttatttccactagcgtggaccgtcctcctcctgccgcttttgctcttacagactccgtag

SEQ ID NO: 28457 - DNA, 1002 bp, Artificial Sequence
  Description of Artificial Sequence: Synthetic coding sequence
atggcagtccggagggactcagtctggaagtactgctggggagtacttatggtgctttgtcgcaccgctatctctaaaagcatcgttctggagccaatctattggaactcctcgaatagcaagtttctaccaggacaagggttagtgctctacccccaaatcggagacaaactcgatatcatttgtccaaaggtagactctaagacagtcggacagtatgagtattacaaagtgtacatggttgacaaggatcaagccgacaggtgcacaattaagaaagaaaacacccctctcttgaactgcgcaaaaccggatcaggatattaaattcacaatcaaatttcaggaattcagcccaaacctttggggactggagttccagaagaacaaggattattacataatatccacatccaatggatccctggaggggttagacaaccaagagggcggagtctgccaaactcgcgcaatgaagatactgatgaaagttggccaggacgcctctagtgccggtagtactaggaataaagatcccacccgacgccctgagttggaggctgggacaaacggtagatcaagcaccacctctcctttcgtgaagccaaatcccggaagcagcacagacggtaactccgccggtcattcaggaaataacatcctagggagcgaagttgcattatttgcgggaatcgcatccgggtgtataatcttcatcgttataatcatcactctcgttgttcttctactgaagtaccggaggaggcatcgtaaacatagcccgcagcacaccaccacccttagcttatccaccctggccaccccaaagcgaagcggtaataacaacggttctgagccttccgatataatcatccctttgcgcacagctgacagcgtgttctgccctcactatgagaaagtcagcggtgactacggtcacccagtttatatagttcaggaaatgcctccacaatctcccgctaatatttattataaggtgtag

SEQ ID NO: 28458 - DNA, 3624 bp, Artificial Sequence
  Description of Artificial Sequence: Synthetic coding sequence
atgcttttaactttgattatcctcctccccgtagtgagcaagttctcattcgtgtccctcagtgctccacagcattggtcatgtcctgaaggaacactggcaggcaacggcaacagcacatgtgtcgggcctgccccattccttatctttagccacggcaacagcatcttcagaatagacaccgaagggaccaactacgagcagctggtcgtcgacgcaggggtgagcgtgattatggattttcactataatgaaaaacgaatttattgggtggatctcgagagacagctgctccagagggtcttcctgaatggtagtcggcaggaacgagtctgtaatatcgagaaaaatgtgtctggcatggcaattaattggattaatgaggaagtgatttggagcaatcagcaggaagggattattaccgtgactgacatgaaagggaacaacagccacattcttctgagtgccctgaagtaccctgcgaatgtagccgttgaccccgttgagcgcttcatcttttggagctccgaagttgcgggtagcttataccgggctgatctagacggcgtgggagttaaagctttgctggagacgtctgaaaaaattaccgccgtatctttggacgtgctggataagaggttgttttggattcagtacaaccgggagggcagcaacagtctgatttgtagttgcgactacgatggcggaagtgtgcatatcagcaaacatccaacacaacacaacctgtttgccatgtcactctttggtgacagaatcttttactccacgtggaagatgaaaacaatttggatcgccaacaagcataccggcaaggatatggtaagaattaatctgcactcctcctttgtgccactaggcgagctgaaagtggttcacccactggcgcagcctaaagctgaggacgatacatgggagccagagcagaagctgtgcaaactgagaaaaggtaattgttcctccacagtgtgtggccaggacctccagtcccacctttgtatgtgcgccgaaggttacgccttaagccgtgataggaagtattgtgaagatgtcaacgaatgcgctttctggaatcacggctgtacattggggtgcaagaacactcccggttcctattattgtacctgccctgttggctttgttctgttgccggatggtaagcggtgccaccagctggtgagttgccctcggaacgtctcggagtgctctcacgactgcgtgctgaccagcgaaggtcctctgtgtttttgccctgaggggagcgtgcttgagagggacggaaagacatgctccggatgtagctcccccgataacggcggttgctcacagctctgcgtgcccctgtctcctgtttcctgggaatgtgactgttttccagggtatgatctccagctggatgagaagtcgtgcgctgcctcggggcctcaaccttttttactgtttgccaattcccaggatatccgtcacatgcattttgatggaactgactacggcacactgttaagccagcaaatgggcatggtctacgccctggaccacgacccggtggaaaacaaaatctattttgcgcacacagctctcaagtggatcgagcgcgctaacatggacggctcgcaaagggaacggctgatcgaagaaggtgtggacgtgcctgaagggcttgcagtcgattggataggcaggagattctactggaccgaccggggtaaaagcctcattggtcgcagtgatctgaacggaaaacgctctaaaattattacaaaggagaatatatctcagcctagaggtattgccgtccacccaatggccaagagattgttctggacagatacggggatcaacccccgaatcgagtcctcatcactccagggtctaggcaggctggttatcgccagctcagacctgatctggcctagtggcatcactattgacttcctgacagacaagttgtattggtgtgatgctaagcagtctgttattgaaatggcaaacttggatggctctaagaggagaagattgacccagaacgatgtgggacacccatttgccgttgctgtgttcgaggattatgtctggtttagtgattgggccatgccgagtgttatgagagtgaataaaagaaccggtaaagatagggttcgcctgcaagggtccatgctcaaaccatcatccctagttgtggtacaccctctagccaagccgggagcagatccctgcttgtaccagaacggaggatgcgagcacatctgtaagaagagattggggacagcatggtgctcctgtagagagggcttcatgaaagccagcgatggtaagacttgcttagccctggacgggcaccagcttctagccggaggagaagtcgacctgaaaaaccaggttacgcccctagacatactatccaaaactcgggtgagcgaagataacataacggaatcgcaacatatgctagtggctgaaattatggtcagtgaccaggatgattgcgccccagttgggtgctcaatgtacgccaggtgcataagcgagggggaagatgccacttgccagtgcctgaaaggcttcgctggagatgggaagctgtgttctgacattgacgaatgcgagatgggtgtgcccgtttgtccacccgctagctctaagtgtattaacaccgaggggggttatgtgtgtagatgcagcgaagggtatcaaggggacggtatacactgcctggacatagacgaatgccagctaggggagcacagttgtggcgaaaatgcatcctgcacaaatacagaaggcggttacacttgcatgtgtgcaggccgattgagcgaaccaggtttgatctgccctgactcaactcccccaccccatctccgtgaggatgaccaccactattcagtgagaaatagcgattctgagtgcccgttgtcccatgatggctattgtctgcacgacggagtatgcatgtacattgaggcattagataaatatgcctgtaactgcgtcgtgggctacattggcgaacggtgccaatatagggatctgaagtggtgggaactaaggcatgccggtcatggacagcagcaaaaagtgatagttgtcgctgtgtgcgtggtggtactggtgatgctgctgctgctgagtctctggggtgcacattattaccgcacccagaaactcctctctaagaatccaaaaaatccttatgaagaaagcagtagggatgtccggtcccgccgaccggctgacaccgaggacggtatgtccagctgccctcaaccgtggttcgtcgtgataaaggagcaccaggatcttaagaatggaggacagcctgtggcaggggaggatggacaggccgcagacggttctatgcagcctactagctggcgccaagagccccaactttgtggtatgggaaccgagcagggttgttggattcctgtcagttccgacaaaggctcttgcccacaggttatggagcgcagctttcacatgccctcctacggcacccagacattagagggcggtgtggaaaaacctcactctttgctgtctgctaatccgctgtggcaacagcgagcactcgatcctcctcaccagatggagctgacccagtag

SEQ ID NO: 28459 - DNA, 3501 bp, Artificial Sequence
  Description of Artificial Sequence: Synthetic coding sequence
atgctgttgactctcataattctgctaccggttgtgtctaaattttcctttgtcagcctgtcagctccacagcattggtcctgtccggagggaacccttgctggtaacggcaattctacatgtgtgggcccagccccatttcttatctttagccacggaaatagtatcttccgaatagacaccgagggtacgaactatgagcaactagtcgtggacgcgggtgtcagtgttatcatggactttcactataacgaaaagaggatctattgggttgacctggagcggcagctgctgcagcgcgtgtttttgaatgggtccaggcaggagcgagtttgcaatatagagaagaatgtttcggggatggccatcaattggatcaatgaagaggtgatatggtctaatcagcaagagggaattatcacagtgactgatatgaagggcaataatagtcatatcttgctgtccgccctgaaatacccggctaacgtagccgttgacccggtagaaaggttcatcttctggagctcagaagtcgccggatctttgtatagagcagatctcgacggggtcggtgtaaaagcgttgttggagactagcgagaagatcacagctgtttctctcgatgtcctggataagcgcctcttctggatacaatacaatagggagggctccaattccctcatctgcagttgcgactacgacgggggtagcgttcacatatcaaaacacccaacacaacataatctctttgctatgagtttgttcggagatcgcattttctactccacttggaaaatgaagaccatctggatagctaataagcatactggtaaagatatggttaggattaacctacacagctctttcgtaccattgggagaactgaaagtggttcaccctctcgctcagcccaaagctgaggacgacacgtgggagcctgaacaaaagctgtgtaagcttaggaaaggaaactgcagcagcacggtttgcggtcaagacttgcagagccacctctgcatgtgcgctgagggttacgccctcagccgtgatcggaaatactgcgaggatgttaacgaatgtgctttctggaatcatggatgtactctcggctgtaagaacacaccgggttcatactattgcacgtgccccgtggggttcgtgctccttccagacggtaaaaggtgccatcagctggtgtcgtgccccaggaacgttagcgaatgcagccacgattgcgttctgacttctgaaggaccactttgcttttgtcccgaggggagcgttttagaaagggatggtaagacatgcagcgggtgctccagtcccgataatgggggatgtagtcagctctgcgttcccctgtccccggtctcatgggaatgcgattgtttccccggatatgacctgcagctagatgagaaatcgtgtgcggcttctgggccacagcccttcctgttattcgctaactcacaggacataaggcacatgcatttcgatgggactgattacggtaccttactgagccaacaaatgggcatggtgtatgccctggaccacgaccctgtggagaataaaatctattttgcacacaccgcattgaagtggatcgagcgcgctaacatggatggaagtcagcgggagagactcatcgaggaaggggtggatgtgcctgaggggttggcagtcgattggatagggcgacgattctactggaccgaccgcggaaaaagcctgatcggcaggtcagacctgaatgggaaacgatctaagatcataacgaaggagaacattagccagccacggggaattgctgtgcaccccatggccaagaggcttttctggacggacacaggcatcaacccacgtattgagagcagctccctacagggactgggcagacttgtgatcgccagttccgacctcatctggccttccggaattactatcgatttcctgactgataaattgtactggtgcgacgcaaagcaatccgtaatagaaatggccaatctcgatgggtccaagaggcgcagactcacccaaaatgacgtcggccatccttttgccgttgccgtcttcgaagattacgtatggttctccgattgggcaatgccctcagtgatgagggttaataagagaactggtaaggacagggtccgcctgcaggggagcatgctcaaacccagctccctcgtcgttgtgcacccgcttgcaaagcctggggcagatccatgcttataccagaatggcggttgtgaacacatctgcaaaaagcgcctgggaacggcctggtgcagctgtcgtgagggatttatgaaggcttcagatggaaagacctgcctggccctggacggacaccagctgctcgctggcggtgaggtagacctgaagaaccaggtaactccactggatatactatcaaaaacgagagtgtcagaggataacatcacggaatcacaacacatgttagtggctgaaatcatggtgtccgatcaggacgactgcgccccagtggggtgctcaatgtatgcgagatgtatctccgaaggcgaggacgctacctgtcaatgcctgaaaggattcgctggcgacggcaagctgtgctcagacatcgacgaatgcgagatgggcgtaccagtttgtccacctgcctcttcaaagtgtatcaataccgagggaggctacgtgtgtcggtgttctgagggttaccagggtgatggtatccactgtctagattctacgcctcccccacacctgagggaggatgatcaccattactccgtgagaaactctgactcagagtgtccactttcacatgacggctactgcttacacgacggagtgtgtatgtacattgaggctctagacaagtacgcctgtaattgtgtcgtggggtacattggagagcgctgccagtatagggacttaaaatggtgggagctgcggcacgcaggccatggacagcagcagaaggtgatcgtcgtggccgtgtgcgtggtggtcctggtgatgcttctgctgttatccctctggggagcccattattatcggactcagaagctcttatcaaagaacccaaaaaatccttatgaggagtcctcacgggacgtgagaagccggaggcctgccgatacggaagatggaatgtccagttgtccacaaccttggtttgtcgtgatcaaagagcatcaggatctgaaaaatggcggacagcccgtcgctggcgaagatggccaggctgcagatggctctatgcaaccaacatcatggaggcaggagccacaactatgtggcatgggtacagaacaaggctgttggatcccggtcagttctgataaaggaagctgcccacaggtcatggagcgctcatttcatatgccaagttatggcacacagactcttgaaggtggagtcgagaagcctcactccctgctaagcgctaaccctctgtggcagcagcgagctttagacccacctcaccaaatggaactcacgcagtag

SEQ ID NO: 28460 - DNA, 3498 bp, Artificial Sequence
  Description of Artificial Sequence: Synthetic coding sequence
atgctcctgaccctgatcatattattaccagtggtgagtaagtttagctttgtgagtctttcagcaccccagcactggtcttgccctgaggggacgcttgcaggtaatggaaattcaacttgtgttggccctgccccttttcttatatttagccatggaaattcaattttccgaattgatacggaaggcactaactacgaacagctagtcgttgatgccggtgtatccgtaatcatggattttcactataacgagaaaagaatttattgggtggacttagagcggcagctcctgcagcgcgtgttcctcaatggtagcaggcaggagcgtgtgtgcaacatagagaaaaacgtttcgggcatggctattaattggataaatgaggaggtaatctggagcaaccagcaagaagggatcatcactgtcaccgatatgaaaggcaacaattctcatattctcctttcagctctaaaatatccagctaacgtcgcagtggaccctgtcgagagattcatcttctggagttccgaagttgccggttcattgtatagggccgacctggatggcgtgggcgtcaaagcactgctcgagactagcgagaagatcacagcagtcagcttggacgtactggataaaagactcttttggatccagtataatcgggaaggtagtaacagcttaatttgttcatgtgactacgatgggggttccgttcacattagtaagcacccaacacagcataatctttttgcaatgtcactgtttggggatagaatcttttacagcacttggaaaatgaaaactatttggatcgccaacaaacatacaggaaaggacatggtgcgaattaatctgcactcctcttttgttccactgggagaactgaaagtcgtgcacccgcttgcccaaccaaaggcagaggacgatacctgggagcccgacgtcaacgaatgcgccttttggaatcacggatgtacactggggtgcaagaatacaccgggtagttattactgtacgtgccccgtgggctttgtgttgctgcccgatggtaagcggtgccatcagttggtatcctgtccacgaaatgtatctgaatgctctcatgactgtgtgttaacctctgaggggccactttgtttctgcccagaaggaagcgttctggagcgggacgggaaaacgtgttccgggtgcagtagtccggataacggtggatgcagccaattgtgcgtgcctctgagcccagtctcttgggagtgcgattgctttcctggatatgaccttcagctggatgaaaaatcttgtgctgcaagtggacctcaacccttcttactgtttgccaattctcaggacatacggcatatgcattttgacggtaccgactatggtaccctgctgagccagcagatgggaatggtctacgccctggaccacgaccctgtggagaataagatatactttgcgcatacagcactgaagtggatagagagggccaatatggacggctcacagagagaacgccttatagaggagggggtggacgtcccagagggtctcgcagtggactggattggcaggagattttattggaccgaccggggaaagagcctcattggcagaagcgatctgaatggcaagcgctccaagatcattaccaaggagaacatcagtcagccaagggggatcgccgtgcaccccatggctaaacggcttttttggacagacaccggaataaatcctaggatagaaagctccagcttgcagggcctgggcagattggtaatagctagcagcgatctgatatggccatcgggaattacgatcgatttcttgacagacaagctttattggtgtgatgccaaacagtcagtcattgaaatggctaatcttgatggtagtaagcgccgtaggctgactcaaaacgacgtagggcaccccttcgcagtagcagtcttcgaggactacgtgtggttttctgattgggccatgccatctgtcatgagggtgaataagcggactggcaaggatcgcgtacggctccaaggctccatgctcaagccttctagcctggtcgtagtccacccactagccaagcccggtgctgatccatgcctttatcagaatgggggatgtgagcacatttgcaagaaaagattggggacggcttggtgtagctgccgcgaagggtttatgaaggcctctgatggaaaaacatgtctggccctcgacgggcaccagttattggcaggtggtgaagtggatcttaaaaatcaggtaaccccccttgacatattgtccaagaccagagtatccgaggataacatcacagagtctcaacacatgctcgtggccgaaattatggtgagcgaccaagacgattgcgcacctgtaggctgctccatgtacgcccgttgcatctccgagggcgaagacgccacatgccaatgcctcaagggcttcgccggagacgggaaactgtgttcagatatcgacgagtgcgagatgggcgtacctgtgtgcccgcctgcctcttctaaatgcatcaacacggagggagggtacgtctgcagatgcagcgagggttatcagggagatggcattcattgtctggatattgacgaatgtcagttgggagagcattcatgtggcgaaaacgctagctgtacaaatactgagggcggatatacttgcatgtgcgcaggacgcctctctgagcctggactcatttgccctgactccacgcctcccccacacctgagagaagacgaccaccattactctgtcagaaattctgacagcgagtgtccgctgtcgcacgatgggtattgcctgcacgatggagtctgcatgtacatagaagccctcgacaagtacgcctgcaactgtgttgtcggatatatcggtgagcggtgtcagtacagggatctcaaatggtgggaattgagacacgccggacatggccagcagcagaaggtgatagttgtcgccgtgtgtgtcgtggttctggtgatgctgttactcttgtctctgtggggcgctcattactataggacacagaagttattgagtaaaaaccctaagaacccgtatgaggaaagctcacgggacgtcaggagtaggcgcccagctgacactgaggacgggatgtcctcttgcccgcagccttggtttgtggtgatcaaggagcaccaggacttgaagaatggcggtcagcctgtggccggagaggatggacaggctgccgacgggagtatgcaaccaaccagctggaggcaagaaccccagttgtgcggtatgggaaccgagcaaggctgctggattcccgtgagttcggataaaggctcttgtccacaggtaatggaacggtccttccatatgccaagctatggtacacagacattagagggcggagttgagaaacctcattctctactgagcgctaatccactgtggcagcaaagggcattagaccccccacatcagatggagctgacccagtag

SEQ ID NO: 28461 - DNA, 3633 bp, Artificial Sequence
  Description of Artificial Sequence: Synthetic coding sequence
atgagacccagcgggactgctggggctgccctattagccctgctggcggcattgtgtcctgccagcagagcattagaggagaaaaaagtgtgtcagggcacatcaaacaagctgacccagctgggtacttttgaagaccattttctgagcctgcaacgcatgttcaacaactgcgaggtcgtattgggcaacctcgagataacttatgtgcagcggaattatgacttgagttttctgaaaacaattcaggaggtggccggttatgtgctcatcgcgctgaacacagtcgaacgaatccctcttgaaaatttacagatcatcagggggaacatgtactacgaaaacagctacgctctggccgtgctctctaactatgatgccaataagaccggactcaaagagctcccgatgcggaacctgcaggagatactgcatggggctgtgaggttttccaacaatcctgctctttgtaacgtggagagcatacagtggagggacatcgtgtcctctgacttcttgagtaatatgagcatggatttccagaaccatctaggtagctgccagaaatgcgacccttcgtgtcccaatggctcttgctggggggctggagaagagaactgccagaagttgacgaaaattatttgtgcccagcagtgtagcgggcgttgcagggggaaaagcccctctgattgctgtcataaccagtgtgccgcaggatgtactggcccacgagagagcgactgtctggtgtgccgcaaatttcgggacgaggctacttgcaaagacacatgtcctcccctgatgttatacaaccccacaacctaccagatggatgtcaatcctgagggaaagtatagctttggtgccacctgcgtaaaaaagtgtccacgcaattacgtggtcaccgaccatgggtcttgtgtgcgagcttgcggggctgattcttatgaaatggaagaagacggggttaggaagtgtaagaagtgtgagggcccttgcaggaaagtgtgcaacggaatcggaatcggcgaatttaaggatagtctcagcattaacgccacaaatatcaagcactttaagaactgtacctccataagtggcgacctccatatactacctgtcgctttccgtggcgattccttcacacacacccctccactggatccgcaagagctggatatactgaagaccgtcaaggaaatcacgggcttcctgcttattcaggcttggccagagaaccgcaccgatttgcatgctttcgaaaacttagagataatacggggacggaccaagcagcatggccaattctccctggccgttgtctcactgaatatcacgtctctgggcctcagaagcctgaaagagatcagcgacggagacgtcataatctctggcaataaaaacttgtgttatgccaacactattaattggaagaagctgttcggaacgagtggacagaagaccaaaattatctctaataggggcgaaaattcctgcaaagctacaggtcaggtgtgccatgccctgtgttcgcctgaggggtgctggggacctgagcctcgggattgtgtgagttgtcggaacgtatcccggggacgtgaatgtgtagataagtgtaacctgctggagggagagcccagagagttcgtggaaaattctgaatgcatccaatgccacccagaatgtctgccacaggccatgaacattacatgtacgggacggggtcccgacaattgcatccagtgcgcacactatatcgacgggcctcactgtgttaagacttgccccgcaggagtgatgggggaaaacaacaccctggtctggaagtatgctgacgccggacacgtctgtcacctttgccacccaaattgcacgtacggatgtaccgggccaggtctggaaggttgccccacaaatggtccaaagataccctccatcgcaacaggcatggtgggcgctctgcttctgctgttggtagttgccctggggattggcctgttcatgcggcgacgacacatagtcagaaagaggaccttgcgtcgactcctgcaggaaagagaactcgtagagccactgaccccttccggcgaagcgcctaatcaggcactgctgagaatcctcaaggaaacagaattcaagaaaataaaagtgctgggaagtggggcttttggcactgtttataaaggtctgtggattccggagggtgagaaagttaagattcctgtcgctatcaaagaactacgcgaggcaaccagccctaaagcaaataaggaaattctggatgaggcctatgtcatggctagcgtggacaatccacacgtgtgcagactgttagggatatgccttacgtcgaccgtccaattaattacccagctgatgcccttcggctgtctgctggactacgtgagagaacataaggacaatattggcagccagtatttactgaattggtgcgtacaaatagcaaaggggatgaactatttggaggaccgacgactagttcatcgagatttggcggcacggaacgtcttggtcaaaaccccccagcatgtcaagatcacagactttgggctagcaaaactcctcggcgctgaggaaaaggaatatcacgccgaggggggaaaagtcccaattaagtggatggccctcgagagcatcctgcataggatctacacgcatcagagtgacgtgtggtcctacggtgtgacagtttgggagctcatgacattcggctccaagccttacgatggaattcctgctagcgagatctcgagtatcctggaaaagggtgaacgcctgccacagcctccaatctgtactatcgatgtttacatgatcatggtaaagtgttggatgattgatgccgattccaggccaaaatttagagagcttatcatcgagtttagcaagatggctcgcgatcctcagagatatctggttattcagggggacgagagaatgcacctgccttcacctaccgattcaaacttttatcgtgctcttatggacgaagaagacatggacgacgtggtggatgctgacgaatatttgatcccccagcagggatttttcagttcaccctctacttcccgaacaccacttctttcctccctgtccgccacttccaacaactccacagtcgcctgcatcgatcgcaatggcctccagtcttgtccaattaaggaggattcatttctccagagatacagctctgacccaacaggggctttgactgaggattcaattgatgacacattcttgccagttcccgagtatatcaaccagtccgtacccaaaagacctgcgggtagtgtccagaatcccgtgtatcacaatcaaccccttaaccctgcaccttctcgcgatcctcactatcaagatcctcactccaccgctgtgggcaaccccgagtacttgaacactgtgcaaccaacttgcgttaactctacattcgattccccagctcactgggcccaaaaggggtcccatcagatctccctggacaatcctgattatcaacaagacttcttccccaaggaagccaagcctaacggcatctttaaaggcagcactgccgaaaatgccgagtatctgcgcgttgctcctcagtcatctgaattcatcggagcgtag

SEQ ID NO: 28462 - DNA, 1887 bp, Artificial Sequence
  Description of Artificial Sequence: Synthetic coding sequence
atgagaccctcgggcaccgcaggcgcagccctgttagcactattggctgcgctctgcccggcatcccgggctttggaagagaagaaagtatgtcagggcactagcaataaactgacgcaactgggcacatttgaggatcactttctttccctacagcgaatgttcaacaactgcgaggtggtgctgggtaatctggagataacttacgtgcaacggaattacgacttgtcctttctgaaaaccatccaggaagttgccggatatgtcctgatagccctcaacacagtagagcggattccactggaaaacttgcagattatccgtggcaatatgtactacgagaacagctacgctttggcagtactaagtaattacgacgcaaacaaaaccggactgaaggaactacccatgaggaacctgcaggaaatcctgcatggagccgtgcggttttccaataaccctgccctgtgcaatgtcgagtctatccaatggagggacattgtgtcctctgattttctgtcgaacatgagcatggacttccagaatcacctgggtagctgtcagaaatgcgatccttcttgtcccaacggctcctgctggggggcaggcgaagagaactgccagaaactcactaaaatcatatgcgctcagcaatgtagcggcagatgtaggggcaaaagcccctccgactgttgccataaccagtgcgctgcaggatgcactgggccacgtgagagtgactgcctggtttgccggaagttccgcgacgaagctacatgcaaggatacgtgtccccctctaatgctgtacaacccaactacctaccagatggatgtaaaccccgaaggaaagtacagtttcggcgctacctgtgttaagaagtgccctagaaactacgtcgttacggaccacgggtcctgcgttagagcctgcggagcagactcttatgagatggaagaggacggcgtgagaaaatgcaaaaagtgcgagggcccatgtaggaaagtgtgcaacggcataggtatcggcgaattcaaggactccctctcaattaacgctactaacatcaaacatttcaaaaattgtacatcaattagcggcgacctgcatattctgcctgtggcgttcaggggagactcttttacccacactccacctcttgacccccaggaactcgacatactgaaaacagtgaaggagataaccggcttcttgctcatacaggcgtggcctgagaatcgcactgatctccacgcctttgagaacttagagatcatccggggtcgaactaagcaacacgggcagttctcccttgccgtggtttctctgaatattacaagtcttggtctaaggtcactcaaagagatctcagacggggatgtcataatctccggaaataagaatttatgctacgctaacacaatcaactggaaaaagctcttcgggacttctggtcaaaaaacaaagatcatatccaatagaggcgaaaacagctgtaaagccacaggccaggtttgtcacgctctttgcagtccagagggatgttggggaccagagccaagagactgtgtatcatgtcgcaatgtcagcagagggagggagtgcgtcgacaagtgtaatctgctggagggagaacctcgggagttcgtggaaaactccgagtgcatccaatgccaccccgaatgcctgcctcaggcaatgaatattacgtgcacgggacgtggtcccgataactgtattcaatgcgcccactacatcgatggtcctcattgcgtaaaaacctgccccgctggtgtcatgggtgagaataacactctggtgtggaaatacgcagatgctggccatgtatgtcacctgtgtcacccaaactgcacatacggcagttag

SEQ ID NO: 28463 - DNA, 2118 bp, Artificial Sequence
  Description of Artificial Sequence: Synthetic coding sequence
atgcggccttctggtaccgccggagcagccctgctcgccctgttggcagccctgtgccccgcttctagggctctcgaggagaagaaagtatgccagggaacaagtaataagctgacacagttaggtactttcgaggaccatttcctttcccttcagcggatgtttaacaactgcgaagtggtgctggggaaccttgagatcacatacgtgcaacgcaattatgatctcagtttcctcaagacaatccaggaagtagctggttacgtcttaattgcgctcaacactgtcgaacggattccactggaaaatctccagattatcagaggaaacatgtattacgagaattcctacgcacttgcagtgttgtccaactacgatgcgaacaaaacaggtcttaaagagctgccgatgaggaaccttcaggagatactacacggcgcagtgaggttctcaaacaatcctgcattgtgtaacgtggaaagtatccagtggcgcgatatcgtaagctctgattttctcagcaatatgagcatggatttccagaaccacttaggcagttgccagaagtgtgacccttcttgcccaaacggttcctgctggggggctggtgaggagaactgtcagaaattgaccaaaattatttgcgcacaacagtgctccggacgctgtcggggaaaatctccctctgactgttgccacaatcagtgcgcagcgggatgcacaggccctcgtgagagtgactgtttagtgtgtcgtaaattcagagacgaggctacatgtaaagatacctgtcctccgctcatgctgtacaacccgactacttatcagatggacgtcaatccggagggtaagtactcatttggagcaacctgtgtcaagaagtgcccccgaaactatgtggtcacggaccatgggagctgtgtgcgggcatgcggtgccgacagctatgaaatggaggaagacggagtgagaaaatgtaaaaaatgtgagggtccctgtagaaaggtctgtaatggcatcggcatcggagaatttaaggacagcttgagcataaatgctaccaatatcaaacatttcaaaaactgcacatccatttctggggacctccacatcctaccagtggctttccgcggtgacagctttacccataccccaccactggatccccaggagctcgatattctaaagaccgtaaaggagattacgggcttcttactgatccaggcctggccggaaaatcggacagatttacatgcctttgagaacctcgaaattattcgaggacggactaagcagcatggacagttttcattagcagtggtgtccctgaacataacaagtctgggcctaagatctttaaaagagatctcagacggggatgtgattatttccggcaataagaacctgtgttatgctaataccattaattggaaaaaactgtttggaacctctgggcaaaagacaaagattatcagtaacaggggagagaactcctgcaaggctacagggcaggtgtgtcacgccctatgttcccccgagggctgctggggtccagagcctagggattgcgtctcttgccggaacgtcagcaggggccgagagtgtgttgataagtgtaacttacttgagggggagcctagggaattcgttgaaaattccgagtgtatccagtgtcatcccgagtgtctgccacaggctatgaatattacatgcactggcagaggacctgacaattgcatccagtgcgcccattatatcgacggacctcattgtgtgaagacatgtcctgcaggcgtcatgggagaaaataatactctggtttggaaatatgcagatgcgggacatgtgtgccacctgtgccatcctaattgtacctacggcccaggtaatgagtctctgaaggctatgctcttctgtttgtttaagctgtcctcatgtaaccagagcaacgatggctccgtatcccatcagtccgggtcacctgcagcccaagagagctgtctcggctggatcccatcactgctcccttccgagtttcagctgggttgggggggatgctcccatctgcatgcttggccctcagcatctgtcatcatcactgcttcctcctgccactag

SEQ ID NO: 28464 - DNA, 3243 bp, Artificial Sequence
  Description of Artificial Sequence: Synthetic coding sequence
aatcgaaccgagggcgctgcccatgaaaaattcacgggaaaccctgcttggcgcagagcggtccagcagcagccttgcccagttgtggaaagtatccagtggcgagatatcgtctctagtgattttctgagtaatatgagtatggacttccagaaccacctcgggtcttgccagaagtgcgatcccagctgtccaaatggatcttgttggggcgcaggtgaagagaactgtcagaagcttaccaaaatcatttgcgcccagcaatgcagtggcagatgccgcggaaaaagcccgagtgattgctgtcataatcagtgcgcagcagggtgtacggggcctagggaatccgactgcctggtgtgtcgcaaatttagggatgaggctacctgcaaggacacttgccccccactgatgctatacaacccgacaacttaccagatggacgtgaacccggaaggaaagtactccttcggcgcaacttgcgtcaagaagtgtccaaggaactacgtggtgaccgaccacggtagctgcgttcgagcgtgcggtgctgatagctacgagatggaggaagacggtgtgcgaaagtgtaagaagtgcgagggaccatgcaggaaggtttgtaacggaatcggtatcggagaatttaaggactctctgtctatcaacgcaaccaatataaagcatttcaaaaactgtactagcatctccggagatcttcacatcctgccggtcgcattccgtggcgatagcttcacccacacgccacccctcgacccccaagagctggacattttaaaaaccgtgaaggagatcacaggcttcctactgattcaggcatggcccgagaaccgcacagacctgcatgccttcgaaaacttagagatcattagaggcaggaccaagcaacacggtcagttcagtctcgcagtggtgtccctaaatattactagcttgggtttgcgctcattgaaagagatttccgatggggatgttatcatcagcggaaataaaaatctgtgctacgcaaacaccattaattggaagaaattgtttgggaccagtggccagaagacgaagataatctcaaaccgcggagagaattcatgcaaggccacgggacaagtatgtcacgccttgtgttcccccgaaggctgttggggaccagaacccagggactgcgtctcctgcagaaacgtcagtcgcggtcgggaatgtgtggacaagtgcaacctattggaaggcgagccgagggaatttgtggaaaacagcgaatgcattcagtgccatcccgaatgtttgccgcaggcgatgaacattacctgcacgggacgtgggccagacaattgcatccagtgtgctcactacattgatggtccacattgtgtcaagacctgcccagcaggagtgatgggcgaaaacaatactcttgtgtggaagtatgctgacgccggtcacgtgtgtcatctgtgtcaccccaactgcacttacggttgcaccggaccaggcctcgagggatgccccactaatggtcctaaaattcctagcatcgctacagggatggtaggtgcacttctgttgctactggttgtggctctcggcattgggctctttatgaggcgcaggcacatcgtgcgaaagaggaccctgaggcgccttctgcaggaacgagaactcgtggagcctctcaccccatccggcgaggcgcctaaccaggccctcctgaggattcttaaagaaaccgaatttaaaaaaatcaaagtactaggcagcggtgctttcgggactgtgtataaggggctttggatcccggaaggcgaaaaagtaaagattcctgtcgcaatcaaggagctccgggaagcaacaagcccaaaggcaaacaaggagattctggatgaagcctatgtgatggcctccgtggacaacccacacgtgtgcaggctattaggcatctgcttgacatctacggtccaactgatcacccaacttatgcccttcggatgccttttggactacgtccgggagcacaaggacaatatcggctcacagtatctgctcaattggtgtgttcaaatcgcgaaaggtatgaactacctcgaggatcgcaggttggtgcaccgcgacttggcggctagaaatgtgctggtcaaaacaccacaacatgtcaaaatcaccgatttcggtctcgctaaactgctgggtgcagaggaaaaggaataccatgcagagggtggcaaggttcctattaaatggatggcactggagagcatcctgcacaggatctacacccaccaatctgatgtgtggagctacggtgttacagtttgggaactgatgactttcgggtcaaagccctacgatggcatcccggcttcagaaatctcaagtattctggagaaaggagagcgcctgccacagcccccaatatgtactatcgacgtgtatatgattatggtaaagtgctggatgattgacgccgatagcagacccaaatttagggagctcattattgaattttccaagatggctagggacccccagcggtatctggtgatccagggcgacgaaagaatgcatctgccgtctcccacagactccaacttttacagagcactcatggacgaggaggacatggacgacgtggtggatgccgacgagtatctcatcccacagcagggctttttctcctcccccagcacctcacggacacctctactgagctctttgagcgctacctcaaataactcgacagtggcatgcatcgataggaacggactgcagagctgtcctatcaaggaggacagttttttgcagcgctactcaagcgacccaactggtgccctgacggaagatagtattgatgatacattcctgccagtgccagagtacattaatcagtccgtcccaaagcgacccgcaggatcagttcagaaccccgtgtatcacaaccaaccgttaaacccagcgccttccagggacccccactatcaggatccccactcaacggccgtgggtaaccccgaatacctcaataccgtgcagcctacttgcgtcaattccacctttgactcgcccgctcactgggctcagaaaggctctcaccaaatctccctcgataatccagattaccagcaagactttttcccaaaagaagctaaaccaaatggtatttttaaaggcagcaccgcagagaatgccgaatatctccgtgtggccccacagtcctccgaatttatcggtgcttag

SEQ ID NO: 28465 - DNA, 1218 bp, Artificial Sequence
  Description of Artificial Sequence: Synthetic coding sequence
atgagaccaagtggtacagcgggagccgctctgctcgccctgcttgcagctctctgccctgcttctcgcgctctggaggagaaaaaggtgtgccaaggcacctccaataaactcacccagttagggacttttgaagaccacttcctgtctctccagaggatgtttaataattgtgaggtggtgctcgggaatctggagatcacgtatgtccaacgcaactatgaccttagcttcctgaaaactatacaagaggtagctgggtacgtcctcattgcacttaacacggtagagcggatccctctcgagaatctgcagattatccgcggtaatatgtactatgagaatagctatgctctggctgttctctccaattatgacgccaataaaaccggattaaaggagctgcccatgcggaacctgcaagagattcttcacggggcagtgagattctccaataatcccgctttatgcaacgtggaaagtatccagtggagggatatcgtgagtagcgatttcttatccaatatgtcgatggatttccaaaaccatcttgggagctgccaaaagtgcgatccatcatgtccaaacggttcttgctggggcgcaggtgaagaaaattgccaaaagcttactaaaattatttgtgcccagcagtgctccggaagatgccgtggcaagtctccttctgattgctgtcacaaccagtgtgcagctggttgcacgggtccaagagaatctgactgtctagtctgccggaaattcagagacgaggcaacatgtaaagatacatgcccacccctgatgctctataaccccacaacatatcaaatggacgtcaatcctgagggcaagtattcatttggcgctacgtgcgtgaagaagtgccctagaaattacgtggtgacagatcacggcagttgcgtgagagcttgcggagcagattcttatgagatggaagaagatggtgtgcgtaagtgcaaaaagtgtgagggaccttgcaggaaagtgtgcaacggcattggcattggcgaatttaaagacagcctaagtatcaacgctaccaatattaaacactttaaaaattgtacctcaatatcaggggatctccacattctgccagtagcatttcggggtgactcattcacacatacccccccactggacccgcaggagctcgacattttgaagacggtcaaggagatcacaggtttgtcgtag

SEQ ID NO: 28466 - DNA, 1974 bp, Artificial Sequence
  Description of Artificial Sequence: Synthetic coding sequence
atgagaccttcaggcactgccggtgcagcactcctagctctgctggctgccctttgtcccgcatctcgggcactcgaggaaaagaaagtctgccagggtacctctaacaaactgacacagctgggaactttcgaagaccactttctgtccctacagcggatgttcaataactgcgaggttgtgctgggcaatctggaaatcacctatgttcagcgcaactatgacctcagcttcctcaagacaatacaggaggtggcaggctacgtactaatcgcccttaacacagtcgagcgtataccgttggagaatctgcagatcatccggggaaatatgtattatgagaacagttacgctctggcagtgttgagcaattacgacgccaacaaaacagggctcaaggagttgcctatgcgtaaccttcaggagattctccacggagcggtccggtttagtaataaccctgccctctgtaatgtcgagagtatacagtggagagatatcgtcagcagcgatttcctctccaatatgtctatggattttcagaaccatctgggctcctgtcaaaaatgtgatccctcttgccctaatggaagctgttggggcgcaggagaagagaactgtcagaaactgactaaaataatttgtgcgcagcaatgctctggcagatgtaggggcaaaagccccagcgactgttgtcacaatcagtgtgcggctggctgcaccgggcctagagaatcagactgcttggtctgccgcaagttcagggatgaagccacttgcaaggacacctgtccgcctcttatgctgtacaatccaacaacttaccagatggacgtgaacccagaaggtaagtattcctttggcgctacatgtgtgaagaagtgcccacggaattatgtggtaactgatcacggtagctgcgtccgtgcatgcggcgctgattcatacgagatggaagaagatggggttcgaaagtgcaagaagtgcgaaggcccatgccgcaaggtctgtaatggcatcggcatcggcgagttcaaggactccctttccattaatgcaactaacataaagcattttaagaattgtactagcatttcaggcgatttgcacatattaccagttgcttttaggggtgattcctttactcacactcccccattggatcctcaggaactggatattcttaaaacagtgaaggagattaccggatttctgctgattcaggcctggccagagaaccgtacagacctgcacgcgttcgagaacctggagatcataagaggcagaaccaagcagcacggccagttcagcctggccgtggtgtcccttaatataactagcctgggacttcgaagcctaaaggagatctcagatggggatgtcatcatttcaggaaataagaacttgtgctacgccaacactatcaattggaaaaagcttttcggtacatctgggcagaaaactaaaattatatctaacagaggggaaaacagctgcaaggctacaggccaggtgtgtcacgccttgtgttctccggagggatgctggggcccagagccaagggactgtgtctcctgtaggaacgtgagccggggaagggaatgtgttgataagtgcaacctgctggaaggggagcccagagaattcgttgagaactccgagtgtattcagtgccacccagagtgccttcctcaagctatgaacataacttgtacagggagaggtccagacaactgtattcagtgcgcccactatatcgatggccctcattgtgttaaaacctgccccgctggagtgatgggggagaataatactttagtgtggaaatatgccgatgctgggcacgtctgtcacctctgtcaccctaactgtacatacggatgtaccggccctgggcttgaagggtgcccgacaaatggcagttatatcgtatcacacttccctcggagcttttacaagatgagcgttcactag

SEQ ID NO: 28467 - DNA, 3474 bp, Artificial Sequence
  Description of Artificial Sequence: Synthetic coding sequence
atgttcaataactgcgaggtcgtgctggggaacctggagatcacttacgtgcaacgcaattacgacctttccttcctgaagaccattcaggaagttgctggttacgtgctcatcgcactcaatactgtggagaggatacctctcgaaaacttacaaatcattcggggaaacatgtattatgaaaactcttatgctctggctgtactgtctaactatgacgccaacaagacagggcttaaggagttgcctatgagaaatctgcaagagatactccacggagctgtacggttctcaaacaatcctgccctctgcaatgttgagtcgatccagtggagggatatcgtgtcaagcgactttctctccaacatgtcaatggacttccagaaccacttaggctcgtgtcagaagtgcgaccctagctgtcccaacgggtcatgttggggagccggagaagagaattgtcaaaaattgaccaaaatcatatgtgctcagcagtgcagcgggaggtgcagagggaagagcccctctgattgctgccacaaccagtgcgccgcaggatgtaccggccctagggagtccgactgtctggtctgtagaaaatttagggacgaggcaacgtgcaaggatacttgtccgccattgatgttgtataaccccaccacctaccagatggacgtgaatcccgagggcaagtactcatttggcgctacgtgcgtcaagaagtgtcccaggaattacgtagtcacagatcatggctcttgtgtacgggcatgcggggctgacagctatgaaatggaagaggatggtgtgcgcaagtgcaaaaagtgtgagggcccatgccgaaaggtgtgtaacggaattggtattggggagtttaaggattctctgtccataaacgccaccaatatcaaacacttcaagaactgcactagtatttctggggacctgcatatactgcccgttgcttttcgcggtgacagcttcacgcacactccacctcttgacccccaggagctcgatatcctgaaaactgtcaaggagataaccgggttcctcctgatacaagcctggcctgagaaccgaactgacctacacgcatttgagaatttggaaataataagaggaaggaccaaacagcacggtcagttttctctagctgtggtcagtctgaacatcacctctctcggcctcagatcgctgaaagagatcagtgacggggatgtgatcatttccggaaacaagaatctgtgctacgctaatacgattaattggaagaaattgttcggcacaagtggacagaaaactaaaatcatttctaacaggggagagaactcttgtaaggctacaggacaagtgtgccatgccctgtgtagcccagaggggtgctggggcccagagccgcgagactgcgtctcgtgccggaacgtgagtagaggtagggaatgcgtggataagtgtaacttactcgagggagaaccacgcgagtttgtcgaaaactcagagtgcatccaatgtcacccagaatgcctgcctcaggctatgaacatcacctgtacagggaggggtccagacaattgcatacagtgcgcacattacatcgatggacctcactgcgtgaaaacctgtcctgccggagttatgggggagaacaacaccctggtctggaaatacgcggatgctgggcacgtgtgccacctctgccatcctaattgcacctacggatgcactggtcccggactcgaaggctgtccaacaaatgggccaaagattccgagtattgccactgggatggttggcgcattactgttgctattggtcgttgcccttggaatcggtctgtttatgaggcgcagacatatcgtaagaaagcgaacactgcggaggttgttacaagaaagggaactggttgagcccctgacccccagtggcgaggctccaaaccaggcactgctcagaattcttaaggaaacggagtttaaaaaaataaaagtactaggttctggagcctttgggacggtgtacaagggcctgtggatcccagagggagaaaaagtgaagatccctgtcgccattaaagagctaagagaagccacctccccgaaggcaaacaaggaaatcctggatgaagcgtacgtgatggcctctgttgataatccacacgtctgccggctgctggggatttgtcttacatcaactgtgcagcttatcactcaattgatgcctttcggatgtctgttagattatgtgagagaacacaaagacaatattggatcccagtacctccttaattggtgcgtgcaaattgcaaaggggatgaattacctggaggaccggaggttagttcacagagacctagccgctcgtaacgtgctggttaagacaccccagcacgtcaaaattacagatttcggactggcaaaactgctcggggctgaagaaaaagagtatcacgctgaaggcggaaaggtccccatcaagtggatggccctcgagtctatcttgcacaggatctatacgcatcagagtgatgtttggtcttatggcgtgacggtgtgggaattgatgacttttggatccaaaccttatgacggcattcctgcgagtgaaattagctctattctggaaaagggagagaggttgccccaaccccctatttgcacaatcgacgtgtatatgattatggtgaaatgctggatgatcgatgccgattcgcggccaaagtttagagaacttattatcgaattctcaaagatggctcgtgacccacagcgctacctagtaatccagggagacgagcggatgcatttgcccagcccaacagacagtaacttttatcgtgctctcatggatgaggaggacatggacgacgtggtagatgccgatgaatacctgattccacagcagggcttcttttccagtcccagtaccagcaggacccctctgctgtcaagtctttctgctaccagcaataattccacagtggcttgtatagaccgcaacggcctgcaatcctgccctatcaaggaagattcttttctccaaagatatagcagtgacccaaccggtgctctcaccgaagattccattgacgacacatttctcccagtgcctgagtatataaatcagagcgtcccaaaacgacctgccggaagcgtgcagaatcccgtctaccataaccagcccctcaacccggctccgtcgagagaccctcattatcaggatccgcattccaccgcagtcggcaatccggagtacctgaataccgtgcagcccacctgtgtcaactccacttttgattcacctgcgcattgggcacagaagggtagtcaccagatttccctagataatcccgattatcagcaggacttctttccgaaggaagccaaacctaatgggatctttaagggcagtactgctgaaaacgcggaatatctaagggtggctccccaatcttccgagtttattggggcatag

SEQ ID NO: 28468 - DNA, 3276 bp, Artificial Sequence
  Description of Artificial Sequence: Synthetic coding sequence
atgcgtccttccgggactgccggagctgcactactcgctttgttagccgcactatgcccagccagtagagctttggaggaaaagaaggtgtgccaggggactagcaacaagttgacacagttgggaacttttgaggaccacttcctcagcctgcagcggatgttcaataactgcgaagtcgtgctgggcaaccttgaaataacatacgttcaaaggaattacgacctgagctttctgaagactattcaggaagttgcaggctacgtgctaatagcccttaacactgtggagagaatccccttggagaacctgcaaatcattcgcggtaacatgtactacgaaaattcctatgcactggccgttctgagcaactacgacgcgaataagactggactcaaagagcttccaatgaggaatcttcagggacaaaagtgcgacccttcatgccctaacggctcttgctggggagctggggaagaaaattgccaaaaactgactaaaattatttgcgcgcagcaatgttccggtcggtgccgtggcaagagccccagtgattgctgccataatcagtgtgctgctggatgcacagggcctcgcgagagcgattgcctggtgtgtcggaaatttcgcgatgaggcaacctgcaaggacacatgcccacccctgatgctgtataacccaactacctaccagatggacgtgaaccccgagggcaaatactcatttggcgctacgtgcgttaagaagtgcccccgaaactacgtcgtcacagaccatggctcctgcgtgcgggcttgtggggcagattcatacgagatggaggaggacggcgtcagaaaatgcaaaaaatgtgaaggtccttgccggaaagtttgcaatgggatcggaataggcgaattcaaggactccctctcaattaacgccacgaatatcaagcactttaaaaattgcacatcaatttccggagacctgcacatcctcccggtggcttttcggggtgactcttttacacatactccccctttggatccccaggagctcgatatactgaaaaccgtgaaggaaataacgggcttccttttgatccaggcgtggccagaaaatagaaccgacctacatgcgttcgagaacctagaaataattaggggcaggactaaacagcacggtcagttctctctggcagtggtgtccctgaacattacgagcctcgggctgaggtctttaaaagaaattagtgacggggacgtgattataagcggaaataagaatctgtgctatgccaataccattaattggaaaaagttgtttggaacgtccggccagaaaacaaaaatcattagcaaccgtggagaaaacagctgtaaggccacaggacaggtgtgtcacgccctttgtagcccagaaggctgctggggacccgagcccagagactgtgtctcttgccgaaatgtaagccgcggacgggaatgcgtggataagtgcaacctactcgagggtgaaccccgagaatttgtagaaaattcagagtgcattcagtgtcatccagaatgcctgcctcaggccatgaacatcacatgcactgggagggggcctgacaactgtatacagtgtgctcactatatcgatggacctcactgtgtgaagacatgccctgctggggtgatgggtgaaaacaacaccctggtgtggaaatacgccgacgctggccacgtctgccacctgtgccaccccaattgcacctatggctgtactggacccggacttgagggctgtccaactaacgggccaaaaattccgtctatagctaccggcatggtgggcgcactactcttactactcgtcgttgccttgggcatcggactattcatgcggcgacgacatattgtgcgaaaacggactcttcgacgcctattacaggaaagagaattggttgagccgctgacccccagcggggaggcccctaatcaggccttattaagaattctgaaagaaaccgagtttaagaagatcaaggtgttgggaagtggcgctttcgggacagtgtacaagggactctggattcccgagggtgagaaggttaagattcccgtcgctattaaggaactgagagaggcaaccagccctaaggccaataaggaaatcctggacgaagcatacgtcatggcatccgtggataatccacatgtctgccggctcctcggtatttgtcttacttctactgtgcagctgatcacccagctcatgccctttggttgtctgctggactatgtgagggagcacaaggataatatcggcagccagtacctactgaattggtgtgtacagatcgccaagggtatgaactatctcgaggataggcgccttgttcaccgcgatttggccgctcggaacgtgctggtgaaaacgcctcaacacgtgaaaattacagattttggccttgcaaagctgctgggggcagaggagaaagagtatcatgcagaggggggtaaggtcccgattaagtggatggcgctcgagtctattctgcacagaatttatacccaccagtcagacgtgtggagctacggggtgacggtctgggagctgatgactttcggcagtaagccatacgatggcatcccagcgtcagaaatttcctccattttggagaagggggagcgcctcccacaacccccaatctgtactatcgatgtatacatgattatggtcaagtgttggatgattgatgccgactctcgcccaaaatttcgggaactaatcatcgagtttagcaaaatggccagggacccacagcgctacctggtgatccaaggcgacgagcgcatgcatctgccttctccaactgattctaacttctaccgggcactgatggacgaggaggacatggatgacgtggtggatgcggacgagtatcttatccctcagcaagggtttttcagttcaccaagtacctctcggacccccctgctgtcttcactctctgctacctccaacaatagcaccgtcgcttgcatagaccgcaacgggctgcagtcttgccccatcaaagaggactcattcctgcagaggtactcaagcgacccaacgggagccctcacagaagattccatagatgacacctttttgccagtcccaggcgagtggctggtatggaagcagtcctgttcatctacctcctcaactcattccgctgccgcaagcctccagtgccccagccaggtgctaccacctgccagcccggaaggagaaacagtcgctgacctgcaaacacagtag

SEQ ID NO: 28469 - DNA, 1395 bp, Artificial Sequence
  Description of Artificial Sequence: Synthetic coding sequence
atgagttccctgacaaagattatttgcgctcagcagtgcagtggcagatgccgagggaagagtccttccgactgctgccacaatcagtgtgccgctggatgcaccggtccgagagaatctgattgcctcgtgtgcaggaagtttcgcgatgaggccacctgtaaggatacttgcccgccacttatgctttacaatcccactacttaccagatggatgtcaatccggaaggcaagtactccttcggggcaacatgcgtgaaaaaatgtccccgaaactacgttgtgacagaccacgggtcttgcgtgagagcatgtggagcagactcatacgagatggaggaagatggggtgcggaaatgtaagaaatgcgaagggccatgtcgaaaagtgtgcaatggcattgggattggtgagtttaaagattctctgtccatcaatgctacaaatataaaacacttcaaaaactgcacctcgataagtggggacctacacatcttgcctgtggccttcaggggagattcttttacacacacacctccactcgaccctcaggaattagacattctaaagactgtcaaggagattaccggattcctgctcattcaggcttggcctgagaacaggaccgacttgcacgccttcgagaatcttgaaatcatccggggacgaactaagcagcatggtcaatttagtctcgccgtggtgagcctgaacattacatccctgggcttgcggtccctaaaagagatatcagacggcgatgtgatcatctccggaaacaagaatctgtgctatgcgaacacaatcaattggaagaaactctttggcacgagcggacagaaaactaagatcatttccaaccgcggagaaaatagttgtaaagccaccgggcaggtgtgccatgcattatgctcaccagaaggttgttggggacccgagccgagagactgcgtctcgtgtaggaacgtgagcagaggccgtgagtgcgtggacaaatgtaatctattggagggtgagcccagagaattcgttgagaacagtgagtgcatacagtgccatccagagtgtctgcctcaagccatgaatattacttgtactgggagagggcctgataactgtatccagtgcgcccactacatagatggcccacactgcgtaaaaacctgtcccgctggtgtgatgggtgagaataacaccttagtgtggaagtatgccgacgcgggacatgtctgccatctgtgccaccccaattgcacctatggctgtactggccctggactggagggctgtccaacaaatggtcctaagattccctccattgcaaccggcatggtgggggctctgttactcctattggttgttgccctgggtatcggactattcatgagacgatag

SEQ ID NO: 28470 - DNA, 843 bp, Artificial Sequence
  Description of Artificial Sequence: Synthetic coding sequence
atgccggctgacatcatggaaaagaactcatcgagtccagtcgccgctacaccagccagcgtaaacactactcccgataagccaaaaaccgcctctgaacacagaaaaagcagtaaacctatcatggagaaacgaaggcgcgcacgaattaatgaaagtctgagccaattgaaaacattaattttagatgcactgaaaaaggactcctcccgacatagcaaacttgagaaggccgatattctggagatgactgtgaagcatcttagaaatctccagcgagcccagatgaccgccgctctctctaccgatccctcagtgttagggaagtatcgggcaggcttctccgagtgtatgaacgaagtcacaaggttcctgagcacatgcgagggagtcaacactgaggtgagaacccgcctcctgggtcatctggcaaattgcatgacacaaatcaacgctatgacatatcctggtcagccgcaccccgcactgcaggctcccccaccgccacctcctggcccaggagggccacagcatgccccatttgctcccccacctcccctagtgcctattcccggaggagccgcaccgccaccagggggagcgccatgcaaactgggctctcaggcaggtgaagcagcaaaggtattcgggggatttcaagttgtaccggctcctgacggccagttcgccttcctgattcctaatggagcttttgcccattccgggccagttattcccgtctatacatcaaactctgggaccagtgttggtcccaacgcagtgagtccgagttcagggccatctcttacagccgacagcatgtggcgaccatggcggaattag

SEQ ID NO: 28471 - DNA, 57 bp, Artificial Sequence
  Description of Artificial Sequence: Synthetic coding sequence
atggctgaaaacagcgtgctcacatccacaacagggcgtacaagcctggccgattag

SEQ ID NO: 28472 - DNA, 2745 bp, Artificial Sequence
  Description of Artificial Sequence: Synthetic coding sequence
atggccgagaattctgtgctgacctccacaacgggcagaaccagcctggccgatagttccatctttgacagcaaggtgaccgagattagcaaagagaatttattgatcggctcgacaagctacgtagaggaggagatgccacaaatcgagacccgtgtaatcctggtgcaggaggctggcaagcaagaagagttaatcaaagctctgaagactatcaagattatggaagtgcctgtgatcaaaattaaagaatcatgccctggcaagtcggatgaaaaactgatcaaatctgtcatcaatatggacatcaaggtgggctttgtcaagatggagtcagtcgaggagttcgaggggctagacagccccgagttcgaaaacgtatttgtagttacggacttccaggacagcgtcttcaatgatttgtacaaagcagattgcagagtcattgggccacccgtggtcctaaattgtagtcagaagggggagcctctcccattcagctgtcgcccactttattgtacctccatgatgaacctggtgttgtgttttaccggttttcgcaaaaaagaggagctagtgcgcctggtgacactggtgcatcacatgggcggagtcatacggaaagattttaacagcaaagtcacacacttagttgccaactgtacgcagggcgagaaattcagagtggcagtgtccttagggacccctattatgaagccggagtggatttataaggcttgggagcgacgaaacgagcaggacttctatgcagcggtggatgacttccggaacgaattcaaggttcctccttttcaggactgtatactgtcttttctgggatttagcgacgaggagaaaactaacatggaagagatgaccgagatgcaggggggaaagtacctgccactcggagatgagcggtgcacccatctggtagtggaagaaaacattgttaaggacctcccattcgagccctccaagaagctgtatgttgttaagcaggagtggttctgggggtcgattcagatggacgccagggccggtgagaccatgtacctgtacgagaaagctaacacgcccgaattgaagaaatccgttagtatgttgtccctaaacaccccaaactctaatagaaaaaggcgacgcctgaaagagaccctggcccaactgtcacgggagacagatgtctctccctttcctccacgtaagcggccatcagctgagcactctttgagcatcgggtccctgcttgacatttctaacacaccggagtcatccattaattacggcgacactcctaaatcatgcaccaagagttccaagtcttcaacaccagtgcctagtaaacagtccgcacggtggcaggttgccaaggaattgtatcaaaccgagtccaactacgtgaacatcctggccaccatcatccaattatttcaggtgccgcttgaggaggaaggacagcggggaggacctatcctggcacctgaagagataaagactatttttggcagtattcctgacattttcgacgtgcacacgaagattaaggacgacctcgaagatcttattgtgaactgggatgagagcaagtcaattggagacatcttcctcaagtactctaaagacctggtaaaaacttacccacccttcgtcaacttcttcgagatgtctaaagaaacgattataaagtgtgagaagcaaaagcctagatttcacgcgttcctaaaaataaaccaggctaagcccgagtgtgggaggcagtctctagttgaactcctgataaggcccgtgcaacggctgccgagcgtggccctcttactgaatgacctgaagaagcacacagccgacgaaaatccggataagtcaaccctggagaaggcaattgggtctctgaaggaggtcatgacacatatcaatgaggacaaacggaagacagaagcccagaagcagatatttgatgtggtttacgaagtggatgggtgcccagccaatctgttgtcgagccatcgcagtctcgtgcagagagtcgaaacaatatccctgggcgaacacccatgtgaccgcggagaacaagtgaccctcttcctgtttaacgactgcctggaaattgccaggaaaagacataaagtgattggaacctttcgcagcccgcatggccaaaccagaccccctgccagtctcaagcacattcacttaatgcccttgagccagatcaagaaagtcttggacattcgcgagaccgaggactgtcataacgcttttgcgctgctcgtcagaccacctactgagcaggctaatgttctactctcgttccagatgacctcggacgagcttcccaaggaaaactggcttaagatgctctgtcgtcatgtggccaataccatctgcaaagccgacgctgaaaacctcatctatactgcagatcccgaatcttttgaagtaaacaccaaggatatggattctacacttagtcgcgcttctagggccattaaaaagacaagcaagaaggtgactagggcattctctttttcaaagacacccaagcgagcgctgaggcgggctctcatgacgtctcatggaagcgtggagggaagaagccccagctccaacgacaagcacgtcatgtcccgcctgagttctaccagctccctggcgggaattcctagcccatccttggtctctctgccctcgttctttgaaagaaggtcccacactctgtctaggtctacgactcatctgatatag

SEQ ID NO: 28473 - DNA, 480 bp, Artificial Sequence
  Description of Artificial Sequence: Synthetic coding sequence
atggcggagaactcagttcttacatcaaccaccgggagaacaagtctggcagactcctcaatttttgattccaaggtcactgaaatctcaaaagaaaacttgttgataggcagcaccagctacgtggaggaagaaatgcctcagatcgagacccgcgtaattctcgtccaggaggctggcaagcaggaagagctgatcaaggcactgaaggacataaaggtgggctttgttaagatggagtccgtggaggaattcgagggtctggactcgcccgagttcgaaaacgtctttgtcgtgaccgacttccaggatagcgtcttcaacgatctctataaagctgattgtagagtgatcggtccacccgtcgtcctcaattgttctcagaaaggagaaccactcccgttcagctgtcgacctctatactgtacttcaatgatgaacttagtgttatgtttcactggatttaggaaaaaggagtag

SEQ ID NO: 28474 - DNA, 2649 bp, Artificial Sequence
  Description of Artificial Sequence: Synthetic coding sequence
atggcagagaactcagtgctgactagtaccacggggagaacctctctggcggactcatctatcttcgactcgaaggtaaccgagatcagcaaggaaaatctcttgatcggcagcacttcatacgtcgaagaaatgccccagattgagacgcgtgtgattctggtccaggaagcgggtaagcaggaggagcttataaaggcgctgaaagatatcaaggttggttttgttaaaatggaatccgtcgaagaatttgaggggcttgactcccctgaattcgagaatgtatttgttgtgaccgacttccaggatagtgtattcaacgatctgtacaaggcagattgccgtgtcattggaccccctgtcgtcctgaactgctctcagaagggggaacctctccccttcagctgtagacccctatactgcacaagcatgatgaatctcgtgctctgcttcactggattcagaaagaaagaggagttggtacgcttagtgaccttagtccatcatatgggcggtgtaatcagaaaagactttaactcaaaggtaactcatctggtcgcgaactgcacccagggagaaaagttccgtgtagctgttagtttaggaactcctatcatgaagccggagtggatttacaaagcgtgggaacgcagaaatgaacaggatttttatgctgcagtagacgattttaggaatgagttcaaggtcccgccattccaagattgtatcctttctttcctaggttttagcgacgaagagaagactaatatggaagagatgactgagatgcaggggggtaagtatctgcctcttggagatgagagatgcactcacctcgtcgtagaggagaatatcgtcaaggacctgccttttgaaccaagcaaaaagctttatgtcgtcaaacaagagtggttctggggttccattcagatggacgcgagggctggggaaacgatgtacctctatgaaaaagccaatacgcctgagctgaagaagagtgtctccatgctgagtctgaatacacccaacagcaaccgtaaacgacgtaggctgaaggaaacactcgctcagctcagtagggaaaccgacgtcagcccattcccaccacgaaaaaggcccagcgccgagcactctctgtccatcggttcattgttggacataagtaacacccctgaaagttccatcaattacggcgacaccccgaaaagctgcacaaaaagttcaaaatcatcaacccccgtgccctctaagcagagcgctcgctggcaggttgcaaaagagctgtaccagactgagagcaattatgtaaatatcctggccacgatcattcagctcttccaagtacccctggaggaggaggggcagaggggaggccctattctggcgccagaggagatcaagacaatattcgggtcaattcccgatatattcgacgtgcacactaaaatcaaggacgatctcgaagatctcattgtcaactgggacgaaagtaagagcatcggagacatcttcctgaagtactctaaggacctggtgaaaacctaccccccatttgtgaacttttttgagatgtctaaggagacaataataaaatgtgaaaagcaaaagcctaggttccacgcatttcttaagatcaaccaggcaaaacctgagtgcggacgccaaagcctcgtggagctacttatccggcctgtgcagcggcttccctctgtggccctgctgctgaacgacctgaaaaagcacaccgccgatgagaatccagataaatctacactggagaaggctatcggttctttaaaggaggttatgactcatataaatgaagacaaacgaaagaccgaggctcaaaagcagattttcgatgtggtctacgaggtcgatggttgccccgctaacctcctgtcatctcacaggagcctggtccaaagggtggaaacaatatcactgggggagcatccatgcgaccgcggagagcaagtaacactcttcctgttcaatgactgcctggagatagctcgcaagcggcacaaagtcattggaacgttccggagtccacatggtcaaactagaccaccggctagcctcaagcacattcatctcatgcccctgagccagattaagaaagtcctggatatacgcgaaacggaagattgccacaatgcatttgcattgcttgtccgtccccctaccgaacaggccaatgtgctgctctccttccaaatgacatccgacgagctgcctaaggagaattggctgaagatgctttgccgacacgtggccaacactatttgcaaagcggacgcagagaacttaatctatacagccgatccggagagctttgaggtaaacacaaaagatatggacagcaccttgtctagagcctctcgagccattaagaagacatcaaaaaaggtcacacgcgcatttagcttctctaagactccaaaaagggctctccgcagggcgcttatgacttctcacggatcagtggaggggcgatcccctagtagtaatgataagcacgtgatgtccagactcagctccactagttcactggccggaataccatccccctccctggtgtctcttccaagcttctttgagcgtcggtcccacaccctttccagaagcacaacacacctcatatag

SEQ ID NO: 28475 - DNA, 321 bp, Artificial Sequence
  Description of Artificial Sequence: Synthetic coding sequence
atggccgaaaactcagtgctgacatccaccacgggacgcactagcctggccgacagctccatcttcgattctaaggtgacagaaatctctaaggaaaatttactcatagggtctacatcctacgttgaggaggagatgccccagatagagactagagtgattttggtccaggaggccggaaagcaagaggagttgatcaaagcactgaaggatatcaaagtcggctttgttaaaatggaatcagtagaagaatttgaaggcctagacagtccagagttcgagaacgtgtttgtcgtgactgatttccaggattccgtgtag

SEQ ID NO: 28476 - DNA, 2784 bp, Artificial Sequence
  Description of Artificial Sequence: Synthetic coding sequence
atggccgaaaactccgtgctgacgagcactaccggaagaacctctcttgctgatagctccatcttcgacagtaaggtaactgagatttcgaaggagaatctgctgattggctcgacaagctacgtggaagaagaaatgccacaaatcgaaaccagggtcatactagtgcaggaagctgggaaacaagaagagctcatcaaggctctcaaagacatcaaggtcggcttcgtaaaaatggagtcagtagaggaatttgagggcctggactcccccgaattcgaaaatgtgttcgtggtgaccgactttcaggacagcgtgttcaatgatctgtacaaagccgactgtagggtcattggcccaccagttgtcctgaattgcagtcagaaaggggaacccttgcctttcagctgtcgcccactgtactgtacctctatgatgaatctcgtgctttgcttcacagggttccggaaaaaagaggagctggtccgccttgtgacactggtccaccacatgggaggagtgatccggaaggactttaactcgaaggtgacacatcttgtggcaaactgcacccaaggggagaaatttcgcgtcgcggtgtctcttggaacccctatcatgaagcctgaatggatttacaaagcatgggagcgtagaaatgaacaggatttctacgctgccgtggacgactttagaaacgagttcaaggtgccccctttccaggactgcattctgagctttctaggattctctgatgaagaaaagaccaacatggaggagatgactgagatgcagggagggaagtacctgcctttgggtgacgaaaggtgcacgcatctcgtggtcgaggagaacattgttaaggaccttccattcgagccatcaaagaagctgtacgtggtgaaacaggaatggttctgggggtccattcaaatggatgcacgtgccggtgagacaatgtatttgtatgaaaaagcaaatacgcccgaacttaagaagagcgtgtctatgctctctcttaacacccccaacagtaatcgtaagagacgccgtctgaaggagacattagcccagttaagccgggagaccgacgtatcccctttcccgccacgcaagcggccatccgctgaacattccctgagcataggaagcttgttggacattagcaatactcccgagagcagcataaattatggcgacactcctaaatcttgcacaaaatcatctaagtcttccacgccagtgccatccaaacagtcagcacggtggcaggtggccaaggagctttaccagacagagagtaactacgtgaacattcttgctacgataattcaactctttcaggtaccactggaagaggagggccagcgaggcggaccaattctggctccggaggagatcaagacgatctttggcagtatccctgacatctttgacgttcacactaagatcaaggacgacttagaggacctgatcgtgaattgggacgaatctaagtccattggcgacatattccttaaatactccaaggatcttgtcaaaacataccccccattcgttaacttctttgagatgagcaaggagaccatcatcaaatgcgaaaagcagaaacctaggtttcacgcgttcttgaagattaatcaagccaagcccgagtgtggcaggcagtccctcgtggagctgctaatacgcccagttcaacgccttccgtctgttgcacttttgttgaatgatttgaaaaagcacacagccgacgaaaacccagacaagtctacgctcgagaaagccatcgggtcattgaaggaggtcatgacacacatcaatgaggataagcggaagacagaggctcagaagcaaatctttgacgtggtttatgaggttgacgggtgtcctgctaacctgctcagtagccacaggagcctcgtccagcgggtcgaaactatatctctcggggaacatccctgcgatcgcggagagcaggttacactttttctgttcaatgattgtttggagattgcaaggaaacgtcacaaagtgattggtacattcagatccccacatggccaaacacggccacccgcaagcctgaaacacattcatctgatgccgctgtcacagatcaagaaagtcctcgacattcgtgagacagaagattgtcacaacgctttcgccctgctggtgaggcctcctaccgagcaggctaacgtcttactttccttccaaatgacatccgatgagttacctaaagaaaactggctgaaaatgctgtgcagacacgtggccaacacaatttgtaaagcagatgcggagaatctgatttacacggcggatcccgagtccttcgaggtaaatacgaaggacatggactcaaccctctcacgcgcttcccgcgcaatcaaaaagacctccaagaaagtcacgcgcgcattcagttttagtaagacacctaaaagggcacttcgtagggcattgatgacctcacacgggtcagtagagggcaggtccccaagctccaatgataagcatgtcatgtcaaggttaagctccacctcaagccttgcaatcactcactccgtgagcacctccaatgtgataggattcactaagcacgtgtacgttcagaggcttaactcaacgggtggcaggtcacaatactcgtggtttcagtccgtgcgacactcagcctttcgggcttctttttctgaaatcctcgagggtaacacagatttttcaaatttcaagaaggttctatccaagagctctctgacttttgttaaaaattag

SEQ ID NO: 28477 - DNA, 2652 bp, Artificial Sequence
  Description of Artificial Sequence: Synthetic coding sequence
atggccgagaattccgtgctcacttctaccaccggaagaacgagtttggctgattccagtatatttgattcaaaggtgaccgaaatatcaaaagagaacctgctgattggctccacctcatacgtagaggaggaaatgccccagatagagacccgtgtcatccttgtacaggaggcaggaaagcaggaagagttgatcaaagccctgaaggacattaaagtgggttttgtgaaaatggagagcgttgaagaatttgagggcctggacagtcctgaattcgagaatgtcttcgtggttacagactttcaggacagtgtgtttaatgatctctataaggccgattgccgcgttatcggccctcccgtggttttgaattgctcacagaaaggggaaccgctgcccttctcctgtcgacccctgtactgtacttcaatgatgaatttggtgctgtgtttcactggatttaggaagaaagaggagctagtgcgacttgtgaccctggttcatcatatgggcggagtgattagaaaagactttaattctaaggtgactcacctggtcgccaattgcactcaaggagagaaatttcgggttgccgtcagcctgggtactccgataatgaaacctgagtggatttataaagcgtgggagagaagaaacgaacaggacttttacgccgcagtggatgatttcaggaacgagtttaaagttccaccttttcaggactgcatattaagcttcctgggatttagtgatgaggagaagactaatatggaagagatgaccgagatgcagggtggcaaatacctgccgctcggcgacgagaggtgcacgcacctcgtcgtggaggaaaacatagtgaaagaccttccgtttgaaccaagtaagaaactgtacgtagtcaaacaagagtggttttgggggagcatccagatggatgccagagctggcgagaccatgtatttgtatgagaaggccaatacaccggagctgaagaaatcggtgagcatgctgagcctgaacacgcctaactctaatcggaaaagaaggcgattgaaggagactcttgcacaactgtctcgggagaccgacgtgagcccctttcctccccgtaaacgcccatccgccgagcattcactgtcaatcggtagtctgctggacatcagcaacacacccgaatcatccatcaactatggggataccccaaagtcttgcacaaagagctcaaagtctagcacacccgtgcccagtaaacagagtgcacggtggcaggtggcgaaggaactgtaccagaccgagtcaaattacgtgaatattctggcgaccattatccagctgttccaggtccccctagaagaggagggccagagaggaggacccatcctcgcaccggaggaaatcaagaccatctttggaagtatccccgatatttttgatgtgcacacaaagatcaaggacgatctcgaagacctcatagttaactgggacgaatctaaaagcattggcgatatttttcttaagtactctaaagacctggttaaaacatacccccctttcgtcaacttctttgaaatgtcaaaagagaccattattaaatgcgagaaacaaaaacccaggttccacgcgttcctcaaaataaaccaggcaaaacctgagtgtggtcgccaaagtcttgtcgaattgctgatccggcctgtgcagagactgccttctgtagctctcctgctgaatgacctgaaaaagcacactgcagacgagaatcctgacaagagtaccctggaaaaagccattggatcccttaaggaagtgatgacccacatcaatgaagacaagcggaagacggaggcccagaagcagattttcgacgtcgtgtacgaggtggatggatgtcccgctaacctcctgtctagccaccgttccctcgtgcagagggtggaaactattagtctcggggagcacccatgcgaccggggtgagcaggtcaccctgttcctgttcaacgactgccttgaaattgcgaggaagagacacaaggttatcggaaccttcaggtcccctcacgggcagacgagaccacccgctagcctgaagcacatacacttgatgccgctatcccaaatcaaaaaggtgctggatataagggaaaccgaggactgccataatgcttttgccctcttagtgcgacctccaacagagcaggccaatgtgctgctcagcttccagatgacgagtgatgaactacctaaggaaaattggctgaagatgctgtgccgacacgtggccaacaccatctgcaaggctgatgctgagaatttgatatacacagctgatccagagtcatttgaagtgaatacaaaagatatggactctaccttgagcagagcatcccgcgctatcaagaaaacgtccaaaaaagtgaccagggctttctccttctcaaaaaccccgaaaagggctctaaggagggcgctgatgacttctcatggatccgtggagggacgcagccccagctctaatgataagcacgttatgtcccgtctcagcagtacttcctcacttgccggaataccctcgcctagtcttgtgtctctcccaagcttcttcgaaagaaggagccacaccctgagcaggtccaccacccacctcatctag

SEQ ID NO: 28478 - DNA, 2745 bp, Artificial Sequence
  Description of Artificial Sequence: Synthetic coding sequence
atggccgagaatagcgttctgacctctaccaccgggcgaaccagcctcgctgacagcagcatctttgactcaaaagtcacagaaatcagcaaggaaaacctgttaattggaagcacatcatatgtagaagaggagatgccccagattgagacgcgagtgatcctggtgcaagaagccggaaaacaggaggagctgattaaggcgcttaagaccattaagattatggaggtccccgtcattaaaattaaggaaagttgtcctggcaaaagtgatgagaagctcatcaaaagcgttataaatatggatattaaggtggggttcgtaaaaatggagagtgttgaagagtttgagggattagactctcccgaatttgagaacgtgttcgtggtgaccgattttcaggattccgtgttcaacgatctgtacaaagcggactgtagagtgatcggcccaccagtggtactgaactgcagccagaaaggagagccactgccattttcatgccgacctctctattgtacctccatgatgaatctggtgttatgtttcacaggttttcggaaaaaggaggaactcgtaagactggtaaccttggtacaccacatggggggagtaatcagaaaggactttaattctaaagttacacaccttgtggcaaattgcacacagggcgaaaaatttcgcgtcgctgtcagtctgggaactccaattatgaagccagaatggatctataaagcatgggagcgcaggaatgagcaggatttttacgctgccgtggacgactttaggaatgagttcaaagtgccacccttccaagactgtattctgtcgtttctgggattttctgacgaggaaaagacaaatatggaggagatgacagagatgcagggagggaaatatctccccctgggagatgagcggtgcacgcatctggtcgtcgaggaaaacatcgtgaaagatctgcccttcgagccaagtaagaaactttatgtagtgaaacaagagtggttttgggggagtatacagatggacgccagagccggagagactatgtatctgtacgagaaggcaaatacgcccgagttaaagaaaagtgtgagcatgctatctctgaacacaccaaacagcaacaggaagcggcgtagattaaaggagaccctggctcagctgtcaagagagactgatgtgtcaccctttcctcccagaaagcgtccgagcgccgaacattccctctcaataggatcgctgctcgatattagtaatacccctgaaagcagtatcaactacggcgatacgcctaaatcatgtacaaagtccagcaagtcatcgacccccgttccgtccaagcagtcagctaggtggcaggttgccaaggagctgtaccagaccgagagcaactatgtgaatatacttgctaccattattcagctgttccaggtccctctagaagaagagggccagcgcggaggacccatcctcgccccagaggaaataaaaacaatcttcggctcgatccccgatatcttcgatgtgcataccaagatcaaggacgacctagaggacctaatagtcaactgggacgagagcaagagtatcggcgatattttcctcaagtactcgaaggacctggtgaaaacgtaccccccttttgttaatttcttcgaaatgagtaaggaaacaattattaagtgtgagaagcagaaaccgaggtttcatgcctttcttaaaataaatcaagccaagcctgagtgcggaaggcagagcctggtggagcttctgatcagacctgttcaacgattgcccagcgtggctttgctgctcaacgacttgaagaagcataccgcggatgagaatccagacaagtccacactggagaaagccatcgggagtcttaaggaagtcatgacccacatcaatgaagataaacgaaaaacggaagctcaaaaacaaatcttcgatgtggtctatgaggtggatgggtgcccggctaacttgctgagcagtcatagaagcctggttcaacgcgttgagacaatctcccttggagagcatccctgcgatagaggcgaacaggtaacactattcctcttcaacgattgccttgagattgctaggaagcggcataaggtgatcggaacttttcggtctccacacggtcagacccggccaccggcaagcctgaagcacattcacctgatgccattatcacagattaaaaaagtgttagacattagagaaacagaagactgtcacaacgcattcgctctcctggtccgtccacctactgagcaggccaacgttttactctcgtttcagatgacaagcgacgagcttccaaaagagaactggttaaagatgctctgccgtcacgttgccaacacaatctgcaaggctgacgccgaaaatctgatatacacagccgatcccgaatctttcgaagtaaacacaaaggacatggatagcaccctctcacgggcttcgagagccatcaaaaagaccagcaagaaagtcacgcgcgcattctctttctcaaagacccccaaaagggccctgcgtcgagctctaatgacatcccacggttctgtcgaaggcagatcaccctctagtaatgacaaacatgtgatgtctcgcctcagctctacctcaagtcttgccggaattccctcaccatccctcgtttctctgccaagtttctttgaacgccgtagccacactttgagccgctccaccacccacctaatctag

SEQ ID NO: 28479 - DNA, 1389 bp, Artificial Sequence
  Description of Artificial Sequence: Synthetic coding sequence
atgtcgatagctggtgtggctgcccaggagattcgagtgcccctaaagaccgggttcctccataacgggagagccatgggcaacatgagaaaaacgtactggtcctccaggtcagagtttaagaataatttcctcaacatcgacccaatcaccatggcatattctctaaacagtagtgcccaggaacgcctcatccctttgggccatgcttcgaaatctgcgcctatgaatggacactgctttgcagaaaatggtccttctcaaaagtcgagtttgccacctcttctcattcctccttccgagaacctgggtccgcacgaggaggatcaagtcgtttgtggctttaaaaaactaacagtcaatggggtctgtgctagcacacccccactgactccgataaagaattctcctagtctgttcccctgcgcaccactctgcgaacgagggagtagacctctcccccctttgccgattagcgaggctctgtctctcgatgatacagactgcgaagtcgagttcttgaccagcagtgacacagattttctcctcgaagactctacactgtctgacttcaaatacgacgtccctgggagaagatcctttagaggatgcggacagattaactatgcttactttgacacccccgctgtatccgccgctgatctttcatacgtctccgatcaaaacggaggtgtgcctgaccctaatcccccaccgcctcagactcacagaaggctgcgacgatctcacagtggcccagcaggctcctttaataagcctgcaatcagaatatccaactgctgcatacaccgggcaagtccaaacagtgacgaagacaaacctgaggtcccgcctcgcgttcctatacctcccaggccagtgaaacccgattacagaaggtggagcgcagaggtgaccagctcaacctactcggacgaagacaggccaccaaaagtgcccccaagggagcctttaagcccttctaactcacgcaccccatccccaaagtcgttgcccagttaccttaatggagtgatgcccccaactcagagtttcgcgccagatccaaagtacgtcagcagcaaggcactgcaacgccagaactctgaaggtagtgccagtaaagttccatgtatacttcccataattgagaacggaaagaaagttagttccacccattactatctcctccccgaacggccaccctacctcgacaaatacgagaagtttttccgcgaagctgaggagactaatgggggtgcccagatccagccattacctgccgactgcggcatttcatcagcaacagagaaacccgatagcaaaacaaaaatggatctggggggacatgtgaagcggaagcacctgagttatgttgtaagcccctag

SEQ ID NO: 28480 - DNA, 1713 bp, Artificial Sequence
  Description of Artificial Sequence: Synthetic coding sequence
atggcccttaagaaatccagtccgtccctagatagtggtgattccgactccgaagaactgcccacgtttgcattcctcaaaaaggaaccaagttcaacgaagcggcgtcagccagaaagagaagagaaaatcgttgtcgtggacataagtgattgcgaagctagctgtccacccgctcctgagttgttttctcccccagtacccgagatcgctgagaccgtaactcaaacccagccagtgaggctgctgtccagcgaatccgaggatgaagaggagttcatccctctggcacaaaggctaacctgtaagtttctgacccataagcaactgtcccctgaagattcgtcctcgcccgtaaagagcgtcctggaccatcagaacaacgagggagccagttgcgactggaaaaaaccctttcccaaaattccagaagtgccactacacgacactccggaacgctccgctgctgacaataaggacctgatcctggatccgtgctgccagctcccggcatatctgtcaacttgtccagggcagagctccagcctggccgtcactaagaccaattccgatattctgcccccacagaagaaaacgaagccatctcagaaggtgcaaggaagagggtcccacggatgccggcagcagcggcaggcgagacagaaagagtcgactcttcgcaggcaggaacggaagaatgcagcgttggtgacaagaatgaaggcccaaagaccggaggagtgtttgaaacatatcatagtggtactggatccagtgctcctgcagatggagggaggcggacagttgctcggggctctgcagacaatggagtgcaggtgcgtgattgaggcacaggctgttccttgcagcgtcacctggcgtaggagggcgggtccttccgaagaccgcgaagattgggtcgaagaaccaacagttctggtcctactgagggcggaggctttcgtctccatgattgacaacgggaagcaggggtccttagacagtaccatgaagggaaaagagaccttgcagggcttcgtgacagatattaccgccaagaccgccggaaaagccctgtcacttgtgatcgttgaccaggaaaaatgctttagcgcccagaaccctccgcgtcggggtaaacagggggctaataagcagaccaaaaaacagcagcagagacaaccggaagcaagcatagggtctatggtgtctagagtggacgcagaggaggctcttgtcgacctgcagctccatactgaggcccaagcacagatagttcagtcttggaaagagcttgccgacttcacatgcgccttcaccaaagcagttgcagaagctcccttcaagaagctccgggatgagaccactttctcattctgtctggaaagtgattgggctggcggagttaaagtcgatctggctggcaggggcttggcactggtttggaggcggcagattcaacagctgaaccgagtctctctggaaatggctagcgctgtggtcaacgcctatccctccccgcaactgctggtccaggcctatcaacagtgcttcagcgataaagagagacagaatctgctggccgatattcaggtgaggcgcggtgaaggtgtgaccagtacatcaagacgtatcggaccagagctgagtagacgcatttatctgcagatgaccacactccagccacacctttcccttgattctgccgactag

SEQ ID NO: 28481 - DNA, 1752 bp, Artificial Sequence
  Description of Artificial Sequence: Synthetic coding sequence
atggccctgaagaaatcatcaccgtcactggacagtggcgactctgactctgaagaactgccaacttttgcgtttctcaaaaaggagccttcctcaacgaagcggagacagccagagagagaagaaaaaattgtcgtagtggacattagcgactgcgaagcttcatgcccaccagctccagaactgttttctccacccgtccccgagatcgcggaaacagtgacccagacacagcctgttcggctgcttagctccgagtccgaggacgaggaagaattcattccacttgctcagaggcttacctgtaagttcctaacccataagcagcttagtcctgaagatagttcttcaccggttaagagcgtgttggaccaccagaacaacgagggtgcctcttgtgattggaaaaaaccttttcctaagattccggaggttcctttgcacgatacacccgagcgctccgccgctgataacaaagacctgatactcgacccctgttgtcagctccccgcttaccttagcacgtgtcctggccagtccagctccctggctgtgacaaagaccaactccgatatcctgcctccccagaaaaaaacgaagccctcgcagaaggttcagggacgtgggtcgcacggctgtaggcagcagagacaggcccgacagaaagagtccaccctgcgtcgacaggagaggaagaatgcagcgctggtgacaaggatgaaagcacagcgcccagaggaatgtctgaaacatattatagttgtcctggatcccgtgcttcttcagatggagggagggggacagctgttaggcgctttgcagacaatggagtgtcgctgcgtgatcgaggcacaggccgtgccgtgcagcgtgacttggcgcaggagagcaggtcctagtgaggaccgcgaggattgggtggaggaacctacagtacttgtcctcctacgcgcagaggctttcgtgtcaatgattgataatggcaagcagggttccctggatagcaccatgaagggcaaagaaactcttcaggggtttgtgacagacatcacagccaaaacagctgggaaagcactttccctcgtgatcgtggaccaagaaaagtgcttttcactggaactgctgttcttcgacttcctgccctgtacctccgcacagaatccacctcggagagggaaacagggcgcaaataagcaaactaagaagcagcagcagcggcagccggaagcttccatcggcagcatggttagtcgagtcgacgcagaggaggcccttgtggatctgcaactgcacacagaggctcaggcacagattgtgcagagctggaaagaactggctgattttacctgtgcattcacgaaagccgtggcagaggcccctttcaaaaagctccgagatgagaccacgttttcattctgcttagagtctgactgggccggtggcgtcaaggtggacctcgcgggaaggggacttgccctagtgtggaggagacagattcagcaactgaacagggtctcactcgaaatggcatccgcggtggtgaatgcttacccctccccccagctattagtgcaagcttaccagcagtgcttctctgacaaggaacgacaaaatctgctcgctgacatccaggttaggaggggcgagggagtaactagtacatctaggcgaatcggtcctgagctctcacggcgtatatatcttcagatgactaccctccaaccccacttgagcctggattccgcagattag

SEQ ID NO: 28482 - DNA, 1752 bp, Artificial Sequence
  Description of Artificial Sequence: Synthetic coding sequence
atggccttgaagaaatcttcccccagcctggactccggcgacagcgactccgaggagctcccgactttcgcgttccttaagaaggaaccgtcaagtaccaagcgacggcagcctgaaagggaggagaaaatcgtggtggttgatatttccgactgtgaggcttcttgtccacctgcccctgagcttttcagcccgcctgtcccagagatcgccgagaccgtaacacagacccagccagtgagactactgagtagtgagtccgaagatgaggaagagtttataccactggctcagcggctcacctgcaaatttctgactcacaagcaactgtctccagaggactcatcctcgcccgtcaagagcgtgctagaccaccaaaacaacgaaggcgcatcatgcgactggaaaaagccatttccgaagattcccgaggtcccgctgcacgacaccccagagcggtcggctgctgacaacaaagatctgatactagacccctgttgtcagcttccggcttaccttagcacctgtcccggacaatccagctctctggccgtcactaaaactaatagcgacatcctaccccctcaaaagaagacgaaaccgagtcagaaagtccagggccgaggtagccacggatgtcgccagcaacgccaggctaggcagaaggagagcacacttaggcgtcaggagaggaagaacgccgctctagtcactagaatgaaagcccagcggcctgaggagtgcctgaaacacatcatcgtggtgttggaccccgttctactgcagatggaaggcggaggccagctgttaggagccttgcaaaccatggaatgccggtgtgtaatcgaagctcaggctgtgccctgctcagtaacttggagaaggcgggctggtccatctgaggatcgcgaggactgggttgaggagcccacagtgttggttttattgcgcgcagaggccttcgtcagcatgatcgataacggcaagcagggttctctggacagcactatgaagggcaaggagacgctgcagggctttgtcacagacatcactgccaagactgccggtaaagccttgtctcttgttattgtggatcaggagaagtgtttttccttggagctcctgttcttcgacttccttccatgcaccagtgctcaaaaccctccaaggcgaggtaaacagggggcaaacaagcagaccaaaaagcagcaacaaagacagccggaagcaagtattggcagtatggtgtcccgtgttgacgccgaggaagctctcgtggatctgcagctgcataccgaagcgcaggcacagatcgttcaatcgtggaaggagcttgcggatttcacttgcgcatttactaaggccgtcgctgaggccccattcaaaaagctgcgggatgagacaaccttcagtttttgcttagagtctgattgggcaggcggtgttaaagtggacctggccggaaggggtctcgccctggtctggcggagacagattcaacagttaaaccgagttagtttggagatggcctccgccgttgtgaatgcttatcctagtccccagctgctggttcaggcttatcaacagtgtttttctgacaaggagaggcaaaatctgctggctgacatccaagtgcggagaggggagggagtgacgtctaccagtcgcagaattggaccagaattgagcagacgtatctaccttcagatgactacgctgcagccccatttgagtttagattctgcagattag

SEQ ID NO: 28483 - DNA, 684 bp, Artificial Sequence
  Description of Artificial Sequence: Synthetic coding sequence
atggccgatcttttgggctcgatcctgtccagcatggagaaaccacctagcctcggcgatcaagagacccgcagaaaggcacgggaacaagccgctagactaaagaaattgcaagagcaagaaaaacagcagaaggtggaattccgaaagcgtatggagaaggaggtttccgacttcatacaagattcaggacagatcaaaaaaaagtttcagccaatgaataagatagagcgatccatccttcacgacgtggtggaagtggcaggtcttaccagttttagtttcggagaggatgatgactgtaggtacgtgatgatcttcaagaaagaattcgctcctagtgacgaggagttagactcttaccgcagaggggaagaatgggatccacagaaagctgaggagaaacgcaagctgaaagagctggcccagaggcaagaagaagaggcggctcagcaaggccctgtcgtggtgtctcccgcatcagactataaagataagtactcccatctgattggcaagggcgcagctaaggacgccgctcatatgcttcaggccaacaaaacctatggctgcgtcccggtggcgaacaaaagagacacaaggagtatcgaagaggcaatgaacgaaattagggctaagaaacgcctgagacagagtggcgaggaactgcccccaacaagctag

SEQ ID NO: 28484 - DNA, 1788 bp, Artificial Sequence
  Description of Artificial Sequence: Synthetic coding sequence
atgacaatgactttacatacgaaggcatcaggcatggcgctgctgcaccagatccagggcaacgagttggaaccgttgaatcgacctcagttgaaaatccctctggagcggccattaggcgaggtgtatctggacagttctaaaccggcagtttataattatccagagggagctgcatacgaattcaacgctgcagccgctgctaacgcccaggtgtacggccagaccggactcccttacgggccaggctcagaggccgctgcgtttgggtccaatggtctaggagggtttcccccactcaacagcgtaagtccctccccactgatgttactccatcctcctccccagctctctccttttctgcagccccatggtcagcaagtgccatattacttagagaacgaacccagcgggtataccgtgcgcgaggccggtccccctgcattctacaggcctaatagcgacaaccggaggcagggcggacgtgaaagactcgcctctacaaacgacaagggctccatggctatggagagtgctaaggagacacgttattgcgccgtctgcaacgactacgctagtgggtaccattacggggtgtggtcctgtgaaggatgtaaggcgttttttaaaagatccattcagggccacaatgactatatgtgcccggcaaccaatcaatgtaccatcgataagaatagaaggaaatcgtgccaagcatgtcgccttagaaagtgttatgaggttggaatgatgaagggcggtattcggaaggaccggagaggtggcaggatgcttaaacacaagcgtcagagggacgacggagaaggtaggggagaggtgggctcagcaggggacatgagggccgctaatctctggccaagccccctcatgattaagcggtcaaaaaaaaactcactggcgctctccttaacagcagatcagatggttagtgcattactggacgcagagcctcctatcctctatagcgagtacgatccaaccaggcctttcagtgaggcgtccatgatgggcctgctgactaatctagctgacagggagctagtgcacatgattaattgggctaagcgcgtgcccggttttgtggacttaacattacatgaccaggtgcatctcctcgagtgcgcctggctcgagatcctcatgattggactggtctggcggagcatggagcaccctgggaaattgctgtttgctccaaacttacttctcgaccggaaccaggggaaatgcgtggaaggcatggtcgagatcttcgatatgcttttagccaccagttctaggttcagaatgatgaacttgcagggtgaggagtttgtgtgtctgaagagtattatccttctgaactctggtgtgtacacctttttgtcctcaaccctgaagtcactcgaggaaaaggaccacattcatcgagttctggacaagataaccgatactttgatccatttgatggcgaaggcaggcctaaccctgcaacagcaacaccagagactcgcccagttgttgcttatcctatcacatatcagacatatgagtaacaaagggatggaacatctctactcgatgaaatgcaagaatgtggtacctctgtacgatctcttactggaaatgttagacgcccatcgcctgcatgcgccaacctctcggggtggggctagtgtggaagaaaccgatcagagtcacttagcaacagccggttcaaccagttcacatagcttgcagaaatactacatcactggcgaggctgagggatttccggcaacagtgtag

SEQ ID NO: 28485 - DNA, 549 bp, Artificial Sequence
  Description of Artificial Sequence: Synthetic coding sequence
atggagtccgctaaagagactcgatactgtgcagtttgcaacgactacgcttccggctaccattacggtgtctggtcttgcgaaggttgcaaagcttttttcaaacgcagcatacagggacacaatgattacatgtgccctgccaccaaccagtgtactatcgacaaaaacaggcgaaagagctgccaagcctgcaggctgagaaagtgttatgaggtgggaatgatgaaaggaggaattcgcaaagatagacgaggcggtcgcatgctcaagcacaagttacttctgattctgtcccacataaggcacatgagtaacaaaggcatggaacacctctactcaatgaaatgtaagaacgtggtcccactatacgatctattacttgagatgctcgatgcacaccgactacacgccccaacatcgcgaggtggggcatctgtcgaagaaaccgaccagtctcatctggccaccgcagggtcgactagttcccactctctgcagaaatactacattactggggaggccgaagggttccctgcgaccgtgtag

SEQ ID NO: 28486 - DNA, 255 bp, Artificial Sequence
  Description of Artificial Sequence: Synthetic coding sequence
atgacaatgacattgcacacgaaagcctcaggtatggctctgcttcaccagatacagggcaacgaactcgaacccctgaacagacctcagctgaaaatccctctggagcggccactgggagaggtgtacctggattctagcaagccagccgtttataactaccccgaaggggctgcctacgagttcaatgcggctgcagccgctaatgcccaagtgtacgggcagacagggctgccgtatgggccaggctcgtag

SEQ ID NO: 28487 - DNA, 1005 bp, Artificial Sequence
  Description of Artificial Sequence: Synthetic coding sequence
atgactatgaccctgcacactaaagcctccggcatggcgctcctgcaccagatccagggcaatgagcttgaacctctcaacagaccgcagctgaaaattcctctggaaagacctttaggggaagtctacctggattcgagcaaaccggctgtttacaactaccccgagggcgcagcttacgagtttaatgccgctgcggctgccaacgcacaggtatacgggcagacagggttgccctatggacccggatcggaagcagcggcattcgggagcaacggcttgggcggtttcccccctctcaatagtgtgtctcccagccccttgatgttattacacccacccccacagttaagccctttcctgcagccacacggacagcaggtgccttactacctggagaacgagcctagcggatatacagttcgagaagcgggaccccctgcattttaccggaaccaggggaaatgcgtcgagggaatggtggaaatcttcgacatgctgcttgcgacctcttcccgattcagaatgatgaacttgcagggcgaagagtttgtgtgtctgaagtctatcatcctactcaattccggtgtgtacaccttcttgtcttctactcttaagtctctggaagaaaaagaccatattcacagggtgttggacaaaattacagacacactcattcacttgatggctaaggccggactcaccctccaacaacagcaccagcggttggcccagttgcttctgatactctctcatatcagacatatgagcaataaaggaatggaacacctttactctatgaaatgcaaaaatgtggtgccactgtatgacctgctactcgagatgctagatgcacaccgtctccatgccccaacatcgcgcggaggcgcaagcgtggaagaaaccgaccaatcgcatctagcgacggctggtagtaccagctcccactctctgcaaaagtattacatcacaggcgaagctgagggtttccccgctactgtgtag

SEQ ID NO: 28488 - DNA, 324 bp, Artificial Sequence
  Description of Artificial Sequence: Synthetic coding sequence
cacaacgactacatgtgcccagcgaccaaccagtgtaccatcgataaaaaccgtcgcaagtcctgtcaggcatgccgcttgagaaaatgttacgaggtcgggatgatgaaggggggatttgttgatctcactctgcacgaccaggtccacttgcttgagtgcgcgtggttggagatccttatgataggtcttgtctggaggagcatggagcaccccggaaagctcttgtttgcgccaaatctcctgctggacagaaaccaaggtaaatgcgtagagggaatggtggagatttttgacatgctcctggccaccagtagccgctag

SEQ ID NO: 28489 - DNA, 1167 bp, Artificial Sequence
  Description of Artificial Sequence: Synthetic coding sequence
tgactgaagattatttcatgccaaccatccgacaaaccagtgccccctggagagaatgcccctgaatggcgcgcaggccagcctggcagcgctcctcgtagtcactgcggcagatcggcagccggacctggccaccgtcgtccactgtgtgattttaacggcgagggacctaattccgacaaccgacgccagggtggtcgcgagcgcctggcttctacgaacgacaaaggaagcatggcaatggagtctgcgaaagagactcggtactgtgccgtgtgcaatgactatgcatcaggttaccactacggggtctggtcctgcgaggggtgtaaggctttttttaagaggtcgatccagggccataacgattatatgtgtcccgctaccaatcagtgtactatcgacaaaaatagacgaaagtcatgccaggcttgtcgtctgcggaagtgctacgaagtgggcatgatgaaaggcggaatccgcaaagaccgccgtggtggccgtatgctaaagcataaaaggcagagggatgacggggagggcaggggggaggtgggctccgccggagatatgagggcggcaaacttgtggcccagtcccctgatgatcaagcggtctaaaaagaattctcttgcattgtctctaacagccgatcagatggttagtgctctgctcgatgcggagccgccaatcctgtacagtgagtatgaccccacgcgacccttctccgaggcttccatgatgggcttgctgacaaacttggccgatcgcgagctggtgcatatgatcaattgggccaagagggtgcctggctttgtggatcttacactccacgatcaagtccatctcctcgagtgcgcctggcttgagatcctgatgatcgggctcgtctggcgatcaatggagcaccccggaaagctgctgttcgcacctaacctgcttttggaccggaatcaggggaaatgtgtagagggcatggtcgaaattttcgatatgctgcttgcgacctcgtctcgcttccgaatgatgaatttacagggggaggagttcgtgtgcctgaaaagcattattctactgaacagcggaatatctcacgtagaggccaaaaaacggattctgaacctccatccaaaaatcttcggtaacaaatggtttcctcgagtgtag

SEQ ID NO: 28490 - DNA, 813 bp, Artificial Sequence
  Description of Artificial Sequence: Synthetic coding sequence
atgtgccccgctacaaaccagtgtactattgacaagaaccgacggaagtcatgccaggcatgtcggttgcgcaagtgctacgaagtcgggatgatgaaggggggaatacgtaaagaccggaggggtgggcgaatgctgaaacacaaacgtcagcgggatgatggagagggacggggtgaagtcgggagtgcgggagacatgagagccgctaacttatggccatcacccctcatgattaaacgttccaagaagaatagcctcgctctgagcctaactgccgatcaaatggttagcgccctgttggacgctgagcctccgattttgtacagcgagtacgatcccacacgtcctttcagcgaagcgtctatgatgggcctactgacaaacctggcggacagggagctggtgcacatgatcaattgggccaagcgggtacccggattcgtcgacttaactttacacgaccaggtccatcttctcgaatgtgcgtggctggagatcctgatgatcggcctggtctggaggtctatggagcatcccggaaagctcctttttgcgcctaatttactgctggactctaacaagggaatggaacacctttattcgatgaagtgcaagaacgtggttccactgtatgatttgttgctcgaaatgttagacgcgcaccgattacacgcacccacctcccgtggaggcgctagcgtggaggagacagaccaatcccatctagcaactgccggttccacgagttctcattcccttcagaaatattacatcacaggcgaagctgagggctttccagcaactgtgtag

SEQ ID NO: 28491 - DNA, 1572 bp, Artificial Sequence
  Description of Artificial Sequence: Synthetic coding sequence
atgactatgactctgcatactaaggcgtctggcatggcactactccatcaaatccaggggaatgaacttgagccccctccactaaattctgtaagtcccagccccctgatgttgctgcatccacctccacagctgagtcccttcctccagccccacgggcagcaggtcccctattatctggagaatgaacctagtggatacactgtccgtgaagcaggccctcccgctttttatcggccaaattctgacaacaggcgccaaggcggtagggagcgtctcgcatccacgaatgacaaggggtccatggctatggaatcagccaaagagacgaggtattgcgctgtgtgcaatgattatgctagtggataccattacggtgtgtggtcgtgcgaaggatgcaaggcattttttaagagatctatccaggggcacaatgattacatgtgccctgcaaccaaccagtgtactattgataaaaatagacgcaaaagttgccaggcctgcaggctacgcaagtgttacgaggtggggatgatgaagggaggcatccgtaaagatcgcagaggtggtcgtatgttgaagcacaagcgccagcgggacgacggcgaagggaggggggaagtgggttccgccggagatatgcgcgcagctaacttgtggccttcacctcttatgattaaacgctccaagaagaattcactcgctctctcacttacggcggaccagatggtcagcgcactcctagacgcagagccaccgattctttactccgaatacgacccaacgcggccatttagcgaggcttctatgatgggcctcctgacaaacctggccgatagggaactggtacacatgatcaactgggccaaaagagtgccaggcttcgtcgaccttaccttgcatgaccaggtccaccttctggaatgcgcctggttagaaatactgatgatcggtttagtgtggaggtccatggagcatcccggaaaactcctgttcgcacccaacctcctgcttgaccgaaaccagggtaagtgcgtggaaggcatggttgagatctttgacatgctgctggccacgagcagccgattcaggatgatgaatctccagggcgaagaattcgtgtgtctcaaaagcattattctgctcaactccggcgtatacaccttcctgtcttccacattgaagtcattagaggagaaggatcacattcacagagttttagataagattacagataccctgatccacttgatggccaaggcaggactgaccctgcagcagcaacaccagagactcgctcagttattgttaattctgagccacatccggcatatgagcaacaagggcatggaacatctttactcaatgaaatgcaaaaatgtagtcccactgtacgatcttcttctagagatgttggacgcacaccgactgcacgccccaaccagcagagggggagcctccgttgaagagaccgaccagtctcacttagctacggccggttcaacaagttcacattctttacagaaatactacataaccggggaggcggagggtttcccagccacggtgtag

SEQ ID NO: 28492 - DNA, 1788 bp, Artificial Sequence
  Description of Artificial Sequence: Synthetic coding sequence
atgacaatgacgttacacaccaaagccagtgggatggccctgctgcatcaaatccaggggaacgagctggagcctctgaacagaccacaactgaaaatcccactcgagcggccactgggcgaagtctacctggattctagtaagcctgcagtttacaattaccctgagggagcagcatacgagttcaatgccgcagctgcagctaatgctcaggtttacgggcagaccggtctcccctacggcccagggtccgaagcagcggctttcggcagtaacggcctcggaggattccccccactgaacagtgttagcccctcacccctgatgctgttgcaccctcctccccagctgagccctttcctgcaaccgcatgggcagcaggtaccttattatctggagaacgagccctccgggtacacggtccgcgaggctggaccaccggcattttacagaccaaattcggataaccgccgtcagggtgggagagagaggctggcctctacaaacgacaaaggcagcatggctatggagtccgctaaagaaacacgttattgtgccgtttgcaacgattatgcctctggctaccattacggagtgtggagttgtgagggctgcaaggcctttttcaagcggtccatccaaggtcacaatgattatatgtgcccagcgacaaatcaatgtaccattgacaaaaaccgtcgaaaatcatgccaggcttgtcggctgcgtaagtgctacgaggtgggcatgatgaagggcggaatccggaaagacaggaggggaggaaggatgctgaagcacaagaggcaacgcgatgacggagaagggagaggcgaagtcggctcagcgggagatatgcgggcagccaacctgtggccaagtcccctcatgatcaaaaggtccaagaagaattcacttgctcttagcctgacagctgaccagatggtctctgctctgcttgatgctgagcctcccattctgtactctgagtacgatcccacgcgtcccttcagtgaggcttctatgatggggctgttaaccaacctggccgaccgggagttagtgcacatgatcaactgggcaaaaagggtgccaggctttgtggatctgacactgcacgatcaggtgcatctgctagaatgcgcatggctggagattttaatgataggcctagtgtggaggagcatggaacatccaggaaagctgctgtttgcacctaaccttctcctggaccggaaccaaggcaagtgtgtggaggggatggtggaaattttcgacatgctgctcgccacctcatcacggtttcgcatgatgaacctgcaaggggaggagtttgtgtgcttaaaatccataattctcctgaactctggagtgtacacatttcttagtagcacactgaagtccctggaggaaaaggaccacatccacagagtgctggacaaaattacagatacgctcatccatttaatggccaaggccggactgaccctgcagcaacaacaccagcgtctggcccagctgctgctcatcctctcccacataaggcacatgtcaaataaaggaatggaacatctctactctatgaagtgtaaaaacgtggttcccctgtatgatctgctgctcgagatgcttgatgcgcaccgcctccatgctcccacatctcgagggggagcctctgtggaagaaacagaccagagtcacctcgctacagcgggtagcacgtccagccatagcttacagaaatactacattaccggagaagcagaagggtttcctgctacagtgtag

SEQ ID NO: 28493 - DNA, 1788 bp, Artificial Sequence
  Description of Artificial Sequence: Synthetic coding sequence
atgactatgactctgcacacaaaggccagtggtatggccctgctccatcaaatccagggaaacgagctggagccactgaatcgacctcagctcaagatcccgctggaacgaccgcttggcgaggtgtatttggattcctctaagccagccgtttataattatcccgaaggcgctgcttacgagtttaacgcagctgccgctgcgaatgctcaggtatacggacagacgggtctgccttacgggcctggtagcgaagccgcagcctttggatctaatgggctcggcggattccccccactgaactccgtgagtcccagcccccttatgctgctgcatccgcctccccagctaagtcctttccttcagccccacgggcaacaagttccatactacctcgagaacgaaccttccggatacacagttcgcgaagccggtcctcctgccttttatagaccaaactctgataaccgcaggcaggggggaagagaacgcttagcttccactaatgacaaagggagcatggctatggaatctgctaaggagaccaggtactgtgcggtgtgcaatgattatgcttccggctaccattacggagtctggtcatgcgagggctgcaaggctttttttaagcgaagtatccagggccacaatgactatatgtgccctgcgaccaatcagtgcactatcgacaagaatcgacgaaaatcctgtcaggcctgccggttgaggaagtgctacgaagtaggtatgatgaaagggggaattcgtaaagatcgaagaggaggtcggatgctcaaacacaaaaggcagcgggacgacggcgaaggcagaggggaggtgggatccgccggagacatgcgagccgcaaacttgtggccttccccactcatgattaaacgatccaaaaagaatagcctggccctgtccctcactgctgaccaaatggtgagcgccctgttagacgctgagcccccaatcctatacagtgagtatgacccgactcgacccttttctgaagcatctatgatggggctgctgacaaacctagctgatcgggaacttgtgcatatgatcaactgggcgaagagagttccaggtttcgttgatctaacccttcacgatcaggtccacctccttgagtgtgcctggttggaaatccttatgattgggcttgtgtggaggtccatggagcatcctggcaaacttctgtttgcaccaaatctactgctcgacaggaaccagggcaagtgtgtggaggggatggtggagatctttgatatgcttttggcgacttccagcagatttcgcatgatgaacctgcaaggggaggaattcgtgtgtttgaagtctatcatactactcaactccggcgtctacaccttcctgagttccacgctcaaatcccttgaggaaaaggaccacatccatcgagtccttgataaaatcactgacactcttatacatctgatggctaaggcaggtttgaccctccagcaacagcatcaacgcctcgcacagctgttacttattctgagtcatataagacacatgagcaacaaaggcatggaacacctttacagcatgaagtgcaagaatgtcgtgccactgtatgacctgctgctagagatgttagacgcacatcggcttcacgctcccacatcacggggaggagcttcagtcgaggagacggaccagtcccacctcgcaaccgccggatctacaagttcacacagcctgcaaaagtattatattaccggggaggctgaaggcttccctgccaccgtgtag

SEQ ID NO: 28494 - DNA, 348 bp, Artificial Sequence
  Description of Artificial Sequence: Synthetic coding sequence
atgactatgaccctacacaccaaggcttccgggatggctctgttacaccagattcaggggaatgagctggaacccctgaataggccacaactgaagatcccacttgagaggcccctgggagaagtgtatctcgattccagtaagcctgccgtctacaattatcccgaaggagctgcttatgagtttaacgcagccgctgccgctaatgcacaggtgtatgggcagactgggttgccttacgggccaggttccgaggcggctgcttttggctccaacgggttgggcggtttcccacctttgaattctgtctcacccagccccctgatgctgttgcacccaccgccatag

SEQ ID NO: 28495 - DNA, 1452 bp, Artificial Sequence
  Description of Artificial Sequence: Synthetic coding sequence
atgaccatgaccctgcacaccaaagcgagcggcatggcacttctccatcaaatccaaggaaatgaattagagccccttaatcggccacagctcaagatcccactggaaaggccattgggcgaagtctacttagattcctctaagcctgccgtgtacaactatccggaaggcgcagcctacgaattcaacgctgccgctgccgctaacgcacaggtgtatggccagacagggctgccctacgggccaggaagcgaggcagctgcctttgggagtaacggcctcggtggattccctcctttgaactcagttagcccatcaccactaatgcttctgcatcctccaccccaactgagccccttcctgcagccccacggccaacaggtgccttactacttggaaaatgaacccagcggctacacggtccgagaagccggacctcctgctttctaccgacccaattctgacaacaggcggcagggtgggagggagcgtctggccagcacgaacgacaaagggagtatggctatggaaagcgctaaagagacccgctactgcgctgtgtgtaacgattacgcctccgggtaccattatggtgtatggtcttgcgaaggatgcaaggcatttttcaagagatcaatccagggtcataacgactatatgtgccctgccaccaatcagtgcaccattgacaaaaacagacgcaaatcgtgtcaggcatgtcggctgcgcaagtgttatgaagtgggcatgatgaaaggaggtttcgttgatctgacacttcacgatcaggtccacctgctggagtgcgcctggctggaaattctcatgattgggctggtctggagaagtatggaacaccccggaaagttgctttttgccccaaacctgctgctggaccggaaccaggggaagtgtgtcgaaggcatggtagaaatttttgacatgctcctggccacatcttcccggttccgtatgatgaatctgcaaggcgaggagttcgtgtgcctcaagagcattattcttctcaactccggggtgtatactttcctgtcctcaaccctgaagagtctcgaggaaaaagaccacattcaccgggttctggacaaaatcactgacaccctgattcacctcatggcgaaagcaggcctgacactccagcagcagcaccagcggctcgcacaactcctgctgatactttctcacattaggcacatgagtaacaagggaatggagcacctctatagcatgaaatgcaagaacgtcgtccccctgtacgacctcctgctggagatgctcgacgcccataggctgcacgctccaacaagcaggggtggcgcatcagtggaggaaacagaccaatctcatctggcaaccgccggatctacaagttcccacagcctccagaaatattacatcactggcgaggccgaaggcttccccgctactgtgtag

SEQ ID NO: 28496 - DNA, 933 bp, Artificial Sequence
  Description of Artificial Sequence: Synthetic coding sequence
atggccatggagagtgcaaaggagacccggtattgcgcagtctgtaacgattatgccagtgggtaccactatggggtctggagctgtgaaggctgcaaagccttcttcaaaaggtctatccaaggacacaatgactatatgtgcccggcaaccaatcaatgcaccattgacaagaataggcgtaaatcttgccaggcctgtaggctgcggaaatgttacgaggtggggatgatgaaaggtggtatcaggaaagacaggagaggtggcagaatgttgaagcataaaaggcagagagacgacggggaaggtcgaggtgaagtcgggtccgcgggagatatgcgggctgcaaatctctggccgtccccgctgatgattaagcgcagcaaaaaaaattctttagctctttcgctgacagcggaccagatggtctcagcacttctggacgccgagcctccaattctgtacagtgaatacgacccgaccaggcctttctccgaggcctccatgatgggtctgctgaccaacctggctgaccgtgagctcgttcacatgattaattgggcaaagcgagtccccggtttcgttgacctaacgttacacgaccaggtgcacctgctggaatgcgcttggctagagattctgatgattggacttgtgtggcgaagcatggaacacccaggcaagctgctgttcgctccgaatttgctcctggatagaaaccaggggaaatgcgttgagggcatggtagaaatttttgacatgcttttggcaacaagctctagattccgcatgatgaacctccaaggggaagagttcgtgtgtttgaaaagcatcattctacttaattccggaatcagccacgtggaggccaaaaaaagaattttaaacttgcacccgaagattttcgggaataaatggtttcctcgggtttag

SEQ ID NO: 28497 - DNA, 1320 bp, Artificial Sequence
  Description of Artificial Sequence: Synthetic coding sequence
atggatatcaagaattcaccatcttctttaaacagtccctctagttataactgttcacagagcatccttccactggagcatggatcaatctacatcccatcaagttatgtggactcccatcacgaataccccgcaatgacattctactcccccgcagtgatgaactatagcatcccgtcaaacgtcaccaacttagagggcggacccggtcgacagacgaccagcccgaatgtcctctggccaactcctggccacctgagtcccttagtggtgcaccgtcagcttagtcacctctacgctgaaccgcagaaaagtccctggtgtgaggccagatccttggagcacaccctccccgtcaacagagagaccctgaagcgcaaagtaagtggcaacagatgcgcgtccccggttactggtccaggaagtaagagggacgcgcacttctgcgcagtgtgtagtgattacgcctccggctaccactacggagtgtggtcctgtgagggctgtaaggctttttttaaacgctccattcagggccacaacgactacatctgccccgctacgaaccagtgcaccatagacaagaacaggcgcaagagttgccaggcgtgcaggctgagaaagtgctacgaggtaggaatggttaaatgcggaagtcgaagggagagatgtggttatcgactggtgcgccgacagcggtcggccgatgagcagctccactgcgctgggaaggctaaacgctcgggcggacatgccccacgtgtgcgcgagctgctgctggacgccctgagcccggaacagctggtgctgacattactcgaagctgagccccctcatgtgcttatttctcgaccgtcggccccttttacagaagccagcatgatgatgtctttgaccaaacttgccgacaaggaactggtgcatatgatttcttgggcgaaaaaaatacccggaatgtatcctctcgtgacagcaacgcaggatgcagattcctctcgcaagctggcacacctcttgaatgcggtcaccgatgctctggtttgggtgattgcaaagtcaggtatcagctcacagcagcagagtatgagattggcgaatcttctgatgcttctgtcccacgtgcgccacgctagtaataagggtatggaacatttattaaacatgaagtgcaagaatgtcgtgcctgtttatgatctgctgctcgagatgctgaatgcccacgtccttaggggctgcaaaagttcaatcaccgggtcagagtgtagccctgctgaggactctaagtcaaaagaggggtctcagaacccacagtctcaatag

SEQ ID NO: 28498 - DNA, 1593 bp, Artificial Sequence
  Description of Artificial Sequence: Synthetic coding sequence
atggacataaaaaacagtccatcgtctttaaactctccttctagctataactgctcccagtcgattctcccgctggaacatgggagcatctacattcccagtagctacgttgacagccatcacgagtatcccgctatgacattttattctcccgctgttatgaattatagcatcccttccaacgtaaccaacctggaaggtggaccaggtcggcagaccacctctccaaacgttttatggcctacaccaggacacttgtctccgctagtcgtccaccgccagctgagccacctgtatgctgaacctcaaaagtccccatggtgtgaagcaagatcgctcgagcacacacttccagtgaaccgcgagacactcaaacgcaaggtgtcaggtaatagatgcgcctcacccgtgactgggccaggttccaagcgcgacgcccacttttgcgcagtttgcagtgactatgccagtggttaccactacggcgtgtggtcctgcgaagggtgtaaggctttcttcaagcgttcaattcagggccacaatgactacatttgccccgcaaccaaccaatgcacaatcgataagaatcgaagaaagagctgtcaggcttgcagattgagaaagtgttacgaagttgggatggtaaaatgcggttcacggagggagagatgtgggtacagactcgtgcgccgtcaaaggtccgcggacgagcagctgcattgcgcagggaaggctaaacggtcaggagggcatgctccaagggtgcgcgagctgttgctcgatgccctcagcccagaacagttggtgctgactttgctcgaagccgagcctccacacgtactgatatccagacctagcgctccgtttaccgaggcctcgatgatgatgagtcttaccaagctcgcggacaaggagctggttcatatgatttcatgggctaagaagattccaggatttgtcgagctgtcactgttcgatcaggtccggttgctcgagagttgttggatggaagttctgatgatggggctcatgtggagaagtatcgaccaccctggcaagctgatctttgcccctgacttggtcttggatcgtgacgaaggtaaatgtgttgaagggatactcgaaatttttgacatgctcctggctacaacgagcagatttcgtgagctgaaattgcaacataaagaatatttatgtgtgaaagctatgatcctcctgaacagctctatgtatcccttggtgactgccactcaagacgccgacagctcccgcaaactcgctcacctgttgaacgccgtgacggacgccctggtttgggtgatcgctaaatccggaattagctctcagcaacaatccatgagattagcaaacctgttaatgcttctatctcacgtaagacatgcctctaacaagggtatggagcaccttctgaacatgaagtgtaagaatgtggtgcccgtctatgacttactgctggagatgttaaacgcgcatgttctaagagggtgcaagagttcaattactggatccgagtgttcccccgctgaagattcaaaatctaaggaagggtcccagaacccacagagccagtag

SEQ ID NO: 28499 - DNA, 1488 bp, Artificial Sequence
  Description of Artificial Sequence: Synthetic coding sequence
atggatatcaaaaacagccctagctcactgaattccccttcctcctataactgctctcagagcatcctcccactggaacacggcagcatttatatcccatcctcctatgtagactctcatcacgaataccctgctatgacattctatagccccgctgtcatgaactattcgataccctctaatgtcaccaaccttgaagggggacctgggagacagacgacatctccaaatgtgctttggccaacgcccggtcacttgagtcccctggttgtgcaccgtcaactatcccacctctacgcggaaccccaaaaaagcccctggtgcgaggcgagaagtctggagcataccttacccgtcaaccgggaaaccctgaagcggaaggtcagcggaaaccgttgtgcctcccccgtgactggccctgggtcaaaaagggatgcacatttttgcgcggtgtgctcggactatgcgtcaggttaccattatggagtctggagctgcgagggttgtaaggcttttttcaagcgtagcatccagggtcataatgattacatttgccccgctactaaccaatgtaccatcgataagaacagaagaaaatcctgtcaggcatgcagactgcggaagtgctatgaggtcggaatggtgaagtgtggctctaggagagaacgctgtggttatcgtctcgtccgcagacagcgttccgccgatgagcagctccattgcgccggaaaagctaagcgttctgggggacacgcccctcgggtgagagagctgctcctagacgcactctctcctgaacagctggtgttaacactactggaggcagagccccctcacgtcctgatcagccgcccatccgccccatttacagaagcctctatgatgatgagtttaactaaactggctgataaagaattagtccacatgatcagttgggccaaaaaaattcccggattcgtggagttgagtctgtttgaccaggtcaggctcttggagtcatgttggatggaagtgctgatgatgggtcttatgtggaggtccattgaccacccaggcaaactgatctttgcacccgatctcgtcctggaccgcgatgaaggaaagtgcgttgaagggatcctggaaatctttgacatgctcctggcgacaacaagccggttcagagaattaaagctgcagcacaaggaatatctctgcgtgaaagccatgatactcttgaactcctctatgtaccccctggtgactgctacccaagacgccgatagctcaaggaagctggctcatctcctgaacgcagtgaccgacgccttggtgtgggtgattgcgaagtcaggcatttcttctcagcagcagtctatgagacttgccaacttactgatgctgttgtctcatgtcagacacgccagggccgagaaagcaagccaaacgttaacctcctttgggatgaagatggagaccctgctccctgaggccaccatggaacaatag

SEQ ID NO: 28500 - DNA, 1446 bp, Artificial Sequence
  Description of Artificial Sequence: Synthetic coding sequence
atggacataaagaattctccctcctctttgaacagtcccagtagttacaattgcagccagtccatactgcccctggagcatggatctatttatattccatccagttatgtggactcccatcacgagtaccccgcaatgactttttacagccctgccgtgatgaattacagcattcctagtaacgtgactaatctggaaggaggacccggtcggcagaccaccagccccaacgtcttgtggccaacacctggacacttaagccctctcgtcgtacacaggcagctaagccatctctacgccgagcctcagaaaagcccatggtgtgaggccagatccctggaacacaccctgcctgtgaatcgcgagacactgaaaagaaaggtaagtggaaataggtgtgctagtccagtgaccggaccaggcagtaaaagggatgctcacttttgcgctgtttgttctgactatgcatcaggctaccactacggcgtatggtcctgtgaagggtgcaaggccttttttaaacggagcattcagggacataacgactacatctgcccagccactaatcagtgcacaatagataaaaacagacggaagtcctgccaagcctgccgtctgagaaaatgttatgaagtgggcatggtgaaatgcggatcccgtcgagaaagatgtgggtacagactggtgagacgccagaggtctgcggacgaacagcttcattgtgctggaaaggcgaaaagaagcgggggacatgcccctagggtgcgcgagttgctgctcgacgccctgtctcctgagcagttggtgctaaccttgctagaggcggaacccccacacgtgctaatcagtcgaccgtcagctccttttaccgaagcctcaatgatgatgtccctaaccaagttagcggataaagagttggtccatatgattagttgggctaagaaaattccaggatttgtggaactttcactttttgatcaggtgagacttttggaatcttgctggatggaagtcctaatgatggggctgatgtggagaagcattgaccacccgggtaagcttattttcgcgcctgacctggttctcgatcgtgacgaaggcaagtgtgtggaaggaatcctcgaaatttttgatatgttgctggctacgacgtccagatttagggagctgaagcttcagcacaaagagtacctatgtgtcaaggcaatgattctgctgaattcctctatgtaccctctggtgactgctacacaagatgctgattcatctcggaaattggcccatctgctgaatgcagtgacggacgccctcgtttgggtgatagccaagtccgggattagttcgcagcaacaatctatgcggctcgcgaacttattgatgctgctgagccatgtcaggcacgctcgctggggcgaaaagcagttcatacacctgaagctttcatag

SEQ ID NO: 28501 - DNA, 1488 bp, Artificial Sequence
  Description of Artificial Sequence: Synthetic coding sequence
atggatatcaagaatagtccctctagcctgaacagcccgtcctcctataattgctcccaatccattttgcccctcgaacacgggagtatctatatcccctcaagctatgtagattctcaccacgagtatccggctatgacgttttacagccctgccgtgatgaactactcaatccccagcaacgtcacaaatctggagggtggaccaggcaggcaaaccaccagcccgaacgtactgtggcccacacctggacatctctcccccctggtggtgcaccgacaattgagccacctgtatgccgaaccacaaaaatcgccttggtgcgaagcacggtccctggagcacacattacctgtgaacagagagacactgaagcggaaagtgagcggcaatcggtgcgcgtccccagtgaccggccctgggtctaagagagatgcccacttttgcgctgtgtgtagtgactacgcttcggggtatcactacggggtctggagctgtgaaggctgtaaggccttctttaagcgctctatccagggccacaacgattatatctgcccagctacaaaccagtgtactatcgacaagaaccgccgaaaatcctgccaggcctgccgcctgaggaaatgctatgaagttggaatggtgaagtgcggatccagacgcgaacggtgcggttaccggctggtaaggaggcagcggagtgccgatgagcagttgcattgcgcgggtaaggccaaaagatctggcggtcatgctcccagagtgagagaattgttgctggacgctctgagccctgagcagttggtgcttacactccttgaggcggaaccaccccatgttctgatctctcggccaagcgcccctttcactgaagccagcatgatgatgtcgctcactaagctggcagacaaagaattggtccacatgatttcctgggctaaaaagatcccaggattcgtggaactgagccttttcgaccaggtgcgattactggaatcctgttggatggaggtactgatgatgggccttatgtggcgcagcattgaccaccccggtaaattgattttcgccccagatcttgtcttagatcgagacgaagggaagtgtgtcgaagggatccttgaaatcttcgatatgcttctcgccaccactagccgattccgggaactgaagctacagcacaaagagtacctgtgcgtcaaggccatgatcctgctgaattcttcgatgtatcctctcgtgactgctactcaagacgcagactcttccagaaaacttgcacatctgctaaatgcagtcactgacgctttagtgtgggtcattgccaagtcaggaatatcttcccagcagcagagcatgagacttgcaaatctgctaatgttactatcacacgtacgtcacgctcgagctgagaaggcgtctcaaacgctcacaagcttcggcatgaaaatggaaaccttgttacctgaagctaccatggaacagtag

SEQ ID NO: 28502 - DNA, 1542 bp, Artificial Sequence
  Description of Artificial Sequence: Synthetic coding sequence
atggatatcaagaactccccgtcctcactcaattctccctcctcttataactgttcccagtccattctccctcttgaacatggctccatttacatccctagctcgtacgtggattcgcaccatgaataccctgctatgacgttttactccccagccgtgatgaactacagtatcccctccaacgtcaccaacttggagggtggtcctggaagacaaacaacgagtcctaacgtgctctggcctactcccggacacctctcgcccctagtagttcatcgccagttatcgcacctgtatgcggagccacagaagtcaccttggtgtgaggcaagatccttggaacacacgctgcccgtgaacagggaaacacttaaaaggaaagtttctgggaatagatgtgccagcccagtgacgggtcctgggagtaaaagagatgcacatttctgcgcagtttgctctgattatgccagcggctaccattatggagtgtggagctgcgagggatgcaaggctttctttaaaaggtccattcagggacataatgattacatatgtccagctactaaccaatgtacaattgataagaaccggaggaagtcctgtcaggcatgtcgcctgaggaaatgctacgaggtggggatggtgaagtgtgggtcacgtcgggagcgatgcggatacagactggtgcggaggcagcgatccgctgacgaacagctccactgtgcaggcaaagctaaaagaagtggtggtcatgccccaagagtgcgggagttactgttggatgccttgtcccctgagcagctcgtgctgactttgctggaggcagagccacctcacgtcctaatcagtaggcccagcgccccattcaccgaggcatccatgatgatgtctctcaccaagttggctgacaaagagctggtgcacatgatatcttgggcaaagaagatccccggtttcgtggaactgtctctctttgatcaggtgcgtctcctggagagctgttggatggaggtcctgatgatgggcctgatgtggaggtcaatcgatcaccccggtaagctcatcttcgcgcctgatttggtgctggaccgcgatgagggcaaatgcgtcgaaggcattcttgagatattcgacatgctgctggccaccacctctaggttccgggagctgaaactccagcacaaggaatatctgtgtgtgaaggcaatgatactgctgaatagctctatgtatccattggtgactgcgacccaggacgctgacagcagtagaaagctggcacatttgctgaatgccgtgaccgatgctcttgtctgggtcatcgctaaatcaggaatttcctcccaacaacagagtatgcggctggccaatctgctgatgttactgtcccacgtgaggcacgccagtagcctcagcctctcctggcggctgtttatgctgagagaagcctcttgtcacggggttaggcagacgccagggggagcgcatgtatctgtaagccggtcacgctcatttgaggcctgtcaacagcccagagaatag

SEQ ID NO: 28503 - DNA, 1488 bp, Artificial Sequence
  Description of Artificial Sequence: Synthetic coding sequence
atggacatcaagaattccccttcttctttaaattccccttccagctacaactgcagccagtccatactacccctcgagcacggctcgatttatatcccctcttcatatgtagactcgcatcacgaataccccgcaatgaccttctatagccctgccgtgatgaactatagcatcccatctaatgtcacgaacctggaggggggaccaggcaggcagaccactagccctaatgtactctggccaacgcccggtcacctttccccactcgtcgtgcaccgccagctgtcccatctgtatgccgagccccagaaatcaccctggtgcgaagctcgcagtttggaacatacgctgcccgtgaatcgagagacactaaagagaaaggtatccggaaacagatgcgccagcccagtgaccggcccaggttctaagcgggatgcccatttctgcgccgtgtgctccgattatgcttccgggtaccactatggagtctggagttgcgaaggctgtaaagcattcttcaagcgatctattcagggacataacgattatatctgcccagctacgaatcagtgcaccattgataagaacaggagaaaatcctgccaggcctgccggcttcgtaaatgctatgaagtggggatggtgaaatgtggaagtcggcgagagcgttgtggctacagactagtgcgacgccagagaagtgctgacgagcagctgcattgcgccggaaaggccaagagatcaggtgggcacgcacccagggttcgggagctgttgctggacgcactcagcccggagcaactggtcttaaccctgttagaggctgaacccccacacgtgctcatatcgagaccaagcgctccatttacggaagccagtatgatgatgagtctgactaagttggcggataaagaactggttcacatgataagctgggccaagaaaattcccggtttcgttgagttgtcactcttcgaccaggtgcgtttgcttgagtcctgctggatggaagtgctgatgatgggacttatgtggcggtcaattgaccaccctggcaagctgatttttgcccctgacttggtacttgatcgggatgaagggaagtgcgtggagggtattctggaaatctttgatatgctgcttgctaccacatcacggtttagggagcttaagctgcagcataaggaatatctctgcgtgaaggccatgattctactcaatagctccatgtatcccctggtaacagccacccaagacgctgattcttccagaaaacttgcacacctccttaacgcagtgaccgacgccttggtctgggtgattgccaagtccggtatctccagccagcagcagtcgatgcggctggcaaatcttcttatgctgctgtcccatgtacggcacgcacgtgcggagaaggcctctcagacacttactagcttcggcatgaagatggaaaccctcctgcccgaggctaccatggaacaatag

SEQ ID NO: 28504 - DNA, 1419 bp, Artificial Sequence
  Description of Artificial Sequence: Synthetic coding sequence
atggatatcaaaaactcccctagctccctcaactcgccaagttcatataattgctcacaatctatactgccactggagcacgggtcaatctacatccccagcagttacgtcgattcccaccacgagtacccagccatgactttctattctcccgctgtgatgaactacagcatcccttccaacgtaaccaacctggaagggggtccgggtaggcagactacttcccctaacgtgttgtggcctacaccagggcacctcagccccttagtcgtgcaccgccagctttctcacctgtatgcagaaccacagaagagtccgtggtgcgaggcgagatcactcgagcacacgcttcctgttaatcgcgagacccttaagcggaaagttagcggaaacaggtgtgcttcaccagtgactggcccagggagtaagcgggatgcccacttttgtgctgtgtgcagcgattacgccagcggctaccactacggcgtttggtcctgcgaaggatgcaaggcgttcttcaaacgaagcattcagggccataacgattatatttgtcctgccaccaaccagtgcaccattgataagaatagacgcaagtcgtgccaggcctgccggctccggaaatgctacgaggtgggtatggtgaaatgtggtagcagacgtgaacgttgtggctatagattagtgcgcaggcagcgaagtgccgatgaacagctgcactgcgcgggtaaggccaaacggtcgggaggtcatgctcctcgggttcgcgaactgctgctggatgcgctatcccctgaacagctggtgctcacactgcttgaggcggagcccccacatgttctcatcagccgacctagtgccccattcacggaggctagcatgatgatgtccctgacaaaattagccgataaagaattagtacacatgatctcctgggcaaaaaagatcccaggttttgtcgaacttagtctatttgatcaggtgcgcctgctcgaatcttgttggatggaggtgctgatgatgggcctgatgtggaggagtatcgatcaccccggtaaactgatcttcgcacccgatctcgtgctcgaccgggatgagggcaagtgtgtagaaggcatcttggagatttttgatatgttgctggcgactaccagtcggttcagggagctgaagctgcagcacaaggaatacttgtgtgtcaaggctatgatccttttaaacagcagcatgtacccgctggtgacggcaacacaggatgcggattcctcacggaagctggcgcacctcctgaacgccgtcactgacgctcttgtgtgggtcattgcgaagtctgggataagcagccagcaacagtctatgaggctggccaacctgctcatgctactctctcacgtacggcacgccagatacgccccttag

SEQ ID NO: 28505 - DNA, 1446 bp, Artificial Sequence
  Description of Artificial Sequence: Synthetic coding sequence
atggacataaagaactcgccatccagcctaaattccccaagctcatacaattgctcccaatcaatcctgccactggagcacggttcaatttacatcccgtcgagttatgttgatagtcatcatgagtaccccgctatgaccttttacagcccagcggtaatgaactatagcatcccatcaaacgtcacaaacctggaggggggacccggacgacagactacatctccaaacgttctgtggccaactccgggacacctctctccactcgtcgtccacaggcagttgtcccacctgtatgccgagccacagaagtcaccctggtgcgaagcccgttcgttggaacacaccttacctgtaaaccgggaaactcttaaacggaaagtcagcggtaaccgttgcgcttcccccgttacagggccaggaagtaagagggacgcccatttctgcgcggtctgctccgactacgcatcagggtaccactacggagtatggtcttgtgagggctgcaaagccttttttaagcgttcaatccaggggcacaatgattacatctgccccgcaaccaaccagtgtacaatcgataagaatcggaggaagtcatgccaggcttgcaggctgagaaagtgctacgaagtgggtatggttaagtgtggttctcgacgggagaggtgtggctaccgcctggtgagacggcagcgttccgccgatgaacagctgcattgtgcaggcaaagcaaaacgatcaggcggacacgcacccagggtgagagaactcttgcttgacgcactgtcccctgaacaactggttctcactctactggaggctgagcctcctcatgtcctaataagtagacccagtgctcctttcactgaggcctcaatgatgatgtctctcacgaaattggccgacaaggaattagttcatatgatctcatgggctaagaaaattccagggttcgtagagctttctctattcgaccaagtgagactcctcgagagttgttggatggaagtgctgatgatgggactcatgtggagaagtatcgaccatcccggaaagcttatatttgctcccgatcttgtcctcgacagagatgagggaaaatgcgtggagggtatcctggaaattttcgatatgctgctggccaccacaagccggttcagggagctgaagttgcaacacaaggagtacctgtgcgtcaaggccatgatcctcctaaattcgagcatgtatccactggttacagcaactcaggacgcagactctagccgaaagctggctcatttattgaatgccgtgaccgacgcgctagtttgggttattgcaaagtcaggaatctctagtcaacaacagtctatgcggctggctaacctgctgatgctcctgagccacgtgagacacgccagatggggtgagaagcagttcatccacctcaaactgtcatag

SEQ ID NO: 28506 - DNA, 1380 bp, Artificial Sequence
  Description of Artificial Sequence: Synthetic coding sequence
atggacgggttctatgatcaacaggttccgtacatggtgaccaacagccagcggggtcgcaattgtaatgaaaagccgacaaatgtgaggaaacgtaagttcattaatagagacctggcacacgacagcgaggaattgtttcaggatctttcccagctgcaggagacttggctcgccgaggtggcatttcatgggttgccactgaagataaagaaagaaccacactccccatgcagcgaaatttcatctgcttgtagccaagagcagccctttaagttttcatatggggagaagtgcctttacaacgtatcagcctacgaccagaaacctcaagtcggcatgcggccatccaacccccctactccctccagtacccctgtctccccccttcaccacgcctcccctaatagcactcatacacccaaaccagacagggcattccctgctcacctgccgccttctcagtcaattcctgactccagttacccaatggaccatcgctttcgtagacaactaagcgaaccctgcaattcattcccccctctgcctacaatgccaagagagggtagacctatgtaccagcggcagatgtccgaaccaaacattccttttccaccgcaggggtttaaacaggaatatcatgaccccgtttatgaacataataccatggtgggatccgcagcctcccagagcttccctcccccacttatgataaaacaagaaccaagggacttcgcatacgactccgaggtacctagttgtcactcgatctatatgaggcaggagggtttcctggcgcatccttctagaacggagggctgtatgtttgaaaagggcccaaggcagttttacgacgacacatgcgtagttccagaaaagttcgatggcgacatcaagcaagagcctggtatgtatcgggaagggccaacataccagcgcagaggatcactccagctctggcagttccttgttgccctcctggatgatccaagcaatagccatttcattgcctggacaggacgcggtatggagtttaaattgattgaacccgaggaagtcgcgagaagatggggcattcagaaaaacaggccagctatgaattacgacaagctgagcaggtccctccgctattattacgagaaaggaatcatgcagaaggttgctggggagcgttacgtctacaagttcgtgtgtgaccccgaggcactgttttctatggctttcccagacaatcagagacccctgcttaagacagatatggagcgccacatcaatgaggaagacactgtgcccttgtctcactttgacgaaagtatggcttacatgccggaggggggatgttgtaatcctcacccatacaatgaaggctacgtatactag

SEQ ID NO: 28507 - DNA, 1380 bp, Artificial Sequence
  Description of Artificial Sequence: Synthetic coding sequence
atggatggcttttacgatcagcaggtgccatatatggttaccaacagccaacgcggaaggaattgcaatgagaagccaacaaacgttagaaagaggaaatttattaatagggacctcgctcacgacagtgaggaactgtttcaggacttatcgcaactgcaagaaacgtggttggcggaggtggccttccatgggctaccacttaaaataaaaaaggaaccacattccccctgtagtgaaattagcagcgcatgtagtcaggaacagccgtttaaattttcgtacggggaaaagtgtctgtacaacgtctcggcctatgaccagaaaccacaggtgggaatgagaccatccaatcctccaaccccatcttcgactcccgtgagtccgctacaccacgcctctccgaactccacacatacgccaaagccagatagagccttcccggcacatttgccacctagccagtctatcccagactcatcatatccgatggaccatcggtttaggagacagctgagtgaaccatgtaacagttttcctcctctgccaacaatgcctcgggaagggagacctatgtaccagaggcaaatgagtgagccaaacattccatttccaccccagggctttaaacaagagtaccatgatcctgtgtacgagcataacacaatggtggggtctgccgcttcacagagctttcccccacccttgatgattaaacaggaaccgcgagattttgcctatgacagcgaagttccttcctgccatagtatctacatgcgtcaagaagggttcctggcacaccccagccgcaccgaaggatgtatgttcgaaaaaggccctcggcagttctacgacgatacatgcgtggtgccagaaaagtttgacggtgatataaagcaagagccagggatgtaccgcgagggccctacataccagaggcgaggatcactgcagctttggcagtttctggtcgcattgctcgatgacccttccaacagtcacttcatcgcatggacaggtaggggaatggaatttaaactcattgagccagaagaggtcgccagacgctgggggatccaaaaaaaccgcccagccatgaactatgacaaactgtctcggagtctaaggtactactacgagaagggaattatgcagaaagtggccggtgaacgctacgtgtacaaatttgtctgtgatcctgaggcattgttctcaatggcgttcccagataatcagcggcctctcctgaagactgatatggaaaggcacatcaatgaggaggatacagtcccgctgtctcattttgatgagagcatggcatatatgccagagggcggatgttgtaatcctcacccctacaatgaggggtatgtctattag

SEQ ID NO: 28508 - DNA, 1125 bp, Artificial Sequence
  Description of Artificial Sequence: Synthetic coding sequence
atgttgcaagatctctccgcgtccgttttttttccgccatgttctcagcataggacgctcgctcaggttcccgataatgatgaacagttcgtccctgattaccaggcagagtcactggcatttcatggcctgcccctgaagattaagaaggagccccacagtccctgctccgaaatctcttcagcctgtagccaggagcaaccgttcaagtttagttacggtgaaaaatgcctgtataatgtgaggtttagaagacaattgtcagaaccttgcaattcatttccaccactgcccaccatgcctcgggaaggtagacccatgtatcagcgccagatgagcgaacctaatattcccttcccacctcagggattcaaacaagagtatcatgacccggtgtacgagcataacacaatggtgggcagcgctgcgagccaaagcttcccgcctccactgatgattaaacaggaacctagggacttcgcatatgactcagaggtcccgtcttgccactctatatacatgaggcaggaaggttttctggcccacccgtctagaaccgaagggtgcatgtttgagaaaggaccccgacagttttacgatgatacttgcgtggtgcccgagaaattcgacggagatataaagcaggaaccaggcatgtacagggaggggccaacatatcagagacgaggctctttgcagctctggcagttcctcgtcgccctgttagacgaccctagcaattctcactttattgcctggactgggaggggcatggagtttaaactcatagagccagaggaagtggcacgcaggtgggggattcagaagaatcgaccagcaatgaactacgataaactctcacgttccttacgctactattacgaaaaagggatcatgcagaaggttgcgggtgaacgttacgtttacaaatttgtttgcgatcctgaggcattgtttagtatggcgtttccagacaaccagaggccacttctgaagacagatatggaacggcatatcaatgaggaggacactgtgcctctgagccatttcgacgagtcgatggcctacatgcctgaagggggatgttgcaatccccacccgtacaatgaaggctatgtatactag

SEQ ID NO: 28509 - DNA, 1380 bp, Artificial Sequence
  Description of Artificial Sequence: Synthetic coding sequence
atggatggtttctacgaccaacaggttccatacatggtgacgaatagtcagcgaggacgtaactgcaatgagaagcctaccaatgtaagaaaaagaaagtttatcaatcgcgatctagctcacgacagtgaagaactgtttcaagatctgagccagctgcaggagacgtggctggctgaggtcgccttccacggactgccccttaagattaaaaaagaaccacacagtccctgctctgaaataagcagtgcttgcagtcaggagcagccatttaagttcagctatggcgaaaaatgcctgtacaacgtgagtgcttatgatcagaaacctcaagtgggtatgagaccctcaaatcctcctacacccagttccacacccgtctcccccctgcatcacgcttctcccaatagtactcacactcctaaaccagaccgcgctttcccagctcatctgcccccatcacagagcatcccagactctagttacccaatggaccataggtttcggagacagctcagtgagccttgcaattcgttcccacctctcccaaccatgccacgtgaaggccgtccaatgtaccaaagacagatgtcagagccaaacataccctttccacctcaggggttcaagcaggagtatcatgatcctgtgtatgagcacaacaccatggtaggaagcgcagcctcccaatcattcccccctccccttatgattaaacaggagccacgggatttcgcctatgattcagaggttccttcgtgtcactctatctatatgagacaggaggggttcctggcccacccctccaggaccgaagggtgcatgtttgaaaagggcccaagacaattttacgatgatacatgcgtcgttcccgagaagttcgacggcgatatcaagcaggagcccggaatgtatagggaggggccaacctaccaaagaagagggtctttgcagctgtggcagttcctggtggctctactggacgatcccagcaactctcacttcattgcttggactggccgtggaatggagttcaaactgatcgagcccgaagaggtggctaggaggtggggtattcaaaaaaaccgaccagccatgaactacgacaagctgagccgatctcttcggtattactatgagaaaggtattatgcaaaaggtggctggggagagatatgtttacaagttcgtctgcgacccagaggcactcttttccatggcgtttccagataatcagaggccacttctgaaaactgatatggaacgtcatatcaatgaagaggatactgtccctctgtcacactttgatgagagtatggcatacatgcccgaaggtggctgctgcaatccccacccttataacgaaggatacgtgtattag

SEQ ID NO: 28510 - DNA, 1434 bp, Artificial Sequence
  Description of Artificial Sequence: Synthetic coding sequence
atggacggtttttacgaccagcaagtgccatatatggttactaacagtcagcggggtcgcaactgcaacgaaaagcccaccaacgtgcgaaagaggaaattcatcaatcgggatctcgctcacgattccgaagagctctttcaggatctctctcagctccaggaaacttggttggccgaggctcaggtaccggacaatgatgaacaattcgtcccagattatcaggccgagtcacttgccttccatgggctgccgctcaagataaaaaaggaaccacatagcccttgttcagagatttctagcgcctgttcccaagaacaaccattcaaattttcatacggggaaaaatgtctgtataatgtaagcgcgtatgatcagaagccacaggttggcatgcgaccctcaaacccccctaccccatctagcacgcctgtcagtcctttgcaccacgcctcgcccaattccacccacacccctaaacccgatcgcgcttttccggctcatttgcccccttcccagtcaattcccgatagcagttatccaatggaccacagatttagacggcagctttctgagccttgcaacagctttcctccattgcccacgatgccaagagaagggcgaccgatgtatcagcgccagatgtcagagcctaatatacccttccccccacaaggattcaagcaggagtaccatgacccggtctatgagcacaacactatggtcgggtcagccgcttcgcagtcctttcccccaccattaatgattaaacaagagccccgagatttcgcctatgattccgaagttccaagctgtcactcaatatatatgcgccaagaaggattcctggcgcaccccagccgcaccgaggggtgcatgttcgagaaggggcctcgtcaattctatgacgatacatgcgtggttccagagaaatttgacggggacatcaaacaggagcccggaatgtacagggaggggcctacgtaccagcgacgcggaagcttgcaactatggcaatttctcgtagctctgctggacgatccaagcaactctcatttcattgcttggacagggcgaggcatggaattcaaactaattgagccagaagaggtcgcacggaggtggggtatccagaagaacaggccggcaatgaattatgataagttgagccgcagcttgcggtattactatgagaaggggatcatgcagaaggtcgcgggagaacgttacgtgtataaatttgtatgcgacccggaggcactcttcagtatggccttccctgacaaccagcggcctctgttaaagactgatatggagcgccatatcaacgaggaggacaccgtgcccctatcccattttgacgaatctatggcttatatgcctgaaggcggttgctgcaatccccacccctataatgagggatacgtgtactag

SEQ ID NO: 28511 - DNA, 1260 bp, Artificial Sequence
  Description of Artificial Sequence: Synthetic coding sequence
atgctccaggacctcagtgcctccgtgttcttccccccttgcagtcagcacagaaccttagtggcattccatggtctgccactcaagattaagaaggaaccacacagcccttgtagcgagatctctagtgcctgcagccaggagcagccattcaagttctcatatggggagaagtgcctgtataacgtgagcgcctacgaccagaaacctcaggtgggtatgcggcctagtaaccctccaaccccgtcatccacccccgtttcacccctccatcacgcaagtcccaactcgactcacactcccaaacctgatcgcgcttttcctgcccacctgccaccgagccagtccatacctgactctagctatccaatggaccatcggttcagacgacagctgagcgaaccctgcaactcatttcctcctttgccgaccatgccacgggaaggaaggcccatgtaccagcgtcaaatgagcgaacctaacattccattccctccgcaaggcttcaaacaagagtaccatgaccccgtatatgagcacaataccatggtagggtcagctgctagtcagagctttccacctcccctcatgatcaagcaggaaccacgggactttgcttatgacagtgaggtgccatcttgccatagcatctatatgcgccaggagggatttctggcccatccctccagaacagaaggttgtatgttcgaaaagggaccgcgacagttctatgatgatacctgtgtcgtaccggaaaaatttgatggagacatcaaacaagaaccaggaatgtacagagaaggcccaacatatcagaggagagggtctctgcagctgtggcagtttctggttgctcttctcgacgacccgtccaactcccacttcattgcctggacaggcaggggcatggaatttaaacttatcgaaccagaagaagttgcccgacgttggggaattcagaaaaaccgacccgctatgaattatgacaagctttctcgttcattgcgttactactacgaaaaggggatcatgcaaaaggtcgccggagagcgctacgtatataagttcgtgtgtgatccggaagccctgttctccatggcctttcccgacaatcagaggccacttctcaagacagacatggagagacacatcaatgaagaagacaccgttcccctctcccatttcgacgagagtatggcatatatgccagagggcggatgttgcaaccctcacccatataacgaaggctacgtgtactag

SEQ ID NO: 28512 - DNA, 372 bp, Artificial Sequence
  Description of Artificial Sequence: Synthetic coding sequence
atggatggcttctatgaccagcaagtcccgtatatggtgacaaatagtcagcgcggtaggaactgtaacgagaagcccacaaacgtcagaaagcgcaagttcatcaacagagatctggcgcacgattcagaggagctgttccaggatctgtcccagctgcaggagacctggctggccgaggcccaggtgccggataatgacgagcagttcgtgcctgattaccaggccgagtccctcgccttccatggcttgcccttaaaaataaagaaggagccacatagcccttgctccgagataagctcagcttgctctcaagagcaacccttcaaatttagctatggtgaaaaatgtttatataatgtgtccgcatag

SEQ ID NO: 28513 - DNA, 1434 bp, Artificial Sequence
  Description of Artificial Sequence: Synthetic coding sequence
atggacggattttatgaccagcaggttccatatatggtcaccaattcccagagaggccgaaattgtaatgagaagcccactaacgttaggaagaggaaattcattaatcgagacttggcacacgattcagaagagttgtttcaggatctgtcacaattgcaggagacctggcttgcagaggctcaggtaccggacaacgacgagcagttcgtcccagactaccaggcagaaagtctggcattccacgggttgccattaaagatcaagaaagagccacattctccttgctcagagatcagctcagcatgctcgcaggaacagccctttaaattttcctatggagagaagtgtctctacaatgtaagcgcctacgatcagaaaccacaagtggggatgcgcccttctaatcctcctacaccctctagcacacctgtgtctccattacaccacgcatcgcctaatagcacacatacaccgaagccagatagggcttttccggcacatctgccgccttctcagtccatccctgatagttcttatcccatggaccatcggttccgtcgccaactcagtgaaccctgtaatagcttcccgcctctgcctacaatgccacgagaagggcgtcccatgtaccagaggcagatgagcgagcccaacattccctttcctccacaggggttcaagcaggaatatcacgaccctgtttacgaacacaacacaatggtcgggtcggcagcaagccagagttttcctccaccactgatgatcaagcaggaacctcgcgacttcgcatacgactctgaagtgccttcctgtcactctatttacatgcggcaggagggctttctggcacatccaagccgcaccgagggttgcatgttcgaaaaggggcctaggcagttctatgatgatacatgcgtagtgccagaaaaatttgatggggatattaaacaggaacccggaatgtatagggaaggacctacttaccagcgtagagggagcttgcagctctggcagttcctggttgctcttctcgacgaccccagcaattctcacttcattgcttggaccgggcgtggaatggagttcaagctgatagaacctgaggaagtggccagacggtggggaatccagaaaaaccgcccagctatgaactacgacaagctatcccgatcccttcggtattactacgaaaagggcattatgcaaaaggtcgccggagagaggtacgtgtacaaattcgtttgtgatcccgaagccctgttctccatggccttccccgacaatcagcgacctctgctgaagaccgacatggagcggcacattaacgaagaagacacggtgccactgagccattttgacgaatccatggcctatatgccagaaggtggctgctgtaacccacacccctacaacgaaggatatgtctattag

SEQ ID NO: 28514 - DNA, 288 bp, Artificial Sequence
  Description of Artificial Sequence: Synthetic coding sequence
atggacggcttctatgatcagcaggtcccttacatggtgacgaactcacagcgcggtcgcaactgcaatgagaaacctaccaacgtgcgcaaaaggaagtttatcaatagggacctggcacatgacagtgaagaattgttccaggacctgtctcagctccaggagacctggctggctgaggctcaggtccccgataatgatgagcagttcgtgccagactaccaggctgaaagcttggcctttcatgggctgccacttaagattaagaaggagccccatagcccatag

SEQ ID NO: 28515 - DNA, 63 bp, Artificial Sequence
  Description of Artificial Sequence: Synthetic coding sequence
atggacggtttctatgatcagcaggtgccttatatggtaacaaacagtcagaggggccgttag

SEQ ID NO: 28516 - DNA, 1314 bp, Artificial Sequence
  Description of Artificial Sequence: Synthetic coding sequence
atgctgcaagatctgagtgcctcggtattttttcccccttgctcacagcaccgtactctcgcccaggtgcctgacaacgatgagcagttcgttcccgactaccaggccgagtctttggccttccacggattacccctgaagatcaaaaaagagcctcattcaccctgctcagagattagctccgcctgcagccaggaacagcctttcaaattcagctacggtgaaaaatgcctctataacgtaagtgcttacgaccagaagccccaggtagggatgcgacctagtaaccctcctacaccgtccagtacacctgtgagccctctacatcatgccagcccaaattcaacacacactcctaaaccagatagggcctttccagcacatctgcccccttctcaaagcatacccgacagttcctaccctatggatcacagatttagaagacaacttagcgaaccttgcaattcctttccaccccttcctaccatgccaagagaaggtagacctatgtatcagcgacagatgagcgaacccaacatcccttttcccccacagggtttcaagcaggagtaccacgaccccgtgtatgaacataatacgatggtgggcagcgccgcttcccagtcttttcctcccccactaatgatcaaacaggaacccagggactttgcctacgactctgaggtccccagttgtcactcaatttacatgaggcaggaaggatttctggcccacccatctcgaactgaaggctgcatgtttgagaagggaccgaggcagttttatgacgacacttgcgtggtcccggagaagtttgacggggacatcaaacaggaacccggaatgtaccgagaggggcctacatatcagcgccgaggcagtctacagctgtggcaattcctcgttgccttattggacgaccctagcaattctcatttcatcgcttggactggtcgtggtatggaattcaaactcatcgagcctgaggaggttgcccgaaggtggggtatccagaagaatagacccgcaatgaactatgataaactcagtcgttctctgaggtattactacgaaaaaggcatcatgcaaaaggtggccggtgagcgatacgtttataaattcgtgtgcgatcccgaagctctgttctcaatggctttcccggacaaccagaggccactcctcaagacagatatggagcgccacatcaatgaggaggatactgttccccttagccatttcgacgagtccatggcgtatatgcctgagggtgggtgttgtaaccctcacccctacaacgagggatacgtgtactag

SEQ ID NO: 28517 - DNA, 1365 bp, Artificial Sequence
  Description of Artificial Sequence: Synthetic coding sequence
atggacggattctacgaccaacaggtgccctacatggtgacgaattcacaaaggggaagaaactgcaatgagaagcccacgaacgtcagaaagcggaaattcattaatagagatcttgctcatgactcagaagaacttttccaagatctttctcagctccaggagacatggttggcagaggctcaggtaccagataacgatgagcagtttgtgcctgactatcaagccgagtctttggctttccacgggcttcctctaaagatcaaaaaggaaccacacagcccttgtagtgagatctcatctgcctgttcccaagaacaaccgtttaagttcagttacggggagaagtgcctgtacaacgttagtgcctacgaccagaagccacaggtggggatgaggccctctaacccacctacccctagttccactcccgtgtcgccactccaccacgcctctccaaattctacacacacgcccaagcctgatagggccttccctgcacacctccccccatcacaatccatcccagattcctcttacccaatggatcaccgctttcgccgtcagcttagcgagccttgcaactcatttccgccattgccaactatgccaagggagggacgccctatgtaccagaggcagatgtcggaaccaaatattcccttcccgcctcagggcttcaaacaggagtaccacgacccagtctacgaacacaatacgatggtcggctctgcggctagccagagtttccccccaccactgatgataaaacaggaacctagagatttcgcttacgactcgggctgcatgttcgaaaagggacccagacaattttatgacgatacctgcgtagtgcctgaaaagttcgacggagatattaagcaggaacccggaatgtaccgcgagggcccaacttaccagcgcaggggctctctgcaactgtggcagtttctggtagctttgctggacgatccttcaaattcccattttatagcttggactggcagaggtatggagttcaagctgattgaaccggaagaggtcgcacgtaggtggggaatacagaagaacagacctgccatgaactacgataaactgagtaggagtctgcgctattattacgagaaaggcataatgcagaaggtcgccggagaacgctacgtgtacaagtttgtctgcgatccagaggccctgttttcaatggccttcccagacaatcagcgtcctctgctcaaaacagatatggaaagacacattaacgaggaggatacagtacctctgtcgcatttcgacgaaagcatggcttacatgccagaggggggatgctgtaatccccatccttataatgaaggttacgtatactag

SEQ ID NO: 28518 - DNA, 1455 bp, Artificial Sequence
  Description of Artificial Sequence: Synthetic coding sequence
atggagcgcagaatgaaagccggttatctggaccagcaggtgccttatactttttcctctaaaagtcccggtaatgggtccctgcgagaggccctgattggcccattaggcaaactcatggatcctggttcactcccgcctctcgactcggaggacctattccaagatctgagtcacttccaagagacatggctcgccgaggcccaggttcctgacagcgacgagcaattcgtacccgacttccactctgagaatctggccttccactcccccacaacacgtatcaagaaagagcctcagtcgcctaggaccgatccggctctatcatgctctcgaaagcctcctctcccctatcatcacggtgaacagtgtctgtacagctctgcctatgaccccccaagacagatcgcgattaagtccccggcaccaggagctctgggtcagagccctctgcaaccattccccagggcagagcaacggaacttcctgcggtcctcaggaacatctcagccccatcctggacacggttatctgggtgagcatagttctgttttccagcaaccgctggacatctgtcatagcttcacgagccaggggggagggcgagagcctctcccagccccttatcagcaccagctgtctgaaccctgccccccttacccgcagcagtcttttaaacaagagtaccacgaccctttgtatgagcaagccggacagccagcggtggatcagggaggggttaacggccacagatacccgggagccggtgtcgtgatcaagcaagagcagacagacttcgcttatgattctgatgtcacaggctgcgcatcaatgtaccttcacacagaaggattcagtgggccatcccccggtgatggagcaatgggatatggttatgagaagccattgcgaccctttccagacgacgtttgtgtagtgcctgaaaagtttgagggtgacatcaaacaggaaggagtgggggcttttcgtgagggacccccatatcagcggaggggagccctccagctatggcagttcctcgtggccctgctggatgatccaacaaacgctcacttcatagcatggactggtcgtggaatggaattcaagctcatcgaacctgaggaggtggcgcgactgtggggcatccagaaaaacaggcctgcaatgaactacgataaattgagtaggagcttgcgctattactacgagaaaggaataatgcagaaagtcgccggtgagcgctacgtgtacaaatttgtgtgcgaacctgaggctctgttctctctggccttccctgacaatcagaggccagccctgaaagctgagtttgataggccagtaagtgaggaagatacggtgcccctgtcgcatctggatgaatcccccgcttatttacctgagcttgccggacccgcacaaccatttggtccgaagggcggatattcctattag

SEQ ID NO: 28519 - DNA, 1455 bp, Artificial Sequence
  Description of Artificial Sequence: Synthetic coding sequence
atggaaaggcgtatgaaggccggttatctagatcaacaagttccttataccttcagttccaagagtccaggaaacggctcgctgcgagaggctctcattgggccactggggaaattaatggaccccggttcactgcctcccctcgactctgaggacctgttccaagatcttagccacttccaagagacttggctggccgaggcacaggttcccgactcagatgaacagtttgtgccggatttccacagcgaaaatttggccttccactctcctacaacgagaattaagaaggaaccccagagccctagaaccgacccagctctgagctgcagccgcaagccacccctgccttaccaccacggcgaacaatgtctgtattctagcgcctacgatccacccaggcagatcgccataaaatctcccgcacctggtgcactgggccagagcccacttcagccatttcctcgggctgagcagagaaactttcttagatcctcaggcacctcccagccacaccccggtcatggctatcttggcgaacattctagcgtgtttcagcaacccctggacatctgtcactcattcacgtcccagggcggaggacgagagcctctccccgcaccttaccagcaccagctgtcagaaccttgcccaccttacccgcagcagtcgtttaagcaggaataccacgatccgctttacgaacaggccggacaaccagctgttgaccagggaggagtgaacggccatcggtaccccggtgccggagtggtgataaaacaagaacagactgactttgcctatgattctgatgtaaccggatgcgcatctatgtaccttcatactgagggattcagtggacccagtcccggagatggagccatgggttacggctatgagaaacccctgcgcccttttccagatgacgtgtgtgtggtaccagagaagttcgaaggcgacatcaagcaggagggcgtaggggcatttcgagaaggtcccccatatcaaagaaggggcgctttgcagttgtggcagttccttgtagccctcctcgatgaccctaccaatgcacatttcatcgcttggaccgggagagggatggagttcaaactgatagagccagaagaagttgctcgattatgggggatacaaaaaaacaggcccgctatgaattatgacaagctatctcgctctctccgttactattacgaaaagggcattatgcagaaggtggccggtgagcggtatgtgtataagttcgtgtgcgaacctgaagcgttattctcactagcatttcccgacaatcaacgcccagccctcaaggctgagtttgacaggccagtttccgaagaagacactgttcctctgagccacttggacgaatccccagcttatctccccgaattggctgggccagcccaaccgtttggaccaaagggagggtatagttattag

SEQ ID NO: 28520 - DNA, 1338 bp, Artificial Sequence
  Description of Artificial Sequence: Synthetic coding sequence
atggatcctgggtcactgcctccactcgacagtgaggacttatttcaggacctgagtcacttccaggaaacctggctggccgaggctcaagtgccagactctgacgagcaatttgtgccagactttcactctgagaatttagcttttcactcaccaacaaccagaattaaaaaagaacctcagtccccgaggacggatccagcacttagttgcagcaggaagccccctctcccataccatcacggcgaacaatgcctctattcatccgcatacgacccccctaggcagattgccatcaagtctccagcacctggcgcattaggccagtctccactgcagcccttccctagagccgaacagcggaactttctacggagtagcggaacgtcccagccccaccccggacatggctatctgggcgagcactcttccgtctttcagcagccccttgacatctgtcattccttcaccagtcagggaggaggtagagagcctctcccagccccataccaacaccaactgtccgagccttgtcctccgtatccccaacagagttttaagcaggagtaccatgatccactctatgaacaggcaggccaaccagctgttgaccagggcggtgtgaatgggcaccgctacccaggagccggagtggtcatcaagcaggagcagacagacttcgcttatgattccgatgtgaccggctgcgctagcatgtacttacacaccgaaggcttctcgggaccaagccccggagacggtgctatgggatatgggtacgaaaagcctcttcgcccattccccgatgatgtgtgcgttgtccctgagaagttcgaaggcgacattaagcaggaaggcgtaggtgccttcagggagggacccccataccagagaagaggcgcactgcaactttggcaattcttggtagcgctcttggatgacccaaccaacgctcactttatcgcctggaccggtaggggcatggagttcaagttgattgaaccagaggaggtggctcgtctgtggggcatccaaaaaaacaggcccgctatgaattatgacaagctgtcccggtctctacgctattattatgaaaaggggatcatgcagaaggttgcaggcgagaggtacgtgtataagttcgtgtgtgaacccgaagcgttattttctctcgccttcccagacaatcagcgtcccgctcttaaggccgagtttgacagacccgtgagcgaagaagacaccgtgccacttagtcacctggatgagtcccctgcttatctccctgagcttgcgggacccgcacaaccgttcggacccaagggtggatatagttattag

SEQ ID NO: 28521 - DNA, 1293 bp, Artificial Sequence
  Description of Artificial Sequence: Synthetic coding sequence
atggaacggagaatgaaagcaggctatctcgaccagcaggtgccctatacattctcttcaaaaagtcccggtaatggcagcctacgcgaagccttgattgggcctctggggaaactgatggatcctggaagtttgcctcccctggattccgaggatttatttcaagatctgagccatttccaggaaacctggcttgcggaagcacaggtccctgattctgacgaacaattcgtccctgacttccattcggaaaacttagctttccactcacctacgacacgaatcaagaaggaaccgcaatcaccccgtaccgaccctgccctgtcctgttctcgcaagccaccattgccataccatcatggagaacagtgtttgtactcgtcctctgtgtttcagcagccacttgacatctgtcactcatttacatcacaggggggaggcagggaacccttacccgcaccgtaccagcatcaactaagcgaaccatgcccaccgtatccccagcaaagttttaagcaggaataccacgacccgctttacgagcaggccggacaacctgccgtcgaccaggggggtgtgaacggccatcgctatccaggcgcaggggtggtgattaagcaggaacagaccgattttgcctatgattctgatgttaccggctgcgcatcaatgtatctgcacacagaagggttctccggcccaagccccggtgatggagcaatgggctacgggtatgaaaagcccctcagacccttccctgacgacgtctgtgttgtgccggaaaaattcgaaggtgacattaagcaggaaggcgtaggtgcttttagagagggcccaccctatcagaggcgcggtgcactccagttgtggcaatttctggtggccctcctggatgacccaactaatgcacacttcatcgcttggaccggcaggggtatggaattcaaattaatcgaacccgaggaggtggcccgtctctggggcatccaaaaaaataggccagcgatgaactatgacaaattgagtcggtcactacgatactactacgaaaagggtatcatgcagaaagttgccggagagcggtacgtttacaagttcgtgtgcgaacctgaggctcttttcagcctggcctttcccgataaccaacgcccagccttaaaagcggagttcgaccggccagtgtcagaggaggacacagttccactgtcccaccttgacgagtctccagcctacctgcccgagctcgcgggtcctgctcagccattcggcccaaaaggaggatacagctactag

SEQ ID NO: 28522 - DNA, 1338 bp, Artificial Sequence
  Description of Artificial Sequence: Synthetic coding sequence
atggatcctggatcactacctccactggactcggaagatctttttcaagatctgtctcatttccaagagacctggctggcagaagcacaggtgcccgacagcgatgagcagtttgtgccggattttcactctgagaatctggcattccacagcccaacaacaagaattaagaaggaacctcagagcccacgtaccgatccagccctaagctgcagtcggaagccacctctcccataccaccatggcgagcaatgcttgtactcgtctgcctacgaccccccacgccaaatcgccatcaaatctcccgctcccggagctctcggccaatctcctctgcagcctttccctcgcgcagagcaaagaaacttcctgagaagctccggaacatcacagccccacccaggacacggctacctcggggaacacagctccgtgtttcagcaacctcttgacatatgtcattcatttactagccagggcggtggtcgagagcccctacctgccccataccaacaccagctctcggagccatgccccccatacccgcagcagtcttttaagcaggagtaccatgatcccttgtacgagcaggcaggccagcccgcagtggatcaagggggtgttaatggacacaggtatcccggagccggagtggtgatcaaacaggagcagaccgacttcgcttatgacagcgatgtcacgggctgcgcttctatgtatctgcatacggaggggttcagtgggccaagcccaggcgatggagctatgggttacggttatgagaaaccattgaggcctttcccagacgatgtgtgtgtggtacccgaaaagtttgagggtgacatcaagcaagagggcgtcggggctttccgagagggtcctccctaccaaaggcgaggtgcgttacaactgtggcagtttctcgttgcgctgcttgatgatccgactaatgcgcactttattgcgtggacgggccgtggaatggagttcaagctaatcgagcctgaagaggtcgcccgtctttggggcattcagaagaatcgccctgccatgaattacgacaaattgtcccgctccctccgatattattatgaaaagggtataatgcagaaagtcgccggagagcggtacgtgtacaaatttgtctgcgaacccgaggcattgttttcactcgctttccccgacaatcagcgtccggcactgaaggctgaatttgacagacccgtcagcgaggaagacactgttcctcttagtcacttggacgagtcacccgcttatctccccgagctggccggacccgctcaacctttcgggcctaagggaggatacagttactag

SEQ ID NO: 28523 - DNA, 1791 bp, Artificial Sequence
  Description of Artificial Sequence: Synthetic coding sequence
atggcaggaaggcgtgttaacgtcaatgtgggagtcctcggtcatattgattccgggaagaccgcactggccagagccttatcaactacagcgtccacggctgcgttcgacaagcaaccccagtcacgcgagcggggtatcaccctcgacctgggattctcctgtttttccgtccccctgcccgctcgactgcgcagtagcttacccgagtttcaggcagcgcctgaggcggaacctgagcctggagagccgctgctccaggtgactctggtggactgtcctgggcacgcctctcttattcgaactataatcggcggagcgcagatcatcgacctcatgatgctggttattgacgtgaccaaaggaatgcaaactcaaagcgccgagtgtctggtaataggacagatcgcctgtcagaaattggtggtagttcttaacaaaatagacctcctgccagaaggtaagcgccaggctgccattgacaagatgaccaagaaaatgcaaaaaaccctggagaataccaaatttcgcggagcacccatcatccctgttgcagccaaacctggcggtccagaggcgcctgaaaccgaagcaccccagggaatccctgaactgattgaattactgacatcccaaatctcaattcccactagagacccctcgggcccattcctcatgagtgttgaccactgctttagcattaaggggcagggcaccgtgatgacgggaaccattctgtccggctccatttctctgggagattctgtggagatcccagcgttgaaagtagtgaaaaaagttaaaagcatgcaaatgttccatatgcccattactagtgcgatgcagggggacagattgggtatttgcgtgactcaatttgacccaaagctgctggaaagaggcctggtatgtgctcctgagtccctgcataccgtacacgcggcactcatttctgtggagaaaataccatattttcgaggaccccttcagaccaaagccaagttccacatcaccgtggggcatgagactgtcatggggcgtcttatgtttttttctccagctccagacaacttcgatcaggaacctattttggattctttcaacttctcccaggagtacctgtttcaagaacagtacttgtcaaaggatcttacccctgccgtcaccgacaacgatgaggccgataaaaaggcaggacaggctacagagggccactgcccccgacagcagtgggccttggtggagtttgaaaagcccgtcacctgtcctcgcctatgtttggtgattggatcaagactggatgcggatatacataccaatacttgccgcctcgccttccatgggatcctgctgcacggtctcgaagaccggaattatgcagattcatttttgcctaggcttaaggtctacaagctgaaacacaaacatggtctggtggaacgagcgatggatgactatagcgtcatagggaggtcactgttcaaaaaggagaccaacatccagctgttcgtcggcttgaaagttcatctgtcaacgggcgagctaggaatcatcgatagcgcctttggccaatctggtaagttcaagatccacataccaggaggcctgagtcccgaatccaaaaagatcctgacacctgctttgaaaaaacgagctagggccggtcggggtgaagctacgagacaagaggagtccgccgagcgttctgagccctctcagcatgtagtcctgagtctcacatttaagaggtacgtgttcgatacgcataagaggatggtccaaagcccttag

SEQ ID NO: 28524 - DNA, 1233 bp, Artificial Sequence
  Description of Artificial Sequence: Synthetic coding sequence
atggccgctgaaatccattctaggccacagtctagccgaccagtgctgctgtctaaaattgagggtcatcaggacgcagtcaccgcggcactgctaataccgaaggaggacggggtgatcacggccagtgaggaccgcaccatccgagtatggcttaagcgtgattccggacagtattggccgtccatctaccacactatggcctccccatgttcagccatggcgtaccatcatgattccagaaggatcttcgtgggacaggacaacggcgctgtaatggaatttcacgtaagcgaggacttcaacaagatgaattttatcaaaacttatccagcacaccagaacagggtaagtgcgatcattttctctctcgccacggaatgggtgatcagcacaggacacgacaagtgcgtctcgtggatgtgcactcgctctgggaacatgctcgggcgacatttctttacctcctgggcctcctgtctgcaatatgatttcgacactcagtacgctttcgtgggcgattattccgggcagataaccctactgaaactggaacaaaatacctgctccgtaatcaccacccttaagggccatgaaggtagtgtcgcatgcctgtggtgggatccgattcagcgcttgctattcagcggggcatccgacaacagcatcatcatgtgggacatcggaggacgcaaggggaggacattgttgctgcagggacaccacgataaggtgcaaagcctgtgttatctgcaactgacacgacagctggtttcatgttcaagcgatggtgggatcgccgtctggaatatggatgtgtcccgagaagaggccccacagtggctggaatcagactcttgtcaaaaatgtgaacaacctttcttctggaacattaagcaaatgtgggataccaaaactttggggctgcggcagcaccattgccggaaatgtggacaggcagtttgcggtaagtgctcttccaagcgctcctcctatccagtaatgggctttgaattccaggttcgcgtgtgcgactcctgttacgattcaatcaaggacgaggataggacatccttggccacctttcatgagggtaaacataatataagccacatgtctatggatattgcccgaggcttaatggtcacttgcggtacagaccgaatcgtaaagatctgggatatgacacccgtggtgggctgctccctggcgaccggattttctcctcattag

SEQ ID NO: 28525 - DNA, 1092 bp, Artificial Sequence
  Description of Artificial Sequence: Synthetic coding sequence
atggcaggggacctgtccgccggtttttttatggaggagttgaatacgtatcgccaaaaacagggagtagtattgaagtaccaagagctgccaaactccgggccacctcatgaccgaagattcacctttcaggtgattatcgacggtcgcgaatttcccgagggggaaggtaggtctaagaaagaagcaaaaaatgcagccgcaaagctggccgtcgagattcttaacaaggaaaagaaagccgtctcaccactactcttgacaacgacgaattctagtgaaggactctctatgggcaactatatcgggctcattaaccgtattgcccagaagaaacgtttgaccgtaaattacgaacagtgcgctagcggcgtgcacggacccgaagggtttcattataaatgcaagatgggacaaaaggaatacagcattgggacaggaagtaccaagcaggaggccaaacagctggccgcaaagttagcatatctccagatactgtccgaagagactagtgttaagtccgactatctgtcgtctggatccttcgccaccacctgtgagtcccagtccaattccctggtgacatcgaccctggcttccgaatcttcttccgagggtgatttcagcgcagacacgtctgagatcaacagcaattctgattccctgaattccagtagtctgctcatgaacggcctgcggaacaaccaacggaaggccaagcgctcgctagcacctcgctttgacctccctgatatgaaggagacaaagtacaccgtggacaaaaggttcggtatggactttaaggagattgagctgatcggatctggaggatttggacaggtatttaaagccaagcataggatcgacggcaagacatacgtgattaagcgtgttaagtacaataacgagagcaagactaagtgcctgtttatacagatggaattctgcgacaaagggacactggagcaatggattgaaaaaaggcgaggtgagaagttggacaaagtcctggcactcgagctgttcgaacagattaccaaaggtgtggactacatacacagtaagaaaaaaaagaaaaaaaaaaagaagtag

SEQ ID NO: 28526 - DNA, 309 bp, Artificial Sequence
  Description of Artificial Sequence: Synthetic coding sequence
atggctggggacctcagtgccggatttttcatggaagagttgaatacatacagacagaaacagggagtggtgcttaagtatcaggagttgccgaatagtggccctcctcatgatagacggtttaccttccaggttataattgatgggcgtgaatttccagagggagaggggaggtcaaagaaagaagccaagaacgcagccgcaaaactcgctgtggagatcttgaataaggagaagaaagctgtgtcacccctcctcctcactacaaccaatagcagtgagggccttagcatgggcaactatatctag

SEQ ID NO: 28527 - DNA, 1656 bp, Artificial Sequence
  Description of Artificial Sequence: Synthetic coding sequence
atggcgggagacctctctgctgggttcttcatggaggagctgaacacctaccgccagaagcaaggtgttgttctgaagtaccaagagctgccaaacagtggacctcctcatgatcggaggttcacctttcaggtgattatcgacgggagggagttcccagagggcgaggggcgtagcaaaaaggaggcaaaaaatgccgctgctaagttggccgtggaaatccttaataaagaaaaaaaagcagtgtcccccctgctgctgaccaccacaaacagcagcgaaggcctgagtatgggcaattacataggtcttatcaataggattgcccaaaagaaaagacttactgtgaactacgagcagtgcgcatccggcgtgcatgggccagaaggcttccattataagtgcaaaatgggccagaaggagtattcaatcggtaccgggagtaccaagcaggaggccaagcagttggctgctaagctggcctatctccagatcctcagcgaggagacaagtgtcaagagcgattacctgtcaagcgggtccttcgctacaacttgtgagagccaatccaactcattggtcacatccacactggcctccgagagctcatcagagggagacttttccgctgatacaagcgaaatcaactcaaacagtgactcgctgaactcctccagtttgttgatgaacgggctgcggaataaccagagaaaagccaagcgctctctggctcccaggttcgatctcccggatatgaaggagactaagtataccgtggacaagagattcgggatggactttaaggagattgaactgattggatcaggcggattcggtcaagtttttaaggcaaagcacaggattgacgggaagacctatgtgatcaagagagtgaaatacaacaacgaaaaagctgagcgcgaagtgaaggccctggctaagctggaccatgtcaatatagtgcactataacgggtgctgggatggcttcgattatgatcctgagaccagtgatgattcactggaatcgagcgattacgaccctgagaactcaaagaactcatcacgcagcaaaactaaatgcctgtttattcagatggaattttgcgacaagggcacgctcgaacagtggattgaaaaacgacgcggagagaaactggacaaggtcctggctttggagctctttgagcagatcaccaaaggagtagattacatccactcaaagaagctaatccaccgggaccttaaaccctccaacatctttctggtggacacgaaacaggtgaagatcggggatttcggcttggtgaccagcctcaagaatgacgggaaacggacccggtcaaagggcacactgagatacatgagccctgagcagatttcctcccaggactacggcaaggaagtagacctgtacgcactcggtctgattctggcagaattattgcatgtgtgtgataccgcctttgagacaagtaagttcttcactgacctgagggatggcatcatttccgatattttcgacaagaaggagaaaaccctcttacagaaacttctgtcaaaaaaacccgaggaccgcccaaacacaagcgagattcttaggactctgactgtgtggaagaagtcgcctgaaaaaaacgaacgtcacacttgttag

SEQ ID NO: 28528 - DNA, 351 bp, Artificial Sequence
  Description of Artificial Sequence: Synthetic coding sequence
atggccggagatctatctgctggcttctttatggaggagctgaacacctatcgacaaaagcagggcgttgtactgaaataccaggaactgccaaattcaggcccaccccatgaccgccgatttacctttcaggtcatcatcgacggcagggagttccctgaaggggaggggcgatcgaagaaagaagctaaaaacgcagctgccaagctggccgtggaaatcctgaataaagaaaagaaggcagtctcgccattgctgctcaccaccaccaactccagtgagggactctcaatggggaattacataggcctcatcaacagaatagcacagaagaagagattaactgtgtag

SEQ ID NO: 28529 - DNA, 1533 bp, Artificial Sequence
  Description of Artificial Sequence: Synthetic coding sequence
atggccggagatctatccgctggcttcttcatggaggagttgaacacttacagacagaaacaaggggtggtcctgaagtaccaagagctccccaactccggcccaccccatgacaggcgattcacctttcaggtgatcatcgatggcagggaatttccggaaggtgagggtcggtccaaaaaggaggccaagaacgcggcagctaaacttgctgtggagatcctgaacaaggagaaaaaagctgtctcccccctcctacttaccacaaccaattcttccgaaggcctgtccatgggaaactatatagggcttatcaaccggatcgcacagaaaaagcgactaaccgtgaactatgaacagtgtgccagtggagtccatgggccagaaggcttccactacaaatgcaaaatgggacagaaggagtactccataggtactggatcaaccaagcaagaggctaagcagttagccgctaagttggcgtaccttcagatactgtcagaagagacctccgtcaagtctgattatctgtcctctggtagttttgccaccacctgtgaatcacagagtaattctctggtgacttctaccctagcctctgagtcatcctcagaaggggactttagcgctgacacttcagagataaatagtaactcagacagcttaaatagtagctcactgcttatgaatggtctaaggaataaccaacgaaaggctaagcggtcattggcaccaaggttcgacctgccagacatgaaggaaaccaaatacaccgtagacaaaagaaaggctgagagggaagttaaagctctggcaaaactggaccacgtcaatatcgtgcactataacggttgttgggacgggtttgattatgaccccgaaacctctgacgattcgctcgagtctagcgattacgaccccgagaactccaaaaatagtagccgctcaaaaactaagtgtctgttcatccagatggagttctgtgataaaggtacactggaacagtggatcgaaaaaaggcgcggagagaaattggacaaggtgctcgcccttgagttatttgaacaaattactaagggggtagactacatacactccaaaaaacttatccacagggatctgaagccgtcaaatatcttcctcgtggatacaaagcaggtgaaaatcggggattttggattggtaacaagtcttaagaacgatggaaagaggacacgctctaaggggaccctgagatacatgagccccgagcagatctcatcccaggactatggcaaggaagtcgacttgtacgccctgggcctgatcctcgctgagctgctgcacgtgtgtgacaccgcctttgaaacatccaaattcttcaccgatcttcgcgacggtatcatttctgatatattcgataagaaggaaaagacccttctccaaaaactcctgagcaaaaagcctgaggaccgacccaataccagtgaaatcttaagaacacttactgtgtggaagaaatctcccgagaagaacgaacgccacacctgttag

SEQ ID NO: 28530 - DNA, 4800 bp, Artificial Sequence
  Description of Artificial Sequence: Synthetic coding sequence
atgaacaaggcgccacagtccaccgggcctcccccagccccaagtcccggacttccccagccggctttcccgcctggacagactgcaccagtcgtttttagcaccccacaggccacacaaatgaacacccccagccagcctcgacagcacttctatcccagtagggcacagcccccatcttcggccgcttctagagtccagagcgcggctccagctagacctggccctgctgcacatgtctatccagcaggcagccaagtgatgatgatcccaagccaaatttcctatcctgcttcccagggcgcttactatattcctggtcagggacgtagtacttacgtagtgccaacacagcagtatcccgttcagccaggcgcacctggattttaccccggtgccagcccaaccgagtttggcacttacgccggtgcttattaccctgcccaaggcgtgcaacagtttccaactggggtggccccaactcctgtgcttatgaaccagccgcctcagatagctccaaagagagaacgcaaaacaatcagaatccgcgatcctaaccaaggaggcaaggatatcacagaagagatcatgtcgggcgcacgaaccgcaagtacccctacaccaccacaaaccggcggtggactcgagcctcaggctaatggagagactcctcaggtggcggtgatcgtacgaccagatgatcgtagccaaggagctattatagcagatcgcccaggactgcctggtcctgagcactccccctccgagtcccagccatcaagtcccagcccaactccatctcccagccctgtactggagcccggtagtgaacctaacttggcagtgttgtccattccaggcgatactatgaccaccatccaaatgagtgttgaagagagtacccctatcagcagggaaacaggggaaccttatcgactgtctcctgagcccactcccctcgcagagcctattctggaggtggaggttacgttatcaaagcccgtgccagagtcagagttcagcagctcacctttgcaagccccaactcctcttgcgtcacacacagtggaaattcatgagcccaacggtatggtgcccagcgaggatctggagcccgaggtggaatccagcccggaactcgccccacccccagcctgcccgtctgaatcacccgtgcctatagccccaactgctcagccagaggaattactcaacggggctccatcacctcccgctgtggacttatctccggtgagtgaacccgaggagcaagctaaggaggtgaccgcttccatggcaccaccaaccatcccttcagcaacccccgctaccgcccctagtgcaacctctcccgctcaggaagaagagatggaggaggaggaggaggaggaggaaggggaggccggagaggcgggtgaagctgaatcggagaaggggggagaggagctactgccgccagagtctactcccatccccgcaaatctatcccaaaacctagaggccgctgctgccacgcaagtggcagttagcgttccaaaaagacgacgcaaaattaaggaactgaataaaaaggaggccgtgggggacctcctagatgcgtttaaggaggcaaatcccgctgtgccggaggtagaaaaccagccacctgccggaagcaaccccggacctgagagcgaaggatccggagtgcccccacgccctgaggaagctgatgagacctgggattctaaagaggacaaaatacacaacgccgagaatatccagcccggagaacagaagtatgagtataagtccgaccagtggaagcctcttaacttggaagagaagaaacgctacgaccgggagtttctcttgggtttccagttcatattcgcaagcatgcaaaaacccgaggggctcccccacatctctgacgtagtcttggataaggcaaacaagacccctctccgcccactggatcctactagactgcaggggattaattgcggtccagattttaccccaagcttcgccaatttgggaagaacaacactgtctactagaggcccaccccgaggaggcccagggggagagctgcccagaggccctgcgggattggggcctcgacggagccagcaggggcctcgcaaagaaccaagaaagatcatcgccacagtcctcatgactgaggatatcaagttgaacaaggctgagaaggcatggaaaccgagcagcaaacggacagctgccgataaggatcggggtgaggaggatgcggatgggagcaagacgcaagatctctttaggcgtgtcagatccatcttaaataagttaacacctcagatgttccagcagttgatgaagcaggtgacgcagctagccattgacaccgaagaacggctaaaaggagttattgatctaatctttgagaaagccatctctgagcctaacttttccgtagcctacgccaacatgtgtagatgtttgatggccttgaaggttccaaccactgaaaaaccgacagtcaccgtcaactttagaaaactgttgctcaacaggtgccagaaagagttcgaaaaggacaaggacgatgacgaggtctttgagaagaaacagaaggagatggatgaagctgctaccgccgaggaacgtggtagactcaaagaggagttggaagaggctcgggacatcgctagacgcaggtccctcgggaatattaagttcatcggcgagctctttaaactgaagatgctgacagaagcaattatgcatgattgcgtggtcaagcttctgaaaaatcatgatgaggaatccctggaatgtctgtgccgcctgctgacgaccattgggaaggacctggattttgaaaaggccaagcctcgaatggatcaatacttcaaccaaatggagaagatcatcaaggagaaaaagacttcatccaggattcgattcatgctacaagatgttttagatctacgtgggtctaactgggtgcccagacgcggagatcaggggcctaaaaccattgaccagatccataaggaggccgaaatggaagagcatagagagcatatcaaggtgcagcaacttatggctaaggggagcgacaaacgtcgcggagggcctccaggaccccctatatcccgtgggcttcctttggtggacgatggaggctggaataccgtgccaatatcaaagggtagccgccctattgatacctctcgcctgacgaagatcacaaagccaggctcaatcgacagtaataatcagctgtttgctcctggcggtagactgtcttgggggaagggaagcagtggaggctccggagccaaaccatctgacgcggcatcagaagctgcccgtcctgcaacatctacgcttaataggttttctgcgctgcagcaggccgtgccgaccgagtcaaccgataatcgcagggtggttcagcggtcatctctgagtagagaacggggtgagaaagcaggcgaccggggagatcgtctggaacggtccgagcggggaggagatcgaggagatcgactggaccgtgctcggacacccgcaaccaagagatcatttagcaaggaagtcgaggagcggtcccgagaaaggccttctcaacctgagggactgaggaaagccgcttcccttaccgaagatagggataggggacgagatgcagtcaaacgggaggcagctctgcctcctgtgagccccctcaaggccgcactcagtgaagaagaactggagaagaagtccaaagccataattgaggagtatctccacctgaatgacatgaaagaagccgtgcagtgtgtgcaggagttagcttcacctagtctgctatttatatttgtaaggcacggggtggaaagtacactggagcgctccgctattgccagagagcatatgggtcagctcctccaccagcttttatgcgcaggccacctgagcacagcccagtattaccaaggactatatgaaatccttgaactcgcagaagacatggagattgatataccacatgtgtggctgtatctggcagaactagtgaccccaattcttcaggaggggggagtaccaatgggggagctattccgagaaatcaccaagccgcttcgccctctgggcaaggccgcatccctgttactagagatcctcggtctgctatgtaagagcatgggccctaagaaggtgggcaccctgtggagggaagccggactatcttggaaagaattcttaccagaaggccaggatattggcgcttttgtggctgagcagaaggtggagtataccctgggggaggaatccgaggcaccaggccagagggctctaccgtcagaggagttaaacaggcagctggagaaactgctcaaggagggcagcagtaatcagagagtgtttgactggattgaggcaaacctgtcagaacagcagattgttagtaacacactcgttagggcactcatgaccgctgtctgttacagcgccatcatctttgagacacccctgagagtggatgtcgccgtactgaaggcacgagcaaagttgctccagaaatatctctgcgacgagcagaaagaactccaggcactttacgcactgcaggccctggtggtgacactggagcaaccgcctaacttgctcaggatgttttttgatgcattgtacgacgaggatgtggtgaaggaggatgctttttattcttgggaatcgtctaaggacccagccgagcaacaaggtaaaggagtcgctctgaagagcgtaacagcctttttcaaatggctccgggaggcagaagaagagagcgaccacaactag

SEQ ID NO: 28531 - DNA, 4803 bp, Artificial Sequence
  Description of Artificial Sequence: Synthetic coding sequence
atgaataaagcccctcagagcaccgggccaccccctgcaccatctccagggcttccccagcctgcgttcccacctgggcagacagcaccggtggtgttctccacaccacaggccactcagatgaacacaccgagccaacccagacagcatttttatcctagtcgggctcagcctccatccagtgctgcttcgagggtccagtctgccgctcctgcacggccaggccctgccgcacacgtgtatcctgcaggcagtcaggttatgatgattccttcacagatctcttatccggcatcccagggggcttattacatacccggacaggggagatccacttatgtggtaccgactcaacagtatcctgtgcagccaggggcaccagggttctatcctggcgcttctcccaccgagtttggtacttacgccggagcctactatccagcacaaggagtacagcaattccccacaggggtcgctcccacgcccgttctaatgaaccagcctcctcagatcgcacccaaacgcgaacggaaaacaattaggatacgtgaccccaatcagggcggtaaggatatcacagaagaaatcatgagcggcgcaagaacggcctccactcccacccctcctcagaccgggggtggattggaacctcaagccaatggggagacaccacaggtggccgtgattgtgcggccagatgaccgcagtcagggcgctatcattgccgacaggccaggattacctggacccgagcacagccctagcgaatctcagcccagctcccccagccctaccccttcaccctcccctgtgctcgaacccggtagcgagcctaatctggctgtgctctcaatccccggagacaccatgaccactatccaaatgagcgttgaggaatcaactcccatttcccgtgaaaccggtgaaccctatcgactctcgcctgagcccacacctttagctgagcctatcttagaagtggaagtgacccttagtaagcccgtacccgaaagtgagttctcatcatcccctctgcaggcccctacccctctcgcaagccacaccgtcgaaatccacgagccaaatgggatggtgccttctgaggatctagaaccagaagttgaatctagtccagagttggctccgcctccagcctgtccttcggaaagtcccgtcccaatagcacccaccgcccagcccgaggagctgctgaacggtgcccctagcccgccagcagtggacttatccccagtgagcgaacccgaagagcaagcaaaggaggtgaccgcgagtatggcacctcccactattccgtctgcaacgcctgctacagccccaagcgcgaccagccctgcccaagaagaagaaatggaggaagaagaggaggaagaggaaggagaagccggagaagccggagaggccgagtcagaaaagggcggtgaggaacttctgcctccggagtctactccgatcccggctaatttgtcgcagaacctcgaagctgccgcagcaacccaggtcgcagtgagtgtccccaagcgcaggcgcaaaattaaagagctcaataaaaaggaagctgtaggagacctgctcgacgcattcaaagaagcaaatcccgctgtacctgaagtggaaaaccaaccgccagccggatccaatcccggtcccgagtctgaaggctctggagtgcccccaaggcctgaagaagctgacgagacatgggactcgaaagaagataagattcacaacgctgagaacatccaacctggggaacagaagtatgaatacaagagtgatcaatggaaacccctcaacttggaggaaaagaaaaggtacgacagagaatttcttcttggcttccagttcatttttgcctcaatgcaaaagcccgagggactgcctcacattagcgatgtagtgctcgataaggccaacaaaaccccactgagaccgctagacccaactagactccagggaattaattgcgggcctgactttactccgtcattcgccaatcttggacgcactaccctcagcactaggggaccccctcgagggggaccaggaggggagctgcctcgtggcccacaagctggcctcggtcctaggcggtctcaacaggggccacgaaaggagcctcgcaagataatcgctaccgtcctaatgaccgaagacattaagctcaacaaagcagagaaggcgtggaaaccaagctcaaaaagaacagccgctgataaagatcggggtgaagaagacgcagacggttctaagacacaagaccttttccgcagggtccgctcaatcttgaacaaactcaccccacaaatgttccaacagttaatgaaacaggtgacccagcttgccatcgataccgaagagcgcctgaagggagtcatcgacttgatcttcgaaaaagctatctcagaacctaatttctccgtggcatacgctaatatgtgtagatgtctcatggcactcaaggtccccactactgaaaaacccaccgtcacggtgaatttcagaaaactattacttaataggtgtcaaaaggaatttgaaaaggacaaagacgacgacgaggtcttcgaaaagaagcagaaagaaatggacgaggccgctaccgctgaagaacgcggacgcctaaaggaagagctagaagaagcaagggacattgcaaggcgtagatcactggggaacattaagttcatcggcgagttgtttaagctcaaaatgctgactgaggccatcatgcacgattgtgttgtgaagctgttaaagaatcacgatgaggaaagcctggagtgtttgtgtcggctcctgaccactattggaaaggatctggactttgaaaaggcgaaacccaggatggaccagtatttcaaccagatggagaaaattattaaggagaaaaaaaccagctctaggattagatttatgttgcaggacgtcctggacctccgcggatcaaactgggttcctaggagaggcgaccagggacctaaaactattgaccaaatccataaggaagccgaaatggaagagcatagggagcatataaaggtacaacaactcatggcgaaaggaagcgacaaacgaagagggggtccacccggtcccccaatttctaggggcctcccacttgtagatgatggaggttggaatacagtgccgatttccaaagggtcccgacccatcgacacgagccgcctcacaaagattactaaaccagggtccatcgactctaacaaccaattgttcgcaccgggaggtcgcctctcatggggaaaagggtctagtggaggcagcggtgccaagccttcagacgctgctagcgaagccgctaggcccgctactagcaccctgaacagattcagtgctctgcaacaggccgtgcctactgagtcaacagacaacaggcgggtggtgcagagaagcagtctgtcccgagaacggggagagaaggccggagatcgcggagatagactggaaaggtctgagaggggcggagaccggggtgaccgcctggatagggcacggacccccgctacaaagcggtccttctctaaggaggtagaggagaggtccagggagcggccttcacagcccgaaggcctaagaaaggcggcttccttgactgaagaccgcgatcgcggtcgagatgccgtgaagagagaagccgctttaccacctgtgtctcctctgaaagctgccctgtcagaggaggagctcgaaaaaaagtccaaagctattatcgaggaatacctgcacctgaacgatatgaaagaggccgtgcagtgcgtacaggagctggcctccccaagtctgctttttatctttgttaggcatggggtggagtccactttagagagatccgccatagcacgtgagcacatggggcagctcctgcaccagctgctttgcgccggacacttgtcaactgcacaatattatcaaggactctacgagatcctggagttggccgaggatatggaaatcgacatcccacacgtatggttgtatctggccgaactagtgacacctattctgcaagaaggaggggtcccaatgggagagctgtttagagagatcaccaagccactcagacctcttgggaaagcagcttccctgcttctcgagattcttggcctgctgtgtaagtccatgggccctaaaaaggtcggtaccttgtggcgggaggccggtctcagctggaaagaatttttgccagaaggacaggacatcggcgctttcgttgctgagcagaaggtggaatatactttgggagaggaatccgaggccccaggtcaacgggctctgccaagcgaggaactgaatcgacaactggagaagctcctaaaggaaggatcaagcaatcagagggtcttcgactggattgaagccaatctgtccgaacaacaaattgtaagcaatacactcgtgagagctctcatgactgctgtatgctattccgcaatcattttcgagacacctctccgtgtggatgtggccgtgttaaaggcacgggctaagctgctgcagaaatacctctgcgatgaacagaaggaacttcaagccctgtatgcactgcaggctctcgtcgtgacactcgagcaaccgcctaatctcttgcgaatgttttttgatgccctatacgacgaagacgtggttaaggaggatgccttttacagttgggaatcctccaaagatcctgctgaacaacaaggtaagggggtcgccctaaaatccgtgaccgccttcttcaagtggctgagagaagccgaggaggagagtgaccacaactag

SEQ ID NO: 28532 - DNA, 4800 bp, Artificial Sequence
  Description of Artificial Sequence: Synthetic coding sequence
atgaataaggctccacagtcaacagggccaccacccgctccctcaccaggcctccctcagccagcctttcctcccggacaaacggcaccggtggtgttcagcacaccacaggccactcagatgaacacccctagccagccgcgtcagcacttctacccaagcagggcccagcccccttcctccgctgcctctagagttcaatcagccgctcctgcaagaccgggtcccgctgcccatgtctaccccgctggatcgcaggtgatgatgattccctctcagatctcctaccctgcgtctcagggggcttattacatcccgggtcaagggagaagcacttatgtcgtgcccacccagcagtacccggtccaaccaggagcccctggattctacccaggggcatccccaactgagttcggtacctatgctggcgcttactacccggcacagggcgtgcagcaatttccaaccggcgttgccccaactcctgtgctcatgaaccagccaccacaaattgcccctaaacgcgaacgcaaaacaattaggatacgggatcctaaccagggagggaaagatataaccgaagagattatgtcaggagccaggactgctagcacccccaccccaccccagaccgggggaggcctggagccgcaagctaacggagagaccccgcaggtagcagtgatcgtaagaccagatgacagatctcagggcgcaatcatagctgatcgcccagggctccccggtccggagcactcaccctcggagtcccagccatcaagtccatctcctactcctagccctagccccgtcctggagcccggttcagaacctaatctggcagtgctgagtatccctggggacaccatgaccactatccagatgtcggttgaagagtccacccctatctcccgcgaaacaggagaaccttaccgtctgtcccctgagcccacccccctggcggaacccattctggaagtcgaagtgacgctgagcaagcccgtgcctgagtccgaattttcttcttccccgctgcaagctcccaccccactggcgtcacacacggtggaaatccacgagcctaatggtatggtaccatccgaggacttagaaccagaggtggaatccagccctgagttggcccctccccctgcatgcccttcagagagtcccgtgcctatcgccccaacagcccagccagaggagctgcttaatggagccccaagccccccagctgtcgacctgagtccagtgagcgagccagaagagcaagccaaggaagttacggctagcatggccccaccaactattccgagcgcgactccagccacggccccatccgccacttctccggcacaggaggaggagatggaggaagaggaggaggaggaggagggagaggctggagaggccggagaggctgaatcggagaagggaggtgaggaactgctgcctcccgaatcaacgcccattccggcaaatctgagccagaatctggaggcagctgctgccacacaggtggccgtgagcgtacccaaacgcagaagaaaaatcaaagaactgaacaagaaagaggccgtcggagacctgctggatgcattcaaagaagcaaaccctgcagtacccgaagtggagaatcagcctcccgctggcagcaatccaggccctgagagcgaaggaagcggtgtcccaccacggcctgaggaagcagatgaaacatgggattccaaagaggacaagatccataacgcagagaatatacaacccggagagcagaaatacgagtacaaatcagaccagtggaagcctttaaatctggaagaaaaaaagcgttacgaccgggagtttctgctgggattccagttcatcttcgccagcatgcagaaacctgaagggttaccacatatttctgacgtggtcctggacaaggctaataagactcctttgcgacctttagaccccacacgccttcagggcattaattgcgggcctgattttacaccatcattcgctaatttgggaaggacgaccctgagcactaggggaccacctagaggcggtcccggaggtgagcttccccgaggccctgcaggcctgggcccaaggcgctcgcagcaggggcctcggaaggaaccacgaaaaattattgccactgtgctcatgaccgaagatattaagctgaataaggctgagaaagcttggaaaccaagcagcaagcggaccgcagcagacaaagatcgaggagaggaggatgcagatggctcaaaaactcaagatctgttccgacgcgttcgctcgattctgaataagctaaccccccagatgttccagcagctgatgaaacaggtcacccagctcgccatcgatacagaagaaaggttgaaaggagtgattgatttgatatttgagaaagcaatctcagaacctaacttcagtgtggcctacgcaaacatgtgtcgttgtctgatggccctgaaggtccctacaactgagaagccgacggtgaccgtgaactttagaaaactgttgcttaaccggtgtcagaaagagttcgagaaagataaggacgacgatgaagtctttgaaaagaaacagaaggaaatggatgaggccgctaccgccgaggagaggggcagattgaaggaggagctggaggaggctcgagatattgcaagaaggcgctccctgggcaatatcaaattcataggtgagctgtttaaactgaagatgcttactgaggctataatgcacgattgtgtggtgaagctccttaagaaccacgacgaggaatccctggagtgcctgtgcaggttattgaccacaatcgggaaggatttggactttgagaaggccaaaccaaggatggatcagtactttaatcaaatggagaaaatcattaaggaaaagaagacatcttccaggattcgtttcatgctgcaagacgtcctagacctaaggggcagcaattgggtaccccgacggggtgaccagggacccaaaacaatcgaccagatccataaggaagctgagatggaggaacatcgcgagcatataaaagtgcaacagttgatggctaaagggagtgataagcgaaggggaggtccaccaggaccacctatcagtcggggtttgccacttgtagatgatggaggatggaacactgtcccaatcagcaaagggtctaggccaatcgacacatcgcggctgacaaaaattaccaagcctggctccatcgattctaacaatcagttgtttgcccctggcggaagactgtcttgggggaaggggtcctccggcggaagtggggcaaagccatcagacgcagcatcggaggccgctcggcctgctacgagcacactcaatcggttttccgcactgcagcaggccgtgccaaccgaatctaccgataatcggagagtggtgcaacggtcgagcctatcccgcgagcgcggagagaaggcaggagaccggggagatagattggaacgtagcgagagaggcggtgatcggggagaccgactggaccgggctagaacaccagcaactaagcggagcttcagtaaggaggtagaggagcggagcagagagcgtcccagccagccggaaggactgagaaaagccgcatccctaaccgaggacagagaccgagggagggacgctgtaaaaagagaggccgcattgccacccgtctcccctctgaaagccgcactgtcggaagaggagctagaaaaaaaatccaaggccatcattgaggagtatcttcacctgaacgatatgaaggaggcagttcagtgcgtgcaagagctggcgagtccaagcctgctgtttatctttgtgagacacggcgtggagagtactctcgagcggagcgcaatcgcaagagagcacatgggccagttgttacaccagttgctttgcgcaggccatcttagcactgctcaatattaccagggactctatgagattctggaacttgctgaggatatggagattgacattcctcacgtttggctgtatctggctgaactggtgacccctatcttacaggaagggggtgtcccgatgggggaactgtttcgggaaataaccaagcctctcagacctctggggaaggctgcatccctgctcctggagatcctgggactcttatgtaaatctatgggtcccaagaaagtggggaccctttggcgcgaagccggtctcagctggaaagaatttctgcctgagggacaagatattggcgcattcgtggccgagcagaaggtcgaatacacactgggagaggagtcagaggcaccgggacagagggcactgccatcggaggagttgaaccggcaattggaaaagttattgaaagaaggctcaagcaaccaacgcgtgtttgattggattgaagccaacctctctgaacagcagatcgtctccaacaccctggtgagggcactgatgacggctgtgtgttactctgctattatattcgagactcctcttcgcgtggacgtcgccgtgctcaaggcccgagctaagttactccaaaagtatttatgcgatgaacagaaagagctccaagctctctatgcactccaagctcttgtggtgacattggagcagccccctaacttactgcggatgttcttcgacgctttgtacgatgaggacgtagtgaaggaggacgctttctactcctgggagagcagcaaggaccccgctgagcagcagggcaaaggcgtggccctgaaaagtgtgacggcgttctttaaatggctccgagaagctgaggaagagtccgaccacaattag

SEQ ID NO: 28533 - DNA, 4308 bp, Artificial Sequence
  Description of Artificial Sequence: Synthetic coding sequence
atgaaccaacccccacaaattgcgcctaaaagagagcgcaagaccataagaattcgagatcccaatcaaggaggaaaggacattaccgaggagatcatgtccggggctcgcaccgctagcacgcccaccccgcctcagactggcggtggtcttgaaccccaggcaaatggcgagaccccccaggtggccgtcattgtgcgtcctgacgacagatcccagggcgcaattatcgccgacaggccaggcctgcctgggccagaacatagtccatccgagtctcagccgtccagtccatctccaacaccctcaccttctccggtcctggagcccggatcggaacctaacctggccgtcctgagcatccccggagatactatgacaacaattcagatgtccgtggaggaaagcacccccataagcagggagaccggagaaccttatcggctcagtcccgaacccacacctctggccgaacccatcctcgaggtcgaagtcacactgtcgaaacctgtacccgaaagcgaattcagcagcagtcctctgcaggctccaacccccctcgctagtcacacagtggaaattcacgagcccaacggtatggtgcccagcgaggatctggagcctgaggtggagagcagtcccgaacttgcaccaccaccggcttgtcctagtgaatctcctgttccaatagcccctactgcccagccagaggagctgctgaatggggcaccgtccccgccagccgtcgacctgtcccccgttagcgaaccagaggaacaagctaaggaagtgaccgctagtatggctcccccaactataccgtcagcaaccccggcaacagccccatccgcaacctcacccgcacaggaggaggaaatggaagaggaagaagaggaggaagagggagaagctggagaagctggcgaggccgagagcgaaaaagggggagaggagctgctgccgccagaatcgacacccatcccggcaaacctgagccaaaatttagaggccgctgcagctactcaggtggccgtgtcagttccgaaacgtcgacggaaaatcaaggaactaaacaagaaggaagcagttggagatttgctcgatgcatttaaagaggctaacccagcagtgccagaggtggagaaccagcctcctgcaggttcaaatcccggacccgaatcggaagggtccggggtcccccctaggcctgaggaagcagacgagacatgggactccaaagaggacaagatccacaatgccgagaacatacaacctggtgaacagaaatacgaatataagtcagaccagtggaagccgctgaacctggaggaaaagaaacggtatgacagagaatttctccttgggttccagtttatctttgcaagcatgcagaagccagaggggctgccccatatcagtgatgtggtgctcgacaaagccaacaagacacctctccggcctttggaccccacccgattgcagggcatcaattgcggtccagatttcacacccagtttcgccaacctgggaagaacaactctctctactagagggccaccgcgtggcggaccaggaggcgaactgcctcgcggacctgctgggctaggccctagaagaagtcaacaagggccacgaaaggaacccaggaagataatcgccaccgtactgatgaccgaggacatcaagcttaacaaggctgagaaagcctggaaaccctccagtaagcgcacagccgcagacaaagatcgcggtgaggaggatgccgacggaagtaagacacaggatctgttccgtagagtgagaagcatcctcaacaaactgactccccaaatgtttcagcaactaatgaagcaggtaactcagctagctatcgataccgaggaaagactgaaaggagtcatcgatctgatcttcgagaaggccattagcgagccaaactttagtgttgcatacgccaacatgtgccgatgtctgatggccctgaaagttccaaccaccgagaagcccacggtcacagtgaacttcaggaaacttttgttaaatcgctgtcagaaggagtttgagaaagataaggacgacgacgaggtgttcgaaaagaaacagaaggagatggatgaagctgccaccgctgaagagaggggacggttaaaagaagagctggaggaagccagggatatagccagacggaggtctttgggcaatataaagtttatcggtgagctctttaagctcaaaatgttaaccgaggctattatgcacgattgcgtggtgaagttactcaagaaccatgacgaggagagtctcgagtgcctgtgcagactgttgacaacgatcggcaaggatcttgatttcgagaaggccaaaccgagaatggatcaatacttcaatcagatggagaagattatcaaggaaaaaaaaaccagctctcgcatccgctttatgctgcaagacgtgctggatctgaggggtagtaattgggtgccgaggagaggagatcaaggtcccaagaccatagatcaaatccataaagaagcagagatggaggagcaccgagagcacatcaaggtgcagcaattgatggccaagggatctgacaagaggaggggcggaccacctggtcctccgattagcagaggcttacccttagtagatgatggcggttggaacaccgtgcctatctccaagggtagccgcccaatcgatactagtcggctgaccaagataactaaaccagggtctatagattccaataaccagttgtttgctcctgggggtcggctgtcatgggggaaaggcagctccggcggttccggagcaaagccgtctgatgccgcatcagaggccgctaggcccgcaacaagcacacttaaccggtttagcgccttacagcaagccgtacctactgaatctaccgacaatcggagagtggtccagcggtcttctctgtcccgcgagagaggcgagaaagccggtgaccgaggcgaccggctcgagagatcagaacgcggaggagatcggggagaccgccttgacagagccagaacccctgccacaaagcgcagctttagtaaggaagtcgaggaaaggagccgagaaagaccttcacaacctgagggtctcaggaaggccgcttctctgacagaggaccgtgaccggggacgtgacgcagtcaagagagaagcggctcttccaccagtctctcccctcaaagctgctctaagtgaggaggaactcgagaagaaatccaaagcaataatcgaggagtatctgcatctgaacgacatgaaagaagccgtgcagtgcgtgcaggaactcgcgagtcccagcctgttgttcattttcgtgcggcacggtgtcgaatcaaccctggaaagaagtgctatcgcgcgtgagcacatgggtcagctgctccaccagctgctctgtgctggtcatctgagcacggcccagtactatcagggactgtacgagattttagagctcgctgaggacatggagattgatatcccccacgtctggttgtatctggccgagttagtgacaccaatcctccaggaaggaggcgtgccaatgggggagctgttccgggaaataactaaacctctgcggcctttaggaaaggccgcatccttgcttctggagatactcggactactgtgtaagtccatgggccctaagaaggtggggacactgtggcgggaggccggtctgtcatggaaagaatttcttccagagggccaggacatcggcgcattcgtggccgaacaaaaggtggagtacactctgggtgaggagtctgaagctccaggtcagagagccctccctagtgaagaacttaatcggcagttggaaaaactacttaaagagggtagctccaaccagcgagttttcgattggattgaagcaaacctctctgagcagcagatcgtgagcaatactctcgtgagggccctgatgactgctgtgtgctacagtgccatcatttttgagacgccactgagggtggacgtggccgtcttgaaggctcgggcaaaactgctgcagaagtacctgtgtgacgagcagaaggagttgcaagcactgtacgctctgcaggccttggtggttacgctggaacagcccccaaacctgctgagaatgttctttgatgcattgtacgatgaagacgtggtcaaggaagacgcattttatagctgggagtcatccaaagaccctgcagagcagcaagggaagggagtcgcattgaaatccgtcacggcttttttcaaatggctgcgggaggcagaggaagagtccgaccacaactag

SEQ ID NO: 28534 - DNA, 4821 bp, Artificial Sequence
  Description of Artificial Sequence: Synthetic coding sequence
atgaataaggcgcctcagtctaccggaccacctcccgcaccctcgccaggcctgccccagccggcatttccgcctggccagacagccccagttgttttctctacacctcaggcgacacagatgaacactccttcacagcctcgacagggtgggtttcgcagcctgcaacacttctacccatccagagcccagccaccttcctcagcggcttcacgagtgcaatcagctgctcctgccaggccgggacctgccgctcacgtgtaccctgccggtagccaggttatgatgatccctagtcaaatctcgtatcctgctagccagggggcatactatataccaggccagggacggtccacctacgtagtacccacacagcagtacccggtccaacccggtgcccctgggttctacccaggggcttcccccacagagttcgggacctacgccggagcatattatccagcacagggggtccaacagttcccaactggcgtggcccctacgccagtgcttatgaaccagccaccacagatagccccaaagagagagagaaaaactatccggataagggacccaaaccaggggggtaaagatatcaccgaagaaattatgtccggggcacgcaccgccagtacacctactcctccacagactggtggcggattggagccacaggctaatggtgagacaccacaggtggctgtaattgtgcgccctgacgaccggtctcaaggggcaatcatcgctgatcgccctgggctccctggacccgagcactccccttccgaatcccagcccagcagtccctctccaactcccagccctagcccagtgctggagcctggatctgagcctaacttagcagtgctgtctatccccggagacaccatgactaccattcagatgagtgttgaggagtcgacgccaatcagcagggagacaggcgagccataccggctgagccctgagcctacacctctcgccgagcccattctggaagtggaggttactctctcgaaacccgtgcctgagtcggagttttctagcagtcctctgcaggctcctactcccttagccagtcatacggtcgagatacacgaacccaacggcatggttccttcagaagacctcgaacctgaggttgagagttccccggagctggcaccgcctccggcatgtccatccgagagccctgtgcccatagcaccgactgcacagcccgaagagctgctcaacggcgctccaagcccacccgcagtagacctgtcacctgtgtccgaacctgaggagcaggctaaagaggtcacggcctctatggcgccacctactatccctagcgccactcccgcaaccgccccaagtgctacgtctccagcccaagaggaagagatggaggaggaagaagaagaggaagaaggagaagcaggagaggcgggagaggccgagtcagaaaagggcggagaggaactgctcccccctgagtcaactcccattcctgccaacctctcacagaacctcgaagccgcagcagcaactcaggtggcagtgtcggtaccaaagcgtcggaggaagatcaaagagctgaacaaaaaagaggctgtgggtgacttattagatgcgtttaaggaggctaacccagcagtgcccgaagtagagaatcagccccctgccggatccaatccaggcccagagagcgaggggtcaggcgtccctccgaggcccgaagaggccgatgagacgtgggactcaaaggaggacaagattcataacgccgaaaatattcagcctggagaacagaagtacgagtataagagtgaccagtggaaacctctcaatttggaagagaaaaagcgctacgatcgggagttccttctgggcttccagtttatttttgcttcaatgcagaaacctgagggccttcctcacatcagcgacgtggtactcgacaaggctaataaaacacccctgcgacctttagatcctacccggctgcagggaattaactgcggcccagattttacccccagctttgcgaatctggggaggactactctctctacacgaggtcccccacggggaggcccaggcggtgaattacctcgcggtcctgccggacttgggcctaggcggtctcaacagggccctcgcaaagaacctcggaagattatcgccaccgttcttatgacagaggatattaagttgaataaagccgagaaagcgtggaagcccagctccaaaaggacagctgccgacaaagatagaggtgaggaagatgcggacgggagcaaaacacaagatctgtttagaagggtgcggagtattcttaataagttgactccgcaaatgttccagcagctgatgaaacaggtgacacaactggccattgacacggaggagcgactgaaaggagtgatcgatctcatcttcgagaaggcaattagtgagccaaacttctctgtcgcatacgcaaacatgtgtagatgcctgatggcattgaaggtgccgactaccgagaagcctacagtgacggtgaacttcagaaagctgctcctcaaccgatgtcagaaagaattcgaaaaggacaaagacgatgatgaggtctttgagaagaagcagaaagagatggacgaggctgctaccgctgaagaaaggggccgattgaaagaggagttggaggaggctcgtgatatagcaaggcgcagaagtctgggcaacatcaagttcattggcgagctctttaagcttaaaatgctgacagaggcgattatgcatgattgtgtcgttaaactactgaagaatcacgatgaagagtctctggagtgcctctgtagactcctgacaacaattggcaaggatcttgactttgagaaggcaaagcccaggatggatcagtattttaatcagatggagaagattatcaaagagaaaaagacgagttcccgaatcaggtttatgttgcaggatgtcctcgatttgcgcggtagtaattgggtgccgagacggggagaccaaggacctaagacgattgaccagatccacaaagaggcagagatggaagagcaccgcgagcacattaaagtgcagcagcttatggcgaagggcagcgacaagcgcagaggtgggccacccggtcctccgatctccagggggctgcctctggtggacgatggaggctggaatactgtgcccatcagtaaagggtctagacctattgatacttctcggctgactaagatcaccaagcccggaagtatagactccaacaatcagttgtttgccccaggcggtcgccttagttggggcaaaggctctagcggcggtagtggggcaaagcccagtgacgcggcatcggaagccgctaggcctgccactagcactctgaaccggttcagcgccttacagcaagccgttcccaccgagtctactgacaacagacgggtagtccagcggagtagtctgtcccgggagcggggagagaaagcaggcgataggggagaccgcctggaacgaagcgaaagggggggagacagaggcgaccggcttgacagagcgaggacgccagccaccaagaggagtttctccaaggaagtcgaggagcgcagtcgtgaacgtccctcccagcctgaggggcttaggaaggctgccagtctgaccgaagaccgcgacaggggcagggacgctgtcaagcgagaagccgcactgcctcctgtttctccattaaaggccgcactgagtgaagaagagctggaaaagaagagcaaggctatcattgaggagtatctgcatctgaatgacatgaaagaggcggtgcaatgtgtgcaagagctggcaagtccatctctcttgttcatctttgtgcgtcacggggtggagtccaccttagaacgaagtgcaatcgccagagaacatatgggccagttgctccatcagctgctctgtgccggacatcttagtaccgctcagtactatcagggcttatatgagattctggaactggcagaggacatggaaattgatattccccatgtctggctgtacttggccgagttggtcactccaatattgcaggagggaggggttcctatgggcgagctgttccgcgagattactaaacccctcaggcccctaggcaaggcggcttctctgctgctggagattcttggtctgttatgtaagtctatgggaccaaaaaaggttggcaccttatggagagaggccggtttgtcttggaaggaattcttacctgaggggcaggacataggagctttcgtggctgaacagaaggtcgagtacacgctaggggaggagagcgaagctccagggcagagagctctgccctccgaggagctgaaccgtcagctcgagaaactgctgaaggagggaagcagtaatcaaagagtcttcgattggatagaggccaatttatccgagcagcagatagtgtctaatactctggtgcgggctctgatgacagctgtgtgctacagtgcaatcatcttcgagactccactgagggtcgacgttgcagtgctgaaggcacgggctaagctgttgcagaagtacttgtgtgatgaacagaaggaactgcaagctctgtacgcacttcaggcactcgtggtcaccctcgagcagccccctaatctgctgaggatgtttttcgatgccctgtacgacgaggatgtcgtgaaggaggatgccttctattcatgggagtcctcaaaggatccagcggagcagcagggcaagggcgtagctttaaaatcagtcacagcctttttcaaatggctaagagaagcagaggaggagagtgaccataattag

SEQ ID NO: 28535 - DNA, 4821 bp, Artificial Sequence
  Description of Artificial Sequence: Synthetic coding sequence
atgaacaaagccccacagagcacggggcctccccctgccccttccccaggcctgcctcagcccgctttccctccagggcagaccgcccctgtagtgttctccacgccccaggcaacacagatgaatacaccatcacagcccaggcaggggggatttcggtcacttcagcacttttatccaagtcgcgctcagccaccatcttctgccgctagtcgcgttcaatctgccgctcccgctcggcctgggcctgcagctcatgtgtacccagccggaagtcaagtgatgatgattccatctcaaatttcataccccgctagtcaaggcgcatactatattccaggccagggtcgctcaacttacgtggtgcctacccagcagtaccccgtacagcctggagccccaggcttctaccccggagcaagtcccaccgagttcgggacctacgccggagcttattaccctgcccagggagtgcaacagttcccaacgggggtggccccaaccccagtcctcatgaatcaaccgccacagatcgccccaaagagagagaggaagacaatcagaatacgggaccccaaccaggggggaaaggacattacggaggagatcatgtctggagccaggactgcaagcacaccgaccccgccacaaaccgggggtggcttggagcctcaagcaaatggtgagacaccccaggtggcggttatcgtgaggcctgacgatcgctcgcaaggcgcaataatagctgataggcctgggctccctgggcctgagcattcaccatcagagtcgcagcccagctcaccatcacccacaccttccccaagtcccgttctagagccaggctccgagccgaacttagccgtgctgtccatccccggtgacactatgacgaccattcagatgtccgtggaggagagtacacccatatcccgagaaactggcgaaccctatcggctgtccccagaaccgacaccactggcagagcccatcctggaggttgaggtaaccctgagcaaacccgtcccagaaagcgaattctcttcctctccccttcaggcaccaacacccttagccagccacaccgtcgagatacatgagcctaatggaatggtgcctagcgaggatttggaacccgaggtggaaagttctccagaactcgcacctcctcctgcttgtcccagtgagtcccctgtgcctattgcccctaccgctcagcccgaagaactcctcaacggtgcacccagtcctcccgcagttgatctttcgcccgtaagcgaacccgaagagcaagccaaggaagtgacagcgtcaatggctcctcccactattccaagcgccacgccggctacagccccttccgctacttcgcctgcacaagaggaggagatggaggaggaggaggaggaggaggagggcgaggccggtgaggctggtgaggcggaaagcgagaaggggggagaagagctcttaccaccagagtctactccaatccccgcaaacctctcgcagaatctggaagctgccgcagcaacacaggttgcggtttctgtccccaagcggaggcgaaagatcaaagaattgaataaaaaagaggcggtgggtgatctgcttgacgccttcaaagaagctaatcctgccgtccccgaagtcgaaaatcaacccccagccggttcaaaccccggtcccgaaagcgaagggagcggagtgccccctagaccagaagaggccgatgagacatgggactcaaaggaggataaaatccacaacgccgagaatatccagcccggagagcagaagtacgaatacaaaagcgatcagtggaagccactgaacctggaagagaagaaaaggtacgatcgggagttcttactcggctttcagttcattttcgcgtccatgcagaaacccgaaggccttcctcacatctctgacgtggtgttggacaaagccaataagaccccgctgcgacctctcgatcccacaaggctgcaaggaatcaattgtggtcccgactttacaccgagtttcgccaatctcggcaggaccacgctttcaaccaggggacccccacggggtggcccaggtggagaactaccccgagggcctgccggacttgggcctcggaggagccagcaagggccaagaaaagagcccaggaaaatcattgcaactgtcctgatgacagaggacattaagcttaacaaagctgaaaaggcatggaagccgtcgtccaaaaggacagccgcagacaaagatcgaggggaagaagatgccgatggctctaagacccaagacctctttaggagggttcgctccatcctgaacaaacttactccacagatgttccaacagctgatgaagcaggtgacccagctagctatcgacactgaggagcgcctcaagggtgtcatcgacttaattttcgagaaagctatttctgaacctaactttagtgttgcatatgccaatatgtgccgctgcttgatggcactcaaggtccccacaaccgaaaaacctacagtgacagtcaatttccggaagctgcttctcaaccgctgtcagaaagaattcgagaaggacaaggatgatgacgaggtcttcgagaaaaagcaaaaggagatggacgaggcagccacagcagaagagaggggcaggctgaaggaggagttggaggaagcaagggatattgccaggcggagaagcctgggcaacatcaaattcataggagagcttttcaaactcaaaatgttgacagaagccataatgcatgattgtgtggttaagctgcttaaaaatcatgatgaggagagtctcgaatgcttgtgtcggctgttgacaactattgggaaggacctggacttcgagaaggccaagccccgtatggaccagtactttaatcagatggagaagattataaaggaaaagaagaccagctcccgaattaggttcatgctccaggatgtcctcgacctgagaggatccaactgggtccctcgtagaggggatcagggccctaagacgatagaccagatccacaaagaggccgaaatggaggagcatcgagagcatatcaaagttcagcagttgatggccaagggctccgataaacgacggggaggacccccaggtcctccgataagtcgcggtctccctctggtcgatgatggcggttggaacaccgtgcccatcagcaaagggtcccgtcccattgataccagcagacttacaaagattaccaagccaggtagcatcgattccaataaccagttatttgcccctgggggacgcctttcttgggggaagggctcttccgggggatccggcgcaaagccatcagacgcagcctctgaggccgctcgaccagccacgtctacgttgaacagattttccgccctgcagcaggcagtgcccacggagtccaccgacaaccgacgggtggtgcagcgttcctcactttcccgagaacgaggcgagaaggccggtgaccggggagaccgactagaacggtccgagcggggaggagaccgaggggatcgtcttgatcgtgctaggacacccgcaactaagcgctccttttctaaggaagttgaagaaagaagtagagagcggccttctcagccagagggtttgcgcaaagccgcatcgctgaccgaagacagagacaggggaagagacgcagtaaaacgagaggccgcactcccaccagtgtctcccctgaaggctgctctgtcggaagaagagctcgagaaaaaaagcaaggccatcatcgaggaatacctccacctgaatgatatgaaagaggcagtgcagtgtgtccaggagctggcttcacctagtctgctatttattttcgtgcggcatggcgtagagagtacacttgagagaagtgcaatagccagggaacacatggggcagttgctgcatcagctgctttgtgccggtcacctctcaaccgcccagtattaccaggggttgtatgaaatcctggagctggcagaagatatggagatcgatattccgcacgtatggctgtacctcgcagagctcgtgacaccaattcttcaggaaggcggtgttcctatgggagagctgttcagggagattacaaagccactgcggccactcggcaaggctgcgagtttgctcctcgagatcctcgggttgctgtgcaaaagtatggggccaaaaaaggtggggaccctgtggagggaggcaggcctgtcttggaaggaattcttgcctgaagggcaggatatcggtgccttcgtcgctgagcagaaggtagagtacacactgggggaagaaagcgaggctcctggccagcgtgccttgcctagcgaggaattgaatcgccagcttgaaaaactgctcaaagaaggttccagtaatcaaagagtcttcgattggatcgaggccaacctttcagaacagcagatcgtctccaacactcttgttagggctctcatgaccgccgtctgttatagtgccatcatattcgagactccactgagggttgacgttgctgtcctgaaagcacgagctaagttgctgcagaagtatctgtgtgacgagcaaaaagagttgcaggcattgtatgccttacaggcactggtggtgactctggaacagcctcccaaccttttgagaatgttcttcgatgcgttatacgatgaggacgttgtgaaagaggatgccttctatagttgggagtcctctaaagatcccgctgaacaacagggaaagggtgtcgcccttaagagtgttactgcattcttcaagtggctgcgcgaggcggaggaagagagtgaccacaactag

SEQ ID NO: 28536 - DNA, 4539 bp, Artificial Sequence
  Description of Artificial Sequence: Synthetic coding sequence
atgatgataccgagtcagatatcttaccctgctagccagggtgcctactatattcctggtcaagggaggtccacctacgttgttcccacccagcagtaccctgtgcagcctggagcacctgggttctaccctggggcttctcctacggaattcgggacttatgctggggcttactacccggcacagggcgtccagcagtttcctacgggagtggccccaacacctgttcttatgaaccaacctcctcaaattgctcccaagagagagaggaagactatccgcattcgcgaccccaatcagggaggcaaagacatcaccgaggagattatgagcggagcaagaacagcttccacccccacaccccctcagacaggagggggactcgagccccaggctaatggagaaactccacaggtggcggtaatcgtccgcccagacgacagatctcaaggcgctataattgcagaccggccagggttgcccggacccgaacatagtcccagcgagtctcaaccttcatcgcctagtcccactccttcgccctctcccgttctggagccaggatctgaaccaaatcttgccgttctgtctatccccggagacaccatgaccactatccagatgtccgtcgaagagtctacccctattagcagagagactggggagccttatcggttgtcccccgagcccacaccactggcggagcccattcttgaagtcgaagtgactctatctaagccggtcccagagagtgagtttagctcttccccactgcaagcgcctacacctctggcatcccacaccgtcgagatccatgagccgaacgggatggtgcctagcgaagacctcgagccagaagtggagtcaagccctgaattagcccctcctcccgcttgccccagtgaaagccccgtccccatagcacccactgcccagcctgaagagctcctgaacggggcacccagcccaccagccgtcgatctgtctcccgtaagcgaaccggaggaacaggctaaggaagttactgccagcatggccccacccactatcccctccgctacccccgcaacagccccttcagcaactagtcccgctcaggaagaggaaatggaggaggaagaagaggaagaggaaggcgaggccggagaggcaggtgaagccgagtcagagaaggggggagaggagctgctgccaccggagtctacaccgattccagccaacctgtctcagaatctagaagccgctgcggcaacacaggttgcggtctctgttcctaaaaggcgtagaaaaattaaggagctaaataagaaagaggcagtcggtgatctgcttgatgctttcaaggaggccaaccccgctgttccggaagtggaaaaccagccacccgctgggtctaaccctggcccagagtccgaaggttccggcgtgccccctcgaccagaggaggcagatgaaacttgggactctaaggaagacaagatccacaatgccgagaacattcagcccggagaacagaagtacgaatacaaatctgatcaatggaaacccttgaatctggaggaaaaaaagagatacgaccgagaattcctgctggggtttcagtttatctttgcctctatgcaaaaacccgaaggattgcctcacatatccgatgtcgtgctggataaggccaacaagacacccctgcgcccactcgacccaacacggttgcaaggcattaactgcggccctgactttacaccatcctttgccaatctgggacggacaacgttgtctaccaggggtccaccacgcggtggccctggtggcgaacttcctcgaggccctgccggtctggggcctcgaaggtcacaacagggccctaggaaggaacccaggaaaattatcgctaccgtacttatgacggaggatattaagttgaataaggctgaaaaggcctggaaaccctcatccaaaaggaccgccgctgataaagacagaggcgaagaggacgccgatggcagcaaaacccaggatcttttcagacgtgtcaggtcaatcctgaataaattaactccccagatgttccagcagctgatgaagcaggttactcagcttgccatcgataccgaggaacggttgaagggcgtgatcgatcttatcttcgagaaggctatttccgagccgaacttttctgttgcctatgctaacatgtgtaggtgtttgatggcgctaaaagttcccacaacagaaaaacccacagttaccgtgaacttccgtaagctgctacttaaccgttgtcaaaaggaattcgagaaagacaaggatgacgacgaagtgttcgagaagaagcagaaggaaatggatgaagcagctacggccgaggaaaggggcaggctaaaagaagaactagaggaggcgagagacattgctcggaggcgatccctagggaatattaaatttattggcgagttgtttaaactcaaaatgctgacagaggcgataatgcacgactgtgtcgtcaaactgcttaaaaatcacgacgaagagagcctggagtgcctatgtcggctgttaactacaataggtaaagatcttgatttcgagaaagcaaagccacggatggatcaatatttcaatcagatggagaaaattatcaaggagaaaaagacgtcgagcaggatccggtttatgctccaagacgtcctcgaccttcggggtagcaactgggtgccacgccgaggcgaccagggcccaaagacaattgaccaaattcacaaagaagctgaaatggaggaacatagggagcatatcaaagttcagcagttgatggctaaagggagtgacaaaaggaggggcggtcctccaggaccacccatcagtaggggcctgcccctcgttgacgatggagggtggaacactgtccctatttcaaagggaagcagacccattgacacatcacgactgactaaaattacaaagcctggctcgatcgactccaataaccagttattcgcaccagggggacgcctgagttggggcaaaggctccagcggcggatcaggtgccaagcccagtgatgcagctagtgaggccgcaagacctgcaacaagcactctgaaccgcttttccgccttgcagcaggcggtccctacagaaagcacagataacaggagagtggttcagagatcctccctgtcccgagaacgcggagagaaggccggagataggggggaccgcctggaacgctctgagcggggaggcgaccgcggagacaggctagaccgtgcacgcacccccgctactaaacgcagtttcagtaaagaagtggaggagcgatcccgggagagaccttcacagccggagggtttgcgcaaggccgcttctctgaccgaggatcgagatcgtgggagagatgctgttaaacgcgaggctgctttgccacctgtgagccctttgaaggcagccctttctgaggaggagttagagaagaagtctaaggcaattattgaagaatacctccacctgaatgacatgaaggaagcagttcagtgtgttcaggagctcgcctcaccgtcgctgctctttattttcgtgagacacggggttgaaagtaccttggaaaggtctgccatcgcgcgtgagcatatggggcaactcctacatcagttgctctgcgcagggcacctcagcactgctcagtattatcaggggctgtatgaaattctggaactggcagaggacatggagattgatattccccacgtgtggttataccttgccgaactcgtcacccctattttgcaggagggaggcgtgcccatgggggagctctttcgggaaatcaccaagcctctccgtcctttgggaaaagccgctagcctcttactcgagattctcggactattatgcaaaagcatgggccctaaaaaggttggaacactgtggcgcgaagctggactgtcttggaaggagttcctgcccgaaggacaggatatcggcgcatttgtggcagaacagaaagtggaatacaccctaggggaagagtctgaggcacctgggcagagggccttgccaagtgaggaactgaaccggcaactagaaaagctactcaaggagggaagttcaaatcagagggttttcgattggatagaagccaacctgagcgagcagcaaatcgtctccaacacactggtgagggctttgatgaccgctgtctgttacagcgcgatcatcttcgaaacacctctcagagtggacgtggcggttctgaaggccagagcaaagctgcttcaaaaatacctgtgcgacgaacagaaggagcttcaggctttgtacgccttgcaggcactggtggttacactggagcagccacctaacttgctgcggatgttcttcgacgctctgtacgatgaggacgtcgtcaaagaggacgctttttactcgtgggagtcttccaaggaccctgcagaacagcaaggcaagggcgtggcacttaagagcgttaccgccttttttaagtggctgagggaagccgaggaagagtccgaccacaactag

SEQ ID NO: 28537 - DNA, 4539 bp, Artificial Sequence
  Description of Artificial Sequence: Synthetic coding sequence
atgatgatcccctctcagatttcttaccctgccagccagggtgcttactatatccccggacagggcagaagcacatacgtggtccctacgcagcagtaccctgtgcagccaggtgcccctggcttttaccctggcgcatctccgaccgaatttggtacttacgctggggcatactaccccgctcagggagtgcagcaattccctactggagtggctcccactcccgtgcttatgaatcagccccctcagatcgccccaaagcgcgaacggaagacgatccgcatcagggatccaaaccagggcggaaaggacattacggaggagattatgagcggggctcgcaccgcctccacgcctacgccacctcagaccggcggagggctggaacctcaggccaatggcgagacgccccaggtcgccgtgattgtgaggccagacgaccgttcacagggagccatcattgccgacaggccaggcctgccaggtccagagcatagccccagtgagagtcagccatcgagtccttcccccacgccaagtcccagtccagtgctggagcctgggtccgagccaaaccttgctgtgctgagcatcccaggagacactatgaccactatccagatgtccgtggaagaatcaactccgatttctcgggaaaccggtgagccttataggttgtcgcccgaacccaccccactggctgaacctatcctagaggtggaggttacactctccaagccagttcctgaatcagagttcagcagcagccccttgcaagcaccaactcctctcgccagccacaccgtagagattcatgagcctaacggcatggttccttccgaagacctcgaaccagaggtcgagtcgtccccagaacttgcgcctccgcctgcctgtccatctgagtctccagtgccgattgcgccaacggcgcagcctgaagaacttctgaacggggctccatccccacccgctgtggacctatctcccgtgtctgaacctgaagagcaagcgaaggaggtcaccgctagcatggcccctcccactattccttctgcaacaccagccacggctccatctgcaacatcgcccgcacaggaagaggagatggaggaagaagaagaagaggaggaaggagaagcaggagaagctggagaggctgaatcagagaagggaggcgaggagctgctgcctcccgagtccacacccatccctgccaatctgtcacagaacctcgaggcagcagccgctactcaggtggccgtcagtgtgcccaaacgtcggcgaaagatcaaagaactaaacaaaaaggaggctgttggcgacttgctggacgcattcaaggaggccaatcccgctgtgccagaggtcgagaatcagccccctgcaggtagtaaccctggccctgaatctgagggatctggcgtgccaccacggcctgaggaggccgatgagacttgggacagtaaggaggacaagatccataatgcagaaaacatccagcccggtgaacaaaagtatgagtacaaatcagatcagtggaaaccattaaacctcgaagagaagaaacgctatgaccgcgagttcttactggggttccagttcatcttcgcctcgatgcagaagcccgaaggcctaccccacataagcgatgtggtgcttgacaaggccaacaaaaccccattgagacctctggaccccactcgactgcaggggatcaattgcggcccagatttcacaccaagttttgctaacctgggcaggacaacactttcgactaggggaccaccaaggggcggacccggaggcgagctgcccagaggaccggctggcttaggcccaagacggtcacagcaggggcctcggaaagaacccaggaaaatcatagcgaccgtcctaatgaccgaagacattaaattgaacaaggcggaaaaagcatggaagccctccagcaagcgtaccgccgcagacaaagatcggggagaggaagacgctgacggctccaaaactcaggatttattcagacgcgtgaggagcatactgaataagcttacaccccagatgttccaacagcttatgaagcaggtcacccagctggcaatcgatacagaggaaaggctgaaaggggttatagacctgattttcgagaaggccatttcagagccaaacttctctgtggcttatgctaacatgtgccgttgcctgatggcactcaaggtgcccacaaccgaaaagcccactgtgaccgtgaatttccggaaactgctcttaaatcggtgtcagaaagaattcgaaaaggataaggacgatgacgaagtgtttgaaaagaagcagaaggaaatggatgaagctgctaccgctgaggaacggggaagactgaaagaggagcttgaggaagcacgtgacattgccaggcgtcgctcgctcggcaatatcaaattcatcggcgaactgttcaagctcaagatgttaaccgaagccataatgcatgactgtgtggtgaagctgctgaagaaccatgatgaagagagtctggagtgcctgtgtcgactgcttacaaccattgggaaggacttggattttgagaaagccaaacctcgaatggaccaatattttaatcagatggaaaaaataatcaaggaaaaaaagacctcatccagaattagatttatgttgcaggacgtgctggatctgcgtggatccaactgggtcccacgtcgaggagatcaaggccctaaaaccatagaccagatccataaggaggccgagatggaggagcatagggagcatatcaaggtccagcagcttatggccaaaggatcagataagaggcgcggaggaccacccggacctcccatctcccggggtctgcctcttgtggacgacgggggttggaatacagtgccaattagcaaaggtagccggccaatagacacctctagactcaccaaaatcacaaaacccggaagtattgattccaacaaccagttgtttgcccctggtgggcgattgtcatggggaaaaggctcttcagggggttctggtgcgaaaccctcagacgcagcgagtgaagctgctcgccctgccacttccacactgaacaggttttctgccctgcaacaggcagtgcccaccgagtcaactgataaccgccgagtcgtccagaggagcagcctgtcaagggagagaggtgaaaaagccggtgaccggggagaccggctcgagagatccgagcgagggggagatagaggagatcgtctcgatagagcaaggacgcccgcaacgaagcgctccttctctaaggaagtcgaggaaagaagccgcgaaagaccatcccagcctgaaggcttacgtaaggcagcaagcctgaccgaggacagggatagggggagggacgcggtgaagagggaagccgctctgcccccagtgagcccgttgaaggctgctctcagcgaagaggagctcgagaaaaagtcaaaggccatcattgaagagtatcttcatctgaacgacatgaaagaggccgtgcagtgtgtgcaggagctcgcttctccatcattgctgtttatttttgtgcgtcacggagtcgaatctaccctggaacgctccgcgatcgccagggagcatatggggcagctcttgcatcagttgctgtgcgctggtcacctgtccacggcccagtactaccaggggctctatgagattctagagctcgccgaggatatggagatagacataccccatgtatggctgtacttagccgagctcgtgactcccatattgcaagaaggaggagttcctatgggcgaactcttccgtgagattactaagcctctccggcctctgggcaaggcagcctctttgctcttggaaattttggggctattatgcaaaagcatgggcccaaagaaggttggaaccttgtggcgtgaggcgggtctgtcatggaaagagttccttcctgagggccaggatattggcgcttttgtcgctgaacagaaggtagagtacacactgggcgaggagtcagaagccccagggcaacgggcacttccatccgaggagctaaacagacagttggagaagttattgaaggaagggtcaagcaatcagcgggtgtttgactggatcgaggcaaatctcagcgaacagcagattgtcagcaatacgttggtcagagcgttgatgaccgccgtgtgctactcagccattatcttcgagacaccgctacgcgtggatgtggcagttctgaaagccagagccaaacttttacagaagtatctttgcgatgaacagaaggagctgcaggcgctctatgccctgcaagctttggttgtgaccttagagcagccgcctaacttgttgaggatgttctttgacgccctgtatgacgaagacgtagtgaaggaggacgccttttactcctgggaatcctccaaggatcctgctgagcagcagggtaaaggtgtggccctaaaatcggttacggcctttttcaaatggcttcgtgaggcagaggaagagagtgaccacaattag

SEQ ID NO: 28538 - DNA, 4683 bp, Artificial Sequence
  Description of Artificial Sequence: Synthetic coding sequence
atgaacaccccttcccagccgcgacagcacttctacccatcgcgcgctcagccccctagttccgctgctagtcgcgtgcagtcagccgcacccgcacgcccaggcccagcagcacacgtgtacccagcgggttcccaggtgatgatgatcccctcccagatcagttatccagcatcacagggagcctattacattcccggacagggtcggtcaacatacgtagtacccacgcagcagtaccctgttcagcctggcgctccgggattttatccaggagctagccccactgagttcgggacttatgctggagcgtactatccagctcaaggggtgcagcaattccccaccggggttgccccaacccccgtcttgatgaatcagccccctcagatcgcacctaagagggaaagaaaaactatcaggatccgagatcccaatcagggcggaaaggacataactgaggaaatcatgagcggcgctcgaaccgcttctaccccaacgccaccacagacaggcggaggccttgaaccccaggctaacggcgagactccccaggtggccgtaatcgtgagacctgacgaccgttctcagggtgcaataatcgctgaccggcctggtctcccaggacccgaacactcaccaagtgagtcccagccctcctctccctcaccaaccccctccccatcgcccgtgctcgagcctggatctgaacccaatctggcggtactgtctattcctggggatacaatgacgaccattcaaatgagtgtcgaagaatccacccccattagcagagaaacgggggaaccctatcgactctccccagagccgaccccactagccgaacccatactggaagtggaagttaccctgtcaaaacctgttcctgagagcgaattttcttccagccctttgcaggcacctacacccctggcgtcccataccgtggagatccatgaaccaaatggaatggttccatcagaggacttagaacccgaggtcgaaagctctccagaactggctcccccaccggcttgtccatccgaatctcccgtgcctattgcaccgactgcgcagcctgaagagttgctgaacggggctccctcgccgcctgccgttgaccttagtccggtaagcgaacctgaggagcaggctaaggaagtcaccgcatcaatggctccaccaactatcccttccgcaacgccggcaaccgcacccagcgcgacaagcccagcccaggaagaagagatggaagaagaggaagaggaagaggagggtgaagctggtgaggcgggagaagcagaaagtgagaaggggggtgaggagcttctccctccagaatccacgcccatcccagcaaatcttagtcagaatctggaggccgctgctgcaacccaagttgccgtgtcagtgcctaagcggcgacgcaaaatcaaagagctcaacaaaaaggaggccgtgggtgatcttctggacgcatttaaggaagctaaccctgccgtgcccgaggtggaaaaccagcctcctgctggctctaaccctggccctgaatcagagggctctggggtacctccccgtccagaagaggccgatgaaacgtgggattctaaagaggataaaattcacaatgccgagaatatacagccaggcgagcagaagtacgaatacaagagcgatcaatggaagccactcaatctggaggaaaagaaaaggtacgatagggaattcctgctcggcttccagttcatcttcgccagcatgcagaaacccgaaggtctgccgcatatcagcgacgttgtgctagataaagccaataaaacaccactccgtccgctcgacccaacccgacttcaaggaatcaactgcggacctgatttcacccccagctttgcaaaccttgggcgaacgactttgtctacacggggtcctccccgtgggggacccggaggtgaactcccaaggggccctcaggccggtttgggtcctagaaggtcgcagcaggggcctcgtaaggaacctcggaaaatcattgctactgtacttatgacggaggacattaaattgaataaagccgagaaagcatggaagccttcctccaaacgcacggctgctgataaagatcgcggtgaggaggacgccgacggttccaaaacacaggatctgttcaggagagtacgatctatcttgaacaagctgacaccccagatgtttcagcagctgatgaagcaggttacccagcttgcaatagataccgaggaaagattaaagggggtaatcgatctcatatttgagaaggccatttccgaacccaatttctcagtcgcttacgcgaatatgtgcaggtgcctcatggccctcaaggtgcctactaccgaaaagcccaccgtgaccgttaatttcaggaagctactcctcaacaggtgtcagaaagagttcgaaaaagacaaggatgatgatgaggtctttgagaagaagcagaaggagatggacgaggcagcaactgccgaggagcggggaaggctgaaggaggaattggaagaagctagagatattgctcgaaggcggtccctaggcaatataaagttcataggagaactttttaagctaaagatgctaactgaggcgattatgcacgattgtgtcgttaagctgctgaagaaccacgatgaggaaagtttggagtgcctgtgccgcttgctgaccacaattgggaaagatctggattttgaaaaggctaaacccagaatggatcagtacttcaatcagatggaaaaaatcattaaggagaagaaaacttcgtcacgcatcaggtttatgctgcaagacgtgctcgatctgcggggttctaactgggtaccgagaagaggggaccagggcccaaagacaatcgatcagatacataaggaagctgaaatggaagagcaccgcgagcacataaaagtgcaacagctgatggctaaaggcagtgacaagcggcgtggcggacccccagggccacccatctcccgcggtctgcctctggtggatgatggtgggtggaataccgttcccatttccaaaggatctcggcctatagatacttctaggctgactaagattaccaaacctggctctatcgattctaataaccaacttttcgccccaggcggtaggttgtcttgggggaagggctcaagcggcggatccggagccaagccgtctgacgccgcatctgaggcggcacgccctgctacctcaacgcttaatcggttctccgcattacagcaagccgtgccaaccgagtctaccgataaccggagagtggtgcagagaagtagtctgtcacgcgagagaggagaaaaggcaggagatcgtggagaccgcctcgagcggtccgagcggggtggggatcgtggggataggttggacagagccaggacacccgcaaccaagagatccttctcaaaagaggtagaggagcgaagtcgcgaacgtcccagccaaccggaggggctccgaaaagccgcatccttaaccgaggatagagaccggggacgcgatgccgtcaagcgcgaggcagcattgcctcccgtttcccccttgaaggctgctctatcagaggaagaactggaaaagaagtcgaaggccatcatcgaagagtatctgcatctcaacgacatgaaggaagcagtacagtgcgtacaggaactagcatctcctagtctgctgttcatatttgtgcggcatggcgtggagtccaccctagagcggtctgctattgcacgtgagcacatgggccagctgctccaccagctgttgtgtgctggacatttgagtacagctcagtactaccagggactttacgagattttagagttagcagaagatatggagatcgatatcccacatgtgtggctttatctggctgagcttgtcaccccaattctccaggaaggaggggttcctatgggggaactgtttcgagagattactaagcctctgagacctctgggtaaagcggctagcctcctcctggaaattttgggcctgctgtgcaaaagtatgggacctaagaaggtcggcaccctgtggcgcgaagcgggtctctcatggaaggagttcctgccagagggtcaggacattggggctttcgttgcagagcagaaagtggagtacaccctgggtgaggaaagcgaggcacccggtcaacgcgcactccctagcgaagagctgaatagacagctggagaaactgctaaaggagggatccagcaatcagagggtgttcgactggattgaagccaatctgagcgagcagcagatcgtgagcaatactctggttagagcactgatgaccgcagtttgttacagcgcaataattttcgagactccccttagggtagacgtggctgtgctgaaggccagggctaaacttttacaaaagtatctgtgcgatgaacagaaagagctgcaagcgctctacgctctgcaggccctcgttgtgaccttggaacagccacctaacctgttgcggatgtttttcgacgccctttatgacgaggacgtggtgaaggaggatgctttttactcatgggagtccagtaaggatcccgctgagcagcaggggaagggggtcgctctgaagagcgtgactgctttcttcaagtggcttcgcgaggctgaggaagaatcagatcacaattag

SEQ ID NO: 28539 - DNA, 4680 bp, Artificial Sequence
  Description of Artificial Sequence: Synthetic coding sequence
atgaacactccctctcagccaagacagcacttttatccctctcgggctcaaccaccttcttcggcggctagtcgggtacaatcagcggctccagcaaggcccggaccggcagctcacgtgtacccagcagggtcacaggtcatgatgataccctcacagattagctatcccgcatctcaaggtgcgtactatatcccgggacaaggacggtccacatacgtggttcccacccaacaatatcccgtgcagcccggtgcccctggcttctacccaggagcgtcaccgacagagtttggaacgtatgctggcgcttactaccccgctcaaggagttcagcagtttcctactggagttgccccaacccctgttttgatgaatcaacctcctcaaatcgctcctaagcgcgaacgtaaaaccattaggatccgcgacccaaatcaagggggtaaggatattactgaagagattatgtccggcgctagaacggcgtccacccccaccccacctcagactggaggagggctggagccgcaggccaacggagagactccacaggtcgctgttattgtgaggcctgatgaccggagccagggtgcaattatcgctgaccggcctggcttacccggtcccgaacacagcccatcagagtcccagcccagcagtccaagccctacgcccagccctagccccgttctggaaccaggatctgaacccaatctggccgtcttgtccatccccggagatactatgaccacaatccagatgagtgtggaggagtccaccccaatctctcgggaaaccggcgaaccctacaggctaagtccagagccaacccccctggccgagcctatcctcgaagtagaggtgacgctgtccaagcctgtgccagaatcagaattctcttcttctccactgcaggcacctacccctctcgccagtcacaccgtcgagattcacgaacctaatgggatggttcctagcgaggatcttgagcctgaggtggagtcttcccccgaactggcccctcctccagcctgtccctctgaatctcccgtgcccattgctccaactgcgcaaccagaggagctgctgaacggtgctccatcccctcccgcagtagatttaagccccgtgtccgagccagaggagcaagcgaaagaagtgacagcatccatggcaccgccaaccattccctctgctacaccggctacagcacccagcgctacgtcccctgcccaggaagaggaaatggaagaggaggaggaggaggaagagggcgaggccggtgaggccggagaagccgagtctgagaagggaggggaggaactgctcccaccagagtccacgcccatccccgctaacctgtctcagaatctcgaggctgctgctgctacccaggtggccgtttcagtgcctaaaaggaggaggaagatcaaggaactgaacaaaaaggaagcagtcggtgacctgctggacgcctttaaagaggctaacccagccgtccccgaggtggagaaccaaccacccgcaggcagcaacccaggcccagaatccgaggggagcggcgtacctcccaggccagaggaggcggatgaaacttgggattcaaaagaggataaaatccacaacgccgagaacattcagcctggcgagcaaaagtacgagtataagagcgaccagtggaagcccctaaacctggaggagaagaagcgctacgaccgagagttcttattgggattccagttcatctttgcgtcaatgcaaaagcctgagggcctcccccacatttccgatgtggtcctggataaagctaataagactccacttcggccactggaccctactcgactgcagggtattaattgcggacctgactttaccccatctttcgccaatctcggaaggactaccttgagcactcggggtcctccacgtggaggacccggaggtgagctgccccgtggtcctgccggattgggaccacgcagaagccagcagggacccaggaaagagccaaggaaaattatcgccactgtgctgatgacagaggatatcaagctaaacaaggccgaaaaagcttggaaaccctcttctaagcgcacagcagccgataaagatagaggtgaagaggacgcggacggaagtaagacacaggatcttttccggagggtccgttcgatcctcaataaactgacaccacagatgtttcagcaactgatgaagcaagtgactcagctggccatcgatactgaggaacgcttgaagggagtgatagacctgatttttgagaaagcgatctctgaaccgaatttttcagtggcatatgcaaacatgtgtaggtgtctaatggcactcaaagtccctactacggagaagcccaccgtcactgttaatttccgaaagctactgctcaaccggtgtcagaaagaattcgaaaaagataaggatgatgatgaggtcttcgagaagaaacagaaagagatggatgaggccgcaacggccgaagagcgtggtcggctcaaggaggagctcgaggaggcccgtgacatcgccaggagacggagcctcggcaacattaaatttattggggagctctttaagctgaaaatgttaacggaggctattatgcatgactgcgtcgttaagttactgaagaaccacgacgaagaatcgctggaatgcctttgtaggcttttaacaaccattggaaaggacctagacttcgaaaaagccaaaccacgcatggatcagtacttcaatcagatggagaaaataatcaaggagaaaaagacatctagcaggatccggtttatgctgcaggatgttctcgacctcagaggatctaattgggtccctagaagaggtgatcaaggccctaagacgatagatcaaatccacaaggaagctgaaatggaggaacaccgcgagcatatcaaagtgcagcagctgatggcgaaaggtagtgataaaagacgcggagggcctcccggacccccaatctcgagaggacttccactggtggacgacggaggctggaataccgtgcccatcagcaaaggctcacgcccaattgatacttctcggctgacaaaaattacaaagccaggctctattgactccaataaccaactgttcgcacccggaggtcgcctgtcatggggcaagggctcatctggcggatccggggctaagccgagcgacgcggctagtgaagcggctcgccctgcaactagcacactcaatcgcttttcagcattgcaacaggcagtccccacagagagcactgataacagaagagtggtgcagcgctcttcattatctagggagcggggagaaaaggcaggagatcggggagacagactggaaagatctgaacgcggaggggaccggggagatcgtctggatagagctcgcacacccgcaaccaagagatccttttcaaaagaggttgaggagcgatcacgagagcgccctagtcagcctgagggactccggaaggctgcgtcactcactgaagaccgggaccgtgggagagatgccgtgaagcgggaggctgcactgcccccagtgtcgcccttaaaggccgctctctctgaggaagagttggaaaagaaaagcaaggctatcatcgaggaataccttcacctcaacgacatgaaggaagctgtccagtgtgttcaagagctcgcctcccccagcctcctatttatcttcgttcggcacggtgttgagagtactctcgagagatcagccattgctcgagagcatatgggacagctcctccaccagctactgtgcgccggacatcttagcactgctcagtattaccaagggctgtatgagattctcgaactcgccgaggatatggagatcgacattccacatgtgtggctatacctggcagaactggtcactcccatattacaggagggtggggtcccgatgggggaactatttagagagataactaagccactgcgccctttgggcaaggccgcatccttgcttcttgagatccttggactgctgtgcaagtctatgggccctaaaaaagtcggaacactctggagggaggcgggtttgtcctggaaggaattcctgcccgaagggcaggacataggtgcctttgttgcagagcagaaggtggaatatacacttggagaagaatcagaggctcctggccagagagctctaccatcagaagagttaaatcgtcagctggagaaactcctgaaagagggaagcagcaaccagcgcgtgttcgattggatcgaggcgaatttgtccgagcaacagatcgtgtcgaatactctggttagagcactgatgaccgctgtgtgttatagcgcaatcatctttgaaacccctctgcgggtggatgtggctgttctgaaagctagggcaaaactgctccaaaaatacttgtgcgacgaacaaaaagagcttcaggccctgtatgccctgcaagcgctggttgtaacactcgaacagcccccaaatctgctacgcatgttcttcgacgctctgtacgacgaggacgtggtgaaagaggacgccttttactcttgggaaagttcaaaggaccccgcagaacagcaggggaagggagtggccctgaagtcagtgaccgccttcttcaagtggctgagggaagccgaggaggagtcagatcacaactag

SEQ ID NO: 28540 - DNA, 4821 bp, Artificial Sequence
  Description of Artificial Sequence: Synthetic coding sequence
atgaataaggcgccacagtcaacaggacctccaccggcaccttcaccgggactacctcaacctgcctttcctccgggacagactgcacctgtggtattctccaccccacaggctactcagatgaatacgccttcacagcctaggcaggggggatttcggagccttcaacatttctaccccagcagagctcaaccgccaagctcagcagcctctcgtgtgcagtctgcagccccagcccgtccgggacccgcagcccatgtctacccagcgggatcccaggtgatgatgatcccctcgcagattagctatcccgcaagccaaggcgcttactacattcccggtcagggacgttccacttacgtcgtgcccacacagcagtatcctgtacagcctggcgcacctggattttatcctggggcatctccaacagagttcggcacatacgcaggtgcctattatccagcacagggcgtgcaacagttcccaactggcgtagcgccaactcccgtcctcatgaatcagccaccacagatcgcccctaaacgtgagcgaaaaacaatccggatccgcgacccgaatcaaggaggaaaagacattacggaagaaattatgagtggagcccgaaccgctagcactccaactccaccccaaacgggtggaggtttggagccacaagccaatggggagaccccacaggtggccgtgatcgttcgacccgatgacaggagccagggtgcaattattgccgacagacccggacttcccggacccgagcatagcccctctgaatcccagcctagctccccatctcccaccccgtcgcccagccccgtcctcgagcctggcagcgagcccaacctggccgtgctgtccatacctggcgatactatgacgacaatccaaatgagcgttgaagagagcacccctatctctcgagaaacaggtgagccctaccgtctctccccagaacctacgccactggccgagcccatcttggaggttgaagtgacactaagtaagcccgtgccagaaagtgaattttcaagtagtcctctccaggcccctaccccactggcttcccatactgttgagatacacgaacccaacgggatggtgccctcagaagaccttgaacctgaagtcgaatcgagccccgagctggctccacctccagcttgccccagtgagtctcctgtgcccatcgctcccaccgctcagcccgaagagctactcaacggagctccaagtccccctgccgtggatttaagtcccgtgtcagagcccgaagaacaggccaaggaagtgacagcatcgatggctccccctacgattccaagcgcgacaccagccactgccccaagcgctacctccccagcacaggaggaagagatggaagaggaggaggaggaggaggagggcgaggcaggtgaagctggggaagccgagagtgagaagggaggcgaggagctcctgccaccagagtccacccccattcccgctaatctgtcgcagaatcttgaggcggcagcggcaactcaggtggccgtgtcggtccctaagcgccgacggaaaatcaaagaactgaataagaaggaggccgtgggagacttgctggacgctttcaaggaggcaaaccctgccgtgccagaagtggaaaatcaacctcccgctggctccaaccccggacccgagtcagaaggatccggcgtgccccctaggccggaagaggcagatgaaacctgggactccaaggaggacaagatccataatgcagaaaatatccaacctggcgaacaaaagtatgagtacaaatccgaccagtggaagccactgaacctggaggaaaagaagcgttatgacagagagttcctcctgggcttccagttcatctttgccagtatgcaaaaacccgagggcctgccacacataagcgatgtcgtgctggataaagcaaataagacacccctgcggcctctcgacccaactaggctgcaggggataaactgtggaccagacttcacaccatcattcgccaatctggggaggactacgctctcgacccgcggacctcccagaggcggacctggaggggagcttcccagggggccagccggtctgggccctaggcgaagtcaacagggcccacgaaaagaaccccgaaagatcattgcaaccgttttgatgactgaagatatcaaactgaacaaggcagaaaaggcctggaagcccagtagcaagaggactgctgcagataaggacaggggtgaagaggacgccgacggctcgaaaacacaagatttgttccgtagggtgcgttctatcctgaataagcttacgccacagatgtttcaacaactcatgaaacaagttacccagctggccatcgacactgaagagcggctcaaaggcgtgattgacctgatatttgagaaggcgatttccgaaccgaacttcagcgtggcttacgctaacatgtgcaggtgtctgatggcattgaaagtgcctaccacggagaagcccacagtgaccgtgaactttcgcaaattgctattaaaccgatgccaaaaggagtttgaaaaagataaagatgatgatgaagtcttcgagaaaaagcagaaagagatggatgaagcagctaccgcagaggagagggggcgactcaaagaagagttggaagaagccagagacattgccaggcggagaagtttaggcaatatcaaattcattggcgagctgtttaagctcaaaatgctcactgaagctattatgcatgactgcgtggtgaaactgttgaaaaaccacgatgaggagagcctcgaatgcctgtgcagacttctgaccacaataggcaaagatctggattttgagaaggcgaagccccgaatggaccagtactttaatcaaatggaaaagataattaaagagaaaaagacgtcatcccgaatccggttcatgttgcaggacgttctggacctgagaggtagtaactgggttccaagacggggagatcaaggccctaagactatcgatcaaattcacaaggaagctgagatggaagagcatagagaacatatcaaagtccaacaattaatggcaaaaggatccgacaaaaggagaggtggtccaccaggtcctccaattagtcggggactgcccctggtggacgatggagggtggaataccgtgcctattagcaaaggcagccgcccaatcgacacctcacggctcacaaagattaccaagcctggttctatcgattccaacaaccagctgtttgcacccggaggcaggctgtcatgggggaaaggaagttccggaggaagcggagccaagccaagcgacgcagcctctgaagcagcccgaccagctacctccacgctaaataggttttctgccctgcaacaggcagttccgacagagtccacagacaaccgccgagtcgttcagcgatcgtctctgtcacgcgaaagaggagaaaaggcaggcgacagaggggaccgcttggaacggtccgagagaggaggcgaccggggagaccgtctggaccgcgctcgtaccccagctacaaagcgatctttttcaaaagaagtggaggaaaggtcacgtgaaagacctagccagcctgagggcttgcgcaaagccgcatcgttaaccgaggatcgtgataggggcagagatgctgtgaaaagagaggccgcactgcccccagtctccccactcaaagcagcactgtcagaagaggagctggagaaaaagagcaaggctatcattgaagagtacctgcatcttaatgatatgaaagaggcagtacagtgcgtccaggaactggcttctccgagcctcctgtttatctttgttcgacacggggtcgaatccactctggaacgttcggcgatcgcaagggagcacatgggacagctgctacaccagctgctgtgcgctggccatttaagtaccgctcagtattaccagggcctatatgagatcctcgaactggcagaggatatggaaatcgatattcctcatgtgtggttatacttggccgaattagttactcctatccttcaggagggcggtgtgcccatgggagagctttttagagagatcacaaaacctctgagacccctgggcaaggcagcctctctcttgctcgagattcttggactgttgtgtaagagtatgggcccaaagaaggttgggaccttatggcgtgaggccggacttagttggaaggagttcctccccgagggccaggatatcggtgcttttgttgccgaacagaaagtcgagtacacactcggcgaggagtctgaagcaccgggacaacgcgcactacccagtgaagaactgaaccgtcagctggaaaaattattgaaagaaggatcttccaatcagcgcgtatttgattggattgaggctaatttaagcgagcagcagatcgtctcaaacaccctggtgagagccctgatgacagcagtctgctattccgcaatcatctttgagacacccttaagggtagacgtcgccgtactcaaagcccgagctaagttgttgcagaagtatctttgcgatgagcagaaagagcttcaggctctgtacgcgctgcaggcattggtagtgactctggagcagccacctaacctgctgcgaatgttcttcgatgccctatatgacgaagacgtggtgaaggaggacgccttctattcttgggaaagctcaaaagatccagccgaacagcagggaaagggtgtcgctttgaagagtgtcacggccttcttcaaatggctgcgagaagccgaggaagagagcgaccataattag

SEQ ID NO: 28541 - DNA, 492 bp, Artificial Sequence
  Description of Artificial Sequence: Synthetic coding sequence
atgagcggagctcgcaccgcctcgaccccaacacctccgcagacaggcggagggttggaaccgcaagctaacggagaaacccctcaagttgctgttatagtacggcctgatgacaggtcacagggcgcaatcatcgcagatagaccaggattgcccggacccgagcacagcccatctgaatctcaacctagttcaccatcccccactccgtctccttctccagtactggagcctgggtcagagccgaatctcgcggtcctgtctatcccaggtgatacgatgaccactattcagatgtctgtggaagagtcaacacctatatcccgtgagactggcgagccttacaggctgtcccctgaacctactcccctggccgagcccattctggaagtggaggtcacacttagtaaaccagtgcccgagtccgagttcagctcttcgcctctccaagcccctacaccactggcctcccacacagtagaaatccattag

SEQ ID NO: 28542 - DNA, 4542 bp, Artificial Sequence
  Description of Artificial Sequence: Synthetic coding sequence
atgatgatcccaagccaaatcagttatcctgcctctcagggggcttattacatacccggacagggcaggtccacctacgtggtacccacacagcagtaccccgtgcagcctggagcacccggtttctatcccggagcaagccccaccgagttcggaacatacgcgggagcctactatcccgctcaaggagtccagcaattcccaacgggcgtcgctcctacgcccgtcctgatgaaccagccgccacagatcgctccaaaacgggagagaaaaacgatccgtatccgggatcctaatcagggcggaaaggacatcacagaggagatcatgagtggcgctagaacagcttccacacccactcccccacagaccggcggagggctggaaccgcaagcaaacggcgaaaccccacaggtggctgtcatcgtaaggcctgacgaccgttcccagggggcaataatagcggatcggccaggtttgcctgggccagagcattctccaagtgagtctcagccttcaagcccctctccgaccccgtcccccagtccggttctggaaccgggaagcgagccgaacttagcagtgttatccatccctggtgacaccatgactactattcagatgagcgttgaggaatctacaccaatcagtcgggaaaccggtgaaccctacagactctccccagaacccactcccctggcggaacccatcctcgaggttgaggtgacactcagcaagcctgtgcctgaatctgagttttcgagctcacccctacaggccccaactcccctcgccagtcacacggtggagatacacgaacctaacggtatggttccctctgaggacctggagcctgaggtggaatctagcccagaactcgcccctccacccgcatgtccatctgaatccccagttcctatcgcgccaacggcccaacccgaggagctgctcaacggggctccctccccccctgccgtggacttgtctcctgtgagcgaacctgaggagcaggccaaagaggtgaccgcaagtatggccccacctaccatcccttcagctactcctgctaccgcacccagcgccacttcacctgcccaggaagaagagatggaggaggaggaagaggaagaggagggcgaagcgggtgaagccggagaggctgagtctgagaagggaggtgaggaactcttgcctccggaatcgactcccatccccgcaaacctgagccagaatttagaggcggcagcggctacacaagtggcagtgagcgtgcctaagcgcagacgaaagatcaaagagcttaacaagaaggaagcagtgggcgacctgctcgatgccttcaaggaggccaatccagcagtgccagaggtggagaatcaaccaccagccggatctaatcccggacccgagtctgaggggtccggagtcccacccaggcctgaggaagccgacgaaacatgggactctaaggaagacaaaatccacaatgccgaaaatattcagcccggagaacaaaaatatgagtacaagtcagaccagtggaagcctctgaatctggaggaaaagaaacgttacgatagggagttcctgttgggcttccaatttatctttgcctctatgcagaagcccgagggattgcctcacatttctgatgtggttctcgacaaagccaacaaaactccactgcgcccactggacccaactcggttgcaaggaatcaactgtgggccagattttaccccctccttcgcgaacctgggtaggaccacattatctactagagggccaccgagaggtggccctggcggtgaactgcctagagggcctcaggccggactggggcctagacgctcccagcaaggacctcgcaaagagcccagaaagattattgccactgtccttatgacagaagatattaagctgaacaaagccgagaaagcctggaagccatcttcaaaaaggacagctgcagacaaggacagaggagaggaggacgcagatggctctaagactcaagatctgtttcggagagtcaggagcatcctaaacaagctgacaccacaaatgttccagcaacttatgaagcaggtgacacaactggctattgacacagaggaacgcctaaaaggcgttatcgacctgatattcgagaaagctatcagtgagcccaatttctccgtggcctatgccaacatgtgccgatgtttgatggcccttaaggttccaacgaccgagaagccgacggttacagtgaattttagaaaattgttgctgaatcggtgccaaaaggagtttgagaaggacaaagacgatgatgaagttttcgagaagaagcaaaaggaaatggacgaagcagccacagcggaagaacgtggaaggcttaaggaagaactcgaggaggcaagggacatcgccagaaggaggtctcttgggaatataaagttcattggagagctattcaagcttaagatgctcaccgaagccattatgcatgattgtgtcgtaaagctcttgaaaaaccacgatgaagaatctctagaatgtttatgtcgtctgctgacaacaataggaaaagatctcgactttgaaaaggctaaacccaggatggatcagtacttcaaccagatggaaaaaataatcaaagaaaaaaaaacaagctcgaggatacggtttatgctgcaagatgtgctagacctgagggggtcaaattgggtccctaggagaggtgaccaaggacccaaaacgatagaccagatccacaaagaagcagaaatggaagaacaccgagaacacatcaaagtccagcagttaatggctaagggaagcgataaaagaaggggtggaccccctggtcccccaattagcagaggactcccgctcgtagacgacggcggatggaatactgtcccgataagcaaagggtcccggccaattgatacgagcagattaactaagatcactaaacctgggtccattgacagtaataatcaactgttcgctccaggaggcaggctgtcatggggaaaggggagttccggcggatcaggagctaagcccagtgatgctgcctcagaggctgcaaggccggctacctccactctcaatcgctttagcgccctgcagcaagccgttccaactgagtcaacagacaatagacgagtggtccagaggtcctcattatcccgggagcgtggggaaaaagccggtgatcgcggagataggctcgagagatccgaacgaggcggtgaccgcggtgatcggctggaccgagcacgtacgccggctaccaagcgctcattcagcaaggaggttgaggagagatctcgagagcgcccaagccagcctgagggtttgcggaaggccgcttcgcttacagaggatcgagacagaggaagagatgccgtcaagagggaggccgctctccctcccgtatctccacttaaggctgccctgtccgaggaggaactagagaagaagagcaaagcaatcatcgaggaatacctgcacttgaacgatatgaaggaagccgttcagtgtgtgcaggagctcgcttcaccatcgctcttgttcatcttcgtccgtcatggcgttgaatctaccctggaacgctctgctatagccagagaacatatggggcagttactgcaccagctgctttgtgccggacacctcagtacagcgcaatattaccaaggactgtatgagattctagaactggctgaagatatggagatagatatccctcacgtttggttatacctggctgaattagtcacgccaatccttcaggagggaggcgtgcccatgggtgagttgtttagggagatcacaaaaccgttgaggcccctgggcaaagcggcttctttgttactcgagatactgggcctgttgtgtaaaagcatgggcccaaagaaggtaggtacactgtggcgcgaggcaggactgtcgtggaaagaatttttgcccgaggggcaggacatcggggcatttgtggcagagcagaaggtcgaatacacactaggtgaagaatccgaggcccctgggcagcgagcactgccttccgaagaattaaaccggcagctcgagaaactgctcaaggaaggttctagtaaccaacgcgtttttgattggatcgaggcgaaccttagcgagcagcagattgtgtcaaacactctggtgcgggctctgatgacggctgtctgctactcagccattatcttcgagaccccgttgcgcgtggacgtcgccgtgctcaaggccagggctaaacttttgcaaaaatatctgtgtgatgaacaaaaggaactgcaggcgctatacgcattgcaggccttggtcgtgacactcgagcaacccccaaaccttcttagaatgtttttcgatgccctgtatgacgaggacgtggtgaaggaggacgccttctacagttgggaatcttcgaaggatccggctgagcaacagggtaaaggcgtggccctgaagtctgtcacggccttctttaagtggttgagggaggccgaagaggagtccgatcacaattag

SEQ ID NO: 28543 - DNA, 432 bp, Artificial Sequence
  Description of Artificial Sequence: Synthetic coding sequence
atgtcaggggcacgcactgcttcaacccccaccccacctcaaacaggcggaggactcgaaccgcaagcaaatggagagacaccacaagtagccgtaattgtcaggcctgacgataggagtcagggagctattattgccgaccgcccaggattgcccggtcctgagcacagcccttctgaatcccagcctagttcccccagtcccacgccctcacctagccctgttctagagcctggcagcgagcccaacctggccgtgctgagtattccaggtgacacgatgaccaccatacagatgtctgtcgaggagtctacccccattagccgcgaaaccggagagccttacagactgtcccctgaacccactccgctggccgagcctattcttgaggtggaggtcactttatctaagcccgtgcccgaatccgagtag

SEQ ID NO: 28544 - DNA, 4215 bp, Artificial Sequence
  Description of Artificial Sequence: Synthetic coding sequence
atgtccggtgctaggaccgcgagcacaccaacgccaccccagaccggcggtgggttagagccccaggcgaacggagagaccccccaggtggctgttatcgtaaggcccgatgaccgctctcagggcgctataatcgccgatagacccggattacctggtcccgagcacagtccgagtgagtcccagcctagttcccctagccctaccccatctccatcaccggttctggagcctggtagcgaacccaacctggccgtgttgtccatccctggggatacaatgaccaccatccaaatgagtgtggaggagtcaacacctattagccgcgagactggagaaccatatagactttctccagagcccacccctcttgcagagcccatcctggaggtcgaggtgacactctcaaagccagtcccagaatctgagttctccagcagtcctctccaggccccaacacctctcgcttcacacacagtagagattcatgaacccaatggaatggtgccatctgaagatctggagccagaagtcgaatcgtcacccgagctggccccaccacccgcatgcccaagtgaatctccagtgccaattgccccaaccgcacaacccgaggagctcctcaacggcgcaccttctccacctgctgtcgatctttcccccgtgtccgagccagaggaacaagcaaaagaggtgactgcctcaatggcccctccaactattccctcagcaacacctgcaacagcaccttccgctacatccccagcacaagaggaggagatggaagaagaagaggaggaggaggagggggaagcgggtgaagctggggaagcagaaagtgaaaagggaggagaagaattactgcctccggagagcacccctatacccgctaacctgtctcagaacctggaggccgcagcggcaacgcaagttgcggtatctgtacccaaaagacgacggaaaatcaaggaattaaacaagaaggaggctgtaggcgatctgcttgatgcctttaaagaagctaacccagccgttcctgaggtggagaaccagccacccgctgggtcaaaccctggccctgaaagcgaaggctcgggcgtgccaccaagaccagaggaggccgatgagacgtgggacagcaaggaagacaaaattcacaacgccgagaacatccaaccaggagaacagaaatacgaatacaagagcgaccagtggaagcctctcaacctcgaggagaagaagcggtacgacagggaattcctccttggcttccagttcatctttgcaagcatgcaaaagccagagggactcccacacataagcgatgttgtcttggacaaagcaaacaagactcctcttaggcccctggatcccacaagactccaaggtataaattgtggtccagattttacaccgagtttcgctaacctgggaagaacaaccctgagcacccgtggaccaccgagaggcggacctggaggtgaactgcccaggggcccacaggccggtttgggaccacgcagaagccagcaaggacccaggaaggagcccaggaaaatcatcgcaactgtgctgatgacggaggatattaaactgaacaaggctgaaaaggcatggaagccttctagtaaacgaacagcagctgataaggatagaggggaagaggacgcagacggcagcaagacacaggacttatttcgacgcgtgcgcagcattctgaataaactaacaccacaaatgtttcagcagctaatgaagcaggttacccagctggcaatcgacactgaggaaaggcttaagggagtgatagatttgatttttgagaaggctatctcggaaccaaactttagcgtcgcttacgccaacatgtgccgatgcttaatggctttgaaagtgccgacgacggaaaagcctactgttacggtaaacttcaggaaacttctgctcaaccgatgtcaaaaagaattcgaaaaagacaaagacgacgacgaggtgttcgagaaaaaacagaaagaaatggacgaggccgcaaccgccgaagagcgcggaagattgaaagaagagctagaagaggcccgtgatatcgctagacgacggagtctcggtaatatcaagttcataggggagctgttcaagttaaaaatgctcaccgaagcgataatgcatgactgcgtggtaaagctcttgaagaaccatgatgaagagagtctggagtgcctgtgccgtctgctgacaaccatcggtaaagacctcgactttgagaaggccaagccccgtatggatcaatattttaatcaaatggagaagatcattaaagaaaagaagacttcttcccgcatccgattcatgcttcaggacgtgctggaccttcgcggaagtaactgggtgcccagacggggagatcagggcccaaagacaatcgaccagatccataaggaggcagagatggaagagcaccgggagcatatcaaggtgcagcaattgatggctaaggggagtgacaaacgtcggggagggcctccgggtccgcctatttcccggggtttacccctggttgacgacggaggctggaacaccgtcccaatctccaaggggagcagacctattgatacttcgcggctgaccaagattaccaaacctggttcaattgactcgaataaccaacttttcgctcctgggggtcggttaagctggggaaagggctctagtgggggaagcggcgcaaaaccgtccgacgcagcctcagaggccgcacgccctgcaacctccactttgaatcgctttagcgccttacagcaggctgtaccaactgaaagtactgacaatcgcagggttgttcagcgttcctcactgtctcgcgaaagaggtgagaaagccggagacagaggggatcgactggagcgatccgaacgagggggagatagaggtgatcgcctggacagagctaggacacccgctacaaaacggtccttcagtaaggaggttgaagagcggtctcgggagcgtccatcccagcctgaggggctccgcaaagctgcatctctcaccgaggaccgggatcgcggacgagacgcagtgaagcgagaggcagcactaccccctgtttctccactgaaggcggctttgtcagaggaggaactggagaaaaaatcaaaagcaatcatagaagagtatttgcacctgaacgatatgaaggaagctgtgcaatgcgtacaggagttggcttctccaagcttgcttttcattttcgtcaggcacggcgtggagtcgacacttgagagaagcgctattgccagggagcatatgggccagctgctgcatcaactgctctgcgcagggcatttgagcaccgctcagtactatcagggcctttatgagatcttggagctggcggaggacatggagatcgacattcctcatgtctggctataccttgcagaacttgttacccccattcttcaggagggtggggtgccaatgggagaactcttccgtgagattacaaaacccctgaggcctctggggaaggcagcctctcttctattagagatccttggcctcctgtgcaagtcgatggggcctaagaaggtcggtacactctggagggaagctggattatcttggaaggagtttctcccagaggggcaggacatcggtgcttttgtcgccgagcaaaaggttgagtacactttgggtgaagagagtgaggcgccaggtcagagagctcttccaagcgaggaactgaaccggcagctcgagaagctacttaaggagggttcctcgaaccaaagggtttttgactggatagaggctaatctctctgagcagcagattgtctcaaacactttagttagggcattaatgacagctgtttgttacagcgcaatcatctttgaaactccattaagggttgatgtcgcagttctcaaggccagagcaaagctcttgcagaaatacctgtgcgacgagcagaaagaacttcaagcactctatgctctgcaggccctagtagttacgttggaacagcccccaaacctgctgaggatgttctttgacgcactgtacgacgaagatgtagtcaaggaagacgctttctattcctgggagtcaagcaaagaccctgccgaacagcaaggtaaaggtgtcgcccttaaatctgtgacagcattcttcaagtggctgcgcgaagctgaagaggaatccgaccacaattag

SEQ ID NO: 28545 - DNA, 4212 bp, Artificial Sequence
  Description of Artificial Sequence: Synthetic coding sequence
atgtccggggctaggacagcgtctacgccaaccccgcctcagacgggcggtggcctggaaccacaggcaaacggtgagaccccgcaggttgctgtcatcgtgcgccctgacgataggtctcagggtgctattatagccgataggccgggactccccggacccgaacactccccctcagagtcacagccctcatcgccaagcccgacaccctcgcccagtcctgttctcgagcccggatctgagcccaacttggctgtgctctccatccccggagacacaatgactactatccaaatgtcagttgaggaatccacccctatttcgcgcgaaaccggagaaccctataggctgtcacctgaacctactcccctggctgagcctatcctggaagtggaggtgactctgagcaagccagtccccgaatctgaatttagcagttccccgctgcaggctccaactccgttagcctcacacaccgtggaaattcatgagcctaacggaatggtccccagtgaagatctcgagcctgaggtggaatcatcacctgagctcgccccaccacctgcctgcccttcagaatcccccgtgccgattgctcccaccgcccagccggaagagttgcttaacggggcacctagtcctcccgctgttgatctatcaccagtaagcgaacctgaagagcaggctaaagaggttaccgcatcaatggctccccctacgattccatccgccacaccggcaactgccccaagcgctacctcgccagcccaggaagaagagatggaagaggaagaggaggaggaagagggagaggccggagaggctggggaagccgaatccgagaagggcggagaggaactccttcctcctgagtccacgcctatccccgctaatctcagccagaatttagaagctgccgcagccactcaggtggcagtctcagttccaaagcggaggaggaagataaaggaactgaataagaaggaggccgtcggtgacctacttgatgcatttaaggaagcaaacccggctgttcctgaagtggagaatcagccaccagctgggtccaatccaggccctgagtcagaagggtccggtgtaccccctcggccagaggaagccgatgagacatgggattcgaaggaggacaagatccacaatgccgagaatatccagccaggggaacagaaatacgaatacaaatcggatcagtggaaacccctcaacctggaggagaaaaaacggtacgaccgcgagtttctgctggggttccagtttatctttgcatcaatgcagaagccagaaggattgccccacataagcgatgtcgtgttagacaaggcgaacaagactcccctaaggcctctcgaccccacacggctgcaggggattaactgcggccctgacttcactccaagtttcgctaatttgggaaggacgacgctgagtactcggggtcctccgcgaggcggtccaggtggcgaactcccaaggggccctgcaggtctcgggccacgccgttctcagcagggtcccaggaaagagcccagaaagatcatagccactgtgctaatgactgaggatattaaactcaataaagcggaaaaagcatggaaaccaagttcgaagaggacggctgccgataaagaccggggtgaggaagatgccgacggtagcaaaacacaggaccttttccggagggtaagatcaattctaaacaagctgactcctcagatgttccagcagttaatgaaacaggtgactcagttggccattgataccgaagaaaggcttaaaggtgttatcgacctgattttcgagaaggccatctccgagcctaacttctcagtggcatatgcaaacatgtgtaggtgtctgatggctttgaaggtgccaaccacagaaaagccgacagtgacagtgaatttccgaaagttgttactgaaccgctgtcaaaaagagttcgagaaagataaggatgacgacgaggtgtttgagaaaaagcagaaggaaatggacgaagcagcaaccgctgaggagcgtggtcggctcaaagaagaactggaggaagcacgcgacatcgccagaagacgatccttgggcaacattaaattcatcggggaactttttaaactcaaaatgctgaccgaggccattatgcacgactgcgtagtgaaacttctaaaaaaccacgatgaggaatcactcgagtgcctgtgccggctgctcaccacaattggaaaggacctggactttgaaaaagctaagccaaggatggaccagtattttaatcaaatggaaaagatcatcaaagaaaagaagaccagctcacgaatcagatttatgcttcaagatgtactggacctcagagggagcaattgggtgcctcggaggggagatcaaggaccgaaaacaatcgaccagatccacaaggaggctgagatggaagagcacagagagcatatcaaagtccaacagctcatggccaaggggtccgataaaaggagaggcggacctccaggaccacccatatcccggggactgcctctagtggatgatggaggctggaacaccgtccccattagtaaagggtcgaggccgatagacactagtaggttaacgaagatcacaaagccaggaagcattgatagtaacaatcagttgttcgcccctggaggtcggctgagctggggaaaaggaagttcagggggatctggagctaaaccctcagacgctgcctccgaggctgccaggcctgctacatccacacttaataggttttcagccttacagcaggcagtgcccacggagagtacagacaaccgcagagtagtacagcggtcttcattatccagagaacggggagagaaagcaggggaccggggagacagactggagcggtcagagagaggcggagacaggggggacaggttagacagagcacggaccccagccactaaaagatccttctccaaggaggttgaggaacggagtagggagcgtcctagtcagcctgagggtcttcgaaaggccgctagtcttaccgaggatagagaccggggacgcgacgccgtcaagcgggaagctgctctgcctccagtctcacccttgaaggcggcactgtcggaggaagaactcgaaaaaaagtccaaagcgattattgaagaataccttcatctgaatgacatgaaggaagctgttcagtgtgtccaggaactggctagccctagcctgttgttcatctttgtccgtcacggtgtggaatctacccttgagcggtccgccatcgccagagagcatatgggccaactgctacatcagctgttgtgcgctgggcacctgagcacggctcagtactaccaggggctgtacgaaatactcgaactggccgaggacatggagattgatattcctcacgtgtggctgtatcttgccgaactggtaactcccatcttgcaggagggtggcgtgccaatgggcgagctttttcgcgaaatcaccaaacccctgaggcctctgggaaaggctgcctcactcttgctggaaattctggggttgctttgtaagagtatggggcctaagaaggtcggcactctctggagggaagctggacttagttggaaggaattcctaccggaaggccaggatatcggagcctttgtggcagagcagaaagtggaatacacattgggcgaggagtctgaagcccctgggcaacgcgctctgccctctgaggaactgaatcgtcagctagaaaagctgctgaaagagggctcgagtaaccaacgggtcttcgactggattgaggcaaacttatccgaacagcagatagtctccaacacgttggttcgggcactgatgaccgccgtgtgttactcggcaattattttcgagacacccctaagagtagacgttgctgtgttgaaagccagggctaaactcctgcagaaatatctgtgcgatgaacagaaggaactccaggcactgtacgcactgcaagcacttgttgtaacactggaacagccacctaacctcctcagaatgtttttcgacgctctgtacgatgaggacgtagtaaaagaagatgccttttatagttgggagtcctctaaagatcctgccgagcagcagggtaaaggcgttgccctcaaatcagtcacagcttttttcaagtggctcagggaggccgaagaggagagcgaccacaattag

SEQ ID NO: 28546 - DNA, 4311 bp, Artificial Sequence
  Description of Artificial Sequence: Synthetic coding sequence
atgaaccaaccgccacaaattgccccaaagcgggagaggaaaactatccgaatccgggaccctaatcagggtggtaaggatatcacggaggaaatcatgtcgggagccaggaccgcgtcaaccccaaccccgccacagactgggggtgggttggagccacaagcgaatggggagactcctcaggtggcagtgatcgtgcgtcccgatgatcgcagtcaaggcgctattatcgcagataggccaggtttgccagggccagagcattcccccagcgagagccagccctcttcaccctctcctacacccagcccctctccagttttagaacccggaagcgaaccaaatctggcagtgctgtccattcccggtgacacgatgaccactatccagatgtccgttgaagagtcaactccaatatctcgggaaacaggtgagccatatcgtctgagccccgagcctaccccactggccgagcccatccttgaggtagaggttacattgagtaaacccgtgccggagtccgagttttcatctagccctttgcaggctccgaccccattggcttctcataccgtggagatacacgagcccaatgggatggttccttcggaagacctggagcctgaggttgaatcgagtccggaacttgctccaccccctgcttgtcccagtgaatctccagtgcccatcgcacccacagcccagccggaggaattgctcaatggcgctccaagcccaccagctgtggacctgtcgccagtgagcgagcctgaagagcaggccaaagaggttacagcttcaatggcgccacctaccattcctagtgcaacccccgctaccgctccttccgctacctctcccgctcaggaggaagagatggaggaagaggaggaggaagaggagggggaagctggagaagccggagaggcagagagcgagaagggaggcgaggagctactgccccctgaatccacccccatccctgctaatctgagccagaatttggaggccgcagctgccacccaggtggcagtgtccgtgcccaagcgcaggcgaaagattaaagaattgaacaaaaaggaggcggttggcgatctgcttgacgctttcaaagaggccaatccggcagttcccgaggtagaaaatcaaccccctgccggttctaaccccggtcctgagtccgagggatcaggggtgccccctcgacctgaggaggctgatgaaacatgggacagcaaggaagacaagatccataatgctgaaaatattcagcctggcgaacagaaatatgagtataagagtgaccaatggaagcctttgaatcttgaagaaaagaagcggtatgacagagaatttttactcggcttccagtttattttcgcttccatgcagaaaccagagggtctgcctcacatatctgatgtggtattggataaggcaaacaagacaccactgaggcctctggatccaacccgccttcaaggcattaattgcgggcctgacttcacaccttccttcgccaaccttggcaggactactctatcaacaagaggccctcccagggggggtcctggaggggaattgccacgcggaccccaggccggactgggacctaggcggtcccaacaagggccacgtaaagaacccagaaagataattgctaccgtgctgatgactgaagatattaaactgaacaaggctgaaaaggcctggaagcctagcagtaagcggacagctgccgacaaggatcggggtgaggaagatgcggatggttctaaaacccaggacctttttagaagggtgagatccattctcaacaagctcacgccgcaaatgttccagcagctcatgaagcaggtgacccagcttgctatagacactgaggagagactaaagggcgtaatcgacctcatcttcgaaaaagctatctccgaaccaaacttctctgttgcctacgccaacatgtgtcggtgcttgatggccctgaaggtccccaccactgagaagccaaccgtgaccgtgaatttccggaagctcctgctgaacagatgccagaaggagttcgagaaggataaggacgacgacgaggtctttgaaaaaaaacaaaaagagatggacgaagcagcaaccgctgaagaacgtgggagactaaaggaggagcttgaagaagcgagagatatcgcgcgtcggcgtagccttggaaacatcaagtttatcggcgagctgtttaaactgaaaatgctgaccgaggctattatgcacgattgcgtggtgaagctcctgaagaaccacgatgaagagtctctcgagtgtctgtgtcgcctgctcacgacgataggtaaggacctcgattttgagaaagccaaaccccgtatggaccaatattttaaccagatggagaagatcataaaggagaaaaagaccagttcaagaatacgatttatgctgcaggacgtgctcgatcttcgcggaagcaattgggtgcctcgccgaggcgatcaggggcctaaaaccatcgatcaaattcataaagaggctgaaatggaagaacaccgcgaacatattaaggtgcaacaactgatggcaaagggatcagacaagcgcagagggggtccgccaggtccccctatttctcgtggcctacctctggtcgatgacggcggttggaacaccgtacccatctctaaggggtcacgcccaatcgacacttctagattgacgaagattactaagcccggaagcattgactctaataaccagctgtttgctcctggcggtcgactctcttggggcaaaggttcctctgggggtagcggagcaaagccctctgatgccgcttccgaggcagcaagacccgctacctcgacacttaaccgctttagtgcattgcagcaggccgtgcctacagaaagcacagacaataggcgggtcgtgcaacggagctctctttccagggaacgcggtgagaaggctggggacagaggggatcgtctggaacgatcggaacggggaggagaccggggagaccggctggaccgggctcggacaccagccacgaaaagatcattttctaaggaggtggaagagcggagcagagagcggccttctcaaccggagggtctgagaaaggccgcttcactgacagaggaccgagatcgcggtcgggacgcggtcaaacgcgaggccgcactaccccctgtgagccccctgaaggctgcgctctcggaggaagaattggagaaaaagagcaaggcaattatcgaggaatatctgcacctgaatgatatgaaggaagctgttcagtgcgtccaggagttagcttctccttctctactttttatatttgtcaggcatggcgttgagtccacactagaaagaagcgcgatcgccagagagcatatgggccagttattgcatcagctgctgtgcgctggccacctctcaacagctcagtactatcagggactctacgaaattctggagcttgcagaagatatggaaatagacattcctcacgtgtggctatatctcgctgagctcgttacacctattctccaggaaggcggagtgccgatgggggaacttttccgggagatcaccaagcctctccgccctctgggaaaagctgcctccctgctccttgagatcctgggcctgctatgcaaaagtatgggccctaaaaaggtgggaacattgtggcgcgaagccggacttagctggaaggagtttctgccagaaggccaggacatcggggcatttgtggctgaacagaaagtggaatacacattgggcgaagagtcagaagcccctggccaacgggcactcccatctgaggagttgaaccgacagctcgagaaactgctgaaggaagggagcagcaaccagcgagttttcgactggattgaggctaacctgtccgaacaacaaatcgtgtccaacaccctggtgcgggctctgatgactgccgtgtgctactctgctatcatcttcgagacccctctcagagtcgacgtggccgtgctgaaagccagagccaagttgttgcagaagtacttgtgcgatgaacagaaggagctgcaggctctgtacgccctccaggctttggtcgtcacattggagcagcctcccaatttgctgagaatgtttttcgatgccctgtacgacgaggacgtggtaaaagaggatgcattttattcttgggagagtagcaaagatccggctgaacagcagggcaaaggggtcgcactcaagtccgtcaccgccttttttaaatggttaagagaagcagaggaagaaagcgatcacaactag

SEQ ID NO: 28547 - DNA, 384 bp, Artificial Sequence
  Description of Artificial Sequence: Synthetic coding sequence
atgagcggcgctcgcaccgcctccacaccgacgccaccccagaccggcggagggttggagcctcaggctaatggcgaaacgccccaggtggctgttattgtccggccagacgaccgcagccaaggggcaatcatcgccgaccgccctggcctgccaggcccagagcattcacccagcgaatctcagcctagttccccaagcccgacccctagcccttcccctgtgctggagcccggttctgaacccaatctggcagtgctgtccattccaggggacactatgacaactatccagatgtccgttgaagaatcgacccctatctctcgagagactggtgaaccctataggcttagccccgagcctaccccgcttgccgagccttag

SEQ ID NO: 28548 - DNA, 264 bp, Artificial Sequence
  Description of Artificial Sequence: Synthetic coding sequence
atgaacaccccctcccaaccacgccaacatttttatccttcccgagcccagccaccaagctctgcagctagtcgagttcaatcggcagcccctgccagaccaggcccagctgcccatgtttaccccgctggcagccaggtgatgatgattccaagccagataagttacccggcaagtcaaggtgcttactacatcccagggcagggtagatcgacctatgtagtgcctactcaacaatatcccgtgcagcctggcgctccctag

SEQ ID NO: 28549 - DNA, 858 bp, Artificial Sequence
  Description of Artificial Sequence: Synthetic coding sequence
atgagtggcgcacggaccgcgtctacccctaccccgccacagactggtggaggtttggaaccgcaagcaaacggcgagacaccacaagtggccgtcatcgtcagacccgacgatagatctcaaggcgcaattatcgccgacaggccaggcctgcccggtcctgagcattctcctagtgagtcacaacccagctctccgagtccaacaccctcgccctcccccgtgttggagccaggcagcgaaccaaacttggccgtgctctctattcctggagataccatgacaactattcagatgagcgtggaagagtctacccccatctcaagggaaacgggagaaccttacagactctcccctgagccaacccccttggccgagccaattctggaggttgaagtcaccctgagtaaacctgttccagaaagcgaattctcgtccagcccgctccaagcaccaaccccgctggccagtcacacagtcgagatccacgaaccaaacggcatggttccaagtgaagatctggaaccagaagtcgagtcttcacctgaactagctccaccacccgcttgtcctagcgagagtcccgtccctattgccccaacagctcagcctgaggagcttctgaacggtgcaccttctccacccgcagtagacctttctcctgtctctgagccagaagagcaggctaaagaggttacagccagcatggctcctcccaccattccgagcgctaccccagcaacagctccatcggctacctcacccgctcaggaggaggagatggaggaggaagaggaggaggaagagggagaagcaggcgaggcgggagaagccgaaagtgagaagggcggagaatag

SEQ ID NO: 28550 - DNA, 1836 bp, Artificial Sequence
  Description of Artificial Sequence: Synthetic coding sequence
atggccgcaagcgcgaaaaagaagaacaagaaaggtaaaacaattagtctcacagatttcctggctgaggacgggggtacgggcggaggaagtacatatgtatccaagcctgtgagctgggcagacgagacagatgaccttgaaggggatgtgtctacaacgtggcacagcaacgatgatgacgtatatagagcccctcctatagacaggtctattctgccaaccgccccaagagccgctcgcgaaccgaatattgacagatccagactgccaaaatcccctccgtatactgccttcctagggaacctgccttatgatgtcactgaggaaagcataaaagaatttttcagggggctgaatatctccgcggtgaggttgcccagagagccttcgaacccagaacgcctgaaaggttttggctacgcagaatttgaagatctggactccctgctgtccgctctcagcttgaatgaggaatccctgggaaacagacgaatacgcgtggacgttgcagaccaagcccaagacaaagatagggacgaccggagcttcggcagggaccgtaacagagactccgataaaaccgacaccgactggagggctcgaccggcaaccgactcattcgatgactatccaccccgaagaggcgacgatagttttggcgacaagtaccgcgatagatacgatagcgaccggtaccgcgatggttatagagatgggtatcgggatggacctagacgagacatggaccgctatggcggtcgcgatcgttacgatgacagaggtagtagagattacgatagaggctacgattctagaatcggttccggaaggcgagcttttgggagcgggtataggcgtgacgacgattatcggggaggaggagacagatacgaggacagatacgatagacgggacgatagaagctggagctctagagacgactactcacgagatgactatcggagagatgataggggccctcctcagaggcctaagctgaacctgaaaccaagatccacccctaaggaagacgatagctccgcttccaccagccagtctacccgggcagcaagtatctttggaggcgctaagcccgttgacaccgccgctcgggagcgcgaggtggaagagagactacaaaaggaacaggagaagctccagcgccagttggacgagccgaagctcgagaggcgtccaagagagcgacacccatcgtggaggagcgaggaaacgcaggagagggagcggtcaagaacaggatcggagtcaagtcagaccggcacatcaaccacaagctctcgcaacgcgagacggcgtgagtcagagaaatccctggaaaacgaaactctgaacaaggaggaggactgtcatagccctacatccaagcctcccaagcccgatcaacccttaaaggtaatgcctgcgccaccccctaaagagaatgcatgggtgaagagaagctcaaaccccccagccagatcacagagtagtgataccgagcagcaaagcccgacttcaggtggcggaaaagtcgcacctgctcagcccagcgaagaagggccaggtagaaaagacgagaataaagtcgatggtatgaatgcacccaaagggcagacaggaaatagcagtcgcggtcccggagacggagggaacagggatcattggaaggaatctgatcgaaaggacggtaagaaagatcaggacagcaggtccgcgccagagccaaagaagcctgaggagaacccggctagcaaattttcatctgcttctaagtatgcagccttgtctgtagacggggaggatgaaaatgaaggggaagattacgctgaatag

SEQ ID NO: 28551 - DNA, 1764 bp, Artificial Sequence
  Description of Artificial Sequence: Synthetic coding sequence
atggccgcatctgctaagaaaaaaaacaaaaagggcaaaacaatatctctcacagattttcttgccgaagatggtgggacagggggtggcagcacatatgtgagcaagccagttagctgggcggacgagacggacgacctggaaggtgatgtctccacaacatggcatagcaatgatgatgatgtgtaccgtgcaccacctatcgaccggtctatcctgccaacggctcccagagcagctcgggaacctaacatcgacaggagccggctaccgaaatctccaccatacacggccttcctggggaacctcccctatgacgtgacagaggagtctattaaggaattctttaggggcctcaacatcagtgcagtccggctgccacgggaaccttccaacccggagcgcctgaagggcttcggttacgcagaattcgaagacttagactccctcctttcagccctatcgttgaatgaggagtctcttggaaatcgtagaatccgcgtggacgtggcggatcaggcccaggacaaagatagagacgacaggagctttgggagagaccggaacagggacagtgataagacggacaccgattggcgtgcacggcctgccaccgattccttcgatgattacccacccagaagaggcgatgattcctttggagacaaatatcgggacagatatgggggtcgtgatagatacgatgaccggggaagcagggactacgataggggatacgattctcgcatcggcagtggcagacgtgccttcggctctggctatagaagagatgacgattatcgcggagggggagaccgctacgaggaccgctacgaccgaagggatgataggtcatggagctcacgagacgactactctagggacgattatagacgggatgacagagggcctcctcagaggcctaagctgaacttgaagccacgtagtacgcccaaagaggacgattcctccgccagcacctcccagagcacgcgcgctgcctcgatttttgggggagctaagcccgtggacacagcagcccgagaacgcgaagtcgaggagcgccttcagaaagagcaggagaaacttcagcggcagctggacgaaccaaagctcgaaagacgaccccgagagagacatcctagctggcgtagcgaggagacgcaggagcgagagagaagccgaacaggctccgagtcaagtcagaccggcacctccactacctcttctagaaatgccaggagacgtgagtccgagaagtctcttgaaaacgagacccttaacaaggaagaagattgccactcacctactagcaagccacccaagccagatcagccactcaaggtcatgcctgcaccgccacccaaggaaaacgcctgggttaagagatcttcaaacccgccagccaggtcacaatcttctgatacagagcagcaatcgcctactagcggtggtggcaaggtggcccctgcacagccttccgaggaaggcccaggcaggaaggacgagaataaagttgacgggatgaatgcacctaaggggcagacaggcaattcctcaagaggacctggcgacggtggaaatagagatcactggaaggagtcagatcgaaaagacgggaagaaagaccaggactcgagatctgcaccagaaccaaaaaaaccggaagagaatcctgctagtaagttttctagcgccagcaaatacgcggctctgagcgtggatggggaggatgagaacgaaggggaggactatgcagaatag

SEQ ID NO: 28552 - DNA, 714 bp, Artificial Sequence
  Description of Artificial Sequence: Synthetic coding sequence
atgctcgacctgacctcccggggtcaggtgggtacatcccggagaatggccgaggccgcatgcagcgctcatttccttgaaacaacacccaccccgaatcctccaacaaccgaagaagagaagaccgaatccaatcaggaagttgctaaccccgagcattacataaaacacccactgcaaaatcggtgggctctgtggttctttaagaatgataagtcaaaaacctggcaggccaacctcagactgatttcaaagtttgataccgtggaggatttttgggcactatacaaccatatccaactgagttctaatctgatgccaggttgtgactacagtctctttaaggacggtattgagcccatgtgggaggatgaaaagaataaaaggggcggaagatggctgatcaccctcaataagcagcagcggagaagtgatcttgatcggttttggctcgagactttactgtgtcttattggcgaatcattcgacgactatagcgatgacgtctgtggagcagttgtaaacgtgcgggctaagggagataagatcgccatatggacaacagaatgtgagaatcgagaagctgtgacacacatcgggcgagtctataaggaacggctgggcctgccacctaagattgtcattggctatcaaagccacgccgacaccgccacaaagtcgggctccacgaccaaaaatcgttttgtggtgtag

SEQ ID NO: 28553 - DNA, 654 bp, Artificial Sequence
  Description of Artificial Sequence: Synthetic coding sequence
atggctactgtcgaaccagagactacacccacacccaaccctcccaccaccgaagaagagaaaaccgaatccaatcaggaagtggcaaacccagagcactatatcaaacatccgctgcagaacaggtgggccctgtggttctttaagaatgacaagagcaagacatggcaagctaatctccgactgatcagcaagttcgacactgtggaggatttctgggccttgtacaaccacatccagctgagtagcaacctgatgccaggctgtgattattcgctgtttaaggacggaatagagccaatgtgggaagacgagaagaacaaacgcggtggtagatggctgattaccctgaacaaacagcagcggcgaagtgatctcgatagattctggctcgaaacacttctctgcctcataggtgaaagctttgatgattactcagacgacgtgtgcggtgctgttgtcaacgtccgggctaaaggggacaagatagctatttggactaccgagtgcgaaaaccgggaggccgtcactcatatcggcagagtgtataaggaacgcctagggctgcctccaaagattgtgataggatatcagtcgcacgcagataccgcaaccaaaagtggcagtacgactaagaatcggtttgtcgtatag

SEQ ID NO: 28554 - DNA, 747 bp, Artificial Sequence
  Description of Artificial Sequence: Synthetic coding sequence
atggccaccgtggaaccagagaccaccccgacacctaacccacctaccacagaggaggagaagacggaaagcaaccaagaggttgcgaatccggagcactacattaaacacccactccagaaccggtgggctttgtggttctttaagaatgacaaaagcaaaacttggcaagccaatcttaggctgatctctaagtttgataccgtcgaagacttctgggccctatataaccatattcaactgtctagtaacctgatgcctggctgcgactactctctgttcaaagatggaatcgaacccatgtgggaggacgagaagaataaacgcggaggccgttggctgatcacattaaataagcagcagcggaggagcgatctggataggttctggttggaaacacgctgggaccttgcaatgctacctaggctagttagcaatttctggccccaggttatactgccactccaacctccaaaggtgctggagctccagctgctgtgcctgattggagagtcctttgacgattattctgacgatgtgtgcggtgccgtggtgaacgtgcgggcaaaaggcgacaagatcgccatttggaccactgaatgtgagaacagagaagctgtgacacacatagggagggtgtacaaagagcgccttggcttgccacctaagatagtcattggttaccagagccatgcggacaccgcgacgaagagtgggtcaaccaccaagaatcgtttcgtggtttag

SEQ ID NO: 28555 - DNA, 357 bp, Artificial Sequence
  Description of Artificial Sequence: Synthetic coding sequence
atgagtggtggttcttcatgctctcaaacaccaagtcgcgcaatcccagcgacgcgaagggtcgtcctgggagatggagttcaactgccaccaggtgattactcaactactccaggcggtaccctgttttccacaacaccaggaggcactcgaattatctacgatcgtaagttcctcatggagtgcaggaactctcctgtaaccaaaactccgcctcgcgacttgcctaccatacccggagtaacatcaccctcttctgatgagccccctatggaagcctctcagagccatttgaggaactcaccagaagacaaaagagcaggaggggaggagagccagtttgaaatggacatctag

SEQ ID NO: 28556 - DNA, 1857 bp, Artificial Sequence
  Description of Artificial Sequence: Synthetic coding sequence
atggcgtcaactgattactccacttactcacaggctgccgcacaacagggttactccgcatacactgcgcagcccacacaaggctacgctcaaacaacacaggcgtatggccagcagagttatggtacatatggtcaaccgactgatgtatcatacacacaggcacagaccactgccacatacgggcagaccgcctatgcaaccagttatggccagccacccaccgggtatacgactcctactgcgcctcaagcctactcacagcccgtgcagggatacggaacaggagcatacgataccaccactgccactgtgaccacaacgcaagcaagttatgccgcacaaagtgcttacgggactcagccagcctaccctgcctacggacagcagccggcagcaaccgcgccaacacggccacaggatggaaataagccaaccgagacgtctcagccccaatcatcaactggaggttataaccagcctagcttaggttatggacaatcaaattactcttacccacaggtacctgggtcgtacccaatgcagccggtaacggcacctccttcatatcccccaacttcttacagttccactcagccgacatcttatgatcagtcctcttacagccagcaaaacacgtacgggcagccgtcatcatatggccagcagtcctcctatggtcagcagtctagttacggccagcagcctcctacttcctatccccctcaaaccggtagctattcccaagccccaagccagtattcacagcaatcatccagctacggccagcaatctagttttagacaggatcacccatcaagtatgggcgtttacggacaggagtcaggagggttttccgggccaggagagaatcgttcaatgtcgggtccagataatcgcggtagaggccgaggaggatttgatcgcggtggaatgtcccgggatccggacgaggatagtgataattctgcgatatacgttcaaggcttaaatgactcggtcacactggacgatcttgcagacttctttaaacagtgcggtgttgtgaagatgaacaagaggacgggccagcctatgattcatatctatctggataaggagactggaaagccaaaaggagacgccacagtgagctatgaggacccacctaccgcaaaggcagccgttgaatggttcgatggcaaggacttccaaggcagcaaactaaaagtgtcacttgccagaaaaaaacctcctatgaacagcatgagaggaggtcttccccctagggagggcagaggaatgcccccaccccttcgaggaggccctggaggacccggtggacccggaggacccatggggaggatggggggacgcggtggcgacaggggaggcttccctccacgtggccctcggggatcacggggaaatccctcaggcggagggaatgtccagcatagggccggagattggcagtgcccaaatcccggttgcggaaaccaaaactttgcctggcgcaccgagtgtaatcagtgcaaggctccgaagcctgaaggtttcctgcctcccccatttccgcctcctgggggtgatagaggtaggggtggacctggtggcatgagggggggtcggggagggctcatggatcggggaggaccaggcggaatgttcaggggcggaagaggaggggacagagggggattcaggggaggcagaggaatggatcggggaggcttcgggggaggcagacggggtggacccggtggtccccctggccctctcatggaacagatgggaggcaggcgcggtgggagaggcggacctggcaaaatggataaaggcgagcataggcaggagcgacgggatcggccttactag

SEQ ID NO: 28557 - DNA, 1803 bp, Artificial Sequence
  Description of Artificial Sequence: Synthetic coding sequence
atggcctccaccgactactcaacttatagtcaggctgcggcacagcaggggtatagtgcctacacggctcagcccacccaaggctacgctcagacgacgcaagcatatgggcagcagtcatatgggacatatgggcaacccacagatgtgtcgtacacacaggctcaaacgacagcaacttacggacaaactgcctatgcgacctcctacgggcagcctcccacagggtacacaaccccaacggcaccccaggcttactcccagcctgtccagggctacggcactggagcctacgatactacaaccgctacagtgacaaccacgcaggcatcatacgcagcacagtcggcatacggcacacagccggcttatcctgcctacggccagcaacccgctgccaccgccccaacaagctacagctccacacagccgacctcatacgaccagtcctcgtattctcagcaaaacacctacggccagcccagctcttacgggcaacaatcatcctacggtcagcagagctcatatggacagcagcctcctacttcttacccaccccagacaggaagctacagtcaagcccctagccaatactcccagcagagctcatcctacgggcaacagagcagttttagacaagatcacccgagctctatgggcgtctacggacaggagagtggcggtttctctggccctggagagaaccgttcaatgtcaggcccagataaccggggaagaggtcgcggtggcttcgacagaggaggtatgtcaagggggggtagggggggagggagagggggtatgggcagcgccggtgagcggggaggctttaacaagccagggggaccaatggatgaagggcctgatctagacctgggcccacccgttgacccagatgaagacagtgacaatagtgctatttatgttcaggggcttaacgatagtgtaaccttagatgatctggctgactttttcaaacagtgcggagtggtaaaaatgaacaagcggacgggtcaacctatgattcacatctatttggacaaagagacggggaaacctaaaggcgacgctaccgtcagctatgaggacccccctaccgccaaagcagctgtggaatggttcgacggcaaggacttccaggggtcaaaactgaaggtatcactggcacgaaaaaagcccccaatgaatagtatgaggggagggctaccacctcgcgaagggcgaggtatgcctccgcctcttcgaggcggacccggtggtccaggtggtcctgggggtcccatgggaagaatgggcggacgcggtggggaccgaggaggctttcctccacgaggacccaggggatcccgcggtaacccatctggcggaggcaacgttcagcatcgggcaggcgactggcagtgtcctaatccaggatgtggaaatcaaaatttcgcgtggagaaccgaatgtaaccaatgtaaggccccaaaaccagagggattcctgcccccaccttttccacctcccggaggcgacaggggccgaggtggccctggtggcatgcggggtggtcggggaggtcttatggatcggggtggtcccggaggtatgtttcgcggtggacgaggaggcgaccggggtggatttcgtggtggaagaggtatggatagaggagggtttggtggagggagacgtgggggaccagggggaccacccggtcctcttatggaacagatggggggacgtcgaggaggacgcggtggaccgggtaagatggataaaggagagcacaggcaagagaggcgggatcgcccttactag

SEQ ID NO: 28558 - DNA, 1752 bp, Artificial Sequence
  Description of Artificial Sequence: Synthetic coding sequence
atggcttctaccgactactctacatatagccaggctgccgctcagcagggctactctgcgtataccgctcagcctactcagggctacgcccaaaccacccaagcctatggacagcagtcttatgggacgtacggacagcctaccgacgtttcctatacccaggcacagactaccgctacatatggacagaccgcttacgctacgagttacggtcagccacctactggatacaccactccaaccgccccacaggcctattcacagccagtacaggggtatggaaccggggcttacgacaccaccaccgccacagttaccactacacaggcgtcttacgccgctcagagtgcttatggtacacagcccgcttaccccgcttatggtcagcagccagctgcaaccgccccaacccgcccacaggatggaaacaagcccaccgagaccagccagccacagtcctcaaccgggggttataatcaacccagcctcggttacgggcaatctaattattcctacccacaggtaccaggctcttaccccatgcagcctgtgacggctcccccttcatacccaccaactagttattctagtacccagccgacgtcctatgaccagtccagctatagtcaacaaaatacgtacggacagccctctagctacggacaacagtctagctacggacagcagtccagctacggacagcagccgcctacatcttatccaccacagaccggttcttatagtcaggctccatctcagtacagccagcagtcttcgtcctacggtcagcagcgccctatggacgagggccctgatctggatctggggccacccgttgaccctgacgaagactctgacaatagtgctatatatgtgcaaggcctgaacgatagtgtgaccctcgacgatctagctgacttttttaagcagtgtggagtggtgaagatgaataaacggacaggccaaccaatgatccatatctatctagataaagagaccggaaaacctaaaggcgacgcaaccgtgagctacgaagatcctcctaccgctaaggccgctgtggagtggttcgatgggaaggattttcagggatctaagctcaaagtctctctggcaagaaagaagcccccaatgaatagcatgaggggaggtttgccaccgcgagaagggcgtggcatgcctcccccactgcggggagggccaggaggcccaggagggcctggcggtcccatggggaggatgggaggaagaggaggggaccgaggcggattcccaccacggggtcctaggggatcgaggggcaatccaagcggcggtggaaatgtgcagcaccgcgcaggtgattggcagtgtcctaatccaggctgcggcaaccaaaatttcgcctggcgcaccgaatgtaatcagtgtaaggccccaaaacccgagggctttctgcccccacccttccccccaccaggaggcgataggggcaggggcggaccgggaggcatgcgtgggggacggggaggtttaatggatagaggtggcccaggtggaatgtttaggggcggtcgagggggtgatcgcggaggatttcgcggtggtagggggatggaccggggaggattcggaggaggcaggcgcggtggcccagggggaccacccggacctctaatggagcagatgggtggacggagaggcggtagaggcggacctggaaagatggataagggagagcaccggcaggaaaggagagataggccatactag

SEQ ID NO: 28559 - DNA, 1971 bp, Artificial Sequence
  Description of Artificial Sequence: Synthetic coding sequence
atggctagtaccgattattccacctactcccaggctgccgcacagcagggctactcggcctacaccgcccagcccactcaagggtatgcacaaacaactcaggcttacggacagcagagttacggcacctacggtcaacctactgacgtgagctacacccaggcacagacaacagcgacatacggccagaccgcctatgctacatcatacggacaaccacctactgggtataccacaccaacagctccccaagcatactcccagcccgtgcagggttatggtactggagcctatgatacgactaccgccaccgtgacaaccacacaggcctcttacgccgcacagtcagcctacggtacgcagcccgcatatccagcatatggccagcagccggcagccacggcaccaacaaggccacaggacggtaataaaccaaccgagactagtcagccccagtcaagcacaggtggttataaccagccatctctcggctatggacagtccaactacagctacccccaggttcccggtagctaccctatgcaaccagtgacggcgccaccgagctaccctcccaccagctacagctcaacccagcccaccagctacgatcagagtagctactctcagcagaatacatacggccagccctcatcgtacggccagcagagttcatatggtcagcagtcctcctacgggcagcaaccacccacatcgtatcctccacaaacgggctcctatagccaggctccaagtcagtactcccagcagtcctcttcatatggtcagcagagtagctttcgacaggaccatccttcttcaatgggagtgtatggacaggagagcggaggcttcagtggaccaggagaaaaccgctccatgtccggccctgacaatcgtggccgtggacggggtgggttcgatcggggtggaatgtcaagaggaggacggggaggaggccgaggtggcatgggcagcgctggggagagagggggattcaacaagccaggcggacccatggacgaaggaccggatttggatctgggaccgcctgttgaccccgacgaggattccgacaactccgccatctacgtccaagggctgaatgacagcgtgaccctcgatgacttggcagacttctttaaacagtgtggcgtggtcaagatgaataagaggacaggacagccaatgatccacatctatctggataaggagacaggtaagcccaagggagacgctaccgtgagctacgaggaccctcctacggccaaggcggcagtggaatggtttgacggtaaagacttccagggatctaagcttaaggtaagcctcgccaggaaaaagccaccgatgaattctatgaggggcggacttccccctcgcgaaggcagaggaatgccgccaccgctgagggggggacccggtggccctggagggcctggcggacctatgggacggatggggggtagaggcggtgaccggggtggattccccccacgcggacccagggggtctcgcggtaatcccagcgggggaggaaacgtccagcatagggcaggcgactggcaatgtcccaaccccggttgcggaaatcagaacttcgcctggaggacagagtgcaaccagtgcaaggcgccaaagcctgagggcttcctgcctccaccttttccacccccagggggtgaccggggacgcggaggtccgggtggcatgagggggggtaggggcggattaatggacagaggcggtcctggaggcatgttccggggagggagaggcggtgaccggggtggattccgaggaggtagaggtatggatcggggaggcttcggcggtgggaggagaggtggacccggaggtcctcccggaccgcttatggagcaaatgggcggtcgacgcggagggcgtgggggtcccggtaaaatggacaagggagagcaccggcaagaaaggcgggatcggccttattag

SEQ ID NO: 28560 - DNA, 1968 bp, Artificial Sequence
  Description of Artificial Sequence: Synthetic coding sequence
atggcgagcactgattattctacatactcccaggccgctgctcaacagggatatagcgcgtacaccgcacagcccacacagggctacgctcagaccacccaagcctatgggcagcaatcatacggtacatacgggcaacctacagatgtctcctacacccaggctcagaccaccgcaacatatgggcagacggcttacgccaccagttacggccagcccccaactggatacactacccccactgccccacaagcctattctcagcccgtgcaggggtacggcaccggcgcatacgacacgaccacagccacggtgactactacacaagccagttacgcggcacagtccgcctatggaacacagccagcatacccagcatacgggcaacagcctgccgctaccgctcctaccagaccacaagatggcaataaaccaacagagacctcccagccacagagcagcaccggcggatataatcagccgtcattggggtacggccagagcaattatagctatcctcaggttccgggaagctatcccatgcagcctgtcacagccccaccctcatatccacccaccagttactcgtccacccagcctacttcatatgaccagtcaagctattcccagcaaaatacatacggacagccctccagttatggccaacaaagttcttatggccagcagtcatcttacggacaacagcccccaacatcatatccgccacagactgggagctacagccaggcaccctcacaatatagccaacagagcagctcctatggtcagcagagcagctttagacaggatcaccctagttcaatgggggtgtatggccaggaatcgggtggattttccgggcctggtgagaatcgcagtatgtcagggcctgacaaccgcggtcgcggtcgaggcggatttgatcggggtggtatgtcccggggtgggagaggaggaggtagagggggaatgggagccggagagagagggggatttaacaagcctggcggtcccatggacgaaggtcccgacctcgacctgggtccccctgttgacccagacgaagacagtgataacagtgcgatttatgtgcagggacttaatgactcagtgaccctggacgatctggctgatttttttaaacagtgcggcgtggtcaaaatgaacaagcgcactggacagccaatgattcatatctatcttgataaggaaaccgggaagccaaagggagacgctaccgtgtcctacgaagatcctccgaccgcaaaggccgctgtagaatggtttgatggcaaggacttccaaggctctaaactcaaagtcagcctggcccgaaaaaagcctcccatgaactccatgcgcggagggcttccccctcgggagggccgtggcatgccccctcctttgcgcggtggtccaggcggtccgggaggacctggaggcccaatgggaagaatgggaggtagagggggagaccggggagggtttccgcctcgaggtcccaggggcagccgcggtaatcctagtgggggtggaaacgtacagcaccgggcaggcgattggcagtgtccgaacccaggttgcgggaaccagaacttcgcctggagaactgaatgcaatcagtgtaaagctcccaagcccgagggattcctgccgccaccattcccaccccctggcggtgaccggggtcggggaggacccggaggtatgaggggcggacgcggaggactaatggatagagggggaccgggtggtatgttccggggaggcaggggcggagatcgcggaggcttccgcggaggaagagggatggaccggggaggctttggcggtgggcgacgcggtgggccaggaggaccaccagggccattgatggagcagatgggcggacgcagaggcggtaggggtggccctgggaagatggacaaaggagaacaccggcaagagcgacgggaccgcccatactag

SEQ ID NO: 28561 - DNA, 1986 bp, Artificial Sequence
  Description of Artificial Sequence: Synthetic coding sequence
atggcaagcactgattattccacatacagccaggcagccgctcaacaaggttacagtgcatacacagcacaacctacccaaggctacgctcagactacacaggcatacgggcagcagagttacggcacatatggacagccaaccgatgtttcttacacacaggcccaaaccaccgctacttatgggcagactgcctacgctaccagctacggccaaccacccactgtggaagggaccagtacaggctacactaccccaaccgcccctcaggcctactcgcagccagtacagggatacggaacgggggcttatgacacgaccaccgcgaccgtgacaacaactcaagcttcctatgcagcgcagtccgcatatggaacccagccggcataccccgcatacggccagcagccagctgccacagccccaacgcgtccgcaggatggtaataagcctaccgaaactagccagccgcagtcaagcaccgggggatataatcagccctctttgggctacggacaatctaactacagctatccgcaggttcccggatcttacccaatgcagcccgttacagcccctccatcttacccacctactagctattcgagcacacagcccacctcttatgaccaatccagctactcacaacagaacacctatggccagccctcctcatacgggcaacagagtagttacgggcagcagagttcatatggacagcagcccccaacatcttatcctcctcagacagggagttattctcaggctccttcacagtattcccaacaaagttcaagctacggccagcaaagttcctttagacaggatcacccatcctctatgggagtgtacgggcaggagtctgggggatttagcggcccaggcgagaacagatctatgagtggtcctgacaaccgcggaagggggagagggggattcgataggggcggaatgtcccgcggtggtcggggtggagggaggggaggcatgggcgctggggagagggggggtttcaataagccaggcggtcccatggatgaaggccctgacctcgaccttggtcctcctgttgatcctgacgaggacagcgacaattcggcgatctacgtgcaggggctcaacgactccgttacgcttgacgacctcgcggattttttcaagcagtgtggtgtcgtcaagatgaacaaaagaacgggacaaccaatgatacatatctatttggataaggagacaggtaagccgaaaggtgacgctaccgtcagctacgaagatcctcccaccgcaaaggcagctgtcgagtggtttgacggcaaggacttccaggggtccaagctcaaggttagccttgcacgaaaaaaaccgcctatgaattcaatgcgcggaggcctgccccctcgagaaggaaggggcatgcccccacctttgcgcggtggacccggaggaccaggcggaccaggcggacccatgggaaggatggggggacggggaggtgatcgtggcggattcccaccgaggggtcccagaggatcaagaggcaaccctagcggcggtggcaatgtgcagcacagggcaggtgattggcaatgcccaaatcctggctgtggaaaccagaacttcgcgtggagaactgagtgcaatcagtgcaaggccccaaagccagaagggttcctgcccccaccatttccccctccagggggagatcggggacgcggagggcctggcggtatgaggggtgggagggggggactgatggacagaggtggacccggtgggatgttccgcggaggcagggggggagatcggggaggctttagaggtggtcgcggaatggatcgtgggggtttcggcggaggcagaagggggggacctggcggtccaccaggacccctgatggagcagatgggcggacgacggggtggcagagggggtcccggaaagatggacaagggagaacatcgacaggaacgccgagacaggccctattag

SEQ ID NO: 28562 - DNA, 543 bp, Artificial Sequence
  Description of Artificial Sequence: Synthetic coding sequence
atggcctctaccgattattcaacttattctcaagcggcagcccagcagggatactccgcctacactgcccagcctacccaaggatatgctcagacgacccaggctagctatgctgcacaatccgcttacggaacccagcccgcataccctgcttacggacaacagcctgctgccactgcacccacccgaccacaggacggcaacaaacccactgagaccagccagcctcagtccagtactggcggatataatcagccctccctcggttacggacagtcaaactactcatacccacaggtcccgggaagttaccccatgcagcctgttacagcccctccttcatatccgcctacaagctactcttctacgcagccgactagctatgatcagagctcctattctcaacagaatacttacgggcagccatcgtcttacggacagcaatcatcttacggtcagcaatcctcttatggacagcagccacccacatcctacccgccacagaccggatcttattctcaggcccctagtcagtacagctag

SEQ ID NO: 28563 - DNA, 1065 bp, Artificial Sequence
  Description of Artificial Sequence: Synthetic coding sequence
atggctagcaccgattatagcacctactcccaggccgcagcacagcagggctacagcgcctacacggctcagcctactcagggctatgcacagacaactcaggcctatgggcagcagtcgtatggcacatatggacagccaaccgacgtgtcctacacacaagctcagaccacagccacttacggacaaacagcgtatgcaacatcctatggtcagcctccgactgggtataccactcctacagcgcctcaggcctacagtcaacccgtccagggttacggtacaggagcttacgatacaacaaccgctactgtgactaccactcaggcaagttacgctgcgcaatcggcatatggaacccagcctgcctaccccgcttatggccaacagcccgctgccacagccccaactagacctcaggacggaaacaagccaacagagacctcccagccccagtcctcaacgggaggatacaaccaaccttccctgggctatggtcaaagcaattatagttatccacaggttcccggttcctatccgatgcaaccagtgaccgccccacccagttacccacccacaagctattcttccacccagccaacgtcttacgatcaaagcagctatagccagcagaacacatatggacagcccagctcttacgggcaacagtctagctatgggcaacagtcctcctatgggcagcagccacctacttcttacccccctcagactggctcatatagccaagcacctagtcaatattcccaacaatcgtcctcatatgggcagcaaagctcctttagacaggatcatccttcttcgatgggcgtttatgggcaagagtccggaggcttctcgggccctggggaaaataggtctatgagcggtcccgataatcggggaagaggacgagggggttttgacagaggcggaatgtcacggggagggcgagggggtggaaggggaggcatgggcctgcagtccgagagcctcgtctacacaagcatcttaaagaaatatccctattcagtcctgtcaaggcagcacaatgaaaaatgggactag

SEQ ID NO: 28564 - DNA, 972 bp, Artificial Sequence
  Description of Artificial Sequence: Synthetic coding sequence
atggaccccggaaaagacaaggagggcgttccccaaccctccggcccacccgcaagaaaaaagtttgtcatacctctcgacgaggacgaggtcccgcctggcgtggccaaaccgttgtttcggtcaacccagagtctgcctacggtcgacacctctgctcaggctgcgcctcagacttacgctgagtatgcaatttcccaaccactagaaggagccggtgcaacgtgtccaacaggaagcgagcccttggcgggtgaaacccccaatcaggctcttaagccaggggcaaagagcaactcaataatcgtgtcccccaggcaacgaggcaacccagtccttaaatttgtccgcaacgtgccctgggaattcggagatgtcatcccagactacgtcctggggcaatccacctgtgccttgtttctaagtctgcggtaccacaaccttcatcccgactatattcacggacggctgcagagcttgggaaaaaactttgctctccgagtcctgcttgtgcaggtggatgtaaaggacccacagcaggccttaaaagagcttgcaaaaatgtgcattctggctgattgtaccttaatcctggcctggagcccggaggaagctggtcgctatctggaaacctacaaagcatacgagcagaagcctgcagaccttttgatggagaagctcgagcaggatttcgtgagcagagtcaccgaatgcctgaccaccgtcaaatctgtcaataaaactgatagtcagaccctgctcaccacctttggctccctcgaacaactcattgccgcttcacgagaggatctggctttatgtcccggactcgggcctcagaaagttcgcgcactaggcaagaatcccagaagctggggcaaggagcgcgctcctaataaacataacctgcgaccacagtcttttaaggttaagaaagaacccaaaacccgccactccggcttccgactgtag

SEQ ID NO: 28565 - DNA, 894 bp, Artificial Sequence
  Description of Artificial Sequence: Synthetic coding sequence
atggaccccggaaaagataaggaaggagttcctcagccatcaggtcctcccgctcgaaagaagttcgtcattcctctcgacgaagatgaagttcctcctggggtcgcgaaacccctcttccgttctactcagtcccttcccacggtcgacacatctgctcaggcagctccgcaaacctatgcagagtatgccatctctcagcctctagagggagctggcgcaacgtgccctaccggctcagaacctcttgcaggagagacccccaatcaggcactgaaaccaggcgcaaaatccaactcaatcattgtttcccctcgccagcgtggcaatcccgtgctgaaattcgtaaggaacgtcccctgggagtttggggacgtcatacccgattacgtgctgggtcaatctacatgcgccttattcctgtctctgcgttaccataacctccatcctgattatattcacggcagattgcaatcattagggaagaactttgccttgagggtcctcctggtccaggtggacgtgaaggacccccaacaggcgcttaaagaactggcaaaaatgtgcattttggccgactgcaccctgatcctggcatggtctcctgaggaagcgggaagatatcttgagacatacaaggcatacgaacagaaaccggctgatctgctgatggaaaagcttgagcaggattttgtgtcccgagtgaccgagtgtctaaccactgtgaaatcagttaataaaaccgactcccagaccctgttgactacattcgggagcttggagcagctgattgctgctagccgcgaggacctggcattgtgtcccggattgggccctcagaaggcacgcagactgtttgacgtgctacatgagccttttcttaaggtcccttag

SEQ ID NO: 28566 - DNA, 822 bp, Artificial Sequence
  Description of Artificial Sequence: Synthetic coding sequence
atggaccctggaaaagataaagagggagtccctcagccatctggtccgcctgcgagaaagaagttcgtgattccactagacgaggacgaggtgccaccgggtgtggctaagcccctttttcgaagcacacaatcactgccaacagtggacaccagcgctcaggctgccccacaaacatatgcagaatacgcgataagccagcccctggaaggcgcaggagcaacttgccccacaggatcagagcccctggcaggcgagactcccaatcaggcactgaagccaggagctaaatccaacagtattatcgtaagtcctagacagcggggtaacccggtactcaaatttgtgaggaacgttccgtgggagtttggcgatgtgatacccgactacgtccttggccaatcaacgtgcgcactctttttatccttgagataccataacctccaccccgactatatccacggtagactgcagtccctaggtaaaaatttcgcgctgagagtactcctggtgcaggtggacgtgaaagatccccagcaagccttgaaagaactcgcgaaaatgtgcattctcgctgactgtactctgatcttagcgtggtcacccgaggaggccggacgatatctggaaacttataaagcgtatgaacaaaaacctgctgatcttttgatggagaaactagaacaggattttgtgtcccgcagtctcgagcagttaatcgcagcctcacgcgaggatcttgccctttgcccaggtttaggaccacagaaggccaggcgactatttgacgtcctgcatgagccgttcttgaaagtgccctag

SEQ ID NO: 28567 - DNA, 678 bp, Artificial Sequence
  Description of Artificial Sequence: Synthetic coding sequence
atggaccccggaaaagataaggagggcgtgccacagccctctggcccaccagcaaggaagaaattcgttatccccctcgatgaagacgaggtcccccctggtgtacgaggaaatcccgtgctaaaatttgtacgaaatgtcccctgggaatttggtgacgtcatacctgactatgtgcttggacaatccacatgcgccctctttctcagcctccgataccacaacctccacccagactatattcatggcagactgcagtctcttggcaaaaattttgccctcagggtgctgctcgtgcaggttgatgtgaaagaccctcagcaggcattgaaggaattagccaagatgtgtatactagccgattgtactctcatcctggcgtggtctcctgaggaagctggaagatacctggaaacctacaaagcttatgagcagaagccggctgacttactcatggaaaagcttgagcaggatttcgtgtctcgggtgaccgagtgcctaacaaccgtgaagtctgtgaacaagaccgactctcagactctgctgactacattcggtagtttagaacaattgatcgccgcttcccgggaggatctggcattatgcccagggctcgggcctcagaaggctaggcgtcttttcgacgtcctgcatgaacccttcctgaaggtgccatag

SEQ ID NO: 28568 - DNA, 120 bp, Artificial Sequence
  Description of Artificial Sequence: Synthetic coding sequence
atggatccagggaaagacaaagagggagtgccccagccttccgggcctcccgcacggaaaaaatttgtcataccgctggacgaagacgaggttccccctggtgtgagcaagcccctctag

SEQ ID NO: 28569 - DNA, 726 bp, Artificial Sequence
  Description of Artificial Sequence: Synthetic coding sequence
atggctagtctgagcggcctggcctcagcactggaatcttatagaggacgagaccgactgatccgtgtactagggtattgctgccaactcgtggggggagtcttggtggaacaatgccccgctcgatcggaagtgggaacccgacttctcgtagtgtccactcagctcagccattgtagaacaatcttacgcctgtttgatgacctggccatgttcgtctatacaaagcagtatggactgggcgctcaggaggaagacgccttcgtgaggtgcgtttcagtattgggcaatcttgcagatcaactctactatccctgcgagcatgtcgcttgggccgctgatgccagagtcttgcacgtggactcttcccggtggtggacactgtcgaccaccctgtgggccctgagcctgctgttgggagtcgccagaagtctgtggatgctgttaaagctgaggcaacgtctccggagccccacagcaccatttacatccccgttgccaaggggcaaacgtagggctatggaggcacaaatgcagtccgaggctctgtccctcctgagcaatcttgctgatcttgctaatgcagtgcactggctccctagaggcgtcctgtgggccggtagatttcctccttggttggtggggctgatgggaactatatcatccatcctctcgatgtatcaggccgctcgagccggtgggcaagccgaggccactaccccctag

SEQ ID NO: 28570 - DNA, 1218 bp, Artificial Sequence
  Description of Artificial Sequence: Synthetic coding sequence
atgcgcgaactgaaaagaactctagacgccaaggggcacggagtgctagagatgccatcagggaccggcaaaaccgtgagccttctagccttaatcatggcgtatcagcgggcttatcccctagaggtgactaaactgatttactgctctcgcactgtcccagagattgagaaagtgatcgaggagctgcgaaagctcttaaatttctacgagaaacaagagggcgaaaagttgcccttcctgggtctggccctgagtagtaggaagaacctgtgtattcaccctgaggtgaccccactgcggtttggcaaggacgtcgatggaaaatgccactcccttactgcatcctacgtcagagcacagtaccaacacgacacctccctcccacattgccggttttacgaggagtttgacgcccacggacgggaggtgcccctgcctgcgggaatctacaaccttgacgatctgaaggctctcggcagacggcagggttggtgcccttacttcttggccaggtattccattcttcatgctaatgtcgtggtgtattcctatcattaccttttggatcctaaaattgctgacctggtttcaaaggagctagccaggaaggctgtggttgtgttcgacgaagcacataatatcgacaacgtgtgtatagactcaatgtccgtcaacctcacccgcaggacacttgataggtgccagggcaatttggagactctgcagaagacagtgttacgcattaaagaaacagacgagcagagattgagggatgagtacagaagacttgttgaaggactgagggaagcctcagccgctagggagaccgatgcccatctcgctaacccagtgctgccagacgaggttctgcaggaggcagtgcccggatctatcagaactgctgaacactttcttggcttcctacgcagactgctcgaatatgtgaaatggagactccgggtgcagcatgttgtccaagaatcacctcccgcttttctgagtggcctagcacagcgcgtttgtatacagcgaaagccccttaggttttgtgctgagcgcttgcgaagcctgctccacaccctcgagatcactgatctcgcagatttttccccactgactcttctcgccaactttgccacgctagtgtccacttatgcaaaaggccaggcccagcactgtggctccagccggaaccagaagcgtagccatccatag

SEQ ID NO: 28571 - DNA, 2133 bp, Artificial Sequence
  Description of Artificial Sequence: Synthetic coding sequence
atgagagaactgaagaggacgttagacgccaaggcctaccccctcgaggtgaccaaactcatttattgctctcgcacagtcccggagatcgagaaagtaattgaagagttacgtaaactgcttaatttttatgaaaagcaggaaggagagaaactgccgtttctgggcctggccctaagtagcaggaaaaatctttgtattcatcccgaagtgactccactccggttcggaaaggatgtggatgggaagtgtcattccctgaccgccagctacgtgcgggctcagtaccagcatgatactagtctaccacactgccggttttacgaggaatttgatgcacacgggcgagaagtgcccctgccagccggtatttataatctggacgacctgaaagccttaggtagacgccagggatggtgcccttatttcctcgcacgctattccatactccacgcaaatgtggtcgtctattcatatcactatctgctcgatccaaagattgccgatcttgtgtcaaaggagttggcaaggaaggccgtggttgtgtttgatgaagcgcataatatcgacaacgtgtgcatcgactccatgtccgtgaacttgacaaggcgaaccctggataggtgccaggggaaccttgagaccctccagaaaacggtcctacgtattaaggagacggacgagcagcgtctccgtgacgagtatcggagacttgtggagggtctgagggaggcttcagccgctcgggagaccgacgctcacctggccaatccggtccttcctgatgaggtgctgcaggaggctgtacctgggtcaatccgtactgctgaacacttcctcggttttctccggcgactgctcgagtatgtcaagtggcggctcagggtgcagcacgtggtgcaggaatcgcctcccgctttcctcagtggcctggctcagagagtgtgtatccaacggaagccattgaggttctgtgcagaaagattgcgctccctgttacacacgctcgaaatcacagatttggcagatttcagtcccttgaccttgctcgcaaactttgccacactggtgtccacatacgccaaagggtttactattataattgaacccttcgacgatcggacaccaacaatcgccaacccgattctgcatttttcttgtatggatgctagtctcgcaattaagccagtgtttgagcggttccagtccgttataattacctcaggtacactgagcccacttgatatctatcccaagatactggacttccaccccgtgaccatggcgacattcactatgaccttagcaagggtctgcctgtgtcctatgattatcgggaggggcaatgaccaggttgcaatctcatccaagtttgaaacaagggaggatattgccgtaatcagaaattacggtaacctgcttctggaaatgtccgccgtcgtgcctgacggcatcgtcgcattttttaccagctaccagtacatggagagcacagtggcatcttggtacgagcaggggatactggagaatattcagcgaaataagctactgtttatagagacccaggatggggctgaaacctctgttgccctcgagaagtaccaggaggcttgcgaaaatggtcgcggtgccatattacttagtgtggccaggggaaaggtgagtgagggcatcgattttgtacatcactatgggcgtgccgtgatcatgttcggggtgccgtatgtgtatactcaatccagaatccttaaagcccgtcttgagtacctgcgcgatcagtttcagattcgtgaaaacgatttcctaacattcgatgccatgcgccatgccgctcagtgcgttggccgagccatcagagggaagactgactatggtttgatggtcttcgcggataaacggtttgctaggggtgataaacgaggcaagcttcccaggtggattcaggagcacttaaccgatgcgaatctcaacctcacagtagatgagggagttcaggttgctaagtactttctgaggcagatggcacaacccttccatcgcgaggaccagttgggactgtcacttctctcccttgagcagttggagtctgaggaaactcttaaacgaatcgagcagatcgcccaacagctctag

SEQ ID NO: 28572 - DNA, 2211 bp, Artificial Sequence
  Description of Artificial Sequence: Synthetic coding sequence
atgcgcgagcttaagcgcacactcgatgcgaagggccatggagtgctagagatgccctccggaaccggcaaaaccgtctccctgttagccctcatcatggcctatcagcgggcatatcccctggaggtaacaaaactgatttattgttctcggacggtgcccgaaattgaaaaggttattgaggagttgcggaagctcctgaatttttatgaaaagcaggaaggggagaaactgcccttcctgggactcgcattgagctcacgaaagaacctgtgcatccaccctgaagtcacaccgctgaggtttggtaaggatgttgatggcaaatgtcattccctcacagcctcctacgttcgggctcagtaccagcatgacacatctctcccacactgccgcttctatgaagaattcgacgcccatgggcgtgaggtccctcttcccgctggaatctacaacctcgatgatctgaaggcactcggcaggagacaggggtggtgcccctacttcttggccagatattctatactgcacgcgaatgtggtggtgtattcctatcactacctgttggacccaaagatagccgaccttgttagcaaggagctggccaggaaagctgtcgtggtttttgacgaggcccataacattgacaatgtgtgcatcgatagcatgagtgtcaacctcacaaggcggacgctagatcgttgtcagggtaatcttgagactctccaaaaaactgtgctccgcattaaggagactgacgaacagcggctgcgggacgagtaccggagacttgtcgaaggtttgcgcgaggctagcgctgcacgagaaaccgatgcccatttggcaaatcccgtgttacctgatgaagtgctgcaggaagcagtgcccggttccatccgcacggctgagcacttcctgggattcctcagaagacttttggaatatgtgaagtggcgcctgcgggtgcagcacgtcgtgcaagagtctcctccggcattcctgtctgggttggctcagagggtgtgcatccagagaaagccactcagattttgcgcagagcggctgcgaagtctcctgcacaccctggagatcacagatctggctgattttagcccgctgacattgttagccaacttcgccacgctggtgagtacctatgcaaaaggctttactattattatcgagcctttcgacgaccgcactcccacgattgcaaatccaattctccacttttcctgcatggatgcctctctggcaatcaagccagttttcgagcgctttcagtcagttatcataacatccgggactctctcaccgctggacatctaccccaaaatactggactttcatccagtgactatggccacgttcaccatgaccctcgctagagtgtgtctgtgcccaatgatcattgggaggggcaatgatcaggtggctataagttccaagttcgaaaccagggaagatattgcagtgatccgcaactatggaaacttgctgcttgaaatgagcgctgttgtacctgacggtatagttgccttctttacctcttatcaatatatggagtctaccgtagcttcctggtatgaacagggaattctcgaaaacattcagagaaacaagctactgttcatcgagactcaggatggcgctgaaactagtgtcgcccttgagaagtaccaggaggcatgcgaaaacggcagaggcgcaatcctgttgtccgtggcccgtggcaaggtgtctgagggtatcgactttgtccaccactatggcagggccgtcatcatgttcggggtcccatacgtgtacacccaatccagaatcctgaaggccaggttggaataccttagggatcaattccagatccgcgagaacgactttttgaccttcgatgccatgagacatgccgctcaatgcgttggacgggctattcgcggaaaaacggactatggcctgatggtgtttgctgacaagcggtttgctcgtggcgacaagcgaggaaaacttcccaggtggatacaagagcatttaactgacgccaatctcaatttgactgtggacgagggagtccaggtagccaagtatttcctccgacagatggcccagcccttccatagggaagaccagctcggcctctcgctactatctctcgaacaattagagtccgaggagacgctaaagaggatcgagcagatcgctcaacagctctag

SEQ ID NO: 28573 - DNA, 2049 bp, Artificial Sequence
  Description of Artificial Sequence: Synthetic coding sequence
atgaagttaaatgtggacggactgctagtgtactttccatatgactacatctatccagagcagttttcatatatgcgcgagctgaagaggaccttggacgcaaagggccacggagtcctcgagatgcccagcggaacaggaaaaaccgtttccttgctcgccttgatcatggcttatcagcgcgcatacccacttgaagttaccaagcttatctattgctcacggaccgtgccagaaatcgaaaaagtgatagaggaactgagaaaattactgaacttttacgagaaacaggaaggtgaaaagttaccatttctggggctggccctttcatccaggaaaaatctctgcattcacccagaaattcttcacgctaatgtggtggtgtattcgtatcactacctgctggatccaaaaattgcagatctggtgagcaaggaactcgcccgaaaggcggtggttgtgttcgacgaggcccataacatcgataacgtctgtatcgactcaatgtccgtcaacctgaccagacgtaccctggaccgctgtcagggaaatctcgagactttgcagaagacggtgcttagaataaaagagacagacgaacagcggcttagggacgagtatcggaggctggtagagggcctcagagaggccagtgctgctcgcgagaccgatgcccatctggctaatcctgtcctacctgatgaagtcctgcaggaggctgtcccgggatcaatccgcaccgccgaacactttcttggcttccttcgacggttactggaatatgtgaagtggcgtcttcgagtgcagcacgtcgtacaagagtccccccctgcgtttttgtcaggcttggcgcagagggtgtgtatccagcgtaaaccgttacggttttgcgccgagcgcctgcgaagcctcttacataccttggagataaccgatctggcagatttctctccacttactctgctggcaaactttgcaaccctggtttccacttatgctaaaggcttcaccataattatcgagccatttgacgatcgtacgccaactattgcaaatcccatcctccacttctcttgtatggatgcttctttagccatcaagcctgtgttcgagcgatttcagtcggtgataattacaagcgggacattgtctcctctagatatttaccctaagatcttggattttcaccctgtgaccatggcgaccttcactatgactctggcgagggtgtgcctgtgccctatgattataggccgagggaatgaccaggtcgcgatttcaagcaagtttgaaaccagggaagatattgcagtgatccgcaactatggaaacctgctccttgagatgtcagccgtagtcccggacggtatagtggctttcttcaccagttatcaatacatggagagcacagttgcaagttggtatgagcaggggatcctggagaatatacagcgaaacaagttgttatttatcgaaacccaggacggtgctgaaacgtcagttgccctcgaaaagtatcaagaggcctgcgaaaacggcaggggagctatcctgctgagtgttgccaggggcaaggtttccgagggtatagactttgtgcatcattacggaagagcagttattatgtttggcgttccgtacgtctacactcagagccgcatcctgaaagcccgattagagtaccttcgcgatcaattccagattcgagaaaacgacttcctcacctttgatgcaatgagacatgcggctcaatgcgtgggccgagcaattaggggcaaaaccgactacggcctaatggtgttcgctgacaaacggttcgcgcgtggcgataaaaggggaaagttacccaggtggatccaagagcacctgacagacgccaatttgaatctcacggttgatgagggagtgcaggtggcaaagtacttcctgaggcagatggcgcagccgtttcatcgagaggaccagctcggattaagtctcctgtcactggaacagttagagtccgaggagacactgaaaaggatcgagcagatcgcccagcagctctag

SEQ ID NO: 28574 - DNA, 2283 bp, Artificial Sequence
  Description of Artificial Sequence: Synthetic coding sequence
atgaagctgaatgttgacggcttgctggtctatttcccttacgattatatctatcccgaacagttcagctacatgcgggagttgaagaggactcttgatgctaagggccacggcgtgctagagatgccttctggcacagggaaaaccgttagcttgctggcacttatcatggcctaccagagagcctaccctctggaggtgactaaactcatctattgctctcgaaccgttccagagatagaaaaggtgatcgaggaactgcggaaactgttgaatttctacgagaaacaggaaggagagaagcttcccttcttggggctcgctctgtctagtcgtaagaatctgtgtatacatccggaagtgactcctctgcggttcgggaaggacgtggacggtaaatgccactctctgacagcaagttacgtgagagcacaatatcagcatgacacgagcctcccccactgcagattctacgaagaattcgacgcccatggcagagaggtgccgctgcccgctggcatctataacctggatgatctgaaggctctggggcgacgacagggatggtgcccatattttctcgctcgctactcaatcctgcatgcaaacgtcgtagtctattcataccattacctccttgaccctaagatcgcagatctcgtctctaaggagttagccagaaaagccgtcgttgtttttgatgaggcccataacatcgacaatgtttgcatagactcaatgagcgtcaatctcactaggagaactttggatcggtgtcaaggaaacttggagactcttcagaagactgtactgcgtattaaggaaaccgatgaacagagactgagggacgaatatcggagactagttgaagggctgcgggaagctagcgcagcgcgagagaccgacgcccatctggctaatcccgtgctgccagacgaggttctccaggaggcagttccaggctctattcggactgcagagcattttctcggcttcctgcgtcggttactggagtacgtcaagtggcgtctgcgcgtccaacacgtagtgcaagaatccccacccgcttttctgtctggactggctcaaagagtctgcattcagcggaaaccactcaggttttgtgcagaaagacttcggtctctcttgcatactctggaaattacggatttggccgacttctcccctctgacactgctggccaatttcgcgaccctggtgtctacgtatgccaagggttttaccataatcatcgagcctttcgatgatcgtacaccaacgatcgcgaaccccatactccatttcagctgtatggatgcatccctcgctatcaagcctgtctttgaacggtttcaatctgtaattatcactagcggcacactcagtcccctcgatatatacccaaagatcctggactttcatccagtcaccatggctaccttcacaatgacactggcacgagtctgcctctgcccaatgattataggtcgcggaaacgatcaggtggcgattagcagcaaatttgaaactcgggaggacattgctgtgatcagaaactacgggaacctcctgctggagatgtcggcagtagtacccgatgggatcgtagcatttttcacgtcatatcagtacatggaaagcaccgttgcttcctggtatgagcagggaatcctcgagaacatacaacggaataagctgctattcatagaaactcaggatggcgcagaaacatcggttgccctcgaaaaatatcaggaagcatgcgaaaacgggaggggggctatcctgctctccgtggcgagaggcaaagtctctgagggcatagatttcgtccaccactacgggagagccgtgattatgttcggagtcccctacgtgtacacacagtctaggattctgaaagccagactcgagtacctaagagaccaatttcagattcgggaaaatgactttctcacctttgatgcaatgagacacgctgcacaatgtgtggggagagccatacgcggaaaaactgattatggtctgatggtttttgccgataagcgatttgctcgcggtgacaaaagaggcaagttgcctaggtggatacaggagcacctgaccgacgccaacttgaatcttactgttgacgagggcgtacaggtggctaaatattttctgcgccagatggctcagcccttccatagggaagaccagcttggcttgagtctcctgtctctagaacagttagagagcgaggagacccttaaacggattgagcagatagcgcaacaactttag

SEQ ID NO: 28575 - DNA, 2751 bp, Artificial Sequence
  Description of Artificial Sequence: Synthetic coding sequence
atggagtctggacaaccggcacgacgtatcgctatggcaccattactggagtatgaacggcagctcgttctcgagctcttggacacagacggactggtggtctgcgctcgagggctcggagctgaccgccttttataccacttcctgcagctgcactgccaccccgcttgtctggtattggtccttaatacccagccagccgaagaggagtattttatcaatcagctgaaaattgagggtgtggagcatttgcccaggcgggttaccaacgagattacttcaaattctcgatacgaggtgtatacccagggcggagtgatattcgctacctcacgcattttagtggttgatttcctgacagatcgcatcccaagtgatctgatcactggcattctcgtctatagggcccacagaataatcgagagctgtcaagaggccttcattttacgcttgtttcgacagaagaataaaagaggatttatcaaagcatttaccgacaacgctgtagcgttcgatactggattttgccacgtcgagcgtgtcatgaggaatctcttcgtgcggaaattgtacttgtggcctcgattccatgtggctgtcaattctttcctagagcagcacaagcccgaagttgtcgagattcatgtgagcatgaccccgactatgctcgctatacaaacagccatactggatattctgaatgcttgcttaaaagaactcaagtgtcacaacccttccctggaggtagaggatctgtcactagaaaacgctattggaaagccattcgacaagacaatccggcactatcttgaccccctctggcaccagctcggggcaaagaccaagagtctggtgcaggacctgaagatcttgaggacactcttgcaatatctgtcacagtatgattgcgttactttcctcaatctcctggaaagcctacgtgccactgagaaggcgttcggccagaactctgggtggttgttcctcgattccagcacttctatgtttataaacgcacgagcacgggtgtaccacctgccagacgccaaaatgtcaaagaaggagaaaattagcgagaagatggagattaaagagggcgaggagacaaagaaggaattagtgcttgagtcgaacccgaaatgggaggcattgactgaggtgctaaaggaaattgaagccgagaataaggagtccgaggcactggggggacccggtcaggtcctaatctgtgcctccgacgaccggacctgtagccaattgcgagattatatcacactcggagccgaagcatttcttcttagactctatcggaaaactttcgaaaaagattccaaagcagaagaggtgtggatgaaattccggaaagaggattcttccaaaagaatacgaaaaagtcacaagcgaccaaaagacccgcagaacaaggagcgcgcaagtaccaaggagcgcacattgaagaagaaaaaaaggaagctgacactgactcaaatggttggaaagccggaggagttggaagaagagggcgatgtagaagagggctaccggcgtgagataagctcctcccctgagtcttgccctgaagagatcaaacatgaggagtttgatgtgaatctgtcttctgatgctgcgtttggcatactaaaagagcccctcactatcatacaccccctcctgggatgttccgatccttacgccctgacccgcgttctccacgaagttgagcctagatatgtggtcttgtatgacgccgaactaacctttgtcagacaactcgagatctatcgggcttcccggccaggaaagccattgagggtctactttctcatatacgggggtagcacagaggaacagcgatatcttacagcattgcggaaagagaaagaggcatttgagaaattaattcgagagaaagcctccatggtagtgcccgaggagcgggaaggtcgggacgagacaaacctcgacctggtacgcggaacagctagcgccgacgtgagcactgacacccgaaaggctggcggacaggaacagaatgggactcaacaatctatcgttgttgatatgcgggagtttcgaagtgaactgccctccctgatccatcgcagggggatcgacatagaacccgtgaccctggaggtgggagactatattctgacaccagaaatgtgcgtcgaacggaaaagtatctccgacctgattggcagtctgaataatggaagattgtattcacagtgcattagtatgagtcgatattacaaacgccctgtcttgctcatcgaatttgacccctccaagcctttctcactaacatcgcggggagccctgttccaagagatcagtagtaatgacatatctagtaagctcacactgctgacccttcactttccgcgacttaggatcttgtggtgcccctcccctcacgcaacggcggagttatttgaagaactgaaacaatccaagccccaacctgacgccgctactgcccttgccatcacagcagattctgaaaccctgccggaatcggagaaatataatcccggtccacaggactttcttctcaagatgcctggagttaacgcgaagaactgccgctccttgatgcaccacgtaaaaaatatagctgaactcgctgccctttcccaagatgagttgacttccattcttggcaacgcggctaatgcaaaacagctgtacgacttcattcacactagtttcgccgaggtggtctctaagggcaagggaaagaaatag

SEQ ID NO: 28576 - DNA, 2715 bp, Artificial Sequence
  Description of Artificial Sequence: Synthetic coding sequence
atggccccactcctggagtacgagcgccagctcgtacttgagctcctcgatactgatggcttggtggtgtgcgccagagggctgggcgctgaccgcctgctgtaccacttcctgcagctacattgccatcctgcctgtcttgtgctcgtgcttaatacgcagccagccgaggaagaatactttatcaatcagctgaagattgagggtgtcgaacacctacctaggcgtgtaaccaatgaaatcacgagtaactcccgatatgaagtctatacacaggggggtgtgatttttgcgacctccaggattctggtggtcgacttccttaccgacaggatcccaagcgacctgattacagggatcctcgtctaccgcgcacacaggattatcgaaagttgtcaggaagcattcattctccggctgtttagacaaaagaacaagcggggattcattaaggcatttaccgataacgctgttgcattcgataccggattttgccacgtcgaacgagtaatgagaaacctgttcgtccgcaaactgtacttgtggccacgatttcatgtggcagtgaatagtttccttgaacagcacaagccagaggtcgtggagattcatgtgtcaatgacacccactatgctggccattcagacagctatcttggatattctgaatgcttgcctcaaggagctcaagtgccacaacccatccttggaagtcgaggatctgagtctggagaacgccattgggaagccattcgataagaccatcagacattacctggaccctctctggcatcaattgggtgctaagacaaagtccttggtccaggatctgaaaatccttaggacactgctccagtacctctcccaatacgactgcgtcacctttctgaatctcctggagagcctgagggctacagagaaggctttcgggcagaactcagggtggttgttcctagactcatctacatccatgttcataaatgctcgcgcaagggtttaccatctccccgacgccaaaatgtctaagaaagaaaaaataagcgagaagatggaaattaaggagggagaggagactaaaaaggagttggtgctggaatctaacccaaagtgggaggcactgacggaagtacttaaggagattgaagccgaaaacaaagagagtgaggccctgggcggtccaggtcaggtactgatctgtgcatcagacgacagaacatgttcccagctgcgggattacataactttgggcgctgaggctttcctgctgagactgtacaggaagacatttgaaaaggatagcaaagctgaggaggtgtggatgaagtttcgcaaggaagacagcagtaaacggatcaggaaaagtcataagcgcccaaaggacccacaaaacaaagaacgggcaagcaccaaggagagaaccctgaaaaagaaaaaaagaaagctcacactaactcaaatggtgggaaaacccgaagagttagaagaggagggtgatgttgaggaaggatatagacgggaaatctctagcagccccgagagctgtcccgaggagatcaagcacgaggaatttgacgtgaatctgagcagtgacgccgctttcggcattctgaaagaaccactgaccatcatccacccactactgggctgctcggacccctacgcactgacaagggtgttacacgaggtggaacccaggtacgtcgtgctgtatgacgcagaactcaccttcgtcaggcaactcgagatttaccgagcttctcgacccggaaagcccctgcgatactttctgatctacggcggatccactgaggagcaaaggtacttgacagccctccgaaaggaaaaagaagcatttgagaaattgatccgggagaaagcaagcatggttgtgcctgaggagagggaaggcagggacgaaacaaatctcgatctggtaagaggaacagcaagcgcagacgtttcaacagacacgcgaaaagccggaggccaggagcagaacggtacccagcaatctattgtagttgatatgagagaattcagaagcgaacttccttccctcatccatcggcgtggtattgacatagaaccggtgacattggaagtcggggattatatcctgacacccgagatgtgcgttgaacggaagtcaattagtgacctgattggcagcctaaacaatggtcggctctactctcagtgtatcagcatgtcgcgttactacaaacgaccagtgttgcttattgagttcgacccaagcaaacctttcagcttgacaagtcgaggcgctttatttcaggagatttcatctaacgacatttcctctaagctgacactgctgaccctccactttcctagactcagaattctttggtgtccaagcccacatgccacagccgaactgttcgaggaattgaagcagtctaaaccgcagcccgatgcagctactgccctcgctatcacagccgattctgagacgcttcctgagtcagaaaagtacaacccaggccctcaggacttcctgcttaaaatgcccggagtgaatgctaaaaattgtaggtctctcatgcatcatgtcaagaacatcgcagaactggctgcactgtctcaggacgaacttaccagcatcctggggaacgccgcaaacgctaagcagctttatgacttcatccatacctctttcgccgaagtcgttagcaagggcaaaggcaaaaaatag

SEQ ID NO: 28577 - DNA, 1071 bp, Artificial Sequence
  Description of Artificial Sequence: Synthetic coding sequence
atggcgcctctccttgaatatgagcgacagctggtgctggaactccttgatacagacggactggtcgtctgcgcaaggggccttggggcagaccggcttctttatcactttcttcagctccattgtcacccagcttgcctcgtgctcgtgctaaatactcagccagccgaagaagagtattttattaaccagttgaagattgagggtgttgagcacttacctaggcgtgtcaccaacgaaattactagcaacagtaggtatgaggtgtatacccagggaggcgtgatcttcgcaacctcccggattcttgtcgtagacttcttaacggataggattcccagtgatcttattacaggaattctggtgtacagggcacaccgaattatcgagtcctgtcaggaggcctttattttgcgtctgttcagacagaagaataaacggggattcattaaggcattcactgacaacgcggtagcattcgatactggattctgccacgttgaacgggtgatgaggaatctctttgtcagaaaactctacctctggccccgattccacgttgctgtgaacagtttcctggagcagcacaagccagaagtggttgagatacacgtatcaatgacccctaccatgcttgcgatccagactgctatcttggacatcctgaacgcctgcctgaaggaactgaaatgtcataacccatccctagaggtggaggatctttctctcgaaaacgccatcggtaagcccttcgacaagacaatccgtcactatcttgatccactgtggcatcaattgggcgctaagacaaagagccttgtccaggatcttaagattctccgaacactcctgcagtatctcagccagtatgattgcgtgacctttttgaatcttcttgagtcattaagggcgactgagaaagccttcggccaaaactcaggttggctctttctcgactcctctaccagcatgtttatcaacgctcgggcaagggtttatcacctgccagatgccaaaatgtcaaaaaaggaaaaaataagcgagaagattaaaaaaaaaaagaaaaagtag

SEQ ID NO: 28578 - DNA, 3561 bp, Artificial Sequence
  Description of Artificial Sequence: Synthetic coding sequence
atgggcgtgcagggattatggaaactccttgagtgcagcgggaggcaggtatctccagaggcacttgaaggaaagatcctggctgtagatatctcaatctggctaaatcaggcactgaagggagtgagggaccgacatggcaacagcatagaaaaccctcacctgcttaccctgttccatcgtctctgcaaacttcttttttttaggatcaggccaatcttcgtcttcgatggagatgcccctctcctcaaaaagcagactctcgttaagaggcggcagcgtaaggacctggcaagctccgatagtcgtaagaccactgaaaagttgctgaaaaccttcctgaaacggcaggccatcaagacagcttttagaagcaaaagggacgaagccctcccgagcctgacacaagtgcggagggagaatgatctctacgtccttccccctttgcaggaagaagaaaaacactcaagcgaagaggaagatgagaaggagtggcaggagaggatgaatcaaaaacaggctcttcaggaggaattttttcacaatcctcaagctatagacatcgaatccgaggacttttcatctctgccccctgaagtgaagcacgagatcctcactgatatgaaagaatttaccaaaaggagacgtactctattcgaggcaatgcctgaagagagtgacgacttttcccaataccagctgaagggccttttgaagaagaattatctgaatcagcatatcgagcacgtccagaaggaaatgaaccagcagcactccgggcatatcagacgacagtacgaagacgagggaggcttcctgaaagaagtggaatctagacgtgttgtgtcagaggatacgagccattatatcttgatcaaggggatccaagcaaagaccgttgctgaggttgactcagaatcgttgccatcctctagcaagatgcatggaatgtcattcgatgttaagtcttccccatgcgagaagctgaagacggaaaaggaaccggacgctactcccccatcacccaggactctgctagcaatgcaggcagccctacttggctctagttcagaagaggaattggagtctgagaatcggagacaggctaggggacggaatgctccagcagccgtggacgagggctctatctctccacgtacacttagcgctatcaaaagggcactggacgatgatgaagatgtcaaggtatgtgcaggagacgacgtacagaccggcggaccaggtgcagaggagatgcggataaattctagcaccgaaaatagtgacgaaggtctgaaggtcagggatggaaaggggataccttttacagccacactagcctcttcgagcgttaattcagcagaggaacacgtagcatcgacaaacgaaggcagggagcccacagatagtgtaccgaaggagcagatgagtttagttcacgtaggcaccgaagctttcccaatatcagatgagtccatgattaaagacagaaaggacaggctcccgttggaaagcgccgtggtgagacattccgacgcgcctggtctgcccaatgggagggagctcactccagctagccctacatgcacaaattctgtgtcaaaaaacgaaacccacgcagaagtattagagcagcagaatgagctgtgcccatacgagagcaaattcgacagcagccttctgagcagcgatgacgaaacaaaatgcaaaccaaatagtgcctcagaagtgatcggcccagtgagcctgcaagaaacgtcttcaatcgtgtctgtccctagtgaagcagtcgataatgttgagaacgtcgtaagcttcaacgcaaaagagcatgagaactttttggagaccatccaggagcagcagactacagagtcagccggtcaagacctaattagcatcccaaaagcagttgagccgatggagattgactcagaggagagcgagtccgatggttcctttatcgaggttcagtctgtaatcagcgacgaggagctgcaggccgaatttcccgagacaagcaagccaccttcagagcagggcgaggaggagctggtcgggactagagaaggagaggccccagctgaatcagagtcattgttgagagataatagcgaacgcgacgacgttgacggagaacctcaggaggcagaaaaggacgcagaggacagtctgcatgagtggcaagatataaacctggaggaattggagacgctggagagtaacttattggcgcagcagaacagcctgaaagcccagaaacagcaacaggaaagaattgctgctacagttactgggcaaatgttcctggaaagtcaggagcttcttcgtctctttggcatcccatacattcaggccccaatggaggccgaagcccagtgtgccattctggacctgactgatcagacgtctggcaccattactgatgattctgatatttggttgtttggagctaggcacgtgtaccgcaactttttcaacaaaaacaaatttgtggaatattatcagtatgtggattttcataaccagctcggcctcgatcgtaacaaattgataaatctcgcctatttgctgggctctgactacaccgaaggaattcccacagtgggatgcgtcacagctatggaaatactcaacgagtttcccggacacggcctggagccacttctgaaattcagcgagtggtggcatgaggcacagaaaaaccccaagatccgaccaaacccgcatgacacaaaagtcaaaaaaaaacttaggaccctgcagcttacccctggtttccccaatcccgctgtcgctgaagcatatctaaagcctgtggtggatgacagcaagggctcatttctgtgggggaagccggacctggataaaattcgcgagttttgccagagatacttcggatggaacaggactaagacagatgagagccttttccccgtgcttaaacagctggatgcccagcaaacacaattgcggatagactccttcttcagactagcacaacaagaaaaggaggacgccaaaagaataaagagccagcgactcaacagagccgtcacctgtatgcttaggaaagagaaggaagctgcggctagtgagatcgaggcagtcagcgtggccatggagaaggagtttgagctgcttgataaagccaaggggaaaacgcagaagcggggaattactaataccctggaggaaagttcttcgctcaagaggaagcgactttctgacagcaaaggcaagaacacctgtggcggattcttaggagaaacatgcttgagtgaatctagcgatggcagctcgtccgaagacgcggagagttcctccttaatgaacgttcaacgaaggactgccgcaaaagagccaaaaacatccgctagcgatagtcagaacagcgtcaaagaggcccctgtgaagaatgggggtgcaacaacaagttcttcttccgattcagacgatgatggcggaaaggaaaaaatggttttagttacagccagatccgtgttcggcaagaaacggcgaaagctgcgacgggcacggggtcgcaaacgcaagacctag

SEQ ID NO: 28579 - DNA, 1260 bp, Artificial Sequence
  Description of Artificial Sequence: Synthetic coding sequence
atgtttcttgagtcacaggagttgctccgattatttggaatcccctatattcaggcaccaatggaggcagaggcccaatgtgcgattctggatctgaccgatcagacgtccggtactataaccgacgacagcgacatctggctgttcggagcaagacacgtgtatcgtaattttttcaacaaaaacaaatttgtggaatactatcagtacgtagactttcacaatcagctgggactggatcgtaataagctcatcaatctggcctacctcctcgggtcagattataccgagggcataccaacagtggggtgtgtaaccgcaatggaaattttaaatgagttccccggacacgggctggagcctcttttaaagtttagcgagtggtggcatgaggcacagaagaatcctaaaataaggcctaacccacacgatactaaggtcaagaaaaagctgcgaactctgcagctcactccaggattcccaaaccctgccgtcgccgaggcataccttaaacccgtcgtggatgattccaaaggatctttcctgtggggcaaacccgatctggacaaaattagagaattttgccaacgatatttcgggtggaacagaactaagaccgatgagtcgctattcccagttctcaagcaattagacgcgcaacagacacagctccgtattgacagcttctttcgactagcacagcaggagaaagaggatgcaaagcgcatcaaatctcagcgactgaatcgagcagtgacctgtatgctccgaaaggagaaggaagccgcagctagcgagattgaggcagtgagcgttgcaatggaaaaggagttcgaactcttggacaaagctaaggggaagactcagaaaagaggaataacgaatacactggaagaatcatcgagtctcaaaagaaagaggctgtccgactcaaagggtaagaatacctgcggaggcttcttgggggagacatgcctatctgaaagcagtgatggaagcagttctgaggatgctgaatcttcttcattaatgaacgtccagaggagaacagccgctaaggaacccaagacgtccgctagcgactcacagaattctgtgaaggaggccccagtgaagaatgggggtgctaccacctcctcaagctcagattctgatgacgacggcggaaaggaaaagatggttctggttacggccagaagcgtgttcggcaagaaaagaaggaagcttcgtagggcccgtggtcgtaagagaaaaacctag

SEQ ID NO: 28580 - DNA, 3057 bp, Artificial Sequence
  Description of Artificial Sequence: Synthetic coding sequence
atgaaccagaagcaggccctgcaggaagagtttttccacaacccccaggcaatcgacatcgagagtgaagatttcagcagtctgcccccagaggtcaagcacgaaatcttaaccgacatgaaagaatttacaaaaaggcgcagaacactcttcgaagctatgccggaagagtctgatgatttttcacagtatcagcttaagggcttactcaaaaaaaactatctgaaccaacatatcgaacacgtgcaaaaagagatgaatcagcaacactcaggacacattagaaggcaatacgaagacgagggagggttcctcaaggaggtcgagagtcgacgggttgtctccgaggatacatcacactacattctgatcaagggtatccaggccaagaccgtcgccgaggtcgacagcgaatccttgccctcaagtagcaagatgcatgggatgagcttcgatgtgaagagctctccctgtgagaaactcaagacagaaaaggaaccggacgcaactccaccctcccccagaacactccttgcaatgcaagctgccttgcttggaagcagctctgaagaggaattggaaagtgaaaaccggaggcaagctcgcggaaggaatgcgccagcagcagtcgacgagggctccattagcccacgaacactctctgcgatcaaaagggccctggacgatgatgaggacgtgaaagtatgtgctggggacgacgtgcagactggcggaccaggggctgaagaaatgcggattaatagctctacagaaaactccgatgaagggctgaaggtccgcgacggcaaaggcatccccttcacagccacactggcgagtagcagcgtgaattctgccgaagagcacgtcgcatctacgaatgaggggagagagccgactgacagtgtgcctaaggaacagatgagtcttgtacacgtgggcaccgaggctttcccgataagcgatgagtccatgattaaagacaggaaagaccgactgccattggagagcgctgtggtaaggcattctgatgcgcctggtctgccaaatgggagagagctgacaccggcttctccgacatgcacaaattccgtgagcaaaaatgaaacccacgctgaggtgttggagcagcaaaacgagctctgtccttacgaaagtaagttcgacagtagtctcctttcatctgatgatgagaccaaatgcaagcccaatagtgctagcgaggttattggaccagtgtctcttcaagagaccagctcaattgtctccgtacctagcgaggccgtcgataatgtggaaaatgttgttagtttcaatgcaaaggaacacgagaattttctagagacgattcaggagcaacagaccactgagtcagccggacaagacctgatctcaatcccgaaagcagtagagcccatggagatcgactccgaggagtccgagagtgatggcagttttattgaggtgcagtcagtgatttccgacgaagagctgcaggccgagtttcctgaaacttctaagcctccctctgagcagggtgaagaagagctggtgggaacaagagagggcgaagccccagccgagtcagagtcactccttagagataatagtgaacgagacgacgtagacggcgagccgcaggaggccgagaaggatgccgaagatagcctccatgagtggcaagacattaacctcgaggagctagagaccctggagtccaatctgttggcgcagcagaactcactaaaagctcaaaaacagcaacaggagagaatcgcggcaacagtcactggccagatgtttttggaatctcaggaattgctccgcttgttcggcattccctacatccaggcacccatggaggctgaagcccagtgcgccattctggatttaactgaccagactagtggcaccattaccgacgattcggacatctggctgtttggggcaaggcatgtataccgtaacttttttaataaaaataaattcgtagaatactatcaatatgtagactttcacaatcagctcggtcttgataggaataaactcatcaatctggcttatttactgggctcagactacacagaggggattccgacagtgggctgcgtgaccgccatggagattttaaacgagtttcccggtcacgggcttgagccacttctgaagtttagcgaatggtggcacgaggcgcagaagaaccctaagattcggccaaacccacacgatacaaaggtgaagaagaaactccgcaccctgcagctcacacccggattccccaaccctgctgtggccgaagcctatctgaaaccagtggtggacgactctaagggctccttcctgtggggaaaaccggacctggacaagatcagagagttttgccagaggtacttcgggtggaataggacaaaaactgatgagtctctctttccggtcctcaaacagctggacgctcagcagactcagttgagaattgactcctttttccgactagcccaacaggagaaagaggatgcaaagagaatcaagtcccagcgcctcaacagagctgtcacctgcatgctaagaaaagagaaggaggctgcagcatcggaaatagaagccgtgagcgtcgcaatggagaaagagtttgaactgctggacaaggcaaaaggaaagactcagaaacgaggcattacgaacacattagaggagtcctcgagcctgaagaggaaacgcctaagcgattcaaaagggaagaatacatgcgggggtttcctgggagagacgtgtctttcagaatcatctgacggttcttcctcagaggacgccgagagctctagcctcatgaatgtgcaaagaagaacagcagccaaggaaccaaagacttccgccagcgactcacagaacagcgtcaaggaggcccctgttaagaatggcggagccacgacctcctcttccagcgactccgatgatgatggcggtaaggagaagatggtcctggtgacagctagatcagtgttcggaaaaaagcggaggaaactgcgacgggctcgaggccgaaagcgaaagacttag

SEQ ID NO: 28581 - DNA, 4836 bp, Artificial Sequence
  Description of Artificial Sequence: Synthetic coding sequence
caaggggcagtcaagtcgttctgtactagcgcttcaggtgcccctcttggcccaaaaggcgacggccattacccctggtcctgtcccgtgactcacaccagagaaaaaatctacgcaatctgctcagactatgcattcctgaaccaggctactagcatctataaaactccaaatcccagcagatccccctgtctgcctgactctacttctctgagcgcgggaaataattcttcacgctacattggcattccaacctccacctccgagatcatctataatgaggagaatagtctcgagaacctgagtaactctctcggtaagctgccactggcctgggagatcgataaaagcgaattcgatggtgtcaccaccaacagcaagcacaaatctggcaacgccaaaaagcaggtctcgaagaggaaaacgtccgacaaaaaaggcaggtatcagaaggaatgtccccaacattcccctttggaggacattaagcagcggaaggtcctggatctgcgacggtggtactgcatttccagacctcagtacaagacaagttgcggcatctcctccctgatttcatgctggaacttcctgtattcaaccatgggcgctggcaatctgccccctatcacccaggaagaagccctgcacattctggggtttcagcctcccttcgaggacattagatttgggccattcacaggtaatacaaccctgatgagatggttccggcagatcaatgaccatttccacgttaaaggctgtagttacgtcttgtacaagccccacggaaagaataagacagccggtgagactgcaagcggagccctaagcaagttgaccagaggacttaaagacgaatccctcgcatatatctatcactgccaaaatcattatttctgtccaattggatttgaggcgacgccagtgaaggctaacaaagccttcagtcggggacccttaagtccgcaagaagtcgaatactggattcttattggcgaatcgtcacggaaacatccagctattcactgcaaaaagtgggctgacattgtgacagacctcaatacacaaaaccccgagtacttagatatacgacatctggaaagagggttgcagtacaggaaaacgaaaaaagtaggcggtaacttgcactgtattatcgcctttcaacggttaaactggcagagatttggactgtggaatttccccttcgggactataagacaggagtctcagccccctacgcacgctcaaggcatcgccaagtctgagtccgaggataacatttccaaaaaacagcatggccgactcggcagaagcttctctgcctcttttcatcaagactcagcctggaagaaaatgtctaatatcagcatttggttaaaccaagccctaaaaggcgtccgggatagacatggtaattctattgaaaatccccacctcttaaccctgttccatcgattgtgtaaactgttgtttttcagaatccgccctattttcgtgtttgatggcgatgcgcctctcctcaaaaagcagactttggtcaagcggagacagcggaaagacttggcttcgagcgacagcagaaaaaccacggaaaaactcctgaaaactttccttaaacggcaagccatcaaaaccgcatttagaagcaagagggatgaggctctccctagcctcacccaggtgcggagagaaaacgatctttatgtcctgccaccgttgcaggaggaggaaaaacactcttctgaggaggaggacgagaaagagtggcaggagagaatgaatcagaaacaggcactacaggaggagttcttccacaacccccaggccattgatatcgagagcgaggatttcagcagcctcccccctgaggtcaaacacgaaatcttgacagatatgaaggagttcacgaagagacgcaggacactctttgaagccatgcccgaagagtccgatgatttctcacagtatcagctcaagggcttgctcaagaaaaattacttgaaccagcatatagagcatgtgcaaaaagagatgaaccagcagcacagcggacacatacgacgacagtacgaagatgaggggggatttctgaaagaggtggagtcccgccgagtagtgtctgaagacacaagccattacatcttgatcaaggggattcaggccaaaactgtggccgaagtggactcggaaagcctgcctagcagctccaaaatgcatggaatgagttttgacgttaagagtagcccgtgcgagaaactcaaaacagagaaagaaccagacgccactcccccttccccacggaccctgctcgccatgcaagctgcacttctgggttcaagcagcgaggaagaactggaatcagagaaccgacgccaggctagaggacgaaacgcgcctgccgcagtggacgaaggcagtattagtccacgaacactgagcgccattaagcgggctcttgacgacgacgaggatgtgaaagtttgcgccggagatgacgttcagactggaggtcccggtgctgaggagatgcgcatcaactcttccacagagaattccgacgagggcctcaaagttagagatggaaaaggaattccctttaccgccactttggcaagtagcagtgtcaacagtgccgaggaacacgtggccagcactaacgagggccgagaaccgaccgatagtgttccaaaggagcaaatgagcctggttcatgttggcaccgaggcttttccaatcagcgatgagagtatgattaaagaccggaaagaccgcttaccactggaatccgccgttgttcggcacagtgacgcccctggccttcctaatggtagagagctcaccccggcatccccgacatgcaccaatagcgtgtctaagaatgagacacatgccgaggtactggaacaacaaaacgagttgtgtccctatgagtctaagttcgatagctcactgctgtcctctgatgatgagactaaatgtaaaccaaattctgccagcgaggtcattggtcccgtttcactccaagaaacatcatctatagtgtccgtcccatctgaggctgtcgataacgtggaaaatgtagtcagcttcaacgcgaaagaacatgagaactttcttgaaaccattcaagagcagcagacgaccgaatccgccggacaagatttaatcagtatacccaaggccgttgagcccatggagatagattcggaggaatcggagtctgatgggtctttcatcgaagtgcagtcagtgattagtgatgaggagctccaggccgagtttccagaaacctctaaaccacccagcgagcagggcgaagaggagcttgtgggtacgagagaaggagaagccccagctgaaagcgagtcactcctaagagacaacagtgaaagagacgacgtggatggtgagccccaggaagcggagaaagatgcggaagatagtctgcatgaatggcaggacattaacttggaggaattagagactctagaatctaacctgctcgctcagcaaaacagtttgaaagcccagaaacagcagcaggagcgaatcgctgctacagtgacaggacaaatgttcctggaatcccaggagttgctccggctctttggcattccttacattcaagctcctatggaagcggaggcacagtgtgctatccttgacctaaccgaccagaccagtggaacaataacagatgactctgatatttggttattcggtgccagacacgtgtatcggaactttttcaataagaacaagtttgttgaatactatcagtacgtcgactttcataatcagctcggactcgatagaaacaagctaattaatctggcctatttgctgggctcagactataccgaaggaattcctacagtcggctgtgttacagcaatggagatactgaacgagttcccgggtcatgggctcgagcccctgctgaaattctctgaatggtggcacgaggcgcagaagaaccccaaaatccgcccaaatccacacgacactaaagtaaaaaaaaaactgcggaccctgcaattaactccaggcttcccgaatccagccgttgcagaggcatatctgaagcctgttgtggacgactcaaaaggttcattcctctgggggaaaccagatctcgacaaaatccgtgagttttgccagaggtactttggctggaaccggactaagaccgacgaaagtctgttccccgtgctgaagcagctggacgctcagcagactcagctgagaatcgactcatttttccgtctcgctcaacaagagaaagaagacgccaaaaggattaagtcccaacggctgaatcgggctgtgacttgtatgctgagaaaggaaaaagaggccgcagcaagcgaaatagaggccgtcagcgtggcaatggagaaggagttcgaactgttggacaaggccaagggcaaaactcagaaacggggaatcacaaatactttagaagagagcagctcccttaagagaaaacgactaagcgactccaaaggaaagaacacttgcggcggatttctgggcgagacctgcttgagcgagtcttctgatggctcctcatccgaagacgccgagagctcgagcctaatgaacgtgcagcggaggactgcagccaaggagccaaaaacctccgcctctgactctcagaattcggtaaaagaagcccctgtgaagaacggcggtgctacaacaagtagcagctctgacagcgacgacgatggcggaaaagagaagatggtgcttgtgaccgccagatccgtctttggtaaaaagcggaggaagctgaggagagcaaggggccgaaaacgaaaaacatag

SEQ ID NO: 28582 - DNA, 699 bp, Artificial Sequence
  Description of Artificial Sequence: Synthetic coding sequence
atgggtgtccagggcctgtggaagttgctcgagtgcagcggaagacaggtgagccccgaagcactcgagggaaaaatcctcgctgttgatatttccatctggttgaaccaagctctaaagggagtgagggacaggcatggcaattctatcgaaaacccccatctgctaactcttttccatagattgtgcaagctgctattctttcgaattagaccaatctttgtcttcgacggtgacgcacccctcctgaaaaaacagacattggttaagcgacgtcagcggaaggacctcgcctcctctgattccaggaaaactacagagaagctgctcaaaactttcttgaagaggcaggccataaagacagcctttcggtcaaagcgcgacgaggctctgccctcccttacacaggtgagaagagagaacgatctgtacgttctgccacctttgcaagaagaggaaaaacactcctccgaagaggaagacgagaaagaatggcaggaaagaatgaatcagaagcaggccttacaagaggaattcttccacaatcctcaggcgatagacatcgagtcggaggatttcagcagcttgcctccggaggtcaagcatgaaatattgaccgatatgaaagagtttacaaagaggcgccgtaccctctttgaggcaatgcccgaggtgtacctgccactccttcaaccatag

SEQ ID NO: 28583 - DNA, 4482 bp, Artificial Sequence
  Description of Artificial Sequence: Synthetic coding sequence
atgccaaacgaaggcatcccccattcttcgcaaactcaggaacaggattgcctccagagccaacccgtgagcaataacgaagagatggctattaagcaggaatctggaggggatggagaggtggaggaatacctctcattccgatctgtgggtgatgggcttagcacttcagcagtgggatgcgcgtcagctgcaccgcgaaggggccctgcgctcttacatatagatagacaccaaattcaggcggttgagcccagtgctcaagcgcttgagctgcagggattgggagtggacgtgtatgaccaggatgtgctcgaacaaggggtcctgcagcaggtggataacgctatacatgaggcgtctcgggcatcccagctggtggacgtggagaaagagtatcgttcagtcctggatgatctgacgagctgcaccacctcactgcgtcagattaataaaataatcgaacagctgtcgcctcaagccgctacaagccgcgacatcaaccggaagttagactcagttaagaggcagaagtataacaaagaacaacagttgaagaaaattacagcgaaacaaaagcatctgcaagccattctcgggggagcagaagtgaagatcgagctggaccacgcctccctggaagaagatgcagagccaggacccagtagtctggggagtatgctcatgcccgtgcaggagacagcatgggaagagctcatccgcactggccagatgacaccattcggcactcaaattcctcagaaacaggagaagaaaccacgcaagatcatgctgaatgaggcttctggctttgaaaagtacctcgctgatcaggctaaactctcctttgaacggaagaagcagggatgcaataagcgagcagctcggaaggcacccgctcccgtgactccacctgccccagttcagaataaaaacaagcccaataaaaaagctagagtcctcagcaagaaggaggagaggttaaaaaaacacatcaaaaaactgcaaaaacgtgcactgcaatttcaaggaaaagttgggctccccaaggcacgccgtccgtgggagtctgatatgcggcctgaagctgagggcgattctgaaggggaggaaagtgagtatttcccaacagaggaggaggaggaggaggaggacgacgaggttgagggcgcagaagcagatctgtctggggacggtacggattacgagcttaagcctttgcctaaaggcggtaagagacagaaaaaggtgccagtgcaagaaatcgatgatgatttctttcctagctctggcgaggaggctgaggctgcaagcgtgggcgaaggtggtggcggagggaggaaagtgggacgctacagagacgacggcgacgaagattactataagcaacgcctgaggagatggaacaagcttcggcttcaggataaggagaagcggctgaaattggaggatgacagcgaagaatctgatgccgaatttgatgagggatttaaggtgccaggattcctgttcaagaaattattcaagtaccagcagacaggcgtgaggtggctgtgggagcttcactgtcagcaggccggtggtatcctaggcgatgagatgggtttggggaaaacaattcaaatcatcgctttcctagctggcctgtcctacagcaagataaggacccgcggatcgaattatagatttgaggggcttggacccactgtcatcgtttgtccaactactgtcatgcatcagtgggtgaaggaattccacacgtggtggccgcctttcagggttgccattctgcatgagactggcagctacacccacaaaaaggaaaagctgatccgcgacgtggcgcactgtcatggaatcttaatcacttcatacagctatattcgcttaatgcaggacgacatatcgcgctacgactggcactatgtgatccttgacgaggggcacaaaatccgcaacccaaatgccgcagtgacactggcctgtaaacaattccggaccccacaccggatcattctctctgggtccccaatgcagaataatctgcgagaattgtggtctctcttcgacttcatctttcctggaaagctcgggacactgcctgtcttcatggagcaatttagcgtgccgatcactatgggtggttactctaatgcttcacctgtacaggtgaaaacagcgtataagtgcgcatgcgtgctgcgggatacaattaacccctacctcttgagaaggatgaaatccgatgtgaagatgtcattatcacttcccgataaaaatgagcaggtgttgttttgtcgacttacggacgaacagcataaagtgtatcagaatttcgtggatagtaaggaagtttatagaattttaaatggagagatgcagattttttcaggcctaattgctctgcggaaaatctgcaaccatcctgacctgttcagtgggggacccaaaaacctcaaaggccttcctgatgacgaactcgaagaggatcaattcgggtattggaagagaagtggtaagatgatcgttgtggagtctttgttaaaaatttggcacaaacagggccagagagtattgcttttttcacaaagtaggcagatgctcgatatcctcgaagtgttcctcagggcccaaaagtacacctacctcaaaatggacggcacgacgactattgccagtcggcagcctctcatcacccgctacaacgaagacaccagtatcttcgtctttctgttaacgactagagtaggcggattgggggtgaacctgactggggcaaacagagtggtgatttatgatcctgattggaatcccagtaccgatacccaagcccgtgagcgggcttggaggatcggtcagaagaagcaagtgaccgtttataggctgttaaccgctggcaccatcgaagaaaaaatataccatcggcaaatcttcaagcaatttctcactaacagagtgcttaaagacccaaaacaaagaaggtttttcaaatctaacgatctgtatgagctctttacactaacctcccctgatgcctcacagtcgactgagacctccgccatcttcgccggtaccggctcagacgtacagactcccaagtgccatcttaaacggcgtattcagccagctttcggcgcagatcacgacgtgccaaagaggaagaaatttcctgcatctaatatcagcgtgaacgatgcaacaagctctgaagagaagagtgaagccaagggggctgaagtgaacgccgtgacttccaaccgatctgaccctttgaaggacgacccgcacatgagctccaacgttacttcaaatgatagactgggggaagagactaacgctgtgtccggaccagaagagctctcagtcatctctggcaacggtgaatgctctaactcgtcgggcaccggcaaaaccagtatgccatcgggcgatgaatctattgatgaaaagctcggtctctcctacaagagggaacgcccatcccaggcccagaccgaggccttttgggagaacaaacagatggagaacaatttttataagcataagtccaagacaaagcaccacagcgttgccgaagaggaaaccttagagaaacacctgcgccctaaacagaaaccaaagaattctaaacactgtcgagatgccaagtttgaagggacacggattcctcatctggtgaagaagcgcagatatcagaagcaggactccgaaaataaatcagaagctaaagaacagtccaacgacgactacgtactagagaaactcttcaagaagtctgtgggggttcacagtgtaatgaaacatgatgcgatcatggacggggcatcccccgattacgtcctggtggaggcggaagctaatcgcgtggcccaagacgcgctcaaggctctgaggctgagtcgccagaggtgtctcggggctgtgtccggtgttcctacctggactggccaccggggtatttccggagccccagcaggaaaaaagagtcgattcgggaagaagaggaatagcaatttttcggtgcagcacccaagctctacctccccaacggaaaagtgccaggatgggatcatgaaaaaggaggggaaggacaatgtgccagagcacttcagtggacgcgctgaagatgcagatagctccagcggcccactagcaagctcttccttgttggctaagatgcgcgctcgaaatcacttgatccttccggagagactcgaatctgagagcggtcaccttcaggaggccagtgctctgctgcctactactgaacatgatgatttactggtcgaaatgagaaacttcatcgcctttcaagctcacactgatggtcaggcctccacgcgtgagatcttgcaagaatttgagtctaagcttagtgctagccaaagctgtgtctttcgagaactcctgcggaacctatgcaccttccatcgcaccagcggcggagaaggtatctggaagttgaagcctgagtactgctag

SEQ ID NO: 28584 - DNA, 2613 bp, Artificial Sequence
  Description of Artificial Sequence: Synthetic coding sequence
cagcagcccttccacagacacctgctgatgacgacagctttacactcggaaaagctgatccgggatgtggcccactgccatggcatacttatcacctcatactcctatatcaggctcatgcaggacgatatcagtcggtacgactggcactatgtcatcctggacgaaggacacaagatacggaaccccaatgcggctgtcactttggcttgtaaacaatttagaacacctcatcggatcatcctgagtggtagtccaatgcaaaataatcttcgcgagttatggagccttttcgacttcatcttccccggtaaactgggcaccctacccgtgtttatggagcagttcagcgttccgattaccatgggaggctactccaacgcttcccctgtgcaggtcaaaacagcttacaagtgcgcctgtgtgctgcgagataccatcaacccttacctcctgagacgaatgaaatccgatgtcaagatgagtctgtccctgcccgacaaaaatgaacaaatttttagcggactgatcgccctgcggaagatttgtaaccatcccgacctcttctcaggtggcccaaagaacctgaaaggactccccgatgatgaactcgaagaggaccagtttggctactggaagagatccgggaagatgatcgtggtcgaaagcctgttgaagatctggcataagcaggggcagcgcgtcctcttgttttctcagagcaggcagatgttggacatcctggaggtcttcctgagagcccagaaatatacttacttgaaaatggatggcacgactactatagcaagtaggcagccactaatcacaagatataatgaggataccagcattttcgtcttccttctgaccacacgtgtcggcggtctgggcgtgaacttgacgggggctaacagggtcgtaatatacgaccctgactggaacccatcaacagatacccaggcacgcgaaagagcatggcgaattgggcaaaaaaaacaagtgaccgtgtataggctccttaccgcaggtaccatcgaggaaaagatctaccatcgacaaatcttcaaacagtttctaacgaaccgggtgctaaaggaccccaagcagagacgattcttcaagtctaatgatctctatgagctgtttacattaaccagtccggacgcatcccagtccacagaaacatcagctatcttcgctggaacggggagcgatgttcagacaccgaaatgtcacttaaagaggaggatccagcctgcattcggggcagatcacgatgtgcctaagagaaaaaagttccccgctagtaacatctccgtcaatgatgccacaagctccgaagagaaatccgaagccaaaggcgctgaagtgaatgctgtaacttctaacagaagcgatcccttgaaggatgacccacatatgtcttcaaatgtcacctctaacgacagactgggagaggagaccaatgctgtctccggcccagaagagctgtcagttatttcaggcaacggggagtgctccaacagcagcgggactggaaaaacaagtatgccaagtggggacgaaagcattgacgagaagctgggcctgagttacaaaagagaacgcccatctcaggcccagaccgaggcattctgggagaataaacaaatggagaataatttctacaagcataagtctaagactaagcatcacagtgtggccgaagaagaaactttggaaaagcatcttcgcccaaagcagaaaccgaagaattccaagcactgtcgggacgccaaatttgagggaacaagaatcccccacctagtgaaaaagcgtcgataccagaagcaggattccgagaacaaatcagaagcaaaggagcaatcaaacgacgattacgttctggaaaaacttttcaagaaatctgtgggagtgcattctgtcatgaaacatgacgccatcatggacggggcttcaccagactacgtgttagtggaagccgaagcgaacagggtggcgcaagacgccctgaaggcgctccgattaagtaggcagaggtgcctgggcgcagtttccggggttcctacctggacagggcatcggggtatttcaggggctccagccggaaagaaatctcggttcggaaaaaagagaaactctaattttagcgtccagcatcccagctccaccagcccaaccgaaaagtgtcaggacgggatcatgaaaaaggaaggtaaagataatgtcccagaacacttttccggtcgcgctgaggacgcagattcatcaagcgggccattggccagttcttccctgctggccaaaatgagagctagaaaccacttgatccttcccgaacggttggagagtgaatcaggtcatcttcaggaggcatcagcacttttgcccacaacggaacacgacgacctgctggtcgagatgcgaaactttattgctttccaggcgcatacagatgggcaagccagcaccagggaaatactccaagagtttgaatctaagctgagtgctagccaatcttgcgtgttcagggagttactgcggaacctgtgtacgttccaccgcacaagcggcggagaagggatttggaaactgaagccagaatactgttag

SEQ ID NO: 28585 - DNA, 540 bp, Artificial Sequence
  Description of Artificial Sequence: Synthetic coding sequence
atgcctaacgagggcatcccccattcatcacaaacgcaggaacaagactgtctccagtctcaacctgtgtcgaataatgaggagatggccataaagcaggaatcgggcggtgatggcgaagtcgaggaatatttgagcttcagaagtgtgggggatggcttgtctaccagcgccgtcgggtgcgcttctgccgctccccgacgaggccctgcactgctccacattgatcgccaccaaatccaagcggttgagccatccgcccaagcactggaactccagggcctgggcgtggatgtctacgaccaggacgtcctggaacagggcgtcctgcagcaggtggataatgccatccacgaggcttctcgagcatcccaactggttgatgtcgaaaaagagtaccggtcggtcctggacgacttgacaagctgtacgacttcactgcgtcaaatcaataaaatcattgagcagctcagcccacaagccgctacatcacgcgatattaaccggaaactggattccgtcaagcgccagaagtattag

SEQ ID NO: 28586 - DNA, 318 bp, Artificial Sequence
  Description of Artificial Sequence: Synthetic coding sequence
atgtccctttcccttcccgacaaaaacgaacaggtgctgttctgcaggcttaccgacgaacagcacaaggtgtaccagaactttgtagattcaaaagaagtgtacagaattcttaacggtgaaatgcaagaggtcttgcagagcttcacgagcattcacctgcacgagagccccctaaatttctttcggtcctttcaggtacgcggatcccggagccattaccccggaaaaggcatgcagacaacactaggtatcgtgaattttttagtggtaacattgaaaagaaaaaagaggaatagattttccccagacctgtag

SEQ ID NO: 28587 - DNA, 2592 bp, Artificial Sequence
  Description of Artificial Sequence: Synthetic coding sequence
atgcaggatgacatctcccgctacgattggcactacgtaattctggacgagggccacaaaatacggaaccctaatgccgcagtgacactagcctgtaagcagtttcggaccccacaccggattatactctcaggtagccccatgcaaaataatcttcgggaactttggtcactcttcgatttcatctttccaggcaagctgggaaccctgccagtgttcatggagcagttttcggtgcctatcactatggggggttatagtaatgccagccctgtgcaagtgaaaaccgcctacaagtgtgcgtgcgtgctacgagatactattaacccatacctactgagaaggatgaagagcgatgttaagatgtctctgagtctgcctgataagaacgagcaggtactcttctgtcgcttgactgacgagcagcacaaagtgtatcagaatttcgtcgactcaaaggaggtgtacagaatactaaacggcgagatgcaaatatttagtggactgattgcgctccggaagatctgcaaccatcctgacttattcagtggagggcctaaaaatctcaagggtctgcccgacgacgaactcgaagaagaccagttcggatattggaagagatcgggcaaaatgatcgtggtggagagtctgctgaagatttggcataagcagggccagcgagtgctgctcttttcccaaagccggcaaatgttagatatcttggaggtcttcctgagggcccagaagtatacctatcttaaaatggatgggaccactacaatcgcctctaggcagcccttgatcactcgctacaacgaggacactagtatcttcgtgtttttactgaccacaagggtcggcggactgggtgtgaacctgaccggtgctaaccgagttgtaatttacgatcctgattggaaccctagcacagacacgcaagcgcgtgagcgagcctggcggatcggacagaaaaaacaagtaacggtttaccggctgctcacagccggaaccattgaggaaaagatctaccacaggcaaatcttcaagcagttcttgacaaatagagtgctcaaggacccaaaacaacgcagattctttaagagcaacgacctgtacgaattgttcactctgacatcaccagatgcgtctcagtctaccgaaacgagtgccatttttgccggtactggctctgacgtgcagaccccaaagtgccacctcaaacgacgcatacagccagccttcggggctgatcacgatgtgcctaaacggaagaagtttccagccagcaacatctctgttaatgacgccacctcctcggaggagaagtctgaggctaagggcgctgaagttaatgccgtgacctctaaccgaagtgaccctctgaaagacgatcctcacatgagtagtaacgttacatcaaacgataggttgggggaggaaactaacgccgtatccggacccgaagagctatcagtcatttccgggaacggagagtgcagcaattccagcggcactgggaaaacaagtatgcccagcggggatgagtccatcgacgaaaaactgggcctgagttataagcgcgagaggccatcacaggcccaaactgaggcattttgggagaacaaacaaatggaaaataatttttacaagcataagagcaagacaaagcatcattcggtggcagaggaggagacattagagaaacatctgagaccaaagcagaagccaaagaactccaaacactgccgggacgctaagttcgagggaacacgaattccccacctcgtaaaaaaaaggcggtatcagaagcaggattcagaaaacaaaagcgaagctaaggagcagagcaatgacgactacgtccttgagaagctgtttaaaaaatctgtgggggttcactctgttatgaagcacgacgcgatcatggatggagcctctcccgactacgtgctcgtagaagctgaagctaatagggtagcacaggatgcacttaaggctctgaggctctctcgacagagatgtctgggggcagtgagcggcgtccctacctggaccgggcaccggggaatttcaggagctcctgccggtaaaaagagcaggtttggaaagaaacgtaactctaacttcagcgtacaacatccatcatccacaagccccactgaaaagtgccaagacggcattatgaaaaaggaaggtaaggacaatgtccccgaacacttctcaggaagggccgaggacgccgactccagttctgggcctctcgcctcttccagccttctcgccaaaatgcgcgctaggaatcatttaattttacctgaacgtctggaatcagaaagtgggcatctgcaggaagcttccgcgctccttcccaccacagagcatgatgatctactggtcgagatgaggaattttatcgcatttcaggcacacacagacgggcaagcgtctaccagagaaatcctgcaagaatttgagagtaaattgtccgccagccagtcctgtgtgtttagggagctgcttcgcaacctgtgcaccttccatagaacatcagggggtgaaggcatttggaagctgaagcccgagtattgctag

SEQ ID NO: 28588 - DNA, 1191 bp, Artificial Sequence
  Description of Artificial Sequence: Synthetic coding sequence
atgctcggtttcctgtcggcgagacagacaggcttagaggaccctttaagactgaggcgcgctgaaagcacaaggagagtcttggggctggagctgaataaggatagagatgtggaacggatccacggcggaggaattaataccctggacatcgaacccgttgaaggtcgttatatgttgtcgggaggatcggatggtgttattgtcctgtacgaccttgagaacagctcccgccaatcatattatacctgtaaagcagtatgctctattggacgtgaccacccagacgtgcatcgttatagcgttgagactgtacagtggtacccccacgacacaggaatgttcacatccagcagcttcgacaaaaccctgaaagtttgggataccaacacactccagacagccgacgtttttaattttgaggagacagtgtatagccaccatatgtcacctgtctctacaaaacactgtctggtggcagtgggtacacggggaccgaaagtacagctctgcgatctaaaatccgggtcctgtagccatatattacaggggcatagacaggagatcttagccgtgtcctggtcccctcgatacgactacatcctggcaacagcctccgccgactcaagagtcaagctatgggacgttaggcgcgcaagtggctgcctgatcactctggaccagcacaatggcaaaaagtctcaggctgtcgagtcggccaataccgctcataatggtaaagtgaacggtctttgttttactagtgatgggctccacttgttaacagtgggtacagataaccgcatgcggttgtggaacagtagtaacggtgagaatactctggtgaattatggaaaggtatgtaataattccaaaaagggcctgaagtttactgtcagttgcggatgctcttcagaattcgtatttgtgccttacgggtcgacaatagccgtgtatacagtctattcgggggagcagattactatgctgaaaggccattataaaactgtggattgttgtgtgttccagtcaaatttccaggagctttacagcggctctcgcgattgtaatatcctcgcttgggtccccagcttgtacgaaccggtgccggatgacgacgaaaccactaccaaatcacagcttaatcctgcatttgaggacgcctggtccagctccgacgaagagggatag

SEQ ID NO: 28589 - DNA, 1017 bp, Artificial Sequence
  Description of Artificial Sequence: Synthetic coding sequence
atgctgtccggaggcagcgatggtgtcatagtcctttatgatttggagaatagttcccgccagagttactacacttgtaaagcagtgtgctccatcggtcgcgatcatcctgatgtgcacaggtatagcgtcgaaacggtgcaatggtatccccatgacacaggcatgtttacaagcagcagtttcgataagaccctgaaagtgtgggacactaacaccctgcagaccgctgatgtgttcaatttcgaagaaacggtatactcgcatcatatgagcccagtgagcactaagcactgcctcgtggcggttgggacccgcggtccaaaggtccagttgtgtgatctcaaatcggggagttgttcccacattttacagggacatagacaagaaatacttgccgtgtcctggagtccaagatatgactatatcttggccacggcctcagctgatagccgggtgaaactctgggacgtgaggagagcgagtggatgtctgatcactcttgatcagcacaatggcaaaaaaagtcaggcggttgagtcggcgaacacagcgcataacggcaaagtgaatggcctttgttttacaagtgatggcctgcaccttctgactgtgggtacagataatagaatgagactgtggaacagctctaacggtgaaaacacactggtgaattacgggaaggtctgtaataactccaagaaaggccttaagttcacggtctcttgcggttgtagttctgagtttgtttttgttccttatggaagcaccatcgctgtgtatactgtgtattctggtgaacaaatcactatgcttaagggtcactacaagaccgtggactgttgtgtgttccagtctaatttccaggaattgtattccgggagcagggattgcaacattcttgcttgggtgccgtcgctgtacgaaccagttcccgatgacgacgagacaaccacaaagagtcagctgaacccagcatttgaagacgcttggtcctctagcgatgaggaaggctag

SEQ ID NO: 28590 - DNA, 1188 bp, Artificial Sequence
  Description of Artificial Sequence: Synthetic coding sequence
atggcgacgagctcggcccctgcaggcgtccgaacaagatacgccggtgtgtttgtgcgtacacctaacgggttcggagggccttcttctccttcagagagcagggtgaatactgaatcattcggaactggcattaacaccctcgatatcgagccagtagagggcagatacatgttatccgggggatcagacggcgtcatagtgctgtacgatctcgaaaattcaagccgccaaagctattacacgtgcaaagcagtctgctcaataggcagggatcatccggacgtccaccgctactcagtggaaacagtgcaatggtatccacacgacacgggaatgtttactagtagctcttttgataaaaccctgaaagtgtgggacaccaataccctgcaaaccgccgatgtttttaactttgaggagactgtctacagtcatcatatgtctcctgtgtcaactaagcactgtctggtggcagttgggacacggggtcccaaggtgcagttgtgcgacctgaagtcaggctcctgtagtcacattctgcagggccataggcaggaaattctggcagtgagctggagtcccaggtacgattacatcctggccaccgcatccgccgacagcagagtcaagctctgggatgtccggagagcatccgggtgcttgataaccctggatcagcacaatggcaaaaagagccaagcggtcgagtccgctaatacggcccataacggtaaagtaaacggactgtgcttcaccagcgacggcctgcacctcctcacagtcggaaccgacaatcgcatgcggctgtggaacagcagtaatggagaaaacaccctggttaactatggtaaggtgtgcaataatagcaaaaagggactgaaatttacagtgagctgtggttgctcctccgaattcgtgtttgtcccttatggttcaactatcgctgtgtataccgtgtacagtggcgaacagatcacgatgcttaaaggccactataaaacggtcgactgttgtgtgttccagtctaactttcaggagctgtacagtggaagcagggattgcaatatcctggcgtgggtgccctctctttacgagccggtgccggatgacgacgaaactacaacaaagtcccaacttaatccagccttcgaggacgcctggtccagttcagacgaggaggggtag

SEQ ID NO: 28591 - DNA, 732 bp, Artificial Sequence
  Description of Artificial Sequence: Synthetic coding sequence
atgggctacaagtacatcaccatcggtaccagaggccctaaggtacaactgtgcgacctcaaatccggctcctgtagccatatactgcagggacatagacaagagatcctggcagtatcttggagccccaggtacgattacatcctggcgactgcaagcgctgatagcagagtcaaactctgggatgtccgtcgcgcatctgggtgcctcatcactcttgatcagcacaatggtaaaaagagccaggctgtggagtcagcaaacaccgcccataatggcaaggttaacgggttatgttttacaagtgacggattgcacctcctgacggtcggcaccgataatcgcatgcgactgtggaacagctccaacggtgagaacacactcgtaaattacggcaaagtctgtaacaatagcaagaaggggctgaagtttacagtgtcttgtggatgcagctctgagtttgttttcgtcccatacggaagcactatcgctgtctacacggtttatagtggtgagcagatcacaatgttgaaaggccactacaaaacagtggactgttgcgtttttcagagcaattttcaggagctttactccggctcccgtgattgcaacattctcgcttgggtgccgtctctatacgagcctgttcctgacgacgacgaaacaacaacgaagtcccagttgaacccagccttcgaagatgcctggtcaagttccgacgaggagggctag

SEQ ID NO: 28592 - DNA, 2541 bp, Artificial Sequence
  Description of Artificial Sequence: Synthetic coding sequence
atgggaatacaaggcctcctccagttcattaaagaggcatcagagccaattcacgtgcgtaaatacaagggacaggtggtcgccgtggacacatattgttggctgcacaaaggggctattgcatgtgcagagaaactggccaagggcgagcctactgatcgctatgtcggcttctgtatgaagtttgtcaatatgctgctttcccatgggatcaaacccattctagtctttgacgggtgcaccctgccgtccaagaaggaagtcgaacggagcaggagagaacgcaggcaggccaacttactaaagggcaagcagctcctacgcgagggtaaagtgagtgaggccagggaatgttttactaggagcattaatataactcacgcaatggctcataaagtcattaaggccgcaaggagtcagggcgtcgactgcctggtggcaccttacgaggccgacgcacagctcgcgtacctaaacaaggccggtattgtgcaggcaataattaccgaggattccgatctgttggcttttggttgtaaaaaggtgattcttaaaatggatcagttcggcaacggtctggagattgatcaggcaagactgggtatgtgccggcaactgggagatgtgtttacagaagagaaattcaggtatatgtgcatcctttctggatgcgattatttatcttctcttcgaggtattgggcttgcaaaggcatgtaaggttctgcgtctcgctaacaacccggatatcgtgaaggtaattaagaaaataggccattatctgaagatgaacattaccgtgcctgaagactatataaacgggtttattcgcgctaataatacatttctgtatcaactcgtgttcgacccaatcaaaagaaagctcataccgctgaacgcgtacgaggatgatgtcgacccagaaacattgtcctacgcgggtcagtacgttgatgacagcatcgcactgcagattgctctgggaaacaaagatatcaatacctttgaacagatagatgattacaatcccgacaccgccatgcctgctcattccaggagccattcgtgggatgataagacttgccagaagtcagccaatgttagctcgatctggcatagaaattacagccccagacctgagagcggcaccgtctctgatgcaccccagctgaaagagaacccctcaacggtgggtgtggagcgtgtgatctcaactaagggcctgaacctgcctcgcaaatccagcattgtaaagaggcccagaagtgctgagctatctgaggatgatctattgagccaatactccctttctttcactaagaagacaaagaaaaacagcagtgaggggaacaagagcctgagtttcagtgaggttttcgtgcctgatcttgtgaatggaccaactaacaagaagtctgtctccaccccacccaggacgaggaataaatttgcaacctttctacagagaaagaatgaagagagtggcgcagtggttgtgccaggcacccgctctcggttcttctgctcatccgatagcacagactgcgtgtcaaacaaggtgagtattcagccacttgatgagaccgccgtgacagataaggagaataacctgcacgagtcggagtacggagaccaagagggcaagaggctcgtcgataccgacgtcgccagaaacagctcagatgatatacccaacaatcacatccccggtgaccatattcccgacaaagccaccgtctttaccgacgaggaatcctattctttcgaaagttcaaaatttaccagaaccattagcccacccactcttggtaccctgcgcagttgcttttcttggtccggtggactgggtgatttttcgcggaccccttccccaagcccatctaccgctctacagcagtttcgccgtaaaagtgacagccctacatcgcttccagaaaacaacatgtccgatgtgtcccaattgaaatctgaggaaagctcggatgacgagtcgcaccctctgagggaggaagcctgttcgagtcagtctcaggagtcaggcgaattcagcctgcagagctctaatgcaagcaaactgagtcagtgctccagcaaggattccgacagtgaggaatctgactgtaacattaagctcttggattcccagtcagatcagacatcgaagctgcggctgtcacacttttccaaaaaggatacacccttaagaaacaaggtgccagggctatacaaatcatcaagcgctgattcactctcaacaactaagatcaaacccttaggcccagccagggcaagtggcctgtctaaaaaacccgcttcaatacagaagcgcaagcaccacaatgcagaaaacaaacccggactgcagattaagctcaacgagctctggaaaaactttgggtttaaaaaggactccgagaagctacccccttgtaagaagccgctctcccctgtaagagacaacattcagctaacacctgaagcagaggaggatatcttcaataagccagaatgtgggagagtgcaacgcgcaattttccaatag

SEQ ID NO: 28593 - DNA, 510 bp, Artificial Sequence
  Description of Artificial Sequence: Synthetic coding sequence
atggggattcagggcttactgcagttcatcaaagaggcctcagagcccatacatgttcggaagtacaagggccaagtggtcgcagtcgatacctactgctggctgcataaaggcgctatcgcctgcgcagagaagttggccaaaggcgaacctacagatcgccgacgtcaggcaaatcttctaaaaggcaagcagctgctgcgcgagggtaaagtatccgaagccagggaatgcttcacaagaagcataaacatcacgcacgccatggctcacaaagttatcaaggcagcacgctctcaaggggtcgactgcttggtggccccatacgaagccgacgctcagctggcctacctgaataaggctggtatcgtgcaggctatcattaccgaagacagtgaccttcttgcgttcggatgcaagaaggtgattttaaagatggaccagttcggcaatggtctcgagatcgaccaggcccgattagggatgtgtcgccagttgggggacgtgtag

SEQ ID NO: 28594 - DNA, 2541 bp, Artificial Sequence
  Description of Artificial Sequence: Synthetic coding sequence
atgggcattcaagggctgctccagttcatcaaggaagcttcagagcctattcatgtgcggaagtataagggccaggttgtggcggtcgacacatattgctggctacacaagggggcaattgcctgcgccgaaaagctagccaaaggggaacctactgatcggtacgtcggattttgcatgaagttcgtgaacatgctgcttagtcatgggatcaagcctattctggtgttcgacggatgtacgctgcccagcaagaaagaagtcgaacggtcaaggcgggagaggcgccaagctaatctccttaagggcaaacagttattgagggagggaaaggtgtcagaagctagagaatgttttactcgatccataaatattacccatgcgatggcccacaaggtcattaaagccgcacggagccagggagttgactgtctagtggcaccatacgaagccgacgcacagctggcctatctgaataaggctggcatagtccaagctatcattacagaggactctgacctcctggccttcgggtgcaagaaggtgatactgaagatggaccagtttgggaacggtcttgagatcgaccaggccaggcttggaatgtgcagacaacttggggatgtttttaccgaagaaaagttcaggtatatgtgcattctttcagggtgtgattatttatcctctctgaggggcattggacttgctaaagcctgcaaggtattgcgcctcgcaaataaccctgatatcgtaaaagtcatcaagaagattggccattatctgaaaatgaacattacagttcccgaagactacattaacggcttcataagagcaaataatacattcctgtaccaactcgtgttcgaccccatcaagagaaaattaatcccactgaacgcatatgaagatgacgtggacccagagactttgagctacgccggtcagtacgtggacgactccattgcgctccagattgctttgggcaacaaagacattaacaccttcgagcagattgatgattataatcctgatacggcaatgccagcccactccaggagccattcctgggacgataagacttgccagaaatccgccaatgtgagctctatatggcataggaattatagcccaaggccggagtccggcaccgtttctgatgcccctcagttgaaagaaaatcccagtactgtcggggtggaaagggttataagcactaaaggactgaatctgccaaggaagagttcaatcgtgaagcggcctcgctctgctgaactaagtgaggacgatttgctgagccagtactccctaagttttaccaaaaaaacaaaaaagaattcatccgagggcaacaagagcttgtcatttagtgaagtgttcgtgccggacttagtaaatgggccaacgaataagaaatcagtgtccacccctccaagaacaaggaacaaatttgccacttttctgcagcggaagaatgaagagtctggcgctgtggtggtcccaggtacaagatcccggtttttctgctcatccgatagcacggattgtgtcagtaataaggtttccattcagcctctggacgaaacggcagtgacagataaggagaataacctccatgagtctgaatacggcgatcaggagggaaagagacttgtcgacaccgatgtcgcacgaaactcatccgatgatatcccgaataaccatataccaggcgaccacatcccagataaagccactgttttcacggacgaagagagttactctttcgagtcatctaaatttactcgaaccatctccccacccaccctcgggacactgcgctcatgcttttcttggagcggaggcctcggcgattttagcaggacaccaagccccagcccaagtacagcactacagcaatttcgcagaaaatctgatagtcctacttcccttcccgaaaacaatatgagcgacgtctcccagttgaaatctgaagaatcaagcgacgacgagagtcatcccctccgagaggaagcgtgttcttctcagtctcaggagtccggagaattctccctgcagagtagcaacgcctctaagttgagccagtgtagcagcaaagatagcgactcagaagagtctgactgcaacatcaaactcctagactcacagtccgaccagacatccaagctgcgcctttctcatttctccaaaaaggatacccccctgcgcaacaaagtacccggactgtataagtcttcttcggccgactccctgagtaccacaaaaatcaagcccctcggaccagcgagagcttccggcctgagcaagaagccagcatctatacaaaaacggaagcaccacaacgctgagaacaaacctggactgcagattaaacttaatgaactgtggaagaatttcggatttaagaaggattccgaaaaactacctccctgcaaaaagccccttagccctgtccgagacaatatccaattgaccccggaggcagaggaagatatattcaataaacccgagtgcggcagggtgcagcgtgccatctttcagtag

SEQ ID NO: 28595 - DNA, 408 bp, Artificial Sequence
  Description of Artificial Sequence: Synthetic coding sequence
atgggtatccagggactgttacagttcattaaggaagcttccgaacccattcacgttaggaagtacaaggggcaggttgtggctgtcgatacttactgttggctgcataaaggagctattgcatgtgccgagaaactagcaaagggagaacccacagacaggtatgttgggttctgtatgaagttcgtgaacatgctgctgtcccacggaatcaagcctatcctagtctttgatggatgcaccctgccatccaaaaaagaggtggagcgctccagaagagagaggcgccaggcaaacctactaaagggtaaacagttgctccgggaaggcaaagtctccgaggctagagaatgtttcacccggtctattaatattacacacgccatggcacacaaggtgatcaaatag

SEQ ID NO: 28596 - DNA, 2412 bp, Artificial Sequence
  Description of Artificial Sequence: Synthetic coding sequence
atgggcatccaggggttgctgcagttcattaaagaagcgagcgagcccattcacgtccggaagtataaaggtcaggttgtggccgttgacacctactgctggctgcataaaggggctatcgcatgtgccgagaagctggcaaagggcgagccgaccgacagatacgtaggattttgtatgaaattcgtaaatatgctcctctcccatggcatcaaaccgattctggtattcgatggctgcaccctgccatctaagaaggaagtggagcggtcaaggcgggagaggaggcaggctaatctcctgaagggaaagcagctgcttagagaggggaaagtgagcgaggctcgtgaatgtttcactaggagcatcaacataacgcatgctatggcccataaggtcataaaagctgcacggtcccagggtgtagattgcctggtggcgccatatgaggcagacgctcaactcgcctacctgaacaaggccggtatcgtgcaggctatcatcacagaggacagcgatctcctcgctttcggatgcaagaaagtaatcttgaaaatggaccagtttggcaatggacttgagattgatcaagccaggctcggcatgtgtcgccagttgggagatgtgttcactgaggaaaaattcaggtacatgtgcattctctctggctgtgactatctgagtagcctccggggaatcgggcttgcaaaagcatgcaaggtgcttcgtctcgctaacaacccggacattgtgaaggtcataaaaaagatagggcattatctgaaaatgaatatcactgttccagaggactacattaacgggtttattcgggctaacaataccttcctgtaccaactggtgtttgatccaattaagaggaaattaatcccactgaacgcctacgaagatgacgtcgacccggagaccctaagctacgctggccagtatgtcgatgattctattgccctgcagattgccttaggaaataaggacatcaacaccttcgagcaaattgatgattataaccccgacacggccatgcccgctcacagcagatcccactcttgggatgataagacatgtcagaaaagcgctaacgtgtccagcatctggcacagaaactattcacccagacctgagagcgggacagtgtctgatgctcctcagctcaaggaaaaccctagcactgtcggggtcgaacgggtcatatcgacaaaggggttaaacctgccccgaaagtcatccatagtgaagagaccgagatcagccgaactgagcgaggacgatctcctgagtcagtattcactcagcttcaccaaaaagaccaaaaagaacagttccgaaggaaataaaagcttgagctttagcgaggtctttgtgcctgatctcgtgaatgggcctactaataagaagagcgtttccacacctccacggacgcgaaataagttcgctactttcctacagaggaagaatgaggaaagcggggctgtggtcgttcccggaacccgttcacgctttttctgcagcagcgattccactgattgtgtttccaacaaggtgagtatccaacccctcgatgaaacggcggtcactgacaaagaaaacaacctgcacgaatcggagtacggggaccaggaaggcaagcgcttagtggacacagatgtcgctcggaactcctcggacgatatcccgaacaaccacattccaggggatcacatcccagacaaagctactgtgtttaccgacgaggaatcttatagcttcgagtccagcaaattcacccgtactatttccccccctactctggggacactgcgcagctgtttcagctggagcggcggattgggagacttttctaggacaccttcaccaagtcctagtaccgcgttgcagcagttccgccgtaagtctgattctcctacttccctgcccgagaataacatgtcagatgtctcccagctgaaaagtgaagagtcaagtgatgacgaaagccaccccctccgagaggaggcatgttccagtcaatcacaggagtctggagagtttagtctgcagtcttccaacgctagcaaactatcacagtgctcctctaaagactccgactctgaagagtctgactgtaatatcaaattattggatagtcaatcagaccagacaagtaaactccggctctcgcattttagcaagaaagacacccccctgcggaacaaagtcccgggtctctataaatccagctcggcggattcactgtccacaacaaagatcaaacctctaggacccgctcgtgccagcgggctcagcaaaaaaccagcctctatacagaagcggaagcaccataacgcagaaaataagcccggattacaaatcaaactcaatgagctgtggaaaaatttcggatttaaaaaattctag

SEQ ID NO: 28597 - DNA, 36 bp, Artificial Sequence
  Description of Artificial Sequence: Synthetic coding sequence
atgggcattcagggcctcctgcaatttatcaaatag

SEQ ID NO: 28598 - DNA, 2241 bp, Artificial Sequence
  Description of Artificial Sequence: Synthetic coding sequence
atgcaggccaaaaaacgatacttcatcctactatccgcgggatcttgcctcgcactgctcttctattttgggggtcttcaatttagggccagtagatcgcacagccggagagaggaacactccggtcggaacggcctccatcacccatctccagaccacttctggcctagatttccagatgccctgcgtccattcgtcccttgggatcagctcgagaacgaggacagctctgtgcatatttctccgagacagaaacgtgacgcaaattccagcatttataaaggtaagaaatgtcggatggaatcctgctttgattttacactgtgtaagaagaatggcttcaaggtctacgtgtatccacaacagaagggagagaagatcgctgagtcttatcagaatatcctggccgctatcgaagggagcagattctacacaagcgatccttcccaggcctgtttgtttgtgttgagtttggatacactggacagggaccagctcagtcctcaatacgttcataatctgaggtcaaaagtacagtcccttcacctctggaacaatgggaggaatcaccttattttcaatctttacagcggaacttggccggattataccgaggatgtggggtttgatatcggccaggccatgctcgctaaggccagcataagtacagagaactttaggcccaactttgacgtgagcatccctttattttctaaggaccaccccaggaccggcggagaacgagggtttctgaagttcaatacaattccacccctgcggaaatatatgcttgttttcaagggcaaaagatatctgactggcatcggcagcgatacgcgaaacgctttgtaccacgtgcataatggggaggacgtagtgttgctcacgacttgcaagcatggcaaggactggcagaaacacaaagattccagatgcgacagggacaacacagagtatgagaagtatgactacagagagatgctgcacaatgcaacgttttgcctcgtacctagaggacggcgtcttggatcttttcggtttcttgaagccttacaagctgcttgtgtgccagtgatgctgagtaacggatgggagctgccgtttagcgaggtcatcaattggaatcaggctgctgtcataggagacgagaggcttctgctgcagatcccctcgacgatccgttccattcatcaggacaagattctggctctcagacaacagactcaattcttatgggaggcttacttttcaagtgtagagaaaatcgttcttacaactctggagataatccaggatcgaattttcaaacacatcagtcgcaactctctcatctggaataaacatccgggagggttgttcgttctacctcaatattctagctacttgggtgatttcccttattactacgccaatctgggcttaaagccacctagtaaattcactgccgtgattcacgcggtgactccccttgtctcacagagccagcccgtgttgaaactcttagtggcagccgcaaagtcccaatactgtgcccagattattgttctttggaactgcgataagccactgccggctaaacaccgctggccggctacagcggtccccgtagtcgtaattgagggcgaatccaaagtgatgtcaagccgcttcctgccctatgataacataatcaccgacgccgttctgtccctcgacgaggacactgtcctgtccaccactgaagtagacttcgccttcacagtgtggcagagtttcccagaaaggattgtcgggtaccctgcccgaagccatttttgggacaattctaaggaacggtggggctacacgtcaaaatggactaacgactactctatggtgttgacaggagctgccatataccataagtactaccactacctttacagtcattatttgcccgcatctctgaaaaatatggtggaccagctggccaactgtgaggatatactcatgaattttctcgtgagcgctgtcactaagctccctcccatcaaggtcacccagaaaaaacagtacaaggaaaccatgatggggcagacctccagagcatcaagatgggctgatccggatcattttgcccagcggcaatcttgcatgaatactttcgccagctggttcggctatatgccattgattcactcccaaatgagactggatcccgtgctcttcaaagaccaagtaagcatccttaggaaaaagtatcgagacatcgagagactttag

SEQ ID NO: 28599 - DNA, 2157 bp, Artificial Sequence
  Description of Artificial Sequence: Synthetic coding sequence
atgtgcgcatctgtgaaatataacattcgcggtcccgcactcatcccacgtatgaagacaaagcatcgaatttactacattactctgttttcgatcgtgctgctggggctgattgcaaccggaatgttccagttctggcctcattccatcgagagttctaatgactggaatgtcgagaagagatcaatacgagacgtgcccgtggtgcggttgccagccgattcacctattccagagagaggggatttgtcatgccgtatgcacacctgctttgacgtgtataggtgcggattcaacccaaagaataagatcaaggtatacatttacgcactgaaaaaatatgttgacgacttcggtgtcagtgtgtctaacaccatttcaagggaatataacgagctacttatggccatctcagatagcgactattacacagatgatataaatagggcttgtctcttcgtgccatctatcgatgtgctgaaccaaaacaccctccgcatcaaggagaccgcacaggccatggcccagttaagccggtgggatcggggaaccaatcatctcctctttaatatgcttcctggcggacccccagattataacacagcgctggacgtgccacgagaccgggctctgttagcaggtggcggtttttccacatggacctatagacaggggtatgacgtgtcaataccagtctattctcccctcagcgcagaggtagacctgcctgaaaagggtccgggtccaagacaatatttcctcctgagctctcaggtggggcttcatcctgaataccgtgaggaccttgaagccttacaggtgaagcatggcgagtctgtcctcgtcctggataaatgcaccaacctgagtgagggcgttttgagcgtgcgcaaaagatgtcacaaacatcaggtgtttgactaccctcaggtacttcaagaggccactttttgtgtagttctgcgcggtgcaaggctcggccaagccgtcctctcagacgtgctgcaagccggatgcgttcctgttgtgatcgccgatagctatattttacctttttccgaggtcctggattggaagagggcgagcgtcgtggtcccagaggaaaagatgagcgacgtctactctatcctgcaatctatcccacaaagacagatcgaagaaatgcagagacaagcaaggtggttttgggaggcctacttccagtcaattaaagcaatcgccctggccaccctgcagattatcaatgatcgaatctacccatacgccgcaatcagctatgaagagtggaacgacccacccgcagtaaaatggggatcagtcagcaatcccttgttcctccctttgatcccgccacaatcccagggattcaccgcaatagtgctaacgtacgatagagtggaaagtttgtttcgcgtgattaccgaagtatctaaggtgccgtccctgtcgaagttgttagtggtttggaataaccaaaataaaaacccaccggaggattcactctggcctaaaattagggtcccgctgaaggtggtgaggactgctgagaacaagttgtcgaataggtttttcccatatgacgagattgaaacagaagcagtgcttgccatcgatgacgacattataatgctgacgtcggatgagttgcagtttgggtatgaggtctggcgggagttccccgaccgtctggtcgggtatccgggaaggttacacctgtgggaccatgagatgaataaatggaaatacgagtcagaatggacaaatgaggtaagtatggtactgactggcgctgccttctatcacaagtattttaattacctgtacacttacaaaatgcccggtgatattaaaaattgggtcgacgcccatatgaactgcgaagatatagccatgaacttcttagtagcgaatgtgaccggaaaggcagtcatcaaggtgactcctcgtaagaagttcaagtgtcccgaatgcacagcgattgacggcctgtcccttgaccaaacccatatggtcgagcgttcagagtgcatcaataagtttgccagcgtgtttggaactatgcctctaaaagtggtcgaacaccgcgctgaccctgttctctataaagacgactttcccgagaagctaaagtccttcccgaacatcgggtcgctgtag

SEQ ID NO: 28600 - DNA, 2187 bp, Artificial Sequence
  Description of Artificial Sequence: Synthetic coding sequence
atgtgcgccagcgtcaagtacaacattagaggccctgcacttattccaaggatgaaaacaaaacaccggatctactatatcaccctattcagtattgtgttgctcgggcttattgccacaggcatgtttcaattctggccccattccattgagagtagcaacgactggaacgtggaaaagcgctctattagagatgtgcctgtcgtgcgcctgccagcagactcccccattcccgagcgaggggatctcagctgtcgaatgcatacttgcttcgacgtgtaccggtgtggatttaatcctaaaaacaagattaaggtttatatctacgccctcaaaaagtacgtggacgatttcggcgtgagcgtgtcaaatactattagtcgggaatacaacgaattactgatggctatatcagactccgactattataccgatgacatcaatcgggcatgcctcttcgtgccctcaattgatgtccttaaccaaaacaccctccgaatcaaagagactgctcaggcaatggcccagctctcacgctgggaccgaggcaccaatcacttgctgttcaacatgctacccggtggacctccagattacaataccgctttagatgtccccagggaccgagctctcttggccggaggaggctttagcacttggacctataggcagggatacgacgtgagtattccagtgtacagcccattatccgcagaggtggatctccctgagaagggccctgggcctcggcagtattttctgctttcgtcccaagtaggccttcatcctgagtacagagaggacctggaagcattacaggtaaagcatggagagagcgtgctagtccttgacaagtgcactaatctgagtgaaggcgtgttaagcgttagaaaacggtgtcacaaacatcaggtgttcgattacccccaggtgctccaggaggccacattctgcgttgtgctgcggggtgccaggctgggccaggctgtgttgtctgatgtgctgcaggccggttgcgtgccggtcgttatagccgattcttatatcttaccttttagtgaggtgctagattggaagcgggcttccgtggtcgtgcccgaggagaaaatgtctgacgtgtatagtatcctacagagcatcccccagcgccaaatcgaagagatgcaacgccagctctttatggaacccgcacggcgtgagaactggtccgccgcaaatcatcagatgaacagcctgatttggcccagggaacagtgggacagccagatcattaatgaccgcatttacccctatgcggctatctcctatgaagagtggaacgacccgcctgccgtcaagtggggaagtgtgtcgaatccactatttctgccccttatcccacctcagagccagggctttacagctattgtcctgacttacgacagagtcgagtcattattccgggtgattacagaggtgtccaaggtgccttcactctctaaactccttgttgtctggaacaaccagaacaaaaatcctcccgaggactccctatggccgaagataagagtgccgttgaaggtagtgcggactgccgaaaacaagctctccaaccgatttttcccctacgacgaaatcgagaccgaggctgtgcttgccatcgatgacgacataataatgctaaccagcgacgagcttcagttcggctacgaagtctggagggagtttcccgacagactcgttggctatcctgggagactccacctctgggaccatgaaatgaataaatggaaatacgagtcagagtggactaacgaggtttctatggttttaactggagctgctttttaccacaagtacttcaactacctgtacacctataagatgcctggagacattaagaattgggtcgacgcacacatgaattgcgaggacatcgctatgaacttcttagtcgctaacgttacgggcaaggcggtgatcaaggtgactccaagaaaaaagttcaagtgcccagaatgcactgccatcgacggtctgtcactagaccagacacacatggtcgagcgaagcgagtgcattaacaaattcgcctctgtatttggcactatgccactaaaagtggtggagcatagggctgatcccgtcctatataaggacgattttcccgaaaagctgaagagcttccccaatattgggtccctctag

SEQ ID NO: 28601 - DNA, 2256 bp, Artificial Sequence
  Description of Artificial Sequence: Synthetic coding sequence
atgagttgcgctagcggaagcggtgggggattaaggcacccactgaggtgccaaaaaccttgggacgaagagtgcgaagaggaggctgtgtgcgtgatcatgtgcgcgtccgtgaaatataacatccggggacccgctctgattcccagaatgaaaactaagcaccgcatttattacataacactgtttagcatcgtgttactggggttgatcgccacaggaatgtttcagttctggccccactccatcgaatcctccaatgactggaacgttgagaagaggtcaatacgagacgtgcccgtagttagactccctgctgattcacctattcccgagaggggggacttatcctgccgaatgcacacttgctttgacgtgtacaggtgcgggtttaaccctaagaacaaaatcaaggtgtatatatacgcactcaaaaaatacgtggatgacttcggcgtgtctgtgtccaataccatctcaagggagtataatgagcttcttatggccattagtgacagcgattattatacggacgacattaatcgggcatgcctgtttgtacccagtattgatgtgctgaaccaaaacacactcagaatcaaggaaacagctcaagcaatggcgcagttgtctaggtgggaccgcggaacaaaccacttgctgtttaatatgctacctggagggccacctgattataacactgctcttgacgtcccaagggatagggcgctgcttgcaggagggggattttccacttggacatacaggcagggttatgacgttagtatccctgtgtactctcctctcagcgccgaagtggatctccccgagaaggggccaggtccgcgacaatacttcctgctttcctcgcaggttggcctacatccagaatatagggaggacctggaggccctgcaggtcaaacatggggagtcggtactggtgctagacaaatgtactaacctcagcgaaggagtgctctctgtgaggaagcgctgtcataagcatcaggtgttcgattacccccaagtactacaggaggctacattttgcgtggtgctgagaggcgcacggctcggccaggccgtgttgtccgacgtgctgcaggccggttgcgtgcctgtggtgatcgcagacagttacatactgccctttagtgaggtcttagattggaagagagccagcgtggtggtgcccgaggaaaaaatgtcagatgtctatagtatcctccagtcaattccccagcgacaaatcgaagagatgcagcggcaggctcgctggttctgggaggcctatttccaatctatcaaagctatcgccctggcaacactgcagattattaatgaccggatctacccctacgctgcaataagctacgaggagtggaacgacccacctgctgtgaagtggggctcggtctctaatccattgtttctgccactcattcccccacagagccagggctttaccgcgattgtgctgacctatgatcgggttgaatcgctctttagggttattacagaggtgagcaaggttccttccctcagcaagcttctcgtcgtgtggaacaatcaaaacaagaacccaccagaggactcactgtggccaaagattcgggtaccacttaaggtggttcgtaccgctgaaaacaagctatccaataggttctttccttatgacgagatagagactgaggcggtcctggctattgatgatgacattataatgttaacgagcgacgagctgcagttcggatacgaggtgtggcgagaatttcctgaccgactcgtgggttatcccggaaggctgcacctatgggatcacgaaatgaacaaatggaagtacgagtctgaatggaccaacgaggtgtcaatggttctgactggcgctgccttctaccataaatattttaattacctctacacctataaaatgcctggggacatcaaaaattgggtggacgctcatatgaactgcgaagatatagccatgaattttctggtggctaacgttaccggcaaggcggtgattaaggtgacgccaagaaagaaattcaagtgcccagaatgtactgccatagacggactcagccttgatcagacacacatggtggaacggagtgagtgtattaataaatttgccagcgtgtttggcaccatgcccctcaaggtcgtggagcatcgcgcagatcccgtcctgtataaggacgactttcctgaaaaactcaaatcatttcctaacatcggctctctgtag

SEQ ID NO: 28602 - DNA, 339 bp, Artificial Sequence
  Description of Artificial Sequence: Synthetic coding sequence
atgtgtgcatcagtgaaatataatatccggggacccgctctgatccctcggatgaaaaccaagcataggatctattatatcactctgttttccatcgtcctgctgggactaattgcaacaggaatgtttcagttttggccccactctatagaatcgtctaatgattggaacgtggaaaaaaggagcatacgcgacgttcccgtggtcagactccctgctgacagtccgattcccgagcgtggggatttatcctgccggatgcacacctgttttgacgtctaccgctgtgggttcaacccaaagaacaaaatcaaagtctatatttatgctttgaaatag

SEQ ID NO: 28603 - DNA, 150 bp, Artificial Sequence
  Description of Artificial Sequence: Synthetic coding sequence
atgtgcgcatcggtgaagtacaacatccgcggtcctgcgttgataccaaggatgaagactaaacaccggatctattacatcacattattctctatcgtgttattagggctgatagccaccgggatgttccagttttggcctcatagttag

SEQ ID NO: 28604 - DNA, 2157 bp, Artificial Sequence
  Description of Artificial Sequence: Synthetic coding sequence
atgtgcgcatctgttaaatacaacatccgtggccctgctctcattcctcgcatgaagactaaacatcgaatttactatattaccttattttctattgttctgcttggcttgattgccacgggtatgttccagttttggccgcattccatcgaaagctcgaacgattggaacgtggaaaagagaagtattcgagatgtccctgtggttaggctgccagccgattcccccatccccgagcggggtgatctgtcctgtaggatgcatacttgttttgatgtgtataggtgcggttttaaccccaagaacaagattaaagtttatatctatgcccttaaaaagtacgtggatgactttggggtctcagtctccaatacgatctcgcgtgagtacaacgaattgctcatggccatttcagactctgactattacaccgatgatattaacagagcttgtttgttcgttcccagcattgacgtgttgaaccagaacacactgaggatcaaagaaaccgcacaggcaatggcccagctttcaagatgggaccgcggaactaatcatctgctatttaatatgctgccaggcggacccccagattacaacacggctttagatgtgccccgagacagggccctgttagctggtgggggattttccacatggacgtatagacagggctatgacgtcagtatccccgtttactcccccttgtccgccgaggtagatctgccagagaaaggacccggaccaaggcagtatttccttttgagctcccaagtggggctccacccagaataccgggaggatcttgaggctctccaagtgaaacatggcgagtctgttttggtgctggacaaatgtacaaacctgtccgagggggtgctgagcgtgcgcaaacggtgtcacaagcaccaagtcttcgattatcctcaagtgctccaggaagctacgttctgcgtggtcctgaggggcgctaggctggggcaagccgtgctgagtgatgtgctacaggcaggatgtgttccagtggtcattgcagactcctacatccttcccttctccgaagtgctggactggaaaagggcctctgtggtcgtgcctgaggagaagatgtctgatgtttactctatcctgcagagcattccccaacggcagatcgaagaaatgcaacgccaagcgaggtggttttgggaggcctacttccagtctataaaagccatcgctcttgccaccttgcagattatcaatgatcgcatttatccgtatgccgcaatcagttacgaagagtggaatgacccgcctgctgtcaagtggggaagcgtctcaaacccgctgtttctgcctttgatcccccctcagagccagggctttactgccatcgtcctgacctatgacagggtagagtccctttttagggtgatcactgaagtctccaaagtgcctagcttgtccaaactcctggtggtatggaacaaccagaataagaatcctcctgaggattccctgtggcccaagatccgggttcccctgaaggtggtacgcaccgctgagaacaaactaagtaaccgtttcttcccttacgacgagattgagactgaggcagttctcgctatcgatgacgatatcatcatgctaacatccgatgaactccaatttgggtacgaagtgtggcgggaattccctgaccgcctggtgggttaccctggtcggctgcacctgtgggaccacgagatgaacaagtggaagtacgagagtgaatggacaaacgaagtgtctatggtactgacaggagctgccttctatcataaatacttcaattatttgtacacctacaaaatgcccggagatatcaagaactgggtcgacgcccacatgaactgcgaggacattgcaatgaatttccttgtcgccaacgtgaccggtaaagccgtcatcaaggtcactcccagaaaaaaattcaagtgccccgaatgtaccgccatagacggtctatccctggatcagacgcatatggtcgagcgaagtgagtgcatcaacaagtttgcttccgtgtttggaaccatgccactgaaggttgtagagcaccgcgcagacccagtgctgtataaagatgatttcccagagaagctgaagagctttcccaatatcggcagtctttag

SEQ ID NO: 28605 - DNA, 1761 bp, Artificial Sequence
  Description of Artificial Sequence: Synthetic coding sequence
atgccaaaacccatcaacgtgcgggttacgaccatggacgcggagctggagttcgccattcaaccaaacacaacaggcaaacagctgttcgaccaggtggtgaagacaatcggcttgcgagaggtgtggtattttggccttcattacgtggacaacaagggcttccctacctggctgaaactcgacaaaaaagtgtctgcacaggaagtgcggaaagaaaacccactccagttcaaattccgcgctaagttttatccagaagatgtggcagaagagctaatccaggatataacccagaaactattttttctgcaggtaaaagaaggcatcctgagtgatgagatctactgccctccagaaactgccgtcctcctgggttcttatgcggtgcaggccaaatttggagactacaacaaagaagtgcacaaatcgggttatctcagcagcgagcggttaattcctcagagagtcatggatcagcacaaactgacccgagaccagtgggaggaccggatccaggtgtggcacgccgagcaccggggtatgctgaaggacaacgccatgctggaatacctgaaaatagcacaagatctggaaatgtacggcattaattatttcgaaattaaaaacaaaaaaggcaccgatctgtggctgggagtcgatgctctgggactaaatatctacgaaaaagatgacaaactgactccaaagatcggattcccctggagcgagatccgcaacatatccttcaacgacaagaagttcgtcataaagcctattgacaagaaagccccagattttgtcttttacgctccaagactgagaatcaataagcgcattctgcagttatgcatggggaaccacgagctgtatatgcgcaggagaaaaccggacacaatagaggtccagcagatgaaggcacaggctcgggaggaaaagcaccagaagcagctagagagacagcagctcgagactgaaaagaaaagacgagagactgttgagagagagaaagagcagatgatgagagagaaggaagagcttatgctccgccttcaggattatgaagagaagaccaaaaaagcagagcgcgagctttcagaacagatacagcgggcactacagctcgaagaggagcggaagagggcccaggaagaggctgaaagattggaagctgacagaatggctgcgcttagagccaaagaggagctcgaacgacaagcggtagaccagattaaatctcaagagcagttggctgccgaactggcagagtacaccgctaagattgctctattggaggaggccaggcggcgaaaggaggatgaagttgaggagtggcaacacagggccaaagaagcacaagatgacttggtgaagacgaaagaagagctgcatctcgtgatgacggcccctccccctccaccccctcccgtgtatgaacctgtgagctatcacgtacaggaaagtttgcaagacgagggtgccgaacctaccggatactctgcggagctcagttccgagggcataagagacgaccggaatgaggaaaagcggattactgaggctgagaagaatgaacgggtccaaagacagctgctgacactgtcctcagagctaagccaagcaagagacgagaacaaacggacgcacaacgatattatccacaacgaaaacatgagacagggaagggacaagtacaaaacactacgtcaaattcggcagggaaatacgaagcagcgcattgacgagtttgaagccctttag

SEQ ID NO: 28606 - DNA, 1761 bp, Artificial Sequence
  Description of Artificial Sequence: Synthetic coding sequence
atgccaaaacccatcaatgtgcgagtgaccactatggatgctgaactagaattcgccatccagcctaataccactggtaaacaactctttgatcaagtggttaaaaccattgggttgagagaagtctggtacttcggcttgcattatgtagataataaaggattccctacttggctgaagctggacaaaaaggtttcagctcaggaggttaggaaagagaatccactgcagttcaagttccgagccaagttttacccggaagatgtggccgaagagctaatacaggatattacacagaagttgttctttctgcaggtcaaggagggaattctatccgacgagatctactgtccgcctgaaaccgcggttctgttaggcagttatgcagtgcaagctaaattcggggattacaataaagaagtccacaagagcggatatttgtcgtccgagagattgatcccacagagggtcatggaccagcataagctgactcgtgaccagtgggaagatagaattcaggtttggcacgccgagcatcgaggaatgctgaaggataacgccatgctcgaatacttaaaaatcgctcaggacttggagatgtacggtatcaattacttcgagataaagaataagaagggaaccgatctatggctaggcgtcgacgctctcggacttaatatatacgagaaagacgacaagctgactccaaaaattgggttcccctggtccgagattcgtaacatctccttcaatgataagaaattcgtcataaagccaattgacaaaaaagccccagatttcgttttttatgccccaagattacgaatcaacaaacgaattctccagctttgtatgggcaaccacgagctttatatgcgcaggaggaaaccagatacaatcgaagtacagcagatgaaagcccaggcccgagaggagaaacaccagaagcagcttgaaagacagcaactggagaccgagaaaaagaggcgcgagacagtagagcgggaaaaggagcagatgatgcgggagaaggaggaactgatgttgcgtctacaagactatgaggaaaagactaagaaagcggagcgggaactgagcgaacagatccagcgggcactccaattggaggaggagagaaaacgtgctcaagaagaagcagagcgactggaggccgatagaatggccgcattacgggctaaggaagagctggaacgacaggcggtggaccagattaaatcccaggagcagctggccgctgaactggctgagtacacagccaaaatcgcactcctggaagaagctcgcaggagaaaggaggacgaggtggaggagtggcagcatagggctaaggaagcccaggatgatttggtgaagactaaagaggaacttcatctggtaatgacagctccacctccccctccacctcctgtgtacgaaccagtgtcctaccatgtccaagaatccctccaggatgaaggcgctgagccaactggctacagcgctgaattgtcctccgaaggcatacgcgacgaccgcaacgaagagaaacgcataaccgaggccgagaaaaacgaacgggttcagcggcagttacttacactgtcaagcgaactctcccaagcaagagatgagaataagcgcacccacaatgacattattcataatgaaaatatgagacaaggcagggacaagtacaaaacactgaggcagatccgccaaggcaatactaagcagaggatagatgaatttgaagccttatag

SEQ ID NO: 28607 - DNA, 1665 bp, Artificial Sequence
  Description of Artificial Sequence: Synthetic coding sequence
atgcctaaacccattaacgttcgggtgacgactatggatgccgaactggaattcgctatccagccaaataccacgggcaaacagttgttcgaccaggtttcggcccaggaagtgagaaaggaaaatccacttcagtttaaattcagagcaaagttctatcctgaagatgtggccgaagagctcattcaggacataacacagaagctgttcttcctgcaggtaaaggaaggaatcttatccgatgaaatctactgcccccctgaaacagctgtgctgctgggctcttacgctgttcaggctaaatttggggattataacaaagaggtgcacaaatccggatacctgagcagtgaaaggcttatcccccaaagggtgatggatcaacacaagttgacaagggatcaatgggaagatcgtatccaggtctggcacgccgaacatagggggatgcttaaagataatgccatgctggaatacctgaagatagctcaggacctagaaatgtacggcataaactactttgagattaaaaacaaaaaaggcaccgatctttggttgggagtcgatgccctaggactaaatatttacgaaaaggacgataagctgactcccaagattggcttcccttggagcgagattcggaatatctcttttaatgataaaaaatttgtgattaaaccaatcgacaaaaaagcccctgatttcgtgttctacgcacctcgcctgcgcatcaataagcgcattctgcagctctgtatggggaaccacgagctgtatatgagacggaggaaaccagatacaattgaagtgcagcagatgaaggctcaggctagagaagagaagcaccagaaacaactggaacgccagcaattggagaccgagaagaaacggagagagactgttgagcgcgagaaggagcaaatgatgcgggagaaagaagagctgatgctgaggctacaggactatgaagaaaaaacaaaaaaagcagaaagggagctgagcgagcagattcagagagcactccaactggaggaggagcgcaaacgcgcacaagaagaagccgagaggttagaagcagataggatggccgcactccgcgctaaggaagagctggaacgacaggctgtagaccagattaagtcccaggaacagctagctgctgaacttgctgagtataccgctaaaatcgctctcctggaagaggcacgacgcagaaaagaggacgaggtcgaagaatggcagcatagggccaaggaagcacaggatgatttagtcaagaccaaagaggagctgcatcttgtgatgactgccccacccccaccgcctcccccagtttacgaaccagtgagctatcatgtacaggaaagcctgcaagacgagggcgctgagccaactggttattctgctgagctctcctctgaaggcattagggacgaccgcaacgaagagaagcgaatcactgaagccgagaagaatgagagggtccagaggcagttgctgacactcagcagtgagctctctcaggccagggatgagaataagaggacacataatgatataattcacaacgagaatatgcgccagggcagagacaaatacaagaccctcagacagattcgtcagggcaataccaagcagagaatcgacgaattcgaggcactgtag

SEQ ID NO: 28608 - DNA, 900 bp, Artificial Sequence
  Description of Artificial Sequence: Synthetic coding sequence
atgggcaccaaggcacaggtggaaaggaaacttctgtgtctctttattttagccattctgctgtgctccctagctcttggctccgtgactgtccattcctcagagcctgaggtccggatcccagaaaacaaccctgtgaagctgtcttgcgcatattccggattctcatcgcctcgcgttgaatggaagttcgatcagggggacacgacacggctggtatgttacaataacaagatcactgcctcatatgaagaccgcgtgactttcctgcctactggtattacctttaagtctgtcaccagagaagacaccggaacttatacgtgcatggtttctgaggaaggaggaaactcctacggggaagtaaaggtcaagcttatcgtattggtgcccccaagcaagcccactgtcaatatcccatctagcgctacaattgggaatcgggctgtgctgacctgctctgaacaggacggcagcccccctagcgagtacacatggttcaaggatggtatcgttatgcctactaacccaaagagtactcgggcattctctaattccagttatgtgcttaatccgaccactggggagctggtcttcgaccccctgtccgcgagcgataccggtgagtactcgtgcgaagccaggaacggttatggcacacccatgacttcgaatgccgttcgcatggaagctgttgagcggaacgtgggggtgatcgtggcggctgtactggtaaccctgatactcttgggaatacttgtgttcggcatctggtttgcttactcccggggtcacttcgaccgcactaaaaagggtacctcttctaagaaggtcatctactcgcagcctagtgccagaagcgagggcgaatttaagcaaacaagcagctttctcgtatag

SEQ ID NO: 28609 - DNA, 900 bp, Artificial Sequence
  Description of Artificial Sequence: Synthetic coding sequence
atggggaccaaagcccaggttgagagaaagctgctctgccttttcatcctggccattcttctgtgctccctggcgctgggatcagtgacagtccatagttctgaaccagaggtgcgcatccctgagaataaccccgttaaactctcttgcgcctattcgggcttttcttccccacgggtggagtggaagttcgatcagggtgatacaactagacttgtatgctataacaataagatcaccgcttcttacgaagatcgcgtaacatttctacctactgggatcacattcaaatccgttacaagggaggatactggcacttatacatgtatggtgtccgaggaaggcggtaactcctacggtgaggtaaaggttaagctgattgtgctcgtaccaccatctaagccaactgtgaatatccctagcagcgccactatcgggaatagggctgtactcacctgctcagagcaggatggctcaccaccttctgagtacacatggtttaaagatggtatcgtgatgccaacaaatcctaaaagcacacgcgctttctctaattcctcctatgtgttaaaccccactactggtgaattggtgttcgatccgctgagtgcatctgacacaggggaatatagttgcgaagccaggaatggttatgggacccccatgacatccaacgccgtaagaatggaggctgttgagcgcaatgtgggagtcatcgtggcggctgttcttgtgacactgatcctgctcggtatactggtcttcgggatttggttcgcgtattcacgagggcacttcgataggactaaaaaggggacttcttcgaagaaagtgatatattcccagccttccgcaagatcagagggagaatttaaacaaactagttcatttttagtgtag

SEQ ID NO: 28610 - DNA, 900 bp, Artificial Sequence
  Description of Artificial Sequence: Synthetic coding sequence
atggggactaaagcccaagtagagcgtaagcttttgtgtctgttcatactggctatattgctgtgttcactagcgcttggatctgtgacagtccactctagtgaacctgaagtccgcattccagagaacaaccccgttaagctgagctgtgcttactccggattttcctcacccagagtcgagtggaaattcgaccagggcgatacaaccagactggtttgctacaacaataaaattaccgcctcctatgaagacagggtgacattcttgcccaccggaatcaccttcaagtccgtaactcgggaggacacgggtacgtacacttgcatggtcagcgaggagggtggaaattcttacggagaggtcaaagtcaagctgatcgtgttagtccctccttcaaagcctacagtaaacatccctagtagcgcaactatcggaaacagagcggtcttgacctgttcagagcaggatggctccccgccttccgagtacacatggtttaaggacggaatagtcatgcccaccaaccccaaatctaccagggcctttagcaattctagctatgtcctgaatcctactacaggtgaactagtcttcgatcctctctctgccagcgacacgggggaatacagttgcgaggctaggaacggctacggtacgcctatgacctccaatgccgtgcggatggaagccgtagagcgtaacgtgggagtgatcgtggcggcagttctggttacgctgatacttctgggcattctggtatttggcatctggtttgcttattcccgcggacattttgacagaacgaaaaaaggaacatccagcaaaaaggtaatctattcccagccgtcagcaagaagtgagggggagttcaagcagacaagcagctttctggtctag

SEQ ID NO: 28611 - DNA, 912 bp, Artificial Sequence
  Description of Artificial Sequence: Synthetic coding sequence
atgctgcaggcccctcgagggcgagctcgcgctgctctgaggagactagccgtggcaaccaggactatggcaggtggctcattggccctgggcagtgtgacggtgcattctagtgaaccagaggtcagaatcccagaaaacaatccagtgaaactgtcatgcgcttacagcgggtttagctctccgagggtggagtggaaattcgatcagggagacactacaaggttagtctgttacaacaataagattaccgcaagttacgaagatcgtgtgacttttctcccaacggggataactttcaaaagcgtcaccagggaggataccggcacctatacctgtatggttagtgaggaggggggaaatagctacggcgaggtaaaagtgaaattaattgttctagtacccccttcgaagcccacagtcaacatccccagctctgctaccattggcaatcgggcagttttgacttgtagcgagcaggatggatccccccctagtgagtacacatggttcaaagacggaatcgtgatgcctacgaaccccaagtccactcgggctttctcaaacagctcctatgtactgaatcccactaccggtgaacttgtgtttgaccccttatccgcttccgataccggggagtacagttgtgaagctcgaaatggctacggaactccaatgacctctaacgccgtgcgcatggaggcggtggaaagaaatgtcggtgtaatagtagcagctgtgctggtcaccctcattctgcttggaatccttgttttcggcatttggtttgcttacagtcgtggtcacttcgaccggactaagaaagggacttcttctaaaaaagttatatattcccagccatccgcacgatcagagggggagtttaaacagacctcatccttcctggtctag

SEQ ID NO: 28612 - DNA, 753 bp, Artificial Sequence
  Description of Artificial Sequence: Synthetic coding sequence
atggggaccaaggcgcaagtggaaagaaagctgctgtgcctgttcattctcgccatactgctatgttccctggccctgggctcagtgacagtccatagcagtgagcccgaggtgcgaattcccgaaaataatcccgtgaagctgtcctgtgcctactctggcttttcttctccgagagttgagtggaagttcgaccaaggcgatacaacgaggttagtgtgctacaacaacaagattaccgtccccccatcaaagccgacagtgaacattccctcctccgctacaataggtaaccgggctgtgcttacctgcagcgaacaggacggaagtcccccttcggaatacacctggtttaaggatggtatcgtcatgccaaccaacccaaagtctacgcgagccttttctaactcctcatacgtgctcaatccaacgacgggagaacttgtcttcgatccactgagcgcctctgacacaggagaatatagctgtgaggctcgtaatggttacggtactccaatgacaagtaatgcggtcaggatggaagctgtggagcgcaacgtgggagtcatcgtggccgctgttttggtaacgctgattctcctgggcatcctcgtttttggcatttggttcgcttatagccggggacactttgaccgtacaaagaagggtacctcttctaaaaaagtgatctattcacagccttccgccagatcagagggcgagttcaagcaaacctccagtttcctcgtgtag

SEQ ID NO: 28613 - DNA, 3357 bp, Artificial Sequence
  Description of Artificial Sequence: Synthetic coding sequence
atgggcgtgcagggattccaagattacatcgaaaaacattgtccttccgctgtagtgcctgtcgagctgcagaaactggctcgaggatctctggtgggcggtggaaggcagaggccccctcaaacgcccctccgactactcgtggatgctgataactgtttgcatcggctgtacggaggcttttacactgattgggtgagcggcggacagtggaatcacatgttaggctacttagctgccctggcaaaggcctgttttggcggaaatattgagctgttcgtcttctttaacggggctctagaaaaggcaaggttgcatgaatgggtgaagcgccaaggcaacgaacgacagacagcccagcagatcgtgtcgcatgttcagaataaagggacgcccccacctaaagtttggttcctcccacccgtttgcatggcacactgcatcagacttgcgctcatacgatttcacgtgaaggtggctcaatcaattgaggaccatcaccaggaagtaatcggattctgtagagagaacggattccacggccttgtggcatacgactccgactacgctctgtgtaacattccctactatttctctgcacacgcgcttaagctctctcgaaacggaaagagtctgactactagccagtatctgatgcacgaggtggccaaacaattagatctcaatccaaacagattcccaatattcgccgctttgcttgggaaccatatcctccccgacgaggacctggcctcatttcattggagtctgctaggcccagagcaccctctggccagcctgaaggtgcgggcacatcagctggtcctgcctccatgtgatgtggtaattaaggcagtggctgattacgttaggaatatccaggataccagcgatctggacgccattgcaaaagatgtgttccagcactcccagagtagaactgacgacaaggtgatccgctttaagcgcgctatcggttactacagcgctacctccaaacccatgtctttccatccaccccactacttagccgcacgaccgggacctttcggaatgcccggtatggttcctccccacgttccaccccagatgttaaatataccccagacatcccttcaggccaaacccgtcgcacctcaagttcctagccccggaggggctccagggcagggcccatacccctacagcctctccgagccagcacccctaacattggatactagcggaaagaatttgaccgaacagaactcatatagcaatatcccccacgagggaaaacataccccactctatgaacgctcctcaccaattaatcctgcccagtctggaagcccgaatcacgtagactccgcatactttcccggatcctcaactagtagctccagcgataacgacgaggggtccggcggagcaaccaaccacatcagcgggaacaagattggctgggagaaaaccggctctcactctgaaccccaggctcggggagaccctggcgatcaaactaaggcggaggggagcagcactgcttcatccggcagtcaattggccgaaggcaagggcagtcagatgggaaccgtccaaccgatcccctgcctcttgagcatgccaacgcggaatcatatggatatcacgactcctccactccccccagtagcccctgaggttctccgtgtagcagaacatcggcacaagaaggggcttatgtacccctacatctttcatgtactgactaaaggagaaatcaagatcgccgtgtccatagaggacgaggcgaacaaggatctcccacccgctgccctcctctatcgcccagtccgacagtatgtgtacggtgtccttttttcactggccgagtcacgcaaaaagactgagaggctcgcatttcggaaaaataggctgcctcccgagttttcccctgtcataatcaaagagtgggcagcttacaagggaaagagtcctcagacccccgagttggtggaagcccttgcattccgtgagtggacatgccccaacctgaaacgcttatggctcggaaaggccgtggaggataagaatcggagaatgagggctttccttgcatgcatgaggtctgacacacccgcaatgcttaacccggctaatgtgcccacccacctgatggtcctgtgctgtgtcctaaggtatatggtccagtggccaggcgctagaattctgaggagacaagaactggatgccttcctagcacaggcacttagccccaagctatatgagcccgatcagcttcaggagttgaaaattgaaaacctcgatcctagaggcatccagctcagcgcactcttcatgtccggcgttgacatggccttatttgccaacgatgcctgtggacaaccgattccgtgggagcattgctgcccctggatgtattttgacgggaagctgtttcagagcaagctgcttaaagcaagtagagagaaaaccccgctgatcgacctgtgcgacggacaggccgatcaggcggctaaagtggaaaagatgcggcagagcgtcctcgaagggctttccttttctagacagtcccacaccctgccattccctccacccccagcccttccattttatccagcaagtgcttacccccgacatttcggtcctgtccctccaagccaaggccgaggcagagggttcgccggagtctgtgggttcggagggccatacggcgaaactgtggcaaccgggccatatagagcttttcgtgtggcagccgctagtggccactgcggcgctttctcaggtagcgatagtagccgaacatcaaagtcgcaggggggagtgcagcccatcccatcacaaggagggaaactcgagattgctggcacggtggtgggtcactgggcagggtccaggaggggcaggggaggcagaggacctttcccacttcaggtggttagtgtgggtggacccgcacgcggtaggccaagaggagtgatctctaccccagtgattcggaccttcggtagaggagggagatactacggtcggggatataagaaccaggctgccatacaaggaaggcccccttacgccgcttccgcggaagaggtggcaaaagaactcaaaagtaagtctggtgagtcaaaatcctcagccatgagcagtgacggaagtctggcagaaaatggcgtcatggccgaagagaaacccgcaccacaaatgaacgggtccaccggcgacgctagggccccatctcactctgagtctgctttgaacaacgattcaaaaacatgtaatactaaccctcacctgaatgctttatcaaccgatagcgcatgtagaagggaggctgcactggaggctgccgtgctaaacaaagaggaatag

SEQ ID NO: 28614 - DNA, 3441 bp, Artificial Sequence
  Description of Artificial Sequence: Synthetic coding sequence
atgggggtgcaaggattccaggactatatcgagaaacactgcccttcagcagttgtacccgtcgagctacagaaactggctcgaggatctctcgtcggcggtggaaggcaaaggccccctcaaacgcccttaaggcttctggtggatgccgacaactgcctccataggttgtatgggggattttacactgactgggtgtcgggcggtcagtggaaccacatgctgggttatctggccgcattagctaaggcgtgctttggtggtaacatcgagctctttgtgtttttcaacggcgctctggaaaaggcacggttgcacgagtgggtgaagcgccaggggaacgagaggcaaaccgctcagcagattgtctcacatgttcaaaacaagggcacaccaccccctaaagtttggtttcttccaccagtgtgcatggcacactgcatccgtctagccctgattagattccacgtaaaggtggcccagtctatcgaggaccatcaccaggaagttattggattttgcagggagaacggctttcacgggctggtcgcttatgactccgactacgctctatgtaatatcccctactactttagcgctcacgctctgaaactctctcggaacggaaagtccctgacaacatcccagtacctcatgcacgaagtggcgaagcagctggatctcaatcccaacaggttccccatctttgcggctttattaggcaaccacattcttcccgatgaggaccttgccagctttcactggagtctgctgggacctgagcatcccttagccagccttaaggttcgtgcacatcagctggtgcttcctccctgcgacgtggtgataaaggccgtggccgactatgtgcgcaatattcaggatacttccgacttagatgccattgccaaagatgttttccaacactctcagagtagaaccgacgacaaagtcatccgctttaagcgagccatagggtactatagcgccacaagtaagcctatgtcattccatcccccacactatcttgcagcacgccctggccctttcggcatgccgggtatggttcctccacacgtacctcctcagatgctgaacatcccccagacaagtctccaggctaagcctgtcgccccacaggttccgtcccccggaggggctcctggtcagggaccatacccctactccctctcagagcctgcccctctaacactggacacgtccggcaagaatttgacggaacagaattcatacagcaatatcccgcacgagggcaaacatacgcccctttacgagagaagttctcctattaatccggctcagagtggctcacccaaccacgtcgacagcgcatatttcccaggttcctctacttcctccagtagtgacaatgatgagggatcgggcggtgccacgaagccatttcaactataccttcagaaaaacttcgtgtttcacaaggagaacagcattgtgctgtgttcaaggattttacgacatgggcatatctctggaaacaaaatagggtgggagaagaccgggtcccacagcgaaccccaagcgaggggcgatccaggagatcagaccaaggccgaaggctcctccactgcttcctcaggcagccagcttgcggaaggcaaaggcagccaaatgggcacagtacagccgattccctgcctcctgtccatgcccactagaaaccatatggatataactacgcccccacttccaccagttgccccagaggtgctgcgagtagccgagcatagacacaaaaaagggctgatgtatccctatatctttcacgttctgacaaagggggaaatcaaaatagcggtatccatagaggacgaagcaaacaaggatctgcctcccgctgctctcttgtatcggcctgtgagacagtacgtgtacggcgtgctcttctcactggccgagtcgagaaagaagaccgagcggcttgcttttcgaaagaatagactgccacctgaattttcacccgttatcattaaggagtgggcagcttacaaaggaaagtccccccaaacacccgaactggttgaagcactggcctttcgggaatggacctgtccaaacctaaaaaggttatggttgggcaaggcggtcgaggacaagaacaggcgcatgcgtgcattccttgcatgtatgcgcagcgacacacctgctatgctgaatcccgcaaatgtgcctacccatctgatggtgctttgctgcgtgcttcgatatatggtgcagtggccaggggctcgcattctgagacggcaggagctagatgcctttctcgcccaagctctttctccaaaactatacgaacctgatcaactgcaggagctgaagatcgaaaacctggatccacgcggaatccaactgtctgccctgttcatgagtggggttgatatggcgttgtttgccaacgatgcctgcggtcaacccattccctgggaacactgctgtccctggatgtactttgatggcaaactgttccagtccaagctcctgaaggcgagtcgagagaaaaccccccttatagatctatgtgatggccaggctgatcaggcagccaaggtggagaagatgcgacagtctgtgctcgaaggcttatccttctcgaggcagtcacacaccctcccattcccaccccctcctgcgctgcctttctaccctgctagtgcatacccaagacactttggccctgtgcctccctctcagggaagggggaggggcttcgcaggagtgtgtggcttcggcggaccatatggcgagactgttgccaccggcccatatcgggcttttagagtcgcagccgcttctgggcactgcggggcttttagcggttccgactcctctaggacatcaaaatcccagggaggtgttcagcccatcccctctcaggggggaaagcttgaaatcgccggtacagtggtgggccactgggccggatccaggagggggaggggcggacgagggccttttccacttcaggtggtgagcgtaggcggtcctgccagagggagacccaggggcgttatttcaacccctgtgatcaggacttttggccgtgggggacgttattatggtcgaggctataaaaaccaggcagccatccagggaaggcctccctatgctgcaagtgccgaagaagtggctaaagagctgaagtccaaatcgggggaaagcaagtcatccgctatgtcgagtgacgggtcacttgccgagaacggcgtgatggcagaggagaaaccagccccacagatgaatgggtcaaccggagatgcgagggcgccaagccactccgagtcagccctcaataatgacagcaagacatgtaataccaacccgcacctcaatgcgctgtccaccgattctgcctgccgaagggaagccgcattagaagccgcagtgctgaataaggaggagtag

SEQ ID NO: 28615 - DNA, 3219 bp, Artificial Sequence
  Description of Artificial Sequence: Synthetic coding sequence
atgggggtccagggctttcaggactacattgagaagcactgtccctcagccgtggtgccagttgagctgcaaaagttggcacggggatctctggtcggtggcggaaggcaacggccacctcaaacccctctgcgcttgcttgttgacgctgacaattgccttcaccgcctgtatggtggattttacactgactgggtcagtgggggtcaatggaaccacatgctcgggtatctggctgccttagcaaaagcttgctttgggggtaatatcgaactcttcgtcttctttaacggagcactggagaaagcaaggcttcatgaatgggtcaaaaggcagggtaacgaacgccagaccgcccagcaaatcgtgtctcacgtacagaataaagggaccccaccgcctaaggtgtggtttctgcctcccgtttgtatggctcactgcattcgattagcacttatccgctttcacgttaaagttgcacaaagcatcgaggaccaccatcaggaagtgataggattctgtagagaaaacggctttcatggcctagtggcttacgattcagattatgcgttgtgcaatatcccctactattttagcgctcatgccctgaagctctcacgaaacgggaagtctctgacaaccagccaatatctcatgcacgaggtagcgaaacagctggatcttaaccccaatcggtttcccatttttgctgccctgctgggtaaccacatcctacctgacgaagatttagcttcattccactggagtttactcgggcctgagcatcccctggctagcctcaaagtgcgcgctcaccaactggtcttacctccatgtgacgtcgttatcaaagcagtggcggattacgtgcgcaacatacaggatacttcagacctggacgctatcgctaaagacgtgttccagcactcccaaagtagaacggatgacaaggttatcagattcaagcgggctattggctactatagtgctaccagtaaacccatgtcctttcatcctccccactatctagctgcccgacccggaccattcggcatgccgggaatggtgcctccccatgtcccgcctcagatgctgaatattcctcagacctctctccaagctaagccagtagctccccaggtgccaagtcccggaggcgctccagggcaggggccatacccgtattccctgtctgagccggcaccccttactcttgacacgtcagggaaaaacctaaccgagcagaacagctactccaacatcccccatgaaggtaaacacacgccgctttatgagagaagctctccaataaaccccgctcagagtggtagccccaatcatgttgactctgcttacttcccgggttcttcaacctcatcaagtagtgacaatgacgagggatctggcggagccacaaaccatatctccggaaacaaaattgggtgggagaaaacgggatcacactcagagccacaggctcgcggtgatccaggtgatcagactaaagccgaggggagtagcaccgccagctcaggctcgcagctcgctgaagggaaaggctctcagatgggaactgttcaacctataccctgcctactcagtatgccgacgcgaaatcatatggatataacaactcctccgctgcctcctgtggcccctgaggtccttcgggtggccgagcaccggcacaagaagggcctcatgtacccgtacattttccatgtgctgacgaagggtgagataaaaatcgcggtgtctatagaagacgaggccaacaaggaccttcctccagcagcactcctatatcgtcccgtccgccaatatgtttatggagtgttgttctctcttgccgagagccggaaaaaaacggaacgtcttgcttttcggaagaatagattacctcccgaattttcccccgtcatcatcaaagagtgggctgcttataaggggaaaagtccacaaacccccgagctcgttgaagccctggctttccgggagtggacctgtccaaacctaaaaagactttggctgggtaaggcggtggaggacaaaaacaggcggatgagggccttcctcgcatgcatgagatccgacacccccgctatgttgaaccctgccaacgtgcccacgcacctaatggtgctctgctgcgttctgcgatatatggtgcagtggcctggggctaggatcttgaggcggcaagagctggacgccttccttgcgcaggcactgagcccaaagctttacgaacccgatcaactgcaggaactcaagatagagaatcttgacccacggggtattcagttatcagcactgtttatgtccggcgtggatatggccctgtttgcaaacgacgcctgcggccagcccatcccttgggaacactgttgtccttggatgtatttcgatggcaagctgttccagtccaaattgcttaaagcatcgcgcgagaagactccgttgatcgatctctgcgacggtcaagccgaccaggccgcaaaagtcgagaaaatgagacagagcgtcctggaaggcctgtctttctcccggcaatcccatactctgcctttccccccaccacccgctcttccgttttaccccgcatccgcttaccctaggcacttcggccctgtcccccctagccagggaagaggtcggggttttgccggtgtgcagcctatcccatcgcaggggggaaagcttgagattgccggtaccgtcgtgggccattgggctggctcaagaagaggtaggggtggacgaggacccttccctttgcaggtagtttcagtagggggacccgctagagggagaccacgcggagtgatatcgacaccagtcatccggacatttgggcgtggcggacgttactacggccgtggatataaaaaccaggccgctatccaagggaggcctccctatgccgcttcagctgaggaagtagcaaaagaattgaagagcaagagcggggaaagtaaatcatcggcaatgagctccgacggcagtctggccgaaaacggggtaatggcggaggagaagccagctcctcaaatgaatggttccacaggggacgcgcgagccccttcccacagtgagagtgcgctgaacaatgattccaagacatgtaacacaaatcctcacctcaacgctctctctaccgattcagcctgcaggcgagaggcagctctggaagcagccgtgttgaacaaggaggaatag

SEQ ID NO: 28616 - DNA, 1887 bp, Artificial Sequence
  Description of Artificial Sequence: Synthetic coding sequence
atgggagtccaaggctttcaggactacatcgaaaagcactgcccgagtgcggtcgttccagtggaacttcagaagctggctaggggatctctcgtgggcggaggacgacagagaccaccacagaccccactcaggctacttgtcgacgctgacaattgcctccatcgcctctatgggggattctacaccgactgggtatcagggggacagtggaatcatatgctgggctatttggcagcccttgccaaagcatgttttggcggtaatattgagctttttgtgttttttaacggcgctctagaaaaggccagactgcacgagtgggttaaacgccaaggaaatgagcgacaaactgcccaacaaattgtatctcacgttcagaacaaaggcactcctccccctaaagtgtggtttctgccccctgtttgcatggcccattgtatcagactggccttaatcagatttcacgttaaggttgctcaatctatcgaagatcaccaccaagaggttattggcttttgccgtgaaaacggtttccacgggctcgtagcatacgattccgattacgctctctgcaatatcccatattacttctccgcccatgccctcaagctgtcccggaatggtaaatctctcacaacctcgcagtatctcatgcatgaagtggcgaaacagttagatctgaacccaaatagattccccatcttcgcagccctgctgggtaaccacatcctcccagacgaggatttagccagctttcactggtcattgctgggcccagaacaccccctcgccagcctgaaagtgcgcgctcaccaactggtgctgccaccttgtgacgtggtcataaaggccgtggccgactacgtgcgcaatatacaggataccagtgaccttgatgcaattgccaaagatgtgtttcagcattctcagagcaggacagacgataaggtgatcaggtttaaaagagctatcggttattactctgccaccagcaagccaatgagcttccaccctcctcattatctggccgctcggcctggtccattcggaatgcctgggatggtgcctccccacgtccctccacaaatgctaaatataccacagacctccttacaggctaagcctgtggccccacaggttccatctcctggaggggcacccggacaaggcccatacccctattcccttagcgaacctgctcccctgactctcgatacttccggaaagaatctgaccgagcagaactcttacagtaatataccccacgagggcaaacataccccactgtacgagagatccagccctattaatcccgctcagtctggtagtccaaatcacgttgatagtgcttattttcctggttcaagcacctctagttcctctgacaatgacgaaggaagcgggggagctaccaatcacatcagcggaaataagatagggtgggaaaaaactggaagtcactcagagccccaggctcgaggggaccccggagaccagactaaggccgaaggctcgtccacggccagcagcgggtctcaactggcggagggtaaaggtagccagatgggaaccgtccagcctatcccctgtcttttaagtatgcctacccgtaaccacatggatataacaactcctcctctgccccctgtggcccctgaagtgctgagggtggccgaacatcgtcacaaaaagggcctcatgtacccctatatcttccacgtcttaaccaaggtcctgtcgaaaggcccatggagcggattctgctaccttatgagtggacacagttatgggtgttttgttttgctgagcttcttcgagccattcttctgtcttacaaatctcctcgagacaaagtttacattcccttttttaaatattgagtag

SEQ ID NO: 28617 - DNA, 1485 bp, Artificial Sequence
  Description of Artificial Sequence: Synthetic coding sequence
ggcgagataaaaatagccgtctcaattgaggacgaagcaaataaggatctgcccccagctgctttattatatcggccagtccgccagtacgtgtacggagtcctgtttagcctcgccgagtcacggaagaaaactgaaagactcgccttcaggaagaaccgactaccaccagagttttctcccgtcatcatcaaagagtgggccgcatacaaaggcaaatcgccacaaacccctgaacttgtggaggcactcgccttccgagaatggacttgtccaaacttgaaaagactgtggttgggaaaggcggtcgaggataaaaacaggcgcatgagagcgtttctggcctgtatgcgcagtgacaccccagccatgcttaacccagctaacgttccaacgcatctgatggttctctgctgcgtcctgcgctatatggtgcagtggccgggagccaggatcctgagaagacaggaactagacgcctttttggcacaggccctgagcccaaagctttacgagccagaccagttgcaggagttaaagattgaaaatctcgaccccaggggcattcagctaagtgctttattcatgagcggggtggatatggctttgtttgccaacgacgcctgcgggcagcccatcccatgggagcactgttgtccctggatgtacttcgacggtaaactcttccagtctaagctgctgaaggctagccgggagaaaacacccttgattgacctatgtgacggacaggccgaccaggccgcaaaggtggagaaaatgaggcaatcagtgctggagggactgtcgttttctcggcagtcgcacaccctgccgttcccgcctcctcccgcacttcccttttacccagcttccgcctatccacgtcatttcggcccagtgccaccctcccaggggcgaggcaggggtttcgccggtgtccagccgatcccatcccaaggtggaaaactcgaaattgccggaacagtggttgggcactgggctggcagtcgaagaggcaggggtggcagagggccatttcctttacaagtggtgtcggtaggtggcccagcacgcggaaggccacgaggagttatctcgactccggtaataagaaccttcggcagggggggacgatactatggtcggggatataagaaccaggctgccatccaagggaggcctccttacgctgcctccgcggaagaggtggcaaaggagctcaagtccaaatccggtgaatctaagtcaagtgccatgagctcagatgggtccctcgcagaaaacggcgtgatggccgaagagaaaccagctccccaaatgaacgggtctacaggtgacgcccgtgcaccaagccattccgagtctgcattaaacaacgatagcaaaacttgtaacacaaatccgcacctgaacgccctctctactgatagcgcttgtcgaagggaagcagctttggaggccgcagtgcttaacaaagaggagtag

SEQ ID NO: 28618 - DNA, 1485 bp, Artificial Sequence
  Description of Artificial Sequence: Synthetic coding sequence
taggtggcacagtcaatcgaggaccatcatcaagaagtaattgggttttgcagagagaacggctttcatgggctcgttgcgtatgattccgactacgcactttgcaacattccctactactttagcgctcacgccctcaaactatccagaaatggaaaatccttgacaaccagtcaatacttgatgcacgaagttgccaagcagctcgacctaaatcctaatagattccctatctttgcggcactgctggggaaccatattctgccagatgaggatctcgcttcattccactggtctctgcttggccctgaacaccccttggctagtttgaaggtcagagcgcatcagctggttctgccgccatgtgacgtcgtgatcaaggcagttgcggactacgttcgcaacattcaggacacctctgatctagacgcaattgccaaagacgtttttcagcattcacagagtcgcacagatgacaaagtcatcaggttcaaaagggccattgggtactattcagccaccagtaaaccaatgagtttccacccccctcattaccttgccgcacggcctggccctttcgggatgcccggtatggtcccccctcacgtgccgcctcagatgctcaacataccccagactagtctccaagccaaacctgtcgcccctcaggtaccttcgcccggaggagcgcctgggcaaggaccttatccatactctttatccgagcctgctccgctgacattagacacttcgggcaagaatcttactgaacaaaattcctactccaacattccacacgaaggcaagcacaccccattgtatgagcgaagctcaccaatcaatcccgcacagtctggatcccccaaccacgtggactcagcatactttccgggttccagcacaagcagctcgtctgacaatgacgaagggagtggcggagcaaccaatcacatcagtggtaacaaaatcggctgggaaaaaaccggcagccatagcgagccccaggcccgaggagatcccggagatcagactaaggctgagggttcgagtactgcatctagcggttctcagcttgcggagggtaagggcagccaaatgggcactgtgcaacccataccctgcttactctctatgccaacccgtaaccatatggacatcactacgcctccactccccccagtggcccctgaagtgctgcgggtggccgaacataggcacaagaaaggactgatgtacccatacatcttccacgtcttgaccaaaggtgagatcaagatagcagtgtcaatcgaagatgaagccaacaaagacctcccgcctgcagcactcctgtaccgacctgtgaggcagtatgtgtatggtgtgctgtttagtctagctgagagtcgaaaaaagacggagcggctggcctttcgtaaaaaccgcctgccaccagaatgcatgtactgcaataacccgctgttcgtctttctcggcacttcatag

SEQ ID NO: 28619 - DNA, 969 bp, Artificial Sequence
  Description of Artificial Sequence: Synthetic coding sequence
atggtggccgacttggagctgcagcaggacctgatcgttcccctgggccatactcccagtcaggagcattttcttttcgagatctttagacggaggctacaagccctgacatccggctggtcagtagcggcttccctccagcgacagagggaactcctgatgtataagcgaattctgctgaggctgccttcaagcgtcctgtgtggaagcagttttcaggcggagcagcccattacggcacgatgtgagcagttttttcatctcgtgaattctgaaatgcgcaatttctgcagtcatggaggggcacttacccaagatattacagcgcactttttccggggtttgttaaatgcctgtctccgcagcagagacccaagcctgatggttgacttcatcttggccaaatgtcaaaccaagtgccctctgatcttgacatccgcactggtgtggtggccttctctggaacccgtgctgctatgcaggtggcgccgtcactgccaatctcccctgcctcgtgagctccagaaactacaagaggggcgtcagtttgcatcagattttctctcccccgaggccgctagtccagcccctaaccccgactggttgtctgcagcagccctccatttcgcaatacagcaggttagggaggaaaatatccgcaagcagttgaagaaattggactgtgaaagagaggagctgctcgtcttcctctttttttttagccttatgggactacttagcagccacctgacgtccaatagtaccaccgacttaccaaaggcatttcacgtttgcgcggctatcttggagtgcctggaaaagcggaagatatcatggctcgccctgttccagttaaccgagagcggcaagaagcacgccgctgaggcccagatgcgacgcgcagctctattcaggggtatcctgcagatggtgaagaacgagccatccctgcgcttcctggcaaagtag

SEQ ID NO: 28620 - DNA, 4368 bp, Artificial Sequence
  Description of Artificial Sequence: Synthetic coding sequence
atgtcagacagctgggtgccaaattcagcgtcaggtcaggatccagggggacgcaggcgggcatgggccgagctcttagccggtagagtaaaaagggaaaagtacaaccctgaaagggcccaaaagctgaaggagtccgcagttcgtctgttacggtctcaccaagacctcaacgccttacttctggaagtggaaggcccactgtgtaagaagctttctttgtccaaggtgattgactgcgactctagtgaggcctacgctaaccacagctcatcgttcattggatctgcactacaggaccaggcttccagattgggtgtaccagttgggattttatccgcgggaatggtggctagctcagtgggccagatttgcacagcacctgccgagacgtcccaccctgtgctccttactgtcgagcagcggaagaagctctcctccttgttggagtttgcccagtacctgctcgcccatagcatgttttcaagactctccttttgtcaggaactgtggaagatccagtctagtcttcttttggaggctgtatggcatttacacgtgcagggtatcgtgtcactccaggaactactggagagccatcctgatatgcatgcagtagggagctggctattccggaacctgtgctgcctatgcgagcagatggaagccagctgtcagcatgcagatgtcgctagagccatgctcagcgacttcgtacagatgttcgtgctccgaggctttcagaagaatagtgatctcagacgcactgtcgagcccgagaagatgcctcaggttaccgttgatgtcctccagcgcatgctgatatttgctctggacgccctagcggctggcgttcaggaagagtctagtactcataagatcgtccgatgctggttcggtgtgtttagcggacacactctggggtcagtaatctctaccgatcctttaaagcgcttcttcagccataccctcacacagatcttgacccatagtcctgtgctgaaggcgtctgatgccgtccaaatgcagagggagtggagtttcgcccgaacgcaccccctgctaaccagcctataccgcagactgttcgttatgctgagcgcagaggagttggtgggccacctccaggaggtgctggagacacaggaggtgcattggcagagggtgcttagttttgtgtctgccctggtggtctgcttcccggaagctcagcagctgctggaagattgggtcgcccgtctcatggcccaggccttcgagagctgtcagctggatagcatggtgaccgccttcctggtggtgcgtcaggcagctcttgaagggccttccgccttcttatcctacgctgactggttcaaagccagtttcggtagcacacgcggataccacggatgtagcaaaaaggcattggttttcttattcacattcctgtctgaattggtgccttttgagagcccaagatatttgcaggtgcatattctgcaccctcccttggtccctggtaagtaccgaagtttattaactgattatattagtctagccaagacccgcctggcggacctcaaagtttcaatcgaaaacatgggcctgtacgaggatctgtcatccgccggagacatcaccgagccccactctcaggcactgcaggacgtcgaaaaagctatcatggtatttgagcataccgggaatatccctgtgactgtcatggaggccagcatattccgaaggccttactacgttagccactttcttccggctctcctgactcccagggtgctgcccaaggtacctgatagcagggtggccttcatcgaatcacttaagcgcgctgacaagatcccaccaagtttatactctacttattgtcaggcttgctctgccgcagaggaaaagcccgaggacgctgcccttggcgtaagagcagagcctaacagcgcagaagaacccctgggtcaacttactgcagcactgggggagctacgagcatctatgaccgatccgtctcaaagagacgtgatctctgctcaggtggccgtgatctctgagcggctgcgagccgtgctcgggcacaatgaagatgactcatctgtggagatcagcaagattcagctgtcaatcaacaccccgcgactggagcccagagagcacatggccgtcgatttattgctgaccagcttctgtcaaaacttgatggccgcaagctcggtggctccgccagaaaggcaggggccttgggcagccctcttcgtgcggactatgtgtggacgggttttgcctgcagtgttgactcgcctgtgtcagctcttacgtcaccagggaccatccctgagcgcccctcatgtattagggctcgctgcattggccgtccacctgggcgagtcacggtctgcgctacctgaagtcgacgtgggaccacccgcacccggagctggactcccagtgccggcactgttcgatagcctcctcacttgccgcaccagagactccctgtttttttgtttgaagttctgcaccgcggctatctcatatagtctgtgtaagtttagttcacagagccgagacaccttgtgtagctgcttgagccctggattaatcaaaaaatttcaatttctgatgttcagactgttttctgaagccaggcagcccctctcagaggaggatgtggcatccctgtcttggcgcccacttcacctgccctcagctgattggcaaagagctgccctgtccctctggacacacaggacttttcgcgaggtgctgaaggaggaggatgtacacctgacttaccaggactggctccatcttgaactggagatccagcctgaggccgatgcactaagcgacaccgagaggcaggacttccaccagtgggccattcatgagcactttttacctgagagctctgcttcaggaggctgtgatggagatctccaggccgcttgcaccatcctggtgaacgccctgatggattttcaccaatccagcagaagttacgaccactctgaaaactctgacctggtttttggcggaaggacaggtaacgaagatattatctcgagactgcaggaaatggttgcggacctagaactccaacaggatctcattgtacccctcgggcacaccccgagccaggagcacttcctgtttgagatttttcggaggcggctgcaagccctgaccagtggctggagcgtggcagcaagtctacaaaggcagcgtgaactccttatgtacaagcggatcctcttgcggttaccatcttccgttctgtgtgggtcgtctttccaggcagaacagcctattaccgcacggtgcgaacagttttttcacctcgtgaacagcgagatgagaaatttttgttctcacggcggagccctaacgcaggatatcactgctcattttttcagaggtctgcttaatgcctgccttaggagtcgcgatcctagtcttatggtcgattttatcctcgcgaaatgtcagactaagtgccctttgattctgacttctgctttagtctggtggcccagtctcgaaccagtgctgctctgtagatggagacgtcattgtcagtcgccccttccgagagagctccagaagctgcaggaaggcaggcaatttgctagcgacttcctcagcccagaagctgccagtcccgcacccaatccagactggctctccgcggcagcactccatttcgctattcagcaagtacgtgaagaaaatatcagaaaacagcttaagaagttagactgcgagcgtgaggaattgctggtctttctgttcttctttagcctcatggggctgctctcatctcatcttacttcaaattcaactaccgacttgcccaaggcattccacgtctgcgctgctattcttgaatgcttggaaaagcgaaaaatcagttggctggccctgttccaattaacggaatcagacctgaggctgggcaggcttttgttgcgggtagcgccagatcaacataccaggctgctccctttcgcattttacagccttctcagttacttccatgaagacgccgcaataagggaggaggcgttcttgcacgttgccgttgatatgtacctgaagctggtgcagctgttcgtagccggtgatacctctaccgtaagccctccagctgggcgaagtcttgagttgaagggccagggaaacccagtcgagctcataactaaagccaggctgtttctgctgcagttgatcccaaggtgtccaaagaagtcgttttcccacgttgctgagctcctcgcagatcgcggagactgtgaccccgaggtctccgcagcccttcagagcagacagcaggccgcaccagacgctgatctgtcgcaggagccccacctattttag

SEQ ID NO: 28621 - DNA, 894 bp, Artificial Sequence
  Description of Artificial Sequence: Synthetic coding sequence
atgagcgatagttgggtgccaaactcagctagcggtcaggatccgggaggacgcaggagggcctgggcagagctgctggcgggtcgtgtgaaacgggagaagtacaaccccgagagagcccagaagcttaaagagtcggccgttcggctccttcggtctcaccaggacctgaatgccctgcttctcgaggttgaaggcccactgtgtaagaaactgagtctgtctaaagtgatagattgcgattcgtccgaagcctatgcaaaccactccagcagcttcatcggaagcgctctgcaagatcaggcaagtcgccttggcgtacctgtgggaattctaagtgctggcatggtggctagttccgttggccagatatgtaccgcgcctgctgaaactagccaccccgtgctgctgacagtcgagcagcgaaaaaagctgagctctctcctggaattcgcccagtacctgcttgcccatagtatgttttctaggctgtccttttgccaagaactgtggaagatccagtccagcctgctgctagaggcagtgtggcaccttcatgtgcagggcattgtttcccttcaggagttgcttgaatcacaccctgacatgcacgccgtgggtagctggctgtttaggaatctgtgctgcctctgtgaacagatggaggcttcatgccagcatgctgacgtggctagagctatgttgtcagacttcgttcagatgttcgttctacgtggcttccagaaaaactccgacctacggagaactgtagagcccgaaaaaatgccccaggtaactgtggatgtgctccagcggatgctcatcttcgccctcgacgccctggccgctggcgtacaggaagaaagcagtacacacaaaatcgtaaggtgctag

SEQ ID NO: 28622 - DNA, 909 bp, Artificial Sequence
  Description of Artificial Sequence: Synthetic coding sequence
atgagcgatagctgggttccgaacagtgcctctggtcaagaccccggaggtagaaggcgcgcttgggcagaactcctggccggtagagtgaagagagaaaagtataacccagagcgcgctcagaaactgaaagagtcagccgtgagattactgcggtctcaccaggatctaaacgctctcctcctggaagtggagggtccgctgtgcaaaaagctttctctttctaaagtgatcgattgcgattcttcagaggcatatgcaaaccacagcagctcctttatagggtctgccttacaagatcaggctagcaggttgggtgttccagtgggcatcctgagcgcgggtatggttgcatcctcagtgggacaaatttgtactgctcctgccgagaccagtcatcctgttttgcttactgttgagcaaagaaagaaactgtccagtctccttgagtttgcacagtatctcttagcccacagcatgttttctcgtctatcattctgccaggagttgtggaagatacagtcgtccctgttgctggaagcggtatggcacttacatgtgcaaggaattgtgtccctgcaggaactgctagagtcacatccggatatgcatgctgtggggtcttggctcttccggaacttatgttgcctgtgcgaacaaatggaagcaagctgtcaacacgccgacgtcgccagagcgatgctgtccgactttgtgcagatgtttgtgctgagaggatttcagaagaactctgatctgagacgcactgtggaacctgagaagatgcctcaggtgaccgttgatgtcctccagcggatgctgatattcgccctcgacgcactggctgccggagttcaagaggaatcgtcaacacataaaattgtcagagcttccgcagctaggagttag

SEQ ID NO: 28623 - DNA, 798 bp, Artificial Sequence
  Description of Artificial Sequence: Synthetic coding sequence
atgtccgactcatgggtgcccaactccgctagtggtcaagatcctggcggacgaaggagggcgtgggcggagctgctggcagggagagtgaaaagagaaaagtacaaccccgaaagagcacagaagctcaaggagtccgctgtaaggctgcttagatcacatcaagacttgaacgcactgttgcttgaggtggaggggccactgtgtaaaaagctgagcctgtccaaggtgatcgattgtgacagttctgaggcctacgctaaccacagttcatctttcatcgggagcgccctccaagaccaggcctcccggctgggagttcccgtcggaatactgtcagccggtatggtggcaagcagtgtcggacaaatctgcactgccccagccgaaactagtcaccccgtcctgttgactgtagagcagcgctccagtctcctgttagaagcagtgtggcacctgcacgtgcaggggatcgtcagcctacaggagctattagaaagtcatcccgatatgcacgcagttggatcttggctgttcaggaacctgtgctgcctgtgtgaacaaatggaggcgagctgccagcacgctgacgtcgcaagagccatgctcagtgatttcgtgcagatgtttgtgctacgaggattccagaagaactcggatctccgaagaactgtcgaaccggaaaaaatgccccaggtgaccgtggatgtcctgcagcgaatgctgatttttgccttagatgcacttgcagcaggcgtgcaggaggaaagtagtacccacaaaatcgtgaggtgctag

SEQ ID NO: 28624 - DNA, 1869 bp, Artificial Sequence
  Description of Artificial Sequence: Synthetic coding sequence
atgtctcgccagaccaccagtgtagggagctcctgtctggacttatggcgggaaaaaaacgaccggctggtccgacaagccaaagtcgcacaaaattcgggtctgacactgcggaggcaacagctagctcaggatgcactggagggtctcagaggcctgctccactcacttcaaggcctcccagcagctgtaccagtccttccactcgaactcacagtgacctgtaactttatcatacttagagcaagtctcgcccaaggatttacagaggaccaggcacaggatatccagagaagcctggagagagtgttagagacccaggaacagcagggtcccagactggagcaggggctgcgagagctgtgggacagcgttttgagggcctcgtgtctgctgccggagttgctctctgccctccatcgattggtaggtctccaagctgccctgtggttgtcagcagaccgtctcggtgatctggcccttcttttggagacattaaatggatcccagtccggtgcaagtaaggatctccttctcctgctcaagacctggagtccgcctgctgaagagctggatgccccactaacattgcaagatgcccagggcctcaaggatgtgctgctgaccgcatttgcttatcgtcaagggctacaagagctgatcaccggtaaccccgacaaagctctgtcttccctgcatgaagctgcgtctggcttgtgccctcgtccagtgttggtgcaagtgtatactgctctcggcagctgccaccggaaaatgggtaacccacaacgggcactgctttacctcgtcgccgcactgaaggaggggagcgcttgggggcctccattacttgaagccagcaggctgtatcaacagttgggcgacaccaccgccgaactggagagcctcgaactcctcgtggaggcactgaacgttccttgctctagcaaggcaccacagtttctgatcgaggttgagttgttgctccctcctcctgacctggcctcgccactccactgtgggacacaatcccagacaaagcacatcttagcctcccggtgtttgcagactggtcgagccggtgacgcagctgaacattacctggacctgctggcgctgctcctggatagttccgaaccacgcttttcgcctcccccttcccctcccggaccatgcatgccagaagtcttcctggaagcagctgtcgccctaattcaggcaggcagggctcaggatgcacttaccctctgtgaggaacttttaagtagaacctcctcactactcccaaagatgtcacggttgtgggaggacgcccgtaagggcaccaaggaactgccctattgtccgctgtgggttagcgctacacatcttctgcagggtcaggcgtgggtccaactcggtgcacagaaggtagctatttccgagttttcacggtgtctcgaactcctgtttcgcgctacacccgaagagaaagagcagggtgccgcatttaactgcgaacaagggtgcaagagtgacgcagccctgcaacaactcagggcggctgccttaataagtcggggattagagtgggtggcaagtggtcaggatactaaagctttacaggacttcttgctgagcgtccagatgtgcccaggcaatcgtgacacatacttccatctactgcaaactctgaagcggttagataggagggatgaggcaactgcgctttggtggcggctggaggctcagaccaaaggatctcatgaggacgctctctggtctctacctctctacttggagagctatctcagctggatacggccttcagacagagatgcctttttagaggagttcagaacaagtttgccgaagtcatgcgacttgtag

SEQ ID NO: 28625 - DNA, 648 bp, Artificial Sequence
  Description of Artificial Sequence: Synthetic coding sequence
atgtcccgtcagacaaccagcgttggcagcagctgcctggatctatggagggagaagaacgatcggctggttagacaggccaaagtggcgcagaactcaggactgaccctgaggcggcagcagctggcgcaggacgctcttgaaggtcttcggggacttctgcacagtctgcagggtttgcccgcagccgtgcctgtcctgcctctggaattgacggtgacctgcaacttcataattctgagggcctccctcgcccagggattcactgaagaccaagctcaggatatccagcgcagcctcgagcgggtcctggagacccaggagcagcaggggccacggctagaacaaggcctgcgggaattgtgggattctgttcttcgggcatcctgcctgctccccgagctgttatccgctttgcacaggctagtcggactgcaggccgcactctggctgtctgctgaccgtctgggagatctggccttattgctggagacgctgaatgggtcccagtccggggcatccaaagacctgttgttacttctcaagacctggagccccccagctgaagagctcgacgcacctctgactttgcaggacgcccagggtttaaaagacgttctgctgaccgcattcgcttaccggcagtag

SEQ ID NO: 28626 - DNA, 1347 bp, Artificial Sequence
  Description of Artificial Sequence: Synthetic coding sequence
atgtcaagacagaccacgtcagtggggtcatcttgccttgatctgtggcgagaaaagaatgacagactcgtacggcaggccaaggtggcccagaattcaggccttacactcaggagacaacaactggcccaggacgccctagagggtttgcggggtttactgcactccctacaggggctcccagctgcagttccggtgctcccactggagctgaccgttacttgcaacttcatcatcctccgggcaagtctggcacaaggttttacagaggaccaggcacaggacatccagcggtctctggagagggttctggagactcaggagcagcaaggacctcgtcttgaacaggggttacgggagctgtgggattctgtcctgcgggcttcctgtcttctgcccgagctgcttagcgctctgcatagactggtgggcctccaggccgcactttggctcagtgccgatcgactcggcgacttggcccttctgctagagactttaaacgggagccagtcaggagcaagcaaggatctgcttttgctcctgaagacgtggagccctccagcagaagagctggatgctcccctgacgttacaggatgcccaaggtcttaaagacgtgcttctcacagcatttgcctatcgacagggcctacaggagctgatcacgggcaaccctgacaaagctctatccagcctccatgaggccgcaagtggtctgtgtccgaggcctgtgctcgttcaggtctatactgcattgggcagttgccacaggaagatgggaaatccgcagcgggctctgctctatctcgtcgccgcacttaaggaaggcagtgcctggggtcctcccctcctcgaggctagccggctttatcaacagctgggagacaccaccgccgagcttgaatctctcgaactgttggtggaagccctcaatgtcccttgctccagtaaggcccctcagtttcttattgaggtcgaactgctgttgccgccacccgatctcgctagcccgctgcactgtggcacacagagccaaacaaaacacattctggcgagccggtgcctgcaaactggacgagcaggcgatgccgctgaacattacctggacttgctcgcccttttgctggattcctcagagcccagatttagcccaccgccttctcctcccggaccctgcatgcctgaggtatttctcgaagccgcagtggccctgattcaggcgggacgtgcccaggacgctctgactctttgcgaggaactgctcagccgtaccagctcactgttgcctaagatgagcaggctgtgggaggatgccagaaagcgcacccgtggctcttttcaactgtag

SEQ ID NO: 28627 - DNA, 663 bp, Artificial Sequence
  Description of Artificial Sequence: Synthetic coding sequence
atgctcggcatttggacccttctgccgttagttctcacaagtgtcgcacgcctctcaagcaaaagcgttaacgcccaggttacggacatcaacagtaaagggctggaactgcgcaaaacagtgaccactgtggagactcagaatctcgagggcctccatcacgatggccagttttgtcacaagccatgcccgccaggcgagcgcaaggcacgggattgcacagtaaacggcgatgaaccggattgcgtgccctgtcaggaaggaaaggaatacacggacaaggcccattttagctccaagtgccgcaggtgtcgcctgtgcgatgaaggacatgggttggaagtggagatcaactgtacgcgtactcagaacacgaagtgcagatgcaaaccaaattttttctgcaactccaccgtgtgcgagcactgcgacccgtgtactaagtgtgagcatggtatcatcaaagagtgtaccctaaccagcaacactaagtgcaaggaggagggcagtcggtcaaatttaggatggctctgcctgttacttctgcccatcccactaatcgtgtgggtgaagagaaaggaggtacaaaaaacatgcagaaagcacagaaaggaaaaccagggttcacacgagtctccaactctgaatccaatgttgacatag

SEQ ID NO: 28628 - DNA, 1008 bp, Artificial Sequence
  Description of Artificial Sequence: Synthetic coding sequence
atgctcggaatttggaccttgcttccattagtgttaacctctgtggcccgtctaagcagcaaatcagtgaatgcgcaggtgaccgatatcaacagcaagggccttgaactgcgcaagaccgttacgacagttgagacccaaaacctggaggggctgcatcacgacggacaattctgccataagccttgccctcccggtgagagaaaagctcgcgactgcactgttaacggggacgagccggactgtgtcccgtgtcaagagggcaaggaatacacggataaggctcacttttctagcaaatgccgacggtgcagactatgtgatgagggacacggattagaggtcgaaattaattgtactaggactcaaaatactaagtgccgctgcaaacctaattttttttgtaacagcacagtttgcgaacattgcgacccctgtactaagtgcgagcacggcataataaaggagtgcacactcacatctaatactaagtgcaaagaagaaggctcacgatctaacttgggatggctgtgcctattactcctgcccatccctctcattgtctgggtgaagaggaaggaggtgcagaaaacatgccggaaacatagaaaagaaaatcaaggcagtcacgaatcccccaccctgaatcccgagacagtggccattaacctgtcggacgttgatttgtcgaaatatataactaccattgcaggggtgatgaccttgtctcaagtcaagggcttcgtgcgcaaaaacggcgtgaatgaggccaagatagacgaaataaagaacgataacgtccaggatactgccgaacaaaaggttcagctccttcggaactggcaccagcttcacggcaagaaggaagcttacgacactttaatcaaagatctgaaaaaagccaacctatgtacactcgctgaaaagatccaaactatcattctcaaggatattacttctgattccgaaaattcaaattttcgaaatgaaattcagagccttgtgtag

SEQ ID NO: 28629 - DNA, 945 bp, Artificial Sequence
  Description of Artificial Sequence: Synthetic coding sequence
atgctgggcatctggactctcttacctctagtgttaacgagtgtagcaaggctgagcagcaaatcagtgaatgcacaggttacggacatcaacagcaagggcctcgaacttaggaaaaccgtgactacagtggaaacacaaaacctcgagggactacatcacgatggtcagttctgccacaaaccgtgtccgccaggggaaagaaaagcacgagactgtaccgtgaatggtgatgagcccgactgcgttccctgtcaggagggcaaagagtatacagacaaggcacacttctcatctaagtgccggcgttgccgcttgtgtgatgaagggcacggtctggaggttgagatcaactgcaccaggacccagaacactaagtgtagatgtaaacccaactttttctgtaacagcacggtgtgtgaacactgtgatccctgcaccaagtgcgagcacggcattatcaaggagtgcacattgaccagcaacactaaatgtaaggaggaggtcaagaggaaagaggtccaaaagacctgtagaaaacaccgcaaggaaaatcagggatctcacgaatcgcccacgctgaaccccgagactgtggcaattaacctcagcgatgtggacctatcaaaatatattacgacaatagccggagtcatgaccctgtctcaagtcaaaggattcgttcggaaaaatggagtcaatgaggccaaaattgacgaaatcaagaatgacaacgtgcaggataccgcagaacagaaagtgcagctgctgcggaactggcaccaactacatggaaaaaaggaggcctatgataccttgataaaagatctcaagaaagccaacttgtgtactctggcagagaaaatccagaccataattcttaaagacataacttccgattcggaaaactcaaattttcggaatgagatccaatccttggtctag

SEQ ID NO: 28630 - DNA, 735 bp, Artificial Sequence
  Description of Artificial Sequence: Synthetic coding sequence
atgttgggcatttggacgttgctaccattggtgcttaccagcgttgcacggttgagctcaaagtcagtaaatgcccaggtgactgatatcaactcaaaggggttggaactgagaaagacagtgactaccgtcgaaacacaaaacttggagggattgcatcacgacgggcagttttgccacaaaccgtgtccccctggagaaagaaaggctcgcgactgcacagtgaacggtgacgaacccgattgtgtgccatgccaagagggcaaggagtacacggacaaggctcactttagtagtaagtgtcgcagatgccgactatgtgacgaggggcatggcctggaggttgaaatcaactgcaccaggacacagaatacgaaatgtcgctgcaagcctaactttttttgtaactctactgtctgtgaacactgtgatccctgcactaagtgcgaacatggaattatcaaagaatgcactctcacttcaaacaccaaatgcaaagaggaggggtcccgtagtaatcttggttggttatgtctgctactgctacctattcccctcattgtgtgggtgaagaggaaggaggttcagaaaacttgccgaaagcatcgcaaggagaatcagggaagccacgagtcacctactctaaacccggagaccgttgcaatcaacctttcagatgttgatttgtctaaataccaccactattgttggagccacgacacaaagtccagttag

SEQ ID NO: 28631 - DNA, 1089 bp, Artificial Sequence
  Description of Artificial Sequence: Synthetic coding sequence
atgcttcgggtgtgcgctcaggggtggcacgcacagggacttcctcacgggaccaactcactgttgaaggggggtaccgagaccagtctgtctactcctacgaggctggtggtgttgacatcggtcgcgcgattgagcagcaagtccgttaatgctcaagttactgatatcaactctaaaggtctggaactgcgtaagaccgttaccactgtggagactcagaatctggaggggctccatcatgatggtcagttttgccacaagccttgtcctcccggagaacgaaaggcccgagattgtacagttaatggggatgaacctgactgcgtgccatgtcaagaaggaaaggagtatacagataaggcccacttctccagtaaatgtcggcgttgcaggttatgtgacgagggtcatggtctggaggtcgagatcaattgcacccgcacccagaacactaagtgtaggtgtaagccaaatttcttctgcaacagcaccgtgtgcgaacattgcgacccctgtacaaagtgtgaacacgggatcataaaagaatgtaccctcacatctaacaccaaatgcaaggaggaaggctcgcgatctaatcttggttggctctgcttgctcctcctgcctatacctctcatcgtgtgggtaaaacgcaaggaggtgcagaaaacctgtagaaagcaccggaaggagaaccaaggcagccacgaatctcccacactcaacccagtggggatcgaaattgacttctcggatgtggacctcagcaaatacattacaactattgcaggagtcatgactctttctcaggttaaagggttcgtgagaaaaaatggtgtcaatgaggctaagatcgatgagataaagaatgataacgtgcaggacactgctgagcagaaggtccagcttctccgtaattggcaccagttacatggtaagaaggaagcctacgatacgctaataaaagatctcaaaaaggccaatctgtgtacactggcagaaaaaattcaaacaattattttaaaggatatcacctccgactcagaaaatagcaattttaggaatgagatacaaagtctcgtctag

SEQ ID NO: 28632 - DNA, 627 bp, Artificial Sequence
  Description of Artificial Sequence: Synthetic coding sequence
atggacccatttctggtgttactccattccgtgagttcctctcttagctcaagcgagctcactgagctgaaatttctttgtctgggcagggtgggaaagagaaagcttgagcgggtgcagtccgggctggacctgttcagtatgctgctggaacagaatgatcttgagcccggtcacactgagttattgagggagcttctggcctctctccggagacatgacctgcttcggcgagtagatgacttcgaagctggtgctgctgctggcgcagccccaggggaagaagacttatgcgcagcctttaatgtgatttgtgacaacgtgggcaaagattggcgccgattggctaggcagctgaaagtctctgataccaagatcgacagtatcgaggaccgctaccccagaaatctcaccgaaagagtgagagaatcgctgagaatatggaaaaacacagagaaggaaaatgccaccgttgcacatctggtcggagccttaaggagctgtcagatgaatctcgtggccgacctggtgcaggaagttcaacaagcgagagatctacagaatcgcagtggagcaatgtcccccatgagctggaatagcgacgcctctacgtcagaggcgagttag

SEQ ID NO: 28633 - DNA, 384 bp, Artificial Sequence
  Description of Artificial Sequence: Synthetic coding sequence
atgcaacaaccctttaactatccctaccctcagatttactgggtggatagcagtgctagctctccttgggcacctccaggaacagtgctgccatgtcctacctctgtccctcgcagacccggtcaacgacgtcctccccctcccccacctcccccacctcttccgcctccaccaccccctccacctttgccacccctgcccctgcctcctctgaaaaaacgcggaaaccattccaccggcctttgcctgctggtaatgtttttcatggtgttagtggcactcgtggggctggggctcggcatgtttcagctgttccaccttcagaaggagctggccgagctaagagaggctacgcccgtccatcccttaaaaaaacggtcctag

SEQ ID NO: 28634 - DNA, 846 bp, Artificial Sequence
  Description of Artificial Sequence: Synthetic coding sequence
atgcagcaacctttcaactatccgtacccacagatttattgggtcgattcaagtgcatcctccccctgggctccacccggaacagtgctcccctgtccgacgtccgtgccacgacggccagggcagaggcgccctcctccacctccccctcccccaccactccctccaccaccgcctcccccacccctgccaccgcttccgctacctcccctgaagaagcggggtaatcattcaaccggtctgtgtctcctggtcatgttcttcatggtgctcgtagccctagtcggcctggggttgggcatgtttcaattgtttcatctccagaaggaacttgctgagctgagagagagcacgtcccagatgcataccgcgtccagcctggagaagcagatcgggcatccaagtccaccacctgagaaaaaagaactgcgcaaagtggcccacctgacaggcaagagcaactctcgctccatgcccctggaatgggaagacacttacggaattgttctgctcagtggcgtcaaatacaagaaagggggacttgtgattaacgagacggggctatactttgtctactccaaagtctacttcagagggcagagttgcaataaccttcccctgtctcataaagtgtatatgcgaaattctaagtacccgcaggacctggtcatgatggaaggaaaaatgatgtcatactgcacgactgggcagatgtgggcccgttcatcatatttgggtgccgtgtttaacctaactagcgccgatcatctatacgtcaacgtcagcgaactgtcgctggttaacttcgaggaatcacaaacgttcttcggactttataaactctag

SEQ ID NO: 28635 - DNA, 13773 bp, Artificial Sequence
  Description of Artificial Sequence: Synthetic coding sequence
atgggtagacatctcgcacttttgttacttctgcttctgcttttccagcactttggcgacagcgacggcagccagagactggagcagacacccctgcagtttacccatctggagtataacgtgacggtacaggaaaatagtgccgcaaaaacttacgtggggcatcctgtaaagatgggtgtgtatattacccatcccgcttgggaagtgaggtataagattgtatcaggtgactccgagaatctgttcaaagccgaggagtatattctcggcgacttttgtttcttgcggattaggactaaaggtggcaacactgctatactgaaccgcgaggtgaaggatcattacacgttgattgttaaggccctggagaagaatactaatgtcgaggctcggactaaggtcagagtgcaggtcctggacacgaacgaccttaggccgcttttctcacctacatcttatagtgtatcccttcctgagaacacagcaattcggactagtattgctcgcgtgagtgctacggacgcagatatcggcacaaacggtgagttctactattcttttaaggatcggacagacatgttcgcgatccacccaacctctggcgtgatcgtgttaaccgggagactggactacctggagacaaagttgtacgaaatggaaatactggccgctgaccggggtatgaagttatacggtagcagcggaatttccagcatggcgaaattgactgtccacattgagcaagctaatgagtgtgcccctgtcataactgcagttaccctgtctccctccgagctcgaccgggatcctgcttacgctattgtcaccgtagacgactgtgaccaaggggctaatggtgacatcgcaagcctgagtatcgtcgctggcgacctgctgcaacagtttcgcaccgtgcgatccttcccaggctctaaggagtataaggtcaaagcaatagggggaattgattgggactcgcacccttttggttacaatcttaccctccaggcaaaggacaagggtactccacctcagttttcatccgtgaaggttatacacgtcacctctccccagtttaaggccggacccgtgaagtttgagaaagatgtgtacagagcagaaataagcgaatttgcgcctccaaacactccagtagttatggtgaaggccatccccgcttatagccacctgaggtacgtcttcaagtccacccccggaaaggccaaattcagtttaaattacaacacaggcttgatcagcatcctggagcctgttaaaagacaacaggctgcccatttcgagttggaggtgacaacaagtgaccgcaaggcatctactaaggtgctggtcaaagtgctgggagccaatagtaacccaccggaattcacccagaccgcttacaaggccgcattcgatgagaacgtgcccattggaactacagtgatgtctctctctgccgtcgacccagatgagggggagaacggatatgtgacgtacagtattgcaaatctgaaccatgtcccttttgcaatcgatcacttcactggcgctgtgagcacctccgagaacttggattacgaactcatgcccagggtgtataccctgcggataagggcctctgactggggattgccctaccgcagagaagtggaggtcttggctaccatcacgcttaataacctgaatgataacaccccgttattcgaaaaaatcaactgcgaaggcaccatcccaagggacctgggtgtgggggaacagatcactacggtttccgccatcgacgctgatgagctgcagctcgtgcaataccagatcgaagcagggaacgaactggatttcttctcactaaacccgaattcaggtgtcctctccctaaaaagatctttaatggatggcctcggggctaaggtcagcttccattcactgagaatcaccgcaaccgacggagaaaatttcgctactccactatacatcaacatcacagtcgctgcttctcataagttggtgaatctacagtgtgaagagacaggcgtcgctaagatgctggccgagaaattactgcaggctaacaagttgcacaaccaaggagaagtggaggatattttcttcgacagtcattctgtcaatgcacacattccccaattcaggtcaacactccctacaggaattcaggtgaaggagaatcaaccagtagggtcttcagttatcttcatgaattcgaccgacctggacactgggtttaatggcaaacttgtgtacgctgttagcggtggaaatgaagattcgtgtttcatgatcgacatggagaccggcatgctgaaaattctaagtccccttgatcgggaaacaaccgacaagtacacactgaatattaccgtgtacgacttgggaatcccacagaaagcagcttggagactcctacacgtggtggtagtggatgcgaatgataacccaccagagtttttacaagaatcatattttgtggaggtctcagaggacaaagaggtccactccgaaataattcaggtcgaagccaccgataaagaccttggccctaacgggcacgttacctacagcatcgttaccgatactgacacattctcaatagatagtgtgacgggtgtagtgaatattgccaggcctctggatcgcgagctgcagcacgagcattccttgaaaatcgaggcacgtgaccaggctcgggaggagccacaactcttctctacggtcgttgttaaggtgtccctcgaagacgtgaatgacaatccccctacattcatccctcctaactaccgggtgaaagtgcgcgaagaccttcccgaaggaacagtaatcatgtggctggaggctcacgaccctgatctcggtcagtctgggcaggtgcggtactctcttcttgatcatggggagggcaattttgatgtggacaaactgtctggcgctgtcaggatcgtgcagcaacttgacttcgagaagaagcaggtgtataacctaaccgtgcgtgcgaaagacaaggggaaacctgtctcgctgtccagcacttgttatgtggaggtggaggtagttgacgtgaatgagaacctgcatccacctgtgttcagttctttcgttgagaagggcactgtgaaagaagacgcccctgtgggcagtttagtgatgactgtgagcgcgcatgacgaggacgccaggagggacggggagataaggtacagcattcgcgacggatccggcgtgggtgtttttaagataggcgaggagaccggggtcattgagacgtcagatcggctggatcgagaaagcactagtcactactggctcaccgtcttcgccaccgaccagggagtagtgccgttgtcctccttcatcgagatctatatagaggtggaggatgtgaacgacaacgcccctcagacctccgagccagtctactaccctgaaataatggaaaacagcccaaaggacgtgagcgtagtccagattgaggccttcgaccccgacagctcctctaacgataaattgatgtacaagattactagcggtaatccccagggattttttagtattcatcccaagactgggctgattaccactactagccgaaagctagaccgcgagcagcaggacgaacatatcctggaggttacggtgacagataatgggtcaccaccaaaaagcactattgcgagagttatcgtaaaaatattagacgagaacgataataagcctcaatttcttcagaagttctataagattaggctcccagagagggagaagcctgaccgtgaacggaacgctcggcgtgaacctctataccacgtgattgctaccgataaggatgaaggtccaaacgcagaaatatcttattcgatagaggatggcaatgagcacggtaagttctttattgagccgaaaactggtgtcgtaagctcgaaaaggttttccgcagcgggtgagtacgacatcctgtctatcaaggcggtggacaacggaagaccccaaaagtcgagcaccacccgcttacacattgaatggataagcaagcccaagccttctctggagcctatttcattcgaggaaagtttcttcactttcacagtgatggagagtgatcctgtggcccacatgatcggagtgataagcgtcgagcccccaggtatcccactatggtttgacattaccggtggcaactacgactcccattttgacgtggacaagggcaccgggaccattatcgtcgctaagcccctggatgcagaacagaagtctaactacaatctgacagtcgaagctactgacgggactaccacaattttaactcaagtgttcatcaaagtgatcgatactaatgaccatagaccacagttctctaccagtaagtacgaggtcgttattccagaagatacagcaccagagaccgagattttgcagatatcggctgtggaccaggacgagaagaacaagctgatctacaccctgcaaagctcgagggacccgctgtcccttaagaaattcagactggatcccgctactggttctctgtatactagcgaaaagctggaccatgaagccgtgcccgctcacctcacagtgatggttagggaccaggacgttcccgttaagagaaatttcgccagaatcgtggtgaacgtaagtgacaccaatgatcacgctccatggttcactgcctcatcttataaaggacgagtgtatgaaagtgcagctgtcggcagcgtcgttctccaggttactgcccttgataaagacaagggcaagaatgcggaggtgctatactccatcgagagcggcaccttcggtaacattggtaatagctttatgattgacccggtcctgggctcgataaaaacggctaaggaacttgaccgctcgaaccaggcagaatacgatctcatggttaaggcgacggacaaaggatcacctcctatgtcagaaatcacctccgtaagaatctttgtgactattgccgacaacgcatctcccaagttcacaagtaaggagtattctgtggagctctctgaaactgtcagtattgggagcttcgtaggaatggtgaccgcacattctcagtcgagcgtggtgtacgagataaaggatggaaacaccggtgatgcattcgacattaatcctcactcaggaacaatcattactcaaaaggcattggactttgaaaccttgcctatctacactctgattattcaaggcacaaacatggctggcctctctaccaatacgaccgttttggtacacctgcaggacgaaaacgataacgctccggtttttatgcaagctgagtatacagggctaatcagcgaatcagcatccattaacagcgtggtgttgacagatcgcaatgttcctttggtgatcagagctgctgatgctgataaagattccaatgcactgctcgtctaccatatcgtagaacctagtgtccatacatacttcgctatcgacagttctactggggctattcatacagtactcagtctcgactacgaagagactagtatattccatttcacagtgcaggtgcacgacatgggaactcccagattgttcgccgagtatgcagcgaacgtcactgttcacgttattgatattaatgactgcccaccggtttttgccaaacccctttatgaagcttctctgcttttgcctacgtataaaggcgtgaaggtgatcactgtgaacgctactgatgctgatagtagcgctttcagtcagctgatctactccatcactgaggggaatatcggggaaaagtttagtatggactacaaaaccggtgccttgacagtgcagaataccactcagctgagatctcgatacgagctgaccgtgagggccagcgacggccgatttgctggcctaacttccgttaagatcaacgttaaggaatcgaaggagagccacctgaaatttacacaggacgtgtattccgctgttgtgaaggagaatagcaccgaagcagagactttggccgtcatcacagcgattggaaatcctatcaacgagcccctcttctaccacatacttaacccagatcgcaggtttaagatttcaagaaccagcggagtgttaagcacaaccggcacgcctttcgacagagaacagcaggaggcattcgatgtggttgtcgaggtcacagaagagcacaagcctagtgccgtggctcatgtagtggtgaaggtgattgttgaggatcagaacgacaatgcccctgtatttgttaacctaccttactacgccgtcgtgaaagtggacaccgaagtgggtcacgtgattcgttacgtgacggccgtagacagggactctggtcgcaatggcgaggttcattattatctgaaagagcatcatgagcattttcagattggcccactaggcgaaataagtctcaagaagcagtttgagctagacactctgaataaggagtatcttgtgaccgtcgtcgccaaagatggaggaaatcctgcattttcagctgaggttattgttcccattaccgttatgaataaagctatgcctgtgtttgaaaagcctttttattctgccgaaatagctgagtcgatacaggtacacagccctgtcgtacacgttcaggctaattcccccgagggtttaaaggtcttttatagcatcacagatggcgacccattctcgcaatttactatcaatttcaatacaggcgtgataaatgtgattgccccacttgatttcgaagctcaccctgcttacaaactgtccattagagctactgattccctgacgggcgctcatgcagaggtgttcgtagacattatcgtggatgatatcaacgataatcctcccgtattcgctcagcaatcctacgccgtgaccctgagcgaggcctccgtgattggcacgagcgttgttcaggtgcgcgctactgactctgattccgagcctaatcggggtatctcctaccagatgtttgggaatcattcgaagtcacacgatcactttcacgtcgactcatccaccggcctgatatcattgctcagaaccctggactatgagcaatccaggcaacacactatcttcgttcgcgcagttgacggcggaatgcctactttaagttccgacgtcattgtgactgtggacgtgacagacctgaacgacaacccccctctctttgaacagcaaatttacgaggccagaatatctgagcacgctccccacggacattttgtaacgtgcgttaaagcctacgacgcagattcttctgacatcgacaaactgcagtattcaatcctgtcaggtaacgaccataagcattttgtgattgacagcgctacagggataattacactttccaatctgcacagacacgctctgaagcctttctacagtctgaacctttcggtgagcgacggtgtcttcaggagtagcactcaggttcacgtgaccgtcattggcggaaacctacactctccagcttttttgcagaacgaatacgaagtggaactggcagaaaacgcaccattgcacaccctggttatggaagtcaagaccactgacggcgacagcggcatatatggccacgtgacttaccacatcgtgaatgatttcgctaaagatcgcttctatatcaacgagcggggacagatcttcactctcgaaaagctcgatagggaaacccccgcagaaaaggttatctctgtgcgtctcatggccaaggacgccggagggaaggtggcattttgcacggtcaatgtcatattaaccgatgataacgataatgcgccacagttccgagcaaccaagtatgaggtcaacatagggtcctcagcagccaaagggacctctgtggtcaaggtgcttgcgtcggacgctgatgaggggtccaacgccgacatcacatatgccatcgaagcggattccgaaagtgtgaaggagaatctggagatcaataaactcagcggtgtcatcaccactaaggaatcactgataggcttggagaacgagttcttcacattttttgtgagggccgtcgacaatggtagtcccagcaaggagagtgtcgtcctggtgtatgtgaaaattcttccccctgaaatgcaactccctaaattttctgagcctttctacacttttacagtttcagaagatgtaccgattgggactgagatagatctcatccgagcagaacatagcggcacagtgctgtacagtctggtgaaaggcaacactcccgagagcaatagagacgagagctttgtgatagatcgccaaagcgggcgattgaagctggaaaagtccctcgaccatgagactacaaagtggtatcagttctccatcctggcacgctgcacgcaagacgaccacgaaatggttgcatcagtggatgtgagcatccaagttaaggacgctaatgacaatagcccagtgtttgagtcttctccttatgaggctttcatcgttgaaaacctcccgggtgggtcccgcgttattcagatacgagcttcagatgcggacagtggtacaaatggacaggtgatgtacagtcttgaccagtctcaatccgtggaggtgatcgaatcctttgccattaacatggagaccgggtggattactacgctcaaagagctagatcacgaaaaacgggataactaccagattaaggtggttgccagtgaccacggggagaagattcagctgtcgagcaccgcgatagtcgacgttactgtgaccgatgtgaacgacagcccgccacgcttcaccgcggaaatttataaagggaccgtgtccgaggatgacccacaaggtggtgtcatcgccattctgtctacgaccgatgcagattccgaagagatcaatcggcaggtgacctactttattaccggaggggaccctctggggcagtttgccgtggagactattcagaatgaatggaaggtgtacgtcaagaagccgctcgatcgagaaaagcgggataactatttgctcaccatcacagccactgacgggacatttagcagcaaagcgattgtcgaagtgaaggtgttggatgccaacgataactctcctgtttgtgagaaaactctgtactctgataccattcccgaagatgtgctgcccggaaagcttattatgcagatctccgcaacggacgccgacatccggagcaatgctgagatcacatacactctgttaggaagcggggctgagaagttcaaattgaacccagataccggagagttgaagacatcaactccactcgatcgcgaagaacaggctgtgtatcacctgttagtgagagcgactgacggaggaggaaggttctgccaagccagtatcgtgttaactcttgaggatgtaaatgataacgctcctgagttttcagccgatccgtatgcgatcactgtgttcgaaaataccgaacctggcaccttgctgaccagggtgcaggctactgacgccgatgccggactgaatagaaagatactttatagtctgatagattccgccgatgggcagtttagcataaacgagttgtccggtatcatacagctcgaaaagcccctcgacagagaacttcaggcagtttatacattatcattgaaagccgtggaccaagggctccctcgtaggctaacagccacaggaacggttatagtgagcgtactagacataaacgacaaccccccagtattcgagtacagggaatacggggcaaccgtgagcgaggacatcctagtcggcacagaggtcctgcaagtatacgcggcttctcgtgacatcgaagccaacgcagagattacttatagcattataagcggaaacgaacacgggaaattttctatcgatagtaagacaggcgcagtttttattatagagaatctcgactacgaatcctctcacgagtactatcttaccgttgaagccaccgacggcggtaccccttcactttctgatgtagcaactgtgaacgtgaatgtgacagacattaacgacaataccccggtatttagtcaggatacatatactaccgttatttctgaagacgcggttctggagcagagcgtgattacagttatggcagatgacgccgatggacccagcaatagccatatccattacagcataatagatggaaatcagggctcttcgtttactatcgatccagtgcgcggagaggtgaaggtcacaaaattgctcgacagagaaaccattagcggatatacgctcacagtgcaggcctcggacaacggcagcccccctcgtgtcaacacaaccacagtgaatatcgatgtgagtgatgtgaacgacaacgcccctgtgttcagccgaggcaactattctgtaattattcaggaaaataagcctgtcggtttctccgtgctgcagctggtggtcaccgacgaggattcatcacacaatggaccgccttttttcttcactatcgtgacagggaacgatgagaaagcctttgaagttaaccctcaaggcgttctgctgacctcaagtgcaatcaagcggaaggagaaagaccactacctgttgcaggtgaaagtggcagacaatggcaaaccacagctgtcttccttgacctatattgacattcgggtgatcgaggagtcaatctaccctccggctatattacctctcgaaatcttcattacttcatccggtgaagagtatagcgggggtgttatcggaaagatacatgctaccgaccaagacgtatatgacaccctcacctattcactggatccgcagatggataatctgtttagtgtgagctccaccggaggaaagctgattgcccataagaagctggacattggacaatatctgttaaacgtttccgttacagacggcaagttcaccaccgttgctgacatcaccgtacacattcggcaggtcactcaggagatgcttaatcataccattgccattcgttttgccaatctcacacccgaagagttcgtgggggactactggagaaattttcagagggcactccggaacattctcggggtgcggcgaaatgacatccagattgtgtccttacaatcctccgaaccccaccctcacttagatgtgcttctctttgtagaaaagcccggatccgctcagatctctacaaagcagctgctgcacaagatcaacagcagcgttaccgacattgaggagattatcggagtccgcatattaaacgtgttccagaaactctgcgctgggctggattgcccctggaagttttgcgatgaaaaggtgtcagtagatgagtcagtgatgtccacccactccacagctcgcctgtcctttgtcacgccaaggcatcaccgcgcagccgtgtgcctgtgtaaagaaggcagatgccctcccgtgcatcatggctgcgaagatgatccttgtcccgagggatctgaatgtgtctctgacccgtgggaggaaaagcacacctgcgtgtgcccgagcgggagatttggccagtgccctggaagctcgagtatgacactgaccggtaactcatacgtgaaataccgattaacggagaatgaaaacaagttggagatgaagctgaccatgagattacggacttattccactcacgcagtggtgatgtacgcccgagggactgactactccatcctcgaaatccaccatggcaggctacaatacaagtttgactgtggatctggacctggtattgtttccgtgcagtctatccaggtcaatgacggtcagtggcacgcggtcgctctagaggttaacgggaattacgcacgacttgtgctggatcaggtgcatacggcaagtggaactgcacccggaaccctaaagaccttgaacctggataattatgtcttcttcggtggacatatcagacagcaaggaaccaggcacggtaggtccccacaggtgggtaatggtttcaggggttgtatggactctatatatttgaacgggcaggagttgcccctcaattcaaaaccgaggtcatatgctcacatcgaagagtccgtggatgtgagcccagggtgctttctgaccgcgaccgaagactgtgctagcaacccatgtcaaaatggtggggtgtgcaatccctcccccgctggcggttattactgtaagtgctctgccctttacatcggaacacactgcgagatttcggtcaatccatgctcttccaagccctgcctatacggaggaacctgtgtagtggataatggaggttttgtctgtcaatgccgcggactgtacactggacagcgttgccagctatcaccatattgcaaagacgagccttgtaagaatggcggtacctgctttgattcgctagatggggctgtatgtcaatgtgattccggatttcgcggagaacggtgtcagagtgacattgacgaatgctcaggaaacccatgcctgcacggtgccctctgcgaaaatacccacggaagctatcactgcaattgttcccacgaatacaggggccgtcattgtgaggacgccgcacctaaccagtacgtgtctaccccgtggaacattggtctagccgaagggatcgggatcgttgtctttgtcgctggtattttcctattggtggtggtcttcgtgttatgcaggaagatgatttcccgcaagaagaagcaccaagccgagcccaaggataagcacctgggccctgccactgcgtttctccagcgcccttattttgactcaaagctcaacaaaaatatctattcggatatcccaccgcaggtgcccgtacgcccaataagttatacacctagcatcccatctgatagtcgcaacaatctcgaccgcaattcctttgagggatcggccatacctgaacaccctgagttttcgaccttcaaccccgaaagtgtccatggtcatagaaaggcggtggcagtgtgttcagtagcacccaatttgcctcctccccctccttccaattcccctagtgactctgactccatacagaagccgtcttgggattttgattatgacacaaaggttgtggacctcgacccctgcctttcaaagaagcccttagaggaaaagccttcccaaccctactctgctagagagtcactgagtgaggtacagagcctttccagttttcagtcggaatcctgcgatgacaatggctaccattgggacactagtgactggatgccctccgtgccgcttccagatatccaggaattcccaaattatgaggtgatcgatgagcagacacccctatattcggctgatcctaacgctattgacacagactactaccctgggggatacgatatagaaagcgatttcccccctccaccggaagatttccctgccgcagacgagttgcctcccctgcctcccgagttctccaatcagttcgagtcaatccacccacccagagacatgcctgcagcgggttccctaggttcctcgagccggaaccgtcagcgcttcaaccttaatcagtacctccctaacttctatcccttagacatgagcgagcctcagacgaagggtaccggggagaactcaacctgccgcgagccccacgctccttacccacctggttaccagagacatttcgaggcccctgcagtcgaatccatgcccatgtcggtatacgcctcaactgctagctgtagtgacgtgtcagcctgctgcgaggtggaatctgaagtcatgatgtctgactacgagtcaggagacgacggtcacttcgaggaggtgacaatcccgccactggattctcagcagcacactgaagtctag

SEQ ID NO: 28636 - DNA, 13767 bp, Artificial Sequence
  Description of Artificial Sequence: Synthetic coding sequence
atgggcagacacttagcgctgctgttgttgctcctgctcttgttccaacatttcggcgactctgacggctctcagaggctggagcaaacaccactgcagtttacccacctggaatacaacgtgactgtgcaggagaactccgccgctaagacgtacgtggggcacccagtgaagatgggagtgtacattacacacccagcctgggaggtgcgttacaagatcgtcagcggcgactccgagaatctgttcaaagccgaggaatatatcctgggagatttctgtttcctgcgcattcggacaaaaggcggaaacaccgccatcctgaacagagaggtgaaagaccactacaccttaatcgttaaagcccttgaaaagaatactaatgtggaggcaagaaccaaggtccgtgtgcaggtcctcgatacaaatgatctgaggccgttgttcagccctacgagttactctgtgtcactgcccgagaatactgcgatacggactagtatcgctagggtgtcggccaccgatgctgatatcggcacaaatggtgaattttactactcatttaaggatcgcactgatatgttcgctatccaccccaccagcggagtcattgttctgaccggacgtcttgactaccttgagacgaaactgtatgaaatggaaattctggcggctgacagaggaatgaagctgtacggcagttcagggatatcgtccatggccaagctcacggtgcacatcgagcaagctaacgagtgtgctcccgtgattacggctgttaccctgagccccagtgagctggatcgggacccagcgtatgccatcgtgacagtggacgattgcgaccagggagcaaacggcgatatcgcgtcgctcagcatcgttgccggagacctgctgcagcaattccggacagtccgcagtttcccagggtctaaggagtacaaggtcaaagcaatcggcggaatcgattgggactcccatccttttggctacaacctcacattgcaggccaaggataagggcacgcccccacagtttagtagtgtcaaagtgatccacgtcacatctcctcagttcaaggcgggacctgtaaaatttgagaaagacgtttatcgtgcggaaatcagcgagtttgcccctcccaacactcctgtggtcatggtgaaagctatacccgcttactcccatttgcgctatgtatttaaatctacacccggaaaagctaaattctcattgaattacaataccggcctgatctctatcctcgaacccgttaagcgccaacaagccgcacactttgagctagaagttaccaccagtgatcgcaaggcctcaacaaaggtgctggtgaaggtgctgggggcaaatagcaatcctccagagttcacccagaccgcttataaagctgcttttgacgagaacgtccccataggaaccaccgtgatgtcgctttctgcagtggaccccgacgagggtgaaaatggatacgtgacttatagtatagcaaatctcaaccacgtccctttcgcaatcgatcacttcaccggggctgtgtccacttccgaaaacttagactatgaactgatgcccagagtgtacaccttgcggattcgggcatccgattgggggctgccttacagacgggaagtggaggtgctggccacaataacattgaataacctaaatgataatacccccctgttcgagaagatcaattgtgagggaaccatacctcgggatttaggtgtcggagaacaaattacgacagtgagtgctatcgacgccgatgaactgcagctggtacaataccagattgaagcgggtaacgaacttgacttcttcagtttgaaccccaactccggtgtgttatctctcaagcgctctctcatggacggactgggcgctaaggtgtcgtttcattctctgcgcataacggcgactgacggagaaaacttcgcgactcctttatatattaacatcaccgtcgctgcatcccataagctggtcaatttgcagtgcgaagaaactggcgtggcgaaaatgttggctgagaagctgttacaagcaaacaagctgcacaatcagggggaggtcgaagatattttcttcgattctcattccgtaaacgcccatatcccccagttcaggtctactctgcccactggcatccaagtcaaggagaatcaacccgtcgggagcagcgtaatcttcatgaacagcactgatctagacactgggtttaatgggaagctggtgtatgcggtgtcaggtgggaacgaagactcttgtttcatgatcgatatggagaccggcatgcttaaaatcctcagccctctggatcgagagactaccgataaatatactctgaatatcaccgtgtatgatcttggcattccacagaaagccgcatggcggctacttcacgtcgtggtggtcgacgctaacgataatcctccagagttcttgcaggaaagttacttcgtggaggtcagtgaggacaaagaggtccacagtgaaattatacaagtggaggctaccgacaaggacctcggaccaaacggccatgtgacatacagtattgtaaccgacactgataccttttcaattgactccgtgaccggggtggtcaacatcgcaaggccattagacagagaactgcaacacgagcattccctaaagatcgaggctcgcgatcaagcccgagaggagccacagctgtttagcaccgtggtggtgaaggtgagcctggaagatgtgaacgacaacccccctacattcattcctcccaattaccgggtgaaggtgagagaagatctgccagaaggtacagtgatcatgtggctggaggcccacgatccggatttggggcaaagcgggcaggtccgctacagtctcctggaccacggagaggggaacttcgatgtcgataagctctcgggcgcagtcaggattgtccagcaactcgatttcgagaagaaacaggtgtataatctgaccgtgcgagctaaagacaaaggaaagccagtgtctttatcctccacatgttatgtagaggtggaggtggtcgatgtgaatgagaacctgcaccctcccgtcttcagtagtttcgtggaaaaaggcaccgtgaaggaggatgctcccgtaggctccctagtgatgaccgtgagtgcacatgatgaagacgcacgacgcgacggcgaaattaggtatagcatccgcgacggcagcggtgtgggcgtattcaaaatcggggaagaaacaggcgtaatcgagacgtcagaccggttagatagggagagtacctcccactactggctaactgttttcgctaccgatcagggtgtcgtgcccttatcctcgttcatcgaaatctatatagaagtagaagacgtcaacgacaacgcccctcagacctccgagccggtgtattaccccgagatcatggaaaattcaccaaaagatgtttccgttgtgcaaattgaagcctttgacccagacagctcaagcaacgacaaactgatgtacaaaattacttcaggcaaccctcagggctttttttcaatacaccctaaaacaggccttattaccaccacgtctagaaaactggatcgcgaacagcaagatgagcacatcctcgaggttacggtcactgataacggctccccccctaagagcaccatcgctagggtcatcgtcaagatattagacgagaatgacaacaaacctcaatttctgcagaaattttataaaattaggctgcctgagagagaaaagccagaccgagaaaggaacgcccgtagagaaccactgtatcatgtgatcgccactgataaggatgaagggccaaatgctgagatctcctattctatagaggatggcaacgaacacggcaaattctttatcgagccaaagacgggagtggtcagctccaagaggttttctgctgcaggagaatatgacattctgtccattaaggccgtcgataacgggagaccgcagaaatcctccactacccggctccatattgaatggattagcaagcctaaaccttccctggaaccgatctccttcgaagagtctttttttacattcacggttatggaaagtgaccctgtcgcgcatatgataggggtgatctcagttgaacccccaggtatcccgctgtggtttgatattacaggcggaaactatgactcacactttgacgtcgataagggcacaggtacaatcattgtggccaagccactcgacgctgagcaaaagagcaattacaatctcacagtcgaagccacagacggcaccacaaccattctgacccaggtctttatcaaggtaatcgataccaatgatcaccggccacaattcagtacttctaagtacgaggtggtcatccctgaggatactgctccagaaacagagatcctccagatttctgcggtagatcaggacgagaaaaacaagttaatctacactttacagtctagtcgggatcccctctccctgaagaagtttaggctcgatccagccaccgggagtctgtacacaagtgaaaagctggatcatgaggcagtgcatcagcacaccctgacagtcatggtcagggatcaggatgtcccagtcaagagaaacttcgcacggattgtggtgaatgtgagtgacacaaatgaccatgcaccctggttcaccgcctcgtcatacaagggacgcgtctatgagagcgcagccgttggatcagttgtactacaggtgacagcactagataaagacaagggtaagaacgcggaggttctatactcaattgagtctgggaacataggcaattcctttatgattgatcctgttctcgggtctatcaagaccgcaaaggagttggataggtccaaccaggcagaatacgatctcatggtgaaagccacagacaagggcagcccgcctatgagtgagataacttccgttaggattttcgtgaccatcgccgataatgcctccccaaagttcacctctaaggaatactctgttgaactatcggagaccgtgtccattggctccttcgttgggatggtgaccgcccactctcagtcctccgtcgtctacgaaatcaaggatgggaacacaggagacgcctttgatattaacccacactccgggaccatcatcactcaaaaggcgttggacttcgaaaccctccctatttatacccttataatccaaggaacgaatatggccggattatctacgaacacgaccgtgctagtccatctccaggatgagaatgataatgcaccagtgtttatgcaagccgagtacactggcctgatcagtgaatccgcttctatcaattctgttgtactgactgaccgtaacgttccattggttatcagagcagcagacgccgacaaggatagcaacgccttactggtctaccacattgttgaaccaagtgtccacacttacttcgcgatcgatagttctactggcgctatacacaccgtactcagccttgattatgaggagaccagcatatttcatttcaccgtgcaagtacacgatatgggtacaccaaggttgttcgcggaatatgccgctaacgtcacagttcacgtcatcgacatcaacgactgccctcccgtgtttgccaagccgctgtacgaggctagcctgttgctcccaacctataaaggcgtcaaagtaatcaccgtcaatgccactgatgcggactcatcagctttcagtcagctcatttatagcattaccgagggaaacatcggagagaaattctccatggattacaagaccggagcactcacggtgcagaatactacccagctcagatctcgctatgaactgacggtgagggcgtccgacgggaggtttgccggattgacatctgtgaaaatcaacgtgaaagagtcaaaagagtctcatctcaagttcacccaggatgtctatagcgctgtcgtcaaggaaaacagtactgaggccgaaacacttgctgtgattaccgctattggcaaccccatcaatgagccgctgttttatcatatactaaaccccgacaggcgcttcaagatttcccgtacatcaggagttctgagcaccaccggaaccccgtttgaccgggaacaacaggaagcattcgatgtagtcgttgaggtgactgaggagcataaaccctccgcagttgcacacgtcgtggtgaaggtgattgtggaagaccagaacgataatgcaccggtcttcgttaatctcccctactacgctgtggtgaaggtagacaccgaagtgggtcacgtgattagatatgtcactgctgtcgaccgcgattccggcaggaatggagaggtacattattatctcaaagaacatcacgagcactttcaaatcgggccactgggagagatctctctgaagaaacaattcgaattggatacactgaataaggaatacctggtgactgtggttgctaaggacggtgggaacccagccttctcagcagaggtaattgtgccaatcacagtgatgaataaggctatgcctgtctttgaaaagcccttctactcggctgagatcgccgagtcaattcaggtccactcccccgtggtacatgttcaggccaatagcccggagggtttaaaggtgttttattccataacggatggcgatcccttcagccagttcaccatcaacttcaataccggggttatcaatgtgattgcgcctctggactttgaagcccaccccgcatataagctgtcaattagggcaactgatagtctgacaggggctcatgcggaagttttcgtggatatcattgtagatgacattaatgacaatcccccagttttcgctcagcagtcttatgcagtcacgctctcagaggcatctgtgattggtacgtcagtggtacaggtgcgagcaactgattcagactcggaaccaaaccgcggaatctcttatcaaatgttcgggaatcacagtaaaagccatgatcacttccatgtggacagctccaccggacttatcagtctgcttaggacactggattacgaacagagtaggcagcataccatcttcgtgagggccgttgatgggggaatgccaaccctttcctccgacgtaattgtgactgtggatgtgacagacctcaatgataacccgccactattcgaacagcagatctacgaggccagaatatccgagcacgcccctcatggccacttcgtgacctgcgttaaggcatacgatgccgactcctctgatattgacaaactccaatactcaatcctaagcgggaacgatcacaagcactttgttatcgatagcgccaccggaattattacgctgagcaatcttcataggcacgcactgaaacctttctattcactcaacttatcggttagcgatggggtgttcaggtcttccacccaagtccacgtcactgtgatcggcggaaacttgcacagtcccgcttttctacagaacgagtacgaagtcgaactggcagagaacgctccactccacacactcgttatggaggtcaaaaccaccgacggagattccggcatttatggacacgtgacctaccatatagtaaatgacttcgcgaaggacaggttttatattaatgagaggggtcagatcttcaccctcgagaaactggaccgagaaacacctgctgagaaagtaatttccgttcggttaatggccaaggacgcaggagggaaggtggcgttttgcaccgtgaacgtgatcctcaccgacgataacgacaatgccccacagttccgggcaacaaagtatgaggtcaatattgggtcttctgctgcaaaagggacaagtgtcgttaaggtactcgcctctgatgcagatgaggggtctaatgctgacataacatatgccatagaagcagatagtgagagtgttaaggaaaatctcgagattaataagctgtctggagttattacaaccaaagaatctctgatcggacttgaaaacgagttctttacattcttcgtgagggcagtcgataatggttccccatccaaagagtctgtagtgcttgtttacgtcaaaatcctccccccagagatgcagctgccgaagttttccgaacccttctacactttcactgtatctgaagacgtgccaatagggaccgaaatcgatctcatcagagccgaacacagcggtacggtgctgtacagtttggtgaagggcaatactccagaaagcaacagagacgagtcttttgtgatcgacagacagtctggcagactgaaactcgaaaaaagcctcgatcacgagaccactaagtggtaccagttctctatactggccaggtgtacccaagacgatcacgagatggtcgcaagtgtcgatgtcagcatccaggtgaaagacgccaatgataatagtcccgtgtttgaatcctccccatatgaggcttttatagtggagaacctgcctggcggaagccgcgtgatacaaatcagggcaagtgacgctgactctgggacaaacggtcaagtgatgtattcactggaccagagccagtctgtagaagtgattgagtcttttgcgatcaatatggagacaggatggattaccactctgaaagagctcgaccatgagaaaagggacaattaccagatcaaagtcgtagcttctgatcatggcgagaaaattcagctttcgagtacagcaatcgtggacgtgactgtcacagatgtgaatgatagcccaccacgattcacagccgagatatataaaggaaccgtcagtgaagatgacccacaggggggtgtaattgctatcctgagcacaacagatgccgactcagaggagattaaccggcaggttacctattttatcacgggtggcgatcctttgggacagtttgccgtcgagacaattcagaacgaatggaaagtttatgtcaagaagccgctggatcgggaaaaaagagataactacctgctaaccattactgccacagatggtacattctcatcgaaggccatcgttgaggtaaaggtgcttgacgctaatgataacagcccggtctgcgaaaaaactctgtatagcgacacaattcctgaagatgtgctacccggtaaactgattatgcagatctctgccactgatgctgacatacgcagcaatgcagaaataacttacacactcctcggaagcggagccgaaaaatttaagctaaacccagatacaggtgaactcaagacctccactccacttgacagagaggagcaggctgtgtaccacctgcttgtgcgagcaactgatgggggtggcaggttttgccaggcaagtattgtgcttaccttagaggacgtaaacgacaatgcacccgaatttagtgcagacccctacgcaatcaccgtgtttgaaaacaccgaacccggtactttactgacaagggtgcaggctacagatgcggacgccggactgaatcggaagattctctatagcctcattgattcagccgatggacagttcagtataaatgagctgtccggcatcattcaattggagaagcctctggacagggaactgcaagcagtgtatactctgtccctgaaggccgtggatcagggcctaccccgaaggctgaccgccaccggcaccgtgatcgtgtctgttctcgacatcaacgacaacccccctgtcttcgagtatcgggaatatggagccaccgtgtctgaagacatcttggtaggtaccgaggttctccaggtgtatgctgcgtctcgcgatatagaagcgaacgctgaaatcacctactccatcatctccggaaatgaacacggcaaattctccatcgattccaaaactggcgcagtatttattatcgagaatctggactacgagtcatcccatgaatactatttgacagtagaagccacagatggaggtactcctagtctaagtgatgtcgccactgttaacgtgaatgtgaccgatatcaacgataatactcctgtcttttcacaggatacatataccaccgtgatttcagaagatgccgttctagagcaatccgttatcaccgtgatggctgacgacgcagacgggccttctaactcccacatccactactctataattgatgggaaccagggttcgtccttcactatcgaccctgtccggggtgaggtgaaggttactaagttgctggacagggagactatcagcggttatactttgactgttcaggcctcggataacggcagccccccaagagtcaatacgaccaccgtcaacatcgacgtatctgacgtaaacgataatgctcccgtattcagtagaggtaactacagtgtcatcatccaggagaataagcctgtgggatttagcgttttgcagctcgtggttacagacgaagattccagtcacaacgggcctccatttttctttacgattgtgacaggcaacgacgaaaaggccttcgaagtgaatccccaaggcgtactactaacttcttccgctataaagcggaaggaaaaagaccactatctgttgcaggtgaaggtggctgataatgggaagccacagctgtcttctttgacatacatagacattcgcgtcattgaagagagcatctaccctccagccatcctcccccttgagatattcattacctcctctggtgaggagtactccggcggagtgatcggaaagatccacgccaccgatcaagacgtgtatgacacgctgacatatagtctggatccacagatggataatctgttttcagttagctctaccggtggaaagctgatcgcacacaaaaagctggacattggccagtaccttctcaatgtcagcgttaccgacggaaagttcacgaccgttgccgatataactgtgcatatacgacaggtgacccaggaaatgctcaaccacactattgcaattaggttcgccaatctgacacccgaggaattcgtgggcgactactggcgcaatttccagcgggctctcagaaacatcttgggcgtgcgccgtaacgacatacagatcgtatctctgcagagtagtgagccacacccacacctggatgtactgctgttcgtggagaagccgggaagcgcacagatttctaccaaacagctgctccataaaattaatagtagtgttaccgacattgaagaaataatcggcgttcgaatcctgaacgtgttccaaaaactctgtgcagggttagactgcccatggaagttttgtgatgagaaggtctctgttgatgagtcagtgatgtccacccattcgactgccaggctttcttttgtgacacctcgtcatcaccgagctgctgtgtgtctatgcaaggaaggcaggtgtcctccagtgcatcacggctgtgaagatgatccatgtcccgagggtagcgaatgcgtgtctgatccctgggaggagaaacacacatgcgtctgtccttctggcagatttggccagtgtcccggatctagcagtatgaccctgacaggaaatagttatgtcaaataccgactcacagagaatgagaataagttggagatgaagcttacaatgcggttaagaacctatagtacccacgcagtggtcatgtatgccaggggcacggactactccatcctggaaattcaccacggccgacttcagtataaattcgactgtggctccggaccgggtatagtcagcgtccaatcaatacaggttaatgacgggcaatggcatgcggttgcactcgaggtgaacggaaattacgcaaggcttgtgctggaccaagtgcacactgctagcgggactgcccctggaaccttgaaaactctaaacttggataactacgttttcttcggagggcacatccggcaacagggcacacgtcatggcaggtcgccccaggtgggcaatggctttcggggatgcatggattccatctatctgaacggccaggaactgccgcttaattctaagccacggtcctatgcacatattgaagagtcagtagacgttagtcctggatgctttctgacagcaactgaagattgcgcatctaacccttgccagaacggcggtgtgtgcaatcccagccctgcaggcggatactactgcaaatgttccgccctttatataggaacgcactgcgaaatctcagtcaatccatgcagtagcaaaccttgtctgtacgggggtacttgcgtcgttgacaatgggggttttgtatgtcagtgtagagggctgtacaccgggcagagatgccagctcagtccatattgtaaagatgaaccctgtaaaaatgggggaacatgttttgatagtctcgacggcgctgtctgtcagtgcgactctggctttcgaggggagaggtgccagagcgacatcgatgagtgtagtggcaacccatgtctgcacggcgctctctgtgagaatacccatggaagctaccactgcaattgtagccacgaatatcggggaagacattgcgaggacgccgctcccaaccaatacgtctctacaccttggaacatagggctcgcggagggcatcggaattgtggttttcgttgccggaatctttctgttagtagtggtcttcgtcctatgcaggaaaatgatctccagaaagaaaaaacaccaggcggaacctaaggataagcacctcggacctgcaaccgcctttctgcagcgaccctattttgattcaaagctcaataaaaatatatactccgacattccaccacaggtgcccgtgcgacctatcagctacacaccatctatacccagcgattctagaaacaaccttgaccgtaatagcttcgagggatcggccataccggagcacccagagtttagtacattcaacccagaatctgttcatgggcaccgtaaggccgtcgccgtctgtagtgtggccccaaacttaccgccaccccctccaagcaattctccttccgattccgattctatacagaagccttcatgggatttcgactatgacaccaaggttgttgacctggacccctgcctgtccaagaagcccttggaggaaaaaccttctcagccttactccgcgagagagtctctgtcagaggtgcagagtttatcctccttccagtctgaaagttgtgatgacaatggataccattgggatacgtctgattggatgccctctgtgcccctgccggacatccaggagttccctaactacgaagttatcgatgagcagaccccactttatagtgctgatccgaacgctatcgatacagactattatcctgggggatacgatatcgagagcgatttcccgcctcctcccgaggactttcccgctgcagatgagctcccacccctcccccctgagttttctaaccagttcgagagtattcacccgcctcgtgacatgccggctgccggatcccttggctcaagctcacgaaaccgccagaggttcaatctcaaccagtatcttcccaacttctatcccctggatatgagcgaacctcagacaaaagggacaggtgagaattcaacttgccgcgagccccacgcaccatatcctcccggttatcagcgccacttcgaggctccagcagttgagagcatgcctatgtctgtctatgcttccacggcctcttgttcggacgtgtctgcgtgctgcgaagtggagtccgaggtgatgatgagcgattatgagagtggcgacgacggacattttgaagaagtgactatccctcctctcgattcccagcagcacactgaagtgtag

SEQ ID NO: 28637 - DNA, 1467 bp, Artificial Sequence
  Description of Artificial Sequence: Synthetic coding sequence
atgggacgccacctggcactgctgctgttgctcctgctgctttttcaacacttcggtgattctgacgggagccagaggctcgaacagaccccactccaattcacccatctggagtataatgttacagtgcaggaaaattccgcagctaaaacatacgtgggacatcctgtcaaaatgggggtgtacattacccatcccgcatgggaagtgaggtataagatcgtgtccggggattccgagaacttattcaaggctgaggagtatattttgggagatttttgctttctcaggattcgcacaaaagggggtaacaccgccatcttgaacagagaggttaaagatcactatacactaatcgtaaaagcgctggaaaaaaacactaatgtagaggccagaactaaggttagggtgcaggtcctcgacactaacgacctaaggccactgttcagccccacatcctactccgtgagccttccagagaataccgccataagaacatccatagccagagtgtctgcgaccgatgcagatataggcaccaatggcgagttctactacagcttcaaggataggaccgatatgtttgctatccatccaaccagcggcgtgatcgtgctgaccggcaggctcgactacctagaaactaagctctacgagatggagatactggctgccgatcgcggaatgaaattatatggaagctcaggcatctcttccatggccaagctcactgtgcacatcgagcaggccaacgagtgtgcgccagttattaccgcggttaccttgtcccccagtgagctggatagagatcccgcttatgctattgtgacagtggacgactgtgaccagggcgctaacggcgacattgcctctctcagtatcgtcgccggagacctgctgcagcaattccggacagtgcggtctttccctgggagcaaggagtataaagtgaaggccatcggagggatcgactgggactcgcacccttttggatacaacctcaccctgcaggccaaagataagggcacacccccacagttttcctcagtaaaggtcatccacgtcacttctccccagtttaaggccggacccgtgaagttcgaaaaagacgtgtacagagccgagatcagcgaattcgcccctccaaacacgcctgtagttatggtgaaggcaatccctgcatattcccatctgcggtacgtattcaagtcaacaccagggaaagccaaattcagcctcaattataatactgggctcatttcgatcttggagcccgtcaaaagacagcaggcagcccacttcgagcttgaggtgacaacatcggatcgaaaggcatctaccaaagtgctggttaaagtcctaggggctaattcaaatccccctgaattcacccaaaccgcctataaggcagcctttgacgaaaacgttccaattggcaccaccgtcatgagcctgtccgctgtgtag

SEQ ID NO: 28638 - DNA, 399 bp, Artificial Sequence
  Description of Artificial Sequence: Synthetic coding sequence
atgtgcgatgctttcgtggggacatggaagctggtctcttcagagaatttcgacgattatatgaaggaagtgggagtgggctttgccacacgcaaggtggccggtatggccaagccaaatatgattatcagcgtcaacggagatgtcatcacaatcaaatcagagagcaccttcaaaaataccgagatatcctttatactcggacaggagttcgacgaagtcacagctgatgaccggaaagttaagtccaccatcacattggacggcggagtgttggtccatgttcaaaagtgggatggaaagtccacaactattaaacgtaaaagagaagatgataaactcgtggtcgaatgtgtgatgaaaggagtgacatccacacgtgtgtacgagcgggcttag

SEQ ID NO: 28639 - DNA, 7536 bp, Artificial Sequence
  Description of Artificial Sequence: Synthetic coding sequence
atggaagaagtagtaattgccggaatgtcggggaagctccctgaatcggagaatctgcaggagttctgggacaacttgatcgggggtgtggatatggtcaccgatgatgaccggagatggaaagcgggtttatacggcctaccaagacgctcaggaaaactcaaagatctgagtcgcttcgatgccagcttttttggcgtccatccaaagcaagcacacacgatggatccccaactgcgcttgctgttagaggtgacctacgaggccatcgtagatggagggattaatcccgactcccttagggggacacacacgggggtatgggtgggtgtgtctggcagtgaaacaagcgaagccctgagtagagacccagaaactctcgttggctattccatggtgggatgccagagggccatgatggctaatcgtctgagctttttttttgactttcgcggacccagtatcgccctcgataccgcatgtagctcctcattgatggcactgcagaacgcctatcaggcgatccactctggtcaatgtcccgcagccatcgtgggcggaatcaacgtattgctgaagccaaacactagtgtccagttccttcgccttgggatgctgtccccagaggggacatgtaaagcttttgacacagccggtaacggatactgcagaagcgaaggtgtggtagccgtgctgctaactaagaaatcattagcccgtcgggtgtatgcaaccatcctgaatgccggtacgaataccgacggattcaaggagcagggagtgacattcccttcaggagatattcaagaacagctcattcgcagcctgtaccagtctgcgggagtggcccctgagtcttttgagtacattgaagcccatggcactggtactaaagtcggggatcctcaagagctcaacggaatcacccgagcgttgtgcgcaaccaggcaggaacccttacttataggctcaaccaagtcaaatatgggtcacccagaacccgcttccggactggctgcactcgcgaaggtgctcctctcactggagcacggactgtgggctccaaatctgcactttcactcgcctaacccggagatcccagccctcctggacggtagactgcaggtggtggatcaacccttgccggtcagggggggtaatgttggcatcaatagctttggattcggcggaagcaacgtgcatatcattctcaggccgaacacccaacccccaccagctcccgcaccccacgctacactgccacgacttctccgggcaagcgggcgaacacctgaggccgttcagaaattgctcgaacaaggtctgagacattcacaggatctggcatttctatctatgctgaatgacatagctgccgtgccagccactgcaatgcccttccggggttatgctgttctgggaggcgagaggggcggtcctgaggtgcagcaggttcctgctggcgagagacccttgtggtttatatgctctgggatgggaacccaatggagaggaatgggcctgagcctcatgcgattggatagatttcgtgattctatactaagaagcgacgaggcagtcaagccttttggcctgaaagtctctcagctactcctgagcaccgacgaatcaacctttgacgatatagtacattcctttgtctccctgaccgctatccaaatcggcctgatcgaccttctgagctgcatggggctccggccagacggtatcgtcggccatagtcttggagaggtcgcatgtggctatgcagatggatgcctctcccaggaagaggctgtgcttgccgcatactggagaggccagtgtatcaaggaggcccatctgccccctggggctatggccgctgtcgggttatcctgggaagagtgcaagcaacggtgtccacctggggtggtacctgcatgtcacaattccaaggataccgtgactatttcaggaccgcaggctcctgtgtttgagttcgtagagcagctgcgcaaagagggcgtgtttgcaaaagaagtccggaccgggggaatggcttttcacagctattttatggaggccatcgctcctcctcttctccaggaacttaagaaagtgatacgggagccaaagcctagatccgctcggtggctgtctaccagcatacctgaggcacagtggcattctagcctcgcacgcacttcatctgccgagtataatgtcaacaacctggtatcaccggtactttttcaagaggcattgtggcatgtgcctgagcatgcggttgtattggagatcgcccctcacgccctactgcaggcggtacttaaaaggggccttaagccatcctgtacgattattcctctgatgaagaaggatcacagggataacctggagttctttctggcaggaattggcagactgcatctcagcggcattgatgccaaccccaacgctctgtttccacctgtggagtttccagcgcctagaggcactcccctgatctcacctctcatcaagtgggatcatagccttgcttgggacgtcccggctgctgaagatttcccaaacggttctggatcgccaagtgccgcaatttacaatattgatacttccagcgagtctcccgaccactatttagtggaccacacgttagatgggcgagtcctttttcctgctactggctacttgagtattgtgtggaaaacgttggcacgggctttgggcctgggggtagaacagctcccagttgtttttgaggacgtggtgcttcaccaggcgaccatcctgccaaagactggaactgtgagtttggaagtccgcctactcgaagctagcagagcctttgaggttagtgagaatgggaatttggtagtgtctgggaaggtatatcagtgggacgatcccgatcctaggctttttgaccaccccgaatcaccaacacctaatccaacagagcccctgtttctcgcccaggcagaggtgtataaagaactgagattgcgcggatacgattacggcccacactttcaggggatcttagaagccagccttgagggggattctgggaggctcctgtggaaagataattgggtgtctttcatggataccatgctacagatgtcaatccttggttctgcgaaacatggtctctacctgcccactcgggtgactgctattcatatcgaccctgctacacatcgccagaagctctatacactccaggacaaggcccaagttgccgacgttgtggtgtctcggtggctgcgcgttacggtggctgggggagtgcacatttccgggttacacactgagtctgcccctaggagacagcaggagcaacaggtgcctatattggagaagttttgctttacaccccacaccgaagaggggtgcctgtccgagcgcgcagccctccaggaggagctgcagttatgtaaggggttagtgcaagccttgcagacgaaagttacgcaacaagggctgaaaatggtggtgccaggacttgatggggctcagatacctcgcgacccatcccagcaagagttacccaggctacttagtgctgcatgccgtctccaactcaatgggaatcttcagcttgaactggcccaggtactggctcaagaacgcccaaagctccccgaagaccctctgttgtccggattgctggactcccccgctttaaaggcatgtctcgatactgctgtggagaatatgccctctctgaaaatgaaggtggtcgaggtactggccggtcacggccacttatattcccgtattcccggtctgttaagcccgcatcccctgctacaactctcatacaccgccactgacaggcaccctcaagcgctggaggcagcgcaagctgagctgcagcaacatgatgtcgctcaggggcagtgggaccccgcagacccagctccttcagctctcggctccgcagatctcctcgtttgtaattgtgctgtggccgcactcggtgatcccgcatcagccctgagtaacatggtagcagctctccgcgagggcggatttcttttactgcacactttgctaaggggccatcccctaggcgacatcgtggcctttttgacaagtacagaacctcaatacggccaagggatactctcacaagacgcttgggagtcgttatttagtcgggtgtccttacgcctggtcggccttaagaaaagcttctacgggtccacgttgtttctttgccggagaccaacaccccaggactctcccatatttttgccggtggacgacaccagctttcggtgggtggagtcactgaagggcatcctggctgacgaggattccagcagacctgtttggttaaaggctatcaattgtgctacgagtggcgttgtaggtctcgttaattgtttacgaagagaaccaggaggaaatcgattgcgctgcgtgctcctgtccaatttgtctagtacatctcatgtgccagaagttgaccccggaagtgctgagttgcagaaggtgcttcagggtgatttggttatgaacgtttatcgggacggagcttggggcgcttttcggcattttttattagaggaagataagccggaagagcccactgcccatgcctttgtctccacattgactaggggtgatcttagctcaatccgttgggtatgctccagtctgcgacacgcccagcccacttgtccgggagcacagctgtgcacggtctattacgcatctctcaacttccgtgacataatgttggccacaggaaagctgagccctgacgcaatccctggcaaatggaccagtcaggactcactcctgggcatggaattcagtggtagggacgcctccgggaagagagtgatgggtctggtgccagccaaggggctagccacatctgtcctcctatcccctgatttcctgtgggatgttccttcaaattggacgttagaggaagcagccagtgttccagtcgtatattccaccgcttactacgcgcttgtggtgaggggtcgggtgcgcccaggagaaacactacttattcatagcggatccggcggtgtgggtcaagccgctattgcgattgccctatccttggggtgtcgggttttcacaaccgtcggcagcgctgaaaaacgggcttatttacaggcccgatttccacagctggactccacatcctttgccaacagccgagacacttcgtttgagcagcacgtcctgtggcataccgggggaaaaggcgtcgatcttgtgcttaatagtctggccgaagaaaaacttcaggcgagcgtgcgttgtctcgcaactcacggacgattcctcgaaattggtaagttcgacctgtctcagaaccaccctctagggatggccatttttctaaagaacgtcacctttcacggtgtactgctggacgcattttttaacgagtcttcggctgactggcgcgaagtgtgggcactcgtgcaggcaggcatccgggacggagtcgtgaggccactgaagtgtacggttttccatggggctcaggtggaggatgcttttcgatatatggctcagggaaaacacattgggaaggtagtggtacaggtgttggccgaggagccggaagccgtcttgaaaggagccaagcccaaattaatgagtgccatctccaagaccttttgcccggctcacaagagctacataattgcaggaggcctcgggggtttcgggttagaactggcccagtggctgatccagaggggggtccaaaaactggtccttacaagcaggtctgggataaggacaggctaccaggcaaagcaggtaaggcggtggcggaggcagggtgtccaggtccaggtaagcactagtaatatctccagtcttgaaggggcaaggggtctgatagctgaggccgctcagttgggcccagtgggaggagtatttaacctggccgtggtgctgcgggacggactgctagaaaaccagacccctgagtttttccaggatgtatgtaagcccaagtactccggtacactcaacctggaccgagttacgagagaggcttgcccagagctggattattttgttgtgttttcttcggtcagctgcggccgtggaaacgcaggacagagtaattatggtttcgctaattcagccatggagcgcatatgcgagaagcggagacacgaagggcttccaggcctggcggttcagtggggcgctattggtgacgtgggcattctggtggaaactatgagcaccaacgatacaattgtctccggaaccctgcctcaaagaatggcaagctgtttggaggtcctcgatctttttcttaaccagcctcatatggtcctgtctagcttcgtgctggccgagaaagcagccgcataccgagatcgagatagccagagagacctggtggaggctgttgcacatatccttgggattcgagacttagcagccgtgaacctggacagctctctggcagatcttgggctggattcactcatgtctgtcgaggtgcgccagactctagagagagaactcaatctagttctgagcgtccgcgaggttaggcagctgacccttcgaaagctgcaggagcttagtagtaaggccgacgaggcttctgagctggcatgtcccacccccaaagaagacggcttggcacagcagcagacacaattaaacctgcgctccttacttgtgaatcccgagggacccaccctgatgaggttaaattccgtgcaaagctctgaacgtcccctctttttggtgcaccccatcgagggcagcacaaccgtatttcattctctggccagccggttgtcaattcccacgtatgggctgcagtgtaccagggcagcacccctggacagtatccactccctggccgcttattacatagactgcataaggcaggtccagcccgaagggccttacagagtcgcagggtactcctatggcgcttgcgtcgcattcgaaatgtgtagccaactccaggctcagcagagccccgctccgacacacaattccctcttcctgttcgacggatcaccgacatatgttttggcctacacccagtcctaccgcgcaaaactcacaccaggttgcgaggccgaggcagaaacagaagccatttgttttttcgtacagcagtttaccgatatggaacataatagagtactcgaggcgctactgcctctgaagggtctggaggagagagtcgccgctgctgttgacttaatcattaaatctcaccagggactagatcgccaggaactgagctttgcagcaaggtccttttactataaactcagggccgcagagcaatacacaccgaaggcaaaataccacggtaacgtgatgcttctcagggcaaagacgggtggggcatacggcgaggaccttggcgcagactataatttgtcgcaagtgtgtgacggtaaagtgagcgtgcacgtcatcgagggggaccaccggacccttctggagggatcaggattagaatccataataagcattattcatagctcactagccgagccaagagtttctgtgcgcgagggataa

SEQ ID NO: 28640 - DNA, 2502 bp, Artificial Sequence
  Description of Artificial Sequence: Synthetic coding sequence
atgtctatcctcggcagcgccaaacatggactgtacctgccgacacgcgtgaccgctatccacattgaccccgctacgcacagacagaaactgtacacgctccaagacaaagcccaggtcgctgatgttgtggtcagtcgctggcttagagtgacggtagctggcggagtccacataagcggcctacataccgagtccgccccacggcgacagcaggaacagcaagtgcctatcttagagaagttttgctttacccctcacaccgaggagggatgcttgtcagagcgcgctgcactccaggaggagctccagctgtgcaagggcctggtgcaggctctgcagaccaaggtgactcaacaagggctgaaaatggtcgtgcctggccttgacggagcccagatcccccgagatcccagccagcaggaacttcctcgcctattgtccgctgcctgtcgcctccaactcaatgggaatctgcagctcgaacttgcacaggtgctggctcaggagagacccaagctgcctgaggaccccctgctgagtggccttttggactctcctgccctgaaagcatgccttgataccgcggtcgagaacatgcccagcttgaagatgaaagttgtggaagtgttggcaggtcacggacatctgtactctcggattcccggactgttgagcccacatcctctgctgcagttatcctacacagcgaccgatcgccatccacaagccctggaagctgctcaggctgagttgcagcagcatgatgtggcccagggtcagtgggaccccgcagacccagcacctagcgcccttggaagtgcggacctgctggtatgcaattgtgcagttgccgctctgggggacccagccagtgcgctctctaacatggttgctgccctccgcgaggggggtttcctgttgctccacaccctcctgcgaggccatccactgggcgatatcgtcgccttcttgactagtacagaaccacagtacggacaaggcattttgtcacaggacgcttgggagtcactcttcagccgagtttctctcaggctcgtcggtctcaaaaagtcattctacggcagcacattgtttctatgtcggcgaccgaccccccaagatagccctatctttctccccgtggatgacacgtcctttaggtgggtggagagccttaaaggtatccttgcagatgaggattcttccagaccagtgtggctcaaagccataaactgtgccacctctggggtggttggccttgtaaactgtctaagaagggagccaggtgggaaccggctgaggtgcgtgctcctgtcaaacctatcttctacctcccacgttcctgaagtcgatcctggtagcgctgagctccagaaggtcctgcagggggaccttgtcatgaatgtctaccgcgacggagcttggggagcattccggcactttctgctggaggaggacaagcccgaggagccaacggcacacgcctttgtgtctactttgacacgaggggatttatcatctattcgatgggtgtgctccagcctgaggcacgcccagcctacatgccccggagctcagttatgcaccgtgtattacgcctctctgaacttccgggacatcatgctggctacaggaaaactgtcacctgacgctatccctggaaaatggacatctcaagattctctgctgggcatggagtttagtggacgcgacgcgagtggaaagcgcgtcatgggcctggtgccagccaaaggactagctacttcagtgctccttagtccggatttcctatgggatgtgccttcaaattggaccttggaagaagctgcctccgtccccgttgtgtactccacagcctactacgccctggttgtcagaggtagggtccggcctggggaaacgctgctcatccacagtgggagcggcggtgttgggcaggccgcaatcgccatcgcgctgtctcttggttgccgggtcttcacgacggtgggctccgccgaaaaaagggcttacctgcaagcaaggtttccgcagctcgactccacatccttcgctaatagcagggacactagtttcgagcagcacgtgctgtggcataccggcggaaagggggtggacttggtgctgaacagcctagccgaggaaaagctgcaggcctcagtgcggtgtctagccacacacgggcgatttctggagatcggcaaatttgacctgtcccagaaccaccctcttggtatggctatttttttaaaaaacgtgacattccatggagttttgctggatgctttttttaatgagtcctctgcagactggcgtgaggtgtgggctctagtacaggccggaatacgagacggcgtggttcgaccattaaagtgtactgtgtttcacggcgcacaggtggaggacgcattccggtatatggcccaggccaaggcatcgcaggcctggccctgtagtggcgctcctagcgccacatgggccttctggtggcgcaggtag

SEQ ID NO: 28641 - DNA, 1143 bp, Artificial Sequence
  Description of Artificial Sequence: Synthetic coding sequence
atgatgttcagcgggtttaatgcagactatgaggcctcttctagcaggtgtagctccgctagtcccgcaggtgatagtctgagctattaccattctcccgctgattcattttcctccatgggtagtcctgttaatgcccaggacttctgtaccgacctggcagtgagctcggcaaattttatccctacagtgacagctatttcgacttcaccggaccttcaatggctggtgcagcccgcactcgtgtcgtcagtcgccccttctcagactcgcgctccccatccatttggcgtgccggcaccatccgccggagcctattcccgcgcaggtgtagtgaaaacaatgactgggggaagagctcaaagcatcggcagacgcggtaaagtcgagcagctttccccggaagaagaggagaagcgaagaatccgcagagagagaaacaaaatggcggcagcaaaatgtaggaacagacggcgagaactgaccgatacccttcaagccgaaaccgaccagctggaagacgagaagtccgcgctgcagacagagattgcaaatttgttgaaggaaaaggaaaagctggagtttatcctggcagcccaccgacctgcgtgtaagattcccgacgatctagggttccctgaggaaatgtctgtcgccagtcttgacttgaccgggggtctgccagaagtcgccacccccgagtccgaagaggcctttacactcccactgttaaacgacccagagcccaagccgtctgtcgagcctgtgaaatcaatttcaagcatggagctgaaaacggaaccatttgacgattttctctttccagcctcttccaggccttcaggatcggagacggcccgtagcgtacctgacatggatctgtccggtagtttctatgccgctgactgggaacctctccacagtgggtcgttaggcatgggtccaatggcaacagagttggaaccattatgtacccctgtcgtgacctgtaccccgtcttgtactgcctatacctccagttttgttttcacgtaccctgaggccgacagcttcccgtcctgtgctgcggcacatagaaaaggatcctcatctaatgagccctcctctgactcactctcaagcccaaccctactggccctgtag

SEQ ID NO: 28642 - DNA, 966 bp, Artificial Sequence
  Description of Artificial Sequence: Synthetic coding sequence
atggaggagggccaatatagtgagatcgaggagctcccccgtcgaagatgttgtaggcggggaacccaaatcgtccttctaggcctggtgaccgccgctctgtgggccggattgctgaccctgttactgctgtggcactgggataccactcagagtttaaaacaactcgaggagagagccgcacgcaacgtttcccaagtgtccaagaatctggagtcgcaccacggagaccagatggcccaaaagtcccaaagcacgcagatcagccaagaactggaggagctgagagctgaacaacagcggctgaagagccaggatttagaactgtcgtggaatttaaacggcctacaggccgacttatcgtcgttcaagtcacaggaattgaacgaacggaacgaggcaagcgacctgcttgaaagactgagggaggaggttacgaagctgcggatggaacttcaggtgtcttcaggttttgtttgcaacacttgcccggaaaagtggattaacttccagcgcaagtgctactattttgggaaaggaaccaagcagtgggtccatgcccgttacgcgtgcgacgacatggaaggccagctagtctctatccactcccctgaagaacaggatttcctcactaaacatgccagtcacactgggtcatggatcggattgagaaacctcgatctgaagggggagtttatttgggtagatggaagtcacgtcgactacagcaattgggcccctggtgagcccacttcccggtcacaaggcgaagactgcgtgatgatgcggggttcaggcagatggaacgatgccttctgtgacagaaagttaggggcatgggtttgcgatcggctggcgacatgcaccccgcctgcttctgagggtagtgccgagagcatgggaccggactcccggcctgatcccgatggaagattgccaactcccagcgccccactgcactcctag

SEQ ID NO: 28643 - DNA, 963 bp, Artificial Sequence
  Description of Artificial Sequence: Synthetic coding sequence
atgaatcctccgtcacaagagattgaagagttgcctcggagacgctgctgcagacgagggacccagattgtactgctggggctggtgacagcggctctgtgggcagggctcctaaccctcctgcttttgtggcattgggacactacccaaagtctgaagcagctcgaagaacgggcagcgagaaacgtgtctcaggttagtaaaaacctggagtctcatcatggggaccaaatggcgcagaagtcccaaagcactcaaatttctcaggaactggaagaattgagagccgagcagcaacgtctgaagtcccaggatctggaacttagctggaacctcaacgggctgcaggcagatctaagctcattcaaaagccaggaactgaatgaacgaaacgaggcttccgaccttcttgaacggcttcgggaggaagtcaccaagctgcggatggagttgcaggtttcttccgggttcgtgtgtaacacatgccccgagaaatggattaattttcagcgcaaatgttattattttggtaagggaactaaacaatgggttcacgcaaggtacgcctgtgatgacatggagggacagctggtgagtatccacagtcccgaggagcaagacttcctcacgaagcatgcatcccataccggaagttggataggactgcgcaacctcgatttaaagggtgaattcatctgggtggatggatcacacgtggactattccaattgggctcctggtgaaccaactagcagaagccagggtgaagactgcgtgatgatgagaggaagtggtagatggaacgatgccttttgcgacagaaagctgggcgcttgggtgtgcgaccgtctggctacctgtactccacctgcaagcgaaggaagtgctgagagcatgggccctgactcccgccctgaccccgatgggcgactgccaactccaagcgccccacttcactcctag

SEQ ID NO: 28644 - DNA, 1125 bp, Artificial Sequence
  Description of Artificial Sequence: Synthetic coding sequence
atgtggttcctcaccaccctgctgctgtgggtgcctgtagacggtcaagtagacactacaaaagccgttatcacactgcagcccccatgggtcagcgtgtttcaggaagaaactgtcactctgcattgtgaggtccttcatttgcccggatcctctagtactcagtggtttctgaatgggaccgcaacacaaacatccaccccttcatacagaataacatctgctagcgttaatgactcgggggaatatcgttgccaacgcggattgtctggaaggtccgatcccattcagctcgagattcaccgtggttggctcttgttgcaggtcagtagtcgagtattcacagagggggagccactcgccttacggtgccatgcttggaaggataaactggtgtataatgtcctgtactaccgcaacggtaaggcattcaagttttttcactggaattcgaacctaacaatactgaaaactaacatttcccacaacggtacgtatcactgttccggaatgggaaagcatagatatacttccgcaggcatctccgtcacggtgaaagagctttttccagcccctgtgctgaatgcaagcgttactagtcctctgctcgaaggcaacctggttacactctcatgtgaaacaaagcttcttctccagcgccctggtcttcaactctatttctctttctacatgggctcgaaaaccctacgtggcaggaatacttcctcagaataccagattctgacagccaggcgcgaagactcggggctatattggtgtgaggccgcaaccgaggacggaaacgtactgaagcgctcacccgagcttgagttgcaggtactgggccttcagctgcctaccccagtatggttccatgtgctgttctacctcgcagttggtattatgttcctggtaaacacggtgctatgggttacaatccgcaaggaactgaaaaggaaaaaaaaatgggacttagagatctccctggattcggggcatgaaaagaaagtgatctcaagcctgcaggaagatcgccacctcgaggaggagctgaaatgtcaggagcaaaaagaggaacagctgcaggagggggtccacagaaaggagccacaaggcgcaacctag

SEQ ID NO: 28645 - DNA, 723 bp, Artificial Sequence
  Description of Artificial Sequence: Synthetic coding sequence
atgtggttcctgacgacactgctgctctgggggtggttattgcttcaagtgtctagcagggtcttcacagagggcgaacccctagccctgagatgccatgcctggaaggataaattggtgtacaacgtgctttactatagaaacggaaaggcatttaaatttttccactggaattcaaacttaactattttaaaaactaatatcagccataacggcacttatcattgcagcgggatgggaaagcacaggtacacatctgctgggattagtgtgaccgtgaaggagctgttccccgcacctgtgctcaacgccagcgtgacatcacctctccttgaggggaatctggtcaccctaagctgcgagactaagctcctgctgcagcgccctggactccagctttacttttcgttttacatgggatcgaaaactctgcgcggtcgcaacacttccagtgagtatcaaatcctgactgccaggcgcgaggactccggcctgtattggtgtgaggcagccacagaggacgggaacgttctcaagaggtcacctgagctggagttgcaggtcctgggcttgcagcttcctacccctgtgtggttccacgttctcttctatttggccgtgggaatcatgttcctcgtgaacacggtgctgtgggtgacgatccgcaaagagctgaagcggaaaaagaagtgggacttagagatctctctggactcgggatag

SEQ ID NO: 28646 - DNA, 2469 bp, Artificial Sequence
  Description of Artificial Sequence: Synthetic coding sequence
atgggattttcgagcgaactgtgcagccctcagggtcacggggtgctccagcagatgcaggaagccgaactgaggttgctagaagggatgcggaaatggatggcccaacgagtcaagtccgatcgcgagtacgcaggcctgctgcaccatatgtccctgcaagactcaggtggccaaagcagggccatatcgccagatagccctatcagtcagagctgggcggagatcacctcacagacagaggggttgtcgaggctactccggcagcacgccgaggatctcaattctggacccctgagtaagctgagcctgctgattcgagaaagacagcagctgcggaagacctattctgagcaatggcagcagctgcagcaagaattaacaaagactcattcacaggacattgagaaactgaaatcgcagtacagggcacttgcgcgtgactccgcgcaggcaaagcggaaatatcaggaggcgtctaaggacaaagaccgcgataaagccaaggataaatacgtccgttcgctctggaagctatttgcccaccataaccgctacgtgcttggagtgcgcgcagcacaattgcatcaccagcatcaccatcagctcttactgccagggctgctacgttccctccaggatcttcatgaggagatggcatgcatattgaaagaaattctacaggagtacctggagattagttctctcgtgcaggacgaggtcgtcgctatacatagagagatggctgccgcagcagccaggattcagcccgaagctgaataccaggggttcctgcgtcaatacggctccgcacctgatgtcccaccttgtgtcacgtttgatgagtcccttcttgaggagggagaaccgttagaacctggagagttacagctcaacgaacttactgtggaatcagttcaacataccttgacctcagtgaccgatgaactggccgtggcaaccgaaatggtattcagacgtcaagaaatggtgactcagctccaacaagagctgcgcaacgaggaggagaatacccaccccagagaaagagttcagctgctggggaaacggcaggtcctgcaggaggcactgcagggactccaagtagctttatgctcccaggctaagctacaggcccagcaagaactgctgcagactaaactggagcacctggggcctggggagcccccacctgtattgttattacaggacgacagacacagtacgagttctagcgagcaagaacgggaaggaggacgcacgcccacactggagatcctcaagtcgcacatttctgggatcttccggcctaagttcagcctgccgccaccactgcaactgattccagaggtgcagaagcctctccatgagcagctctggtatcacggcgcaattccgagggcagaagtggccgagctgcttgtgcacagcggtgactttttggtgcgcgaatcgcagggcaaacaggaatatgtgttatcagtgctgtgggacggcctgcctagacacttcattattcagtcactggacaatctctaccggttggaaggcgaggggttccctagcatcccactcctcatcgaccatctgctaagtacccagcaacccctgactaaaaagtctggcgtagtgctacaccgggctgtgcctaaagataagtgggtgctaaaccatgaggatcttgtattaggggaacagatagggaggggcaacttcggcgaggtttttagcggtagattgcgtgccgataataccctcgtggctgtgaagtcatgccgcgagactctgccccctgacctgaaggcgaaattcctacaggaggcccgaatattgaagcagtatagccatccaaacatcgtccgcctcatcggcgtatgcacgcaaaagcagcctatatacatagttatggagttagtccaaggcggagactttctaacttttcttcggacggagggggcacgcctgcgagtgaagactctactccaaatggtgggggatgccgctgcgggaatggagtatttggagagcaagtgctgtattcaccgggacctggctgctagaaattgcctggttactgagaagaacgtgttgaagatttctgattttgggatgtctagagaagaggccgacggggtgtacgccgcaagtggcggattgaggcaggtaccagtaaaatggaccgccccagaggccctcaattacggtcgctatagctcggagtccgacgtgtggagttttggaatccttctgtgggagactttctccctcggcgcatcaccctaccccaatctgtctaatcaacagactcgcgagtttgtggaaaaaggcggaaggctaccctgccctgagctgtgcccagatgcagtgtttcgactgatggagcaatgttgggcttatgaacctgggcagcgcccttcatttagtaccatttatcaagaattgcagtccatacggaagcgtcaccggtag

SEQ ID NO: 28647 - DNA, 2295 bp, Artificial Sequence
  Description of Artificial Sequence: Synthetic coding sequence
atgggcttcagctctgaactgtgttcacctcaaggccatggggttttgcagcagatgcaagaggcagaacttcggctcttagaaggaatgaggaagtggatggctcagcgggtaaaatccgacagagaatacgccggtctcctacaccacatgtcactgcaggactcaggagggcaatcaagggccatcagtcccgatagccctatatctcagacccactcccaggatatcgaaaaattgaagtctcagtacagagcactggccagggatagcgctcaggccaagcgtaagtaccaggaggctagcaaggacaaggacagagacaaggcaaaagataaatacgtgagatcactttggaagctgtttgcccaccacaatcggtatgttctaggagtgagggcagcccaattgcatcaccaacatcaccaccaactgctgttgcctggcctgctgaggtcacttcaggacctgcatgaggagatggcatgcatcctgaaggagatcctccaggagtacctggaaatcagctctctggttcaggatgaagtggttgccatccatcgggagatggcagccgctgccgcacgcatccagcctgaggccgaataccagggattcctgcgtcagtacggatcagctccggacgtccccccttgtgttacctttgacgagagcctcctggaggagggcgaacccttagagccgggtgaactccaactgaatgagctgactgttgagagcgtccagcataccttaacttccgtcaccgatgagctggccgtcgcaaccgagatggtgtttcgacgccaggaaatggtcacacaactgcagcaagagctgcgcaacgaagaagagaatactcatccccgtgaacgggtccaactgttggggaaacggcaagttctgcaggaagccctacagggattgcaggtggcactgtgcagtcaagctaaactccaagctcagcaggagctgctccagactaaactcgaacatctcgggccaggcgaaccaccgcctgtgcttctgcttcaagacgaccggcactccacgtctagcagcgaacaggaaagagaaggcggacggaccccaactctcgaaatcctaaaatctcatatttccgggatttttcggccaaaattctccctgcccccaccgctacagcttattcctgaagttcaaaagccccttcatgagcagctctggtatcacggggctataccaagagccgaggtcgccgagttgctggtgcactccggagatttccttgtgcgggaatcacagggtaaacaagaatacgtccttagcgtcctctgggatggactgccacgacacttcataattcagtcacttgataacctgtatcgtttagaaggggaagggtttccaagcatccccttattgattgaccatctgctttcaactcagcagcctcttactaaaaaaagcggagtggtgctgcacagggcagtgcccaaagataaatgggtgctgaatcatgaggatttggttttgggtgaacagattgggaggggcaacttcggagaagttttcagtggacgtctgagagccgacaacaccctggtagctgtgaaatcctgtagggaaactctgccaccagacctaaaggccaagtttctgcaagaagcccgtattctgaagcagtacagccaccctaacatcgttcggcttattggcgtttgtacccagaaacagcctatttatattgtcatggaattagtccagggcggtgactttctcactttcttacggaccgaaggagcacgcctcagggtgaaaacattgctccagatggtcggcgatgcagccgctggcatggaatatctggaatcaaaatgctgcatccatagggacctcgccgctagaaattgcctggttactgagaaaaacgtgctcaagatctcagactttggaatgtccagggaagaggcagacggggtgtacgcagctagtgggggtttgagacaagtgccagttaaatggactgcgcctgaagctctgaattatggcaggtattccagcgaatcagacgtttggtctttcggtatccttctttgggagactttctcacttggcgctagtccatatccgaacctttcaaatcagcaaactagagagttcgtggaaaaggggggaaggctgccttgtcccgaactctgcccggacgctgtctttaggctcatggagcagtgttgggcttacgaacccggtcaaagaccatccttttctacaatctaccaagaactgcagtctatccggaagcgacacagatag

SEQ ID NO: 28648 - DNA, 2046 bp, Artificial Sequence
  Description of Artificial Sequence: Synthetic coding sequence
atgggtttttccagtgagctgtgtagtccccagggccacggagtcctgcagcaaatgcaggaagctgaactgagacttttggagggcatgaggaaatggatggcccaaagagtcaaatctgacagggagtacgctgggcttctgcatcatatgtccttacaggactctgggggtcagagccgggcaatcagtcctgatagtccaatttctcagacacattcgcaagacatcgagaaattgaaatcccaataccgcgctctggccagagactctgcacaggctaaacggaaataccaggaggcttctaaagataaggatcgcgataaggcaaaagacaagtacgttaggtctttgtggaagcttttcgctcaccacaatcggtatgtcctgggggtgagagctgcgcaactgcaccaccaacatcatcaccagctgttactgcccggtctcttacgcagtctgcaggaccttcacgaagagatggcttgtattttgaaagagatcctacaagagtatttagagatctcctccctcgtccaggatgaagtagtggccattcatcgggaaatggcagcagcagcagcacgcattcagccggaagcagagtaccaagggtttctgcgacagtacggatcagcgccagatgtgcctccatgcgtgacatttgacgagtccctgctggaggagggtgagccccttgagcccggagaactccaattgaatgagctcactgtggagtccgtgcagcatacccttacgagcgtcactgacgagctggcagtggccacagaaatggtattcagacgccaagaaatggtgacgcaattgcagcaagaactacggaacgaggaagaaaatacgcatcctagggagagagtccagctcctgggtaaacgtcaggtcttgcaggaagctcttcaggggttgcaagtggctttatgctcgcaggccaaactgcaggcacagcaggaactgctgcaaactaagcttgagcacttgggaccaggagagccccctcctgttctgctccttcaagatgataggcacagcaccagctctagcgagcaagagcgggaagggggaagaaccccaaccctggaaatcctgaagagccatatcagcggcattttcagacccaagtttagtaacctatatagactcgaaggcgagggattcccatcaattcccctgcttattgatcatttgctctctacacagcaacccctgacaaaaaagtccggggttgtcctgcatcgcgcagtgcccaaggacaaatgggtgctcaaccacgaagatctcgtccttggtgagcaaattggacgtggtaactttggcgaggtattctccggcaggctgcgcgcagacaacactctcgtggcagtgaagtcttgccgtgaaaccttgccccctgacctcaaggccaagttcttgcaggaagccagaagcagcccatccacctcgtcatggagtctgtgcagagggtcttcacctcctgcaggtggcgatttccttaccttcctccgcacggagggcgctaggttacgggtgaagactttgctgcagatggttggcgatgccgctgcgggaatggagtacctagagtccaagtgctgtatccatcgggacctggccgctcggaattgtctcgtcactgagaagaatgttctcaaaatctctgattttggtatgagtcgagaggaagctgatggcgtttatgccgcatccggtggactgagacaagtgcctgttaaatggacggcaccagaggcactcaattacggtagatacagcagtgaaagcgacgtctggagcttcgggatactgctttgggagacttttagcctcggcgctagtccctatcccaatctctctaatcaacagactcgcgagtttgtggaaaaaggagggaggttgccatgcccggaactgtgccccgacgccgtgttccggttaatggagcagtgttgggcatacgagccaggacaaagaccaagcttctcgaccatctaccaagaacttcagtctattcgcaagcgccaccgctag

SEQ ID NO: 28649 - DNA, 2085 bp, Artificial Sequence
  Description of Artificial Sequence: Synthetic coding sequence
atgggtttctccagcgagctatgcagcccacaggggcatggagtcttgcaacagatgcaagaagccgaactgcgcttgctcgaggggatgcgcaagtggatggcccagagagtgaaatcagatcgggaatacgctggactgttacaccatatgagcttacaagattctggcggtcagtcgcgcgctatcagcccggactctccaattagccaaacgcatagccaggacatcgagaagttgaagagccagtacagggctctggctcgggactcagcccaggctaagcgaaagtaccaggaggcttcaaaagacaaggatagagacaaggccaaggacaaatatgtgcgctccctgtggaaactctttgctcaccacaacaggtacgtgctgggggttcgagctgcccagctgcaccaccagcaccaccatcaactgttgctcccgggattgctgaggtcactacaagatctgcatgaggagatggcctgcatactgaaagagatcctgcaagagtacctggagatctctagcctggtccaggacgaggtggtggcgattcacagggagatggctgccgctgctgctcggatccagccagaagccgagtaccaggggtttctgcggcagtatggatccgcgccagacgtcccaccgtgtgtgaccttcgatgagagtctgctcgaagagggcgagccactggagccaggtgagctccagttaaacgagttaacggtggagtctgtgcagcacactctcacgagcgtgaccgacgagttggccgtagccaccgaaatggtttttcgccgacaggaaatggtaacacagctacagcaggagttgcgcaatgaggaagagaatacgcacccacgtgagagggtgcagctgttggggaagcgtcaagtcctgcaagaagctctgcagggactccaggttgccctgtgtagtcaggcgaaattacaggcccagcaggaactgctgcagacaaagctcgagcatcttggccctggtgagcccccacctgtcttattacttcaggatgatcgccatagcacctcctcatcagaacaggagcgagaaggcggaagaaccccaacactggagatcttaaagagccacatcagcggtatatttaggcccaagttctccaatctttaccggctggagggcgaggggttccccagcatccctctcctcatcgatcatctgctcagcacacagcagcctctgacgaagaagtccggcgtggtcctacaccgagccgtgcccaaagacaagtgggttctcaatcatgaagaccttgtgctcggcgaacaaatcgggagaggcaattttggagaagtcttctccggacggctgagggcagacaacacgctggtggcggtgaagtcctgcagggagaccctccctccggaccttaaagccaaattcctgcaggaagccaggatactgaagcagtactcccatcctaatatcgtgaggctgattggagtctgtacccaaaagcagcctatatatatagtgatggagctggtgcaagggggtgattttctgacatttcttcgtactgaaggggctcgacttcgagttaaaactctactacaaatggtaggtgacgcagctgcaggcatggaatatctggaaagcaagtgttgcattcaccgtgatctcgccgctagaaactgtctggtcactgaaaaaaatgtacttaagatcagcgactttgggatgtccagggaagaggcggatggcgtctacgctgccagcgggggactgagacaggtgcccgttaagtggacagcaccggaagcgctgaattacggaaggtatagcagtgaatcggatgtctggtcatttggtattctcttatgggaaactttctcgctgggcgcaagcccctatcccaacctgtccaatcagcagacacgggagtttgtcgaaaagggcggacgtctcccttgccccgaactgtgtcccgacgccgtgttccgtctcatggaacaatgttgggcctacgagcccggacaaaggccctctttctccaccatctatcaggagctgcagtcaatccgaaaaagacataggtag

SEQ ID NO: 28650 - DNA, 129 bp, Artificial Sequence
  Description of Artificial Sequence: Synthetic coding sequence
atgggcttcagcagtgaactgtgctcccctcagggccacggggtgctgcaacaaatgcaggaggcagagctgcggctcctggagggtatgaggaaatggatggctcagcgagtgaaaagcgatagatag

SEQ ID NO: 28651 - DNA, 348 bp, Artificial Sequence
  Description of Artificial Sequence: Synthetic coding sequence
atgggcttctcgtcggaactctgcagccctcagggacacggcgttctgcagcagatgcaggaggccgagctgcgattactcgagggtatgaggaaatggatggcccagcgggttaagagcgacagggagtacgcagggctgctacaccacatgagccttcaagatagcgggggacagagtcgtgccataagccctgattctccaatctcccagtcgtgggccgaaataactagccagaccgaggggctcagtaggcttctgaggcagcacgccgaggatctaaattcagggcctctgtcaaagcttagtcttctaattcgggagcggcaacaacttcgtaagacatag

SEQ ID NO: 28652 - DNA, 2259 bp, Artificial Sequence
  Description of Artificial Sequence: Synthetic coding sequence
atgggctttagttccgaactgtgctcccctcagggtcacggtgttctgcagcagatgcaggaagcagaactccgcttgttggaagggatgcggaaatggatggcccaacgtgtgaagagcgaccgggaatacgcaggcctgctccatcatatgtcgcttcaggacagtgggggacagagtagagccatttcccccgactcaccgatttctcagagctgggctgagattacctcccagacagaggggctgagtcgactactgcggcagcacgctgaagacctcaattctgggcctttatctaagcttagtctgcttatccgggagaggcagcagctgaggaagacgtattcagaacaatggcagcaacttcagcaggagttgaccaagacacattctcaagacattgaaaagctaaagagtcagtaccgcgctctggccagggatagtgcacaagcaaagaggaagtaccaggaggcctcaaaagacaaggaccgcgacaaagctaaagataaatacgtcaggtccctgtggaaactattcgcacatcacaaccggtacgttctaggcgtgagagctgcacagcttcaccatcagcaccatcaccagctccttcttccaggcttgctgcgaagcctgcaggacttgcatgaagagatggcttgcattctcaaggagatactgcaggaatatcttgagatctccagcctggtgcaggatgaagtagtcgccatccaccgagaaatggcagctgccgctgcacgaattcaacctgaggcagaataccaggggttcctcagacagtacggctcagcacctgacgttcctccctgcgtgacattcgacgagtctctgttagaggaaggtgagccactcgagcctggcgagttgcagctgaatgaacttacagtggaatccgtacagcacacactgacttcagtgaccgatgaactggcagttgctaccgagatggtgttccgcagacaggagatggtcacacagctgcagcaggaactgcgcaacgaggaggaaaatacccatccaagagagcgtgttcagctgctgggcaagcgacaggtcctccaagaggctctgcaggggctgcaggtagctctctgctcacaggccaagttacaggcgcagcaggagctgctgcagacgaagctggagcacctgggccctggggaaccgcctcccgtgctgctgctccaagacgatcgccacagtacatcatcatcagagcaggagagggaaggaggcaggacccccacactggaaatcctgaagtcgcacatttccggcatatttcgaccaaaattttcaaacctctaccggcttgagggtgaggggttccccagtattccgctgttaatcgaccatttgctgagcacccagcaaccattgaccaagaaaagcggcgtggtgttacatcgagccgttcctaaggacaagtgggtgttgaatcacgaggatctcgtcctaggagagcaaatcggccgaggtaattttggtgaggtgttcagcgggcgactgagggctgacaatacactcgtggcagttaaatcgtgcagagagacattgcccccagacctcaaggccaagttccttcaggaagctcgaatcttaaaacagtactcccaccccaacatagttcgactgattggggtgtgcacacagaagcagcctatctacatcgtaatggaactggtgcaggggggagatttcctgacatttctgcgaaccgaaggtgctagactgagggtgaagaccttattgcagatggtaggggatgctgccgcaggcatggagtatctggaaagcaaatgctgcatccaccgcgacctcgctgcccgaaactgcctcgtcaccgaaaagaatgttctgaagatttcagatttcggcatgagccgtgaagaggcggacggggtgtacgcagcctccggcggtctgagacaggtgccagtgaaatggactgcacccgaagccctgaactatgggagatacagtagcgagtccgatgtctggtctttcgggatattactgtgggaaactttctcattgggtgcaagtccctatcccaacttaagtaatcagcagacccgtgagttcgtggagaaagggggtaggctgccttgccccgaactgtgcccagacgcagtctttcgccttatggaacagtgctgggcctacgagcctggacagaggcctagcttcagcaccatttatcaagaactccagtcaatcagaaaaaggcatagatag

SEQ ID NO: 28653 - DNA, 2085 bp, Artificial Sequence
  Description of Artificial Sequence: Synthetic coding sequence
atgggcttttctagtgagctatgcagccctcagggtcacggcgtgctgcagcagatgcaggaagctgaactccggctgctggaaggaatgaggaagtggatggctcagagagtgaaaagtgatagagagtacgctggtctactacaccatatgtctctccaggattctggcggacagtcaagagccatctccccggattccccaatttctcagacccacagccaggacattgagaagctgaaatcccagtaccgagccctcgcgagggacagtgcccaggccaaaaggaaataccaggaggccagcaaagataaggatcgggataaggctaaggataagtacgtgcgatctctgtggaaactgttcgctcatcataataggtacgttctgggagtgagagccgctcagcttcaccaccagcatcaccatcagctgctgctccccggtcttctgagatctctgcaggatctccacgaggagatggcatgcatactgaaggaaatactccaggagtatctggaaatctcgtctctagtccaggatgaggtcgtagctattcaccgcgaaatggccgctgctgccgctcggatccagcctgaggcagagtaccaaggattcctgcggcaatatggatcagctcccgatgtacccccatgcgtgacattcgatgagtctctgttagaggagggtgaacctctggagcccggagaactgcaactgaatgaattaacggtcgagtccgtccaacacacactgacaagcgtgactgatgaactggctgtggccacggaaatggttttccgaagacaagagatggttacccaactgcagcaggaactgcggaatgaggaggagaacacacatcctcgcgagcgcgtgcagctcctgggtaagcggcaggtcctccaggaggcgctccagggcctgcaagtggccctctgtagccaggctaagcttcaagcccagcaggaactgctgcaaactaagctagagcacttgggtcccggagagcccccaccagtactgctcctgcaggacgaccgccattcaacatctagctcggaacaggagagggagggtggaaggactccaaccttggaaatactcaaatcacacattagtgggatctttcgacccaagtttagcaatctgtacagactggagggcgaagggttccctagcatccccctgttaatcgatcacctcttgagtacccagcaacccctcaccaagaaatcaggggttgtgctacatcgagctgtgcccaaggacaaatgggtcttgaatcacgaggatcttgtcctgggtgagcagattggacgtggaaactttggcgaggtgttctcaggacgtctacgcgctgacaacacacttgtggcggtcaaatcatgtagagaaacgctgccccctgatcttaaggcaaagttcctgcaggaggccagaattctgaaacagtattctcacccaaatattgtaagattgataggcgtgtgtacccagaagcaaccgatctacattgttatggaattggtgcaaggaggagattttctgacttttttgcgcacggaaggtgcccgactgcgggtcaagacccttctgcaaatggtgggagatgcagccgctggcatggaatatcttgagtccaaatgctgcattcatcgcgatttggccgctagaaattgtctcgtgacagagaaaaatgtactgaaaatctccgattttggcatgagtcgtgaagaggctgacggtgtatacgcagcatctgggggactccgacaggtgcccgtcaagtggaccgctccagaagccctcaactacgggagatatagctccgagtccgacgtctggagtttcggaattctgctctgggaaaccttctctctgggagctagcccgtaccccaacttatcaaatcagcaaaccagagaattcgtggaaaaggggggacggctgccgtgtcccgagctgtgccctgatgctgtgtttcgcctcatggagcagtgctgggcctacgagcccggacagagacctagtttctccacaatataccaggagcttcagtcaattaggaaaagacatcgatag

SEQ ID NO: 28654 - DNA, 444 bp, Artificial Sequence
  Description of Artificial Sequence: Synthetic coding sequence
atgggtttctccagcgagctatgttcaccacagggccacggtgtgttacagcaaatgcaggaggcagaattacgcttgcttgaaggcatgcgtaaatggatggcacaaagagtgaagtccgacagggagtatgctggactccttcatcatatgagccttcaagacagtggagggcagtcccgggctatttctccagattcgcctatcagccagtcttgggctgaaatcacaagtcagacggaggggctgagtaggcttctccgacagcacgccgaagacttgaactccgggccattaagtaaactgtcacttttgataagagaaagacaacagctgcggaagacctacagtgagcagtggcaacagttacagcaagaactgactaaaacccactcccaggacatcgagaaactcaagtcccagtacagagcccttgcccgatag

SEQ ID NO: 28655 - DNA, 1638 bp, Artificial Sequence
  Description of Artificial Sequence: Synthetic coding sequence
atgggtttttcctccgaactctgctccccacaggggcatggcgtgctgcagcaaatgcaggaggccgaactccgcctactggaagggatgaggaaatggatggcacagcgcgtgaagtcagatagggagtatgccggattactccatcatatgtccctacaagactctggaggccagtcgcgcgctatcagccccgacagccctatcagtcaaagctgggccgagatcacctctcagactgagggcctgagcaggcttcttcgccaacacgcagaggacttgaactcaggacccctctccaaactcagtctgttgatccgggagcggcagcaactgcgcaagacgtattcagagcagtggcaacagttgcagcaggagctaacaaagacccacagccaggacatagagaagctgaagtctcagtaccgggcactggctcgggactccgctcaggctaagagaaaatatcaagaggcttccaaagataaagacagggacaaagctaaagacaagtacgtgcggtctctttggaaattgtttgcgcatcataaccgctatgtactaggggtaagggccgctcaactgcatcatcagcatcatcatcagctgctgctccccggtctgctgagatccctgcaggacctccacgaagaaatggcctgtatcctgaaagagattctgcaggagtaccttgagatttcaagtctggtccaagatgaggtggtagccattcaccgagaaatggcggcagccgctgccagaatccagccagaagcagagtatcaaggcttcctacggcaatacggctctgctcctgacgtgcctccttgcgtgaccttcgatgagagtcttctggaggaaggtgaacccctcgagcctggggagctgcaacttaatgaactgacagtcgaaagcgtgcagcacacgcttaccagcgtaacagatgagttggccgtagctaccgaaatggtattcaggagacaggagatggtgacacagctgcagcaggaactgcgtaacgaggaagagaacacccatcccagagagagagtgcaactgctggggaagagacaggttctccaagaagctctgcagggactacaagtagctttgtgttcacaggcaaagttgcaggcccagcaagagctgctccagacaaagctggagcacttggggccaggagaacctccccctgtactgctgctccaggatgaccggcattccaccagctcgtcagaacaggaacgcgaagggggaaggacccccacactagaaatactcaaatctcacatcagtggcatttttagacctaagttttctctaccacctcctctgcaactgattcctgaagttcagaagccactgcatgaacagctttggtaccatggcgcaatacctcgcgcagaggtggcggaacttctcgtgcactccggtgattttctggtcagggagagccaaggcaaacaggaatacgtcctgtccgtgctatgggacgggctgcccaggcactttattattcaggcccacgccccttctgaatggagattgttgactcccggtccgcttccctgccgaacatgcaccgattggaaaggcaaagcctttctcgctttcctgtgctcctccacaacatattag

SEQ ID NO: 28656 - DNA, 366 bp, Artificial Sequence
  Description of Artificial Sequence: Synthetic coding sequence
atggggttttcctcagagctttgctctccacaggggcacggggtgctccagcagatgcaagaggcggaattgcgtctcttggaaggcatgaggaaatggatggcccagcgcgtaaagtcagatcgggagtacgcaggcctgcttcaccatatgtcgcttcaggacagcggcggacagagccgggctatcagtcccgattctcctatatcacaggtagggctgtatgggacactggtgggcgctggatgcatctgcttactgctgccattgttgggagccctgtggggaagcgggtggaggtccggcagacctatgcttggctcacattgtgctccactgcctgcgtcccctatctgcgccgtatag

SEQ ID NO: 28657 - DNA, 510 bp, Artificial Sequence
  Description of Artificial Sequence: Synthetic coding sequence
atgggattctcatctgagctgtgtagtccccaggggcacggcgtgctgcaacagatgcaggaggccgagttacgcctgctggaaggcatgaggaaatggatggcgcagagagtgaagagcgacagggagtatgcaggcctccttcatcatatgtccctccaggactccggcggacagagccgagccatttctcccgattcccctattagtcaatcctgggccgagattacaagccagacagaaggtctgtcgcgacttctgcgccagcacgctgaggacctcaattctggcccattgtcaaaattatcactgcttatcagagagcgccagcaacttcggaagacttattcagaacaatggcaacagctgcagcaggagctcactaagacccacagtcaggatattgagaaactgaagagtcagtatagagccctggcccgtgattcagcccaggcaaaaagaaaataccaggaggcaagcaaagataaggatcgggacaaagctaaatag

SEQ ID NO: 28658 - DNA, 2283 bp, Artificial Sequence
  Description of Artificial Sequence: Synthetic coding sequence
atgaaaacttgggtgaagatagtatttggtgttgcaaccagcgcagtgctggctctgctcgtgatgtgcatcgtgctgagacccagccgagtgcataactccgaggaaaacacaatgagggccctcacattgaaggacattctgaatgggacctttagttataagacttttttccccaactggatttcgggtcaggagtacctacatcagagtgccgataataacatcgtgctttacaacatcgagacgggtcagagttacaccatcttgtccaacaggaccatgaaatcagtcaacgctagcaactatggcctctcgccggacaggcagtttgtgtacctcgagtctgactactcaaaactctggcggtacagctatacagccacctattacatttacgacttgtctaacggtgaattcgtaaggggcaacgagctgccacggcctattcagtacctgtgctggagtcctgttgggtccaagttggcttacgtttaccagaataacatttacctgaagcagagacctggagacccaccttttcaaattacattcaatgggagagaaaataaaattttcaatgggatccccgactgggtctacgaagaagagatgctcgcgacaaaatatgccctgtggtggtctccgaacggaaagtttctcgcgtacgccgagttcaacgatactgacatccctgttatcgcctatagttactatggagacgagcaatatcctaggacaattaacatcccttatccaaaagccggagcgaagaacccggtcgtgcgcatcttcatcatagataccacctacccggcttacgtgggaccacaggaggtccccgtccctgctatgatcgcctcttccgattactacttttcctggctaacatgggtgacagacgaaagggtgtgtttacagtggctcaagagggttcagaatgtctccgtcttatcaatttgcgacttcagggaagattggcaaacctgggattgtcccaagacccaggaacatattgaagagtcccgcactggatgggccggagggttcttcgtctctacccctgtcttcagttacgacgctatctcttactataagatcttctctgacaaggacggctataaacatattcactatataaaggacactgtcgagaacgctatccaaattacaagtgggaaatgggaggcaatcaatatcttcagggtgacacaggactctttattctactcctcaaatgaattcgaagagtaccccggacgaagaaatatctatcgcatttcaattggctcttaccccccatcaaaaaaatgcgtgacctgccacctgaggaaagaacgatgtcaatattatacagcttccttttcagattatgcgaagtactatgctctggtctgttatggaccaggcatccccatctccacactgcatgacgggcgtacagaccaggaaattaagatcttggaagagaacaaggagttagaaaacgctcttaaaaacatccagctgcccaaagaggagataaagaaactagaggttgacgagattacactgtggtacaagatgattctgcctcctcagtttgacagaagtaagaagtaccccctgcttatccaggtctacggtggcccatgtagccagagcgtgcgcagcgtctttgccgtgaactggatctcttaccttgcctccaaggaaggaatggtaatagccttagttgatggtcgcggtactgcttttcagggagacaagctgctttacgccgtgtatcgcaagcttggggtgtatgaggtcgaggaccagatcactgcagttcgtaaattcattgaaatgggcttcatcgacgagaagcgcatcgccatttggggatggtcatatggaggctatgtgagcagcctagctctcgcctctggtactgggctcttcaaatgcggcattgcagtagcgcctgtatcctcctgggagtattatgctagcgtgtataccgagagatttatgggattgcctaccaaagatgacaatttggagcattataaaaactccacagtaatggccagagccgagtacttcaggaacgtcgattatctgctgattcacggcactgcggatgacaatgtgcactttcagaactccgcgcagatcgccaaagccctggttaatgcccaagtcgactttcaggccatgtggtactccgaccagaatcatgggctgtccggcctttcgactaatcacctgtacacccacatgacacactttttgaagcagtgtttcagcttaagcgactag

SEQ ID NO: 28659 - DNA, 2208 bp, Artificial Sequence
  Description of Artificial Sequence: Synthetic coding sequence
atgaagacgtgggttaaaattgtgtttggggtggcaacgtcagccgtgctggcactgctcgtaatgtgtatcgttcttagaccgagccgagtgcacaatagtgaggagaacaccatgcgcgcacttacgctgaaggatatcctgaacggtactttcagctacaaaacattctttccgaactggatctctggccaggagtaccttcatcagtccgccgacaacaacattgtactttataatatcgagacaggccagagctatacaattctgagcaatagaaccatgctgtggcggtactcatacacggctacatactatatctatgatctatctaatggggaatttgtaagagggaatgagctgcctcgtcccatccaatatctttgctggtctcctgtgggcagtaaactggcgtacgtgtaccaaaataatatatacctgaagcagaggcccggagaccctcctttccagatcacctttaatggacgagaaaacaaaatttttaatggtattcctgactgggtctatgaggaggagatgctcgctacaaagtatgctttatggtggagtcccaacggaaagttcttggcttatgctgaatttaatgatacagacatccccgttatcgcttactcttactacggagatgagcaatacccccgaactataaacatcccataccccaaggcgggtgctaagaaccctgtggtgcggatattcattatcgacacaacatacccagcctacgtggggccacaggaggtccccgtgcccgcaatgattgcctctagcgactattatttcagctggctgacctgggtgacagacgaacgcgtgtgcttacaatggctgaaaagagttcagaatgtaagcgttcttagcatctgcgacttccgcgaggactggcagacttgggactgcccaaaaacccaagaacatattgaggaaagcagaaccgggtgggctggtggttttttcgtgagcaccccagttttctcttacgacgcaataagctattataaaatattctcagacaaagatggttacaaacacatccactatatcaaagatacagtggaaaatgccatccagataaccagtggcaagtgggaagccatcaacatctttcgcgtcacacaggatagtttattctattcttcaaatgaatttgaagaatacccaggaagacgcaatatctaccggatcagtatcggctcttaccctcccagtaagaagtgtgttacctgccaccttcgaaaggaaaggtgccagtattacacggcgtcattcagcgattacgctaaatattatgctctggtgtgttacgggccaggaatacctatttcgacgctgcacgacggtcggacagatcaagaaattaagatcctcgaggaaaataaggagttggagaatgccttgaaaaatattcagcttccaaaggaggagatcaaaaagttggaggtggatgagattaccttgtggtacaagatgatacttccaccacagtttgaccgctcaaaaaagtaccccctgcttatacaggtttacggaggcccttgtagccagtcagtccggtccgtcttcgccgttaactggatttcctacttggcctccaaggaaggaatggtaatcgccctcgttgacggtcgcggaacggccttccagggagataagttgctctacgctgtctaccgcaaactcggtgtgtatgaagttgaggatcagatcactgcagtccgaaagttcatagaaatggggttcatagacgagaaaagaattgccatctggggatggtcctatggcggttatgtttcttctctggccctagcctctggaacggggttgttcaagtgtggaattgctgttgcccctgtgtccagctgggaatattacgcatccgtgtatactgaaaggtttatggggttaccaacaaaggacgacaaccttgagcactacaagaacagcaccgtcatggcccgtgccgagtacttcagaaacgtggactatctactgatccatggaacggcagatgataatgttcattttcagaactctgcccagatcgccaaagccttggttaatgcccaggtagacttccaagccatgtggtactctgatcagaatcacggattgtcagggctgtccaccaaccatctttatactcacatgacacactttttgaaacagtgcttctctctgtctgattag

SEQ ID NO: 28660 - DNA, 468 bp, Artificial Sequence
  Description of Artificial Sequence: Synthetic coding sequence
atggccgaaggcgaaataaccacatttacagcgctcactgaaaagttcaacctgccacctggcaattataagaaaccgaaactcctgtattgttccaacggcggacattttctgcgcatccttcccgacgggacagttgatggcaccagggataggagtgatcagcatattcagttgcagctcagcgcagaaagcgtcggagaggtttacatcaagtcgacggagacgggccagtacctggcaatggacacagatggattactctatggctcgcagactcctaatgaagagtgcttattcctcgaaaggctagaagagaatcattacaacacttacatatctaaaaaacatgccgagaagaattggtttgtaggtctgaagaaaaacggatcctgtaaaagaggaccccgaacccactacgggcagaaggcaatcctgtttctgccactcccggtctcctctgactag

SEQ ID NO: 28661 - DNA, 468 bp, Artificial Sequence
  Description of Artificial Sequence: Synthetic coding sequence
atggccgagggagagattacaacttttacagctttaacagagaaattcaacctcccgcctgggaactataagaaacccaaactcctttactgcagcaatggaggccattttctaaggattctgccggatggaaccgtagacggaacccgcgataggagcgaccagcatatccagcttcagttgtctgctgagagcgttggtgaggtctacattaaaagtacagagactggacagtatttagccatggataccgacggtctgttgtatggtagccaaacgccaaacgaggagtgtctcttcctggaacgtctagaggaaaaccactacaatacctatatctcaaaaaagcacgcagaaaagaattggttcgtcggacttaaaaaaaatggctcatgcaaaagaggacccaggacccattacgggcagaaagccatattgtttttgccactccctgtttcttccgattag

SEQ ID NO: 28662 - DNA, 468 bp, Artificial Sequence
  Description of Artificial Sequence: Synthetic coding sequence
atggcagagggcgaaattaccacgttcaccgctctgaccgagaagttcaatctgcccccaggcaattataaaaagcctaaactgctgtactgctccaacggagggcacttcctgcggattctgccagacggaacagtcgacggcacacgcgaccgaagcgatcagcacatccagctgcagctgtctgccgaatcggtaggagaggtgtacattaagagcacagagactggtcaatatctggccatggacaccgacgggctgctctacggctctcagactcccaatgaggagtgcctatttttagagagactcgaggagaatcattataacacctacatttccaagaagcacgctgagaaaaattggttcgtgggtcttaaaaagaatggctcctgcaaaagaggacctcgaacacactatggacagaaggccattctgtttttaccactccccgtgtcatccgattag

SEQ ID NO: 28663 - DNA, 177 bp, Artificial Sequence
  Description of Artificial Sequence: Synthetic coding sequence
atggccgagggcgaaatcaccacatttactgctctgacggagaagtttaacctaccccctggaaactacaaaaaacctaagctgctgtactgtagcaatgggggacacttcctcaggatcctccctgacggaacggttgacggtaccagagatcgaagcgatcagcacatccagtag

SEQ ID NO: 28664 - DNA, 126 bp, Artificial Sequence
  Description of Artificial Sequence: Synthetic coding sequence
atggccgagggagaaatcacaactttcactgccctgactgagaagtttaatttacccccagggaactacaaaaaacccaaactcctgtactgctccaacggcggacacttccttcgcattctgtag

SEQ ID NO: 28665 - DNA, 468 bp, Artificial Sequence
  Description of Artificial Sequence: Synthetic coding sequence
atggccgagggagagatcaccacattcacagctctcactgagaaatttaacctgccacctggaaactacaaaaagccaaagttgctgtactgtagtaacgggggtcattttcttaggatcctccccgatgggacggtggacggcacaagggatcgctctgaccagcacatacagctccagctctcagctgagtctgtaggggaggtgtatataaagtccaccgaaaccggccagtacctggccatggacacggacggcttactttacggctctcagacaccaaacgaggagtgtctgttcctagagcggctagaggagaatcattataacacatatattagtaaaaagcacgccgagaaaaactggtttgttggactcaaaaagaatggcagctgcaagcggggacccagaactcattatgggcaaaaagctatactcttcttacctctgccggtttcctccgattag

SEQ ID NO: 28666 - DNA, 468 bp, Artificial Sequence
  Description of Artificial Sequence: Synthetic coding sequence
atggccgaaggggagattactacatttactgcactgacagagaagttcaatctaccgccagggaattacaaaaaaccgaagctgctgtattgttccaacggcggacattttttaagaattttacccgatgggactgttgatggcaccagagacagaagcgaccagcacatacagcttcagctgtcagcagagtccgtgggggaggtctatatcaagagcacagagaccggacagtatctcgctatggacacagacggtctgctgtacggctctcagacacccaacgaggagtgtcttttcctggagaggttggaagaaaaccactataacacctacatctcaaagaagcatgctgagaagaactggtttgtgggtctgaaaaaaaatgggtcgtgtaaaaggggacccagaacacactatgggcaaaaggccatcctctttctgcctctgcctgtgtcctctgattag

SEQ ID NO: 28667 - DNA, 183 bp, Artificial Sequence
  Description of Artificial Sequence: Synthetic coding sequence
atggcggaaggcgaaattaccacctttacagcgctgactgagaagttcaatctgcctcccggaaactacaaaaagcccaaacttctgtactgctcaaacggcggtcactttctgaggatcctccccgacggcacggttgacggtacacgggacagaagtgaccagcacactgatactaaatag

SEQ ID NO: 28668 - DNA, 627 bp, Artificial Sequence
  Description of Artificial Sequence: Synthetic coding sequence
atgtggaagtggatactgacccactgcgcctccgcgttcccgcacctcccagggtgctgctgttgttgttttctcctcctgttcttggtaagctcggtccccgttacctgtcaagctctcggccaggacatggtgtccccggaggccacgaactcaagctcctctagctttagttcacccagcagtgcgggaagacatgtgcggtcctataaccaccttcaaggcgatgtgcggtggagaaagctctttagtttcacaaaatattttctgaagatcgagaaaaatggaaaagtttctggaaccaaaaaagaaaattgtccctatagcatcctggagataacttctgtggagatcggggttgtcgccgtcaaggccattaactcaaattattacttagccatgaacaaaaagggcaaactgtatgggagcaaggagttcaataacgactgtaagcttaaagaacgaatcgaggaaaacggttacaatacgtacgcgtcatttaactggcaacataacggcagacagatgtacgtcgccctgaatgggaagggggcacctcgtcggggtcaaaaaactcggcgtaagaatacatctgcccatttcctacctatggtcgtgcactcttag

SEQ ID NO: 28669 - DNA, 201 bp, Artificial Sequence
  Description of Artificial Sequence: Synthetic coding sequence
atgtggaagtggatacttacacattgcgcttccgcattcccgcaccttcccggatgctgctgttgttgttttctgctgcttttcctggtctccagcgtgcctgttacttgtcaggccctggggcaagacatggtcagccctgaagcaaccaactccagtagctcttccttttcatctccttcaagtgccggacgccactag

SEQ ID NO: 28670 - DNA, 867 bp, Artificial Sequence
  Description of Artificial Sequence: Synthetic coding sequence
ctggtgggagtcgggggaggcgatgtagaagatgtgactcctcgcccaggcggatgccagatatcaggtcgtggggctagaggctgcaacgggatccccggtgcagcagcctgggaggcagcactcccacgtagacggccaagaaggcaccctagcgtcaacccccgatccagggctgcgggatcaccacgaacaaggggcaggagaaccgaggagaggccgtccggtagtcgcctgggtgaccgcggacgcggaagggctctgcccggaggcagactggggggaagaggaagaggcagagcgccagagcgcgtagggggtcgaggcagagggcgtggcactgcagccccacgtgccgcacccgcagcaagaggctcccggcctggcccagcaggtacaatggcggctgggagcatcacgacgctcccagcgctgcccgaggacggcggttccggcgcttttccaccaggtcattttaaagaccctaagcgcctgtactgtaaaaacggaggttttttcttgcggattcaccctgatggacgcgtagatggcgttcgcgagaagagcgatcctcacattaagctgcagcttcaggcagaggaaaggggagtcgtttccattaagggcgtatgcgccaatcgataccttgccatgaaggaggatgggaggctgttggcgtcaaaatgcgtaacagacgaatgcttcttctttgaacgcctggaatccaataattacaacacctacaggtctcggaagtatactagctggtatgtggccttgaagcgcactgggcagtacaagctggggtctaaaacagggcctggtcagaaagcaatcctctttctgcctatgtctgctaaaagctag

SEQ ID NO: 28671 - DNA, 585 bp, Artificial Sequence
  Description of Artificial Sequence: Synthetic coding sequence
atgcacaaatggattttgacgtggatattacccaccctcctttatcggagttgttttcatatcatctgtctggtcgggacaattagtctagcctgcaacgatatgacccctgagcagatggctaccaacgtgaactgctcatcgcctgagaggcatacacggtcctatgattacatggagggcggagatattagggtgcgtcggctgttttgtcggacacagtggtacctgcggattgataagcggggtaaggtaaaaggcacacaagagatgaagaacaactacaatattatggagattagaactgtagctgtgggcatcgtggctataaagggcgtggaatccgagttctatctggccatgaacaaagagggaaagttatatgccaagaaggaatgcaacgaggactgcaattttaaagagctaatcctcgagaatcattacaacacatacgcctcagccaagtggactcacaacggcggagagatgttcgtggccctgaatcagaaagggatccctgtgagggggaagaagacgaagaaagaacagaagactgctcactttttgccgatggccatcacctag

SEQ ID NO: 28672 - DNA, 585 bp, Artificial Sequence
  Description of Artificial Sequence: Synthetic coding sequence
atgcacaagtggatcctaacatggatcctccccacactgctttaccggtcttgctttcatatcatttgcctggtgggaactatcagtttggcctgtaatgacatgacccctgaacagatggctacaaatgttaattgttcaagccctgagcggcatactcgctcatacgactacatggaaggcggagatatacgtgtgcgcaggttgttttgcaggacccaatggtacttgaggattgacaagcgcggtaaggtcaaaggaacccaggagatgaagaataattacaacataatggagataaggacggtggccgttgggatcgtcgctatcaagggcgtcgaatccgaattttacttagcaatgaataaagaagggaagctgtatgcaaaaaaggaatgtaatgaggattgtaattttaaggagctgatcctggaaaaccactacaacacgtacgccagtgccaagtggacacacaatggaggtgagatgtttgtggcgctaaatcagaagggaatccctgtccgcggaaagaaaaccaagaaggagcagaagactgcccattttttaccaatggccattacctag

SEQ ID NO: 28673 - DNA, 705 bp, Artificial Sequence
  Description of Artificial Sequence: Synthetic coding sequence
atgaagatctgtagcttaacgctgctttccttccttctactggcggcacaggtgctgctggtggagggtaagaaaaaggtcaaaaatgggctgcacagcaaggtagtaagcgaacagaaggacactctgggcaatacccagataaaacaaaagagtcggcctggaaataagggaaaattcgtgacaaaagaccaagccaattgtcgatgggctgccacagagcaggaagaaggaatctcactaaaagttgagtgtactcaacttgatcacgagttttcctgcgtgttcgctggcaatccgacctcttgcttgaagctgaaagacgagcgggtctattggaaacaggtcgccagaaatctccgctctcagaaggacatctgtcggtattcaaagacggcggtgaaaaccagagtatgccggaaagacttcccagaatcctcactgaagctggtgtccagcactctgtttggtaacacaaagccacggaaagaaaaaaccgagatgagccctagagagcacattaaaggaaaggaaacaacaccaagcagcctggccgtaacacagaccatggcaaccaaggcccctgaatgcgtggaagatccagacatggccaaccagaggaagacagccctggaattctgtggcgagacttggagctcactttgtaccttcttcttgagcattgtccaagatacatcttgctag

SEQ ID NO: 28674 - DNA, 705 bp, Artificial Sequence
  Description of Artificial Sequence: Synthetic coding sequence
atgaagatttgttccttaacactgctaagtttcctcctcttagcggcacaagtgttattagtggagggcaagaaaaaggtcaaaaatggtctgcattccaaagtggtttctgaacagaaggacacactggggaatactcagattaaacaaaaaagtcgccctgggaacaaaggaaaatttgtgaccaaagaccaggcaaattgccgctgggcagctactgaacaggaggagggcataagccttaaagttgagtgtacccagctcgaccacgagttctcttgcgtgttcgctggcaaccctacatcctgtctcaaacttaaagatgagcgggtttactggaaacaggtcgccaggaacctccgcagccaaaaagacatctgccgatattcaaaaaccgcagtaaagacgagagtttgtcggaaggatttccccgaaagctccttgaaattggtgtcttctacattgtttgggaacaccaaaccccgaaaggaaaagactgaaatgagccctagggaacacataaagggcaaggaaactacaccatcatctctggcggtcactcagactatggccactaaagccccagaatgcgtggaggaccctgatatggcaaatcagcggaaaacagcattagaattctgcggcgaaacatggtcatccctctgtacatttttcctctctattgtacaggacacatcatgctag

SEQ ID NO: 28675 - DNA, 2421 bp, Artificial Sequence
  Description of Artificial Sequence: Synthetic coding sequence
atgggtgctccagcctgcgctctggccctctgtgtggccgtggccatagtggccggagccagcagcgagtcattgggtaccgagcaaagggtggtcggtcgagcagcagaagtcccagggccagagcctggacaacaagaacagctcgtctttggtagcggtgatgccgttgagctctcctgcccacccccaggcggtggtcctatgggcccaacggtatgggtaaaagacggcacgggcctcgtgccctccgagcgagtacttgtcgggccacagagactccaggtactcaacgcctcgcatgaggatagtggcgcttactcatgccggcagcgcctgacccagagggtgctgtgccacttctccgtgagagtgactgatgcaccaagcagtggggatgatgaagacggcgaagatgaggcagaagacaccggggtggacactggtgctccctattggactcgccctgaaaggatggacaagaagctgctggcagttcccgcagctaacaccgtgcggtttagatgccctgctgccggtaatcctacaccctccattagctggctcaagaacgggagggaattcagaggggaacatcggattggcggaattaaactcagacatcagcagtggtcgctggtaatggaaagtgtagtgccttctgataggggcaattatacctgtgtggtcgagaacaaattcggctccatcaggcaaacgtacactttggatgtgcttgaacgctctccacaccggcctatcctgcaggccggactgccagctaaccaaacagctgtcctggggagcgatgttgaatttcattgcaaggtgtactcagatgcgcagcctcatatacaatggctaaagcatgtggaggtcaatggttccaaggtgggtccggacggaactccatatgtgacagtcttgaaaactgcaggagctaacactactgacaaagagctggaagtactgagtctgcacaacgtgaccttcgaggatgctggggaatacacgtgcctagcagggaattctattggctttagccatcatagcgcgtggttagtagtcctcccagcagaggaagagctggtggaggccgacgaggctggcagcgtttacgccggaatcttgtcctatggagtcggttttttcttattcatactggtagtggccgctgttactctttgcagattaaggtctcccccaaaaaagggactcgggagccccactgtgcataagatatccaggttccctcttaagcggcaggtatcattggagtctaacgcgagcatgagttcaaacacacctctggtccgcattgcaaggttgagttcaggagagggccctactctggcaaacgtgtctgaactggagctccccgcagacccaaagtgggagctgtctcgggctcgcctcacattgggcaagcctctgggtgaaggctgctttgggcaagtagtgatggctgaggccattgggatcgacaaggacagggctgccaagcctgtgaccgtagcagtgaaaatgttaaaggacgacgcaacagataaggatctgtcagatctggtgtctgagatggaaatgatgaaaatgatcggaaaacacaagaatataatcaatctcctcggcgcttgcacacagggtggcccactctatgtcctggtcgaatacgcagctaagggcaacctgagggagttccttagagctcggcgtcctcctggactcgactattccttcgatacttgtaagcccccagaagagcagcttacttttaaggatctggtgtcctgtgcttaccaggtcgccagagggatggagtatctggccagccagaagtgcattcatcgggacttggcggcacgaaacgtcttggtgaccgaggataacgttatgaagatagcagactttggacttgcccgagatgtacacaatctggattattacaaaaagactaccaatggtaggcttcccgttaaatggatggccccagaagccttattcgatcgggtgtacacacaccagtctgacgtttggtcttttggtgtgcttctttgggagatattcactcttgggggaagcccatacccgggaattcctgtggaagaactgtttaagttacttaaggagggccatagaatggacaaaccagctaactgtacccacgatctgtatatgatcatgcgggaatgttggcatgctgccccttcacagcggcctacattcaagcagctcgtggaggacctcgatagggtcctgactgttacctcaactgacgagtacctggacttgagcgctccctttgaacagtatagtccgggagggcaggacacaccttcgtcaagcagcagcggggatgattccgtgtttgcacatgacctgctacccccagcccctccctccagcggtggtagtcgtacatag

SEQ ID NO: 28676 - DNA, 513 bp, Artificial Sequence
  Description of Artificial Sequence: Synthetic coding sequence
gagtacctggatctgagtgcgccattcgaacagtactcaccaggagggcaggataccccatcttcgtcctcatccggggacgatagtgtgttcgcacatgacctgctcgccactggaccgcagcagtgcgagggatcactggccgcacatcctgccgcaggggcacagccacttccaggcatgcgcttgtccgccgatggggagacagctacacagtcatttggactttgtgtgtgcgtatgtgtttgtgtctgttgtactagtgcatgtgcctgtgtgagagcacatctggcatctaggtgtagaggtactctcggggttccagccgcagtccagaggtctcctgattggtgctgtagtacagaagggcctctcttctggggagacccggtgcagaacgtctctgggccaacacggtgggaccctggtcagggggcaggaccagatatgcgccctctgccactgcatcacgggacaagccaaggactgggcccttcacacactcaatcctag

SEQ ID NO: 28677 - DNA, 2427 bp, Artificial Sequence
  Description of Artificial Sequence: Synthetic coding sequence
atgggggctcctgcctgtgccttagctctctgtgtcgcggtcgcgatcgtcgccggagcctcgagcgaatcattgggcacagagcaaagggtcgtcgggagagctgccgaagtcccgggaccagaacctggtcagcaggaacagctggtgtttggaagcggcgatgccgttgagcttagttgtcctccccctggaggcggaccaatgggacccacagtctgggttaaggacgggactggtctcgtgccttccgagcgggtacttgtggggcctcagcggctacaggtgctaaacgcaagtcatgaagactccggggcttatagctgccgccagcggttaactcagcgagtgctatgtcattttagcgttcgcgtgacagacgccccaagctccggggatgatgaggatggagaggatgaggcagaggacaccggtgtcgacacaggtgcaccctactggactcgaccagagagaatggataagaagctcctcgcagtgcctgccgctaatacagttcggtttcgttgtccagctgcaggcaaccctacccctagcattagctggctgaagaacggtcgggaatttagaggcgagcacaggataggcggaatcaaactgaggcaccagcagtggagcttagtgatggagtcggtagtaccgagtgatcggggaaattacacatgtgtggtggaaaacaagttcggatccatacgacagacatacacactggacgtgttggaacgatcccctcatcgtcccatcctgcaagctggcttaccagcaaaccagacagccgttcttgggtccgacgtggaattccactgtaaggtctattctgatgcacagccacacatacaatggttaaaacacgtggaggtcaatggcagcaaggtgggacccgacggaacgccgtatgttacagtgctcaaaagttggatatctgaatctgtggaagccgacgtccgcctgcggctcgcaaatgtgtctgaaagggacggcggagaatacctgtgcagagctacaaacttcatcggcgtagcagaaaaagcattttggctgagtgtgcacggccctagggctgcagaggaagagctagttgaggccgacgaggcgggttctgtgtatgcgggaattctttcttacggggtcgggttctttctgtttattttagtcgtggccgctgttacgctttgtcgactgcggagcccgcctaaaaagggactcggaagccctacagttcataaaataagtcgatttccacttaagagacaagtgtcgttggaatccaacgccagcatgagctctaatacccctcttgtgcgcatcgctaggctctcttccggggaaggaccgactctggcaaacgtgagcgaattggagctcccagccgatccaaagtgggagttgtctcgcgcacgcctgaccctgggaaagcccctcggcgaaggctgttttggccaagtggtaatggctgaggccattggcattgataaagaccgggcagcaaagcccgtcaccgtcgccgtgaagatgcttaaagatgatgctaccgataaggacctgtcagacctggtctctgagatggaaatgatgaaaatgataggaaaacataaaaacatcattaatttgctaggtgcctgtacacaagggggacccttatacgtgctggtagagtacgcagccaaggggaatcttcgggaatttttaagggcaaggcggccaccaggcctggactatagctttgacacatgtaaaccccctgaggagcagttgaccttcaaagatctggtgagttgtgcctaccaggtcgccaggggaatggagtacttggcctctcagaaatgcatccaccgggacctggccgctcgaaacgtactagtgactgaggataacgtgatgaagatcgcagacttcggactcgctcgggacgtacataatctagattactataagaagacaactaatggtcgcctgcccgtcaaatggatggctcccgaagccctctttgatagggtgtatactcaccagtccgacgtctggagctttggagtgctgctgtgggagattttcactttgggaggaagcccatatccaggcatccctgtggaagagttgttcaaactgctgaaagagggccacagaatggacaagcctgccaactgtactcatgatctttacatgattatgcgggagtgttggcacgccgcaccatctcagcggcctactttcaagcagcttgtggaagatctagacagggtgcttactgtcacctctactgacgaatacctcgatctgtccgcgccttttgagcagtattcccctggcggtcaggacactcctagctccagttcaagcggcgacgattccgtcttcgctcatgatctgttgccaccagcgccaccttcctcgggcggaagcaggacctag

SEQ ID NO: 28678 - DNA, 2085 bp, Artificial Sequence
  Description of Artificial Sequence: Synthetic coding sequence
atgggtgcaccagcttgcgctctggccctgtgtgtcgccgtagccatcgtggccggagccagctccgaatcattgggaactgagcagcgagtggtggggcgagctgccgaagttcccggaccagaacctgggcagcaggagcaactggtattcgggagcggggacgcggtggaattaagctgccctccccctggtggaggccctatgggcccaacagtgtgggttaaagacgggactggactggtgccatcagagcgagtgttggtcgggccacaaagactgcaggtgttgaatgcgtcgcacgaagatagtggagcgtatagttgccggcaaagactgacgcagagggtgctgtgccacttctcagtaagagtgacagacgctcccagttcgggcgacgacgaagatggggaagacgaagccgaggatactggagtagataccggagctccgtattggactagacccgaacgaatggacaaaaaacttctagctgtgcccgcagccaacacggtccgcttccggtgccctgccgcaggaaatcccacaccgagcatcagctggctgaagaacggtcgcgagtttcggggagagcacagaatcggcggtatcaaactgcggcaccagcagtggagcctggtgatggaatctgttgtgccgagtgacagaggtaactacacctgcgtggtagagaataaattcggctcaatccgccaaacctacactctggatgttttggagagaagccctcatcggccaatcctgcaggctggactgccagcaaaccagaccgccgtgttaggcagcgatgtcgagtttcactgcaaagtgtattctgacgcccagccacatatccaatggctgaagcacgttgaggttaatggctctaaggtcggcccagacggcaccccatatgtcaccgtgttgaaggtctccctggagtccaatgcctcaatgtcgtccaataccccactcgtgaggatcgctagactgtcaagcggtgagggcccaacattggctaacgtgtcggaactggaactccccgctgaccctaaatgggaactgtccagggcgcgattaactcttggaaaacctctcggcgaagggtgcttcggccaggtcgttatggcagaagctattgggatcgacaaagaccgggctgctaagccagtcacggtcgcagtcaaaatgttgaaggacgacgctaccgacaaggatctttcagacctggtaagcgaaatggagatgatgaagatgatcggcaagcacaagaatatcatcaacctgctcggcgcatgtactcagggtggccctttgtacgtcctcgtcgaatatgccgctaaaggaaatctgagagaattcttgcgcgctagacggccacccggactggattactcgtttgatacatgcaaacctccggaagagcagctgacattcaaagatctcgtgagttgcgcttatcaggtggctcggggaatggaatacttggcctcccagaaatgcatccacagagatttggccgctcgcaacgttctcgtgaccgaggataacgtcatgaaaatcgccgattttgggctggcgagggatgtgcacaatctggactattataaaaaaactaccaacggcaggctgcctgtaaagtggatggcgcctgaagctctttttgatcgggtttatacacatcagtcagacgtgtggtcattcggcgtgttattgtgggagatcttcactttggggggaagcccgtatcccggaatcccagtcgaggaactatttaagctgctgaaggaggggcaccggatggataagccggcaaactgcacccacgacctgtatatgattatgcgagagtgctggcacgccgctcctagccagcgacctaccttcaaacaactcgtggaagacctcgacagagtgctgacggttacaagcacagatgaatatttagacctgtcagcgccttttgagcaatactccccagggggtcaggacactccatcttcatcttcatcaggtgatgatagcgtgttcgctcatgacctgttgccaccagcgcctcccagctccggagggagcagaacttag

SEQ ID NO: 28679 - DNA, 2421 bp, Artificial Sequence
  Description of Artificial Sequence: Synthetic coding sequence
atgggcgctcccgcatgtgcgctggctctgtgtgtggctgtagcaatagtggccggtgccagttcggagagcctgggcactgaacagcgggtggtggggagggctgcagaagtgccaggtccagagcccggtcagcaagagcagttagtcttcggaagtggtgacgccgtcgaactgagttgtccccctcctggaggtggacctatgggccctacggtttgggtgaaggatggaacaggcctagtgccttcagaacgtgtgctggtcggcccacagcgcctgcaagtcttgaacgccagtcacgaggattcaggcgcttacagctgtagacagaggcttactcaacgtgtgctgtgtcacttttccgtccgagtcacagacgctccctctagcggggacgacgaagatggggaagacgaggctgaggacactggcgtggacactggggctccttactggactaggcccgagcgaatggataaaaaactactcgctgtgcctgcggctaataccgtccgtttccgctgcccagccgctggaaaccctacaccttccatctcctggctcaagaatggacgcgaattcagaggtgagcatcggatcggtggaattaagctcagacatcaacagtggtctctagttatggaatctgtggtccccagcgaccgtggaaactacacttgcgtcgtggagaataagttcgggtcaattcgacagacttatacactcgacgtgctggagaggtcccctcacagacccatactacaggccggactaccagcaaatcagacagctgttcttggttctgacgttgaattccactgcaaagtctattcagatgcacagccacacattcagtggctgaaacatgtagaggtgaatggcagtaaagtggggccagatggtactccatacgtgaccgtgctcaaaacggcaggtgcaaacactaccgataaagaactggaagtcctctcgttgcacaacgtcaccttcgaggacgccggagagtatacttgcctcgccggtaacagcatcggtttctctcatcacagtgcctggctggtcgttctgcctgctgaggaggagctggtggaggcagacgaggccggatccgtgtatgccggtatcctctcttacggggtaggcttttttttattcattctcgtggtggccgctgtgaccctgtgtcggttgcgatctcctccgaaaaaggggttgggtagcccaactgtgcacaagatcagccggttccctcttaaaaggcaggtatcactggagtcaaacgccagcatgtcctcaaacacgccccttgttcgcatcgcacggttgtcatctggcgaaggaccgactttagctaatgtcagcgagctggagcttcccgcagacccgaaatgggagctttctcgagcccgtcttacgctggggaaacctcttggagagggatgtttcggccaagtcgtaatggcggaggcaatcggcatcgataaggatcgagctgcgaaacccgtcaccgtagcagtaaaaatgcttaaagatgacgcaacagataaagacctcagcgacctggtctcagaaatggaaatgatgaaaatgataggcaagcataagaacataatcaacctcctgggagcctgtactcaggggggtcctctctatgtactcgttgaatatgcggcaaaaggaaatctgcgagaattccttcgggcaaggcggcctccagggctggattattccttcgatacatgtaaaccgccagaggaacagctgacattcaaggatttagtgtcctgtgcataccaggtggcacgtggaatggagtatctggccagccaaaaatgcattcatcgggatctggccgctagaaacgtcctcgtgaccgaagacaacgtcatgaagatcgcggacttcggtttggcccgtgatgtccacaatctggattactacaaaaagacaactaacgggaggcttcccgtgaaatggatggcgcctgaagctctgttcgacagggtctatacccatcagagtgacgtatggtctttcggagtgctgctttgggagatctttaccctcggcggaagcccttatcccggtattcccgttgaagagctttttaaactgctcaaggaagggcatcggatggacaagccagcaaactgcactcacgacctgtatatgatcatgcgagaatgctggcacgctgctccaagccagagaccaaccttcaagcagttggtcgaagacctggaccgagtgctcaccgtgacatcaaccgacgagtaccttgatctttccgcgcctttcgaacagtattctcccggaggccaggataccccctcctcttcttcatcgggagatgactccgtcttcgcccacgatctgctgccgccagctcctccatcttccggcggatcccgaacctag

SEQ ID NO: 28680 - DNA, 2379 bp, Artificial Sequence
  Description of Artificial Sequence: Synthetic coding sequence
atgggggcacccgcatgtgcgctcgctctgtgcgttgccgtagccattgtggccggagccagctctgagagccttggcactgagcagcgtgtggtggggcgtgccgctgaagtccccggacctgagccgggtcagcaggaacagctggtgtttggctctggcgacgccgtggagctctcctgcccgccacctgggggtggccctatgggtccgactgtgtgggtgaaggacggcaccggtttggtaccatcagagagagtcctggttggcccacagagacttcaagtactgaacgccagccatgaggactcaggggcttacagttgtcggcaacgtcttactcagagggtgctgtgccatttttccgtgagggtcaccgatgccccttcctcaggggacgacgaggacggagaggacgaagcggaagacaccggggttgacacaggggctccatactggacgagaccagagcggatggataaaaagctactcgctgttccggcagctaacacagtgagattccgatgtcccgctgcagggaaccccaccccttcgatcagttggctcaagaacgggagagagttcagaggagaacaccgaataggcggaatcaagctgcgccaccagcagtggtctcttgttatggagtcagtggtgcctagcgataggggaaattatacatgcgtggtagagaacaagttcggcagcattaggcagacatatacgttggacgtcttggaacgctcccctcaccgccctatattgcaggcgggtctgccagcaaatcagacagctgtcttagggtcggacgtggaatttcactgtaaagtgtactccgacgcccaaccccatatccagtggctgaagcacgtcgaggtaaatgggtcaaaagtgggtccagatggcacaccctacgtgacagtgctcaagacagcaggtgcaaacaccacagacaaggagttggaggttctgtccttacataatgtaacatttgaggacgcaggggaatacacctgcctggccggaaactccataggattttcccatcattcagcgtggcttgtcgtgctcccagccgaggaagaactggtagaagccgacgaggccggatccgtgtacgctgggattctcagctatggtgtggggttcttcttattcatactggtagtggccgctgtcacactctgtcggctgcggtctccccctaaaaaggggttaggctcaccaacagttcacaaaattagtagatttccactgaaacgacagcaagtttctttagagagcaatgctagcatgtcttccaatacccccctggtgagaattgcgaggctcagttcaggggagggacctactcttgctaacgtgagcgaactggagctcccagccgaccccaaatgggaactgagtagggctaggcttactctcggaaagccactgggggagggctgcttcggtcaggtggttatggcagaggccatcgggatcgataaagacagggcggctaagccggtcactgtcgcagtgaagatgctcaaggatgacgccaccgataaagacctgagtgaccttgtttcagagatggaaatgatgaaaatgatagggaaacataaaaacataatcaatttactgggagcctgtacccagggcggacctctctatgtcctggttgagtacgctgcaaaagggaaccttagagaatttctgcgggctcggaggccaccaggactcgactactcgtttgacacttgcaaaccgccagaggagcagttgaccttcaaggatttagttagttgtgcttatcaggtcgccagagggatggagtatctggcaagtcaaaaatgtatccatagggatttggctgccagaaatgtccttgtaacagaggacaacgtgatgaagattgctgacttcggcctggcacgggatgttcacaacctagattattataagaagactaccaatctggtgctctgggggcctgcgttgggggacctccacgcaggcggtttgccagtcccacggcacccttgtggcggagcacttcaggcggcagaggggggacctccgcacggccaggctcggcagctgcacactcgtccggtgcacgaccatgcaggtgtccttgcatgtagagccctccctgaggcccacctacaggctgccggaggtggccctggaccttgtccctatcgggacgtgcatcgcagggtccctgggcctgtgggtgctttccgcgctgtgctgcccggatggccaggacatccacagcttcaattactcagaggtcggttgcgcgtgtgccctcggccagcagcgccaggtccaactcagcagtgggggttggcagatgtgaaaggtcactggtccccaaccatgtag

SEQ ID NO: 28681 - DNA, 2409 bp, Artificial Sequence
  Description of Artificial Sequence: Synthetic coding sequence
atgcgactcctgctagctctgctcggagtcctgctctccgtgcccggtcccccagttctttctctggaagcatcagaggaagtagagcttgaaccttgcctggccccatctcttgaacaacaggagcaggagctgaccgttgctttaggacagccagttagattatgctgcggcagagccgagcggggagggcattggtacaaagagggctcgagattggctccagccggacgcgtccggggatggagaggtaggctagagatcgctagtttcctgcctgaggacgccggtcgctatctgtgtctagctagagggagtatgatcgtgttgcagaatttaaccctcatcacaggcgactcactgacttcttcaaatgatgatgaggaccctaaaagtcatcgggatccatccaacagacacagctacccacagcaggctccatactggactcaccctcagcggatggagaagaagctacacgctgtgccagccggaaatacagttaagtttaggtgcccagccgcaggaaaccctacacctaccatcaggtggcttaaagacggacaggccttccatggggagaacagaatcggcggaattaggctgcgccatcagcattggtcactggtgatggaatctgtggtaccctcagaccgaggtacatacacttgcctcgtggagaacgcggtgggatccatccgctataactatttgttggacgtgttagagagaagtccgcataggcccatcctgcaagctggtctgccggctaacacaacagccgtggttggcagcgatgtagagctgctttgcaaggtctactccgacgcccagccacacatacagtggctgaagcacatcgtgataaacggatcgtcctttggagccgacggcttcccatacgtgcaagtcctaaagaccgccgacattaacagcagcgaagtcgaggtgctgtatctgagaaacgtgtccgctgaggacgcgggagagtatacatgcctggcagggaactctattgggctgtcttaccagtctgcctggctaaccgtgctgcccgaagaagaccctacatggacagcagcagccccagaggcccgttacactgacattatcctgtacgcctctggtagcctggcccttgcggtgcttcttcttctcgccggattataccgaggacaagcactacacggacgtcacccgagacccccagctacagtccagaagctgtcgaggttcccactcgcccgacaatttagcctcgaaagcggtagctccggtaagagtagctcttcattggtccgcggagtccgccttagctcctcaggccctgctctgctcgctgggctggtctcacttgacctgcccctcgacccattgtgggagtttcctcgagatcgactggtcctgggcaaacctctcggtgaggggtgcttcggtcaagtggtgagagccgaagctttcggaatggaccccgcacggcctgaccaggcctccaccgttgcagtgaaaatgttgaaggacaatgcttctgacaaggatctggccgatctagtcagcgagatggaggtgatgaagctgattggcaggcacaagaacatcattaacttactgggcgtatgcacccaagaaggcccactgtatgttatcgtagagtgcgcagcaaaggggaaccttcgtgagtttcttagagcacggaggccacccggtcctgacctgtcccccgacggcccacgctcttctgagggtcccctgtctttccccgtacttgtaagctgtgcttatcaagtggcacggggaatgcaatacctcgagagccgtaagtgcattcatcgggatttggctgcacggaatgttttagttacggaggataatgtgatgaaaattgccgattttggcttggccagaggcgtgcaccatatcgattattataagaagactagcaacgggagactgcccgtcaaatggatggcccctgaggcgttatttgatagagtctatacccaccaatccgatgtgtggtcctttgggatactactttgggagatcttcacgttaggcggatcgccctatccaggaataccagtagaggaattattcagcctgctcagggaaggccatcgcatggaccgcccacctcactgtcctcccgagctgtacgggcttatgagagaatgctggcacgccgctccatctcagaggcccaccttcaaacaactggtggaagctttggataaggtgctgctggccgtgtcagaagaatatctggaccttcgcctgacttttggtccctacagcccctcaggaggcgatgccagctctacctgctcatctagtgatagtgtgttttcccatgaccccctgccactgggatcctcatcatttccattcgggtccggcgtgcagacatag

SEQ ID NO: 28682 - DNA, 2289 bp, Artificial Sequence
  Description of Artificial Sequence: Synthetic coding sequence
atgagactcctgctcgcccttctgggcgtactactttctgtacccggacccccagtgctgtcactggaggcaagcgaagaagtcgaactggagccctgcctggccccttcacttgaacagcaggaacaggagctcactgtggcactgggtcaaccggtaagactgtgttgtggacgggcagaaagaggaggccactggtacaaggagggatccagactggcacccgctgggagagtgcggggatggcgtgggcgtttggaaatcgcaagctttcttcctgaggatgctgggaggtacctgtgcttggccagaggcagcatgatcgtcttgcagaacctaaccctcataacgggagactctttaacctcaagcaatgatgacgaagatcctaagtcccatcgggaccctagcaaccggcacagctatccccagcaggctccctactggacccacccccaaaggatggaaaagaaactgcacgctgttccagcgggaaacacagtgaagttccggtgccccgctgcaggaaatcctacacctactataaggtggttaaaagacggacaggcgtttcacggagagaatcgcatcggtggtatccgcttgcggcaccaacactggtctctggtcatggaaagcgttgtcccctcggacaggggcacgtatacatgtctggttgagaatgccgttggttctatcagatataattatctgctggacgtactggagcggtcgccacaccgtcccatcctgcaggccggactgccggcaaacaccacggctgtggtgggaagtgacgtggagctgctttgcaaggtttactctgatgcccagccacacattcagtggcttaaacatatagtgataaacggaagctcctttggcgcagacggcttcccatatgtgcaggttctgaagaccgccgatatcaactcgagcgaagtagaagtgctgtacctcagaaacgtgagcgcagaagacgcaggagagtatacatgcctggccggaaatagtattggattgtcctatcagtctgcctggttaaccgttctgcccggtaccggacgtatcccgcatcttacatgtgactcactcacaccagccggaagaacaaaatctcccacactccagttctctctcgaaagtggcagcagcggaaagtcttcaagtagcctggtgcggggagtgcggcttagcagcagtgggcctgcgttactcgcagggcttgtcagcctggacttgcccctggatcccctttgggaatttccgagagatcggcttgtgctcggcaagccattgggcgaagggtgcttcggacaggtcgtacgtgctgaagcattcggtatggacccagccaggcctgatcaggccagcacagtggcagtcaaaatgcttaaagacaacgcctctgacaaagatctggccgatctcgtgagtgagatggaagtgatgaaactgattggtcgccacaagaacatcatcaacctgctcggagtgtgtacccaggagggacccctgtatgtgatcgtcgaatgcgctgcaaagggcaacctacgggaatttctgcgtgcgaggagaccccctggtcctgatctctctccggatggacccaggtccagtgaggggcctctatcctttccagtcctggtttcctgcgcttatcaggtggctcgtggcatgcagtatttggagtctcggaagtgcatacatcgggatcttgctgccaggaatgtcctcgtgaccgaggacaacgtaatgaagattgccgacttcggccttgccagaggtgtgcatcacattgattattataaaaaaacaagcaatgggagattacccgtgaagtggatggcgccagaagcgctgtttgacagagtctatactcaccagtccgacgtgtggtccttcggcatcctgctatgggaaatcttcacattgggcggatccccctaccctggaattcccgtcgaagagctatttagcttgttgagggaaggccaccggatggacagacctccccattgccccccagagctctacgggttaatgagggagtgttggcacgcagcccctagtcagcgccctacctttaaacagctggtggaggctctggacaaagtgctcctggccgttagtgaggagtatctggacttgcggctaactttcggtccctactccccgtccggtggagacgccagcagcacatgttcatcctcagattcagtgtttagtcacgaccccctgccccttggatctagctctttcccgttcgggagtggcgtgcagacctag

SEQ ID NO: 28683 - DNA, 3093 bp, Artificial Sequence
  Description of Artificial Sequence: Synthetic coding sequence
ccttgcatgtggcatcaacagcatgtgccctgtgtgtgcgtgtgcccttacgtctgtgtgtgtatgagggtttgcgtttgtgtatgctggcccctgtcctgcgccttgaatgcagtgtgtgtcacatgccctaagtccgtggccttcgcattgggcgtggcatctgccgcatgcggatgcgtgggtgtcaaagagtggtggctcctgcaacacgcacttcaatcggcttgtgccctgcatgtgcgttgtgttctctgtactcaggaggctgcttctgacggggcagcaggcagtgctgatttatgtcctcttcccaccgagccgtgtctcgctccatccctcgaacaacaggagcaggagctcactgtggctctggggcagcccgtaaggctttgttgtggacgcgcagaaaggggtgggcattggtacaaggagggatccagactggcacccgctggtcgggttcgcggatggaggggacgactggaaatcgcctccttccttcccgaggacgcgggacggtatctgtgccttgcaaggggatccatgatcgtgctgcaaaacctcactttaataaccggcgattcccctcctgctactatgatgaggacgccatcccctatcggcactcccagaatcggtactgtcaccccttccaaagtttcacgctcacctcgcacctgtgtcccagccgcagcccacctgatcaccgagaagagacgccctgtctgggagcataccgtgatactcggggctttcccttgccccccagctccttattggactcacccacagagaatggaaaaaaagttgcatgcagtgccagctggtaacacagtgaaattccgatgccctgccgcaggcaaccccacacctaccatccggtggctcaaggacgggcaggcttttcacggcgaaaaccgtatcggcggaatacgcctacgtcaccagcattggagtcttgtgatggagtctgtggtcccgagcgaccgaggaacatatacctgcctcgtagagaatgcagtaggaagcatcagatacaattaccttctagatgttttggagcgcagtcctcaccgtcctatactgcaagctggactgccggctaataccacagccgtggtgggcagcgatgtcgagctcctctgcaaggtgtattctgatgcgcagcctcatatccagtggctcaagcacatcgtcatcaatggatcgtcgtttggggctgatggcttcccgtacgttcaagtgctgaagaccgcagatattaacagctctgaggtcgaggtactctacctccggaatgtctcggctgaagatgccggagaatacacatgtctcgcaggcaactccatcgggcttagttatcagagcgcgtggcttaccgttctgcccggagagcacctgaagggccaagagatgctgagggacgcaccactcggtcaacagtggggtctctggcctgtggggtggtccgtgagtgtcggcctctggggactggcatggggagcagtctgtggctttgtcggtctatcttgcatgacagctcccctctgtctcagcacgcgagggaggccttgtgacaggcttctcaggtgcgggtgtcttggccttggtattacgacagcgagctctgtttgcgttcctacatatgtgggaagctgggaagggctagggtgtaccggaagaccagtgtcccccctgacctccctgtcagtctgtgtctgcccatgtgccagggcggaggaagacccaacttggactgctgccgcacccgaggccagatataccgacattatcctctatgcgtcaggcagtctggcattagccgtgctgcttctgcttgctggattgtaccggggtcaagccctgcacgggagacaccccaggccccctgccactgtgcagaagctgtctagattcccactggctcgccagttcagcctagagtccggaagctccggaaaaagcagcagtagcctggtccggggagtcaggcttagcagtagcggcccagcactgttggcgggtctggtgtcccttgatttacctctcgacccactctgggagttcccaagggatcgcctggttttgggcaagccgctcggagagggatgcttcgggcaggtggtgcgcgctgaagccttcggaatggaccctgcaagacccgaccaagcctctacagttgccgtgaaaatgctgaaggataatgcttccgacaaagatctcgcagatctggtctctgagatggaggtgatgaagctcatcggacgccataagaacatcatcaacttactcggagtctgtacacaggagggcccactgtacgtgattgttgaatgtgctgctaaaggtaacttgcgcgagttcctaagggcccgtcgaccaccaggacctgatttatcccctgatggtccaagaagttcagaaggccctttgagtttccccgtgctggtcagttgcgcctatcaggtcgcacgcggtatgcagtacctcgagtctcgcaaatgtatccatcgagatttggccgcaaggaacgtcttggtgactgaggataacgtcatgaagattgccgactttggactcgccagaggagtccaccacattgactactacaagaagacctccaacgggcgtctgcccgtaaaatggatggcgcctgaggcactgtttgatagggtgtacactcaccagtccgatgtctggtccttcggcattctcttatgggaaatcttcactctcggcggaagtccatatcccggaatcccagtcgaggagttgttttctctgctgcgggagggccaccgtatggatagacctccgcactgtccaccagagctgtacgggctgatgagggaatgttggcatgcagccccttctcagagaccgacctttaagcagttagttgaagccctggataaagttcttttggccgtcagcgaagagtacctcgatctgagactgaccttcggcccttacagcccctccggcggagatgccagcagtacatgttcaagttcagatagtgtgttctcccacgatccactccccttgggttcctcttcctttcccttcggatccggggtgcaaacatag

SEQ ID NO: 28684 - DNA, 2289 bp, Artificial Sequence
  Description of Artificial Sequence: Synthetic coding sequence
atgcgccttcttctggccctgttaggcgtcttgctgtcagtacctggaccaccagtgttgtctctcgaggcctccgaggaagtcgaactggaaccttgtctggctcccagtctcgagcagcaagagcaggaactgacagtcgctcttggacagcccgtgagactctgttgcggcagggctgaacgtggaggacattggtataaggagggtagcagactggcaccggctggaagagtccgcggttggaggggaagactggaaatcgctagtttcctacccgaagacgccggtaggtatctgtgcctggctcgcggatcgatgatcgttcttcagaacctgaccctcatcactggcgacagtttgacctctagtaatgatgacgaggatcctaaatcccatagggacccctcaaacagacactcctacccccagcaggcaccctattggacccatcctcagaggatggaaaagaaactccacgctgtgcccgctggcaatactgttaagttccgatgtccagccgcagggaatccgacaccaactatcagatggcttaaagacgggcaggcttttcacggagagaatcgcataggcggtattcgtctgagacaccaacattggagcctagtaatggagtccgtggtgccttcagacaggggcacctacacttgtctagtagagaatgctgtaggcagtatccggtataactatttgctcgacgtcttggaacgctcaccacataggcctatactgcaggccggactgccagcgaataccaccgccgtggtcggcagcgacgtggaactgttatgcaaggtgtattccgacgcacagcctcatatacagtggctgaagcacattgttatcaatggtagctccttcggcgcagacgggtttccgtatgtgcaggtgttaaagaccgctgatataaactcctctgaagttgaggtgctctatctgagaaatgtgagtgcagaagacgcgggtgaatacacctgccttgccggaaattccatagggttgtcataccagagtgcctggcttacagttttgcctggaactgggaggattccacacctgacctgcgattctctaacacccgctggccgtacgaagagccccacactgcaattcagcctggagtcaggatcatctggtaaaagttcatcctccctggtgaggggcgtgcggctgtcctctagtggacccgctctgctggctggtctggtgagcctggatctccctttggatccgctgtgggagtttccccgtgaccgcctggtgctcggcaagcctctgggtgaggggtgctttggacaggtggtcagggcagaagcgttcgggatggatcccgcaaggcctgatcaggcaagcacggtggccgtgaagatgctgaaggataacgctagtgacaaggacctggcagacttagtgagcgagatggaagttatgaaactgatcggtcgccataaaaacatcataaacctgctgggcgtatgcacccaggagggcccactatatgtgattgtggaatgcgcggcaaagggtaatctgcgagaatttctgcgggcacgacgtccacccggacccgatctaagccccgacggtcctcggtctagcgagggacccctgtcgttccccgtactggttagctgcgcctaccaagtagccaggggtatgcagtatctggaaagccggaagtgtatacaccgcgacctagcagcacggaacgttttggttaccgaggacaatgttatgaaaatcgccgatttcggtctggcgaggggggtgcatcatattgactactacaaaaagactagcaatggcagactgcccgttaagtggatggcgccagaggcactcttcgatcgagtgtacacccaccagtccgatgtttggtctttcgggatattgttatgggagatatttaccctggggggttccccttatcctggaatccctgttgaggagcttttcagtctcctgagagaaggccatcgaatggatcggccaccccattgccctcctgagttatacggattaatgcgggaatgttggcatgccgcaccatctcagcgacccacattcaagcagctcgtggaagccttagacaaagtcttactggctgttagtgaggagtatctcgaccttagactcaccttcggcccatattcaccctccggaggcgatgcaagttccacatgttcttcaagcgactccgtgttcagccacgatccgttgcccttgggctcatcctcatttccgtttgggtctggcgtgcaaacatag

SEQ ID NO: 28685 - DNA, 2409 bp, Artificial Sequence
  Description of Artificial Sequence: Synthetic coding sequence
atgcgcctgttactcgccctcctaggcgtgttactgagtgtaccaggcccacccgtcctgtccttggaggcatctgaagaagtggagcttgagccctgcctggccccttccctggaacaacaggagcaagagctcaccgtggcgctgggacagcctgtgcgtttgtgctgtggacgagcggagaggggaggacactggtacaaggaggggagcaggttggctcccgctggccgagtgcgcggttggcggggtcgcctagaaatcgcgagttttttacctgaagacgcgggtcgctatctgtgtctggcacgaggttcaatgattgtgcttcagaacctcacgttgattacaggtgactctctgacctcctctaatgacgacgaggatccgaaaagtcatcgcgatccgagcaatcgtcattcctacccacagcaagccccttattggacccaccctcagagaatggaaaagaagctccatgctgtgccagccggtaatactgttaaatttagatgccccgcagcagggaaccccacaccaacaatcagatggctgaaagacggtcaagcatttcatggcgagaatcggatcggcggtattcggctgaggcatcagcactggtccctggtgatggaaagcgtggtgcctagtgaccgcggaacatatacctgtcttgtggaaaacgctgtaggcagtattcggtataattacctcctggacgtgctggaaaggagcccacatcgccctattctgcaggcgggtcttcctgcaaataccacagcggtcgtcggatctgatgtggaactgttgtgcaaggtctacagcgacgctcaaccccacatccagtggctgaagcatatcgtgatcaacggatcaagttttggcgctgatggattcccatatgtgcaggtcctgaaaacggcagatattaattcttctgaggttgaggtcctctaccttcggaacgtgtctgctgaagacgctggagagtacacatgcctggccggaaattcgattggtctgtcttatcaaagcgcatggctcacagtgctccctgaagaggatccgacatggacagcagctgcgcctgaagcaagatacaccgatattatcctctacgcttctggctctctggccttggcggtgttattgttactggcaggtctatacaggggacaggcactccatggtcgccatccaaggcctccggctacagttcagaaactaagtcgctttcctcttgcccgacagttctctttggagtctgggtccagtggaaaaagttcttcatctctcgtgagaggcgttaggctgtctagcagcggtcctgccctgctggcagggcttgtgagcttggacctacctctggaccctctatgggagttcccacgtgatagattggtcctgggtaagccactgggtgagggctgtttcggccaggtggtgcgggctgaagccttcggcatggaccctgccaggcccgaccaggcgtcaacagttgcagtcaaaatgctcaaggacaacgcctccgacaaggacctggccgatttagtcagtgaaatggaggtcatgaagctcattgggaggcataaaaatatcattaacctgttaggtgtttgtacgcaggaagggcctctttatgttatcgttgagtgcgcagcgaagggtaacctacgcgagttcctcagggccaggagacctccgggtccagacctgagtcccgatggaccacggagctctgagggacctctttctttccccgtgctggtgtcctgcgcctaccaggtggcccgtggcatgcagtacctcgagtcccgcaagtgcatccatcgggatctggcagctaggaacgtgctggtcacagaggacaatgtgatgaaaatcgcggactttggcttggctagaggagtgcatcatatagattattacaaaaaaacttccaatggccgtctgcctgtcaagtggatggcccctgaggcgctgtttgatcgggtctacacacatcaaagcgacgtttggagctttggaatacttctgtgggagatctttactcttggaggaagtccctatcctggtatccccgtagaggagctgttctctttgctgcgagagggccatagaatggacaggccaccacactgcccccctgagctgtatggcctgatgcgcgagtgttggcacgcagctcccagccagagacctactttcaagcagttagtggaagccctggacaaagtgcttctggctgtctctgaagagtacctggatctaagactcacgtttggcccttatagcccttccggcggtgacgcctcatctacctgctcaagctccgattcagtcttttcacacgatcccttacccttaggctctagctcattcccctttggctcaggggttcagacctag

SEQ ID NO: 28686 - DNA, 606 bp, Artificial Sequence
  Description of Artificial Sequence: Synthetic coding sequence
atgcgcctgctgctggcactgctcggcgtgctgctgtctgttcccggtccaccagtgctcagtctggaggcctcagaggaggtcgagttggaaccttgccttgccccttccctcgagcagcaggagcaggaactgaccgtcgctctcggacagccggtgcgattatgttgcgggagggcagagcggggtggccactggtacaaagaaggcagtagattggctccagcaggcagggtgcgtggttggcgcggtcggcttgagatcgcatcattcctgccagaagacgcgggacgctatctgtgtttagccagggggtctatgatcgtattgcagaaccttaccctcatcaccggtgactcacttacaagtagtaatgatgacgaagaccccaagagccacagagatcctagcaatcgtcactcatatccacagcaggccccttactggactcacccccagcgaatggaaaagaagcttcacgcggttcccgctggtaataccgtgaagtttagatgcccagctgccggaaaccccaccccaactattagatggctgaaggacggccaagctttccatggcgaaaatcgtattggcggtatcagatag

SEQ ID NO: 28687 - DNA, 264 bp, Artificial Sequence
  Description of Artificial Sequence: Synthetic coding sequence
atgcggttgcttttggcgttgttgggcgttcttttaagcgtcccgggacccccagtgctgtctttagaggcttcagaagaagtggagctcgaaccctgcctagctccttccttggaacaacaggaacaggagttgactgtggccttgggacagcctgtgagattgtgttgcggcagagctgaaagagggggtcactggtataaggagggcagcaggctggcccctgcgggacgagttagaggctggaggggcaggctggagtag

SEQ ID NO: 28688 - DNA, 327 bp, Artificial Sequence
  Description of Artificial Sequence: Synthetic coding sequence
atgcggctcctgctggcactactgggcgtgctgctgtcagttcctgggcctcctgtgctgagtctggaggcttctgaggaggtggagctggagccgtgcctggctccaagcttggagcagcaggagcaggaattaaccgtcgcgctgggccagcccgttaggctgtgctgcgggagagccgagagaggaggccattggtataaagagggatcccgcctcgcccctgcgggacgcgtgcgaggatggcgcggaaggctcgagatcgctagcttcctgcccgaagatgcaggcagatacctgtgcttggctcgaggatctatgatctag

SEQ ID NO: 28689 - DNA, 345 bp, Artificial Sequence
  Description of Artificial Sequence: Synthetic coding sequence
atgcgtcttctgctggccctactcggagtcttactgtcggtgcccggtccccctgttctcagcctggaagcttctgaagaagttgagttggagccatgtctggcacctagcctggaacagcaggagcaggaactaaccgtcgccctaggacaaccagtgagactctgctgtggcagggctgaacggggtggacactggtacaaagaaggtagtaggctggcacccgctgggcgtgtgaggggctggcgaggaaggctcgaaattgcttccttcctccccgaggatgccggtagatacctgtgtctggctcggggtagcatgatcgtgttgcagaaccttacttag

SEQ ID NO: 28690 - DNA, 7163 bp, Artificial Sequence
  Description of Artificial Sequence: Synthetic coding sequence
atgctgcggggtcctgggcctggcctactccttttagccgtccagtgtctgggaaccgctgtcccaagcactggagcgtctaagagtaagcggcaggctcagcaaatggtccagcctcagagtcctgttgccgtatcccaatctaaacccggttgctacgataacggaaaacattaccaaatcaaccaacaatgggaaaggacgtatctcggtaatgccctggtatgcacttgctacggcggtagtaggggcttcaactgcgagagtaagccggaggccgaagaaacatgttttgataagtacacaggcaatacttatcgagtcggggatacatacgagaggcccaaggactccatgatttgggactgtacatgtataggcgctggtagaggccgaatctcttgtacaattgcaaacagatgccacgagggtggccaaagttataagatcggcgatacctggaggcgaccacacgagactggagggtatatgctggagtgtgtgtgtctcggtaatggcaagggtgagtggacatgtaagcccatcgccgaaaagtgcttcgatcatgccgcaggtactagctacgttgtgggtgaaacctgggaaaaaccttaccaaggctggatgatggtcgattgcacatgtcttggggagggctccgggcgaattacttgtacctcccggaataggtgcaatgatcaggatactcgcacttcatatcgtatcggtgacacgtggagcaaaaaggataaccggggaaaccttcttcagtgtatatgtactggaaatgggagaggcgagtggaaatgcgagcgtcatacttccgtccaaaccacctcaagcggatccggacctttcacagatgtgcgtgctgccgtctaccaaccacagccacatccacaaccgccaccttatgggcattgtgtgacagatagcggagtcgtctattccgttgggatgcagtggcttaagacgcaggggaataagcagatgctgtgcacctgcctggggaatggggtgtcttgccaggagaccgcggtcacacagacttatggcggaaattctaatggtgagccctgtgtacttccctttacctataacggacgtacgttttactcctgtaccaccgagggcagacaggatggacacttgtggtgctccacgaccagcaattacgaacaggaccagaagtacagcttttgcactgaccataccgttttggttcagacaagaggcggaaattctaacggagctttatgccacttccccttcttatacaacaaccataactatactgactgcacaagcgagggtcgcagggataacatgaagtggtgtggcacaacacaaaattacgacgcagatcaaaaattcggattttgcccgatggcagctcacgaggaaatctgcacgacaaacgaaggtgtgatgtaccggataggagaccagtgggataagcagcatgacatgggccatatgatgagatgcacctgcgtgggcaacggaaggggggagtggacctgcattgcatatagccagctacgcgaccagtgcattgtggacgacattacttataacgtgaacgatacctttcacaaacgtcacgaagagggccacatgttgaattgcacttgctttggccaggggagaggcaggtggaagtgtgaccccgtagaccagtgccaggattcagagacgggtaccttctaccagataggagactcttgggagaagtatgttcatggggtgaggtaccagtgctactgttacggtagaggtattggagagtggcactgccagccattacagacctatccttcctcttcaggaccagtggaggtgttcattacagaaacaccatctcagcctaatagccatccaattcagtggaacgcgccacaaccctctcatataagtaagtacattctccgctggcgtccgaaaaactcagttggccgttggaaagaggccaccattcccggacatttgaattcttacacaattaaaggcctcaagccaggagtcgtgtatgagggccagctgatttctatccagcaatatgggcaccaggaagtgacacgctttgattttacaacaacatctacctcaacgccggtcacatctaatactgtgaccggggagacaaccccttttagtccactggtagccacgtctgagagcgtcacggagataactgctagttctttcgttgtctcgtgggtaagcgcttcagacacggtgagcgggtttagggtggagtatgaactctctgaagaaggtgacgagcctcaatacctagatttaccaagtaccgctaccagtgtgaatattcctgacttgctccccggacggaagtatatagttaacgtctatcagatttctgaggatggagaacaatcgttgatactgagtacatcacagaccacggctccagatgcccctccggacactaccgtagaccaagtcgacgacacttccatcgtcgtgcgttggagtcgtccacaagctcctatcaccggttacaggatcgtatactcaccttcagtggagggatcaagtactgagctcaatctgccagagactgctaattccgtcaccttatctgatcttcagccgggagttcagtacaacatcaccatatacgctgtggaggagaatcaggagagtactccagttgttattcaacaggagaccacaggtactcccaggtccgatacagtaccctctccccgtgaccttcagtttgtagaggttaccgacgtcaaagtcacaattatgtggaccccaccagagtccgccgtcactggctaccgggttgacgtcatacccgtcaacttgcccggagagcacggtcagcgtttacctattagcagaaatacattcgccgaagtgaccggtctcagtccaggggtgacctactattttaaagtgttcgcagtgtctcacggtcgcgagagtaagcctctcacagcgcagcagacaacgaaactggacgcacctaccaacctgcagttcgtcaatgagacagacagtacggtgctggtgcggtggacacctccaagagcacagataaccggctacaggctgacagttggcctcaccagaaggggccagccccgacagtacaatgttggaccgtctgtgagcaagtacccgttgagaaacctgcaacctgcttcggagtataccgtgtcactggttgccattaagggcaaccaggagagccctaaggccaccggggttttcaccacactacagcccggaagctctatccctccttataacactgaagtgacagagaccaccatcgttatcacctggacaccggcaccacgaattggattcaagctaggagttagaccgagtcagggtggagaggccccaagggaagtgacttccgatagcggttctattgtagtctccggccttaccccaggtgtggagtatgtgtacacaatccaggtgctgagagatggccaggagagggacgcacccatcgttaataaagtggtgactcctttatctccgcctacaaacctgcatctcgaggccaatccagatacaggggttctgacagtctcttgggagcggtccactaccccagatattactggctacagaatcacaaccacccctactaatgggcagcagggaaattcccttgaagaagtggtacatgccgatcaatcctcttgtacctttgacaatctttcccccggtcttgagtacaacgttagtgtgtacactgtgaaggatgataaggagagcgttccaatcagcgatacaatcatcccagaggtgccccagctgaccgacctatcctttgttgacataacggatagctcgataggcctcagatggaccccactgaacagctcaaccattatcggttaccgtattacagtggtggctgcaggcgaagggataccaatcttcgaagatttcgttgacagttcggtcgggtattacaccgtgaccggacttgagcccggaatcgattatgatatctcagtgataactcttatcaacggcggtgaatcagccccaactaccctaacacagcagaccgctgtccctccacccacagatcttcggttttttagcgatataacagcgaactcatttaccgttcattggatcgcaccaagagcaactatcactggataccgcattcgacatcatcctgaacacttctcaggacgccctagagaagaccgagtacctcacagccgaaactctatcaccctgaccaatttgacccccggaacggagtatgttgtaagtatcgtcgcactcaacgggagggaagagagccctcttcttataggtcaacagagtacagtgtctgacgttccacgggacctggaggtggtcgcagcgactccgacgtctttgctcatctcttgggacgccccagccgtcaccgtgcggtattacagaattacttacggcgaaactggaggtaactccccagtccaggagttcaccgttcccggttctaagagcactgctaccattagcggactcaagcccggagtggactacactattacagtctacgctgtaaccggcagaggggatagccccgcatcttccaagcccattagcattaactaccgcacggagatcgataagccctcccagatgcaggtcactgatgtacaggataactcaatcagcgtgaaatggttgcccagctcatcgcctgtcacaggctatagggtgacaacaacacctaaaaacggaccaggcccaactaaaacaaagaccgcagggcctgaccaaaccgaaatgactatcgaaggactgcaacccaccgtggagtacgtcgtcagcgtatacgcccagaatcccagtggtgaatcacaacccctggttcagacagccgtaaccaatatcgatagacctaagggattagcatttaccgacgtggacgtagacagtattaagatagcttgggaatctcctcaggggcaagttagcaggtacagagtgacctattcttcccccgaggacggcatccacgagctgtttccagcaccagatggggaagaagatactgccgaacttcaaggccttagacctggctcggagtacaccgtgagcgtggtcgctctccacgacgacatggagtctcagccgctgataggcacccagtctaccgctatcccagctccaactgacctgaaattcacccaggtgactccaactagcctgagcgcacagtggacaccacctaatgtgcagctcaccggctaccgggtgagagtgactccaaaggagaagaccggccctatgaaagaaatcaacctcgctccagattctagctctgtcgtcgtatctggcctcatggtggctacgaaatatgaagtctctgtgtacgctctgaaggacaccctcacatcccggcctgcgcaaggcgtcgttacaacattagaaaacgtctcccctcctcgccgtgctcgtgttacagatgcaacggagactactatcacaatttcctggcggacaaaaactgaaacaataacagggtttcaggttgacgccgttcccgcaaatggacagactccgattcagcgaaccatcaagccagatgtcagaagctatactattacgggcttacagcctggcactgattacaagatttatttgtacactcttaatgacaacgccagatcaagccccgttgtgatcgacgcctcaaccgcaatcgacgcaccctctaacctcaggttcctggcaactactccgaattccctgctggtgagctggcagccaccccgagccaggatcaccggatacatcatcaagtacgaaaagccagggagtcctccacgggaagtcgtgcccaggccacggccaggggtcactgaggccacaatcaccggcctcgaaccgggtaccgaatacactatttacgtaattgccctgaagaataatcagaagtctgaaccactcatcggcagaaaaaagacagatgaactgccgcaactagtcactttgcctcaccccaatctgcacggacccgagattctcgacgtgccatcaaccgtacaaaaaaccccgttcgtcacacaccctggatacgacacaggcaacggaattcaactgcctggcacctccggtcagcaacccagtgtgggccagcagatgatctttgaggagcacggcttccggagaactacgcctccaactaccgctactccgatccggcaccggcctagaccttaccccccaaacgtcggcgaagaaattcagatcggccacattcccagggaggacgtggactatcacctctatcctcacgggcctggactaaaccccaatgccagcaccgggcaggaggccttatcccaaacgactatcagctgggcccctttccaggatacctcagagtatatcatttcatgccatcctgtgggaaccgacgaggagcccctccagttccgggtgcctgggaccagcacttcagctaccctgacaggtttgactcgaggcgcaacatacaatgtcattgttgaggcccttaaagaccaacagcgacataaggtgagagaagaggtcgtcacagtgggtaatagcgtgaacgaaggcctcaaccagccaaccgatgatagctgctttgacccatacacagtatcccattatgctgtcggggacgagtgggagcgcatgagcgagagtggctttaagttactgtgccaatgcctcggattcggttctggacattttcggtgcgacagcagtaggtggtgtcacgacaatggggtcaattacaagatcggagagaagtgggaccggcagggggagaacggccaaatgatgagctgcacatgcttgggaaatggaaaaggggagttcaaatgcgaccctcacgaggccacctgctacgacgatggaaaaacttatcacgtgggagagcagtggcagaaagagtaccttggcgctatctgctcatgcacatgctttgggggacagaggggttggagatgcgacaactgcagacgccctggtggcgagccaagccccgaaggaactacaggccagtcctataaccagtactcacagaggtaccaccagcgcaccaacaccaatgtcaactgtcctatcgagtgctttatgcctttggatgtgcaggcagatagagaagatagccgtgaata

SEQ ID NO: 28691 - DNA, 7341 bp, Artificial Sequence
  Description of Artificial Sequence: Synthetic coding sequence
atgctgagagggcctgggccaggcctgttgcttctggcggtgcagtgtcttggaacagcggtaccttccactggagcctcaaaatcgaaacgccaggcacaacaaatggtgcagcctcaatccccggtggccgtttctcagagtaagcccggatgctacgataacggcaagcactatcagatcaaccaacagtgggagcggacttacctgggcaacgctctggtgtgcacatgctatgggggaagcagaggcttcaactgtgaatctaagcctgaagccgaggagacctgctttgataagtacactggtaacacctacagggtaggcgacacctacgagaggccaaaagactctatgatctgggactgtacttgtatcggtgctggacgagggcgaatctcctgcacaatagctaatcgttgccatgagggcggacagagctataagattggggatacatggagacgcccacacgaaaccggtggctacatgcttgaatgtgtgtgtttggggaacggaaagggtgagtggacctgtaagcctatcgctgagaaatgtttcgatcatgctgctggtacgtcttatgtcgtgggagaaacttgggagaagccttaccaaggatggatgatggttgattgtacttgtctcggggaaggcagtggccgtattacctgtacctcccggaatagatgtaatgatcaagatactcggacaagttaccgaattggggatacgtggtctaaaaaagataatagagggaatttgctgcagtgcatttgtacggggaacggcagaggtgagtggaaatgtgagagacacactagcgtgcagacaactagcagcggatctggccctttcaccgacgtacgagccgctgtctatcagccccagccacacccccaaccccctccctacggacactgcgtgactgactctggggtggtttattcggtaggcatgcaatggctcaaaacccaggggaacaagcagatgctgtgtacgtgcttaggcaatggtgtgtcttgccaagaaacagctgtgactcaaacttacgggggtaactccaatggcgagccttgtgtcctgcccttcacctacaacggaaggacattctatagttgcacaactgagggtcgccaggacggtcatctgtggtgtagcaccaccagtaattatgaacaagaccagaaatactcattctgcactgatcacactgtcttggtgcagacccgcggaggtaattcaaacggagcactatgtcacttcccgttcctgtacaacaaccacaactacactgattgtacttccgaaggcagaagggataacatgaagtggtgcggcaccacccagaactacgatgcagatcagaaattcgggttctgccctatggcggcacacgaggaaatttgcaccaccaatgagggagttatgtatcgcatcggtgaccagtgggacaagcagcatgatatgggacatatgatgcgttgtacctgtgtgggcaatggcagaggggaatggacctgtatcgcctatagccagttgcgggatcaatgtatagttgacgacattacgtataatgtgaacgatacattccacaaaagacacgaagaaggacatatgttgaattgtacctgcttcggacaggggcgaggccgttggaagtgtgaccccgtagaccaatgtcaagacagcgaaacgggcactttttaccagattggcgactcctgggagaagtatgttcatggggtaagataccagtgctactgttatgggaggggaataggagagtggcactgccagccgctccaaacctacccttctagtagcgggcctgtggaagtttttataaccgaaaccccatcacagcccaacagccaccccatacagtggaacgctccccagcccagccatataagcaagtacattctccgatggcgcccaaaaaactccgtcggaaggtggaaggaggctaccatacccggtcacttaaattcatacacaattaaaggcctgaaacccggtgtggtgtacgaggggcaactgatctctatccagcaatacggccaccaggaagtgacccggttcgattttactacaacaagcacctcaacccccgtcacttcaaacacagtgacgggcgagacgacgcccttctctcctttggtagctactagtgagtcagtcacggagataactgcttcgtcattcgtagtgagctgggtaagcgcgagcgataccgttagcggcttcagggtggaatatgaactcagcgaagagggagatgaacctcaatacctcgacctgccatcaaccgccacatcagttaacataccagatttgttgcccggtaggaagtatattgttaacgtgtaccagatctctgaggacggcgagcagtctcttattttgagcacctcccagacgaccgctcccgatgcgcctcccgacaccacagtggatcaagtcgatgacacctcgatcgtggtgaggtggtcacggccacaagcacccatcaccggatatcgaattgtgtatagcccttcggtggaggggtcatcaacggagctcaatttacccgagacagctaattccgtgacattgtcagaccttcagcccggagtccagtacaatatcacgatatacgccgtggaagaaaatcaggaatctacacccgtggtcatccaacaggagaccaccgggacgccgagatctgacaccgttccaagccctcgtgatctgcaatttgtcgaggtgacggatgtaaaagttacaataatgtggacaccccctgaatcagccgtgacagggtaccgcgttgacgtcatccccgttaacctcccgggtgaacacggacagcgactgcctatttcccgcaacaccttcgccgaggtcaccgggctgtcacccggagtaacctactacttcaaagttttcgctgtctcgcatggcagagaaagcaaacctctgactgcccagcaaaccaccaagttagatgcgcctaccaacttacagttcgtgaacgagaccgattccactgtcctggtgaggtggacccctcctcgagcacagatcactggatacaggctcaccgtggggctcactagacggggacagcctagacaatacaatgtgggtccaagcgtgtccaaatacccattgaggaatttgcagcccgcaagcgagtacaccgtatccctcgttgccattaaagggaatcaggagtcacccaaagctacgggtgtgtttaccaccctccagccgggatcaagcatacctccgtacaataccgaggtcacagaaaccacaatcgttatcacatggactccagctcccagaattggatttaaacttggcgttcgaccaagccagggcggtgaagcaccacgggaggttacctctgattctggcagcatagtggtctcaggactgactcccggagtcgagtatgtttacaccatccaggtcctaagggatggacaggaacgcgacgcgccaatagtaaataaggtggtgacacccctgtcaccacccaccaacctccatctcgaggccaaccctgacactggtgtactgacagtgtcatgggagagatcgaccacaccggatattactggatatagaatcacgactacacctacaaatggtcagcagggcaactcacttgaagaagtggtgcacgcagaccagagcagctgcaccttcgacaacttatcacccggacttgagtacaacgtgtcagtgtacaccgttaaagacgacaaagagtcagtgcccataagcgacaccatcatacctgaagtgccgcagctcaccgatctgtctttcgtggatattacagactcctcgattgggcttaggtggacaccactcaactcatctactattataggttatcggatcactgttgtggctgctggggaaggtattcctattttcgaggactttgtggattcgtctgtgggatattataccgttacgggtctcgagcctggcatagactatgatatttcagtgataacactgatcaacgggggtgagtcagccccaacgactctcacacagcagaccgcggtgcccccaccaaccgatctgcggttcaccaatatcggtcctgataccatgcgagttacctgggctccacccccttcgatcgacctgactaatttcctggtccgctacagcccagtgaagaatgaagaggacgtagccgaactgtcaatcagtccttctgacaatgcggttgtcctgaccaacttgctcccagggaccgagtacgttgtctccgtgagctcagtctacgaacagcatgagtctactcctctgcgcggacgccagaagaccggcctagacagtcccaccggtatcgatttcagcgacattacggccaattcctttacggtgcattggattgcccctcgggcaacaataacagggtatagaattcggcaccatccagaacatttctcaggcagacccagagaggatcgcgtcccgcattctcggaattctattaccctgaccaatctgactcccggaacagaatacgtagtgagcattgttgcgctgaacggacgagaggagagcccgctgcttatcggccagcagagcacggtaagtgacgtgcccagggacctcgaagtggtggccgcaacccctactagtctgctcatctcatgggatgcccctgctgtgacagtgaggtattataggatcacctacggcgagacaggtgggaactcgcctgtccaggagttcacagtgcctggctccaaatctacagccactataagcggtctgaaaccgggagtcgactatacaatcacggtgtacgcagtcaccggacggggtgacagtccggcaagcagtaagcctatcagcattaactataggaccgaaatagataagccatcgcagatgcaggtaacggatgttcaggacaatagcattagcgtgaaatggctcccctcatccagcccagtgacaggctatcgcgtaacaacgacaccgaaaaacggaccaggacctactaagacgaagacagccggtcctgaccagacagagatgaccattgaaggactgcagccgacagtggagtacgtggtatctgtgtacgcccagaacccatcaggcgaaagccagcccctagtccaaactgcagtaaccaacatcgacagacccaagggactggctttcaccgacgtggacgtggactcaattaagatcgcctgggagtcaccccaaggccaggtgagtaggtaccgggtcacatatagttcccccgaagatggaatacatgaactgttcccagccccagatggcgaggaggacaccgcagagctacagggccttcggccaggctccgaatacactgtgtccgtggtcgctttacatgacgatatggagtcacagcctctcatcgggacccagtccacagctataccagctcccaccgacctcaagttcacccaggttactcctacatccctttccgcccagtggacacctcccaatgttcaactgaccggctaccgcgttagggtaactcccaaggaaaagactggtccgatgaaggagatcaatctcgctcccgatagcagctctgtggtagtgagcgggctcatggtggccactaagtatgaagtatctgtgtacgccctcaaagacacgctgacatcccggcctgcccagggtgtggtaacgaccctcgagaatgtttcccctcctagacgtgcccgtgtcactgatgccactgaaaccaccattactattagctggagaaccaaaactgagaccatcacgggatttcaggtggacgccgtacccgctaacggccagaccccgatacaaaggacaatcaaaccagacgtcaggagttacacaattaccgggctgcagcctggaaccgattataaaatatatctatacaccctcaacgacaatgccagatcatcacccgtggtgatagacgcctccacagcgatagacgccccatctaacctcagatttctagcaaccaccccaaactcactcttagtatcctggcagcccccaagagctcgtatcactggctatattataaagtacgagaagcccggatctccccctagggaggtggttccaagaccgagaccgggagttaccgaggcaactataaccggtctggagccgggtactgaatacaccatttacgtgatagccctgaaaaataatcagaagtctgaaccgctgatcggtcgcaaaaagactgatgagctaccacagttggtaacgctaccccaccctaatctgcatggccctgagatccttgatgtgccctcaaccgtccagaagacccctttcgtgacacatcctggatatgacaccggaaatgggatccagttgccagggactagcggccagcagccatcagtgggccagcaaatgattttcgaggaacatggatttcgacgtaccacgccgcctaccaccgccacgcctatccgacacagaccacggccttacccccctaacgtgggccaggaggcactcagtcaaacaacaatttcttgggccccttttcaggatacaagcgagtatattatctcatgtcaccccgtgggcactgacgaggagccactgcagttcagggttccagggactagtacaagcgctacccttactggcctaacacgtggggctacctataacgtcattgtcgaagcgctgaaggatcagcagcgacacaaagtgcgagaggaggttgtaaccgtaggaaactccgtaaacgaaggcctcaatcagcctaccgacgactcctgcttcgatccatacacagtgtctcattatgcggttggggatgagtgggagaggatgagtgaaagcggcttcaagctcctgtgccagtgtctaggctttgggtcaggccatttcaggtgtgatagctcccgctggtgtcacgacaatggcgtgaactacaagatcggtgagaagtgggatcggcagggcgagaacggtcagatgatgtcttgcacttgtttaggcaatggcaagggtgaatttaagtgtgacccacacgaagctacgtgctatgacgatgggaaaacgtaccacgtcggcgagcagtggcagaaagagtatttaggagccatatgttcatgcacttgcttcggaggacagaggggttggcggtgcgataactgcagacggcctggcggtgagccttcccctgaaggtacaaccggacagtcgtacaatcaatacagtcaacggtatcaccagcggactaatacaaacgtgaactgcccgatcgagtgctttatgccccttgacgtgcaggctgatagagaagactctagggagtac

SEQ ID NO: 28692 - DNA, 7068 bp, Artificial Sequence
  Description of Artificial Sequence: Synthetic coding sequence
atgctcagaggtccaggaccgggactgctccttctggccgtacaatgtctcgggacagccgtcccatccacaggggcatctaaatcgaagagacaagcccagcaaatggtacagccacaatccccagtggccgttagccagagcaagccgggatgctatgacaacggtaagcattatcagatcaatcagcaatgggagcggacctatctgggtaatgctctcgtctgcacttgttacggaggtagtagaggtttcaattgtgagtctaaacccgaagcagaggagacttgctttgacaaatataccgggaacacctaccgcgtgggagatacatacgaaaggcctaaggattcaatgatctgggattgcacttgtatcggagctggcagagggcgaatttcctgcactattgccaatagatgccacgaaggcggacaatcctataaaatcggcgatacatggcgtaggccccacgaaacagggggttacatgttagagtgcgtctgtctgggtaatgggaaaggcgagtggacgtgcaaacccatcgccgaaaaatgtttcgaccatgctgcaggaactagctatgtggtaggcgagacctgggagaaaccttaccagggctggatgatggtggactgcacttgtctgggcgagggttccgggcgaataacttgtacctctaggaacagatgtaacgatcaggacaccagaacgtcgtatcgaataggggatacgtggtctaaaaaagataatcgcggtaatcttctccaatgcatttgcactggaaatgggaggggggagtggaagtgcgaaagacatacctctgtgcagactacttccagcggttccgggccatttactgatgtgcgcgctgccgtctaccagccccagccacaccctcagccgcctccgtacggacactgcgtcacagactccggagtggtgtacagtgttggaatgcaatggctcaaaacacagggaaataaacagatgctctgtacgtgcctcgggaacggcgtctcctgccaagaaactgcagtcacgcagacatacgggggtaactctaacggagaaccttgcgtgctgccttttacgtacaatggcagaacattttacagctgtaccaccgagggtcgccaagatggacatttgtggtgttctaccacatccaactatgaacaggaccagaaatacagcttctgtaccgatcacacagtcttagtccagacaaggggcggtaactccaatggcgctctttgccacttcccctttctttacaacaaccacaactacaccgactgcacatctgagggaaggcgggacaacatgaaatggtgtggcactacacagaactacgacgccgaccagaaattcggcttctgtcctatggccgcacatgaagaaatttgcactacgaacgaaggagttatgtataggattggcgaccaatgggataagcaacatgatatgggtcacatgatgcggtgtacttgcgtcggcaacggacgcggtgagtggacttgtatcgcctatagccaattgagggaccaatgtatcgtagatgatattacgtacaatgttaatgataccttccataagcgtcacgaggagggccatatgcttaattgtacctgctttggccaggggcgaggaaggtggaagtgcgatcccgtagaccagtgccaggatagcgagaccggcactttctaccagataggcgacagttgggagaagtacgtgcatggcgttaggtaccagtgttactgctatgggcgaggcattggagaatggcattgtcagcctctgcaaacgtatccgtccagtagtgggcctgtagaggtgttcatcaccgagacaccctcccaaccgaactcccaccctatccagtggaacgctccacagccatcacatatttcaaagtacatattgaggtggcgtccaaaaaactcggtaggaaggtggaaggaggccactatccctggccacctaaacagctacacaattaagggcctgaaaccaggcgtggtatatgaggggcagcttataagcattcagcagtacgggcaccaggaagtgactcgcttcgacttcacaaccaccagtacttctactccggtgacctccaacacggtaactggggaaactactccattctctcccctggtagcaacaagcgagtccgttactgaaattacagcttccagctttgtggttagttgggtgtctgccagcgacacagtgtctggttttcgcgtcgaatacgagctgtcagaagagggagacgagccccagtaccttgatctcccatctactgctacctccgttaatatcccagatctgctgccagggcgtaaatatattgttaacgtctatcagatttctgaggacggcgaacaaagcctcatcctttccacctcccagacaactgcgcctgacgctccgccagataccacagtggatcaggtagacgatacctctatcgtggtcagatggagtagaccccaagctccaatcacgggctatcgcatcgtttattcgccgtcagtagagggtagcagcacagaattgaatctgcccgagactgccaattcggttaccctatccgacttgcaacccggagtacagtacaatatcacgatttacgcagttgaggaaaaccaagaaagcactcctgtcgtgatccagcaggaaacaacaggaaccccacgttctgataccgtgccatccccccgtgatctccagttcgtagaggttacagatgtcaaagtaacaatcatgtggacaccccctgagagcgcggtcaccggctatcgggttgatgtcattcctgttaacctccctggagagcacgggcagaggttgcctatctcccgtaacaccttcgccgaagttaccggtctgtctcctggtgtgacttactactttaaagtatttgccgtctctcacggacgcgagagcaaaccactgaccgctcagcagactacaaaactggatgctccaactaacctgcagtttgtgaacgagactgattctaccgtactggttagatggacaccaccgagggcccagattaccggataccgtctaacagttggactcacccgccgaggacaacctaggcaatataatgtgggaccaagtgtttcaaagtatccactgaggaatctgcagcctgctagtgagtacaccgtatccctcgtggcaataaaaggcaaccaagagtcccccaaggccactggcgtgtttaccacacttcagccaggttcttcaatcccgccttataataccgaggtgaccgaaaccaccatcgtgatcacatggacccccgctcctcggataggcttcaagttgggagtgagacccagtcagggtggcgaagcccctcgcgaggtaacaagcgattcagggtctatcgtggtgtcaggcctgacacccggtgtggagtatgtgtacactattcaggtcctccgggacggtcaggaacgcgacgctccaattgtaaacaaagtcgttactcccctatctccccctacaaatctgcacctagaagcaaatcccgatactggagtattgacagtatcttgggagcgcagtactacacctgatatcacaggttacaggatcactaccacaccaacgaatgggcagcaggggaacagcctggaggaggtggtgcacgctgaccagagtagctgtacattcgacaacctctctcctggcctcgagtataatgtatccgtgtacacagtgaaggacgataaggagtccgtgcccattagcgacaccatcataccagccgtgcccccacccactgacctgcggtttacaaatatcgggcctgataccatgcgagttacatgggcaccacctccatcaatcgatttgactaacttcttggtacggtatagtcctgtgaagaacgaggaggacgtggcagagctctccatctcgccatcagataacgccgtggtacttacaaatctccttcctggcaccgagtatgtggtcagcgtttcaagcgtgtacgagcagcacgaatcaacacctctcaggggaagacagaagacaggcctggattcaccgacagggattgacttttctgacatcacggctaacagcttcaccgtgcactggattgcgccaagagccacgatcaccggctacaggatacgccaccatcccgagcacttcagcgggaggcctagggaagaccgcgtgccgcactctcgtaactccattacccttacaaatcttacaccaggcaccgaatacgtggtttccattgtggctcttaatggtcgcgaagaaagtcctctcctaattggtcagcagtcaaccgtgagcgatgtgccacgagacctggaggtggtcgcagccacccctacttcactgttgatatcgtgggacgctccagcagtcaccgttcggtattacaggattacatatggagagaccggcggaaatagcccagtacaggagtttactgtaccagggtccaaaagcacagccacgatctccggcctgaagcctggagtcgattacaccatcaccgtgtacgctgtcaccggccgaggcgactcccctgcctcaagtaaacctataagtattaactacagaactgagatcgataaaccaagccagatgcaagtgacagacgtgcaagacaacagcatttccgtcaagtggctcccatcatcctcaccggttacagggtatcgcgtcacgaccactccaaagaatggccctggacccaccaagaccaagacagcaggcccagatcagaccgaaatgaccatcgaggggttgcagccaactgttgaatatgtggtcagtgtttacgctcagaatccttccggggaatcccagcccctggtccaaactgccgttacgaatattgatcggcctaaaggcctcgctttcaccgacgttgacgtggattcaataaaaatcgcatgggagagcccacaaggtcaggtgtcacgctatcgcgtcacttattcttcccccgaggacggcatccatgagctgtttccagccccagacggtgaggaggatacggccgaacttcaaggcctacggccaggcagtgaatatacagtctcagtagtggcgctgcatgatgatatggaaagccagccattgatcgggacccagagtaccgccattccagctccgactgacctcaagttcacccaggtgaccccaacctcattgagtgcccaatggaccccaccaaacgtccaattaactggttatcgcgtgcgtgttaccccgaaggagaaaacaggcccaatgaaagagattaacctggcccctgactcctcctctgtcgtggtaagcggcctgatggtggccaccaagtacgaagtgtccgtttacgccctgaaagacacgttaaccagcaggcctgcacaaggagtggtcaccactctcgaaaatgtgagccctccacgcagagctcgggttaccgatgctaccgagaccacgattacaatttcttggcgcaccaagactgagacaattaccggattccaggtggatgctgttccagccaacgggcagacacctatccaaaggacaataaagcccgacgtgcgttcttatacaatcaccgggctgcagcccggaactgattacaagatctatctgtatacactcaatgataatgccaggagttcgcccgttgtcatcgacgctagtaccgccatcgacgccccatctaatcttcgttttctcgccacaactcccaattctttattagtctcctggcagcccccaagagcaagaattaccgggtatataataaagtacgagaaaccagggtccccccctcgagaagtcgtgccgagaccgaggcctggcgtcaccgaagcgacgatcactggtctggagcccggtacggaatacaccatctatgttatcgcgctgaaaaacaatcagaaatccgagcccctgatcggcagaaaaaaaactgacgagcttccacaactggtcacactgccgcaccccaacctgcacgggccagagattttggatgtgccgagcaccgtgcagaaaactcctttcgtgacacatccaggctacgatacaggtaacggtattcaactgccgggaacttctggtcagcagcccagcgtaggtcagcagatgatcttcgaggaacatgggtttcgtaggacaactccccctaccactgctacacctattcgccaccgtcctcggccatatcccccaaatgtgggtcaggaagccctttctcaaaccacaataagttgggccccttttcaggacacttcggaatacatcattagctgtcatcctgtcggaaccgatgaggagcccctgcagtttcgggtccctggtacgtctacctcagccactctgacaggtctaacaagaggggcaacctacaatgttatagtcgaggctctcaaagaccagcagcgacacaaggtgcgtgaggaagtcgtgacagttggcaactccgtcaatgagggcctcaatcagccaaccgatgatagctgttttgacccttacaccgtaagccactatgcggtaggggatgaatgggaacggatgagcgagtccgggttcaaactactttgccaatgcttgggcttcggctcaggccatttccggtgcgactcaagtcgatggtgccacgataacggcgtgaactacaaaatcggtgagaagtgggacaggcagggcgaaaacggccagatgatgtcgtgtacatgcctgggcaacggtaagggcgaattcaaatgcgaccctcacgaagctacttgctacgacgatggcaaaacatatcatgtgggagagcagtggcagaaggaatatctcggagcaatctgttcatgcacttgctttggaggccagcgcggatggcgttgcgacaactgtcggcgacccggtggcgagcccagccctgagggaaccacagggcagagctataaccagtatagccagaggtaccatcagagaacaaacacgaatgtgaattgcccaatcgagtgcttcatgcccctagacgtgcaagctgatcgcgaagactctcgcgagtaa

SEQ ID NO: 28693 - DNA, 6555 bp, Artificial Sequence
  Description of Artificial Sequence: Synthetic coding sequence
atgctgcgtggcccaggaccgggtctcctgctgctagccgtgcaatgtctggggacagcagtgcctagtacaggagccagtaaaagtaaacggcaggcgcagcaaatggttcaaccccagtccccagtggccgtgtctcagagtaaacccggatgttacgacaacggaaaacactatcagattaatcagcaatgggagaggacatacctgggaaacgccctggtgtgcacgtgttacgggggtagtcgtggcttcaactgtgagagcaaaccggaagccgaggaaacctgttttgacaagtacaccggcaacacgtaccgggttggcgacacctatgagagacccaaagactccatgatatgggactgcacttgcattggggcaggacgcggtcgaatttcttgcacaatcgccaatcgatgccacgagggaggacagtcttataaaataggtgatacatggagaaggccccatgagaccggagggtacatgcttgagtgcgtatgtctgggcaatggtaagggagaatggacatgcaaacctatcgccgaaaaatgcttcgaccacgctgcaggcacctcatatgtagtcggcgaaacgtgggagaagccctaccagggctggatgatggtggactgtacatgtcttggggagggatctggtagaattacatgcactagccgcaacagatgcaatgatcaagacactcgcacttcctatcgcattggggacacttggtctaagaaagacaacagaggaaacctgctgcaatgtatttgcacaggaaatggcaggggcgagtggaagtgtgaacgccatacatccgtgcagacgaccagctcgggcagtggtcccttcaccgacgtgagggccgctgtgtaccagccccagcctcatccacagccaccaccttatggccactgtgtaacagactccggggtggtttattccgtggggatgcagtggcttaaaactcaagggaacaagcagatgctttgtacttgtttaggaaatggggtatcttgtcaagaaaccgcagtcacgcaaacatatggagggaatagtaatggagaaccatgcgtcctcccctttacttataacgggagaacattttacagttgtacaacggaaggccgacaggatggccatttgtggtgtagtaccacctccaactatgagcaggatcagaagtattctttctgtacagaccacacggtcttagttcaaacccgaggcggaaacagcaacggagcactctgccattttccttttctgtacaataatcacaattacaccgactgcacatctgaagggagaagagacaatatgaagtggtgtggtacgacgcagaattacgatgcagaccagaagtttggattctgtcctatggccgctcacgaggaaatttgcactaccaacgagggagtcatgtaccgtatcggtgatcagtgggataagcagcacgatatgggacatatgatgagatgtacgtgcgtggggaatggccgaggcgaatggacctgtattgcgtacagccagttgagagaccagtgtattgttgacgacataacatataacgtgaacgacacattccacaaaaggcacgaggagggacacatgcttaattgtacttgttttggccagggcaggggcagatggaaatgtgacccagttgatcagtgtcaggactctgagacagggactttttatcaaatcggagactcttgggagaaatatgtgcatggagtgagataccaatgctactgctacggacgcggaatcggggaatggcactgtcagcccctgcagacttatccaagttcttctggccctgtagaggtttttattactgaaacaccatctcagcccaattcccacccaattcagtggaatgcgcctcagccttcccatatatcaaagtacattttaaggtggcgtcctaaaaactcagtcggacgctggaaagaagccaccattcctggccacctgaattcctatacaattaaggggctgaagccaggtgttgtttacgaaggccaactaatatcgatccagcagtacggacaccaagaagtgacgagattcgatttcaccactacatctacgagcactccagtgacctcaaataccgtcacaggcgagacgacacccttctctcctctggtcgccactagtgagtccgtgacagagattaccgcgagttctttcgtcgtgagttgggtgtccgccagcgacactgttagtggcttcagggtggagtacgagctgtccgaggagggagacgagccccagtatcttgacctgccctcaacagccacttcagttaatatccccgacctgctgccaggtcgaaagtacatagtcaacgtgtaccagatttctgaggacggtgagcaatcactgattctcagcacgagccagacaacagcccctgacgcaccacctgacacgacagttgaccaggttgacgacacgagtatcgtggtgcgatggtccaggccccaggccccaatcaccgggtaccgcatagtttactctccttctgtggaagggtcttccacagaacttaacctgcctgagacagcaaatagcgttaccctgagcgacttacagcctggtgttcagtataatattacaatctatgcagtcgaggaaaaccaagaaagtacgcctgtggtaatccagcaggagacaaccggcacgccgaggtccgacactgtccctagtccaagggatctgcagtttgtagaggtgacggatgtgaaggtgactataatgtggacacctcctgagtcagccgtaaccggctatcgggtggacgtaattccagttaacctgcccggagaacacggtcagcggttgcctatttcccgaaatacctttgcagaggttactggactgtctcccggagttacctactacttcaaagtctttgccgtctctcatgggagggaatcgaagcccctgacagcccagcaaaccactaagctcgacgcgcctaccaatctgcagtttgtgaacgaaacggattccacagtgttggtgcggtggactcctccacgcgcacagattacaggttacaggctgactgttggacttacccgtcggggacaaccgcgacagtacaacgtgggcccttcagtcagtaaataccccctgaggaacctccagcccgctagcgaatacaccgtttctcttgtggccatcaaaggcaaccaggagagtccaaaggctacgggcgtattcaccacattgcagcccggatcctcaattcccccatacaatacggaggtaaccgagaccactattgtgatcacctggacaccagcaccacgcattggttttaaactgggggtgcgtccatctcaaggaggggaagctcccagggaggtgacctctgatagcggatcaatcgtcgtcagcggcttgacgcccggagtggaatacgtttacactatacaagtgttgcgggatgggcaagagagagatgccccaattgtcaataaggtggtcactcccctgagcccgcctaccaacctccacctcgaggcgaacccagatacaggcgtgctgaccgtgtcatgggaaaggagcacaactccagacattactgggtatagaatcacaactactccgactaacgggcaacaggggaatagtttagaggaggtagtccatgcagatcagtcaagttgcaccttcgacaatttgtccccaggactggagtacaacgtttccgtttacaccgtgaaggacgacaaagagagcgttcctataagcgataccatcataccggcagtgccgccacctaccgacttgcggttcaccaatattggccctgacactatgcgagtgacatgggctccaccccctagcatcgacctaaccaatttcctggtgcggtatagccccgtgaaaaatgaagaagacgtggctgaactgtccatttcaccaagtgacaacgccgtcgttttgaccaacctgctgcctggcacagagtatgtagtgagtgtgtcaagtgtgtacgagcagcacgaatcaacacctctgaggggcaggcagaaaactggactggactcgcccacaggcattgatttctctgacattaccgcaaatagtttcacagtgcactggattgcacctagagctaccatcactggctaccgtatacggcaccatcccgagcactttagcggaagaccaagggaagatagagttccccatagccgaaactctattacgctcacaaatctgactcctggcactgaatacgtggtgtccatcgtggctcttaatggacgggaagaaagtccactacttatcggtcaacagagcacagtgagcgacgtcccccgagatctggaagtcgtagctgcgactcctaccagtttactcatctcttgggacgccccagcagtcacagtcagatactaccgcatcacttatggcgaaactggaggaaactcacctgtgcaggagtttacagtcccaggcagtaagtccaccgctaccatttccgggttgaaaccaggggtggattacactatcaccgtgtacgctgtgacggggagaggcgattctccggcttcctcaaagcccatctctatcaattatcggacagagattgataagccttctcagatgcaggtcacagacgtacaggataactccattagcgttaaatggttgccctcgagctccccggttaccggctaccgggtaaccacaacccctaaaaacgggcctgggcctaccaagacgaaaacagcaggtccagatcagaccgagatgaccatagagggcctgcagcccacggtggagtacgttgttagtgtttatgcccagaatcctagcggcgagagtcagccattagtgcaaacagctgtgacgaacatcgacagacccaagggactggcttttaccgacgtcgatgttgattcaatcaagatcgcatgggaatcacctcaggggcaggtctccagataccgcgtaacctactcatctcctgaggatgggattcatgaactctttcctgcccctgacggcgaagaggacaccgctgagctgcagggcttgagaccaggttccgaatataccgtttcagtcgtggcactgcacgatgatatggagagccagccactgattggcacgcaatcaactgcaataccagcccctactgatctgaagttcactcaggttacaccaacctctctgtctgcccagtggacacccccaaatgtgcagttgacggggtacagagtgcgagtcactcctaaggaaaagaccgggcctatgaaggaaatcaacctggctcctgacagttcaagcgtggtggttagcggcttgatggtggcaacaaagtatgaagtgtccgtctatgcactgaaggatactttgacaagtcggcctgctcagggagtggtgactacactggagaatgttagccccccaagacgcgcacgtgtcacggatgccaccgagaccaccatcaccatttcatggcggacaaagactgagaccatcacaggatttcaagttgatgccgtcccagctaacggtcaaacgcctattcagcggaccattaaacccgacgtgagaagctatactatcactggcctgcagcctggcacagattacaagatctacctctacactctgaacgacaatgcacggagcagccccgtggtgatcgacgcctccaccgcaatcgatgcccctagcaaccttagatttctcgctacaacaccaaactcccttctggtcagctggcaaccacctcgggcaagaatcactggctatatcattaaatacgagaagccaggcagcccaccaagggaagtggtgcctcggcctcgcccaggcgtcaccgaagccaccatcacgggcctggagccgggtactgagtatacaatctatgtcattgcacttaagaacaaccagaagtctgaaccactgatcggcagaaagaagaccgtcaacgagggactgaaccagcccactgatgattcctgtttcgatccttataccgtatctcactatgctgttggggatgaatgggagcggatgtcggaatcaggattcaaacttctgtgccagtgcctgggattcggaagcgggcacttccgctgtgacagtagcagatggtgccacgacaacggcgtcaattacaaaattggggagaaatgggacaggcagggtgagaacggccaaatgatgtcgtgcacatgtctcggaaacggaaagggtgaattcaagtgcgatccccatgaggctacctgttatgatgatggcaaaacctaccatgtaggggagcagtggcagaaggaatacctaggggcaatttgcagttgtacatgctttggcggtcagaggggatggcggtgtgataactgcagacgtcctggtggtgagccttctcctgaagggacaaccggtcaatcgtataatcagtatagtcagaggtaccaccagaggaccaatacaaacgtgaattgcccaatcgagtgttttatgccgctcgatgtgcaggccgacagggaagattccagggagtat

SEQ ID NO: 28694 - DNA, 6636 bp, Artificial Sequence
  Description of Artificial Sequence: Synthetic coding sequence
atgttgagagggcctggtccaggacttttactcctcgctgtgcaatgccttggcaccgccgttccctctactggagcctcaaagagtaaaagacaggcacagcaaatggtgcaaccacaaagcccagtggctgtcagccaaagtaaacctggatgttatgacaacggcaagcactaccagattaaccaacaatgggaaagaacatatctcggcaatgcgctcgtctgcacttgttacgggggatcccgcggatttaattgtgagtcaaaacccgaggccgaggagacttgcttcgacaagtataccgggaatacctatcgagtcggggatacctacgagaggcctaaagacagtatgatttgggattgtacttgtattggggctggcagaggccgaataagttgtactattgctaaccgctgccatgaagggggacagagctataagatcggagatacgtggagaagaccccacgagactgggggatatatgctcgaatgcgtgtgcctaggcaacggcaagggtgaatggacttgtaagcctattgctgaaaaatgctttgaccacgccgcaggcacctcgtatgtcgttggcgaaacttgggaaaagccgtaccagggctggatgatggttgactgcacatgtcttggagaaggcagcgggaggatcacatgtacatcccgaaaccgctgcaacgatcaggacacaagaacttcctaccgcattggagatacctggagcaagaaggacaaccgcggaaatctgctgcagtgtatctgtacaggcaacgggagaggagagtggaagtgcgaaagacacacaagcgttcaaacaacctcatcagggagcgggccttttactgacgtgcgcgctgccgtgtatcagccccagcctcacccgcagccaccgccttacggccattgcgtcactgattctggtgtggtttattccgtcggcatgcagtggttgaaaacccagggtaataagcagatgctgtgcacctgcctgggtaacggggtcagctgccaggaaactgctgtgacacaaacctatgggggaaatagcaatggagaaccttgtgtgctgcctttcacctataacgggaggaccttttattcctgcaccaccgagggccgtcaggatggacatctctggtgttccacaacttctaactacgagcaggatcagaaatactctttctgcaccgaccatacagtcctcgtccagacccggggtggaaatagtaacggcgcattgtgccacttcccatttctgtataacaatcacaattacacggactgtacttctgaaggacgcagggacaatatgaagtggtgtggaaccacgcagaactacgatgctgaccagaaattcggcttctgccctatggcagctcacgaggagatttgcaccaccaatgagggcgtgatgtatcgcattggggaccagtgggataagcagcatgacatgggccacatgatgcggtgcacatgcgtgggaaacggcaggggagaatggacctgtattgcttattcacaactcagggatcagtgcatcgtggacgacatcacttacaatgtcaacgatactttccataagcggcatgaagagggccacatgttaaactgtacctgctttggacagggtcgcggacggtggaaatgtgatcctgtcgatcagtgccaggatagcgaaaccggcacgttctatcaaatcggcgattcctgggaaaaatacgtacatggcgtgagatatcagtgctattgttatggacgcggtatcggtgaatggcactgccagccgctgcagacctacccatctagttccggtcccgttgaggtgttcattacagagactccttcccagccaaatagtcatccaatccagtggaacgctccacagccatcccatatttctaaatacatcttgagatggcgccctaagaatagtgtcggacgatggaaagaagctacaatccccggtcacctgaattcatacaccattaagggactgaagcctggcgtagtgtacgaggggcaactgatctcaatacagcagtatggccatcaagaggtgacaagattcgattttactactacaagtacgagcactcctgtgacatctaacaccgtgacaggagaaaccacgcccttctctccactggtcgcgacatcagaaagcgttactgagattacggccagcagctttgttgtgtcctgggtctccgccagcgacaccgtgagcggattcagagtggagtacgagttatcagaggagggtgatgaaccacagtatctggatttgcctagcacagccacatcggtgaacatccccgatctactccccggaagaaagtacatcgttaacgtgtatcagatctctgaagacggggagcagagcttaatcctgtcgaccagccagactaccgctcccgacgctccacccgacaccactgtggaccaggtagatgacacatccatcgtagttcgttggtccaggcctcaggctccaattacagggtaccgaatcgtctattccccttccgtcgagggatcaagcactgaactgaatttaccagagaccgctaattcggtcaccctaagcgacctgcagccaggagtgcagtacaatataactatttacgccgtagaagagaaccaggagagcacaccagtcgtcatccagcaggagacaacaggcactccgcgaagcgataccgtcccgagccccagggacttgcaattcgtagaagtcaccgatgtgaaagtgacgatcatgtggacacctcctgagagtgcagttaccggttatcgcgtggatgtgatacctgtgaatctaccgggagaacatggtcagagattgcctatcagcaggaatacctttgctgaagtcaccggtttatcccctggcgttacctattactttaaagtcttcgcggtgagccatgggagggagagcaagcctctgactgcgcagcaaactacaaagttggatgctccaactaacctgcagttcgtaaacgaaaccgacagcaccgtacttgtgaggtggaccccaccaagggcacagatcacaggctatcggctgactgtgggactgaccaggcgtggccagccgaggcagtacaacgtaggacctagcgtgagcaaatatccactccggaacctccagccagcttcagagtacacagtttcactggttgcaatcaaggggaatcaggagagccctaaggcgaccggagttttcaccactctccagcctggatccagcatacccccttacaataccgaggtgactgaaaccaccatcgtgattacttggacaccagcaccccgaattggattcaagttgggcgtgagaccgagccaaggtggcgaagccccacgagaagtgacatccgattcaggaagtattgtagtgtcgggcctgacaccgggtgttgagtacgtgtacaccatccaggtgttaagggacgggcaggaacgggatgcacccatcgtcaacaaggtggtgactcctctgtcaccccctaccaacctgcacttagaggctaatcctgatacgggagtgcttacggtcagttgggagcggagcacaacacccgacattacaggctacaggattacaacaactcctacaaatggccaacagggaaattctctggaagaggtggtgcacgcagatcagtcttcctgtacctttgataacctctcgcctggtctcgaatacaatgtcagtgtgtatacagtcaaggatgacaaggagtctgtgcctatatccgatacaatcatccccgctgtgccacctcccaccgaccttcgcttcaccaatattggaccagatactatgagggtgacttgggccccaccacccagtattgacttgaccaattttctggtcaggtattcacccgtaaagaacgaagaagacgtggccgagctgtcaatatctccctccgacaatgccgtggtgcttaccaacctgctgcctggtaccgaatacgtagtctctgtgagctctgtgtatgaacagcatgagtcaacaccattgcggggacgtcaaaagaccgggttggacagccccaccggaatcgatttttcagatataaccgctaatagcttcaccgtccattggatcgccccacgcgctaccatcacaggctataggatccgccatcacccagaacacttttcaggacggccacgagaggatagagtgccacactccagaaactcaatcacactcaccaacctgactccaggcactgaatatgtggtgagcatcgttgccctaaacggtagagaagagagtccattgctcattggtcaacagagcaccgtgtccgatgtgccaagggacctcgaggtcgtcgctgcgacgcctacctcattactgatttcctgggacgccccagccgtcacggtccgttactaccggataacttatggagagaccggaggcaattctcctgtgcaggagtttactgtgcccggatctaagtcaactgccacaatcagtggcctcaaaccaggggtcgactacacgattacagtgtacgcagtgactggtagaggcgatagtcccgcaagtagcaagcccatttctataaattatcggaccgagattgacaagccttcccagatgcaggtgacagacgttcaggataatagcatctccgttaagtggttgccatcatctagccccgtgacaggatatagagtgactacaacgccgaaaaacgggcctggccctacgaaaaccaagacagcaggaccagatcaaacagagatgacgatcgaaggcctccagcccacagttgagtatgtggtcagtgtctacgcacagaatccctctggggagtcgcagccccttgttcagaccgcagtgacaaacatcgatcgtcctaaagggctggctttcactgacgtagatgttgattctataaaaatcgcctgggagagccctcagggacaagtaagccgttacagagtgacatacagctctcccgaggatggaatacacgaactattcccagcaccagacggagaggaagatacagccgaacttcaagggcttaggccagggtcagaatataccgtctctgtggtggcactgcatgatgatatggagagtcagcctctgatcgggacccaatctaccgcgatcccagctcccaccgacctgaagttcacacaggtgacccccacgagcttaagcgcacagtggaccccccctaacgttcagctgacaggttacagggtacgtgtgacccccaaggagaaaacgggccctatgaaagaaattaacctggcccctgacagctcgtctgttgtcgtgtcggggttgatggtggccaccaagtatgaagtgagtgtttacgcgttgaaagatacactgacctcacgacccgctcagggcgtggtgacaacacttgaaaacgtgtccccacctcgcagggccagagtgacggatgccacagaaactacaattacaatcagctggcggacaaaaacggagacaattaccggatttcaggtcgacgccgtcccggctaacgggcagacaccaatacagcggactattaagcccgacgtccgctcatacaccatcacaggcctgcagccaggaacggattacaagatctatctctacactctaaatgacaacgccagatcaagtcctgtggtcattgacgcttccactgcaatcgatgccccaagcaatctgcgtttcctggcgaccacaccaaactccttactggtctcttggcaaccacctagggcgagaattaccggctatatcattaagtacgaaaagcccggtagtcccccacgggaggtggtaccacgccctaggcccggagttactgaggccacaattaccggattggagccgggtacagaatataccatctacgtgatagccctgaagaacaaccaaaagtcagaaccactgattggtagaaagaaaactggtcaggaggccttgagccagactactatatcctgggctcccttccaggacacatcggagtacattattagctgccatcctgttggaactgacgaggaaccacttcagtttcgagtgccagggacgagtacctccgcgactttaacgggcctgacaagaggcgcaacctataatgtcattgtcgaggccttaaaggaccagcagcgtcataaagttcgcgaggaggttgtgactgtgggtaatagcggctggtgccatgacaatggagtgaactacaagatcggtgagaaatgggaccgccagggcgagaacggacagatgatgtcttgcacatgcctggggaatgggaagggggaatttaagtgtgatcctcatgaggctacgtgctacgatgatgggaagacttatcacgttggagagcagtggcaaaaggaatacctgggcgctatctgttcttgcacatgctttggtggacagagaggctggcgttgtgacaattgtcgacgtcctggaggcgagccatcccctgaaggaaccacggggcagagttataatcagtatagccaaaggtaccatcagaggaccaataccaatgtgaactgccccatcgagtgttttatgcctctggatgtgcaggcagaccgggaggattctcgagagtac

SEQ ID NO: 28695 - DNA, 7434 bp, Artificial Sequence
  Description of Artificial Sequence: Synthetic coding sequence
atgttgaggggtcccggtcctggacttttgctcctggcagtccagtgcctgggaaccgcagtgccatcaacaggagctagcaagagcaaacgccaggcccagcagatggtacagcctcaatctccagtggcggtgtcacagtccaagccgggatgttacgacaatggaaagcattaccagattaaccaacagtgggagcgtacctacctagggaacgctctcgtgtgtacttgttatggcggaagtcggggatttaactgcgagtcgaagcctgaagctgaggagacctgtttcgataagtacactggcaacacataccgcgtcggagatacttacgaaagacccaaggacagtatgatctgggattgtacatgtatcggagccggaaggggaaggattagctgtactatagccaataggtgtcacgaggggggacagtcttacaaaatcggggacacctggaggcgtcctcatgaaacgggcggatacatgttggaatgtgtgtgcttgggcaatggcaagggtgaatggacttgtaaacccatagcagaaaagtgcttcgaccatgccgcagggactagttacgtagtgggagagacatgggagaaaccataccagggttggatgatggtcgactgcacttgcctaggcgagggctctgggcgaatcacctgtacctccaggaatcgctgtaatgaccaggatacaagaacttcctataggataggagacacatggagcaagaaagataatcggggaaatcttctgcaatgtatttgcaccggtaatgggagaggcgaatggaaatgtgaacgccacaccagtgttcagaccacaagcagcggctctggaccctttacggatgtccgcgctgccgtgtatcagccgcagccccatcctcagccgcctccttatggacactgcgtgaccgactccggcgtggtctactccgtgggtatgcaatggctaaagacccaaggaaacaaacaaatgctttgcacttgcctcgggaacggtgtctcttgtcaggagaccgccgtcacacagacatacgggggaaatagcaacggagaaccatgcgtactgccgtttacctacaatgggcgtacattctactcctgtaccactgagggacgccaggacgggcacctgtggtgctccacaacgtccaattatgaacaggaccagaagtactcgttctgcactgatcacaccgtgctggtgcaaacaagaggcggaaactctaatggagcactgtgtcattttccatttctgtataacaatcataattacacagattgcactagcgaaggcaggagggacaacatgaagtggtgtggcaccacccagaattatgacgcagatcagaaatttggtttctgcccgatggcggcacacgaagagatttgcaccaccaatgagggagtcatgtacaggatcggcgaccagtgggataaacagcatgatatgggccatatgatgcgatgcacttgcgtgggcaacggacggggagagtggacttgcatcgcttatagccaactgcgcgatcaatgcatcgtcgacgatatcacctacaacgtgaatgacaccttccataaaaggcacgaggagggacatatgcttaactgtacttgtttcggacagggacgcggacggtggaagtgcgacccggtggaccagtgtcaagacagtgagacgggaacgttttaccagattggggactcctgggagaaatatgtgcacggcgttcgctatcagtgctactgctacggaaggggcatcggggaatggcattgtcagccactgcagacatacccctcttccagtgggccagttgaagtgtttataaccgagaccccaagtcagcccaatagccacccaatacagtggaacgctcctcagccctcccatatctccaaatatatccttcggtggagacccaagaattctgtggggcgttggaaagaggcaactatccccggacatctgaactcttacactattaagggactgaaaccaggagttgtctatgaaggccaactcatatcaattcaacagtacggtcaccaagaagtaactcgcttcgatttcacgacaacctccacctctacaccagttacctccaatactgtaaccggagaaaccaccccatttagccccctggtggccacttccgagagcgtgacggagatcacagcttcatccttcgtggtgagctgggtgtcggcaagcgatacagtgtctggattccgggtcgaatatgagcttagtgaagagggcgatgaaccacagtacctagatttgccctctacagcaaccagtgtgaatattcctgatctgctcccaggacggaagtatattgtcaacgtgtatcaaatatccgaagatggcgagcaatccttaatacttagtacatcccagaccaccgctccagatgcccctcctgacaccactgtggatcaggtagacgacaccagcattgtcgttcgctggtccaggccccaggctccaattaccggctataggattgtgtattcaccatctgtcgagggctcttcaacagagttgaacctgcctgagactgcgaactccgtgactctttccgatctgcagcctggtgtgcagtataacatcacgatctatgccgttgaggagaatcaggaaagtacaccagtggtcatccaacaggagacgaccggcactcccaggtctgatacggtgccgtcaccgagagacctgcaatttgtagaagttaccgatgtgaaggtgactattatgtggacaccaccagaatctgccgtgacaggatacagagtggatgtgatcccggtaaacttgcccggtgaacatggccagcggctcccaatatctcgcaacactttcgccgaagttaccggcctgagtccaggtgttacctattacttcaaggtctttgccgttagccacggaagagagtccaaacctcttacagctcaacaaaccacgaagctggatgcaccgacaaacctgcagttcgtaaatgagaccgactcaacggtgctggtgcgctggaccccaccccgagctcagatcacgggataccgcctcaccgttggactcacgaggagggggcaaccacggcagtataacgttggaccctcggtctctaaatacccactgcgcaatttgcagccagcctctgagtatacggtatctcttgtagccattaaagggaatcaggaaagccctaaagccactggggtgtttactacgcttcagcccggatcgagcatcccgccatataataccgaagttactgagaccaccatcgtgattacttggactcctgcccctaggatcgggttcaagctgggggtgcgcccttcacaaggtggcgaggccccacgcgaagtgacttcagactccggaagcattgtggtcagtgggttgactccgggagtggagtacgtgtacactatccaagtgttgagggatggccaggagcgcgacgctcccatagtcaacaaggtggtgactccccttagccccccaactaacttgcatctggaggcaaatcctgacaccggggtccttactgtgtcatgggaaaggagtacgacgcccgacataaccggatatcgaattaccactacccccacaaacggccagcagggaaattccctggaggaggttgtgcacgcggaccagagctcatgcacattcgacaatcttagcccaggactggagtataacgtttcggtgtatacagtcaaagatgataaggagtccgtgccaatctccgacacaatcatccccgaagtccctcagttaaccgatttaagttttgtggacattactgacagcagtataggtttaagatggactcccctgaacagctctaccatcatcggttatcggatcacagtagtggccgctggggagggcattcccattttcgaggacttcgtggactcttctgtcggctactacaccgtaaccggtttagagccgggaatagactatgatatctccgtgattacattgatcaatgggggtgagtctgcccctaccacgctgacccaacagacagcagttcccccaccaacggacctgcgtttcactaatattggacctgacactatgagggtcacgtgggcgccaccaccgtccatcgacctgactaacttcctcgtaagatactcccctgtgaagaacgaagaagacgtcgcagaactctcaattagtccatcagacaacgctgtggtcttgactaacctcctacccggaactgaatacgtggtaagcgtcagcagcgtgtatgagcagcacgagtctacaccactgcgcggaaggcagaagactggcctggacagtcctaccgggattgacttcagcgatatcacggctaatagtttcaccgtccattggattgcccctagagccaccatcaccggatataggattagacatcatccggaacatttctctggccgacccagagaggacagggtgccgcatagtcggaactcaattaccttgaccaatctgacacctggcaccgaatacgttgtaagtatcgttgccctgaacgggagagaggaaagccctctgcttattggccagcagtctaccgtttccgacgttcctcgcgacctagaggtggttgctgcgaccccaaccagtttacttatcagttgggacgcgcctgccgtgactgttaggtattatcggatcacgtacggggaaaccggcggaaatagccccgtacaggaatttacagtgcctggcagcaagagcacagccacaatctctgggttgaagccaggcgtggattatacgatcaccgtatatgccgtcacagggaggggagactcccccgcttccagcaaaccaatcagcatcaattaccggacggagatagacaagccaagtcagatgcaggttacggacgttcaggacaactcaatctctgttaagtggctccctagtagcagtcctgtgacaggctaccgggtgacaaccacccctaagaacggtcccggtccaacaaagacaaaaaccgcgggtcccgaccagacagaaatgaccattgagggattgcagccaaccgtggaatacgtagtttcagtctatgcccagaatccatcgggggagtctcagccattggtgcaaacagcagtaactaatattgatcgaccaaagggactggcctttaccgatgtagatgtggactcgattaagatcgcctgggagtcgccacagggacaggtctctagataccgcgttacctactctagtcccgaagacggcatccacgaattgtttcccgcacccgatggcgaggaggataccgcagaattacagggcttgaggcccggatctgagtataccgtttctgtcgtagcccttcacgacgacatggaatcgcaacctctgattggcactcagagcacagctatccccgcaccaacagacctcaagtttacccaagtgacccccacttcactgtctgcccaatggactccacccaatgtacaattgactggttacagggtgcgagtgacccccaaggagaagactggacctatgaaggaaattaatctggcacctgattcaagcagcgtcgtggtatccggcctcatggttgccaccaagtatgaagtgagcgtgtatgccttgaaggacactctcacttcccgccctgctcaaggagtggtgaccactctggaaaacgtgagcccccctcgaagagcgcgtgtaactgatgcaaccgagacgaccattactatctcttggaggacaaagaccgagacgataacaggtttccaggtggatgcagttcccgcaaatgggcaaacacctatccagagaactatcaaaccagatgttaggtcttacaccatcactggtctgcagccgggaactgactacaaaatatacctttataccctgaatgacaacgctaggtcctcccctgtggtgatcgacgcttcaacagctattgacgctcctagtaacttgcgattcctggcgacgactcctaattctctgctagtgtcgtggcagcctccgagggcacgcattactggttacatcattaagtatgaaaagccagggagtcctccccgtgaggtggtaccaaggccccgtccgggtgtcacggaagcaaccattactggccttgagcctggtactgagtatacaatttatgtcatcgctttgaagaacaatcagaaatcagagccacttatagggcgaaagaagaccgatgagctgcctcaactggtgactttgccacatccaaacctgcatgggccagaaattctcgatgtgccctctacagtccaaaagacaccgtttgtgactcaccccggatatgacaccggcaacgggattcagctccccggaacgagcgggcagcagccaagtgtgggacagcagatgatcttcgaggaacacggtttcagacggactaccccgccaacaaccgccacaccaattcgccacagaccgaggccataccctccaaatgttggcgaggagatccagatcggacacattcccagagaggatgtggattaccatttgtacccgcatggccctggcctcaacccaaacgcttctaccgggcaggaggccctgtctcaaaccactattagttgggccccattccaggatacatccgagtacatcattagttgccaccccgtcggtacagatgaagagccgcttcaattccgagtgcccggaacatcgacaagcgccaccctgactggcctgacacgtggcgctacctacaatgtgatagttgaggccctcaaagaccaacagaggcataaggtccgggaggaagtggtcacagtggggaactcagtgaatgagggcctgaatcagccgactgacgacagctgttttgacccgtataccgtgtctcactatgctgtcggcgatgaatgggagagaatgagcgaatccggtttcaaattactttgtcagtgtttagggttcggtagtggtcatttccgatgcgatagcagccgctggtgccacgataacggggtaaattacaaaattggtgaaaaatgggacagacagggagagaatggacagatgatgagttgcacctgccttggcaatggaaagggtgagtttaagtgcgatcctcatgaggcaacatgttatgacgatggaaaaacctaccacgtgggcgaacagtggcagaaggagtacctgggagccatatgctcgtgtacgtgcttcggcggacagcggggatggcggtgcgataactgtcggagacctggtggggagccttcccccgaaggcacaacaggtcagtcttataaccagtacagtcagaggtaccaccaacggactaatacaaacgtcaattgccctatcgaatgtttcatgccactcgatgtacaagctgatcgggaagattctcgggaatac

SEQ ID NO: 28696 - DNA, 6891 bp, Artificial Sequence
  Description of Artificial Sequence: Synthetic coding sequence
atgcttagaggacccggtcccggactattacttttagccgtgcagtgtttgggcacagctgtgccctcaactggagcaagcaagagcaagaggcaggctcagcagatggtgcagccacagagtccagtggcagtgtctcaatcaaagccaggttgctatgacaatgggaagcactaccagatcaatcaacagtgggagcggacctacctgggcaatgccttggtgtgtacttgctacgggggatcgaggggatttaactgcgaatcaaaaccagaagcagaagagacatgtttcgataaatatactgggaatacatatagagtaggtgacacctacgagcggccaaaggactctatgatctgggactgcacgtgcatcggggcaggccgaggacggatatcatgcaccattgccaatcgttgccatgagggcggtcaaagctacaaaatcggggatacatggaggagacctcacgaaactggcggttatatgctcgagtgcgtttgcctgggaaacgggaagggcgaatggacctgtaagcctatcgcagagaaatgctttgaccacgctgcaggtacatcctatgtggtcggtgaaacttgggaaaagccttatcagggctggatgatggttgactgcacatgccttggcgagggcagtggtcgcatcacctgcacatccagaaacagatgtaacgatcaagacactcgcaccagctatagaataggcgacacgtggtccaagaaggacaataggggtaacctcttgcagtgcatttgtactggaaacgggaggggagagtggaaatgtgagcggcatacctccgttcaaacaacctcttctgggagtggacctttcactgatgtacgagccgcagtctatcaaccccagccccatcctcagcccccaccttatggccattgtgtgacggatagcggggtcgtctactcagtcggaatgcagtggctaaagactcaggggaacaaacagatgctttgcacgtgtctcggtaacggagtttcctgtcaggaaacagccgtgacccagacttatggcggaaacagcaatggagagccctgtgttctcccatttacctacaacggccgaacgttctattcgtgtacaaccgagggacgccaggatggacacctgtggtgctccacaacatccaactacgaacaggatcaaaaatactccttttgtacagatcacacagtgttagttcagacgcggggagggaacagcaatggggctttgtgccacttccctttcttgtataacaatcacaattatacagactgtacatccgagggtagacgtgataacatgaagtggtgcgggactacccagaactatgatgcggaccagaagttcgggttctgcccgatggcagcacacgaggagatatgcaccaccaatgagggggtgatgtatcgcataggcgatcaatgggacaagcaacatgatatgggtcatatgatgagatgcacatgcgtgggcaacggaaggggtgagtggacttgcatagcatactcgcagcttcgggatcaatgtattgtggacgacatcacctataacgtcaacgatacattccacaagcgacatgaggaaggacatatgctgaactgcacatgttttgggcaaggtagagggagatggaagtgtgatccagtggatcagtgccaggactccgaaaccgggactttctatcagatcggcgattcgtgggaaaagtatgttcatggcgtcaggtatcagtgctattgctatgggagaggtattggggagtggcattgtcaaccgctccaaacctatccatcaagctcggggcctgtggaggtgttcattactgaaactccaagccagcccaactcccaccccattcaatggaatgcaccgcaaccctcacatatatcgaagtacatcctccgctggcgccctaagaactccgtcgggcgatggaaggaggctaccatacccggacatctaaatagttacactatcaagggattaaagccaggtgttgtgtatgagggacagctgataagcatacagcagtacggccatcaagaggtgacccgttttgattttactaccacctcgacatccacccccgtgactagcaacacagttaccggcgagaccaccccttttagccctctcgtagcaacttcagaatcagtgactgagataactgccagctcttttgtggtctcatgggtgagtgccagtgacactgtgtccgggttccgagtggagtatgagctgagtgaggagggcgatgagcctcagtacctggatctgccttcaaccgcaaccagcgtgaatattcccgacctgctcccagggagaaaatacatcgtgaacgtctatcagatctcagaggatggtgagcaatctctgatcctttccaccagccagacgaccgcccctgacgctcctcccgacaccacagtcgaccaggtcgatgatacgtctatcgtggtccggtggtccaggcctcaggcaccgatcaccggttacagaatcgtgtacagtccaagcgtggagggaagcagcaccgaactgaacctgcctgagactgccaactccgttaccctgagtgatctgcagcccggtgtccagtacaatattactatttatgccgtggaagagaatcaggagtctacccccgtggtgatccagcaggaaaccactgggacgcccagatctgatacggtcccttcaccacgtgatctgcagtttgttgaggtgactgacgtgaaagttactatcatgtggacccctccggaaagtgccgttacgggttaccgtgtggacgtgatcccagttaatcttcctggagagcatgggcaacgcctcccgatttcccgaaatacattcgcggaggtcaccggacttagccctggggtgacttattatttcaaagtctttgccgtgagccacgggagggagtccaaacccctgacagcccagcagactaccaaactggatgcacccaccaacctgcagtttgttaacgagacagactcaaccgtcctcgtcagatggacgccccctcgggctcagattacgggctataggctaactgtgggcctcacccggcgaggccaaccgagacagtataatgtgggaccatccgtgagtaagtaccccctccggaacctacagccagcgagcgagtacacagtgtctctggtcgccattaaaggcaaccaggagtctccaaaggccacaggcgtgtttactacactgcagcctggaagctctatcccaccatacaacacagaggtgaccgagacaacaattgtgattacctggacaccagcaccaagaatagggttcaaacttggtgtaagaccctcccaaggaggggaagcccctagagaggtgactagcgactctgggagcattgtagtctctggtttaactcccggtgtagagtacgtctacacaatccaggtgcttcgggacgggcaggagagggatgctcccattgtcaacaaagtcgtcacacctctttctcccccaacaaaccttcacctcgaggccaatcctgacaccggcgttctgacggttagttgggagcgaagcacaaccccagacattacgggctaccggatcacgacaacccccaccaatggtcagcagggaaactcactcgaggaagtggttcatgccgatcagtcatcttgtacattcgacaatctaagcccaggcctggagtacaacgtatccgtgtatacggtaaaggatgataaagagagcgtgcctatatcggacactattatccctgcagtccccccacccaccgacctcagatttacgaacatcgggcctgatacgatgcgcgtgacgtgggctcctcccccaagcattgatcttacaaactttctcgtgcggtacagccccgttaaaaacgaagaggatgttgccgagttgtctattagccccagcgacaacgccgttgtgctgaccaacctactgccagggacagagtacgtggtctcggtctctagcgtctacgaacagcatgagagcacccctctgagaggaaggcaaaaaacgggattagatagccccaccggtatcgatttctcagacatcacagcaaacagtttcaccgtgcactggattgctcctagagctaccatcaccggctataggattcggcatcacccagagcactttagcggccgacctcgggaggaccgggttccacactctagaaactccattaccctgacaaaccttacgccaggaacagaatatgtggtttcaatcgtcgctcttaatggacgggaggagtctccattactcattggacagcagagtacagtctctgacgtaccgagggatttagaggtggtcgcagcgacccctacttccctgctcataagctgggatgccccagccgtgactgttagatactatcgcattacctatggcgagactggaggtaattcaccagtccaggaattcaccgtgcctgggtccaagagtacagctactatttccggccttaagccgggagtcgattacacaattacggtatatgccgtgacgggtcgaggcgacagccctgcctcctcaaagcccatctctataaactacaggacggagattgacaagccgtcacaaatgcaagtgactgatgttcaagacaatagcataagcgtgaagtggctcccaagctcaagccccgtaaccgggtatagagtgaccacgacccccaaaaatggacccggaccaaccaagactaaaaccgcgggtcccgatcagactgaaatgacaattgagggcctccagcctacggtcgaatacgtagtgagcgtctacgcccagaatccttcaggagagtcacagcctttagttcagactgcagttaccactatacccgcacccaccgatctcaagttcacccaggtgacaccgacttcgttgtccgctcaatggacaccacccaacgtccagctgacggggtatcgtgttcgggttacacccaaagagaagactgggcctatgaaagaaatcaatcttgcaccagattcgtcctcagtcgttgtttccggcctgatggtggcaacgaagtatgaggtgtctgtttatgcgttgaaggacactcttaccagtcgccctgcacagggcgtcgtcacaaccctggagaacgtctcaccaccccgtcgggctcgcgtgaccgacgcaacagagactacaattaccattagttggaggactaagactgagaccatcaccggattccaggtggacgccgtgccagccaacgggcagaccccaatccagcgtacgatcaaacccgacgtgaggtcatacaccatcaccggcctccagccaggaaccgattacaagatatacctgtacacacttaacgacaacgcaagatcctctcctgtggtgatcgacgccagcactgcaattgatgctccatccaacctgcgctttctcgccactactcccaacagcttactagtgtcatggcaaccaccacgtgcccgaattacgggatacattatcaaatacgagaagcccggttctcctcccagggaagtggttcctcggccaagacccggagtgaccgaggccaccataacaggccttgaacccggtactgagtatactatctatgtgattgcgttgaaaaacaatcaaaaatctgagcctctaataggccgtaaaaagacggatgagctgccccaacttgtgactttgccgcatcccaatctgcatggtcctgagatccttgacgtccctagcacggtccagaagactccctttgttacccacccaggctatgacaccggtaatggaatccagctccctggtaccagtggccaacagccttcagttggacagcagatgatttttgaagagcacggatttcggaggacaacccctccgacaactgcaacacccatccgtcatcggcctaggccttatccccctaatgttggcgaagagattcagatcgggcacatcccacgagaggatgttgattatcacctgtacccacatgggccaggtttgaatcctaacgccagcactggacaggaggccctgagccagaccaccatttcctgggccccttttcaggacacatctgagtatatcatctcttgtcatccagtggggaccgacgaagaaccgctgcagttcagagttccaggtaccagcacctctgctactctcacaggcttgacaagaggcgctacatacaacgtaatcgttgaggcgctcaaggatcagcagcgccataaggtgagggaggaggtggttacggtgggaaattccgtgaatgagggattaaaccagcccactgacgactcatgctttgacccctatactgtgagccactatgctgtcggcgacgaatgggagcgaatgagtgaaagcgggtttaaactgctctgccaatgtctcgggttcggttcaggtcatttccgctgcgacagtagcaggtggtgtcacgataatggcgttaattataagatcggggagaagtgggacagacaaggagagaacgggcaaatgatgagctgcacctgcctcggcaacggcaaaggggagttcaagtgtgacccacatgaagccacatgctacgatgatggaaaaacataccacgtgggcgaacagtggcagaaagaatacctgggggctatttgctcttgtacttgcttcggagggcagcggggttggaggtgcgacaactgtaggaggccgggtggtgaacccagccccgagggcaccactggccaaagctacaaccaatattctcagagatatcatcagaggacaaataccaacgtcaattgtcccattgagtgcttcatgccacttgacgtgcaggcagacagagaggacagccgggaataa

SEQ ID NO: 28697 - DNA, 6095 bp, Artificial Sequence
  Description of Artificial Sequence: Synthetic coding sequence
atgctgcgagggcctggacctggcctgctactgcttgcagtccagtgtctcggcacagccgtccccagcacaggcgcatcgaaatccaagcgccaagcccaacagatggtgcagccccagtccccagttgcagtcagtcaaagcaagccagggtgttatgacaatggaaagcactatcaaattaatcagcaatgggaaaggacctaccttggcaatgccctcgtatgtacgtgctacgggggttctagagggttcaactgtgagagcaagccggaggccgaagagacctgcttcgataagtacaccggcaatacttaccgtgtgggggacacttacgaaagaccaaaggattcaatgatctgggactgtacgtgcatcggcgcaggcagaggtcggatcagttgcacaatagccaaccggtgtcacgaaggtggccaatcctataaaatcggtgacacatggaggaggccccacgaaactggaggttacatgctcgagtgcgtgtgtctgggaaacggaaaaggcgaatggacctgtaaaccaatagcagagaaatgttttgatcacgccgctggaacgtcctacgtggtgggagagacatgggaaaagccttaccagggctggatgatggtagattgcacttgcttgggggaaggatccgggcgtatcacatgcacctcccgcaacagatgtaatgaccaggacaccaggacatcttaccgaattggtgacacttggagcaagaaggataatcggggtaatctgctccaatgtatctgcactggcaatggacgcggagagtggaaatgcgagaggcatacctccgtgcagacaacaagctcaggatcgggcccttttacagatgtgagagctgcagtatatcaaccgcaaccccatccgcagccgcctccatatggacattgtgtcacagactccggcgttgtatatagcgtcggaatgcagtggctgaagactcaggggaacaagcaaatgttatgcacatgtctggggaacggtgtctcatgccaagagactgccgtgacacagacctacggcggtaacagcaatggcgagccatgtgtgttgccattcacttacaacgggaggaccttctattcctgcactactgaggggaggcaggacggacacctgtggtgttctactacctcaaactatgagcaagatcagaaatacagcttctgtaccgatcacaccgtgctggtacagacacggggtggtaattctaatggtgccctctgccattttccttttctctataacaaccataattataccgactgtacaagcgaggggaggcgcgacaatatgaagtggtgcggtacgacacaaaactatgatgccgatcagaagttcggattttgccctatggccgctcatgaggaaatttgcaccacaaacgagggcgttatgtacaggatcggagaccagtgggacaagcaacacgacatgggccatatgatgagatgcacctgcgtgggtaacggaagaggggagtggacgtgcatcgcctactcccagctgcgcgatcagtgcatcgttgacgatatcacttacaatgtgaacgatacgttccataaaaggcacgaggagggacacatgctcaattgcacttgctttggacagggcagagggagatggaaatgcgaccccgtggatcagtgtcaggattcggaaacaggcactttttaccagatcggcgattcctgggaaaagtacgtgcacggagttagatatcagtgttactgttatgggcgtggaataggagagtggcactgtcagcccttgcaaacgtacccctcaagtagcggacccgtcgaggtttttatcacagaaacaccaagtcaaccgaacagccatcccatccaatggaatgcccctcaaccgagccacatatcaaagtatattttgaggtggcgcccaaagaatagcgtgggcagatggaaagaggccaccattcctgggcacctgaattcttacaccatcaaagggctcaagccaggcgtcgtgtacgaggggcagctcatctccatccagcagtacggacaccaggaagtgacccgctttgattttaccaccacgtcgacatcaacccccgttacctcaaataccgtcactggtgagactaccccgttttcgcccctagttgctacatccgagagcgtgacagagattactgcaagttcattcgtggtttcgtgggtgagcgccagcgacacagtttcgggatttcgtgttgaatatgagctcagcgaggaaggggacgagccccagtacctggatctgccctcaaccgcaactagtgtcaacattcctgacctgctcccaggcagaaagtacatcgtcaacgtgtaccaaatctctgaagatggtgaacaatcactcatactgagtacaagccaaaccacagccccagacgcacctccggatacaactgtggatcaagtcgatgacacgtcaattgtggttagatggtctcgtccccaggccccaatcacaggctaccggatcgtctattccccctctgtggaaggctctagtactgagttaaacttacctgagactgccaatagtgtcaccctgtctgacctccagcccggagtgcagtacaatattaccatctacgcggtggaggagaaccaggagagcacacctgttgtgatccaacaggagaccaccggaactccgaggagcgatactgtgccttctcccagggatttgcagtttgtggaagtaactgacgtaaaggtgacaattatgtggacaccacccgagtccgccgtaacaggttatcgagtggatgttattcctgtgaacctccctggggaacatgggcagaggttgccgatcagtcggaatacctttgctgaagtaaccgggttatctcccggtgtgacttactactttaaagtgttcgcagtgtctcacggcagagaatcgaagccacttacagcacagcaaaccaccaaacttgatgcacctactaatctgcaatttgtaaatgagaccgactcaaccgtattagtacggtggacgccaccacgtgcacagatcaccgggtaccgactcactgtcggcctgacacggagagggcagcctcgccagtacaacgttggcccatcagtctccaagtacccactccgcaatcttcagcccgcatcggaatacactgtgagccttgtggcgattaaaggcaatcaagagtcgccaaaagccacaggggtgtttacaacccttcaacctggatctagtatacccccttataacactgaggtgactgaaactaccatagtgattacatggacgccagcacccaggattggtttcaagcttggtgtgagaccgtcccagggaggcgaagcccctcgggaggtgaccagcgattccggatctattgtagtgagcgggcttacacctggggtggaatatgtttacactatacaggtgctgcgcgacggccaggagagagacgctcctattgtgaataaagtggttaccccgctgagtcctccgaccaacctccacctagaggccaaccctgatactggagtgcttacggtatcctgggagcgcagtactactcctgacattaccggatacagaattaccaccactccgactaacggccagcaggggaactctctggaggaggtcgtgcacgcagatcagtccagctgcacctttgacaacctaagccccggacttgaatacaacgtgtctgtgtatactgtgaaggatgataaagaatccgtgcccatctcagacaccattatacctgctgtgccccctccaacggacctcagatttacaaatataggacccgataccatgcgggtgacctgggctccgccaccaagcattgacttaactaatttcctcgtaagatattcccctgtgaaaaacgaggaggatgttgccgaactctcaatctctccctccgataacgccgtcgtgttgactaacctcctgcctgggactgagtacgtggttagcgttagctctgtctatgagcagcacgaatctacgcccctcaggggtcggcagaaaaccggcttggattcacctactgggatcgatttctcagacattactgctaattctttcaccgtgcactggattgcccctcgtgccaccatcactggataccgcatccggcaccaccccgaacatttttctggtcgacccagggaggaccgcgtgccacacagccgtaacagtatcactctgacaaacttgaccccagggacagaatatgtggtgtctatagtagccctgaatgggcgagaagaatcacccttactgatcgggcagcaatcaactgtgtccgatgttccaagggacctggaggtagtggctgcaactccaacatcgctcttaatttcttgggatgctcctgctgtcacagttaggtactatagaatcacctatggtgagacagggggaaactctccggtccaggaattcacagttccaggatctaaatctaccgcaacaatcagcggactcaaacccggtgtggactacacaataacggtctacgccgttaccggcagaggggactcaccggctagcagcaaaccaatctcaattaattaccggactgagatcgacaagccatctcagatgcaggtgaccgacgtgcaggataatagcatcagtgttaaatggctgcctagctcgtcccctgtgactggttaccgcgttacaacaactccaaaaaatggacccggtcctacaaaaacaaagacagctggcccagatcaaaccgaaatgacgatcgaaggcctgcagcctacagtagagtatgtggttagcgtctacgcacagaacccttcaggcgaatcgcagccacttgttcagactgctgtgacaaatattgatcggccaaagggcctggccttcaccgacgtagacgtggattccattaagattgcatgggaaagtccccaaggacaggtgagcagataccgggttacttactccagtccggaagatggaatccacgaactatttcccgctccagacggagaagaagatacagcggagctgcaggggcttcgaccaggtagcgagtacaccgtgtcagtggtcgctctgcatgatgatatggaatcgcaacctcttataggtacccagtccaccgccatccctgccccaaccgatctcaagtttactcaggttacaccgacaagcctctctgcccagtggacccctcccaacgttcagctcaccggttatcgagtgagggtgacccccaaagagaagaccggccctatgaaggaaattaatctagcccctgacagctcgtctgtagttgtcagcggcttgatggttgccaccaaatatgaggtgagtgtgtatgcgctgaaagacaccttgaccagccgcccagcacagggcgtagtgacaactttggagaacgtgtcccctccgaggcgagccagagtgacagacgcaacagaaactactattacgatctcctggagaaccaagacagagactatcacgggcttccaagtggatgctgtgccggctaatggtcagacaccgatccagcggacaattaaacctgatgttcggtcctacacaattaccgggctacagccaggtacagattataagatctacctttatactttgaatgataatgctcgctcatctcctgtggtgattgatgcgagcaccgctattgacgctccgagcaacctgcggttcttggcaaccaccccgaactccctgctggtgtcatggcaacctccacgcgctaggataacaggatacatcatcaagtacgagaagcccggatctcctccgcgagaagttgtacctcgccctcgcccaggagtcaccgaagctacaatcactggacttgagccaggcacagaatacaccatctatgtgattgctctgaagaataaccagaaatcagaacccttgattgggaggaaaaagacaggtcaggaggccctttctcaaacaacaataagctgggcaccctttcaggatacgtccgaatatattattagctgccatccggtgggcactgatgaggaacctttgcagagtaccaaggccta

SEQ ID NO: 28698 - DNA, 6531 bp, Artificial Sequence
  Description of Artificial Sequence: Synthetic coding sequence
atgctccgtgggccaggtcccggtcttctgttattggctgttcagtgccttggaaccgctgtaccttcaacaggcgcatccaagagtaagagacaggctcagcaaatggtacagccgcagtccccagtggctgtctcccaatccaagcccggttgctatgacaacggaaaacattaccaaatcaaccagcagtgggaacgaacttacttgggaaacgcattagtgtgtacttgttacggcggatcccggggtttcaattgtgagtcaaaaccagaggcagaggaaacatgtttcgataaatacaccggaaacacgtacagagtgggagacacctacgaacgcccaaaggattctatgatatgggactgtacatgtattggcgctggaagaggaaggatctcatgtaccattgctaacaggtgccatgaggggggacagagctacaaaattggggatacctggcgacggccacacgagaccggcggttacatgctggaatgcgtgtgcttgggcaacggaaagggcgaatggacctgcaagcccatagccgagaagtgcttcgatcatgccgcaggcacctcttacgtggtcggagagacctgggaaaaaccttaccaaggctggatgatggttgactgtacatgtctaggagaggggtctggacgcatcacatgcacgagccgcaatcgctgtaacgaccaagacactaggactagctataggattggggacacatggagcaaaaaggacaatcgaggcaacctgctgcaatgcatctgtacaggcaacggccgaggggagtggaaatgcgaaagacatacatccgtgcagacaaccagttctggaagtggcccattcacagacgtccgcgctgcggtctatcagccccagccccacccccagccaccaccgtacggtcactgcgtgaccgactcaggtgtggtgtattcagttggcatgcaatggttgaaaactcagggcaacaaacagatgctgtgcacctgcctggggaatggtgtcagctgccaggaaaccgcagttacacaaacatacggtgggaactcgaatggcgagccatgcgtcctcccattcacgtacaacggtcgtacattctatagttgtacaacagaaggccgacaggacggccacctgtggtgctctacaaccagcaattacgaacaggaccaaaagtatagcttctgcaccgatcatacagtccttgttcagacacgaggaggcaactccaatggagcgctgtgtcatttcccctttctgtacaacaatcataactataccgactgcacatcagaaggtcgcagggataacatgaagtggtgcggcaccacgcaaaattacgatgccgaccaaaaatttggtttctgtcccatggccgcacatgaagagatctgcacaacaaatgaaggagtcatgtatcgcattggggaccagtgggacaaacagcacgacatgggccacatgatgcgttgtacttgtgtgggtaacggtcgaggagaatggacatgcatcgcatactcccagctgagagaccaatgtattgtagatgatatcacatataatgtgaacgataccttccacaaaagacacgaggaaggacacatgctgaattgtacctgtttcggtcagggtaggggcagatggaaatgtgaccccgtagatcagtgtcaggatagcgaaaccggcactttctatcaaataggcgatagctgggagaagtacgtgcatggtgtgaggtaccaatgctattgctacggtcgtggtatcggagaatggcactgccagcccctccagacttatccctcgtcctccggcccagtggaagtctttataacagagaccccctctcagccaaattcgcaccctattcaatggaacgcaccccagccatcacatatctctaagtacattttacgatggagacctaagaacagtgtgggacgttggaaggaggcgacaatccccggacacctaaactcgtacaccattaaggggctcaagccaggcgtggtgtacgagggccagctcattagcattcagcagtacggccatcaggaggtgacgcggtttgatttcacgacaacctcaacgagcacacccgttacatctaacaccgtgactggcgaaactacaccattctccccgctagtggcaacctccgagtcagttacagagatcacggccagctctttcgtcgtgtcatgggtctcagcttccgatacagttagcggatttagggtggaatacgaactaagtgaggagggggatgagccgcagtacctcgacttaccctctactgcaacttctgtgaacatacccgatctgctgccagggaggaaatatattgtcaatgtctaccagataagcgaagacggggagcagtccctcattctttccacaagccaaactaccgcacccgacgcaccaccggacaccaccgtcgaccaggtggatgacactagcattgtcgtgaggtggtccaggccgcaagcgccaatcacagggtatagaatcgtgtactcaccctccgtcgagggtagttccaccgagctgaacttacccgagaccgcaaattccgtgacgctgtctgatttgcagcctggagtccagtacaacatcacgatctatgctgtggaggagaaccaagagagcacaccagtcgtcatccagcaggaaaccaccgggacaccacgttcagataccgtgccatcccctcgggacctccagtttgtcgaggtgacagatgtgaaggtcacgattatgtggaccccccctgagtctgcagtcacaggttatcgggtggatgtcattcccgtcaacctgccaggggaacacggccagaggctgcctatttcgaggaatacctttgccgaggtcacaggcctgagtccaggcgtgacttattactttaaagtttttgccgtgtcccacgggagagaatccaagcccttgactgcacagcaaaccaccaagcttgacgccccaactaacttgcaattcgtcaatgagacggactcaaccgtgctggtgcgatggactccccctcgggctcagatcactggctaccgactgactgttggcctgaccaggaggggccaaccaaggcagtacaacgtcggcccatcagtgagcaaatatcctctccgcaatctgcaaccagcatctgaatacactgtttcgctggtagcaataaaaggcaaccaggagtcaccgaaggctaccggagtcttcacgactttgcaacctggaagctctattcccccttacaatactgaagtcactgagacaacaattgttattacgtggacccctgcaccccgtataggattcaaactgggggtgcgcccatctcaaggcggagaagccccaagagaagtgactagtgattcagggtcaatcgtcgtgtctggcctaacacctggagtggagtatgtctatactattcaagtgctgcgtgatgggcaggaaagggatgcaccgattgtcaataaagtcgtgacacccctgtcccctccaactaatctgcatttagaagccaacccagacacaggggtattgacagtgagttgggaacggtcaacaaccccagacatcactgggtaccggataacaaccacacccacgaacgggcagcagggcaactccctggaggaggtcgtacacgctgatcagtcatcctgcactttcgataacctgagtccgggtctagaatataacgtgagcgtatacaccgtgaaagacgataaggaatccgtaccaatttctgacactattatccccgcagttcctccccctaccgacctaagattcacaaatattggaccagatacaatgcgagtgacatgggctcctcccccttcaattgacttaacaaatttccttgtgaggtactcccctgtgaaaaacgaggaggacgttgcagagcttagcatctccccttcagataatgcagtagtgttgactaatctcctcccgggaactgaatatgtggtctccgtctcttccgtatatgagcagcatgagtctactccgttacgcggtcggcagaagactggcctggactctccaacagggatcgactttagtgacatcacagcaaattcgttcaccgtgcactggatcgcccctagggctacaatcacaggttaccgcatccggcatcaccctgaacacttttcaggcaggccacgggaggaccgagtgccccacagcaggaattccataactttaactaacttgactccaggcactgaatatgtagtcagtatcgtcgctttgaatgggcgagaagaatcacctctgctgatcgggcagcaaagcacagtgtcagatgtcccacgggacctggaggtggtagccgcaacaccgacaagtctcctcatttcctgggacgccccagctgtgaccgtacgctattatagaatcacctatggagagaccggaggcaacagcccagtccaggaattcaccgttccaggttccaagtctactgccaccataagcggcctgaagccgggtgtcgattacactattacggtttacgctgtgacgggaaggggagattcccccgcttcctctaagcctatctctattaattatcgcactgagatagataagccttcccaaatgcaggtaacggacgtccaggataatagtattagtgttaaatggctgccttctagctcccccgtgaccggttatcgtgtgaccacaacgcctaaaaatggccctgggcctaccaagacgaagaccgccggacccgatcagacagaaatgactattgagggtcttcagcctacagtggagtatgttgtcagcgtgtatgcccagaatcccagcggggaatcccagcctctggtgcagactgcagtcacaacaatccctgcacccacagatctgaaattcactcaggtgactcccacctccctgtcagctcagtggacaccgcctaatgtgcagttgacaggctaccgggtgagggtcacgcctaaagaaaaaactggaccaatgaaagagatcaatttggctccagatagcagcagtgttgttgtcagtggactgatggttgccactaaatacgaagtgagcgtttatgctctgaaggatacgctcacctcccgcccagcccagggcgttgtaaccaccctcgaaaacgtctcaccccctcgcagggcccgtgtaactgacgcaacagagaccacaattaccatctcctggcgcaccaaaaccgagaccatcactggattccaggtggacgctgtgccagccaacggtcagactcctatacagcgtactatcaagcccgacgtgcggagttatacaattaccggcctgcaacccggaacagattataaaatttatctctacacgcttaacgacaacgcgcgttccagtcctgtggtgatcgatgccagtaccgcaatcgacgcccctagcaatctgcgctttcttgctacaacaccaaacagtctgctggtctcatggcagccgccaagggctagaattacaggctacatcatcaaatatgaaaaaccaggcagcccgcctcgcgaggtcgtacctaggccgagacccggtgttaccgaagctacaattaccggcctggaacccggtacagaatacacaatttatgtaattgccctgaaaaacaaccagaagtccgagcctctcattggacgaaagaagaccggtcaggaagccttgtcgcaaacaacaattagctgggcaccgtttcaggatacaagcgagtacatcatctcatgccacccagtggggacagacgaggagcctctgcagttccgggtacccggaaccagcacttccgccacgctgaccgggcttacacgcggagccacgtacaatgttatcgtggaggcgctcaaagatcagcagcgtcacaaagtccgagaggaggtggtaacagttggaaattccgtcaacgagggccttaatcagcccacggacgacagttgtttcgacccatacacagtgtcccactatgccgtgggggacgagtgggaaaggatgtcagaatcaggtttcaagctgctttgtcagtgtttggggtttgggtccggtcacttcaggtgcgattctagccggtggtgccacgacaacggtgtcaattataaaataggcgaaaaatgggatcgccagggagagaacgggcagatgatgtcttgcacatgtctgggaaacggcaaaggggagttcaagtgtgatccccatgaggcaacttgctacgatgacggcaaaacttatcacgtgggtgaacagtggcagaaggagtatctcggggcaatttgcagctgcacctgcttcggaggccagcgtggatggcggtgcgacaactgtcgccgaccaggtggagaaccctcaccagagggcacaaccggacagagctacaaccaatacagccagcgctatcaccagaggaccaacaccaacgtgaattgtcctattgagtgctttatgcctttggacgtccaagcagaccgcgaagattctcgagaataa

SEQ ID NO: 28699 - DNA, 7161 bp, Artificial Sequence
  Description of Artificial Sequence: Synthetic coding sequence
atgctaagagggccaggccctggccttctactgctggcagtgcagtgtttggggactgccgttccctcaacaggagcatcaaagtctaagaggcaggcccaacagatggtgcagccccaatcacctgtggctgtgtcacaaagcaagcctgggtgctacgataacggcaaacattatcagatcaaccaacaatgggaacggacttatcttggcaacgcgcttgtgtgcacctgctacgggggaagccggggtttcaattgcgagtcaaagcctgaagcagaggagacttgctttgacaaatacactggcaacacctaccgagtcggcgatacctacgaacgccctaaagatagtatgatctgggattgtacctgcatcggcgcagggcgaggccgaatttcatgtactatagccaatagatgccacgagggaggccagagttataaaattggcgacacatggcggagaccccatgagaccggagggtatatgctggaatgcgtctgtctggggaacggtaaaggcgaatggacctgcaagcctatcgctgagaaatgttttgatcatgccgcaggcacctcttacgtcgtcggagagacctgggagaagccttatcaaggctggatgatggttgactgcacatgcctcggggaaggtagcgggcgaattacttgcacatctcggaacagatgtaacgaccaagatacaagaaccagttataggataggggacacctggtccaaaaaggataaccgcggaaacctgctccagtgtatctgtacaggcaacgggaggggcgaatggaagtgcgaacgccatactagcgttcagactaccagtagcggttcagggccatttacagatgtgagggcagctgtgtaccaaccccagccccatccacagccgcctccctatggccattgcgttacagactcaggcgtcgtgtattctgttggcatgcagtggttgaagacccagggtaacaagcagatgttgtgtacttgcttgggcaacggcgttagttgtcaggagacagcggtcacacaaacctatggcggaaactccaacggagagccatgcgttctgccctttacctacaacggcaggactttctattcttgcactaccgaaggcagacaggatggccacctctggtgttcaacgacgagcaactacgagcaggaccagaagtattctttctgtacggatcataccgttctcgtacagacgagggggggtaattccaacggtgcattgtgccactttcccttcctgtacaataatcacaactacacagactgcacttctgaagggaggcgcgataatatgaagtggtgcggaaccactcagaactatgacgccgatcagaagttcggcttttgtcctatggccgctcacgaggagatttgtaccactaacgagggcgtaatgtatcggatcggggaccagtgggacaagcagcacgatatgggccacatgatgcgctgcacctgcgtcgggaacggcagaggagaatggacatgcatcgcttactcccagctcagggaccaatgcatcgtagacgacattacttacaacgtgaatgacacatttcacaaacgtcatgaagaggggcacatgttgaactgcacctgctttgggcaggggagaggaaggtggaagtgcgatcccgtggaccagtgtcaggacagcgagacagggacgttttaccagataggggactcctgggaaaagtatgtgcacggtgtgaggtaccagtgttattgttacgggaggggtatcggtgagtggcattgccagccattgcagacgtatccctcaagttctggcccagtggaggtctttataaccgagaccccttcgcaaccgaactctcaccccattcagtggaacgcccctcagccatctcacatcagtaaatatatcttgcggtggcgcccaaagaactcagttggaagatggaaggaggcgacaatcccgggtcacctgaacagctacactatcaaaggactgaaacccggtgtggtttatgaagggcagctcatcagtatccagcagtatgggcatcaggaggtgacccggttcgactttacaaccaccagcacttccaccccagttacaagtaacacggttacgggagagacaacccctttttcacctcttgtggccacgtcggagagcgtcacggagattactgcatccagctttgtggttagttgggtgagtgccagcgatacggtctcaggattccgagtggaatatgagctcagcgaagagggggacgagccccagtatctcgacctgccgagcacagcgacctccgtcaatattccggatctgctgccagggaggaaatatatagtgaacgtgtaccagatcagcgaggacggggaacagagcctcatcctcagtacttcccagaccaccgcgccagatgctccgcctgacaccacggtggaccaagtcgacgacacatccatcgtggtcaggtggtcccgaccccaagctccgatcacgggctatagaattgtgtattccccttccgtggaaggatcatctacagaattaaatctgcctgagaccgcaaactccgttactctgtctgatctgcaacctggagtgcaatataacatcaccatctacgcggtcgaggagaaccaggaaagcacacctgtggtgatccaacaggagactacaggtactccaaggtctgacacagtccccagtcctcgtgacttgcaattcgtggaagtcaccgacgtgaaagtgacaataatgtggactccccctgagagcgctgttaccggttaccgcgttgatgttatcccggtgaatctgcctggcgaacacggacagcggctccccatatcccgcaacacctttgcagaggtgaccgggctatcacctggcgttacgtattactttaaagtttttgccgtcagccatgggagagagtctaagccgcttacggcccagcagaccacaaagctagacgcacccacaaatctccagttcgtcaatgagacagattccaccgtgctggtgagatggaccccgccaagagctcaaatcaccggttacagactcaccgtgggcctcactagaaggggacagcccagacagtataacgttggcccaagtgtttcgaaatatccactgcgcaatttgcagcctgcctccgaatacactgtcagtctggtggctatcaaagggaatcaggaatcccccaaagccacaggcgtcttcaccactctgcagcctggctcatctattccgccttacaatacagaagtgaccgagaccaccattgtgatcacatggacccccgcacctcgcatcggcttcaaactaggggtgaggccatctcaaggaggggaagctcctcgagaggtcaccagtgacagcggaagcatagtcgtgtcaggcctgacacctggtgtcgaatacgtgtatacaattcaagtcttgcgggatgggcaggagcgcgatgccccaatcgtgaacaaagttgtgactccgctttcccctccgacgaacttgcacctggaggcgaaccctgacacaggcgtacttacggtcagctgggagaggtctacaacacccgacattacgggatataggattaccaccaccccgacgaacgggcagcagggcaattctctggaggaagtggtccacgcagatcagagcagctgcacttttgataacctctcacctggactggaatataatgttagcgtttacactgtcaaagatgacaaagaatccgtgcctatctctgatactattattcccgctgtcccaccgcctaccgatctgcggttcacaaacattggacctgataccatgcgcgttacctgggcccctcccccatcaatcgatcttacaaattttctggtacggtattcacccgtcaaaaatgaggaagatgtggcagagctctctatcagccccagcgacaacgcagtcgtcctgacaaacctcctgcctggtacagaatatgtcgtcagcgtatcctcagtgtacgagcaacacgaatccaccccactgaggggacgccagaaaacagggttagattcacctacgggcattgattttagtgatatcacagccaatagctttacggtccactggattgctcctcgcgctacgattacaggataccggatcaggcatcacccggaacatttttccggtcgtcccagggaggaccgggtcccacatagtcgaaactctatcacattgaccaacctcactcccggtaccgaatatgtggtcagcattgtcgcgttaaatgggcgagaggagtcgccactgcttattggccagcaatctaccgtgagcgatgtgccgagggacttagaagtggtcgccgcaaccccaacctccctcctgatctcctgggacgccccagccgtgactgtgcggtactatagaatcacctatggggagacaggagggaatagtccagtgcaagaatttaccgtaccaggaagcaaatctactgccaccatcagcggactgaaacctggtgtggattatacaatcacggtgtacgctgtgactggcaggggcgacagtcccgcaagtagcaaaccgatctcaataaactatcgtactgagatcgacaagcctagccagatgcaggtgaccgacgtccaggacaactcaatctccgtgaagtggttaccctcaagtagccctgtgaccggatacagagtgaccactacacctaagaatgggccagggcctaccaagaccaagactgccggacccgaccagacagagatgactatagaaggcctacagcccaccgtggagtacgtcgtgagtgtatacgcccagaatccatccggggagagccaacctttggtgcagactgccgtcacaaatatcgaccgcccaaagggcctggctttcacggacgttgatgtggacagtatcaagatagcctgggagagcccacagggacaggtttcaaggtacagggtaacctacagctctcctgaagatggcatccatgagctttttccagccccagatggagaagaagatacagcagagctgcagggactaaggcccggaagcgagtacactgtctcagtcgtggcattgcacgacgatatggagtctcagccccttattgggacccagagcacagccataccagctcccactgacctcaaattcactcaagtcactcccaccagtttatcagcgcagtggaccccacctaatgtacaacttaccggttacagggtaagggtgactcccaaggaaaagaccggaccaatgaaggaaataaatctcgcgcctgattcatccagcgtagtcgtgagtggactgatggtggccaccaaatacgaggtcagcgtgtacgcactgaaagacacgcttaccagccgccctgcccaaggcgtcgtcacaacactcgaaaatgtgtcaccaccacggagggccagggttactgacgctaccgagacgacgatcactatatcatggaggacaaagactgagacaatcaccggttttcaggtggatgcagttccagccaacggccaaaccccaatccagcggactataaaaccggacgtgcggtcctacactatcacggggttacagccaggaaccgactacaaaatttacctatatacactcaacgacaacgcccgatcctctcccgtagtcattgatgcatccactgccattgacgcaccgtctaacctgcgattccttgcaactacacccaattccctgctggtgtcctggcaacctccgagagcgagaattacaggctacataattaagtacgaaaaacctggaagtccccctagggaggtggtccctcgtccccgtccgggagtgactgaggctaccataacagggctagagcctggtacagagtatacaatttacgtgatcgctctgaagaacaatcaaaagtccgagccgctgattggcagaaaaaagaccgatgagctgccccaactcgtcacactgcctcacccgaaccttcacggcccagagatcctcgacgtgccttcaaccgtgcagaagacaccttttgtgacacaccctggctatgacactggcaatgggattcaactgccagggacctccgggcagcagccgagcgtgggacagcagatgatctttgaagagcacggatttagacgcactaccccgccaactaccgccactcccataaggcacaggcctcgcccttatcctcccaatgtgggcgaagaaatccaaattggacatatacccagggaggatgtggattatcatctgtatcctcatggtcccggtctgaaccccaacgctagtaccggtcaggaagctctcagtcagacaaccatctcttgggcaccattccaggacacctcggaatacatcatcagctgccacccagtgggaacggacgaggaacctttacagtttagagttccaggaaccagcaccagtgcaaccctgaccggactcacacgaggagctacatacaatgtgattgtagaggcacttaaggatcagcagcggcacaaagtgagggaagaggtcgtcacagtaggcaatagcgtcaacgaaggcctgaaccagcccaccgacgactcatgtttcgatccctacacggtcagtcactacgccgttggggacgaatgggaaaggatgtcagaaagcggttttaagcttttgtgtcagtgcctaggttttggaagcgggcacttcaggtgtgactcgagccggtggtgtcacgataacggcgttaattataagattggagaaaagtgggatcgccagggcgagaatgggcaaatgatgagctgcacctgtctgggtaatgggaagggagagtttaagtgtgaccctcacgaggcaacctgctacgacgacggtaaaacctaccatgtgggcgagcaatggcaaaaggaatacttaggggctatttgttcatgcacgtgcttcggaggacagcggggttggcgttgcgacaactgccgtaggccaggtggggagccaagcccggagggaaccactggccaaagctataatcagtatagtcagcgctaccaccagagaacaaacactaacgttaactgccccatcgagtgcttcatgccactcgatgtccaggcagatcgtgaggattctcgggagtac

SEQ ID NO: 28700 - DNA, 6723 bp, Artificial Sequence
  Description of Artificial Sequence: Synthetic coding sequence
atgctgcggggtcctggaccgggacttctgttgctcgcggtccagtgtctggggacggccgttccgtcgacaggggcatctaagagcaaacggcaggcgcaacagatggttcagccacagtcacctgtcgccgtgtcccaatccaaacccggatgctacgataacggaaaacattatcagataaatcagcagtgggaacgcacttatctaggcaatgccctcgtgtgtacgtgctacggcggatcacgcggtttcaactgcgaaagcaaacccgaggccgaagaaacgtgttttgacaaatacaccggcaatacttaccgagtcggtgacacctacgagcggcctaaggactcaatgatttgggactgcacttgcatcggagcgggtaggggtaggatctcatgcaccattgcaaacagatgtcacgaaggcggtcagtcttataagatcggcgatacatggagacggcctcatgagacaggcggatatatgttagagtgtgtgtgcttgggaaatggaaaaggggaatggacatgcaaacccattgcggagaaatgctttgaccacgcggcaggaacatcctacgttgtgggtgaaacctgggaaaaaccatatcagggttggatgatggtcgattgtacctgtttgggcgaagggagtgggcgaattacatgtaccagccgaaacagatgcaatgaccaagatacaaggactagctaccggatcggggacacctggtccaagaaagacaatcggggaaacctcctccagtgcatttgtacagggaatggtcgtggggaatggaaatgcgagaggcatacaagcgtccagaccacttcaagtgggtcgggaccattcacggacgttcgagctgctgtgtaccagccccagccacatccccagcctcccccttacggccattgtgtgactgatagcggtgtagtgtatagcgtggggatgcagtggttaaaaacccaagggaacaaacagatgctgtgcacttgcctcgggaacggggtgtcatgtcaagagacggctgtgactcagacctacggagggaattccaatggtgagccctgcgtcctgccattcacctacaacggccgtaccttctactcctgcacaactgaaggaagacaggatggtcatctgtggtgcagtactaccagcaactacgaacaggaccagaagtactcattttgcacagaccacaccgtgttggtgcagactcggggagggaacagcaatggcgctctctgccactttccattcttgtataataaccacaattacaccgattgtacaagtgaaggccgacgcgacaatatgaagtggtgtgggactacccagaattacgacgctgaccagaaattcggcttttgccccatggccgcacacgaggagatatgcactacaaatgagggcgtgatgtaccgaatcggagatcaatgggataagcaacacgatatgggccatatgatgcgctgtacctgcgttgggaatggacggggtgagtggacctgcattgcatacagtcagctgagggatcaatgcatcgtcgacgacatcacctataacgtaaacgatacctttcacaagcgccacgaggagggccatatgctgaactgtacttgctttggtcagggccgtggacggtggaagtgtgacccagtagaccaatgccaagactcggaaaccggcactttctatcagataggcgacagttgggaaaaatatgttcatggcgtgcggtatcagtgctactgttatggcagaggcattggcgaatggcactgtcagcctctacagacttatccttcatccagtgggcctgtggaagtgttcattaccgagacaccatcccagcctaattcacatccaattcaatggaacgccccacaacccagccatatttccaaatatattttacgatggcgaccaaagaattcagtgggcaggtggaaagaggccacaattccaggtcacctgaactcatacaccatcaagggactgaagccaggagtggtatacgaaggacagttaatctctatacagcagtatggacaccaggaggtgactagattcgacttcaccacgacctctaccagcacccccgtgaccagcaataccgtgaccggagagactacccctttttcccctttggttgctacatctgaatccgttaccgagattactgcctccagttttgtggtcagctgggtcagcgcgtctgacacagtgagtggtttcagagtcgagtacgaattaagtgaagaaggtgatgaaccgcagtacctggatctcccttcaacggcaacgagcgttaacatcccagatctcctgccaggcaggaagtacattgtgaacgtctatcagatctccgaagacggagagcaaagtctaatcctttcaacatcccagactactgctccggacgctccacctgacaccaccgtggaccaggtggacgacacttcaatcgtcgtacgctggagccggccacaggcccctatcaccgggtatagaatcgtatattctcctagcgttgaaggaagcagcactgagcttaaccttcccgaaaccgctaatagcgttaccttgtctgacctacagccaggtgtacaatacaatatcacgatttacgctgtggaggaaaatcaggaatcgacccccgtggtgatacaacaggagacaaccgggactcccaggtcggataccgtcccctctccgcgtgacctgcaattcgtcgaggtgacagacgtaaaggtgacaatcatgtggactccccctgagagtgccgtgacaggctacagagtcgatgttattcctgtgaatctgcccggagaacacggccagcgactgccaatttcgagaaacacatttgctgaagtgactgggctctcacctggtgtgacctactacttcaaagtgtttgccgtgagtcatggtcgcgaaagtaaacctctgacggcccaacagacaactaaactggacgctccgaccaatctacagttcgtgaacgagacagatagtacagttctggttcgatggaccccccctagagcccagatcacaggatataggttgacagtggggcttacgagacgtggacagccgagacagtacaatgtgggccctagcgtgagcaaatacccactgagaaacctccagccggcatcagagtatactgtgagcctggtggccatcaaaggaaaccaggaatctcctaaagcgacgggcgttttcaccaccttgcagccgggatcttcgatacccccatataacactgaagtgaccgagacaacaattgtgataacttggacaccagcccctcgcattggatttaaacttggcgtgagaccgtctcagggcggagaggcaccgagagaggtgaccagcgactcaggcagtatcgtggtaagcgggctgaccccaggtgtggagtacgtgtacaccattcaggtgctgcgagacggccaggaaagggatgccccaatcgtgaataaggtagttactcctctctcccctcccacaaaccttcacctggaggcaaatcctgacaccggagtgctaaccgtgagctgggagcggagcacaactcctgacataacggggtacagaatcacaacaacaccgacaaacggtcagcaggggaacagtttagaagaagtggtgcatgcggatcagtcttcttgtacttttgataatctctctcccggactcgagtacaatgtttccgtgtacacagtgaaggacgacaaggagagcgtgccgatatcagacacaatcattccagcagtaccaccaccaacagatttgagatttacaaacataggccctgacaccatgcgagttacgtgggctccacccccttctattgacctgaccaacttcctcgtgcgctattctcctgtaaagaacgaagaagacgtggccgaactgagcatctctccgagcgataacgcagttgtgttgaccaacttgctaccgggaacagagtacgtggtatccgtgtccagcgtctatgaacagcacgagtcgaccccattgagggggaggcaaaaaacgggactcgactctccaaccggtatcgacttttccgacatcacagccaattccttcacagtgcactggatcgcacccagagcgactattactggctatcggatcaggcaccacccggagcacttcagtggtcggcctcgtgaggacagggtgccccattcccgaaatagcatcaccctgactaatttgacccctggcactgaatacgtggtttctattgttgcgttaaacggacgggaggaatcacccttgctcatcggacagcagtctaccgtgtctgacgtgcctagagaccttgaggtcgtggcagccacaccaacgtcccttctgatttcttgggatgccccagcggtgactgtgcgctactacaggattacctacggcgaaaccggaggaaattctcctgttcaggaattcaccgtgccagggagcaaaagtaccgcaacaattagtggtctcaaacccggagtggattacacaataacagtgtatgcggtcaccggtaggggggacagtcctgcctctagcaaacccatttccatcaactatagaacagagattgacaagccctcacagatgcaggttactgatgtgcaggacaattcgattagcgttaaatggcttcctagctcatctcctgtgactggttatcgggtcaccactactcccaaaaatggccctggcccaaccaaaaccaaaaccgctggcccagaccagaccgaaatgacaattgagggactgcagcccacggttgaatatgtggtaagtgtctatgcccagaatcccagcggagagtcacagcctctggtgcagaccgctgtcaccaccatccctgctccaactgacctgaagttcacacaagtcacccccacttcactctccgctcagtggactccccctaatgtgcagttaacgggctaccgagtccgggttacgccgaaggagaagactggacctatgaaagagatcaacctggcacccgacagctcttctgtagtggtgagcggcttaatggtggctacaaagtacgaagtgtctgtatatgccctgaaagatacactcacatcgagacctgctcagggagtggttaccacattagaaaatgtttcgccccctcgcagggcgcgagttacagacgcaacagaaacaaccatcaccatatcctggcggacgaaaacagaaacgattaccggcttccaggtcgatgcagttccggcaaatgggcaaacaccaatccagaggactattaagcccgatgtgaggtcctacactattaccggattgcaacctggcactgactacaaaatctatctgtacacgctgaatgacaatgcgaggagcagtcccgtcgtgattgacgcctcaaccgctatcgacgctccatctaatttgcgatttctggcaaccacacccaattcactgctggtcagttggcagcccccacgagcgaggatcacaggttacattatcaaatatgaaaagcctgggagcccaccaagagaggtggtaccacgacccagacccggagttacggaggccacaatcacaggattagagcccggaaccgaatataccatttacgtcattgcactaaagaataaccagaaatctgagcccctgataggccgaaaaaagaccgttcaaaagactccgtttgtaacgcaccccggttatgataccggaaacggcattcagctccccggtacatccggtcagcagcccagtgtcgggcagcagatgatctttgaggaacatggcttcagaaggactacccctcctacaacggccaccccaatccggcatcggccacgtccatatccgccaaatgtggggcaggaagccttaagtcagacaacaatcagttgggccccatttcaggacacatctgaatatataatctcatgccacccagtcggcactgacgaggagccactccagttccgagtaccaggcacctcgaccagcgccacccttactggtctgactcgtggggctacatacaatgtgatcgttgaggcgctgaaggaccagcagcggcacaaggttcgtgaagaagttgtgacagtgggtaattctgtcaacgaggggctaaatcaacccacagatgatagttgttttgatccctacaccgtctctcactacgccgtgggcgatgagtgggaaaggatgagcgaaagcggctttaagctgctgtgtcaatgcctcggttttggtagcggtcacttccgctgtgacagcagccgctggtgtcacgataacggcgtgaactacaaaattggagaaaaatgggacagacaaggggaaaacggccagatgatgtcttgcacctgtctgggcaacggcaagggggaatttaaatgcgatcctcacgaggccacctgctatgatgacggcaagacctaccatgtgggggagcaatggcaaaaagaatatctcggcgctatatgcagctgcacctgcttcggcggacagagaggatggagatgcgacaactgccgccgtccaggcggtgagccatcccctgaaggcaccacgggtcaatcatataaccagtacagccagcgctatcaccaacgcaccaacacaaatgtgaattgtcctatcgagtgctttatgcccctcgatgttcaggccgacagggaagatagccgtgaataa

SEQ ID NO: 28701 - DNA, 1974 bp, Artificial Sequence
  Description of Artificial Sequence: Synthetic coding sequence
atgctgcgcggacccggtcccggtttgctgctgctagcagtccagtgtcttgggaccgctgtccctagcactggggcttccaagtccaaaagacaggctcagcagatggtgcaaccacaatcaccagtcgctgtttctcaaagtaagcctggctgttacgataacgggaaacactaccaaatcaatcaacagtgggagagaacttatttgggtaacgcgctggtgtgtacctgctacggaggcagtcggggatttaactgcgagtcgaaacccgaagccgaagaaacctgttttgacaagtacaccggcaacacttaccgtgtcggagacacctatgaacgacccaaagacagcatgatctgggattgtacttgtatcggggctggcaggggtcggatctcctgcacgatcgccaaccgttgccatgaggggggtcagtcttacaagataggggacacatggcgccgtcctcacgaaacgggcggatatatgttggagtgtgtgtgtctgggcaatggcaaaggtgagtggacatgtaagccaatcgccgaaaagtgtttcgaccatgccgctggcacatcttacgtggtcggcgagacctgggaaaaaccataccaaggctggatgatggtggactgcacgtgtctcggagaagggagcgggcgtatcacgtgtactagtaggaacaggtgcaatgaccaagatactcgaacatcctacagaatcggagatacttggagtaaaaaagataatcggggaaacctcctgcagtgcatctgtaccgggaatggcaggggcgagtggaaatgcgaaaggcacaccagcgtacagaccactagctctggctcaggcccatttactgacgtgagagcagctgtataccagccccagccacaccctcaaccccctccctatggccactgcgtgacagatagcggagtggtatactcagtgggcatgcaatggctgaaaacccaagggaacaaacaaatgctgtgcacatgtcttgggaacggcgtgtcttgccaggagactgctgtgactcaaacatacggcggtaactctaatggggagccgtgtgtactaccattcacatacaacggcaggactttttactcatgcacaaccgagggaaggcaagacggacacctttggtgcagcactactagtaattacgagcaagaccagaagtactcattttgtactgaccataccgtgttggtgcagacacgcggaggtaatagtaatggtgccttgtgccactttcctttcttatataacaatcacaactacaccgattgtacctctgagggcaggagggacaatatgaaatggtgtgggacaactcaaaactatgacgcagaccagaagtttgggttttgtccaatggctgcccacgaggagatttgcaccaccaatgagggggtgatgtatcgcatcggcgaccaatgggacaaacagcacgatatggggcacatgatgcggtgcacctgcgtgggtaacggccgaggagagtggacctgcatcgcctattcacagttgcgggaccaatgcattgtggacgacattacttataacgttaatgacacattccacaagaggcatgaagaggggcacatgctcaattgtacctgtttcggacagggccgaggacggtggaaatgcgatcccgttgaccagtgccaggactccgagacaggcaccttttatcagatcggagacagctgggagaaatatgtgcatggcgtgagatatcagtgctattgttatggtagaggaatcggtgaatggcactgccagcctctccagacctacccaagctcgtctggtccagtggaggtattcatcacagaaaccccgtctcagccaaacagtcaccccattcagtggaacgcccctcagccttcgcatatctcaaagtatatcctgcgctggcgtccagtgagcatacctcctaggaacttgggatattag

SEQ ID NO: 28702 - DNA, 6804 bp, Artificial Sequence
  Description of Artificial Sequence: Synthetic coding sequence
atgctgcggggtccaggtccgggactgctgctgcttgccgtccagtgcctgggtacagctgttccaagtaccggcgctagcaaaagcaaacgccaagcacagcagatggtccagccacagagtccagtggcagtgtcacagagcaagccaggctgctatgacaatggtaagcactatcaaatcaatcagcagtgggagcgtacttatctagggaatgccctggtgtgcacttgctatggcggatcacgagggtttaactgtgaatctaagcccgaggctgaagagacctgctttgacaaatacaccgggaacacatacagagtcggggatacgtacgagcggcctaaggatagtatgatttgggactgtacctgcataggagcagggcgaggcagaatcagctgtaccatcgccaaccgctgtcatgagggagggcagtcctataagatcggtgacacctggaggaggccccatgaaaccggcggatacatgctcgagtgcgtctgtttaggcaatggcaaaggcgaatggacatgtaaaccgattgcagaaaaatgcttcgatcacgcagcaggaacaagctatgttgtcggcgagacatgggagaaaccttaccaaggctggatgatggtggattgcacctgccttggggaaggatccggaaggatcacttgcacatcaagaaatcggtgcaacgatcaggatactcgcacctcttatcgtatcggagacacgtggagcaagaaagacaatcgaggcaacctgctccagtgtatctgcaccggtaacgggagaggagaatggaaatgcgagagacatacttcagtccagacaacaagcagcggcagcggcccattcaccgatgtgagagcagcagtgtatcagcctcagcctcaccctcagccacctccatatggacattgcgtcacagatagcggtgtggtgtactcggtcgggatgcagtggctgaagacacaggggaataagcaaatgctatgcacatgcttaggcaacggggttagctgccaggagacagctgtcacgcagacctatggaggtaattcaaacggtgaaccctgcgttctgcctttcacttataatgggcgaacattttactcatgcaccaccgaggggaggcaggatggccacctgtggtgttctaccacaagtaattacgagcaggaccagaaatattctttctgcacagatcacacagtactcgtgcaaacacgagggggtaactcgaatggagccctgtgtcattttccattcctttacaacaatcacaactataccgactgtactagcgagggccgaagggacaacatgaagtggtgcggcacgactcaaaactacgacgccgaccagaaatttggattttgtccgatggctgcccatgaggagatatgcaccacgaacgagggagtgatgtacaggataggcgatcagtgggacaaacagcatgacatgggccacatgatgcgttgcacatgtgtaggtaacggaaggggggagtggacctgcatcgcctacagccaactgcgggaccagtgtatcgtggatgatataacctataatgtcaacgacacatttcataagaggcatgaggaagggcacatgctgaattgtacttgtttcggccagggtagaggtcgctggaagtgtgatcccgtggaccagtgccaggactccgaaacaggcacattttaccagatcggcgacagctgggagaaatatgtgcacggtgttcgataccagtgttattgctacggcagaggaattggagagtggcattgccagccattacagacttacccatcttcctctggtccggtggaggtgttcatcaccgaaacgccctcacagccaaactcccacccaatacagtggaacgccccacagccatcacacatcagcaaatatatactgcgttggagacccaagaattctgtgggcagatggaaagaggctactatccccggacacctgaatagctatacaatcaagggactgaagcccggtgtggtgtacgagggccaattgatctccatccagcagtatggacaccaggaggtcacccggtttgacttcactacaacctccacgagtacacctgtcacctcaaacactgtgaccggggaaacgactcctttcagtcccctggtcgctaccagtgaaagtgttacagagatcacggccagcagtttcgtggtcagttgggtcagtgctagcgacacagtgagcggctttagagtggaatacgaactgagcgaagaaggtgatgaacctcagtacctcgacctgccgagtactgctacaagcgttaatatccccgacctgctcccaggtagaaagtatatcgtcaatgtctaccagattagcgaagacggcgaacagagcctaatactgagcacgtcccagacaacagcacccgacgctccaccggacaccacagttgatcaagtggacgatacttccatagtggtgcgttggtctaggcctcaggcccctattacagggtatcggatagtctatagtccgtccgtggagggaagttcaactgaactcaacctgccagagacggccaatagtgtgacattgtcggatctccaacccggagtacagtataatataaccatctatgccgtagaggagaaccaggaaagtacacccgttgttatccaacaggagacgactggcacccctcgaagtgatacagtgccaagccccagggacctgcagtttgtggaggtcactgatgtgaaagtgaccatcatgtggacaccgcctgagtctgcagtgacaggataccgggtggatgttatccctgtgaacctgccaggagagcacgggcagcggctgccgatttcaaggaatacgttcgctgaggtcactgggctttcaccaggcgtcacatactacttcaaagttttcgccgtgagccatggcagggagtccaagccattgacggctcagcaaacaacaaaactggacgccccaaccaacctgcagttcgtcaatgagacggacagtacagtgctcgtgagatggaccccacccagagctcagattaccggctataggctaacagtgggattaacacgtaggggacagcctcgccagtacaatgttggcccttcggtttctaagtatccgcttagaaatctgcaacctgcatctgaatacacagtgtcactggtggctatcaaaggaaatcaggagagccctaaagcaaccggcgtgtttacaactcttcaaccaggatcatcgatccctccctataacacagaggtcacagagacgaccattgtgataacctggactccggcaccccgaatcggctttaagctcggagtccgaccatcccaggggggagaagcaccaagggaggttacttctgactctggctctattgtggtatcgggcctaacccccggagtcgaatatgtgtatacaattcaagtcctcagagatggccaggagcgcgatgctcccatcgtcaataaagttgtgactccccttagcccacccaccaacctgcatctggaggcaaatcctgacaccggcgtgttgacagtatcctgggaaaggagcaccacacctgatatcaccgggtaccggattactacaaccccaacaaacggccaacaaggcaatagcctggaagaggtggttcacgccgatcaaagcagctgtacatttgataatctgagtccaggcctggagtacaatgttagcgtttatactgtgaaggatgacaaagagagcgtgccaatatccgacactatcatcccagaagtgccccagttgacggatctgtcatttgtggacatcaccgattcgtctatcggcctgagatggaccccgttgaactccagtactattattggttataggattacggtggtggccgcaggggagggaattcccatctttgaggattttgtcgatagttctgtcggatattataccgtgacggggttagagccaggcattgactacgatatatctgtgatcacacttatcaatggaggtgaaagtgctccaaccacgttgactcagcagactgctgtgcctcccccaacggatctgcgcttcacaaacatcggcccagatactatgcgtgtaacctgggctcccccaccttctattgacctgacaaattttcttgttcgctactcccccgtgaagaacgaggaggatgttgcagagctgagtatctcaccatccgacaatgccgttgtccttacgaacctgttgccagggactgaatacgtggtgagcgtgtcttccgtatacgagcagcatgaaagcacgccccttcgaggcaggcagaagacaggcctggattcacctactggaattgatttcagcgacatcacagctaacagttttacagtgcattggattgcccctagagctaccatcacagggtaccgtattcggcaccacccggaacatttcagtgggagacctagggaagatcgtgtgccccacagcaggaattcaatcaccctgacaaacttgacacccggaactgaatatgttgtgtccattgtggctctcaacggcagagaggagtcacctttgctgatcggacagcagagtactgtgtcggacgttcctcgggacctagaggtggtggctgccaccccaacgtccctgcttatctcctgggacgccccagctgtgactgtccggtattatcgcattacatatggggaaaccgggggtaattcgccagttcaagagtttacagtgccaggatctaagagtactgccacaataagcgggctgaagccaggggtcgattacacaattactgtgtacgctgtcacgggcaggggggactcacccgctagctctaaaccgatcagtattaactacagaaccgaaattgataaaccatcccagatgcaagtcactgatgttcaggataattcaatttcagtgaaatggttgcccagtagcagcccagttaccggttaccgggtgactacgacaccaaagaatggtcctgggcctacgaagactaaaacagccggtcccgaccagactgaaatgaccattgagggcttgcagcccacagttgaatatgtagtgagcgtttatgcccagaatcctagtggagaatcgcaaccgctcgtgcagactgccgtcaccacaatcccagcgccaacagacctgaagttcacccaggttaccccgacgtccctgtccgcccaatggaccccgccaaatgtgcaactaacggggtatagggtccgcgtgacaccaaaagaaaagactggtcctatgaaagaaatcaatctggcccctgatagttcttcagtggtagtcagtggactaatggtagcaaccaagtacgaagtgagtgtctacgctctgaaggacactctgacaagccggcctgcacagggagtggtcactacacttgagaatgtcagcccacctaggcgagcacgcgtgacggatgctacggaaactaccattaccattagttggcggacaaaaacggaaacaatcaccggatttcaggtcgacgcagtgccggcaaatggccagactcccatccagcggacaattaagcctgacgttcggagctacaccattacaggtctacagccaggtacagattataagatctatctgtacactcttaatgacaacgctaggtcaagccctgtggttatcgacgccagtacagccatcgacgcaccatctaatctccggtttcttgctactacaccaaatagcttgctcgtatcctggcagccacccagggccaggatcactgggtacattattaaatatgaaaagcctggctcccccccacgcgaagtggttccacggcctcgcccaggggtgaccgaggccacaatcaccggtttagagcccggaacggagtacaccatttacgtcattgccctgaagaataatcagaagagcgaacctctgattgggaggaagaaaactggtcaggaggcactgtctcaaacaactataagctgggccccattccaggatacctccgagtatatcatatcctgccatcccgtgggtacagatgaggagccccttcagttccgggtgccgggaacctccactagtgccacactgaccggactaacccgcggtgccacgtacaacgtgatcgttgaagccctgaaggatcaacagcgccataaggtgagggaggaagttgtgactgttggtaactcggtaaacgaaggtctgaaccagcctaccgacgattcttgtttcgatccctataccgtcagccactacgctgtaggggacgaatgggaaaggatgagcgagtccggattcaagcttctctgtcaatgtctgggattcgggtctggacattttaggtgtgatagctcgagatggtgccacgacaacggtgtgaattataaaatcggtgaaaaatgggaccgacaaggtgagaatggtcaaatgatgtcatgcacatgccttggcaatggtaaaggggagttcaaatgtgatccccacgaggcaacatgttacgacgacggaaagacataccacgtcggcgaacagtggcaaaaagagtacctaggcgcaatctgttcctgcacttgtttcggcggtcagagaggctggaggtgtgataactgtcgccgaccagggggtgaaccctccccagaggggacaacaggacagtcatacaaccaatattctcaacgttatcaccagcgtaccaacactaatgtcaactgcccaattgagtgttttatgcctctggacgtgcaggccgaccgcgaggactccagagagtac

SEQ ID NO: 28703 - DNA, 6798 bp, Artificial Sequence
  Description of Artificial Sequence: Synthetic coding sequence
atgctgcgtggccctgggccagggctgttactcctggctgtgcagtgtctaggcactgcagtccctagcacaggagcttctaaatctaagagacaggcacagcaaatggtgcaacctcagtctccagtcgcagtgagtcaatctaagcccggatgttacgacaatggaaagcactaccaaatcaatcagcagtgggaacgaacgtatcttggcaatgctctcgtgtgcacctgctatgggggatctcgtggctttaactgtgaatcgaagcctgaagcggaagagacgtgtttcgacaagtacacggggaacacctaccgggtcggggacacttatgaacggccaaaggacagcatgatctgggattgcacgtgcatcggcgcaggtaggggaagaatctcttgtactattgctaatcgctgtcatgaagggggacagtcttacaagataggcgacacctggaggcgacctcacgagacgggcggttacatgcttgaatgtgtatgcttggggaacggcaagggggaatggacctgcaagcctatcgctgagaagtgtttcgatcacgccgcaggaacctcatacgtcgtgggagaaacgtgggaaaaaccgtaccagggatggatgatggttgactgcacctgcctgggtgaaggttccggacgcatcacgtgcaccagccgaaatcgctgcaacgaccaggatactcgcacctcctatcggataggcgatacatggtcaaagaaggataatcggggaaacctgttacagtgcatctgtacgggaaatggtcgcggtgagtggaaatgcgagagacacactagcgtgcagacgactagcagtgggtccgggcctttcaccgacgtgagggctgctgtttatcaaccacagccacatcctcagccaccgccatacggacattgcgtgacagattccggcgtggtgtatagtgtgggaatgcagtggttaaaaacccagggtaataaacagatgctgtgcacctgcctaggaaacggcgtgtcttgccaagagacagccgtgacccaaacttacggaggtaatagcaacggtgagccctgcgtgttgccatttacatataatggcaggactttttattcatgcactactgaggggaggcaggacggccacttatggtgtagcaccacttcaaactatgaacaggatcaaaagtattctttctgtaccgatcatacggttctggtgcaaacccggggagggaacagcaatggagccctgtgccacttccctttcctgtataataatcacaattataccgattgcacaagcgaaggcagacgagacaatatgaagtggtgtgggacaactcaaaactatgatgccgaccagaagttcggcttttgtccaatggcggcacacgaggagatttgcacaacgaacgaaggggtcatgtacaggatcggtgaccagtgggataagcagcacgatatgggccacatgatgagatgcacatgtgtggggaatgggcgtggagaatggacctgtatcgcttacagccagcttagagaccaatgtattgttgacgatatcacttataacgtgaatgacacctttcacaagagacacgaggagggccacatgctgaactgtacctgctttggccaaggcagaggtcggtggaagtgtgaccccgtggatcaatgccaagacagcgagaccggcacgttctatcaaattggagacagttgggaaaagtatgtgcacggcgtgcggtatcaatgctactgctatgggagaggaattggcgagtggcattgccagccactgcagacatacccgtcctcctccggtcccgttgaggtattcattactgaaactccaagtcaacccaattctcatccaatccaatggaatgcaccgcagcccagccatatctccaagtatatcctgaggtggagaccaaagaactctgtgggcaggtggaaggaggccacaattcctggccatctaaacagctacacaattaagggtctgaagcccggtgttgtctacgaaggccaacttatttccattcaacagtacggccaccaggaggtgactagatttgactttacgaccacttccacttccacccctgtgacaagtaatactgtcacaggtgaaactacccccttttctcccctggttgcaacaagcgagtccgtgacagagatcacggcttcaagcttcgtggtctcttgggtgtccgcatctgataccgtttcaggctttcgtgtggaatatgaactttctgaagaaggcgacgaaccccaataccttgacctgcctagcacagcaaccagcgtcaatatccccgacctgttgcctggcagaaaatacatcgtgaacgtgtatcagatatccgaggatggagaacagtccttgatcctctccactagtcagaccaccgccccagatgctcccccagacaccactgtggaccaggtggatgatacttctatagtggttaggtggtcacgaccgcaagcgcctattactggctacagaattgtgtattctcctagcgtagaaggcagtagcactgaactcaacctgcccgaaacggcaaactccgtcaccctctccgacctccagccgggagtgcagtacaacatcacgatttatgccgttgaagaaaaccaagaatccacacccgtggtgattcagcaggaaacgactggtacaccaagatccgataccgtgccaagccccagggacctgcagtttgtggaagtgacagatgtcaaagtgaccattatgtggactccaccagagtcggctgttactggctatagagtagatgtcatcccagtgaatcttcctggagaacacgggcagaggctcccaatcagcaggaacaccttcgccgaggtgacaggcctcagccccggtgtcacatattacttcaaggtctttgccgtgtctcacggtagagaatctaaacccctgaccgcccagcagaccactaagctggacgcccctacaaacctgcagtttgtcaatgagactgactccactgtactggttagatggacccctccaagagcacagatcaccgggtaccggctgactgtgggcctcactcgacggggacagcccaggcagtacaatgtagggccatctgtctcaaaatacccactccggaacctccagccagcttcagaatacacagtgagccttgtcgctatcaaaggcaatcaggaaagcccaaaagcaacgggggtctttaccaccttacagcccggatcctccatcccaccttataacaccgaggtaacagaaactaccattgtcatcacttggactcccgctcctagaatcggattcaagcttggagtaaggccgtcgcagggaggtgaggcccctcgggaagttacatccgatagcgggagcatcgtggtgtccggcttgacaccaggggttgaatacgtttacaccatacaggtgctgcgagatggtcaggaaagggacgctccaatcgtgaataaagtcgtgacaccgttatcaccacccacgaatctgcacctggaggcaaatcctgatacaggcgtgcttacagtgtcatgggaacgcagtaccactcctgacatcacagggtatagaataaccacaacccccacaaacggacagcagggcaatagcctggaagaggttgtgcatgctgaccagtcatcgtgcacatttgataacctgtccccaggtctggagtataatgtgtctgtgtatactgttaaagacgataaagaatccgtgccgatcagcgacaccattatacccgctgtgccccctcccacagatctgcggtttaccaacattggacccgacaccatgcgggtgacatgggctccacccccatccattgatctgacaaactttctcgtccggtactctcctgtgaagaatgaagaagacgtggctgaactgtcgatctccccatccgataatgccgttgtgttgactaatcttctcccgggaaccgaatacgtggtcagtgtgagtagtgtttacgagcagcacgaaagcactcccctacggggaagacagaagaccggtcttgacagtcctaccggaattgacttttccgacatcaccgccaactcgtttacagtgcattggatagccccacgcgctacaatcacaggctatagaatacggcaccatcctgaacactttagtgggaggccacgagaagatagggtgccacatagtcggaattcaattactctgacaaacctgaccccgggaacggaatacgtggtatccattgtggctctgaatggacgggaagagtcacctctcctgattggacagcagtcgaccgttagcgacgtacccagggatcttgaagtggtcgcagccactcccaccagcctgcttattagctgggatgccccagccgtgacagtcaggtactaccgtattacctacggtgaaactgggggtaattctcctgtgcaggagttcactgttccaggcagcaaaagcacagctaccatcagtgggctgaagcccggagtcgactacacaatcacagtctacgcggttaccggtaggggagactcgcccgcttcctctaaaccaatatctataaattatcgaaccgaaattgacaaacccagccaaatgcaggtgacagacgttcaggacaactccatatcagtcaaatggctgccgagctccagcccagttaccggctatagggttacaaccacacccaagaacggaccaggccctacaaaaaccaagaccgccggtcccgatcagacagagatgacgatcgagggcctccagcctacggttgaatatgtggtctcagtgtacgcccagaacccctcaggggaatctcaaccgctcgtccagactgccgtgacaactattcctgccccaacagatctgaagtttactcaggtcacccctacctcactgagcgcccagtggacccccccaaatgtgcagttgacaggctacagggtgagggtgactcctaaagaaaaaactggccctatgaaggaaatcaacttagcgccagatagctcctcagtggtggtgagtggtcttatggtggcgactaagtatgaagtttcagtttatgcacttaaggacactctgacaagccggccagcccagggggtggtgaccactctggagaatgtgtctccaccacgcagggctagagtgacggatgctactgaaaccactataacgatttcgtggcgaacaaagacagagactatcacaggcttccaggtggacgcagttccagctaatgggcagacccccatccagcggactatcaagcccgacgtgcggtcttatacaatcacaggcctgcaacccggaaccgattataaaatatatctgtatacactaaacgacaacgccaggagcagtcccgtggttatcgacgcaagtacagcaattgacgcgccttcaaatctgcggtttcttgcgaccactccgaactcactactggtttcatggcagccccctcgggctagaatcactggctatatcatcaagtacgagaagcctggtagcccacctagagaagttgtgccgagaccaaggccaggcgtcacggaagccacaataacagggctcgagccgggaactgagtatactatctacgtgatcgctctgaagaacaaccagaaaagcgaacctcttatcggacgaaaaaaaacagacgaattgccccagttggtgacactaccacaccctaacttgcatggaccagagattctggatgtccctagcactgtacagaaaacaccctttgttacacatccgggttacgatacagggaacggtattcagctcccaggaactagtggtcagcagccttccgtcggacagcagatgatttttgaggagcatggtttcaggaggacaactccacctacaaccgctaccccaatcagacacagacctcggccttacccacccaacgtcgggcaggaagcactgtcccagaccacgattagttgggccccatttcaggatactagcgagtatattatcagttgccatcctgtgggcactgacgaagagcccttgcagttcagagtgccaggaacgtctactagcgcaactctgaccggtctgacaagaggagctacctacaatgttatagtggaggcgctgaaggaccaacagaggcataaagttcgggaagaggtcgtgactgttggcaattccgtgaatgaaggattgaaccagcctactgacgatagctgcttcgacccctacaccgtctcacattacgccgtcggtgacgagtgggagcgtatgtcagaaagcggcttcaagttactgtgtcaatgtctgggctttgggagcggccacttccgctgcgatagctctcggtggtgccacgacaatggtgtcaattataaaattggggagaaatgggaccggcaaggcgagaacgggcagatgatgtcctgtacatgcctggggaatgggaagggcgaattcaagtgcgacccgcatgaagcgacttgttacgacgatggcaaaacatatcacgttggcgagcaatggcagaaggagtacttaggggcaatttgctcctgcacttgtttcgggggacagagaggctggcgctgcgataactgtagacgcccaggcggagagccctcaccagagggcactacaggtcaatcctataatcagtattctcaacgctatcaccagcggacgaacactaacgtgaactgccctatcgagtgttttatgcccctggatgtgcaggctgatcgtgaggactcaagagaatag

SEQ ID NO: 28704 - DNA, 6993 bp, Artificial Sequence
  Description of Artificial Sequence: Synthetic coding sequence
atgttaaggggacctggccctggtctgctcctactcgccgtccaatgccttggtacagccgtgccctcaactggggcttccaaatcaaagaggcaagcacaacagatggtacaaccgcagagtcctgtcgcagtgagtcaaagtaagcccggatgttatgacaatgggaaacattaccaaatcaaccaacagtgggaacggacctatctgggcaatgccttggtctgtacctgctatgggggtagcagggggttcaattgcgagtctaaacccgaagccgaggagacatgctttgacaagtacactggtaatacgtatcgcgtgggtgatacctacgaacgccctaaagacagtatgatttgggattgtacctgcatcggcgctggtcggggacggattagttgcacaatcgccaatcgttgtcacgagggcggacagagctacaagataggtgacacctggcgcagaccacacgagactggcggatacatgcttgagtgtgtgtgccttggcaacggcaaaggtgaatggacatgtaagcctatcgccgaaaagtgctttgaccacgctgctggcacaagctatgttgtgggcgaaacatgggaaaaaccctaccaaggttggatgatggtggattgtacttgcctgggcgagggatccggacgcatcacttgcactagccggaacagatgtaatgatcaggacactcggacttcgtatcgaataggggacacgtggagtaaaaaggacaatcggggaaaccttctgcaatgcatatgtacaggcaacggtcggggagaatggaagtgcgagaggcatacatccgtgcagactacaagctccggcagcggacctttcacagacgttcgcgcagctgtgtaccaacctcagccacacccccagccacctccatacggccattgcgtaacagactctggggtggtttactccgtcggaatgcagtggctcaagacacaggggaacaaacagatgctttgcacttgcctgggcaatggtgtgagttgccaggaaaccgctgtgactcaaacttacgggggtaatagcaacggtgaaccctgtgtacttcccttcacttataatggtaggacattctattcttgcaccaccgaaggacgacaagatggacacttgtggtgtagcacaaccagcaattatgaacaggaccagaagtacagtttttgcacggaccacacagtgctcgtacagacaagagggggaaactccaatggagcactgtgccacttcccttttctgtacaacaaccacaactataccgattgcaccagcgagggaaggagggacaatatgaagtggtgtgggactacacagaactatgatgctgaccaaaagtttggattctgccctatggccgcacacgaagagatctgcactaccaacgaaggcgtgatgtatcggattggtgaccagtgggacaagcaacatgatatgggccacatgatgcggtgcacgtgtgtaggtaacggcagaggcgagtggacttgcattgcctattctcagctccgggatcaatgcatcgtggatgatattacctacaacgtcaacgataccttccacaaaagacacgaggaaggccatatgcttaattgtacctgctttggccagggcaggggcaggtggaaatgcgacccggttgaccaatgccaggacagtgaaaccggaaccttttatcagattggcgatagttgggaaaagtacgtgcatggtgtaagatatcagtgttattgttatggtagaggcatcggagagtggcactgtcagcctctgcagacctacccaagctcttctggtcctgttgaggtcttcatcacagagactccctctcagcccaatagccatccaattcagtggaatgccccacagcctagccacatatctaaatacatcttgcgctggagacctaagaatagcgtgggacggtggaaggaggcaaccatccccggacatctgaacagctacaccatcaagggattgaaacctggagtggtgtatgaagggcagttaatcagtatccagcaatacggccatcaggaggtgactagatttgacttcaccaccacgtcaacctcgactcccgtaaccagtaatacagtaaccggagagaccacccctttttctcctctggtcgcaacttctgaaagtgtgacagagatcacagcgtcatcctttgtggtgagctgggttagcgctagcgatactgtttcagggttccgcgtggagtacgagctgtctgaagagggggatgagcctcagtacctcgacctgccaagtactgcaaccagtgttaacattccagacctgttgcccggacgaaagtacatagtgaacgtgtatcaaatcagtgaggatggagagcagagtctgatcttatcaacctcccaaacaaccgccccagatgcccctcccgacacgacagttgatcaggtcgacgatacatccattgtggtgagatggagtcggcctcaggccccaattacgggttacagaattgtatactccccgagtgttgaagggtcctctactgagttgaacctgccagaaacagccaattccgttaccctaagcgatttgcagcccggtgtccagtacaacatcacgatctacgcggtggaagaaaatcaagagagtaccccagttgtgatccagcaggagacgaccggcacccctcgcagcgacacggtgcctagtccaagagacctgcagtttgtcgaggtaactgacgtgaaggtaaccattatgtggacaccgcctgagtcagccgtgacgggataccgggtggatgtgattcccgtcaaccttcctggcgagcatggccagcggctgcctatatcccgtaacacatttgcagaagtgacaggactcagtccaggcgtcacatactactttaaagtctttgctgtatcacacggacgcgaatcgaaacccttgacggcacagcaaacaaccaagctcgatgccccaaccaatttgcagtttgtgaacgagacagacagcacagttttggttagatggacacccccaagggcacagatcacaggatatcgactcactgttgggctgacacgcagggggcagcctcgacaatacaatgtgggcccttccgtgagtaaatacccactgcgtaaccttcaacccgcatccgagtacacagtttccctggttgcaatcaagggtaatcaggagtctccaaaggccacaggcgtattcacgaccctccaacccggttccagtatacctccatataacaccgaagtgaccgagaccacgatcgtgattacatggactcccgcacccagaatcggttttaagctcggggtgcgccctagccaaggcggtgaagcacccagggaagtgacaagcgattctggcagcatagttgtgtccggtctaacaccgggagtggagtacgtatacacaatccaggtgctgagagacggccaagagcgagacgcacccattgtaaataaggtggtgacccccctctcgcctcctactaatttacacctcgaggccaacccagacactggcgtactcaccgtatcatgggagaggtcaacgactcccgatatcaccggctatcggattaccacgactccaacaaacggtcagcaggggaattctttggaggaagtcgtacacgctgaccagagttcatgcacgttcgataacctgagcccaggactggagtacaacgtgtcagtgtacaccgtcaaggacgataaggagtcagtccctatttctgatacaattatcccggcagtccctccaccaacagatctacgtttcacaaacatcggacccgatactatgcgcgttacttgggccccacccccatccatagacctgacaaattttttagtcagatacagccccgtcaagaatgaagaagacgtggcagagctgtcaatttctccatcggataatgccgtcgtgttgacgaatctcttacctgggacagagtacgtagtttcggtgagcagtgtgtatgagcagcacgagagtactccactgagaggaagacagaaaacagggttggattcaccgactggcatcgacttttctgatatcaccgctaattcattcaccgttcattggatagcgccacgcgctacgattaccggttatcgcatcagacatcaccctgagcattttagtggcagaccaagggaggacagggtgccacactcaaggaactctatcacactgaccaacctgactcccggaactgaatatgtcgtctccatagtggctctcaacggaagggaagaatcccctctgctgataggacagcagtctacggtttctgacgttcctagagaccttgaggtcgtagctgccacacctacgtctctgttaatcagctgggatgctccagcagtgaccgtgaggtattaccgcataacatacggcgaaacgggtgggaacagtccggtgcaagagttcactgtgcccggatccaagtccacagccactattagtggcctcaagcccggagtggattatacgatcacggtgtacgccgtcacaggcagaggggatagtccagcaagctcaaaacctatcagcataaactacagaacagagatcgacaagccctcccagatgcaggtaaccgatgtgcaggataacagcatatctgtcaaatggctgccttcttcatctcccgtcacaggataccgcgtgactaccacacccaagaatgggcctggtccaacaaaaacaaagactgctgggccagaccagaccgaaatgacgattgaggggctccagcccacagtggaatacgtagtatccgtctacgctcaaaatccgtctggggagagccagccattggtgcagacagccgttacaaatatcgatagacctaagggcttagcatttactgacgttgacgtggactctatcaagattgcttgggaaagtccacaaggacaggtgtcacgttaccgggtcacatatagttcacctgaggatggaattcatgagctctttccagcaccagacggcgaggaggacactgctgaattgcagggcctgcggcctggttcggagtacacggtctccgtggttgcattacacgatgacatggaatcccagcctctcatcgggacccagagcactgccattccagcacccacagatctcaagtttacacaggtgacccccacttccctatccgcgcagtggactccccctaacgtgcagttaactgggtaccgggtgagggtaacgccgaaagagaagactggacctatgaaggagatcaatctcgcccctgatagcagtagcgtggtcgtcagcgggctgatggtcgctactaagtatgaggtgtccgtctacgccctgaaggacacgctgacttcaaggccggctcaaggcgtcgtcactaccctcgaaaatgtgtccccgcctaggcgtgcacgcgtgactgacgcaaccgaaaccaccatcaccattagctggcggaccaagaccgagacgataaccggctttcaggtggacgctgttcccgcaaacggccagacacccattcagcgcactatcaaaccggacgtgcgcagctataccatcaccgggctgcagcctggtactgattataagatctacctctatactctgaatgataacgcacgaagtagtcccgttgtgattgacgcttctacagctattgacgctccttccaaccttcggttcctggccaccacccccaattcacttcttgtgagctggcagccaccaagagcccgaatcaccggttatatcatcaagtacgagaaacccggtagcccaccacgcgaggttgtaccaagaccacgacccggagtaaccgaagctacgattacaggcctcgaacctggcacagagtatacaatctacgtcattgccttgaagaataatcagaagtctgaaccgctgattggcagaaagaagactgtccaaaagaccccatttgtcacacatcccggttacgataccggcaacgggattcagcttcctggcacaagtggacagcagccgtctgtggggcagcaaatgatttttgaggagcacggattcaggcggacaaccccccctacaacggcaactcccattcgtcaccgtccgagaccgtacccccctaacgtgggacaggaggctttatctcagactaccatctcttgggcacccttccaggacaccagcgaatacattatcagttgtcatcctgtggggaccgacgaagagccccttcagttccgggtgccgggtaccagcacctctgccacactcactggcctgacccgtggagccacctacaacgtgatcgtcgaagcgctgaaggaccagcagcgccataaagttcgggaagaagtagtgaccgtaggcaactccgtcaacgaggggctgaatcagcccacagatgatagttgttttgatccctacaccgtatcccactacgctgttggggacgaatgggaacgcatgtcggaaagcggctttaagttactttgtcagtgtctgggattcggctcgggacactttcgatgtgattcctcacgctggtgccatgataacggtgtgaactacaagataggagagaagtgggaccgccagggagagaatggccagatgatgtcatgcacttgcctgggcaatggaaagggcgaatttaaatgcgatcctcatgaggccacatgttatgatgacgggaagacttaccatgttggagaacagtggcagaaggagtaccttggcgctatctgctcctgcacctgtttcgggggacagcgcggttggagatgtgataactgcagacgaccagggggagaacctagccccgagggaaccacaggacagtcttacaatcaatacagccagcgctaccaccagcgcaccaataccaatgtcaattgtccgatagagtgctttatgcctctggatgttcaagcggaccgggaggattcacgtgagtaa

SEQ ID NO: 28705 - DNA, 3312 bp, Artificial Sequence
  Description of Artificial Sequence: Synthetic coding sequence
ctgaggtggacccctttgaacagcagcaccatcatcggttaccggatcaccgtcgtggcagctggagagggcatcccgatttttgaggacttcgtggactcttcagttggttactacaccgtaacgggcttggaacctggtatcgactacgacatttctgtgattactctgatcaacggtggggaatctgcaccaaccacgctcacccagcagacggccgtgcctccccctaccgacctcaggttcacgaacatcggtcccgatacgatgcgggtgacctgggcccctcctccgagcattgacctgaccaattttctagttagatactcacccgtaaaaaatgaagaggacgtcgccgagctgagcatcagcccatcagataatgcggtggtccttacgaatctgttgccgggtacagagtacgtggtgagcgtgagcagcgtgtacgagcagcatgaatctacgcccctgcgcggaaggcagaagacaggacttgattctcccacaggtattgacttctcagatataactgctaactccttcaccgtgcactggatagctccaagggctacaatcacagggtatagaatcaggcaccatcccgagcactttagcggtaggcccagagaggaccgggttcctcattcaagaaactcaatcaccctgacaaacctcactcctggcaccgagtacgtcgtgtctattgtggctttgaatgggcgagaggaatccccgttgttgatcggccagcagagcaccgtgagtgacgtacctcgagacttagaagtcgtcgccgcaacgcctactagtctgctgatctcctgggatgctccagccgtgaccgttaggtactaccggatcacatatggcgaaacaggagggaactcacccgtgcaagaatttaccgtgcctggatctaagagtaccgcaaccatatcaggcctgaagcctggcgtagactacaccattaccgtgtacgcagtgacaggcaggggagactcccctgcttctagtaagccaatatcaattaactatcgtaccgaaattgataagccctctcaaatgcaggtgactgacgtacaagacaattccatcagtgttaaatggctccccagctcctctcctgtcactggatatcgggtcacaacaacaccaaagaatggcccagggcctaccaaaacaaagactgccggacctgaccaaacggagatgaccatagaaggccttcagccgaccgtggagtatgtcgtgagtgtttatgctcaaaatccatctggagagagccagcccctggtgcagactgccgttaccactatccccgcacctacagacctcaagttcacccaggtcacccccactagcctgtctgctcagtggactccgccaaacgtgcaactcaccggatatcgcgtgagggtcacgcccaaagagaagaccgggccaatgaaagaaataaatcttgcacccgatagctcctcggtagtggtatctggtctcatggtggcaaccaaatacgaggtctctgtatacgcattgaaagacacacttacctcgaggccagcgcagggagtggttacaacactagagaacgtctctccccctagacgggcacgggtcaccgatgccacggagaccactattacgatcagctggagaacgaagactgagaccatcaccggcttccaagttgacgctgtgcctgccaacggccaaacgcccattcagcgtacaataaagcctgacgtgagatcctacaccattactggattacagccaggaacagattacaaaatatacctatatacccttaatgataatgctcgcagcagtccagttgtgatcgatgctagcactgcgattgatgccccaagcaatctccgattcttagccacgactcccaacagcctgctggtgagctggcagccccctcgggctcgcatcaccggttatataatcaaatacgaaaaaccaggctcaccgccaagggaagtggtccccagacctagaccaggcgtgactgaggccacaatcactggccttgaaccaggcacggaatataccatctacgtaatcgccttgaagaacaatcagaagagtgagcctctcatcggacggaaaaagaccgacgaactccctcaactggtgacactgccgcaccccaatttacacggacccgaaatccttgacgtgccaagtacagttcaaaaaacgccttttgtgacacaccctggctatgacacggggaatggcatccagctgcctggaaccagtggtcagcagccaagcgtgggacagcaaatgatcttcgaggaacacgggtttcggaggacaacacccccaactaccgctacccccattagacacagaccgagaccctaccccccaaatgttggcgaagaaatccagataggccacatccctagggaggatgtggactatcacctatatcctcatggacccggtctgaacccaaacgccagtactggtcaggaggctctcagtcagaccaccatcagttgggcccctttccaggataccagtgagtatataattagctgccaccctgtgggtactgacgaggaacccctacaatttcgagtccccggaacgagcaccagtgctacattgacgggcctgacacgaggcgcaacgtacaatgtgatcgtagaagcattaaaagatcagcagcgccacaaggtgagggaggaggtggtgacagtcgggaactcagttaacgagggactcaaccagccaacagatgactcatgcttcgacccctacaccgtaagccattacgctgtaggcgatgagtgggagcggatgagcgagagtggcttcaagctcctgtgtcagtgccttggctttggatcaggacacttccgctgcgactcatccagatggtgccacgacaatggtgtaaactataaaatcggagagaaatgggaccggcagggtgaaaacggccaaatgatgtcatgcacgtgcttgggaaacgggaaaggcgagttcaaatgtgacccacacgaggcaacctgttacgatgatgggaagacatatcacgtgggcgagcaatggcaaaaagagtaccttggggctatttgtagttgtacctgctttgggggacagcggggttggcgctgtgacaactgccgcaggccaggcggtgagccatcccccgagggaaccactggccagagttataatcagtattcacaacgttaccatcagcgcactaatacaaacgttaattgcccaatcgaatgctttatgccattggatgtgcaagctgatagagaagactccagggaatag

SEQ ID NO: 28706 - DNA, 312 bp, Artificial Sequence
  Description of Artificial Sequence: Synthetic coding sequence
atgcccgtgtcggtgtcaagcgggagaactttccctaagcggggtcagacctgcgttgtgcattatacgggcatgttagaggacggcaagaagttcgacagttctagggaccgaaataaacctttcaaatttatgctgggcaaacaagaggttatccggggttgggaggagggagtggctcagatgtcagtcggacaaagggccaagcttactatctccccagactacgcctacggcgcaactggacatcccggaataatccctcctcacgccactttggtgtttgatgtagaactgctcaagctggagtag

SEQ ID NO: 28707 - DNA, 327 bp, Artificial Sequence
  Description of Artificial Sequence: Synthetic coding sequence
atgggggtacaggtcgaaaccattagtcctggcgatggaaggacctttcctaagagagggcagacctgtgtcgtgcattatacgggcatgcttgaagacggaaaaaaatttgattcctcccgggatcgcaataaaccttttaagttcatgctgggaaagcaggaagtcattcgtggctgggaagaaggcgtggcccagatgtccgtgggtcaacgggctaagcttacaatatccccagattatgcctatggcgcaacagggcaccccggaatcatcccccctcacgctaccctcgtcttcgatgtggagctgctgaaactggaatag

SEQ ID NO: 28708 - DNA, 312 bp, Artificial Sequence
  Description of Artificial Sequence: Synthetic coding sequence
atgcccgtgtcagtgagctcagggcgtacatttcccaagcgaggccagacctgtgttgtgcactacaccggaatgctagaggacggcaaaaagttcgactcttccagagacaggaataagccgtttaaattcatgttgggtaagcaggaagtcataaggggatgggaggaaggtgtggcccagatgtctgttggtcaacgtgccaagctgactattagcccggactacgcatatggggctaccggccatccgggtatcatccccccacatgcgaccctggtgttcgatgtggagctgctaaagctggaatag

SEQ ID NO: 28709 - DNA, 327 bp, Artificial Sequence
  Description of Artificial Sequence: Synthetic coding sequence
atgggagtgcaggtggaaacaattagccccggtgatgggcgaaccttccctaagcggggacagacctgtgttgttcactacactggcatgttagaggacggtaagaagttcgactcaagtagagatcgtaacaaaccctttaagtttatgttaggtaagcaggaagtgattcgaggctgggaggagggcgtagctcaaatgtctgtgggtcagagagccaagctgacaattagccccgactacgcatacggcgctaccgggcaccccggtattattcctcctcacgccaccttggtgttcgacgtggagctcctgaagctggagtag

SEQ ID NO: 28710 - DNA, 279 bp, Artificial Sequence
  Description of Artificial Sequence: Synthetic coding sequence
atgggggtccaggtcgagaccattagtccgggtgatgggatgcttgaggacgggaaaaaatttgattcatcaagagataggaataaacccttcaaatttatgctgggcaagcaggaagtgatcagaggttgggaggagggcgtagcccaaatgtccgtgggacagcgggcaaagctgaccatctccccagattacgcatatggggcaacaggacacccgggaatcatccccccacacgccacccttgtgtttgacgtggaactgctgaagctggaatag

SEQ ID NO: 28711 - DNA, 1143 bp, Artificial Sequence
  Description of Artificial Sequence: Synthetic coding sequence
atggggattcagggactggccaaactgatagcagacgtggcaccgagtgctattcgggagaatgatatcaagtcgtatttcggacgcaaggtggcaatcgacgcttctatgtctatataccagttcttgatcgcagtgcggcagggcggtgacgtgttgcaaaatgaggaaggcgagacgacaagccatttgatgggcatgttctaccgtacaattcgcatgatggagaacgggataaaacccgtgtacgtcttcgatggcaaaccccctcagctcaagagcggtgaactggctaagaggtcagaaaggcgggctgaggccgagaagcagctacaacaggcccaggccgcaggtgctgagcaggaggtggagaaatttaccaagcggctcgtgaaagtgactaaacagcataacgacgagtgtaagcacttactcagcctcatgggcatcccatatttggatgcacctagtgaggcggaggcttcctgtgcggctctcgtgaaagctggcaaggtgtatgctgctgccaccgaggatatggactgcctgacattcgggtcaccagtgcttatgaggcacctgacagcttccgaggccaaaaaactgcccattcaggagtttcacctgagccggattctgcaggagttgggcctaaatcaggagcagtttgtggacctttgtatcctgctgggcagcgactactgtgaatccattcgcggaatcggaccaaaacgagccgtggacttgattcagaagcacaaaagcattgaagaaattgtcaggcgcttggatcccaacaagtaccccgtgcctgagaattggcttcacaaggaagctcatcaacttttcctcgagcctgaggtgctcgatcccgagtcggtggagctgaagtggagcgagcccaatgaagaagagttgataaagttcatgtgtggggaaaaacaatttagcgaggaacggatacgctccggagtcaaacgactaagcaaatccagacaggggagcacacagggcaggttggatgactttttcaaagtcactggtagcctgtcttccgcaaagagaaaagaaccggagcccaagggatccacaaaaaagaaagccaagaccggggcagctgggaaatttaagcggggaaaatag

SEQ ID NO: 28712 - DNA, 498 bp, Artificial Sequence
  Description of Artificial Sequence: Synthetic coding sequence
atgggaattcaaggtctggcaaaactgatagctgacgtggccccatcagccattagggagaacgacattaagtcttatttcggacggaaggtggccattgacgcaagtatgagtatctaccagttcctaattgcagtgagacaagggggagatgtgctgcagaacgaagaaggcgagacaacctcgcacctgatgggcatgttctacaggaccatccgtatgatggaaaatggcatcaaaccagtatacgtgtttgacgggaagcctccacagctgaaatccggcgagctcgccaagagaagcgaaaggcgggctgaggcagagaagcagctgcagcaggcgcaggccgctggtgctgagcaggaagtggaaaaattcacaaagcgacttgtgaaggtgacaaagcagcacaacgacgagtgcaaacaccttttgagcttgatgggcattccctacctggatgcccctagcgaagccgaagcttcttgcgctgcgtag

SEQ ID NO: 28713 - DNA, 4017 bp, Artificial Sequence
  Description of Artificial Sequence: Synthetic coding sequence
atggtaagctactgggataccggcgttctcctgtgtgctcttctttcctgtttgctgttgaccggatcttcttcaggatccaaactgaaagatcccgagctatccttgaagggcacccaacacattatgcaagccggacaaaccctgcaccttcaatgtaggggcgaggcagcacataaatggtcgctaccagagatggtttctaaagagagcgagaggctgagtatcactaagtcagcctgcggtaggaacggcaagcagttctgttccacgttaacgcttaacacggcacaggctaatcacactggattttactcttgcaagtatttggcagtgcccaccagcaaaaagaaagagactgagagcgcaatttacatttttatctctgacactgggcgaccattcgtagaaatgtactctgaaatccccgagatcattcacatgacagaagggcgagaactcgtgatcccttgccgcgtgacttccccgaatatcacagtaactcttaaaaagttcccactcgacactctaattcccgacggtaagagaatcatctgggacagccgcaagggttttattatcagcaacgccacctataaggaaataggactcctgacttgtgaggctacggtcaatggccacctttataagactaactatctcactcacaggcagacgaacaccatcattgatgttcaaatttccacgccacgccctgttaaattgctacggggacacaccctcgtgctaaattgtaccgccactacgcccctgaacactagagtccagatgacatggagctatcctgacgaaaaaaataagcgtgcatccgtgagacgcaggattgaccagtccaactcccacgctaacattttttatagtgtgctcaccattgacaaaatgcaaaataaggacaaagggctgtatacctgcagagtgcgatccggcccttccttcaaaagtgtgaacacctcggtacacatctacgacaaagcatttattaccgtgaagcatcgaaaacagcaagtgcttgagacagtggcagggaagcgcagctacagactgtcaatgaaagtaaaggcctttccgtcccctgaagtggtttggctgaaggatggactcccggcaacagagaaatcggccaggtacctcacccggggatactctctgattatcaaagacgttaccgaagaggacgctggcaattacacaatcctcttatccattaagcagagtaacgtttttaagaatttgactgcgacactgatagtgaacgtcaagccgcagatttatgagaaggcagtcagttcctttccggatcccgcactgtacccattgggctcccgccagatactaacctgtactgcctacggaatacctcagcctacaatcaaatggttttggcatccttgtaaccacaaccattctgaggctcgctgtgacttttgcagtaacaatgaagagtcatttattctggatgctgactctaacatgggaaacagaattgaaagcattacacagcgtatggctatcattgaggggaaaaacaagatggcaagcactctggtggttgcagattctcgaatatcaggcatctacatttgcattgccagcaacaaggttggtacagttggtagaaatatttctttttacataacggacgtaccaaatgggttccacgtaaacctggagaagatgcctacagaaggcgaggacctcaagctctcttgtaccgtgaataaattcctttacagggacgtgacatggatcctcctccgaactgtgaacaatcgcacaatgcattactccatcagtaaacagaagatggcaattacgaaggaacactccataaccctgaacctgacgattatgaacgtgagcctccaggactcagggacatatgcttgcagagcgcgaaatgtctacactggggaagagatccttcaaaaaaaagaaattaccatcagagatcaagaggctccctacttactcagaaatctatcagaccacaccgtggccatcagctcatctacaacccttgactgccatgccaacggggtgcctgagccacaaataacgtggttcaaaaacaaccataagatacagcaggaaccaggcatcatccttggcccagggagttccaccctgttcattgagcgcgtgactgaggaggatgagggagtgtaccattgtaaggcaactaatcagaagggctctgtggaatcatccgcctacctgactgtgcagggtacatccgacaaatctaaccttgagctaataacgctcacttgcacgtgtgtcgccgcaaccctcttctggctgttacttaccctcttcattcgtaagatgaaacgaagcagcagcgagattaagactgattacctgtccatcattatggatcccgacgaagtcccactggatgaacagtgtgagagactgccttatgatgcatcgaagtgggagttcgccagagaacgattgaaactgggcaaaagtctgggtcgaggggcatttggcaaagttgtacaggcatctgcctttgggatcaagaaatctccaacatgtcgaactgttgccgtgaagatgctaaaagaaggcgctaccgcgtcagagtacaaggccctgatgactgaactgaaaattctgacccacattggacatcacctgaacgttgtgaacttactgggcgcttgtactaaacaggggggacctcttatggtgatcgtagaatattgtaaatacggcaacctcagcaattaccttaagagcaaacgggatctgtttttcctaaataaggatgccgctctgcacatggagcccaaaaaggaaaagatggaacccggattggagcaggggaagaaaccaagactagactcggtaaccagcagtgagtcgttcgcctccagtgggtttcaggaagacaagagcttgtccgatgtggaggaagaggaagactccgatgggttctacaaagagcccataaccatggaggacctcatctcttactccttccaggtggcccgaggcatggaatttctctcatcccggaagtgcattcaccgcgacttggcagccaggaatattttactaagcgagaacaacgtcgtcaagatttgtgatttcggtctggctcgcgacatttacaagaatcctgactacgttcggaaaggggacactagattgccactgaagtggatggcccctgaatctattttcgataaaatttattctacaaaatcggatgtctggagctacggtgtcctcctctgggagatcttcagtctgggtggctctccttatcctggcgtgcagatggacgaagatttctgttctaggctcagagagggaatgcgtatgagggctcctgagtactcaacgcccgaaatctaccaaatcatgttagactgctggcatcgcgaccccaaggagcggcctagattcgcggagctggtagaaaaactgggtgatctactgcaggcaaatgtgcagcaggacggcaaagactacatccccattaacgctatccttacgggcaactccggttttacttattcgacccccgctttcagtgaggatttctttaaagagtccatctcggctcccaaatttaacagcgggagctcagacgatgtgcggtatgttaacgctttcaaatttatgtccctggagcggatcaaaacctttgaggaactgcttcccaatgcgacctccatgttcgatgactaccagggagacagtagtacattgttggcttcacctatgctgaaaagatttacctggactgattctaaacccaaggcatctttgaaaatagatctgagggtcacaagcaaaagcaaagagtcaggtttgagcgacgtgagccgcccaagcttctgccacagttcatgcggccacgtgtcagaaggaaagcggagatttacctatgatcacgctgaactggagaggaagatagcctgctgctcacctcccccagattacaactctgtcgtcctatactcaactcccccaatctag

SEQ ID NO: 28714 - DNA, 531 bp, Artificial Sequence
  Description of Artificial Sequence: Synthetic coding sequence
atggtcagttactgggataccggagtattgctgtgcgcactcctgtcttgtttacttttgaccggctctagctcaggatcaaaactcaaagatccagaattaagtctgaagggtacccagcatataatgcaggccggacaaaccctgcatctgcagtgtaggggtgaagccgcacacaaatggagcctgcctgagatggtgtccaaagagagcgagcggctgagcatcaccaaaagcgcgtgcgggcgaaacgggaaacagttttgttctaccctaacactaaatactgctcaggctaatcataccggcttctactcctgcaagtatctcgccgtccctaccagtaaaaaaaaagagactgagagcgccatctatattttcataagcgacaccgggagacctttcgtggagatgtattccgaaattccagagattatccacatgactgaaggcagagagctagtcatcccttgcagagtgactagtccaaatatcacggtaacactcaagaaaaagaataagagagcctag

SEQ ID NO: 28715 - DNA, 1626 bp, Artificial Sequence
  Description of Artificial Sequence: Synthetic coding sequence
atggtgtcttattgggacaccggcgtactgctgtgtgcgttgctatcttgcctgcttctgactggctccagtagtggctccaagctgaaggacccagagctgtccctaaaaggaacccaacacataatgcaggccggacagacgctgcatcttcaatgccgcggagaggcagcacacaagtggtcccttcctgagatggtgagcaaagagagcgagcgcctgagtataactaagagcgcttgcggcaggaatgggaagcaattttgtagcacattgaccctcaataccgcccaggcgaatcacacgggtttttatagctgtaaatacctagcagtgccaacctctaaaaagaaggaaactgagtcagcaatctacatcttcatcagcgatacgggtcggccatttgttgaaatgtactccgaaatccctgagatcattcacatgaccgaaggcagggaactcgtgataccatgccgcgtaacatcaccaaatatcacagtgacactgaaaaagttcccactggacacactgatccccgatgggaaaagaattatatgggattcgcggaaaggcttcattatctccaatgctacgtataaagaaattggactactcacctgtgaagccactgtgaacggccacctgtacaagaccaactatctgacgcataggcagacaaataccatcattgacgtgcagatctctacaccacggccagttaaacttttaagagggcacaccctggtgctgaactgcaccgccacaactccgcttaacactagggtgcaaatgacatggtcttatcccgatgagaagaacaagcgcgcttcagtgcggcgacggattgatcaatcaaactctcatgctaacatcttttattctgtcctgactatcgataaaatgcagaataaggataaaggactatacacgtgcagagtgcggtccggacccagcttcaagtccgtcaatacctcagtgcacatttatgacaaggctttcatcaccgtcaaacatcgcaagcagcaggtgctggaaaccgtcgccggaaagcgcagttataggttgagcatgaaggtcaaagcatttccgtcccctgaagtggtgtggcttaaagatgggctgcctgccactgaaaaaagtgcgaggtacctcacccggggatactcccttatcatcaaggacgtcaccgaggaggatgcgggaaattataccatccttttatctattaaacaatctaacgtatttaaaaatctaacagccacactcatcgttaacgtgaaaccccagatatacgagaaagccgtctcaagcttccctgaccccgcactctaccctctgggttcccgccagatcctgacgtgtactgcctatgggattccccagccaactatcaagtggttctggcacccctgtaatcataaccattccgaggctcgttgcgatttttgttctaataacgaggaatccttcatattggacgccgacagtaacatgggcaaccggatcgaatccatcacacagaggatggctattatcgaggggaaaaacaaactgcctccagctaactcgtcattcatgctccccccaacctccttcagctccaattactttcacttcttgccttag

SEQ ID NO: 28716 - DNA, 1671 bp, Artificial Sequence
  Description of Artificial Sequence: Synthetic coding sequence
atgaaaaggagcagcagtgaaattaaaactgactacctctctatcattatggaccccgacgaagtgcctctggatgagcagtgcgaacgcctgccctacgacgcctccaaatgggaatttgcccgtgaacgcctcaagttgggaaagtctctaggtaggggtgccttcgggaaggtggttcaagcctcggcattcgggattaagaaatcacccacttgtcgaactgtagccgtgaaaatgctgaaggagggagccaccgcctctgaatacaaggcactaatgacagaactgaagatacttacccacataggccatcacctgaatgtcgttaatctcctgggcgcttgtaccaagcaaggcggtcccctgatggtgatcgttgagtattgtaaatacggaaatttgtctaattacctgaagagtaaacgagacctgttctttctgaacaaagatgcagccctgcatatggagccaaagaaggagaaaatggagcctggcctggagcaggggaagaaacccaggctggactccgtgacaagctcagagtcctttgcatcctcaggttttcaggaagacaaaagccttagcgacgtagaggaggaggaagattccgacggcttctataaggagcccatcacaatggaggacctgatttcgtattcttttcaggttgcgagaggaatggaattcctgagctcccgcaaatgcatccatagggatcttgctgcacggaacattctgctgtcggaaaataatgtggtgaagatttgcgactttggcttagcaagggatatttataagaatccggactacgttcgtaaaggggacacgagactgccattgaagtggatggctcccgagagtattttcgataagatctacagtaccaagtccgacgtctggagctacggcgtgcttctctgggagattttctcgctcggaggtagcccctaccccggtgtgcagatggatgaagacttttgttcccgtctgagggaagggatgagaatgagggcaccagagtactcaactccggagatctaccaaattatgctcgactgctggcatagagatccaaaagagagaccgcgattcgctgagctcgtggaaaagctgggcgatttgcttcaggccaatgtccagcaggacggaaaagactacatccctatcaacgccatcctcacggggaatagcggattcacatactcaacacccgcattttccgaggatttttttaaggagtctatctctgcacctaaattcaactcaggatcttcggacgacgttagatacgtgaatgccttcaagttcatgtctttggagagaatcaagacctttgaggaattgctcccaaacgccacttccatgttcgacgactatcagggtgactcctccactttgctcgcctctccaatgttgaaaaggttcacctggaccgactccaaacctaaagccagcctgaaaatcgatctgcgggtgacgtccaaaagtaaagagtccggcttgagcgacgtatctcggccatcgttctgccatagctcttgcgggcacgtctcagagggaaaacgcagatttacctacgatcatgcagaactcgaaaggaagatcgcctgttgttctccacctcccgactacaattcagtggtcctttacagtacgccacctatttag

SEQ ID NO: 28717 - DNA, 45 bp, Artificial Sequence
  Description of Artificial Sequence: Synthetic coding sequence
gaacttagcaacttcgagtgcctgcatccatgctctcaggaatag

SEQ ID NO: 28718 - DNA, 2202 bp, Artificial Sequence
  Description of Artificial Sequence: Synthetic coding sequence
atggtttcatattgggacactggagtgctgctgtgcgcccttctatcctgccttcttctgaccggtagttcatccggcagcaaattgaaagacccagaactatctctgaaagggacccagcacattatgcaggcagggcagacattgcatttgcagtgtcgtggcgaagctgcccacaagtggtcactgcctgagatggtatcaaaggagtcggaacggctttctatcactaagtctgcatgtggtcgcaatggtaaacagttctgtagcacgcttactttgaacactgcacaagccaatcacacaggcttttattcatgtaagtacctcgcagttcccacttccaaaaaaaaagagacagaatcagcaatctatatctttatatccgacacaggcaggccatttgtggagatgtactctgagatcccggaaatcatccatatgacggagggcagggagctggtgattccctgccgggttactagtccgaacatcaccgtaaccctgaagaagttccctctcgacactctgataccagacggaaaaagaatcatctgggacagcaggaagggttttattatctcaaatgccacatataaagagataggattactcacttgcgaggccactgtgaacggccatctgtacaaaacgaattatctcacccaccggcaaacaaacaccattatagatgtgcaaatcagtactcccaggcctgtgaagctgcttcggggtcatacacttgtcctcaactgcacggcaaccacacctttaaatacaagggtgcagatgacctggtcgtaccccgatgagaaaaacaaaagggcaagcgtgagaaggaggattgatcagtcaaatagtcacgcaaatattttttattcagtcctgaccatcgacaaaatgcagaacaaggataagggtctctacacttgtcgcgtacgcagcgggcctagctttaagtccgtgaatacatccgtccacatttacgataaggccttcatcactgtgaaacacagaaaacagcaggtgctggagacggtggcaggaaaaagatcctatcgattaagtatgaaggtgaaagccttccctagccccgaggtcgtctggctcaaagatgggctgcctgcgactgaaaagtccgcccgatatctgacaaggggttactccctgattattaaggatgtgaccgaagaagacgctggcaactatacaatcttactgagtataaagcagagtaatgttttcaagaacctgactgctactctcatcgtcaatgtgaagccgcaaatctatgagaaggctgtctccagttttcccgaccccgcactgtaccccctggggagcaggcaaattctgacctgtactgcctatggaatcccccagcccacaatcaagtggttctggcatccttgcaaccacaatcacagcgaagcccgttgcgatttttgtagcaataacgaagaaagttttatactggatgccgactctaacatgggtaaccggatagaaagtatcacgcagcgtatggctatcatagaaggtaagaataagatggcctcgacgttagtcgtggcagattccaggatcagtgggatctatatttgcattgcctccaataaggtcggcacagtgggaaggaatatttcattttacattacggacgtgccaaatggattccacgtgaatctggagaagatgccaactgagggtgaagatctcaaactgtcctgtaccgtgaacaagtttctttaccgcgacgtgacctggattctgctgcgcacagtgaataatcgtactatgcattatagcatctctaaacagaaaatggccatcaccaaggaacacagtataaccctgaacttgacgatcatgaatgtttccctacaagacagcggaacatacgcgtgcagagcgagaaacgtgtacaccggagaggaaattctccagaaaaaggaaatcacaatcagggaccaggaggctccttacttactaagaaatcttagcgaccatacagtggccatttcctcatccacaacactggattgccacgcaaacggagtgcctgaacctcagattacatggttcaagaacaatcacaagatccagcaggagcccgaactatatactagtacttcgccttctagcagcagctcttctccactttcctcctcgagctcatcctctagtagctcctccagttag

SEQ ID NO: 28719 - DNA, 1086 bp, Artificial Sequence
  Description of Artificial Sequence: Synthetic coding sequence
atgaattcagacctgctggtcgattccgacggcttctataaagagcccataactatggaggacctcatctcctactcctttcaagtggcacgaggcatggagtttttatctagtaggaagtgcatccatcgtgatctggctgccagaaacattttgttgtcagaaaataacgttgttaaaatttgcgacttcggactcgcaagagatatatacaagaaccccgactatgtgcgcaaaggcgacacacgactgcctctgaagtggatggccccagaatctatattcgataagatttattctacaaaaagcgatgtctggtcttacggtgtattgctgtgggagattttcagcctggggggatctccttacccaggcgtgcagatggacgaagacttctgtagcaggctgcgagaggggatgcgcatgagagctccagagtatagtacgcctgagatttatcagattatgctggactgttggcaccgagatccaaaggagagaccgagattcgcagagttggtcgaaaagctcggcgaccttctgcaagcgaacgtgcagcaagacggcaaagattatatacctattaacgcaatccttaccggaaacagcgggttcacctatagcacccccgctttcagtgaagatttctttaaggaatccatcagtgctcccaaattcaattcggggtcctctgatgatgtcagatacgtgaatgccttcaaatttatgtctcttgagaggatcaagacgttcgaagagttattacccaacgctactagcatgttcgacgactaccaaggagactcctccaccctgctggcctctcctatgctgaagcgattcacgtggacagactctaagccaaaggcgagtcttaagattgatctgcgcgtcacctcaaaatctaaagagagtggcctgagtgatgtgagccgcccttcattttgtcactcgagttgcgggcacgttagcgaaggtaaacggagatttacgtacgaccatgccgagctggagagaaagattgcctgctgcagccccccacccgattacaactctgtagtgctctattcaacccctccgatctag

SEQ ID NO: 28720 - DNA, 75 bp, Artificial Sequence
  Description of Artificial Sequence: Synthetic coding sequence
ctgcctcctgccaattctagtttcatgctacctcctaccagtttttccagcaattatttccacttcttaccttag

SEQ ID NO: 28721 - DNA, 1062 bp, Artificial Sequence
  Description of Artificial Sequence: Synthetic coding sequence
atggagttgaccgaactgctgttagtcgtgatgctgctgttgacagctcggctgacattgagctctccagcaccccctgcttgcgaccttcgcgtgctgtctaaactgctacgggatagtcatgttttgcactctcgcctgagccaatgtcctgaggtccatcccctgccaaccccagtcctgctccccgctgtcgatttttccctgggtgagtggaaaacccagatggaggagactaaggcgcaggatatcctcggtgccgtaacccttctacttgaaggggttatggccgcaaggggacagctcggcccaacttgtctgtcttctctgttaggacaattgagtggacaggtgagactgctactgggcgctctgcagtcattgcttgggacccagttgccgccacagggccgaaccaccgcccataaggaccctaacgccatttttctgtcttttcagcacctactcagaggcaaggtcaggtttttgatgctggtcgggggtagcaccctgtgcgtgcgcagagcacctccgactacagcggtgccctcccggacttccctggtgctcacactgaacgaactaccaaatagaacctcgggcctccttgaaacaaacttcacggccagcgcacgaaccactggctccggattattgaagtggcaacagggattcagagcaaaaatacctgggctgctgaaccagacgagtaggtccctggaccagatacctgggtatctgaaccgcatccacgagctattgaatggcacacggggtctctttcccggacctagccgcaggacgttgggagcccctgatatatcctctggcacatcagatacaggctccttgccacctaacctacagccgggttattccccgtcacccactcaccctcctaccggccagtacaccttgttccccttaccacccactctcccaacaccagtggtccaattacaccctctcctcccagacccatcagcccctacccccacaccgacttctcctctgctcaacacctcttacacccattctcaaaacctctctcaggagggctag

SEQ ID NO: 28722 - DNA, 537 bp, Artificial Sequence
  Description of Artificial Sequence: Synthetic coding sequence
atgaccgtgcttgctcccgcatggtctccaaccacttatctgctgctgcttctgcttctttcgagcggcctcagcggtacacaggattgctcttttcagcacagccctatatcaagcgacttcgcagtgaaaattcgggagttaagtgactaccttctgcaggactaccccgtcaccgttgcctcgaacctccaagatgaggaattgtgcggaggactctggcgtctggttctggcacagcgctggatggagaggctaaagaccgtcgccggttccaaaatgcaagggctgttagaaagggtgaacactgagatccacttcgtgactaagtgtgctttccaacccccaccttcttgtctcaggttcgtccaaacaaatatttcccgtctcctgcaggaaacctctgaacaattagtggcccttaaaccatggattactcgtcaaaacttctccagatgcctggagttgcaatgccaacctgttgaaacggtcttccatcgcgtaagccaggacgggctggatctgttgacttcctag

SEQ ID NO: 28723 - DNA, 708 bp, Artificial Sequence
  Description of Artificial Sequence: Synthetic coding sequence
atgactgtccttgcacccgcttggtcaccgaccacttatctgctgcttctgctactgctgtcctctgggttatctggcacacaggactgttcttttcagcactccccaatcagcagtgactttgcagtaaaaatccgggaactttctgattaccttctccaagactatcctgttacagtcgcgagcaatttacaggatgaagagctgtgcgggggtctgtggcggctcgttctggctcagaggtggatggagcggcttaaaacagtggctggcagcaagatgcagggcctcctggaacgggtgaacacagagatccattttgttaccaagtgtgcctttcagcctccccctagttgcctcaggttcgtgcaaactaacattagtcgcctgctgcaggagacgagtgaacagctcgtggctctgaaaccgtggatcaccagacagaatttcagccgctgcctcgagttacagtgccagcccgactctagtactctgcctccaccgtggtcacccaggcccctggaggcaacggcccctactgctcctcaaccacctctactgctgctactcctcctgcctgtcgggctgttgttactggccgctgcttggtgcttacattggcagaggacccgcagacgcacccctcgccctggggaacaggtgccgccagtccccagcccccaggacctgctgctggttgagcattag

SEQ ID NO: 28724 - DNA, 4092 bp, Artificial Sequence
  Description of Artificial Sequence: Synthetic coding sequence
atgcagcgcggagccgctctctgcctccgcctctggttgtgcttggggctgctggatgggctggtttctggatactccatgacccctcccactctgaatatcaccgaggaaagtcacgtaatcgatactggtgactccttgtccattagctgcagaggccagcatccgcttgagtgggcatggccgggagcacaggaagccccagccacaggagacaaagacagcgaggacacgggggtcgtgagagattgcgagggtaccgacgctagaccctactgcaaggtcttgctcctgcacgaggtgcacgctaacgatacaggttcttatgtgtgctactataaatatatcaaggcgaggattgagggaactaccgccgcttccagttatgtgttcgtgcgggacttcgaacagccctttataaataagccagacactctcctggttaaccgtaaagacgccatgtgggtcccctgcctcgtttccataccagggctgaacgtgaccttacggtcccagtcttcagtcctgtggcccgacggccaggaggttgtgtgggatgatcggaggggtatgctggtatcaacgccattactacacgatgcactgtacctccagtgcgaaacgacttggggagaccaagatttcctgagtaacccattcctcgtgcacattacgggcaacgaactctacgacatccaactgcttccccgtaaatccctggagcttctggtaggagagaaactcgttctcaactgtacagtgtgggctgagtttaactccggggtcactttcgactgggattatccaggtaaacaggcagagcgaggcaaatgggtccctgaacggaggagccagcagacccatactgagctcagcagcattctcacaatccacaacgtctcacaacacgacttggggagctatgtttgcaaggccaataatggtattcagcggttcagggaatccactgaggttatcgtccatgagaatccatttattagcgtggaatggttgaagggccctatactagaggccacagccggtgacgagttagtgaagctaccagtcaagctcgcggcttacccacctcctgaatttcagtggtacaaggatggtaaggccctgtcgggtaggcactccccccatgctcttgtcctcaaggaggtgaccgaggcatcaaccggaacttatactctggcgctgtggaatagtgcagccggactccgacggaacatttcgctggagctcgtggtcaatgtgccccctcaaatccatgagaaggaggctagtagcccaagcatatacagcaggcacagcaggcaagctctcacctgtaccgcttacggcgtgcctctgccgctgtcaatacagtggcattggaggccttggacaccgtgcaaaatgttcgcccagcgaagcctgagaagacgccagcagcaggatctgatgcctcagtgcagagactggcgagcggtgactacacaggacgccgtgaacccaatcgagagtctggacacttggactgagttcgtggagggtaagaataagaccgtttctaagctggtaatccagaatgctaacgtctccgccatgtataagtgcgtggtttccaacaaggttggtcaggacgaaaggctgatctacttttatgttacgaccattccagacggctttactatcgagtctaaaccctctgaagaattgttggaagggcaaccggtgctgctctcttgccaggccgactcatacaagtacgaacacttacgttggtaccgcctaaacctcagcactctacacgatgcccacggcaatccacttttgctggactgtaagaatgttcatctgtttgcgacacctcttgcggcttccctggaagaagtggccccaggcgcaagacatgccaccttatctctttctatcccccgagtcgctccagagcatgagggccactacgtttgtgaagtccaagatcgcagaagtcacgataagcattgccacaaaaaatatctgagcgtgcaggctctggaagcccctaggctcacacagaatctgacagatctactcgtgaatgtgagtgacagcctggagatgcagtgcttggtggccggagcacacgccccatcaatcgtgtggtacaaggacgaacgccttctggaggagaaatcaggtgtggaccttgccgattccaaccaaaagttatccattcagcgcgtgagagaggaagacgccggtagatacctttgctctgtatgcaacgccaaggggtgcgtcaactcctccgcgtcggttgccgtggagggctcagaggacaaagggtccatggagatcgtgatattagtcgggacaggggtgattgctgtttttttttgggtcctgcttctattaatcttttgcaatatgcgacggcctgcccacgccgatattaagacgggctacctgagtatcatcatggatccaggggaagttccgttagaggagcagtgtgaatacttaagttacgatgcctctcagtgggaattcccacgggagaggctccatctcggtagagtgcttggatatggcgctttcggaaaggtcgtggaggcaagcgcctttggaatacataagggcagctcttgcgatacagtggccgtgaaaatgttgaaggagggggctaccgcaagtgagcatcgggctctgatgtcggagctgaagatcttgattcacattggtaaccatctgaacgtggtcaacctgctgggggcatgcaccaagccacagggtccgttgatggtcattgtggaattttgtaaatacggcaatctgagtaattttctcagggcgaaacgagacgccttcagcccatgtgcagaaaaatcccctgaacagcgaggcagatttcgcgctatggtagagctggcgaggctggacagacgcagaccagggtcttccgatcgcgtgctttttgcgagattcagcaagactgagggtggtgccaggcgggcatccccggaccaggaagcagaagatttgtggctgagccctttaactatggaagatctggtctgttacagttttcaggtagcgcgtggcatggagttcttagcttctcggaagtgcatccatagggaccttgcggcacggaatattctgctgtctgaatccgatgtcgtaaaaatctgtgactttggccttgccagggacatatacaaagatccagattacgttcgcaaaggatccgcacggctgccgctcaagtggatggcacctgagtctattttcgataaagtgtacactacccagagcgacgtttggagcttcggcgtcttgctgtgggagatctttagtctcggagcttccccttacccgggagtccagataaacgaggagttttgccagaggctgagagatgggacccgcatgagggccccagagctggcaactccggcaatcaggcgcattatgcttaattgttggtctggggaccccaaggcaaggcccgctttctccgagttagtcgagatcctgggggacctcctgcaggggaggggactccaggaggaggaggaggtgtgtatggcccctaggtccagccagtcttctgaggaaggctctttcagtcaggtgtccaccatggcccttcacattgcccaggctgacgcagaggattcacctccctccctgcagaggcatagcttagcagcacggtattacaactgggtcagctttccagggtgtctggccagaggagctgagaccagaggttcatcgaggatgaagactttcgaagaatttcctatgactcccactacatacaaaggctccgtggataatcagactgactcgggcatggtgctggcatctgaggagtttgagcagattgagagccgtcaccgacaagaatcgggcttctcctgtaagggtccgggtcaaaatgtggctgtgacgcgtgcccaccctgattcacagggtaggcggcgaaggccagagaggggagcacggggtggccaggtcttctacaactccgaatacggggaactgtcagaaccctcagaagaggatcactgctcgcccagtgctagagtgactttcttcacagacaattcgtattag

SEQ ID NO: 28725 - DNA, 2283 bp, Artificial Sequence
  Description of Artificial Sequence: Synthetic coding sequence
atgttagtatcgactcccctgcttcatgatgccctgtatctgcagtgtgagaccacttggggagatcaggattttctgtccaatccattcctagtgcacattacgggaaacgagctttatgatatccagcttctcccaaggaagtccttggaactcttagtaggagagaagctggtactgaactgcacggtctgggccgagttcaatagcggtgtgacgttcgactgggactacccaggcaaacaggcagaacggggtaagtgggtacctgaacgcaggagccaacaaacccacaccgaactatcatctattctcaccatccataatgtatcccagcacgatcttggatcatacgtttgcaaggctaacaatggcatccagagattcagggaatccacagaggtcatcgtgcatgaaaatccctttatttctgtggaatggctcaaggggccaattttggaggcaacagcgggagatgaactggttaaactgcctgtgaagctggctgcctatccccctccagagttccagtggtacaaggacggcaaggctctcagcggcagacactctcctcacgctctggtattaaaggaagtgactgaagcgtccacaggcacatacacactagctttgtggaactctgcggcaggactacgacggaatatatcattggagctcgtggtgaacgttccaccgcagatacatgaaaaggaagcttcttctccatctatctactcacggcactccaggcaggcccttacttgcactgcatatggagtgcccttgcctctgtccattcagtggcactggcggccatggacgccctgcaaaatgttcgcacagagatctctgagacggaggcaacagcaggatctgatgcctcagtgtcgcgactggcgcgctgtgactacccaggatgccgtaaatccaatcgagagcttggacacctggacagagttcgtagagggcaagaataagactgtttctaaactggttatccagaacgcaaatgtgagcgccatgtataagtgtgtggtgtctaacaaggtcggccaggacgagagactcatttacttttatgtcactaccatccccgacggttttacaatcgagagcaagccgagtgaggagctccttgaaggacagccagtgctcctgtcttgccaagcagactcatacaaatacgagcacctgcgatggtacaggctgaatttgtccaccctgcacgatgcacacgggaatcccttactgctggactgcaagaatgtccatcttttcgcgacaccactggctgcgtcactggaggaggtagcaccaggcgcaagacacgccaccctctctctgtccatcccacgagtggcccctgaacatgaaggccattatgtctgtgaggtgcaggatcggcgttctcatgacaagcattgtcataagaagtatctgagcgttcaagctctcgaagccccacggctaactcagaatcttacagacttactggtgaacgtgtccgattctcttgaaatgcagtgtctggtcgcaggagcccacgcaccaagcatcgtgtggtacaaggatgagagattgctggaggagaagtctggggtagatctggcagactctaatcagaagctttctatacagagagtgcgtgaagaggacgcagggagatatctatgcagtgtttgcaacgccaaaggatgcgtgaattcatcggcctcagtcgctgtggaaggcagcgaggacaaagggtcaatggaaattgtgattctggtgggcaccggcgtgattgccgtcttcttttgggtgctgctcctgttaattttttgtaacatgcgacgacctgcgcatgctgacatcaagaccggctacctgtctattatcatggatcccggagaggttccccttgaagagcagtgtgagtacctttcgtacgacgccagccagtgggagttccccagagaaaggctgcatctgggaagggtcctgggctatggagcctttggtaaggtcgtcgaagctagtgccttcggtattcacaaaggaagctcttgcgacaccgtcgccgtaaagatgctcaagggtgtaggaagcgctggcggacgcggttccctagctggtgaagaacagcagctgggggtgggtcggtgggatggcaattccggaagggagacagaggctggtagccagtcacacccaaggttttacagggaagccgcaggttttagagctgaagggcctccagagcccccatcagtggggcctgccggatgtcctggcggaccatag

SEQ ID NO: 28726 - DNA, 3897 bp, Artificial Sequence
  Description of Artificial Sequence: Synthetic coding sequence
atgcagcggggagcagctttgtgccttcgactctggttgtgtctgggcctcttggacggcttagtctcaggatacagcatgaccccccctacattaaacattacagaggaatcacatgtgatagataccggggactctctcagcataagctgtaggggccagcatcccctggagtgggcatggcccggagctcaggaggccccagcaacaggagataaagacagtgaagatacaggggtcgtaagggactgtgaaggaactgatgcgagaccttattgcaaagtgctcctgctgcatgaggtgcacgccaatgacaccggaagctatgtttgttattataaatatatcaaagccaggatcgagggcactacagccgcatcatcatacgtgtttgtgcgcgatttcgaacagccatttattaacaaacctgacacattgctggtgaatagaaaggacgcaatgtgggtgccatgtttggtttcgatccccggactgaatgtcacactacgcagccagtcttcagtcttgtggccagacgggcaggaagtggtgtgggatgatcgtagggggatgctcgtctccacccctctcctgcacgacgctctgtacctgcagtgcgagaccacatggggggaccaggatttcttgtcaaatccatttttggtacatatcaccggcaatgaactgtacgatatccaattactgccacgcaagagcttggagcttctggttggcgaaaagctcgtgttgaattgcacagtctgggcggaatttaactctggcgtgacctttgactgggactaccccggtaagcaggccgagcggggaaagtgggtcccagagagacggagccagcagactcacaccgaactgagttcaatcctgacaatacacaacgtgtcacagcatgatcttggaagttacgtttgcaaggctaataacggcatacagagattccgggaaagcacagaggtgatcgtgcacgagaatccctttatttctgtggagtggttaaaagggcctatcctggaggctactgcgggagacgagctagtgaagctaccggtgaaactggctgcctacccgccacccgaattccagtggtataaagacggcaaggccctgagcggtcgccactctcctcatgctctggtcctgaaggaagtaacagaggctagcacagggacctacacccttgcactctggaattccgcagccggactgcgacggaacatcagcctcgaactggtggtgaacgtccctccccagatccacgagaaggaagcttcctcccccagcatttatagtcgccacagtagacaagcacttacttgcaccgcctacggcgtaccactgccgctgtcgatccagtggcactggcgtccttggacaccgtgtaagatgttcgcgcagaggagcctgcggcgtcggcagcaacaggatcttatgccacaatgcagggactggcgagccgtgacaactcaggatgccgtgaaccctattgagagcctggatacttggaccgaattcgtcgaggggaaaaataagaccgtgtctaagcttgttattcaaaacgctaatgtctctgccatgtataagtgcgtagtctcgaacaaggtgggccaggacgaacgcctgatttatttttacgttaccaccattccagacggatttaccatcgagagtaaaccttctgaagaactgctcgaaggtcagcctgttttgctctcatgccaggccgatagttacaaatacgaacaccttcgatggtaccggttaaatttgtcaactctccatgatgcacacgggaatccactcctccttgactgcaaaaatgttcatctgttcgcgacacctttggcagcaagtttagaggaggtcgcccctggtgcccgtcacgcaactctttccttgtccatccctcgggtcgcgcctgagcacgagggccattacgtatgcgaggtccaggatcgaaggtcccacgataagcattgccacaaaaaatatctgtcagtgcaggccctggaagcacccaggctcacacagaacctcaccgacctcctcgtgaacgtttctgattctctggaaatgcagtgcctcgtggccggagcacacgccccaagtatcgtctggtacaaggatgagagattgcttgaagagaagtccggtgtcgacttggctgactccaatcaaaagctttccatccaaagggtccgcgaagaagatgccggaagatacctctgtagcgtatgcaacgcgaagggctgcgtcaactcctcagcaagcgtggctgtggagggttcagaggataaggggagcatggaaatcgtgatcttagtcggtacaggcgtgatcgccgtctttttttgggtgctcctgctgcttatcttttgcaacatgcgcagaccagcacatgcggatattaaaacgggctacctgtcgatcattatggaccctggagaagtgcccctggaagaacaatgtgaatacttgtcgtatgacgcctcccaatgggagtttccaagggagagactgcacctgggcagggtgttaggctacggggctttcgggaaggtggttgaagctagtgcctttggcatccataaaggaagctcctgtgatactgtggcagtgaagatgctgaaagagggagccacagcctcagagcaccgggctctgatgtcagagttaaaaatacttattcacatcggcaatcatctgaacgtcgtgaatctgctcggggcttgcaccaagccgcagggccctctcatggtgatcgtcgagttctgtaagtacgggaacctgtcaaacttcctccgcgcaaagcgggacgctttcagcccgtgcgcggagaagagccccgagcagcggggtcgcttccgggctatggtcgaactggctcgccttgatcgccgaagacctggatcgagtgaccgggttctttttgctagattctccaagactgagggtggggcacgcagagctagtccggaccaggaggcggaggacctttggttaagccctcttacaatggaagatctagtgtgctacagctttcaggttgctagaggtatggagtttctcgcgagcagaaagtgcatccaccgcgacctggccgcacggaacatcctcctgagtgaatcagatgttgtgaaaatttgcgatttcggcctggctagagacatctacaaggaccctgattatgtgcggaaaggaagtgctaggctcccactaaagtggatggcccctgagtccattttcgacaaggtttacacaactcaatctgatgtgtggtcattcggggtgctgctgtgggaaatcttctccctgggggcatcgccataccccggagttcagataaacgaggagttctgccagcggctgcgcgatgggacacgtatgcgtgccccagagctggctacgcccgctatccggagaataatgttgaattgctggagcggggaccccaaggcacgtccagccttcagcgaactcgtggaaatcctgggcgacctgctgcaaggtcggggtctgcaggaagaggaagaagtgtgtatggcgcctcgctcaagccagagtagcgaggagggatctttctcgcaggtcagcacgatggccctccatatagcacaggcagatgccgaagattcgcccccaagcctgcagcgtcactcattagcagccaggtactacaattgggtgtctttccccggatgtcttgcgaggggcgcagaaacccgagggtccagtcggatgaaaacctttgaagagtttcccatgacaccaacgacatacaagggttccgtcgacaatcagacagatagcggtatggtgctcgcctccgaggagtttgaacagatcgaatcaagacaccggcaagaatccggatttcgttag

SEQ ID NO: 28727 - DNA, 3921 bp, Artificial Sequence
  Description of Artificial Sequence: Synthetic coding sequence
atgcaaagaggggcagccctctgtctgcgactttggctgtgcttaggccttttggatggcctcgtgtcaggatatagcatgacccctcccactctcaatattacagaggaaagtcatgtcatcgataccggagattccttgtcgatttcttgtcgaggccagcatcctcttgaatgggcatggccaggcgctcaggaagcgcctgctacaggcgataaggacagtgaagatacaggagtcgttcgggattgtgaaggaaccgatgctaggccttactgcaaagtactccttctgcatgaggtccacgccaatgatactgggagctatgtgtgctactacaagtatatcaaagccagaattgaaggcacgacggctgctagcagctacgtgtttgtaagggatttcgagcagccatttattaacaaacctgacaccctgcttgtgaaccggaaggatgcaatgtgggtcccttgtttggtgagtatcccaggactcaacgtgaccctacggtcccagtcctctgtgctgtggccggatggccaggaggtggtctgggacgatcggaggggcatgttagtaagcactccccttcttcacgatgccctctaccttcagtgtgaaaccacctggggcgatcaggacttccttagtaacccatttttggtacatataaccggcaatgagctctacgatatccagctgttgccgagaaaatctctggagctcttagttggggaaaagctcgtgctgaactgtacagtctgggcggagtttaacagtggggttacgtttgattgggattacccagggaagcaggccgagcgaggcaagtgggtccctgaaagaagatcacagcaaacacacaccgagttgagcagcatcctcaccatccacaatgtcagccaacatgacttaggaagttacgtctgtaaggccaataatgggattcagaggtttagagaatccacagaggtgattgtgcacgagaatccttttatcagtgtagagtggctgaagggcccaatattagaggcgacagctggcgacgagttggtgaaactcccagttaagctggcagcctacccaccccctgagttccaatggtacaaagacggtaaggccttatccggaaggcactctccccacgcgctcgtgctaaaggaagtgactgaagcgtccacaggcacatatacactggccctgtggaactcggccgctggcctaaggcgcaatattagtctggaactcgtggttaatgtgccgcctcaaatccatgagaaagaagcgagctcaccgagcatctactctcggcacagccgtcaggcgctcacatgtactgcctacggcgtgcctcttcccctgtcaatccaatggcattggcggccatggactccttgtaaaatgttcgcacaaaggtcgctgagacgcagacagcaacaagatctaatgccccagtgcagagattggcgggctgtgacaacccaggacgctgtcaacccaatcgaatccttagacacttggacagagtttgtggaaggaaaaaacaaaaccgtttcgaagctggtgatccagaacgcaaatgtgtccgccatgtataagtgcgtggtgtctaacaaggtgggtcaggatgagaggctcatttacttctacgtgaccacgattccagatggattcactatcgagtcaaaaccctctgaggaactcctggaaggacagcctgtgcttctgtcctgccaagccgacagttacaagtacgagcaccttaggtggtacaggctgaatctgagtaccctccacgacgcgcacggcaacccactcctgctagattgcaaaaacgtccatctgtttgctacaccccttgcggctagcctcgaagaagtggccccaggagccaggcacgctacactttccctgtctatcccgagagttgcccctgaacatgaaggacattatgtgtgtgaggtgcaggatcggaggtcgcatgataagcactgccacaaaaagtacctgtcggtgcaggccctggaggccccaagactcacccagaatctgaccgatctcttagtgaatgtgtccgactctctggagatgcagtgccttgtggctggagcgcacgctcctagcattgtgtggtacaaagacgaaaggctgctggaggaaaagtccggagttgatctggccgattcgaatcagaagttgtccatccagagggtacgggaagaagatgccggacggtacctgtgcagtgtatgcaatgctaaaggttgcgtgaactcctcggcatctgttgcagttgagggttcggaagataaaggaagtatggagatcgtcattctggttggaacaggcgtaatagctgtgtttttttgggtcctgctcctgctgatattctgtaacatgcgcaggccggcacatgcagatattaaaacaggataccttagtatcattatggaccccggagaggttcccctggaggaacagtgtgagtacctcagttacgacgcttcacaatgggaatttcccagagaacggttgcatctgggccgagttcttggatatggtgccttcggcaaagtggttgaggccagtgcctttggcattcataaagggagctcctgtgataccgtggctgtgaagatgctgaaggagggcgctacagcctcggagcaccgagccttgatgtccgaattgaaaattctcatacacataggcaaccatttgaatgtggtaaatctgctgggggcatgcaccaaaccccagggccctctgatggtgatcgtggagttttgcaagtatggcaacttatcaaacttcctaagagccaagcgggacgctttctcaccttgcgctgagaagtcgcccgagcagaggggtcgattcagggctatggtagagcttgcccgtctagatagaagaaggcctgggtctagcgatcgggttcttttcgcacgcttttctaagacagaggggggagctaggcgtgcctcccccgaccaggaagcagaggacctgtggctgtcgccactcactatggaagatctggtttgttattcattccaggtcgcaagaggtatggagttccttgcgagccgaaaatgcatccatcgggacctagccgctcggaacatcctgctaagcgaatctgatgtagtgaagatctgcgactttgggctggccagggacatttataaagacccagactatgtgcgcaagggtagcgcccgattacccttaaaatggatggcccctgagtccattttcgataaggtgtataccacccaaagtgatgtgtggtcattcggcgtccttttgtgggagattttctccttgggagcgtcaccttatccaggagtacagatcaatgaagagttttgtcagagattaagagacggtaccaggatgagagcccctgaactggccaccccggcaatccggaggatcatgcttaattgctggtcaggggacccaaaggcccgacccgcattcagcgaactcgtagagatattaggcgacttgcttcagggccgtgggctgcaagaggaggaagaggtctgcatggcacctcgcagcagccaaagcagcgaggagggcagtttcagtcaggtgagcacaatggcgctgcacatcgcccaagccgatgctgaggacagtcccccttctttgcaacggcactccctcgcagccagatattacaattgggtatcgttcccgggatgcctcgccagaggagccgagacaaggggtagttctcgtatgaaaaccttcgaagaatttcctatgactcctacaacatataaaggctctgtcgacaatcagacggactccggcatggtgctggctagcgaggaattcgaacaaatcgagtcaagacaccgccaggaatccggctttagaggcacacgcagaaccagaggcgcttag

SEQ ID NO: 28728 - DNA, 1740 bp, Artificial Sequence
  Description of Artificial Sequence: Synthetic coding sequence
atgaacgccattgttgctctttgtcatttttgcgagttgcacggacccaggaccctgttctgtacggaggtacttcacgcgccattaccacagggagatgggaatgaagactctccaggccagggcgagcaagccgaggaggaagagggaggcatacagatgaacagccggatgcgcgcacatagtcccgcagagggggcttcagtggagagctcttctcctggcccaaaaaaatcagatatgtgcgaaggctgcaggtcgctggcggctggtcatcctggctacatttcccatgataaggaaacctcaattaagtacgtgtctcaccagcacccctctcatcctcagttattcagcatcgtcagacaagcgtgtgttcggagtttatcttgtgaagtgtgccccggtcgagagggccctatttttttcggcgacgagcaacacggattcgtgtttagtcatacgttctttatcaaagattcacttgctcgtggttttcagcggtggtatagcatcatcactatcatgatggacaggatctacttaattaacagctggcctttcctactcgggaaagtccgtggcatcatagatgagcttcagggcaaagctctgaaagttttcgaggcagaacaatttggctgccctcagagggctcagcggatgaatacggccttcacgcccttcttacaccagcgcaacgggaacgctgcccgatccttgacttctcttaccagcgatgacaacctctgggcctgtttgcatacatctttcgcctggttgctgaaggcctgcggttcccgactgacggaaaaattacttgagggagctcccacagaggataccctggtgcagatggagaagctggctgaccttgaggaggaaagtgaatcttgggacaactctgaggctgaggaggaggagaaggcgcctgtgcttcctgaatcaaccgagggaagagagctcactcaggggcctgcggaatccagtagtctgtctggctgtggctcatggcagccaagaaagctgccggtctttaaaagcctgaggcacatgagacaggtccttggcgcaccatctttccgcatgctggcctggcacgtactaatggggaatcaggttatttggaaatccagggatgtcgatctggtccagtcagcttttgaagtactgcgcactatgttgcctgtcggctgcgtccgaatcataccctactccagccagtacgaggaagcgtatcgttgcaatttcctcggtctatctccacatgtacagatccctcctcatgtgctctccagcgaattcgccgtgatagttgaagtacacgccgctgcaaggagcacactgcatcccgtcggatgtgaagacgatcagagtttaagtaagtatgaattcgtcgtgacatcagggagccctgtggctgccgatcgcgttggcccaaccatcttgaacaagatcgaggctgccctcacgaatcagaacttatctgtggatgtcgtggaccagtgcctcgtgtgtctcaaagaggaatggatgaataaggtgaaagttctgtttaagtttaccaaggtcgactcccgaccgaaagaagatacacagaaactgttgtctattttgggagctagcgaggaggataacgtgaaattgctgaagttttggatgaccggactgagtaaaacctacaaaagtcacctgatgtctaccgttcgctccccgaccgcctcagaatctaggaattag

SEQ ID NO: 28729 - DNA, 594 bp, Artificial Sequence
  Description of Artificial Sequence: Synthetic coding sequence
atgaatgccatagtcgccctctgccatttctgcgagctacatgggccaagaactctgttttgtactgaggtgctccacgctcccctccctcagggtgacggcaacgaagattctcctgggcaaggggagcaagccgaagaggaagagggcggtattcagatgaacagtcgaatgcgggcacactcacccgctgaaggggcttctgtcgagagttcctcacctggcccaaaaaagtccgatatgtgtgaaggctgccggtcactcgctgcaggtcacccaggatatataagccatgataaggaaacctccattaaatatgtgtcccaccagcatccctcccacccgcaactgttctcaatcgtgaggcaggcctgcgtgaggtcactgtcttgcgaggtctccctggtcgcaaccgaaccagtgtcagtcggcgctcacatgctgcccggagcattggggggtctcggagcgtccattgcacagggcggtcgccactggtcttcgttgcgtgcagacccacagatatctacggctcaaggaaccggcaggctgccctgcccggagctaagggaggagagctgttggacctgctag

SEQ ID NO: 28730 - DNA, 1029 bp, Artificial Sequence
  Description of Artificial Sequence: Synthetic coding sequence
atgaacgctattgtggccctatgccatttctgtgagctgcatggtccacgaaccctgttttgtacagaggttctgcatgccccactgccccagggagacggtaacgaggatagtccaggacagggtgaacaggcagaggaagaagaagggggtattcagatgaacagtcggatgcgcgctcacagccctgctgagggcgcatccgtagagtcctcgtctcccggtccaaaaaagtcagacatgtgcgaggggtgtaggtctctcgcagctgggcaccctggctatatttcccacgataaagaaacctccatcaagtacgtttcccatcagcacccatcccacccccagctattcagtatcgttcggcaagcgtgcgtgcgcagcttgtcttgtgaggtgtgtccgggaagagaggggcctatcttctttggcgacgaacagcatgggtttgtgttctctcataccttctttattaaggactctctggcacgcggatttcagcgttggtattcaataatcaccataatgatggatcgcatctacctaatcaactcttggcctttcctgcttggaaaggttagaggtatcattgatgagctccaaggaaaggccctcaaagtgtttgaggccgaacagttcggatgcccgcagcgagcccagcggatgaatacagcgtttacgccctttttacaccaaaggaacgggaacgctgcaaggtctcttacctccctgacatctgatgacaacttgtgggcatgtttgcataccagctttgcctggctgctcaaagcctgtggcagccggctaaccgaaaagctgctggagggagcgcctacagaggacaccttggttcagatggagaaactggccggagaggctggtgtgttacttcctggtccatggcctggctggccttgggggggtactagctgcctgctatcatggcaggagtccttgagagaaggaaatgctgcactcaatcagcccagaactagcctacgggaagcccatccacctatatctgtctag

SEQ ID NO: 28731 - DNA, 594 bp, Artificial Sequence
  Description of Artificial Sequence: Synthetic coding sequence
atgaatgcaattgtggccctgtgtcacttttgcgagttacatgggcctagaaccctgttttgcaccgaggtgctgcacgccccactgcctcagggtgatgggaatgaagatagtccagggcagggcgaacaggccgaagaagaggagggaggcattcagatgaatagcaggatgcgcgctcactctcctgccgagggcgcttcagtagagtctagctctcctggtccgaagaaatctgacatgtgtgagggatgccggagcctggccgcaggacatccaggctatatttctcatgacaaagaaacatccatcaagtatgtgagccaccaacaccctagtcatccccagctgtttagcattgtacggcaggcatgcgtgaggagcctgagttgcgaggtgtccttagtcgcaactgaaccagtgtcagttggagcacatatgttaccaggcgcacttgggggtcttggagcaagtatcgctcagggaggtcggcactggtcctcattgcgcgctgatcctcagatcagtaccgcccaggggacgggccgtctcccatgcccagagcttcgtgaagagtcctgttggacctgctag

SEQ ID NO: 28732 - DNA, 462 bp, Artificial Sequence
  Description of Artificial Sequence: Synthetic coding sequence
atgaattcgcggatgagagcccactcaccggcagaaggcgctagtgtcgagtcctcttcgccgggacccaagaaatctgacatgtgcgaaggctgccgctcactggctgctggccacccagggtacatatcccacgacaaggaaactagtatcaaatacgtgtcccaccaacaccctagccatccccaactgttttcaatagttagacaggcctgtgttagatctttgtcatgtgaagtctgtcctggacgtgaaggacccatatttttcggagatgaacaacacggcttcgtcttctcacacacctttttcatcaaagattcattagccagagggttccagaggtggtacagcattatcaccataatgatggacaggatctacctgattaattcctggccgtttctcctcggaaaggtgcggggaatcatcgacgagctgcagggaaaggcactgaagtag

SEQ ID NO: 28733 - DNA, 1419 bp, Artificial Sequence
  Description of Artificial Sequence: Synthetic coding sequence
atgctgggtacagtgaaaatggagggtcacgagacctcggactggaactcctattatgcagatactcaagaagcctattcgagcgtgcctgttagtaatatgaattcaggcctggggagcatgaattctatgaacacatatatgacaatgaacaccatgactactagtggcaacatgacgccagccagtttcaatatgtcatacgctaatccaggactgggagccggtctcagccccggtgccgtggctggtatgccaggaggaagcgctggagcaatgaattcgatgacagcggctggagtcacagctatgggtaccgctctctccccctctggaatgggcgctatgggcgctcaacaagcagccagtatgaacggacttgggccatacgctgccgctatgaatccgtgtatgtctccaatggcctacgcaccctcaaacttgggccgttcccgggctggcggtggcggagacgccaaaacattcaagagatcctatcctcatgcaaagcccccatattcatacattagcctgatcacaatggccattcaacaggcgccttctaagatgctcactttgtcagagatctaccagtggattatggatctttttccttactaccggcagaatcagcagcgatggcagaatagcatcaggcactcgctttcctttaatgactgtttcgttaaggtcgccaggagccccgataaacctggaaaagggagctactggacgttacatccagattctgggaatatgtttgaaaacggttgttatctgcggagacagaaaaggtttaagtgcgagaagcagccaggtgccggtggaggaggcggttctggttccgggggaagcggggctaagggcggtccagagtctcgcaaggacccttcaggggcaagcaacccatcggccgacagcccacttcatcgaggagtccacgggaaaacaggacagctggaaggtgcgcctgcccctggccctgccgcaagcccccagaccctggatcactccggtgcaacagccaccgggggagccagtgagctgaagacgcctgcaagctcaaccgcccctcccattagctctgggccaggggctctcgctagcgtcccagcaagccacccggcacacgggctcgcccctcatgagtctcagctccatctgaagggcgacccacattactcctttaaccaccctttttcaattaacaacttaatgagctcctcagagcagcagcataaactggatttcaaagcctacgaacaggccctccagtacagcccatacgggtccaccttgcccgctagtttgcccctgggatccgcctccgtcacgacccgctccccaatcgaacccagtgccctggagcccgcatattaccagggcgtttattcacggccagtactcaacacatcctag

SEQ ID NO: 28734 - DNA, 1320 bp, Artificial Sequence
  Description of Artificial Sequence: Synthetic coding sequence
atgaatagcggtctggggtcaatgaacagcatgaatacatacatgaccatgaacacaatgactacatccggaaatatgacgccagccagtttcaatatgtcatatgcaaatcccggactgggagctggtctttcacctggagccgtggctggtatgcctggcggaagcgccggagcgatgaactcgatgaccgctgccggtgtgactgccatgggtactgcactcagtccgagtggaatgggggcaatgggcgctcaacaggctgccagcatgaatggactaggaccctatgccgctgccatgaatccatgcatgtcacccatggcatatgcgccttctaatctcggccgtagcagagccggaggaggtggcgacgccaagacatttaaacgtagctatccacatgcgaagcccccttattcatacatttctctgatcactatggctatacagcaggccccttccaaaatgcttacactgtccgaaatttaccagtggataatggatctctttccttattaccgccagaatcagcagcggtggcaaaacagtataagacattcccttagtttcaacgattgcttcgtcaaagttgccagatcacccgataagccagggaaaggctcttattggaccttacaccccgacagcggaaatatgtttgaaaacggatgttatctccgtaggcagaaacgcttcaagtgtgaaaaacagcccggagcagggggtggcggaggcagcgggagcggcggatccggcgctaagggaggaccagagtcccgcaaggatccttctggcgcatcgaacccaagcgccgacagccccctgcatcgcggagtgcacggaaaaacaggtcagctcgagggtgcacctgctccaggcccagccgcaagtccgcagacactggatcattcaggtgcgaccgcgacaggtggtgcaagcgagctcaagacaccagcctcatctacagctcctcccatctcctctgggcctggtgctcttgcgagcgtgcccgcatctcaccccgctcacggcctggccccacacgaatctcaattacacctcaaaggagatccccattactcatttaaccatccgtttagcattaacaatcttatgtcttcttctgaacagcaacataagcttgacttcaaagcgtacgagcaggccctgcagtacagcccctatgggagcacccttcctgctagcctgcctctgggttcggcaagtgttacaacacgaagtcctatagagcccagcgccctagagccagcatactaccaaggcgtctattcacggcctgtgctgaacactagttag

SEQ ID NO: 28735 - DNA, 1506 bp, Artificial Sequence
  Description of Artificial Sequence: Synthetic coding sequence
atgcaggctcgatattccgtcagcgatccgaatgctcttggcgtcgtgccctatttaagtgagcaaaattattacagagccgctgggtcctatggaggtatggcttcccccatgggcgtctacagtggacatcctgaacagtattccgctggcatgggacgtagctatgccccatatcatcaccatcagcctgctgctccgaaggatctcgtgaaacctccttacagttacattgccctgataaccatggctatccagaacgctcccgagaagaaaatcacccttaacggtatttatcagtttatcatggacaggtttccattctatagagagaacaaacaaggctggcagaattccatccgccataacctttcccttaacgaatgcttcgtgaaagtaccccgagatgacaagaaacccggtaaaggaagttattggaccctggatcccgacagctacaacatgttcgagaacggctccttcctccgtagacggcgaaggtttaagaagaaagacgtgtcaaaggaaaaggaagaaagagcccacctcaaagaaccacccccagccgcaagcaaaggcgctcccgcaacgcctcaccttgctgatgctcccaaggaggcggaaaaaaaggtcgtgataaaaagcgaggctgcgagccccgcactgccagtgattaccaaggtcgagactctgtctcccgagtccgcccttcagggttctcccaggagcgccgcaagcacccctgcagggagccccgatggcagcctgcccgaacaccatgcggcagcccctaacggccttcccggtttttccgttgaaaatatcatgaccttgcgcacttctcccccagggggtgagctcagtcccggtgccggtcgcgctggcttagtagtaccccctctggctctaccatacgccgctgcacctccggctgcgtacggacagccttgtgcacaagggcttgaggcaggtgctgccggtggctatcagtgttcaatgagagccatgagcctgtacaccggcgcagagaggcctgctcacatgtgtgtaccacctgcactggacgaagctctgtctgaccaccccagtggccctacctctccactcagcgcactgaacttggccgcaggccaagagggggctttggccgctaccggtcatcaccatcagcaccacggtcatcaccacccgcaggcgcctcccccacctcccgcaccacagcctcagccgacaccacagcccggtgccgcagctgcccaggcagccagttggtacctcaatcatagtggcgacctgaatcacttaccaggccacactttcgcagcacagcagcaaacattcccaaatgtcagagaaatgttcaactcccacaggttaggcattgagaacagcaccctgggagaatcccaggtctcgggaaacgcctcttgccaattgccttatagatctacaccacccctctatagacatgcagctccctactcgtatgactgcaccaagtactag

SEQ ID NO: 28736 - DNA, 1968 bp, Artificial Sequence
  Description of Artificial Sequence: Synthetic coding sequence
atggcggaggcacctcaagtagtagagattgaccccgactttgagccgctgccacgccctcgatcatgcacgtggcccttaccacgtccagagttcagccaaagcaatagcgcaacaagctctcccgctccctcaggtagtgctgccgctaatcccgatgccgcagccggtttgccttcggcctcagctgcagcagtgagcgccgactttatgagcaacttgtcactactggaggagagcgaagacttcccacaggctccgggttctgtggccgcagctgtcgccgcagcagcagcagcggcagctacaggaggcctgtgcggggacttccaaggcccagaggcagggtgtctccatcccgctcccccacaacctccaccgccagggcctctttctcaacaccccccagtgccacctgccgctgctggcccattagcaggccagccaagaaaatcatcatccagtaggaggaatgcttgggggaatctgagttacgccgacctgattacaaaggctatcgaaagttccgcagagaaacgattgacactgagtcagatatatgagtggatggttaagtctgtaccctacttcaaggacaaaggtgactctaacagttctgccggatggaagaacagcattcgtcacaatctgagcttacactctaaattcatcagagttcagaatgagggaaccggaaaatcttcctggtggatgctgaaccccgagggagggaaaagcggtaaaagccctcggagaagggcggctagtatggataataattcaaaatttgcaaaatcacgcagtagagcggctaagaaaaaggcgtcactgcagagcggacaggagggtgccggtgactcaccaggctcacagttctctaagtggccggcaagtccaggtagtcactcaaatgacgatttcgacaattggtccactttccgacccaggacaagctctaatgcatccaccatctcaggccgactcagtccgattatgacagaacaagacgacctgggagaaggggatgtccactccatggtctaccctccatcagctgcaaagatggcctcaaccttaccgagcctgtcagagatctcaaatcccgaaaatatggagaacctcctcgacaatttgaatctgttatccagccctacatcgcttacggtgagtacccagtcgagccccggaaccatgatgcagcagacaccctgttacagctttgcacctcctaatacctcacttaattccccaagtcccaactatcagaaatacacctacgggcagtcatccatgtctccactgccccaaatgccgatacagaccctccaggacaacaagagcagctacggagggatgtcccagtacaactgcgccccaggtctgctgaaggaactgcttacaagcgactcaccgccacataacgacatcatgacccccgtggacccaggcgtagctcagcccaactcacgcgtactcggacagaacgtaatgatgggtcccaactccgtcatgagtacttacggctctcaggcttcccataacaaaatgatgaacccaagtagccacacccatcccggtcatgcgcagcagacttccgcggtgaatggccgaccactgcctcacactgtgtcaaccatgcctcacacctccggcatgaacagactgacgcaggtcaaaacacccgttcaagttcctttgccccaccctatgcagatgtcagccctgggcggttattccagtgtgtcatcctgcaacggctatggacgcatgggacttctgcaccaggaaaagctgccgtcagatctagacgggatgtttatcgagcgactggactgtgacatggagtcgatcatcagaaatgatctgatggatggggataccctcgactttaatttcgataacgtgcttcctaaccagtcatttccgcacagcgttaagaccacaactcattcctgggttagtggctag

SEQ ID NO: 28737 - DNA, 2022 bp, Artificial Sequence
  Description of Artificial Sequence: Synthetic coding sequence
atggccgaggcccctgcatctcctgctcctctttccccactcgaagttgagctggaccctgagttcgagccacagtccagacctagaagttgtacctggcccctacagaggcctgaattacaggcctctccagcaaaacccagcggggaaaccgctgccgacagcatgattcccgaagaggaggacgatgaagatgatgaagacggcggaggcagggccggaagtgctatggccattggcggtgggggaggcagcggcactctggggagtggactgttactggaggatagcgccagggtgttagcgccagggggacaagaccctgggtcaggaccagctactgcagctggtggtctgtcagggggtacacaagccctcctgcagcctcaacaaccactaccaccaccacaaccaggagctgctggagggagcggccagccgcgtaagtgctcttcccgcagaaacgcttggggcaatctgtcttacgcagatctgatcactagagcgatagagtcatcaccagataaacgcctgacgctcagtcagatttatgagtggatggtgagatgcgtaccctactttaaggacaaaggtgatagtaattccagcgcgggttggaaaaattccataagacacaatctgagtttgcatagcaggttcatgcgggtgcaaaacgagggtacaggtaagtcatcttggtggatcattaatcccgacgggggtaaatctggaaaagccccaaggaggcgcgctgttagcatggacaacagcaataaatacaccaagtcccggggacgggctgccaaaaagaaagccgcattgcaaacagccccagaatccgcagacgatagccccagtcagctgtctaaatggccgggatcacctacctcccgatcatctgatgagctggacgcctggaccgatttccggtcccgaactaactcaaacgccagtactgtttccggtcgattaagcccgatcatggcttctactgagctagatgaagtgcaagacgacgatgccccactttctccaatgttgtactcgtcatctgcttccctgtcaccatccgtctcaaagccttgcaccgttgagctgccaagactcacagatatggccggaacgatgaacctgaacgacggcttgacggaaaatctcatggatgatctcctggacaatatcacactcccgccttcacaaccaagccccaccggagggctgatgcaacgctcttcttctttcccatacaccacaaagggatcaggcctagggtccccgactagttccttcaatagtacagtatttggcccatccagcctgaatagcttgagacagagtcccatgcagactattcaggagaataagcccgctacgttttcttctatgagtcattatggaaaccagacactccaagaccttttgacatctgattcactctcccattcagacgtaatgatgacccaatccgacccactgatgtcgcaagcctccactgccgtatccgcacaaaacagtagacgcaatgttatgctgaggaatgaccccatgatgagtttcgcagcccagcccaatcaggggtcgctggtgaatcaaaatctgctgcatcaccaacatcagacccagggtgcacttgggggtagccgcgctttgtcaaattcagtgtccaatatgggactttctgagtcttccagtttggggagcgctaaacatcaacagcagagccctgttagtcagtctatgcagactctgtccgactcccttagcggctcaagcctgtattcgacatcagccaatctgccagtaatggggcacgagaaattcccatctgatttggacttagatatgttcaacggctctttggagtgcgacatggaatcgataatacgctcagaactgatggatgccgatggcttggattttaattttgattcccttatcagcacgcagaatgtggttgggctgaatgttggaaactttactggtgccaaacaggcttcttcccagagctgggtgccagggtag

SEQ ID NO: 28738 - DNA, 2022 bp, Artificial Sequence
  Description of Artificial Sequence: Synthetic coding sequence
atggcagaggccccagcttcacccgcacctctgagcccactagaggtcgagctggaccccgaattcgaaccacagagtcgcccacgatcttgcacctggcctctgcagcgcccagagctgcaggcatcacctgccaagccaagcggggagacagcagctgactccatgattcctgaggaggaagacgacgaggatgatgaggacggcggaggaagagcaggtagtgcaatggctatcggtgggggagggggatcaggaacgctcgggtcgggcctcctccttgaggactccgcacgtgtgctggcacctggaggacaggatccaggctcagggccagccacagccgcaggtgggctttcagggggtacccaggctctgctgcaaccacagcagcctctgcctcccccacagcccggagctgcaggagggtcaggccagcctcggaagtgtagttcccgcaggaacgcatggggcaatttgtcctatgcagatttaatcactcgggctattgagtcgtccccagacaaaagactcacattgagccagatttacgaatggatggtgcgatgcgtgccctactttaaagataagggcgacagcaattcttctgccggatggaagaattcaatcagacataatctgagcctgcactcacgttttatgcgggtgcagaatgagggcactggcaagtcaagctggtggattattaatccggatgggggaaagtccgggaaggctcctaggcgcagagcagtctccatggacaattctaacaagtacactaagagccgcggtcgcgctgccaagaagaaagcagcgttacagacggcaccagaatctgccgatgatagtcctagccaactgagcaagtggcccggttcaccgaccagcagatcttcggatgagctggacgcatggaccgatttcaggtctcgtaccaacagtaacgcctctaccgtttccggacgactgtcgccaatcatggcatccacagaactggatgaagtccaggatgacgatgctcccctgtctcccatgctttattcctcctctgctagcttgtccccttctgtgtctaagccctgtacggtggagctccctcggctcactgacatggcgggaaccatgaaccttaacgatggcctcacagaaaaccttatggatgaccttcttgacaatatcacactacctccatctcaaccaagcccaactggcggactcatgcagaggtcttcttctttcccatataccacaaagggttccggcctggggtccccgaccagttcctttaatagtacagtttttgggccatcctcccttaactctttacgacaatcccctatgcagaccattcaggagaacaaaccagcaactttttcctccatgagccactacggaaaccaaactctgcaggacttactgacgtccgactccctgtctcactctgacgtaatgatgactcagtctgatccactcatgtcacaggcgagcacagccgtgtctgcccagaattccaggcgcaatgtgatgctgcggaatgatcccatgatgagcttcgctgctcaacctaaccaaggatcactcgtaaaccagaaccttctacatcaccagcaccaaacccagggagctcttggtggctcacgagctttgtctaattcggtctccaatatgggcctcagtgagtcctctagcttgggcagcgccaagcatcagcagcagagcccagttagccaatcgatgcagacattgtcagactcacttagcggctcctccctgtactccacctcggccaatctgccggtgatggggcatgaaaagtttcccagcgacctcgatctggacatgttcaacggcagcctggaatgtgacatggaatctataatcaggtctgaactgatggacgctgacgggctcgacttcaattttgactccttgataagtacccagaacgtggtgggcctcaacgttggtaactttacaggcgctaaacaggcatctagccagtcctgggtgcccggttag

SEQ ID NO: 28739 - DNA, 1302 bp, Artificial Sequence
  Description of Artificial Sequence: Synthetic coding sequence
atgcgggtgcagaatgaggggaccggaaagtccagttggtggatcatcaacccagatggaggcaaaagcggaaaggcccctcgaaggagggctgtgtccatggacaacagcaataagtacaccaaatctagaggacgggcagccaaaaagaaggctgctctgcagacagcacctgagagtgccgatgactccccttcacagctgtctaaatggcctgggagccccacttctcggagctctgacgagttagacgcttggaccgatttccgctctaggaccaattctaatgcttccaccgtgtccggccgactctctcctataatggcttccaccgagctcgacgaggtgcaggatgacgacgctcctctctcccctatgctgtatagctctagcgcatctctctctccctctgtgtccaagccctgcaccgtcgaactgcccagactcacagacatggcgggaaccatgaacctcaacgatggcctgaccgaaaatttaatggatgacttgttggataatatcaccctgcctccaagccagccgtcgcctacaggcggtctgatgcaacgctcctcttctttcccgtatacgacgaagggctctggccttggctcgcccacttcctcttttaatagcaccgtcttcggaccctctagcttaaactcattaagacagagccccatgcagaccattcaagagaacaaacctgccacgttcagttctatgtcccattacggaaatcagacattacaagacctgctgacaagcgattccctttctcacagtgatgtcatgatgacccagagtgatcccctgatgtcccaggcttctaccgccgtgtcagcacagaacagtcggcgaaacgtcatgctacgtaacgatccaatgatgtcttttgctgcacagcccaatcaggggagcctggtgaaccaaaatctcctgcaccatcagcaccaaactcagggagccttggggggttcgagagccctaagcaatagtgtgtcaaatatgggcttgagtgagtcctccagcctgggctccgccaaacatcagcagcagagtcctgtgtcacagtccatgcaaacactgtccgattctctctcaggatcaagcctgtattcaaccagtgccaacctgccagtgatgggacacgaaaaatttccaagcgaccttgatctggacatgtccatgggtgcctggaatgtgacgtggagccctctttccgtggtgaacagttggatgcttatgggatggatactcacactaatcccgtcttctccacataggatgctgctggtgtag

SEQ ID NO: 28740 - DNA, 1362 bp, Artificial Sequence
  Description of Artificial Sequence: Synthetic coding sequence
atgcgggtgcaaaatgagggtactggcaagtcttcttggtggattataaatcccgacggtgggaagtcggggaaggctcccaggaggagagccgtgagtatggataactccaataaatatactaagtctaggggcagagctgcgaagaagaaagctgcacttcaaacagcacccgaatcagcagatgacagcccctcacagctgtctaaatggcccggatcccctacgagtagaagcagcgacgagctggacgcctggaccgactttcgcagccgcactaacagcaacgcctcaacagtgagtggcagattatcccccatcatggcttccacggagctggacgaggtccaagacgatgatgctcctctgtccccaatgctctactcgagctcagcaagcttaagcccaagtgtaagcaaaccctgtactgtcgaattgcccaggctgaccgatatggccggaacaatgaacttaaacgatgggctgaccgaaaacctgatggatgatctcttagacaatataacgcttcccccaagccagccttctccaacgggcggtctgatgcagcgttcttcgtcctttccctacactacgaaaggcagcggccttggctcaccgacatcctcattcaatagcacagtgtttggccctagtagccttaattcactgcggcagagccctatgcagactatccaggaaaacaaacccgctacattctcctcaatgtctcattacggtaaccagaccttgcaggatctgctaacgtctgactctctgagccactccgacgtcatgatgactcagagcgaccccctaatgtcccaggcctccaccgccgttagcgcacagaattcacggcgtaatgtaatgctgagaaatgatcctatgatgagttttgcggctcaaccaaatcagggcagcttggtgaatcagaatctgctgcaccaccagcaccagacacagggcgctctagggggaagccgggcactgtcgaactctgttagtaatatggggctctctgagtcctcttccttgggatcggcgaagcatcaacaacagtcgcccgtgtcccagtccatgcagactctctcagactccctttcaggaagttccttgtattcgacttccgcaaacctaccggttatgggacacgaaaagtttccttcagatctggacttggatatgttcaacggaagtctggagtgcgatatggaatccatcatcaggagcgagctcatggatgccgacggcttagatttcaactttgactctttaattagtacgcaaaatgtagtcgggctaaatgtcggcaacttcacgggagctaaacaggcgtccagccagagttgggtgcctggatag

SEQ ID NO: 28741 - DNA, 444 bp, Artificial Sequence
  Description of Artificial Sequence: Synthetic coding sequence
atgtccttcaggttcggtcagcatctgataaagccttccgtggtcttcttaaaaacagagctatcattcgcattggtgaaccgcaagcccgtggtgcccggacatgtcttggtttgtcccctcaggccagtcgaacggtttcacgatctgagacctgatgaagtggccgatcttttccagacgactcagagagttgggacagtggtggaaaaacactttcacggcacaagtctgacgttctcaatgcaggatggccctgaagccggacagaccgtcaaacatgtacatgtgcatgtgctgccccgtaaagctggagatttccaccgcaatgactctatttacgaagagctgcagaaacatgataaggaggattttcctgcatcttggagatctgaagaggaaatggcagcggaagctgctgccttaagagtgtatttccagtag

SEQ ID NO: 28742 - DNA, 444 bp, Artificial Sequence
  Description of Artificial Sequence: Synthetic coding sequence
atgtccttcaggttcggccagcatctgataaagccgagtgtggtcttccttaaaacggagctgtcgtttgccctggtcaaccggaagccagtagtccctggccatgtgctcgtttgcccacttcgcccagtggaacgctttcacgacctccgccctgacgaggtggctgacctatttcagaccacgcaaagggttggaaccgtggtggagaaacattttcacggcaccagtctcacattttctatgcaggatggacccgaagccggacaaaccgtgaagcacgtgcacgtccacgtcctgccaagaaaagctggcgacttccacaggaatgactccatctacgaggaactgcagaagcatgacaaggaagacttccctgcaagctggaggagtgaagaggagatggcagccgaggcagcagccttgagagtttacttccaatag

SEQ ID NO: 28743 - DNA, 444 bp, Artificial Sequence
  Description of Artificial Sequence: Synthetic coding sequence
atgagtttccgttttggccaacatctgattaagccttcagttgtcttcctgaagactgagctctccttcgccttggttaaccgaaagcctgtcgtgccaggccatgtgctggtctgtcctttgcggcctgtggaaagattccacgacctccgtccagacgaagtggctgacctgttccagacaacccagcgcgtgggtaccgttgtcgagaaacatttccacggaacctccctgacattcagcatgcaagacgggcctgaagccggacagactgtaaagcacgtgcacgtccacgtgttgcctcggaaggctggtgactttcaccgcaatgactctatttatgaggagcttcagaagcatgacaaggaggactttcctgcttcttggagatctgaggaggaaatggcagccgaggctgccgctcttagggtatacttccaatag

SEQ ID NO: 28744 - DNA, 240 bp, Artificial Sequence
  Description of Artificial Sequence: Synthetic coding sequence
atgtccttccgtttcggacagcatttaatcaagccaagtgtggttttcctcaagacagagctcagcttcgcattagttaaccggaaacccgtggtccctggacacgtgttagtatgccctctccgccctgtggaacgctttcatgatctgcgccctgacgaggtcgccgatctatttcaaacaacacagagggtgggaactgtcgtggagaagcactttcacggtaccagcttgacatag

SEQ ID NO: 28745 - DNA, 444 bp, Artificial Sequence
  Description of Artificial Sequence: Synthetic coding sequence
atgtcttttcggtttggacagcacctcattaagccaagcgttgtcttcttaaagacggagctaagttttgctctggtgaaccggaagccagtcgtgcctgggcacgtactggtgtgtccactccgcccagtggaacggttccacgatctcaggcccgatgaggtggccgatttatttcagactacccagcgcgttggaacagttgtggaaaagcattttcacggtaccagtctcacattctctatgcaggatggacccgaggcaggccagacagtaaagcatgtgcacgtgcacgtgctcccgagaaaggccggtgacttccatcgcaacgatagcatttatgaggaactgcagaagcacgataaggaggatttcccggcatcttggagatctgaggaagaaatggctgccgaggccgcagctttgcgcgtgtatttccagtag

SEQ ID NO: 28746 - DNA, 1725 bp, Artificial Sequence
  Description of Artificial Sequence: Synthetic coding sequence
atgagagatccgggagcagcggctcccctctcttccttgggactttgtgcccttgtgctcgccctgctgggggctctgagcgccggtgccggtgctcagccttatcacggagaaaaagggatttctgtacccgaccatggcttttgccagcccatttcaatccctttgtgtactgacatcgcctacaaccaaactatcttgcctaatctgctcgggcacaccaatcaagaagatgcagggttagaggttcaccagttttatcctctcgtcaaggttcagtgcagtccggaactaagattcttcctgtgttcaatgtacgctccagtctgcacggtgctggatcaggccattccgccatgccgctcactttgcgagcgcgcaagacaaggctgcgaggctctgatgaacaaattcggtttccagtggccggaacggctgcgctgtgaaaactttccagtccacggagccggagaaatctgcgtgggtcaaaacacaagcgacggaagcggcggaccaggtgggggaccgacggcttatcccactgcaccctacctacccgacctgccttttaccgctctccctcccggtgcctcagatggtaggggccgtcctgctttcccattttcctgtccccgtcagctgaaagttccgccatatctcgggtacaggttcctgggtgagagggattgcggtgccccttgcgagcccggtcgggcaaacgggctgatgtatttcaaggaggaggagcgtaggtttgcccgactgtgggtgggtgtctggtccgtcctgtgctgtgcatccaccctcttcaccgtattgacatatctggtcgatatgcggcgtttcagctaccccgagcggccaataatcttcctcagcgggtgttattttatggtggcagtagctcacgtggctggcttcctgttggaggatagggccgtctgcgtcgagagattttccgatgatggatatagaaccgtggcgcaaggcactaagaaagagggctgcaccatcctgttcatggtgctctatttcttcggcatggcttcttctatttggtgggtaatcctttcactaacttggtttctggcagccggaatgaagtggggccacgaggccatcgaggcgaatagccagtattttcacttggccgcttgggccgttccggcagtgaaaaccattaccatcctcgcgatggggcaggttgacggggacttgttatcaggagtgtgctatgtgggcctgtcaagtgtggatgcccttagagggtttgtgctggccccacttttcgtatacttatttattggtacctccttcttgctggctgggttcgttagcctatttaggattagaaccattatgaaacatgacggcactaagaccgaaaagctcgagaagttaatggttagaataggggttttctccgtactgtatactgtccctgcgacaatcgtgctcgcgtgttacttttacgagcaggcgttccgcgagcattgggaaagaacatggctcctacagacctgtaagagctacgcggtaccctgccctcctggccactttccccctatgtcacctgatttcactgtgtttatgataaaatacttgatgactatgatcgtggggattacaactggcttttggatttggtctggcaagaccctgcagtcgtggcggcgattctatcatcgattgtcacactcctcaaaaggcgagacagctgtgtag

SEQ ID NO: 28747 - DNA, 654 bp, Artificial Sequence
  Description of Artificial Sequence: Synthetic coding sequence
atgagctttcgtggaggaggcagagggggattcaatagaggcggaggcggtggcggtttcaacagagggggttcttcaaaccacttccggggtgggggtggagggggaggaggaggaaactttcggggaggcggacggggaggttttgggcgtggaggaggaagggggggtttcaacaaaggtcaggatcagggtcctcctgaacgcgtggtgcttttgggagagttcctccacccatgcgaggacgatatcgtgtgtaaatgtacaaccgatgaaaataaagtgccttacttcaacgccccagtgtacctggaaaacaaagaacagatcggcaaggttgatgaaatctttggacaattgagagacttctattttagcgttaagctctctgagaacatgaaggcttccagtttcaaaaagttgcagaagttttacatagatccatacaagctcctgcctctccagagattcctgccacgaccccctggggaaaagggaccaccacgcggaggaggtcgcggtggacgcggaggtggtcgaggtggaggtggacgtggcggtggccgaggtggagggtttcggggtggaagggggggtgggggaggcggatttcgaggcggaagaggagggggtttcagaggccgtggccattag

SEQ ID NO: 28748 - DNA, 1533 bp, Artificial Sequence
  Description of Artificial Sequence: Synthetic coding sequence
atgtaccgcgcactccggttgctggccagatccagacccttggtgcgtgcccctgctgccgctcttgcttccgccccagggcttggtggtgctgctgtgcccagcttctggcctcccaatgcagccagaatggcaagtcaaaactctttcaggatagagtatgacacctttggggagctcaaggttccaaatgacaaatattatggtgcacagaccgttcgcagcactatgaattttaagattggtggggtaacggagagaatgcccacgcccgtcatcaaggccttcggaatcctgaagagagccgcagccgaagtgaatcaagactatggacttgaccccaagattgccaatgccatcatgaaggccgctgacgaagttgcggagggaaaactcaacgaccacttcccactggtggtgtggcaaacaggaagcgggactcagactaatatgaatgtgaacgaggtcatctcgaatcgcgcaattgagatgttggggggtgaactggggtccaaaatcccagtgcaccccaacgatcacgtgaacaagtctcaaagtagcaatgacaccttcccaaccgccatgcacatcgctgccgctatcgaagtgcatgaggtgttgctgccaggtctccagaagttacacgatgccttagacgctaaatccaaggagtttgcccaaattatcaagatcgggaggactcacactcaggacgcagtgcccttgacactggggcaggagttctccggctatgtccagcaggtgaagtatgccatgactcgcatcaaggccgctatgccacggatctatgaactagccgcaggcggtacagccgtgggaactggcttgaacacccggattggctttgccgagaaggtcgccgctaaagtggcagctcttaccggactgccttttgtgacagccccaaataagttcgaagcactcgccgctcatgatgcccttgtagagttatcgggcgcaatgaataccacagcttgttcactgatgaaaatcgccaacgacatccgctttctagggagcggtcctcgcagtggcctgggagagctgatcttgcccgaaaatgagccaggttcttcgatcatgcctggaaaggttaatcccacacaatgcgaagccatgaccatggtggccgcacaagtaatgggcaatcacgtggctgtgacagtgggtggctctaacgggcatttcgaactgaatgtttttaaacccatgatgatcaaaaacgtactgcactcagcgaggctgctgggtgacgcatctgtgtcattcactgagaactgcgtggtgggaatccaggccaataccgaacgaattaacaaactcatgaacgaatcactcatgctggtgactgctctaaatcctcacatcggctacgataaggcagccaaaattgccaaaacagcccataaaaacggatcaaccctgaaggagaccgcaatcgagttgggttatctcacggcggagcagtttgatgaatgggtgaagcccaaagacatgctcggccctaagtag

SEQ ID NO: 28749 - DNA, 537 bp, Artificial Sequence
  Description of Artificial Sequence: Synthetic coding sequence
atgtccccgagtgggcgactgtgcctcctcacaatcgtgggactcatactcccgacgaggggtcagacactgaaggacacgacgagcagcagcagcgcggactcaactatcatggatatccaggtccctactcgagctccagatgccgtttacactgagttgcagcctactagtccgacaccaacttggcccgctgatgaaacaccacagccgcagacacagacacagcagctggagggaaccgacgggcctttagtcacggaccccgagacccataagtcaactaaggctgctcacccgacagatgatactaccacactgagtgagcggccatctccctccaccgatgtgcagacggatccacagacactcaaaccatcagggttccatgaggacgatccttttttctatgatgaacataccttgagaaaacggggtctcctggttgccgcagtgttattcatcacaggtataatcatacttacgtccggcaagtgcagacagctcagtaggctgtgcaggaatagatgtcgatag

SEQ ID NO: 28750 - DNA, 324 bp, Artificial Sequence
  Description of Artificial Sequence: Synthetic coding sequence
atgcagacactgagtaatattccatgtttctgcctccatggcagcctgctcccatcgacagaccttgctacgctttcagctcacccgaccgacgacacaaccacgttgtcagagcgcccttcacctagcactgatgtgcagaccgaccctcaaaccctgaaaccgtccggttttcacgaagatgatccgtttttttacgatgaacacaccttgcgaaagcgcggactgcttgtggccgcagtcttatttataacaggcataatcatattgacctctgggaagtgtcgccagctgtcaaggttgtgccggaaccgctgcagatag

SEQ ID NO: 28751 - DNA, 291 bp, Artificial Sequence
  Description of Artificial Sequence: Synthetic coding sequence
atgagcccatccgggaggctgtgcctgcttacaattgtgggcctgattttgccaactagagggcaaactctgaaggacactacaagttcctcaagtgcagattctactataatggacattcaggttccaaccagagcacccgatgcggtgtacacagagctacaaccaacaagtcctacaccaacgtggcctgcagatggagcctatatcactgcctacggcgttacccactttctgatgaacatgctggccgtgtcgtcctttttctgtctacacactgctccccagtag

SEQ ID NO: 28752 - DNA, 537 bp, Artificial Sequence
  Description of Artificial Sequence: Synthetic coding sequence
atgtctccctccggacgactgtgtcttctgacgatcgtgggtcttatccttcccacaagaggtcaaaccctgaaggacactacatccagctcttccgcagacagcactataatggacatccaggtgcccacacgcgcacccgacgccgtatacactgagttgcagccaactagtcccaccccaacttggccagccgacgagaccccacagccgcaaactcagactcaacaactcgagggcaccgacggtcccctggtgaccgatccagagacacacaaatccacaaaagctgcacacccaactgatgataccactacactttcggagcgaccatctccctcgaccgacgtgcagacggatcctcagaccctcaagccatcaggattccacgaggacgacccgtttttctacgatgagcacacgcttcgcaaaagaggtctgttagtggcagcggtgctatttattacaggaatcataattctgactagtggtaagtgtcgtcagctgagccgattatgtcgaaatcgttgccggtag

SEQ ID NO: 28753 - DNA, 537 bp, Artificial Sequence
  Description of Artificial Sequence: Synthetic coding sequence
atgtccccgtcaggtcgtctgtgtctcttgaccattgtgggtttgattcttcccacccgaggtcagactctcaaggacactacctcttctagctctgcagactcaaccatcatggacatacaagttccgacaagggccccagacgccgtgtacaccgagctgcagccaacaagccccacacccacctggcccgctgacgaaaccccacagccccagactcagacgcaacagctggaggggacagacggtcctttggtgacggaccccgaaacccataaaagtacaaaagccgctcaccccaccgatgatacaaccactctgtccgagaggccctccccatccaccgatgtacagacagatccacaaactttgaagccttctggatttcacgaggatgatccttttttctatgatgaacatactttgcgcaaacgtggcctccttgtcgcggcagttttgttcattacgggcatcataatcttgacatctggaaagtgcaggcaactgtctcggctctgtaggaaccgttgtcgttag

SEQ ID NO: 28754 - DNA, 537 bp, Artificial Sequence
  Description of Artificial Sequence: Synthetic coding sequence
atgagcccaagcggcaggctttgtcttctgacaatagtcggactgatacttcccactagggggcaaactctgaaggatactacaagctcctctagcgccgactcaacaattatggatatccaggtgcctacacgggctcccgatgcagtgtacaccgaattgcagcctacttcccccacccccacttggccggcagacgagactcctcagcctcaaacgcaaacccagcagctagaaggtactgacggcccattggtcaccgacccggagacccacaaatcaacaaaggctgcccatccgacagatgatacaaccaccctgtccgaacggccaagtcccagtacagacgtgcagactgatccccagacgctgaagcctagcggattccacgaggacgatccatttttctacgacgagcacacactgagaaaaagaggactgctcgttgctgcggtcctgtttatcaccggcattataattctgacgtcagggaagtgcagacaactgtcacgtctgtgcagaaatcgctgtagatag

SEQ ID NO: 28755 - DNA, 585 bp, Artificial Sequence
  Description of Artificial Sequence: Synthetic coding sequence
atgagccctagcggcagactgtgcctgctaacgatagtgggtctgatccttccgacccggggacagaccctgaaagataccactagctcaagctcagcggactctacgataatggacattcaagtgccaacgcgcgcaccagacgctgtctacacagagctgcaacctacttcccccaccccaacctggcctgccgacgagaccccacaacctcagacacaaacccagcaactcgaggggacagatggcccactggtaaccgatccagagactcacaaatctactaaggctgctcatcccacggatgacacaactaccctcagcgagcgtccgtcccctagcacagatgtccagactgatccccaaactctgaagccgtccggttttcacgaagacgacccattcttctacgacgagcacaccttgaggaaacggggactgctggtcgccgcagtgctgtttatcaccgggatcataatccttactagcgaaaactggggttgggttggacgaactcccaggcctggaggtggattgatgaccgaagggtgggtgctaaagggtccttgggctatactgttttag

SEQ ID NO: 28756 - DNA, 1518 bp, Artificial Sequence
  Description of Artificial Sequence: Synthetic coding sequence
atgtccaatatctgtcaacggctgtgggagtatttagagccttacttaccctgtctctcaactgaagccgataagtccaccgttattgagaaccccggagccctgtgctctccccagagccaaagacacggtcactattttgtcgccctgtttgattatcaggcgaggactgccgaggacttatccttcagggccggagataaactacaggtactagatacccttcacgaaggttggtggtttgccaggcacttggaaaagagacgagatggcagctcccaacagctccagggatacatcccaagcaattatgtcgcagaggataggagcttacaggccgaaccgtggttcttcggtgcgattggtcggtccgatgcagaaaaacaactactctatagcgaaaataagaccgggagtttcttgatccgggagagcgagtcgcagaagggagagttttcgctgtcagtgttggatggcgcagtggtgaagcattacaggataaaaagattagatgagggcggattttttctgaccagaagacgcatattctcaacgcttaatgagttcgtgtcccactacaccaagacctcagacggcctgtgcgtcaagttaggcaagccatgcttgaagatccaggtccctgcgccatttgacctcagttacaaaacggtggatcaatgggaaattgatcgaaattcgattcaactcctgaagagactcggctctggccagtttggtgaggtttgggaagggctgtggaataacacaacaccagtcgccgttaagacattgaagccaggcagcatggatccaaacgatttcctccgtgaggctcagatcatgaagaatctccgccatcccaaactcattcagttatacgctgtctgcacccttgaggaccctatctatatcatcactgagctgatgcgccacggaagcctgcaggagtaccttcagaatgataccgggtccaagatccacctgacccagcaagtggatatggctgctcaggtagccagcgggatggcatacttagagtctagaaactacattcatagagacctcgcagccagaaatgttctggttggagagcacaatatttacaaggtcgctgatttcgggttagcacgtgttttcaaggtggacaacgaggacatttatgaatcccggcacgagattaagctccctgttaaatggactgctcctgaagccatacggtccaataaatttagcattaagtcggatgtttggagctttggcatattgttatacgagatcatcacatacgggaaaatgccatactcaggtatgactggcgctcaggtgatccagatgctggcccagaactatcgcctaccacagccgagcaattgtcctcagcagttttacaatatcatgctcgagtgctggaatgcagagccaaaagagcgcccaaccttcgaaaccctgaggtggaagttggaggattacttcgaaactgactccagctacagcgacgctaataacttcatcagatag

SEQ ID NO: 28757 - DNA, 1092 bp, Artificial Sequence
  Description of Artificial Sequence: Synthetic coding sequence
atggatagtacatcattgctccccaacccatggatccgcgtgctggacggcgctgtggttaagcactaccgcataaaaaggctagacgagggcggtttcttcctcacacgaagacggatcttttctactctgaacgagttcgtatcgcattacaccaagaccagcgatggcctctgtgtgaagctgggtaagccatgcctgaaaattcaggtgccagcccctttcgacttgtcttataaaaccgtggatcagtgggaaatagatagaaactccatccagctgttaaagagactggggtcaggacagttcggagaagtctgggagggactgtggaataatactacgcccgtagcggtgaagacactgaagcccggtagcatggaccccaatgacttcctacgggaggcccagatcatgaaaaatctgagacatccaaagctcatacagctgtatgcggtctgtactctggaggatcctatatatattatcactgaacttatgaggcacggcagtctccaggaatatctgcagaatgatacaggatcaaagatccacctgacgcaacaggtcgacatggctgctcaggtcgcgtctgggatggcctacctggagtcaagaaattatatccatcgcgatctcgcagccagaaatgtactagtgggtgagcataatatttataaggttgccgatttcggtctcgccagggtatttaaggtagacaatgaggacatttatgagagcagacacgaaattaagttaccagtcaagtggacagcaccagaagccatcaggagtaacaaattctcaattaaatcagatgtgtggagttttggcatacttctctatgagatcatcacgtatggtaaaatgccgtacagcggtatgaccggagcccaggtgattcagatgctagcccaaaactaccggttacctcagcctagcaactgccctcagcagttctataatataatgttagagtgctggaatgcggaacccaaggagaggcccacttttgagaccctccggtggaagttagaggactatttcgaaactgatagcagctattctgatgccaataacttcattcgatag

SEQ ID NO: 28758 - DNA, 1128 bp, Artificial Sequence
  Description of Artificial Sequence: Synthetic coding sequence
atgcgatcagtggctccctctgggcctaagatgggcaatatcactgctgataattcttctatgagctgcacaatcgaccacactattcatcagacgctggcccctgtggtctacgtaacggtcctagtagtgggcttcccagccaattgcctcagcctctacttcgggtatctgcagattaaggcacgcaacgaattgggggtatacctctgtaatcttacagtggccgacctgttctatatatgctccctgccattttggctgcagtacgtgctgcagcatgataattggtcccacggcgatctgtcatgtcaagtctgtggcattctgctatatgagaacatctacatttccgtgggcttcctgtgctgtatcagtgtagatcgttaccttgctgttgcacatcccttcagatttcaccagtttcggacccttaaggccgcagttggggtgagcgtggttatatgggcaaaggagcttttaactagcatctacttcttaatgcatgaggaagtgattgaggacgaaaaccagcaccgggtctgcttcgagcattaccccatccaggcatggcaacgagccatcaattactaccgcttcctggtgggcttcctcttccccatctgcttgttactggcctcctaccagggaattttgagggcagtgcgccgttcgcatgggacgcagaaatcgcggaaagatcagattcagcggctcgtgttgagtacagtggttatcttcctcgcgtgtttcctgccgtatcatgtcttgctgctggtacgcagcgtgtgggaggcgtcatgcgactttgccaaaggcgtgtttaacgcataccatttcagcttattactcacctcctttaattgcgtcgcagacccagtgctgtactgctttgtgtccgagaccacccaccgggatctggccagactgaggggagcctgtctcgcctttctaacctgctccagaactggtcgcgctagagaggcttatccactgggcgctcctgaggctagcgggaaatccggtgctcagggtgaggagccagaactgctaactaaactgcatccggcattccagacaccaaacagtcccggttctggcggttttcccacgggtcgcttagcttag

SEQ ID NO: 28759 - DNA, 1017 bp, Artificial Sequence
  Description of Artificial Sequence: Synthetic coding sequence
atgggcaatatcacagcagacaattcttcaatgagctgcactattgaccataccatccaccagactctagccccagttgtttatgtgaccgtattagtggtcggcttccctgcgaattgtctctcactgtactttgggtatttgcagatcaaagcaaggaacgaactaggagtatacttatgcaaccttacagttgcggatttgttttacatctgttctttacccttctggctccagtacgtgctgcagcatgataattggagtcacggcgatctcagctgtcaggtgtgcgggattctactgtacgaaaacatttacatctcagtcgggtttctgtgttgcatttccgtagaccgctatttagctgttgcccaccctttccggtttcatcagttccgtactctcaaagctgcggtcggcgtctcagtagtcatttgggccaaggaactgttgaccagcatctatttcctgatgcatgaggaggtgatcgaggacgagaatcaacatcgggtgtgcttcgaacattatcccatacaggcctggcaacgggcaattaattactacagattcctcgtcggtttcctgttcccaatttgcctccttttagcatcgtaccaggggatattgagggctgtgaggagatcccacggtacccagaagtcacgaaaggaccagatacagcgactggtgctgtcgactgtcgttatattcctcgcatgttttctgccctaccatgtgttgctgctggtccgttctgtgtgggaggcctcctgcgattttgcaaagggggtcttcaatgcgtaccatttctcactgctgctgactagcttcaactgtgttgcagatcctgtcctgtattgcttcgtgtcagaaaccactcatagggacttagctcgccttcgaggagcgtgtttagcttttctaacttgtagtcgcacaggccgagctcgcgaggcctatcctttaggtgcccctgaggccagtgggaaatccggagctcagggcgaagaaccctag

SEQ ID NO: 28760 - DNA, 1098 bp, Artificial Sequence
  Description of Artificial Sequence: Synthetic coding sequence
atgggcaacatcacagccgacaattcaagcatgagctgcacaatcgaccatactatccatcagaccttggccccagtggtttacgtgaccgtgcttgtcgtagggttcccagcgaattgtctctcgctatatttcggatatctgcagattaaggccaggaacgagttgggcgtgtacctgtgtaacctgactgtcgctgacctgttctacatatgcagtctccctttttggctgcaatatgtgttacagcacgacaattggagccacggtgacctttcttgtcaggtatgtggaattctgctttatgaaaacatctacattagtgttgggtttctctgttgcatatccgtggatcggtaccttgctgtggcccacccgtttcgcttccaccaatttcggacgctgaaagctgccgtcggagtgtccgtggtgatttgggcaaaggagcttctcaccagcatttattttctgatgcacgaagaggtgatcgaggacgagaaccaacatagagtctgcttcgagcactatccaatccaggcatggcagcgcgctatcaattattacagatttctggtggggtttctcttcccgatttgcctcctgctggcctcttatcagggcatattaagggcagtgcgacgatcacacgggacccaaaagtcacggaaagaccagattcagaggctcgtcttatccactgtagttatcttcctagcctgctttctgccctaccacgtactcctgctggttagatccgtctgggaagctagctgcgactttgccaagggtgtgttcaatgcttatcacttctccttattactgacctctttcaattgcgtggcagatcccgtgctttattgcttcgtgtctgaaaccacccacagggatctggctagacttcgaggcgcttgccttgcatttctgacatgcagcaggactgggagagccagagaggcctaccccctcggggcacctgaggccagcggaaagtctggcgcacagggggaagagccggaactccttacaaagctacacccggcatttcagactcccaatagccccggttctggaggctttcccacaggtcgactggcctag

SEQ ID NO: 28761 - DNA, 1098 bp, Artificial Sequence
  Description of Artificial Sequence: Synthetic coding sequence
atgggaaacataaccgcagacaacagctctatgtcttgcacaattgatcacacgattcatcaaacattggccccagtggtgtacgtaacagttctggtggtgggctttccagctaactgcttaagtctgtattttggctacttacagattaaagctcgaaacgagctgggcgtgtacctctgtaaccttactgttgccgatctgttttatatttgcagtctgccattctggctgcaatacgtccttcagcacgataactggtcgcacggtgatctttcctgccaggtgtgcggaattctgctgtacgaaaatatttacatctccgtgggattcttatgttgcatctctgtagatcgctacctggcagtggcccatcctttcagattccatcaattcaggacactaaaggcagcggtaggcgtcagtgttgtaatctgggccaaagaactgctcaccagcatctatttccttatgcacgaggaggttatcgaagacgaaaaccaacacagggtttgctttgagcactaccctatccaggcctggcaaagagcaatcaattattatcgattccttgtgggcttcctcttccctatctgccttctgcttgcttcttaccagggcatcctgagagctgtacggaggagccatgggacccagaaaagccggaaagaccaaatacagcggctcgtcttatccactgtggtgatatttctcgcgtgtttcttgccgtaccatgtgcttctgctggtaagatcggtatgggaagcctcctgtgacttcgccaagggggtgtttaacgcataccacttttctctgctcctcaccagcttcaattgcgtcgctgatcctgtgctgtactgcttcgtgagcgagaccacgcacagagacctggcccgtctgcggggtgcttgcctggctttcctgacctgttcccgaaccggcagggcgagagaggcttacccactcggcgctccagaggccagcggaaagtccggcgcacagggcgaagaaccagagctgctgactaagcttcatcccgcattccaaacgccgaactctcctggtagcggcggatttcctacgggacgactggcatag

SEQ ID NO: 28762 - DNA, 2100 bp, Artificial Sequence
  Description of Artificial Sequence: Synthetic coding sequence
atgaccttacgtcggaaatgcaatgaagacgatgaggtctttttcggtcctttcggtcacaaggagcgctgcatagctgctagcctcgagttaaataatcccgtgcccgaacagcccccactcccaacgagcgaatcaccatttgcttggagtcctttagctggggagaagttcgtcgaggtctataaggaagcacacttgctggcactccacattgagtcttcatcacggaatcaggcagcacaggccgcaaagcctgaagacccaagatcacagggcgtggagagatttatccaggagagtaagttgaagatcaatttattcgagaaggaaaaggagatgaagaagtcccccacgagtcttaagcgggaaacctactatctgtccgattcacccctccttggaccgccagtgggcgaacctcggctgctcgctagtagcccagctctcccctcaagtggtgcacaggccagactcacacgcgctcccggaccaccccacagcgcacacgcgctaccacgtgaatcatgcactgcccacgccgcatcacaggcagccacgcagagaaaacctgggacaaaacttctgctccctagagccgctagcgtgaggggtagatccattcctggggcagctgagaaacctaagaaggagatacccgcttcaccatcccggacaaaaattcccgcagagaaggagtcccatagggacgtcctaccagataaaccggctcctggggcagttaacgtgccggctgcaggctcacatctgggccaaggcaagagggccatccccgtgcctaacaaactgggtctgaagaaaacattgctaaaggctcctgggagcacatccaacctggctcgcaaatccagctcgggacctgtctggtctggggcttcttccgcttgcacctctcctgccgtcggtaaggcaaaatccagtgaattcgcaagcatccctgccaacagcagtcggcctctgagtaatatctccaaatcagggagaatgggacctgccatgctacgaccagctttgcctgccggtcctgtgggagccagcagctggcaggccaagcgggtggatgtaagcgaacttgccgcagaacaactcaccgcccctccttccgcgagtcccacacagccccaaactcctgaaggtgggggacagtggctcaattcaagctgcgcctggagcgaatcctctcagctgaacaagacacgttccattcgcaggcgagactcctgtctgaactcgaaaacaaaagtgatgcctactccgaccaaccagtttaagataccaaaattttccattggggatagccctgactcttctactcccaagctctcgagagcgcaaagaccacagtcttgtacaagcgtgggacgagtgacagttcacagcactccagtgaggagatccagtggccctgcccctcagtcactgctgtctgcctggcgcgtatctgcgcttcccacccccgcaagcaggcgctgcagcggcctacctcccatgaccccaaaaaccatgcccagggccgtgggttcaccactctgcgtccctgctagacgcagatcatctgaaccaaggaagaacagcgccatgcggaccgaaccaacacgtgaatctaaccgaaaaaccgacagtaggctagtggacgtgagccctgaccgaggctcacctcccagtcgggtaccacaggcgctgaatttcagccccgaagagagcgattctactttcagcaaatccacggcaactgaggtggccagagaggaagcaaagcctgggggagacgcagccccttctgaggccctcctggtggatattaagctggagccactcgctgttacaccagacgctgctagccaacccctcatagatctgcctctcatcgacttttgcgacacacctgaggcgcatgtggctgtgggatccgaaagccgcccacttattgacctgatgacaaacactccggacatgaacaagaatgtggccaaaccttcacctgtggtgggacagctgattgacctctcctctcccctgattcaactgtcaccagaggctgacaaagaaaatgtcgactcccctttgttgaagttctag

SEQ ID NO: 28763 - DNA, 2220 bp, Artificial Sequence
  Description of Artificial Sequence: Synthetic coding sequence
atggagggagggggtggtcgggatgagcccagcgcgtgtagagctggtgatgtcaatatggacgaccctaagaaggaggacatcctactgctcgcagatgagaagttcgactttgacctatccttgtcctcaagctctgccaacgaagatgatgaggtgtttttcggcccatttggtcacaaggagcggtgcatcgcagcctccctggagcttaacaaccccgtacccgaacagcccccactccccacgtctgaatctccatttgcttggtcccctctggctggcgagaaatttgttgaagtgtataaagaggcccacttgctggccctgcatattgagagtagctcccggaatcaggccgctcaggctgctaaacccgaagatccccgttcacagggagtggaacgcttcatccaggaatctaagttgaaaattaacttgtttgaaaaagaaaaggagatgaaaaaaagccccactagtttgaaacgcgagacatactatctttcagattctcctctgctggggccacctgtgggggagccacggttgcttgcctcgtcacctgccctgccatcttctggcgcacaggctaggttgacgagagcacccggaccccctcacagtgcacacgccctgccacgcgagagctgtacagcccatgctgctagtcaagccgctacacagcggaagcctggtactaaactcctgctgcctcgcgcagcctcagtcagaggcagaagtattcctggagccgctgagaaacccaaaaaggaaattcctgcatctccctccaggacaaagattcccgcagaaaaggaaagccacagggatgtgctgccggacaagcctgcccctggcgcagttaatgtgccagccgcagggtcccatctgggccaaggcaagcgcgcaatccccgtacctaataagttagggcttaaaaaaacactgctcaaggctcctggcagcacgtctaacctcgcaagaaaaagctcgtctggaccggtttggtccggcgcaagctccgcttgtacctcccctgcagtggggaaggcaaaatcctcagagtttgctagtattccagcaaacagcagcagacctctcagcaatatctccaagtctggacggatgggcccagccatgctgcgcccagctctgcctgctggtcccgtaggggcttcgtcatggcaggccaaacgcgttgatgttagtgagctggccgcagagcagctgacagcacccccatccgccagccccactcagccgcagacgccggagggtgggggacagtggttgaattcctcatgtgcttggagtgaatccagccaacttaacaagaccagaagtattcggaggcgcgattcctgtcttaactccaaaactaaggtgatgcccacccctacgaatcagtttaagatcccaaaattcagcattggtgattcacctgactcgagcacccccaagctgtctcgagcgcaacggcctcagtcatgcacatccgttggacgagttactgtacactcaacccctgtacgtagatctagtggtcctgcacctcagtcgctcctctctgcttggagggtgtccgcactgcccacgccagcctctcgtaggtgtagcggcctgccccctatgacacccaagacgatgcctagagcagtggggtcaccgctctgcgtgcccgctcggagacggtcctccgaaccacggaaaaactccgcaatgaggacagagcctacacgggaaagcaaccgtaagacagattctagactggtggacgtttcgccagacaggggaagccctccaagtcgggtcccacaggcacttaacttttcacccgaggagtctgattctactttctcaaagagcaccgcaactgaagtggccagagaggaagcgaagcctggtggagatgccgcaccctcagaggccctcttagttgacatcaagcttgaaccattagccgtgacaccagacgccgcttcccagccccttatcgatctgcctcttatcgatttctgcgataccccagaggctcacgtggcagtaggctcagagtccagacctttgattgacttgatgaccaacacgccggatatgaacaaaaacgtggctaaaccatccccagtggtcggacagctgatcgatctatcttctcccttgatccagctctctcctgaagctgacaaggaaaatgtcgactccccactgctaaagttctag

SEQ ID NO: 28764 - DNA, 1149 bp, Artificial Sequence
  Description of Artificial Sequence: Synthetic coding sequence
atgggtgactggtctgctcttggtaaactgctggataaagtccaggcatatagcacagccggtggcaaagtgtggctttcggttctcttcatattccgaatactgttgctggggactgccgtcgaatctgcctggggagatgagcagtccgcgttcagatgcaacacccagcagccgggatgcgagaatgtttgctacgataagagcttccccatctcccacgtgaggttttgggttcttcagataattttcgtgtctgtccctaccttattgtatctggcccacgttttctacgttatgcgcaaagaggaaaaacttaataagaaggaggaagaactgaaggtcgctcaaactgatggcgtcaatgtggacatgcacctgaaacagatcgagatcaaaaagtttaagtacggtatcgaggaacacgggaaggtgaagatgcggggaggtttgctgcgtacttacatcatcagcatcctgttcaagtcaatatttgaagtggcttttctgctgatccagtggtatatctacggattctcgctatctgctgtatatacctgcaagcgcgacccctgtccccaccaggttgattgctttctcagtcggccaaccgagaaaactatattcatcattttcatgctggtcgtgagccttgtttctctcgctctaaatattattgagttgttctatgtcttcttcaaaggtgttaaggatagagtgaaaggcaagtctgatccctaccacgctaccagcggggctctgtctcccgctaaggattgcggaagccagaaatatgcctacttcaacggatgttcctcacccaccgcaccactatctcccatgagtcctcccggatataagttggtaaccggagatagaaacaactcaagctgccgcaattataacaagcaggctagcgagcagaactgggccaactacagcgccgagcagaacagaatgggccaggccggaagtacgataagcaactcacacgcccagcctttcgacttccctgacgacaatcagaacagcaagaagctggccgctggacacgagcttcagccactggctatcgtcgatcagcgcccttcatcgcgggcttcctctcgcgcttcctcccgcccaagacctgacgacttggaaatctag

SEQ ID NO: 28765 - DNA, 1101 bp, Artificial Sequence
  Description of Artificial Sequence: Synthetic coding sequence
atgggggattggtcggccctggggaaacttctagacaaggtccaggcgtattcaacggctggcggaaaagtgtggctctccgcttggggagatgaacaatctgccttccggtgcaatacgcaacagcccggttgtgaaaacgtttgttacgacaaatcattccctatctcgcatgtgcggttctgggtgttgcagatcatctttgtgagtgtccctacactgctgtacttagcccacgtgttttacgtcatgcggaaggaggagaagttgaacaaaaaggaggaggagctcaaggtcgctcagacagacggcgtgaatgttgacatgcatcttaaacaaatagagatcaaaaagttcaaatacgggattgaggagcacggaaaggtgaagatgagaggagggctgttaagaacctacatcatttcaattctttttaagtccatatttgaagtcgcttttctgctgatccaatggtacatttacggattttcgcttagcgctgtctacacctgcaaacgcgatccttgccctcaccaggtcgactgctttctgagtagacctactgagaaaacaatatttatcatttttatgcttgtcgttagtctcgtgtctctagctcttaacatcattgagctcttttatgttttttttaaaggcgtgaaggaccgagtaaagggcaagtctgacccgtaccacgccactagcggggctttgtctccagctaaagactgtggcagccagaaatacgcttattttaacggttgcagctcacccaccgcgccactctcacctatgtctcccccaggatacaaactggtgaccggagatagaaataactcctcgtgtagaaactataataaacaagccagtgaacagaattgggccaattatagcgctgaacagaatagaatgggacaagctgggtccacaatttccaattcccacgcccaaccctttgatttcccagacgataatcagaattcaaaaaagctggccgcaggccatgagttacagcccctggccattgttgaccagagaccttccagtcgcgctagcagcagggcttcctcccgaccccgacccgatgatctcgaaatctag

SEQ ID NO: 28766 - DNA, 2673 bp, Artificial Sequence
  Description of Artificial Sequence: Synthetic coding sequence
atggattcaaacactgcaccacttggacctagctgtccacagccacccccagctccccagcctcaggcgcgttctcgacttaacgctacggcgtctctggagcaggaaaggtccgagcgcccaagagcacccggaccccaggccggaccaggccctggagtgcgggatgctgccgcacctgctgagcctcaagcccagcacacccgtagcagggaacgggctgatgggacaggacccactaaaggggacatggagattcccttcgaggaggtgttggaaagggccaaggccggagatccgaaagcacagacagaggtaggcaagcattatctccaactcgcaggggatactgacgaagagttgaattcttgtacagctgtggattggcttgtcctggctgccaaacagggccgacgagaggcggtgaagctgctgcggagatgcctggccgatcggcgagggattacctccgaaaacgagagggaggttcgccaattgtcaagtgaaacagatctcgagcgggcagtccgcaaggctgcactggtcatgtactggaagcttaaccctaaaaaaaagaagcaagtggctgtggctgagctgctcgaaaacgttggtcaggtgaatgaacacgacggtggtgcccagccgggaccagtgcccaaatcactccagaagcaacggcgtatgttggaaaggctggttagttccgagagcaagaattacatcgcacttgacgatttcgtcgagattacaaaaaagtacgctaagggcgtgatcccatctagtctctttttgcaagacgacgaggatgatgacgaactggccggaaagtctccggaagacctgccactcaggctgaaagtggtgaaataccctttgcacgcgatcatggagattaaggagtatctgattgacatggcctctcgtgccggaatgcactggttatctaccataatcccaactcatcatatcaatgcccttattttcttttttattgtgtcaaatctgacgatcgatttcttcgcgttctttatccctctggtcattttttacttaagtttcatatcaatggtgatctgcaccctgaaagtttttcaggatagtaaggcctgggaaaattttcgaaccctaacagatctgttgttgcgctttgaaccgaatctcgacgtcgaacaagccgaagtcaatttcggttggaatcacctggaaccctacgctcatttcctcctcagtgtcttttttgttattttcagtttccccattgcttccaaggactgcatcccctgcagtgaactggccgtcattacaggctttttcaccgtcaccagctatttaagtctgagtactcacgccgaaccatacacaagacgcgcattagccacggaggtgactgccggactgctctccctgctacctagcatgcctctgaactggccatatctaaaggttctcggccagacgtttattacggtccctgtcgggcacctggtggtgcttaacgtgagcgtgccatgtctcctgtacgtgtatcttctgtatctgtttttccggatggcccagctgagaaatttcaaggggacctactgttacttagtgccttacctggtgtgtttcatgtggtgtgagctatctgtggtaatcttacttgagtccacggggttaggcctgctccgcgcttccatcggctattttctctttttgttcgcgctcccaattctagtagcgggtctggccctggtgggcgtgctccagtttgctaggtggtttacctccttggaacttaccaaaatcgctgtgacggtagcagtctgttccgtgcccttgctgctacgatggtggaccaaggcttcgttttcagtggtcggaatggtcaagtctctgactcggtcttcaatggtcaaattgatcctggtgtggctcacagctattgttctattctgttggttctacgtgtatcgatccgaggggatgaaagtgtataatagtaccctgacgtggcagcaatacggagccctgtgtggccctagggcatggaaggaaaccaatatggccaggacacagatcttgtgttcccatttagaggggcatcgagtcacctggacgggaagattcaaatatgttagagtgaccgacatcgataactcagccgaaagcgcgataaatatgcttcctttctttattggagactggatgcgttgtctctatggagaggcctatccggcttgttcccccggtaacacctcaaccgccgaagaggaactctgtcggctaaagctgctcgcaaaacatccctgtcatatcaagaaatttgataggtacaagtttgagattaccgtggggatgcctttcagctcaggagctgatgggtctcgttctagagaagaagatgacgtgaccaaagacatcgttctcagggccagctctgaattcaagagtgtgctgttatctttgaggcaggggtctctcatcgagtttagcaccatcctggaaggtcggctcggcagcaaatggccggtgttcgaactaaaagccatatcctgtctgaactgtatggcacagctgtccccaacaaggcgccacgtcaagatagagcatgactggagatcaaccgtccacggcgcagtcaagttcgcctttgatttcttttttttccctttcctcagcgctgcttag

SEQ ID NO: 28767 - DNA, 654 bp, Artificial Sequence
  Description of Artificial Sequence: Synthetic coding sequence
atgtcgtttagaggaggagggagagggggtttcaaccggggagggggtggcggaggattcaacagaggaggatctagtaaccattttcgcggaggcggaggcggaggcggtggcggaaatttccgcggtgggggtaggggaggtttcggacgcggaggaggtaggggcggatttaataagggtcaggatcaggggcctcccgagcgggtggtgcttctgggcgagtttctgcacccctgcgaggacgatattgtctgtaaatgtacaacggatgagaacaaagtgccatactttaacgctcccgtctacctggagaataaagaacagatagggaaagtggacgagatcttcggccagctccgggatttttacttcagcgtgaagctgtctgagaatatgaaagcatcatccttcaagaaattgcagaaattttatattgacccttataagctgctgccacttcagcgctttctacccagaccccctggagagaaggggcctcctcgagggggaggtcgcggaggtaggggcggtgggagggggggtggcggaagaggcggaggtagaggaggaggtttcaggggtggacgaggaggaggcggaggcggattcagaggcggtcggggtggagggtttcggggtagaggacattag

SEQ ID NO: 28768 - DNA, 1590 bp, Artificial Sequence
  Description of Artificial Sequence: Synthetic coding sequence
atgggttgtgtcttctgcaaaaaattggagcccgttgccaccgccaaggaagacgcaggattggagggcgacttcagatcctatggagctgctgaccactacggtcccgacccaaccaaggctcggccagccagctcctttgcgcacattcccaactacagtaactttagtagccaggcaatcaaccctggatttctggattccggcacgatcaggggcgtcagcggtatcggggtgaccctcttcattgctctgtatgactacgaggcccgaaccgaagacgaccttacatttaccaagggtgagaaattccacatcctgaacaatacagagggtgattggtgggaggccagaagccttagcagcggaaaaaccggatgtattcccagtaattatgtggctcccgtggactcaattcaggccgaggaatggtatttcgggaaaattggacggaaagatgcagaacgccagctcctttctccaggcaaccctcagggggctttcctgatcagggaatccgagactacaaagggtgcatatagtctttcaataagggattgggaccagacacgtggcgaccacgttaagcactacaaaattagaaagctggatatgggcggatattacatcacgacccgtgttcaattcaacagcgtgcaagaacttgtgcagcactacatggaggttaacgatggattatgcaacctgctgattgcaccctgtaccatcatgaaacctcagaccttgggcctcgcaaaggacgcctgggaaatatctagatcaagtataactctggagagaagactgggtactggctgtttcggtgatgtgtggctgggaacttggaacggctctacgaaagtcgccgtgaaaaccctgaagccagggacgatgagtcctaaagcatttctcgaggaagcccaagttatgaagcttctgaggcacgacaaactggtgcagttgtatgctgtggtgtctgaggaaccaatttacatcgtgactgagtttatgtgccacggttctttactggattttttaaagaaccccgagggccaagatctgagattgccacaattggtggatatggctgcacaggttgcagagggcatggcgtatatggagcgtatgaattatatccacagagatctgcgagcagctaatattttagtgggggagcggctggcttgcaaaattgcggactttggcctggctcgacttatcaaggatgacgaatataatccctgccagggctccaaatttccgatcaagtggacggcccctgaagccgcacttttcggccgttttacaataaaaagtgatgtgtggtcttttgggattctcctgaccgaactgataactaagggcagaattccctatcctggaatgaacaagagagaggtgctcgaacaggtggagcaggggtatcacatgccatgcccacctgggtgccctgcctccctctacgaggccatggagcagacctggcgattggaccccgaggaaagaccgacatttgagtatttgcagagttttctggaggattactttaccagcgcggagccacaatatcagcctggcgatcagacatag

SEQ ID NO: 28769 - DNA, 1590 bp, Artificial Sequence
  Description of Artificial Sequence: Synthetic coding sequence
atggggtgtgtcttctgcaagaagttagaaccagtggccaccgccaaggaggacgccggactggagggtgacttccgctcttacggcgcagcggaccactacggcccagatcctacaaaggcaagacctgcgagttcgttcgcgcacatccctaactattctaatttcagctcacaggcaatcaaccctggcttcctggactcaggtacgatcagaggcgtaagtgggatcggggtaacgctattcatcgctctgtatgattatgaagcacgaacggaagacgatcttacattcacgaaaggcgagaaattccacattctgaataacacagagggagattggtgggaagctaggtcattgtcaagcggcaagaccggatgcatacctagcaattacgtggctccggttgatagcatacaagccgaagagtggtactttggtaagattggcagaaaggatgccgagcgtcagctgctttcccccggaaatccacaaggcgcattcttgatacgcgaaagcgaaacaactaagggagcttactcactcagcatcagggattgggatcagactcgcggtgaccacgttaagcactataagattcgtaagctcgacatgggcggttattatatcacaaccagggttcagtttaattcggttcaggagcttgtacagcattacatggaagttaatgacggtctgtgcaacctcctcatagccccatgcactatcatgaagccccagaccctcggtcttgctaaggacgcctgggaaattagtcgcagttcaataaccctggaacgacgactgggaaccggatgcttcggcgatgtgtggctggggacctggaacgggtcaacaaaagtcgctgttaaaacgcttaaaccagggaccatgtctcccaaggccttcttagaggaagcacaagttatgaaactcctgcgccacgacaaactggtgcagttgtatgcagtggttagtgaggagcctatctatatagtgactgaattcatgtgccatgggtcactcctggattttttgaagaatccagagggacaagacctacgcctgcctcagctcgtagatatggctgcgcaggtggccgagggcatggcttacatggagcggatgaactacatccatagagacctgagagcagcaaacattcttgtgggagagcggctagcatgcaagattgctgacttcggcctcgccagactcatcaaggacgatgaatacaatccctgtcaaggcagcaaattcccgatcaaatggaccgccccagaggcagccctattcggccgatttacgattaagtctgacgtctggtccttcggaatactgctgacagaattgattactaaaggtcggatcccatacccaggaatgaataaaagagaagttctggagcaagtggagcaaggttaccatatgccctgccctccagggtgccctgctagcttatatgaggctatggagcaaacttggaggctggacccagaagagagaccaacttttgaatatttgcagtcttttcttgaagactatttcacgagcgccgagccccagtatcaaccaggagatcagacttag

SEQ ID NO: 28770 - DNA, 1590 bp, Artificial Sequence
  Description of Artificial Sequence: Synthetic coding sequence
atgggctgtgttttttgtaaaaaattggaacctgtggctactgccaaagaggatgctggccttgaaggtgactttcgcagttacggcgctgcggaccactacggtcccgatcctactaaagctaggccagcttcgtcttttgcccacattccgaattatagtaattttagctctcaggcaattaacccagggttcctcgacagcgggaccattcggggagtctctggcatcggcgtgacattgttcattgcattatacgattacgaagctagaacagaagatgacctgaccttcaccaagggggaaaagttccatattttgaataacacagaaggggactggtgggaggccagatcgcttagttccggaaagactgggtgcatcccgagcaactacgtggcccctgtggacagtatccaggctgaggagtggtatttcggtaaaatcggtcggaaggacgccgagagacaactgctcagccccggaaaccctcagggtgctttccttattagggaaagtgaaacaacgaagggggcatattctctctctattcgagactgggaccagacaagaggtgatcacgttaagcactacaagatcagaaagctggatatgggcggatactacattaccacccgcgtgcagttcaatagcgtgcaagaactggtacagcattacatggaggtgaacgatggtctctgtaacttattaatagcaccgtgtacaataatgaagccccaaaccctgggactggcaaaagatgcttgggaaatctcaagaagcagcatcactttggagaggcgacttggaacaggttgctttggtgacgtctggcttgggacctggaacggctctaccaaagtggcggtcaagactttaaagcccggaaccatgtctcccaaagcattcttagaagaggcgcaggtgatgaaattgttgcgacacgacaagctggtacagctatatgcagtcgtgtccgaggaaccaatatacattgttaccgaattcatgtgccacgggtctctcctggacttcctaaagaatccagaagggcaggatctgcggctgccccagctggtggatatggccgctcaagtcgcagaggggatggcctatatggagagaatgaactacattcatagagatctaagagccgctaatattcttgtgggagagcgattagcatgtaagatcgcggatttcggcctggcaagattgataaaggatgacgaatataacccatgccagggctcaaagttccccattaagtggaccgctcctgaggcggcactttttggcagattcacgataaaatctgacgtttggtcttttggcatcttactaaccgagttgattacaaaaggtcggataccctaccctgggatgaataagagggaggtgctggaacaggttgaacaaggctaccatatgccttgcccaccaggctgccccgcttctctctatgaagccatggagcagacctggcgactggatccggaagagaggcccacgtttgagtatctccagtcctttctcgaagattactttaccagtgctgagccgcagtaccagccaggagatcagacctag

SEQ ID NO: 28771 - DNA, 1590 bp, Artificial Sequence
  Description of Artificial Sequence: Synthetic coding sequence
atgggctgcgttttctgtaagaagctggaaccggttgccaccgctaaagaagacgccggattggaaggcgactttcgctcttacggcgcagcagatcactacgggccagaccctacaaaagcaaggccggctagttcctttgcgcatattccgaactactctaacttctcttcccaggccatcaatccaggcttcttggatagcggtacaattcgcggagtgagcgggattggtgtgaccctcttcattgccttatacgattacgaggcacgcacggaagacgacctgacattcactaagggagagaaatttcacatcctgaataacacagagggtgactggtgggaggccagaagcctgtctagtggcaaaaccggttgcatcccaagcaactacgtggcccctgtggattcgattcaggcagaggagtggtatttcggcaagattggcaggaaggatgcagagcgccagctgctgtctcctggcaacccccagggcgcattcctgatcagagaatcagagacaaccaagggcgcttacagtctgtcaatccgcgactgggaccagactaggggcgatcatgtaaaacattacaaaatccgaaagctggatatgggaggatattacatcacgacaagggtccagtttaacagcgtccaggagctcgtccagcattatatggaagtgaatgatggtctgtgcaacctccttatcgccccttgcacaatcatgaaacctcaaacgctggggctggcaaaggatgcgtgggagatctctaggtcttcgatcacgctggagaggcgccttggtaccgggtgctttggtgacgtgtggctgggaacatggaatgggagtaccaaagtggccgtgaagaccctgaagcctgggaccatgagccccaaagcgtttctagaggaagctcaggtaatgaagctgctgagacacgacaagctggtacagctttatgccgtggtgtctgaggaacctatctatatagtgacggaatttatgtgtcacgggtccttgttggactttctgaaaaaccccgaaggccaggacctgaggctcccacagctggtcgatatggccgcacaggttgccgagggaatggcctacatggagcgtatgaactatatccaccgtgacctgcgcgctgccaacatcctggtcggtgagcggttagcctgcaagattgcagacttcggcctggctaggctgattaaggatgatgagtataacccctgtcagggaagtaaatttccgattaaatggaccgcacccgaagctgcactgtttggtagattcactatcaaaagcgatgtgtggtctttcggtatactccttacagaacttatcacaaaggggaggatcccctatccaggcatgaataaacgagaggtgctggaacaggtggagcagggttaccatatgccctgccctccgggttgccccgctagcctctatgaggctatggaacagacttggcggctcgacccagaggagaggcctaccttcgagtatttgcagtcatttcttgaggattactttacctcagcagagcctcaatatcagccaggcgaccagacatag

SEQ ID NO: 28772 - DNA, 942 bp, Artificial Sequence
  Description of Artificial Sequence: Synthetic coding sequence
atgggttgcgtgttctgtaagaagctggagcctgtggcaacggcaaaggaggacgcaggactggagggggattttcggagctacggggcagccgatcactatggacctgatcctacgaaggcgagacccgcttctagttttgcccacatccccaactacagtaacttctccagccaagcaatcaatcccggattcctggattcagggacgatccgtggggtaagcggaatcggggtcaccctttttatcgctctctatgattatgaagccagaaccgaagacgacctgacattcacgaaaggggaaaagtttcatatcctgaacaatactgaaggggattggtgggaagcacgctctctgtctagtggtaagacgggatgtattccctctaactatgtggcaccagtcgacagcatccaggctgaggagtggtatttcggcaagattggacgcaaggacgccgaacgccagctgttgtctcccggaaatccccaaggcgcttttctgattcgtgagtcagagacgacgaaaggtgcatacagcctgagcattcgagactgggatcagactcgtggcgaccacgtcaagcactacaagatccggaagctggacatgggtggctattacattacaacccgggttcagttcaactctgtccaggagctggtacagcactacatggaggtcaacgatggcctgtgtaatctgctgatcgcgccttgtactattatgaagccccagaccctcggattggccaaggatgcctgggagatcagtcgaagcagcatcacactcgaaaggaggctcgggacgggttgcttcggtgacgtttggttgggaacctggaatggttccacaaaggtggctgtcaaaacactgaaacccggtaccatgtccccaaaagcttttctggaggaagcccaagtgatgaaattgctgtag

SEQ ID NO: 28773 - DNA, 1392 bp, Artificial Sequence
  Description of Artificial Sequence: Synthetic coding sequence
atgggttgtgtattttgtaagaagctagagccagtcgcaactgccaaggaggacgcgggactcgagggcgactttcgttcatatggcgcagccgaccactacggtccagatccaacgaaagcgaggcctgcctcgtcttttgctcatatccctaactatagtaacttttctagccaggcaataaatccgggtttcctggacagcggaacaatacggggagtttccgggataggcgtaaccctcttcatcgccctgtacgactatgaggcgaggaccgaggacgacctgactttcacgaagggggagaaatttcacattctgaacaacacggaaggggcatattcactgagcattcgagactgggaccaaaccagaggggaccatgtgaaacattacaaaatccggaaacttgatatgggcggatattatataacaacaagggtgcaattcaacagcgttcaggagctggtccagcattacatggaggtgaatgatggattatgtaaccttctaatagcaccttgtaccattatgaagccccaaacactcggcctcgccaaggatgcctgggagatcagtaggtcttctatcacattggagcgcaggctcggtaccggatgctttggagacgtctggctcggcacttggaacggaagtacaaaggttgcagtgaagaccttaaagccaggcacgatgtcccccaaagcgtttctcgaagaagcccaagtgatgaaactgctcagacatgataaactggtgcagttatatgctgtggtctctgaagaacctatttacatagtgacagaattcatgtgccacggctcacttctcgacttcttaaaaaacccagagggtcaggatctcaggcttccccagctcgtggacatggcagcccaggttgccgaagggatggcctatatggagagaatgaattatatacatagagacttgcgggctgcgaacattcttgtgggggaacgattggcttgtaagatcgccgatttcggactggccaggctgattaaggatgacgagtacaacccatgtcaaggatcaaaattcccaatcaagtggacagctcctgaagccgcactcttcggtcgtttcactatcaaatctgacgtctggtcattcgggatactcctgaccgagctcatcaccaaaggacgtatcccatatcccggtatgaacaaacgcgaggtcttggaacaagtggagcaggggtaccatatgccttgccctcccggatgtcccgcaagcctgtacgaggccatggaacagacatggcgactggaccccgaggaaagacccacattcgagtatctgcaatcattcttggaagactatttcacttcggcagagcctcagtatcaaccaggcgatcaaacctag

SEQ ID NO: 28774 - DNA, 1005 bp, Artificial Sequence
  Description of Artificial Sequence: Synthetic coding sequence
atggagttccccggtctcggttctctggggacctcagaaccactgccccagttcgtggaccctgccctcgtgagcagtactccggaatctggcgtgttctttcccagcggacctgagggacttgatgccgcagcctcctccactgcacccagtacggcaaccgccgctgcggcagccctggcatactatcgggacgcggaggcctacagacacagtcctgtctttcaggtgtaccccttattgaactgtatggagggaatcccaggagggagcccatacgccggttgggcctatggtaaaactgggctttatccagcgtccactgtgtgcccaacaagagaggattctccacctcaggctgtcgaggacctcgatggcaagggcagtacttctttcctcgaaacactcaagaccgagcgactcagccccgacctcctgacgttgggcccagctctgccgtcaagtctgccagtgcctaattccgcttacggcggacccgacttctcttctactttcttctcgccgaccgggagtccgctgaatagtgctgcgtactcatcaccgaaactgcgtggtaccctgccactccctccctgtgaggcgcgagaatgcgtgaattgtggggcaaccgccacaccactctggcgcagagaccgaactggtcattacttatgcaatgcatgcggactgtatcacaagatgaatggccaaaatcgtcccctcatccgcccaaagaagcggctgatagtgtccaaaagagctggcactcaatgcaccaattgtcaaacgacaacaacaactctgtggaggaggaatgcgagcggtgacccagtctgcaacgcatgcggcctgtattacaagctccaccagcattattgcggcggtagcgcgcaactgatgcgcgcacagagcatggcgagcaggggcggtgtggtttctttttcatcttgttcccagaactccggccaaccaaaatcacttgggccaaggcaccccttggcatag

SEQ ID NO: 28775 - DNA, 1242 bp, Artificial Sequence
  Description of Artificial Sequence: Synthetic coding sequence
atggagtttccgggactaggaagccttggtacctcagagccactcccccagttcgtggaccccgctctcgtgagcagcacacccgagtccggggtgtttttcccctccggccctgaggggctcgacgccgctgctagctcaaccgccccttcgaccgccaccgctgctgccgctgctcttgcgtattacagagatgcagaagcctaccgccactcacctgtctttcaggtataccccctcctaaactgtatggaaggaattccgggaggttcaccctatgctggatgggcgtacggcaaaaccggcctctaccccgctagtacagtctgccctactcgtgaggactctccccctcaggccgtggaagacttagacggcaaggggagcactagctttctggaaacccttaagacggagcgccttagccctgacctcctcacgctcggtcccgctctgccgagcagcctgcctgtccctaacagtgcctacggagggcctgacttcagcagcaccttcttttctcctacaggctctcccttgaacagcgcagcttacagctctcccaaactgcggggaacgctgcccctgccaccgtgtgaggcccgagaatgcgtcaactgcggcgcaactgccacaccactttggagacgtgataggaccggtcactatttatgtaatgcatgcggcctgtaccacaagatgaatggccaaaatcgaccgctgattagacccaagaagaggttgattgtgtctaagcgcgcagggacccagtgtaccaactgtcagacaacgaccaccaccctgtggcgaaggaacgccagtggcgatcccgtgtgcaacgcttgtggcctttattacaaactccatcaagtcaatcgaccactgacaatgagaaaagatggcatccagacacggaaccgcaaggcttctggaaagggcaagaaaaaacggggtagctctttggggggtactggggctgccgagggcccagccggaggttttatggtagtggctggcggaagcggaagcgggaattgtggggaggttgcttccggactgacactagggccacccggaacagctcacctatatcagggcctaggtcccgttgtcctgagtggcccagtctctcacttaatgccattccccggtccgctactcggctcaccaaccggaagcttcccaacaggccctatgccccctactacctccactaccgtagtcgcgccactcagctcctag

SEQ ID NO: 28776 - DNA, 369 bp, Artificial Sequence
  Description of Artificial Sequence: Synthetic coding sequence
tgacagaatcgtcccctgatccgtcccaaaaaacggttgatcgtgtccaagcgggcaggcacacaatgcaccaactgccaaaccacaaccactactctttggagaagaaatgcaagcggcgatccggtgtgtaacgcctgtggtctatactacaagctgcatcaggtcaaccgtccccttaccatgcggaaagacggcatacagacaaggaaccggaaagcctcaggcaagggcaagaaaaaacggggttcctcactggggggtactggagcagcagaaggcccagcactgttatggtggctccgcagcgctcacgaaggtacagagcacgggctgcagaggagaggtggcgtactgcttctactttag

SEQ ID NO: 28777 - DNA, 1332 bp, Artificial Sequence
  Description of Artificial Sequence: Synthetic coding sequence
atggaggtgaccgccgatcagcccagatgggtttcccaccatcatcctgccgttctgaatggtcagcatcccgatacccaccaccccggattatcacacagctatatggacgccgctcagtatcccttgcctgaggaggtcgatgtattattcaacatcgatggtcaaggtaaccacgtgccaccctattacggcaacagcgtgagggctaccgtccagaggtacccacctacccaccacggaagtcaggtgtgtagaccgcctttgctccacggttctcttccatggctggatggaggcaaggctctcggatcgcatcacacagccagcccttggaacctctcacctttctccaagacctcaattcaccacggaagccccggtccactgtccgtttacccccctgcctcgtcctcctctctaagtggtgggcatgcctccccacatctcttcaccttcccaccaacgccccctaaggacgtgagccccgacccatctctctcaactcccggaagcgcagggtcagctaggcaggatgaaaaagaatgcttgaagtaccaggtgcccttgcctgattccatgaagctggagagcagccattcgaggggtagtatgactgccctggggggtgcgtcttcatccactcaccatcccattacaacctatccgccatatgtgccagaatacagctctggtttattcccaccgtcttccctgttggggggatcaccaactggatttggctgcaagtcgcggcctaaggcgaggagtagcactggacgagaatgtgtgaattgcggggctacgtcgacgccattatggcgtcgggacggcacaggccattatctgtgtaatgcatgcggcctataccataagatgaacgggcagaatcggccacttatcaaaccgaaacgcagactgagcgcagcacggagagccggtaccagctgcgctaattgtcagaccactaccaccactctctggcggcgaaatgctaacggtgatcccgtgtgcaacgcttgcggactttactataagttgcacaatatcaatcggcctctcaccatgaagaaggagggtatccagactcgaaaccgtaaaatgtcctctaaatccaaaaagtgtaaaaaggtgcacgattcccttgaggattttcctaagaactcctcctttaatcctgccgcactgtcccgacatatgtcgtccctttctcatatatcgccattctctcattcatcccatatgttgacaaccccaaccccaatgcacccaccttcatcattatcgtttgggccacatcatcccagttcaatggtaactgcaatgggatag

SEQ ID NO: 28778 - DNA, 1335 bp, Artificial Sequence
  Description of Artificial Sequence: Synthetic coding sequence
atggaggtgaccgccgatcaacccaggtgggtgagccatcaccacccagcggtgctgaacgggcaacaccccgatactcatcatccaggactatcgcatagctacatggatgcggcacaatacccacttcccgaagaagttgacgtgttatttaatatcgatggacaaggaaatcacgtcccgccatactacggaaacagcgtgcgggcaaccgtgcaaaggtacccacccactcatcacggctcacaggtgtgtcggcctcctttgctccatggttctctgccttggctcgatggtggcaaggcactcggaagccaccatacagcctccccttggaatctctcccccttcagcaagaccagcatccaccatgggtcaccaggccctctgtcagtgtacccaccagcctcttcttcatccctcagcggaggccatgcctccccccatctgttcacttttccccctactccccctaaagatgtgtcacccgatcctagtctgagtacaccgggaagcgcagggagcgccaggcaagacgaaaaggaatgtctcaagtatcaggtacccctgcctgactcgatgaaactcgaatcatcgcattcccgcggaagcatgacagccctgggtggggctagtagctccacccaccatccaattaccacctatcccccttacgtacctgagtatagcagtggtcttttccccccttctagtttgctcggcggaagccctaccgggtttggatgcaaatcgcgcccaaaagcaagaagctctacagagggccgtgagtgcgtgaactgtggggctacctcaactcctctgtggagacgagacgggacgggccactatctgtgcaatgcatgtggcctttaccataagatgaacggccagaataggccacttattaagccgaagcgtaggctctcagcagccagacgggcagggactagttgcgcaaattgccagaccactactactacgctgtggcgtcgcaacgccaatggggaccctgtttgcaacgcctgtgggctttactacaagttgcacaacattaatagacccctgacaatgaaaaaggaaggtatacagacacgcaaccggaaaatgagttctaagagcaagaagtgcaaaaaggtccatgacagcttagaagacttccccaaaaattccagtttcaatccggctgctctaagtaggcatatgtcaagtctctctcacatcagccctttcagtcacagctctcatatgctgacaacgcccacacctatgcacccacccagcagtctgtccttcggaccccaccatccgagcagtatggtcacagccatgggctag

SEQ ID NO: 28779 - DNA, 393 bp, Artificial Sequence
  Description of Artificial Sequence: Synthetic coding sequence
atggaggtgacggcagaccaacccaggtgggtctcccaccaccatccggcagtgcttaatggacagcatcctgatacccatcaccccggtctgtcccattcatatatggatgcggctcaatatcccttgcctgaagaggtggatgttctgttcaatatcgatggtcaaggcaaccacgttcccccatattatggcaactcagtccgagccactgtccagagatacccacctacccatcacggaagccaggtttgtagacctccactgctgcacggttcattgccctggctggacggcggtaaggctctcggctcgcatcataccgcgtccccctggaatctacgtccttgcttacaatgcctgtgggccctacttcaggcctcacaatgctag

SEQ ID NO: 28780 - DNA, 798 bp, Artificial Sequence
  Description of Artificial Sequence: Synthetic coding sequence
atgcgcagggccgagcttgcaggactgaaaaccatggcttgggttcctgctgaatcagcagttgaagaacttatgccaagactgctgcccgtggaaccatgcgatcttactgagggctttgatccctccgttccacccaggacgccccaagaatatctccgaagggtgcagatcgaagccgctcaatgtccggacgtggtggttgcccagattgacccaaagaagctcaagaggaagcagtctgtgaatatttcgctgagcggatgccagccagctccagaaggatactctccaaccctccagtggcagcagcagcaggtggcgcagttttccaccgttcgccagaatgttaacaaacataggagccactggaagagtcagcaactggactcaaacgtgactatgcccaagagcgaagatgaggaaggatggaagaaattttgcctgggagagaagctctgcgcagacggtgccgtggggcctgccaccaacgagagccctggaatcgactatgttcaggcaaccgtgacctctgtgttggaatatctgtcaaactggtttggcgaacgcgactttactcctgagctcggacgatggctctacgcccttttggcctgcctggaaaagcccctactgccagaagcccactctttaattagacaactggctcgcaggtgttccgaggtcagattactggtcgactctaaagacgatgaacgagttcctgccctcaatctcctgatttgcctcgtaagccgctactttgatcagcgggacctcgctgacgagccttcgtag

SEQ ID NO: 28781 - DNA, 843 bp, Artificial Sequence
  Description of Artificial Sequence: Synthetic coding sequence
atgagacgcgcagagttggcaggcctgaaaaccatggcctgggtacccgcagagtcagccgtggaggagctgatgcctcgccttttgcccgtggaaccctgtgatttgacagagggctttgacccctcggtgcctccccgtacaccgcaggaatacctgcggagggtccaaatcgaggccgcacagtgtccagacgtagtagtggcgcaaattgatcccaaaaaactgaagcggaagcagagcgtgaatatatctctctctggttgtcaacccgcacccgagggctattctccgaccctgcaatggcagcagcagcaggtagctcagttctctactgtccgccagaatgtgaacaagcaccgctcccattggaagtcacagcagctcgactcaaatgtgacaatgcccaaatcagaggatgaggagggctggaaaaaattttgcctgggcgagaaactatgcgcagacggagctgtgggaccggctactaacgagtcacccggtatcgactatgttcaaatagggtttcctccgcttctgtcaattgtctcgcgtatgaaccaggccactgtcacatcagttctggaatatctgtcaaactggtttggagaacgtgactttacacctgaactggggcgatggctgtacgccctactcgcctgtttggaaaagcccctgctacccgaagcacacagcctgatcagacagctggcacggaggtgcagcgaagtaagactgctggtagatagtaaggatgacgagcgagtccccgctctgaatctgcttatttgcttggtcagccggtacttcgaccagcgggacttggcagacgagccatcttag

SEQ ID NO: 28782 - DNA, 753 bp, Artificial Sequence
  Description of Artificial Sequence: Synthetic coding sequence
atgcgcagggccgaactggcgggactgaagaccatggcttgggtgcctgcagagtcagctgtggaggagctaatgccgaggctactgccagtggagccatgtgacttaacagaaggctttgaccctagcgtgccccctaggacacctcaggaatatctgcggcgtgtgcagattgaagcggctcaatgtccagatgttgtggtcgctcagatcgatccaaaaaagctgaagaggaagcagtcagtcaatatttcccttagcggctgccagccagctccggaggggtatagccctacattacagtggcaacagcaacaggttgcccagttttctaccgtgcgccaaaacgtgaacaagcacaggtcccattggaaaagccagcaactggatagtaacgttaccatgcccaaaagcgaggacgaggagggctggaagaaattttgcctgggggaaaagctgtgcgccgatggcgctgtggggcctgcaaccaatgagtcccccggtatagactacgtccagatcggattcccgcctctgttatccatagtctcccggatgaatcaggccactgtgacatcggtcctggaatacctgtcgaattggtttggtgaacgtgatttcacacctgaactgggaaggtggctgtacgcactccttgcctgcctggaaaaacctctcctcccagaggcccactctctaattcgacagctggccaggagatgtagtgaggtgcgtctgcttgtggtgttttag

SEQ ID NO: 28783 - DNA, 768 bp, Artificial Sequence
  Description of Artificial Sequence: Synthetic coding sequence
atggacgtgatggacgggtgtcaattctccccttccgagtatttctatgatgggtcgtgcataccatcacccgagggggagttcggtgatgagtttgtgccacgggtcgccgcattcggagcacacaaggcagaactgcaggggagcgatgaggatgaacatgtaagagcgcctaccggtcatcatcaggctggccattgcctaatgtgggcatgtaaagcatgcaaacggaagtcaacaactatggatcgcagaaaggcggctactatgcgcgagagacgcagactgaagaaggtgaaccaggctttcgagacgcttaagcggtgcactacaactaaccccaatcagcggctacccaaagtagagattctgcgaaatgctattagatacatcgagtccttgcaggaactgctgagggagcaggttgaaaactattatagcctccccggacagtcctgcagcgagcctacgagtcctacctctaactgttctgacgggatgcctgaatgcaattcacccgtttggtcccgcaaatcatccacctttgacagcatctattgtcctgacgtgtcaaacgtatatgccaccgataagaactcgctgagctcgcttgattgcctctctaacatcgtcgatcgcatcacttcaagcgagcagccaggtctcccacttcaggaccttgcatccttgtctcctgtcgcatcaacagattcacagcccgctactcctggggcttctagctccaggctgatctaccacgtgctctag

SEQ ID NO: 28784 - DNA, 1725 bp, Artificial Sequence
  Description of Artificial Sequence: Synthetic coding sequence
ctgagtccatccttgggatttccggctcagatgaaccaccagaaggggccaagcccttctttcggtgtgcagccttgcgggccacacgatagcgcaagaggtggtatgatcccacacccacagagtcggggtccttttcccacctgccagctcaagagcgagcttgacatgctagttgggaagtgtagggaggagcctctcgaaggggacatgtcgagtccaaattctaccggtatccaggacccgctgctggggatgttggacggccgagaagatttggaaagggaagaaaaaagggagcctgagtccgtgtacgaaacggactgcaggtgggatggatgtagccaggaattcgattcacaggagcaactcgtgcatcacataaactcagaacacatccatggtgaaagaaaagaatttgtttgccactggggaggatgcagccgagaattgcgtccatttaaagcacaatatatgctggtggtgcatatgcgacggcacacaggcgaaaaaccacacaagtgcacattcgaaggttgtagaaaatcctacagcaggcttgagaacttgaagacccatctgcgttcacacacgggcgagaagccatacatgtgtgaacacgagggttgttctaaagcatttagcaatgcatcggacagagcaaagcaccagaaccggacacattctaacgagaagccatatgtctgcaagctcccgggatgtaccaagaggtacacagatccctcttctctacgcaagcatgtcaagactgtccacggcccagatgcccatgtgaccaaacgtcaccgaggtgatggccctctccccagagcccctagtatttctacagtggagccgaagagagaacgcgagggcggaccaatccgagaagaaagcagactgactgtgccagaaggagccatgcctcctcaccctcaaccactgttttcacattacccccagcctagccccccacagtacttgcagagtgggccttacactcagccgccacccgattacttgccctcagagcccaggccttgcctggatttcgattcccctacacatagtactggccagctcaaagcacagctcgtgtgcaactacgttcagagccagcaggagttgctgtgggaaggagggggacgcgaggacgccccagcccaggagccttcttaccaaagccctaagttcctaggcggtagccaggtaagtccgtctcgcgctaaggccccagtcaacacatacggccctggctttggcccaaacctgcctaaccataagagtggtagctatccaacaccctctccttgtcacgaaaatttcgtagtcggtgccaaccgcgcatcgcaccgtgcagcagctccacctcgcttactgccccctttgccaacgtgctatggccctcttaaggttgggggaactaacccaagctgtggtcacccagaggtgggcaggctcggtggagggcctgccctgtacccccctcccgagggccaggtgtgtaaccctctggattcactcgaccttgataacacccagctggattttgtggctatattagacgagccacaggggctaagtccacctccatctcatgatcagcgcggttctagtgggcatactccaccgcctagtggccctcctaatatggctgtgggcaacatgtccgtgctcctacgcagtctgccaggcgagactgagttcttgaattccagtgcctag

SEQ ID NO: 28785 - DNA, 390 bp, Artificial Sequence
  Description of Artificial Sequence: Synthetic coding sequence
atgtttaacagcatgaccccacccccaatctccagctatggcgagccttgctgtctccgcccattgccctctcagggagccccaagtgtaggaacagagggactaagcggtccaccattctgccatcaagccaatctgatgtcaggaccacactcgtacggtccagcccgagagaccaactcatgtaccgaagggcctctgttctctagccctcggtcagccgtgaagttgaccaaaaaaagggcattaagtatcagtcccctgtccgacgcctctcttgatctccagactgtgatccgtactagtcccagttccctggtggcgtttatcaacagtcgatgcacatcacctggtggcagctacggacatttgtctattggaactatgtag

SEQ ID NO: 28786 - DNA, 3198 bp, Artificial Sequence
  Description of Artificial Sequence: Synthetic coding sequence
atgtttaacagtatgacacccccacccatatcaagttacggcgaaccttgttgtctccgtccccttccatcccagggggcacccagcgtgggcacggaggtgaaactgaccaaaaaacgagcccttagtatctctcccttaagcgatgcctccctggacctgcaaaccgtgatcaggacatctccctcgtccctcgtggcctttatcaatagtcggtgtaccagccctggcggatcatatggccatctgtccattggaacaatgagcccttctcttgggtttcccgcacagatgaaccaccaaaaggggccaagccccagcttcggcgtccagccatgtggcccacatgatagcgcaaggggcggaatgattccccacccgcagtctcgaggaccatttcccacctgtcagctcaaatccgagctggacatgctcgtgggtaagtgtcgagaagagccactggagggcgacatgtcatcgccgaatagcactgggatccaggatccgctgctcgggatgctggatggcagggaagacttagaaagagaagaaaagcgcgagccggaatccgtgtacgagactgattgcaggtgggatgggtgttctcaggaattcgattcacaggagcagctggttcatcacattaatagtgagcacattcacggggaaagaaaggagttcgtatgtcattggggagggtgtagtcgcgaactgagaccgtttaaggcccaatatatgcttgtcgttcacatgaggcgccacactggcgagaagcctcataaatgtacttttgaaggctgtagaaagagctatagtcgtttagagaatctcaaaacccacttgagatcacacacaggagagaagccctatatgtgtgagcatgaaggttgtagtaaggctttcagcaatgcttcggaccgcgcaaagcaccagaacaggactcacagcaacgaaaagccttacgtttgcaagctgccaggatgtacaaagcgatacacggatccatcgagccttcggaaacacgtcaaaactgtgcatggtcctgatgcccacgtgactaaacggcatcgaggggatggacccctcccaagggcaccatccatctctactgtggagcctaagcgtgagcgcgaaggcggacccatcagagaagaatctcgtctcacagtgccggaaggagccatgaaaccccagccatcccccggagcacagtctagctgtagtagcgaccactccccggctggctccgcagccaatacagacagtggcgtggaaatgacgggcaacgctgggggatctactgaggaccttagctctttggatgagggaccctgcattgcagggacaggcctgagcacgctgcgacgccttgagaacttacgtctcgaccagttacatcagctgcgccctatcggtacccgtggacttaagctgcctagcctttctcacacgggcactacagtctccaggcgggttgggcctcccgtctctctcgagagacgctcatcctcttctagttcaatcagcagcgcttacacagtctctcggcgaagttcacttgcaagcccgttcccgccagggagcccacctgaaaacggagcatctagcctgccagggctgatgcccgcacagcattacttactgagagccaggtacgctagtgccagaggaggaggcacgagtcctactgcagccagtagtcttgacagaattggaggcctcccgatgcccccatggagaagtagggccgagtaccccggatataaccccaacgccggtgtcacaaggagggcatctgatcctgcccaagccgcagatagacctgctccagctagagtgcagcgattcaagtccctgggctgcgttcatacaccccctactgtcgctggagggggtcagaactttgacccttatctacccacttcagtctatagccctcaaccacctagcattacggaaaacgccgctatggatgctagagggctacaggaggagccggaggtaggtacaagtatggtcgggtctggtctgaacccttatatggatttccccccaaccgacaccctggggtacgggggtccagagggggctgccgctgagccctatggggctaggggtccaggctcactgccccttggccctggccctcccacaaactacggtcctaatccctgtccccagcaggctagttaccccgatcctactcaagaaacctggggggagtttccatctcacagtggactttacccgggacctaaggcattaggcggaacctatagtcagtgccctcgcttggaacattacgggcaggtgcaggtgaaacctgagcagggatgccccgtgggaagcgacagcactggccttgctccatgcctaaatgcccacccctccgaaggcccacctcaccctcagcctctcttctcacactacccccagccatctcctccacagtacctacagtcgggcccttacacgcagcccccacctgactacctgccttccgaacccagaccttgtctggacttcgattctcccacacattcaactggccagctgaaggcacaactggtgtgtaattatgttcagtcacagcaggaactgctgtgggagggcggagggagggaagacgccccagcgcaggaacccagctatcagtctccaaaattccttggtggatcacaagtgagtccaagtcgggctaaagccccagtgaacacttacggcccaggctttggccctaatctccccaaccacaaatctggttcctacccaactccctccccttgtcatgaaaatttcgtggtgggcgctaacagagccagccatagggccgctgctccaccacgcctgctgccccctctgcccacctgttatggacctcttaaagtgggaggtacaaacccatcttgcggacatccggaagtgggcagattggggggtggccctgccctgtatcctcctcccgaggggcaggtttgtaatcccctggatagcctggacctggacaatactcagctggacttcgtggctatactggatgagccacaaggcctatcccctcctccatctcacgaccagaggggaagctcaggacacactccaccaccaagcgggccacctaacatggcagtaggcaatatgtccgtgctactcagatctctgccaggagaaaccgaatttttgaacagctcagcctag

SEQ ID NO: 28787 - DNA, 528 bp, Artificial Sequence
  Description of Artificial Sequence: Synthetic coding sequence
atgagccctagtctgggctttccggctcaaatgaaccaccagaagggtccttcccctagtttcggggtgcagccatgtggacctcatgatagcgccagggggggaatgattccccacccccagtcccgtggtccatttcctacctgtcaactgaaatcagagctggacatgcttgtagggaagtgccgggaagaacccctcgaaggcgacatgtcttctccaaattctactggtattcaggacccccttttgggtatgctggatggcagagaggatttggaaagagaggagaaacgcgagcctgaaagcgtgtacgagacggactgtagatgggatggttgcagccaggaatttgattctcaggaacagctcgtacaccacatcaattccgagcatatccatggcgagaggaaggagtttgtttgccactggggtggctgcagcagggagctgcgcccattcaaggcacagtacatgctggtggttcatatgaggcggcacacaggggagaagccccacaaatgttag

SEQ ID NO: 28788 - DNA, 2937 bp, Artificial Sequence
  Description of Artificial Sequence: Synthetic coding sequence
atgagtccttcactcggttttcctgcccagatgaatcatcaaaaggggccttccccaagttttggcgtccagccctgcggtccccatgactctgcccgaggtggcatgatcccccaccctcagagcaggggaccttttccgacttgtcagctgaagagtgagctggatatgttggttgggaagtgccgagaagagcccctagaaggggatatgtcctctccaaactccaccgggattcaagatcccctgctcggaatgctcgatggccgtgaggacttggagcgcgaagaaaagagggaaccagagagcgtctatgagaccgattgccgttgggatggttgtagtcaggagtttgactcgcaggagcagctggtccaccatataaacagcgaacacatacacggagaacgtaaagaatttgtttgccattggggaggttgttcccgggagcttcgaccattcaaggcccaatatatgctggtggtacacatgcgacgccatactggcgaaaagccccataagtgtacctttgaaggatgcaggaagtcatattccagactggagaatttgaagacacacctgaggagtcacacaggggagaaaccgtacatgtgtgaacatgaaggatgctccaaagcgttttcaaacgctagtgatcgagcaaaacaccagaatagaacccactccaatgaaaagccctacgtgtgtaagctgccaggttgcactaaacggtacactgacccttcgtctctgaggaaacatgtcaaaacagtgcacggccctgatgcccatgttacaaagcgacacagaggggatggaccactcccacgggctccttccatttcgacggttgaacccaaaagggagcgggaaggaggccctattcgagaggaaagcaggttgactgtgccagaaggagccatgaaaccccaaccatcccccggtgcacagtcatcctgttcatctgatcatagtccggctgggagcgccgctaacacagacagcggggtcgaaatgactgggaatgctggcggatcaacagaagacttgagcagcctggacgaaggaccctgtattgctgggaccggactaagcacccttagaaggctggagaatctacggcttgaccagctccaccaacttagacctattggaactcggggtctgaagttgcctagcttgtctcacactggcactacagtgagtagacgggtcgggccaccggtctccctggaaagaaggtccagctccagtagctccatatcatctgcatataccgtttctagacgcagctccctcgcttcaccatttcctccgggttcccctcctgaaaatggtgcctctagcctgcccggactgatgcctgctcagcattatttactgcgtgcgagatacgcttctgctcgaggcggaggtacatcacccactgccgcttcatcacttgacagaatcggaggactgcccatgccaccatggagaagcagagccgagtatccaggatataaccctaatgccggtgttacacggcgagccagcgatccggctcaggccgctgaccgacctgcacccgctcgcgtgcagagatttaaatcgctgggctgcgtccacactccacccaccgtcgccggtgggggacaaaacttcgacccctatctgcccacctccgtgtacagtccacagccaccctccatcacggaaaatgccgctatggatgcccgtggcttacaggaggaacctgaagtagggacctctatggtggggtccggcctgaatccctatatggattttcctccgacagacactctggggtacggaggacccgagggcgcagctgctgagccctatggagctcgcggtccaggaagcttacctttgggaccgggtccccctacaaactacggccctaatccttgcccccagcaggctagttaccccgatcctactcaagagacctggggtgagttcccttctcactccgggttataccccggtcccaaagctcttggaggaacctattcacagtgtcctaggctggagcattatggccaggtccaagtgaaaccagaacagggttgccctgtggggagcgattccaccggactggccccttgtctaaatgcccacccttccgaggggcctccacacccacagcccctcttctctcactatccgcagccatcaccgccacaatacctgcagtcgggtccatacacgcagccccctcccgattacctgccatccgaacctaggccttgcctggatttcgactccccaacccactctacgggccagctgaaagcccagttagtctgcaactatgtgcagagtcagcaggaactgctatgggaagggggagggagagaggacgcacctgcccaggaaccatcttatcagagccctaaattcctggggggatcccaggtgagtccttctcgggctaaggcacctgttaacacgtatgggccaggttttggtccaaacctgcctaatcataagtctggatcataccccacaccatcaccctgccatgaaaattttgtcgtgggagccaaccgtgcctcccatcgagccgcagcgccaccacgcctactgcctccactacctacctgctacggcccactcaaagtggggggtactaatcctagctgtggccacccagaagtggggagactcggcggtggcccagcactgtatccacctcctgagggccaggtgtgtaatcccctggattcactggaccttgacaatactcagctcgatttcgtggctattctggatgagccacagggcctctccccccctccctcccacgatcagcgcggatcgagcggacacacaccccctccttcaggacctcctaacatggctgtcggcaacatgtccgtgttactcaggtctctcccaggggagaccgaattcctcaactcttccgcctag

SEQ ID NO: 28789 - DNA, 135 bp, Artificial Sequence
  Description of Artificial Sequence: Synthetic coding sequence
atgtcaggtcctcattcttatgggcctgccagagagaccaattcctgcacagagggccctcttttttcctcgcctcgaagtgctgtaaagctcactaaaaaacgtgcacttagcatctctccactcagtgattag

SEQ ID NO: 28790 - DNA, 3198 bp, Artificial Sequence
  Description of Artificial Sequence: Synthetic coding sequence
atgtttaacagcatgacaccgccacctatcagttcctatggcgagccttgctgcctgcgacccctcccctcacagggcgctcccagtgtgggaaccgaggtgaagttgaccaagaaaagggcgctgagcattagtccgttgtcagacgcttctttggacctacagaccgtcataaggacatccccttcctctctcgtggctttcatcaattctcggtgcactagtccagggggtagttacgggcacttatccattggcacaatgagtcctagcctcggatttcctgctcagatgaaccatcaaaagggtccgtctcctagcttcggagtgcaaccatgtggaccccacgactcagcccgaggagggatgatcccacaccctcaatcccgtgggccattccccacatgccagctgaagtcggagctggatatgctggtcgggaaatgcagagaagagcctctcgaaggcgatatgagtagccccaacagcaccggaatccaagatcctctgctgggtatgctcgacggacgggaagatctcgaacgcgaggagaaacgtgagcccgagtcagtatacgagacggactgcagatgggacggatgttcacaagagttcgacagtcaggagcagctggtccatcacattaacagcgagcacattcatggcgagcgcaaggagttcgtatgtcattggggcggatgcagccgcgaactgcgaccatttaaggcacaatatatgttggtggtgcatatgcgtcgtcatactggtgagaaaccccataagtgcacgttcgaaggttgccgcaaatcttacagtaggttggagaatttaaagacgcatctccggagtcacaccggcgaaaagccatatatgtgtgagcacgaggggtgctctaaggccttctccaatgcgagcgaccgagccaagcaccagaatagaacacattcaaacgaaaagccatacgtgtgcaagctgcctgggtgtactaagaggtataccgatccgagctcccttcggaagcacgtcaagaccgtccacggaccggatgcccacgtcacaaagagacaccgcggtgatggaccacttccgagggctccttctatttccaccgtggaaccaaaacgggaaagagaaggagggcctatccgcgaagaaagtagacttacggtgccggaaggagctatgaaacctcagcccagcccaggcgctcagtcatcctgttcatcagatcatagtccggctggatcggccgcaaacacggattcaggcgtggaaatgacaggaaacgctggaggtagcaccgaagacttgagctctctggacgagggtccatgtattgcaggcactgggctgagcactctccggcgtctggaaaacctccgtcttgatcagctgcaccaactcaggcctattggaaccaggggccttaagctccccagtcttagccacacaggaacgaccgtgtctcggagagtaggaccccctgtgagcttagaacggcgaagctccagctcatcaagtatttcttccgcctatacagtctcaagacgctcgagtctcgcctcccctttccctcccggaagccctccagagaatggagccagctcattaccaggactaatgcctgcccaacattatttactgcgggctcgctatgctagcgcccgtggagggggaacttcccctacagcagcaagcagcttggacaggatcggcggactgccgatgcccccttggaggagccgagctgaatacccaggctacaaccctaatgctggggttacccgcagggcctccgatccggctcaagcggcagacaggcccgctcctgccagagttcagagatttaaaagcttgggatgcgtgcacacacctccaaccgttgctggtggtgggcagaattttgatccttatttgcccacgtcagtgtacagcccccagcccccttctataacagaaaacgccgctatggatgccagagggcttcaggaagaaccggaggtgggcacatcaatggtggggagcgggcttaatccatatatggactttcctcccacagatacactgggatatgggggacccgaaggagccgcagctgaaccttacggcgcacgaggaccgggttctctgcccctgggcccaggccctcctaccaactacgggccaaatccctgcccgcagcaggctagctaccctgacccaacacaggagacttggggtgagtttcccagtcactctggactctatcctggacctaaagctctcggaggtacctacagccagtgccccagactggagcattacgggcaggtccaagtcaagcccgagcaaggttgtcccgtgggctctgattctactggcctcgctccctgtttaaacgcccaccccagtgagggccctccgcacccccagcccctgttttcccattatccccagccatcacctccccagtacttgcagagcgggccttatactcagcccccaccagactacctgccgtctgaacccaggccgtgtctagatttcgactcacccacacattccaccgggcagttaaaagctcagctggtatgtaactatgtgcagtcccagcaagaactcctgtgggaaggcggtggacgcgaagacgccccagctcaggaaccctcatatcaaagtcctaagtttctgggcggaagtcaagtgagccctagcagagcaaaggcacctgtgaacacatatggacccggatttggaccaaacctgcctaaccacaaatctggatcctatccgactccttcaccatgtcacgagaatttcgtggtcggcgcaaatcgcgcatcccacagagccgctgcgcctcccaggctgttgccccctctccctacttgctacggccctctgaaggtgggtgggacgaaccctagttgtggccacccggaagtgggcaggttgggcggtggacccgctctatatcctcctccggaaggacaggtgtgtaatcccctcgactctctggatctggataatacgcagctagacttcgtggccatcctggatgaaccacaggggttatctcccccaccgagccacgatcagcggggatcttccgggcacaccccccctccttccgggcctccaaatatggctgtaggcaacatgtcagtgctgttaagatctttgccaggggagactgaatttcttaactcttctgcctag

SEQ ID NO: 28791 - DNA, 1548 bp, Artificial Sequence
  Description of Artificial Sequence: Synthetic coding sequence
atggctgagcaggtcgccttgagcaggacgcaggtttgtggaatcctgagagaagagctgttccagggtgatgccttccaccagtccgatacccacatatttattataatgggcgcatctggcgacctggcaaagaagaagatctatccaaccatctggtggttgtttagggatggacttctgccagaaaatacattcattgtggggtatgccaggagtcggctaacggtggcagacattaggaaacagtctgaacctttcttcaaggcaacaccagaagaaaagcttaaactcgaagatttcttcgccaggaactcatacgttgctgggcagtacgatgacgcagcttcttatcaacgccttaattcccatatgaatgccctgcacctcggttcccaggctaatcgactcttctacttggccctaccccctactgtctacgaagctgtgacaaaaaacatccacgaaagctgcatgagccaaattggctggaacagaattatcgtcgaaaagcccttcggtcgggatctccagagctccgacagattgagcaaccacatttcgtctttatttcgggaagatcagatttacagaattgaccattatcttggtaaggaaatggttcaaaacttgatggtgttgaggttcgccaacagaatattcgggcctatctggaatagagacaacattgcctgcgttatactaactttcaaagagcccttcggaaccgaaggcagggggggttactttgatgaatttggtatcatcagagatgtcatgcagaatcatctgttgcaaatgctatgcttggtggctatggaaaagccagcttctacgaactctgacgacgttcgtgatgaaaaggtgaaagttctcaagtgtatcagcgaggtgcaagccaacaacgtcgttctaggccaatacgtgggaaaccctgatggtgaaggggaggccacgaaaggctacctggacgaccccaccgtcccacgtggaagcacaactgcaacttttgcggctgttgtgttatatgtggaaaatgaacgttgggacggcgtccccttcatactgcgatgcgggaaggcattgaatgaaagaaaggcggaggtacggctacagttccatgacgttgcaggggatatatttcatcagcagtgcaagcgaaatgagttggtgattagggttcagcctaatgaagcagtttacactaaaatgatgaccaaaaaacccggtatgtttttcaaccctgaggagtccgagctggacctgacgtatggaaatcggtacaagaacgtaaaactgcctgatgcatacgaacgtctgattctggatgtgttctgcggtagccagatgcacttcgtccggtcggatgaactgagagaggcctggcggatatttaccccgctcctgcatcaaatcgagctggagaaacctaagcccattccatatatctacggaagccgcggtcctactgaggctgacgaactcatgaagcgagtgggattccagtacgaggggacttacaaatgggtcaatcctcacaagctgtag

SEQ ID NO: 28792 - DNA, 1686 bp, Artificial Sequence
  Description of Artificial Sequence: Synthetic coding sequence
atggccgaacaagtggcgctgtcccgtacacaagtgtgcggcatcctcagggaggaactcttccagggcgatgcctttcaccagagcgatactcacattttcatcatcatgggtgcatctggtgacctcgcaaagaagaaaatttatcctacgatctggtggctgttcagggacggccttctcccagaaaacacgtttatagtcggatatgcgagatcccgcttgaccgtcgccgacattagaaagcagtcggagccattttttaaggctacgcctgaagaaaagcttaagctcgaggatttctttgcgagaaactcttacgtggcaggccagtatgacgatgctgcttcttaccagaggttgaactcccatatgaatgccttgcatctcggcagccaggctaataggcttttctatttggccctgccgccaacagtgtatgaagcagtcaccaaaaacattcacgaatcctgcatgagccaaatcggatggaaccgaattatagttgaaaaaccctttggacgcgacctgcagtcgagcgataggctgtccaaccacatttccagtctgttcagggaggaccagatctatcgaatcgatcactacctgggaaaagagatggtccagaacctcatggttctgcggttcgctaacagaatattcgggccaatctggaacagagacaatatcgcatgtgtcatcctcacatttaaagaacccttcggcacagaggggaggggcggatacttcgatgaatttgggataatacgagggcctgggaggcaaggaggatccggatccgagtcatgcagcttgtcactaggaagtctcgtctgggggcctcatgccctggagcctggagaacagggcggagaattgcgtcgcgcactcgccagctctgtaccacgggatgtcatgcaaaaccatttgctacaaatgctttgtctggtggccatggaaaagcccgctagcacaaactcggacgatgttagggatgagaaggttaaggtacttaagtgtatttcagaggtgcaggctaataacgtagtactgggccagtacgtgggaaatcccgacggtgagggggaggcaactaaggggtatctggatgaccccaccgtgccaaggggcagcacaaccgccacatttgcagccgttgtgctgtatgtggaaaacgagcgttgggatggggtccctttcatattacggtgcggcaaggctctgaatgaaaggaaggccgaggttaggctgcaatttcacgatgtcgcaggggacattttccaccaacagtgcaagcgaaacgaacttgttatccgagtacagcctaacgaggctgtttacacaaagatgatgaccaagaagcccggtatgttctttaaccccgaggaatctgagttagacttaacgtatggcaataggtataagaacgtaaagctcccagacgcctatgaacgcctcattttggatgtgttttgcggctcccagatgcactttgtccgctctgatgagttgcgggaggcatggcggatctttacgcctctcttgcatcagatagagctcgaaaagcctaagcccataccctacatttatggaagccgcggaccaaccgaagccgacgaactcatgaaacgagtgggatttcagtatgaaggtacgtataagtgggtcaacccacataaattgtag

SEQ ID NO: 28793 - DNA, 1638 bp, Artificial Sequence
  Description of Artificial Sequence: Synthetic coding sequence
atgggcagaagggggagtgctcctggcaacggcagaacgctgcgaggatgtgaacgcggaggccgacggcgacggagcgcagactctgttatggccgagcaggtggccctgagccgaacccaggtctgcgggattctgcgcgaagagctgttccaaggcgatgcgttccaccagtccgacactcatattttcataatcatgggagccagcggtgacctagccaagaagaagatttatccgactatctggtggctcttcagagacggtcttctgccggaaaacacatttatcgtcggatacgcaagatcacgcctgactgtggccgatatcaggaaacaatcagagccgttctttaaggccacccccgaggagaagcttaagctggaagatttctttgcacggaactcctacgtggctgggcaatacgatgatgcggcatcatatcagaggctgaattcgcacatgaatgctctacaccttggcagccaggctaacaggcttttctacctggcgctccccccaactgtgtacgaggccgtaaccaaaaatattcacgaaagttgtatgtcccaaataggctggaacaggattatagtcgagaaaccttttggtagagacctccagtcttccgatcgcctgtcaaaccacatttcctccctgttccgagaagaccaaatctataggatcgaccactatttgggtaaagagatggtgcaaaatctgatggtgctgagattcgcaaatcgtatctttggcccaatctggaaccgcgacaatatagcttgtgtaatcttgactttcaaagagccctttggaaccgagggccgaggaggctactttgacgagtttggaataatccgtgacgtgatgcaaaatcatctcctgcagatgctgtgtttagtagccatggaaaaaccagcctctactaatagcgatgacgtgagggacgaaaaggttaaagtcctaaagtgcattagtgaggtgcaggccaataatgtcgtgctgggtcaatatgtgggaaaccctgacggcgaaggggaagccacaaaaggttacctcgacgatcccaccgtgccaagaggctcaaccaccgccactttcgccgcagtcgttttgtacgtggaaaacgagcgctgggacggagtcccctttattctgaggtgcggcaaagctctaaatgaacgcaaagctgaagtgcgactgcagtttcacgacgtcgcgggagacattttccatcagcagtgcaagagaaacgaactggtaattcgcgtacagccaaacgaagctgtctacactaaaatgatgacaaaaaagcccggaatgttcttcaatccagaagaaagcgaattggatcttacttacgggaacaggtacaaaaatgttaaattacccgatgcctatgagcgcctgatcttggacgtgttttgtggttctcagatgcacttcgtaagatcagatgagttgagagaagcctggagaattttcactccattgctgcaccagatcgaactggagaagcctaaacccataccttatatctacggcagccggggtcccactgaggctgacgagttaatgaagagggtgggcttccagtacgaggggacatacaaatgggtgaacccgcacaagctgtag

SEQ ID NO: 28794 - DNA, 1548 bp, Artificial Sequence
  Description of Artificial Sequence: Synthetic coding sequence
atggccgagcaggtggccctcagtcggactcaagtctgcggaattcttcgcgaggaactctttcaaggagacgccttccaccagtctgacacgcacatcttcataatcatgggggctagcggggacctggctaagaaaaagatatatcccaccatctggtggctttttagggatggactcttacctgaaaacacgtttatcgtgggttacgccaggtcccggctcactgtagcggatatcaggaagcagtcagagccgttttttaaggcaacacctgaagagaagctgaaactggaggacttttttgctagaaactcatacgttgccggacagtatgatgatgcagcctcatatcagcgcctgaattcccatatgaacgccctgcacctgggaagtcaggcgaatagactgttctacctggctcttccaccgaccgtctacgaggcggttaccaagaacatccatgaaagttgcatgtcccagataggatggaatcgaataatagtggagaagccttttggacgcgatttacagtcatctgaccggttgtcaaatcatatctcgagtctgtttagagaagaccagatctaccgcatcgaccattatctgggcaaggaaatggtgcagaacttgatggtccttaggtttgccaatagaatctttggaccaatctggaatcgggacaacatcgcctgcgtcatcctcacatttaaagagccctttggcaccgagggaagaggtggctatttcgatgaatttggcatcatcagggacgtcatgcagaaccacttactacaaatgttatgtcttgtcgctatggagaagcccgcttctacaaattcagatgacgtcagggatgagaaggttaaggtccttaagtgtatcagcgaagtgcaggccaataacgtggtactaggccagtacgtaggcaacccggatggggagggtgaagctaccaagggttacttggacgatccgaccgtgcctagaggatccaccacagcaacatttgcagccgtggtgttgtacgtggagaacgagaggtgggacggagtgccattcatcttacgatgcggcaaggctctcaacgaaaggaaagctgaggtgaggctccaattccatgacgtcgccggagatatttttcaccaacaatgtaaacggaatgagctggttataagagttcagcccaatgaggcagtgtatacaaaaatgatgaccaaaaaacccggtatgttttttaaccccgaggagtccgaactcgatttgacttacggaaaccgctacaagaatgtgaaactacccgacgcctatgaacgcctgattctggatgtgttttgtgggtctcagatgcattttgtcaggagcgacgagcttagagaagcctggagaatcttcacccctttactgcaccagatcgagctagaaaaacctaagccaataccatacatctatggcagccggggacccaccgaggctgatgaactcatgaaacgtgtgggcttccaatatgagggcacctacaagtgggtgaacccccataagttgtag

SEQ ID NO: 28795 - DNA, 771 bp, Artificial Sequence
  Description of Artificial Sequence: Synthetic coding sequence
atggccgagcaagtcgcgctcagtcgaacacaggtctgcgggatcctaagagaggagttattccagggcgacgcattccaccagagcgatactcacatatttatcatcatgggagccagcggagatttggctaagaagaagatctaccccactatctggtggctgtttagggacggtctcctgcccgagaacacatttattgtgggttacgctcgctcccgacttacagtcgcggacatcaggaagcagtcagagcccttctttaaagcaacacccgaagagaagttgaaactggaggattttttcgcccgtaattcgtatgtggcaggccagtatgacgacgctgcctcctatcaacgattgaactcacacatgaatgccttgcaccttggatcccaagccaatagactattttaccttgcactgccacctactgtttatgaggcggtgaccaagaacatccatgagtcctgtatgagccagatcgggtggaaccgaattattgtggagaagccctttggacgcgatctgcagtcctctgataggctctccaatcacatctccagtctgttccgcgaggatcagatctatcggatcgaccattatctgggaaaggaaatggtgcagaacctaatggtgttacgcttcgctaacagaatctttggccctatttggaacagagacaacatcgcttgcgtgatccttactttcaaggagccatttggcacagagggcaggggaggctatttcgatgagttcggtattatctag

SEQ ID NO: 28796 - DNA, 681 bp, Artificial Sequence
  Description of Artificial Sequence: Synthetic coding sequence
  Description of Combined DNA/RNA Molecule: Synthetic coding sequence
atggcaagactgcttcaggcttcctgcctgctgtccctgctcctggctggcttcgtgagtcagagtagaggccaagagaaaagcaaaatggattgccacgggggtatatctggcaccatatacgagtacggcgctctcactattgatggagaagagtacatccccttcaagcagtacgctggaaaatatgtgctgttcgtcaacgtagccagctacugaggcctgaccggccagtacattgagctgaatgccttgcaggaagagctggccccttttgggttggttattctggggttcccttgtaaccagttcggcaagcaggagccaggggagaattctgagattctgcctacactgaagtacgtgaggccaggaggcggatttgtgcccaactttcagttgtttgaaaagggggacgttaatggcgagaaggaacagaagttctatacattcttgaaaaactcatgccctccaacctcagagttactcgggacgtcagaccgtcttttttgggaaccgatgaaagtccatgatattaggtggaactttgagaagttcttggttgggcctgacggaatccctattatgcgatggcatcaccggaccaccgtctcaaacgtaaaaatggatatcctgtcatatatgaggaggcaagcagccttgggggtgaagaggaaatag

SEQ ID NO: 28797 - DNA, 219 bp, Artificial Sequence
  Description of Artificial Sequence: Synthetic coding sequence
atggccagacttttacaggctagctgtcttttgagtctcctcctcgctggcttcgtgtcgcaatctcgaggccaggaaaaatcaaaaatggactgtcacggcggtatcagcggaaccatctacgagtatggggcactgacaattgatggagaggaatacatacccttcaaacagtacgctggcaaatatgtactcttcgtcaatgtcgcttcatattag

SEQ ID NO: 28798 - DNA, 633 bp, Artificial Sequence
  Description of Artificial Sequence: Synthetic coding sequence
atgccaccctatacagtggtgtatttcccagtccgcggacggtgtgctgccctgcgaatgctgttagctgatcaaggacaaagctggaaggaagaggtggttaccgtggaaacgtggcaggagggttctctgaaggcatcatgtctgtatggtcagcttccaaagttccaggatggagatctcaccctgtaccaatcaaacaccatccttaggcatcttggccgtacattgggtctctatggtaaagatcagcaggaggctgccctcgttgacatggtgaatgacggggtcgaggatttgaggtgcaaatatatttctctcatctatacaaactatgaggccggaaaggatgactacgtgaaggcattgcctggccaactaaagcctttcgagacactgctctctcagaatcagggtgggaagacttttatcgtgggagaccaaatttcttttgcagactacaatctgctggatctgctgctgattcacgaagttttggccccaggctgtctggatgcgttccccctgctgtccgcttatgtgggtcgcctgtctgcccgtcccaaactgaaggccttcctggcttctcccgagtatgtcaacctcccgatcaacggtaatggcaaacagtag

SEQ ID NO: 28799 - DNA, 2184 bp, Artificial Sequence
  Description of Artificial Sequence: Synthetic coding sequence
atggcctttcagaaggccgtgaaaggaaccatcctggtgggcggaggagctctggccacagtccttggtctgtcccagttcgctcattatagaagaaagcagatgaacttggcatacgtgaaagcggctgactgtatcagtgaacctgttaaccgagagcccccatccagagaggcgcaattactgacactgcagaacacatcagaattcgacatccttgtgattggaggaggcgctacaggatctggctgcgcactggatgccgtcacaaggggacttaaaacagctcttgtggagagggacgactttagtagcggcacgtcaagcaggtcaacaaaactgatccacggcggagtccgctatctccagaaggccattatgaagctcgacattgaacagtacagaatggttaaggaagctctgcatgagagggccaacttgctggagatcgccccacatctgtccgcccctctgccgattatgctcccagtgtacaaatggtggcagctgccctattactgggttggcatcaaactgtacgacctggtggccggatccaactgtcttaagtcatcctacgtgctgtctaagtcccgagccctggagcacttccctatgttacaaaaagacaagttggtgggggcaatcgtatattacgacgggcagcacaatgatgccagaatgaacctggccattgcacttactgctgcacggtacggagctgccaccgccaattacatggaagttgtttcactcctgaaaaagaccgaccctcagaccggcaaagtacgcgtatctggagctcggtgtaaagacgtccttaccggccaggagttcgatgtccgagctaagtgcgtcataaacgccaccggaccctttacagactcagtacgcaagatggacgacaaggatgccgctgccatatgccagccaagtgctggagtccacatcgtgatgcccggttactacagccccgaatctatgggcctgctagatcccgcaacatcagatgggagggtgatattttttctgccctggcaaaagatgactatcgccggaaccaccgatactccgactgacgtcacacaccacccaattccatcagaagaggacatcaacttcattttaaacgaagttaggaactatttatcatgcgatgtggaagtccggagaggggatgtcctcgcggcatggagtgggattagacctctggtaacggatcccaagtcagctgacacacagagcatcagtaggaaccatgtcgtggatatcagtgagtctggcctaatcaccattgccggaggtaaatggactacttaccggagcatggccgaggacacaatcaacgccgcagtcaaaactcataacttaaaagccggaccaagcagaacagtcggtttgtttctccaaggaggaaaggactggtccccaaccttgtacattcgtctagtacaggactacggcctggagagtgaggtggcccagcacctagcagctacttatggggataaagccttcgaggtcgctaagatggcctcagtgactgggaagaggtggccaattgtgggggttcgcctggttagcgaattcccttacatcgaagccgaggtcaagtacggtattaaggagtacgcgtgtaccgccgttgatatgatttctaggcgtacccgtctggctttcctgaatgttcaggccgctgaggaagccctcccaaggattgttgaattgatgggcagagagctgaactgggacgactacaagaagcaggagcagctagagactgctcgaaagtttctttactacgagatgggatacaagtcccgtagtgaacaactgactgacaggtccgagatttcgctgctgccatccgacatagaccgttacaaaaagcgattccataaattcgacgcagaccagaaggggttcataaccattgttgacgttcagcgggtacttgaatcaataaacgttcaaatggatgaaaacaccctccacgagatactgaacgaggtggatttaaacaagaatggccaagttgagctgaacgagttcctccaactgatgtctgccatacagaagggcagggttagcgggtctagactcgcaattttgatgaaaaccgctgaggaaaatctggataggcgtgtccccatccctgtggaccgatcatgcggcggtttgtag

SEQ ID NO: 28800 - DNA, 1503 bp, Artificial Sequence
  Description of Artificial Sequence: Synthetic coding sequence
atgaatctggcaattgcacttacagccgctcgctacggagccgcaacagctaactacatggaagtggtgtccctgcttaagaaaactgaccctcagactggcaaggtgagggtctctggcgctcgctgtaaggatgtgctaacagggcaggagtttgacgtgagagccaaatgtgtgattaatgccacagggccatttacagactcagtcagaaagatggacgataaagacgctgcagccatctgccagccatctgccggagtccacatcgtcatgcctggctattacagtcctgagtcaatgggtcttctggatcctgctacctctgacggtagagtcatttttttcctcccatggcaaaaaatgacaatcgcgggaacaacagacacccccactgatgttactcatcacccgatccctagcgaggaagacattaattttatccttaatgaggttcggaactacctgagttgtgatgtggaagttcgccgaggagatgtgctcgcggcttggagcggaatcagaccactggttacagatcctaagagtgccgacactcagtcaataagcaggaatcatgttgtagacatctccgagtccggattgatcacaattgccggaggcaaatggacaacctaccgtagtatggccgaggacactataaatgctgccgtaaagacgcataatctgaaggcgggtccctcacggactgtcggattgtttctccaaggaggaaaggactggagccccaccctttacattagattggtccaggactacggcctcgaatccgaggtagcgcagcatcttgctgccacgtacggggacaaagccttcgaggtggctaagatggcaagcgtaacaggcaagcggtggccaatcgtgggagtccgtctggtatccgaatttccatacatcgaggcagaagtgaagtatggcatcaaagagtatgcatgcaccgccgtcgatatgatttctcgccgaaccagactagcctttcttaatgtccaggccgcagaagaggcattgcccaggatcgtggaactgatggggcgtgagttaaattgggatgattataagaagcaggaacagttagagactgccaggaagttcctgtattacgagatggggtacaaatctagatcagaacagctaaccgacaggtccgaaattagcctgttgcctagtgacatagatcggtacaagaaaaggttccacaagttcgatgccgatcagaagggtttcatcacaattgtagatgtgcagagggtgttagagtccataaacgtgcagatggatgagaacactctgcatgagatcctgaacgaggtggacctgaacaaaaatggacaggttgagctgaatgagttcctccagctgatgtcagccatccagaagggacgcgtttccggttccagacttgctatcctgatgaagacagccgaggagaatcttgatagacgggttccaatacctgtcgatcggagttgcggcggactctag

SEQ ID NO: 28801 - DNA, 2184 bp, Artificial Sequence
  Description of Artificial Sequence: Synthetic coding sequence
atggcctttcagaaggctgttaaggggactatcctggtcggcggaggggctttggccaccgtgcttggtctgtctcaattcgcccactaccgtaggaaacagatgaatcttgcatatgttaaagccgcagattgcatttctgagccagttaacagggaaccacccagcagggaggcacagctgctgacattgcaaaataccagcgagttcgatattctcgtcatcggtgggggagccactgggtcgggctgtgctctggatgccgtcactcgcggacttaaaactgcgctggtagagcgggacgacttctctagtgggaccagctcccgcagcactaagctgatccatggcggagtcagatatctgcagaaagctataatgaaacttgacatcgaacagtatcgcatggtgaaggaagccttgcatgagcgggcaaatctcctggagatcgctccccatctctccgcacctctacctattatgctaccggtatacaagtggtggcaactcccctactattgggtgggaattaagctctacgatctagtcgctggctccaactgcctgaagtctagttacgtgctgagtaagtctcgcgctttggagcactttccgatgttgcagaaagataaactggtcggcgctattgtctattatgacgggcagcacaatgacgctcggatgaatctggccatcgcactgacagccgctcgctatggagcagcaacggcaaattatatggaagttgtcagcctcttaaagaagaccgatccacagacagggaaagtgcgcgtgagtggagctcgctgtaaggatgtgctgactgggcaggaattcgacgttagagccaaatgtgtcataaacgccaccgggccattcaccgatagcgtccggaaaatggacgataaagacgccgcagcaatctgccaaccctctgccggtgttcacatcgtgatgcccggatattattctcccgaatccatgggtctactggaccccgctacttctgatgggagggtcatttttttcctcccctggcagaagatgacgatcgccggaactacagacacacccaccgatgtgacacatcatcccatcccttcagaggaggacatcaacttcatcttgaatgaagtgaggaactatctctcgtgcgacgttgaagttagacggggagatgtcttagcagcttggtctggaatcagacctcttgtgaccgacccaaaaagcgcagatacacagagcatatcacgtaaccacgtggttgatatttctgagtccggcctgattactatcgccggtggaaagtggactacttaccggtcaatggctgaagataccataaacgcagccgtgaagactcacaacttgaaggctgggcctagcagaaccgtcggcctgttcctccagggcggaaaggactggtctcctaccctttatattagactagttcaggattatgggctggagagcgaagtggcccagcatctcgccgctacttacggagataaagccttcgaggtagctaaaatggcaagcgtgacagggaaaaggtggcccatagtaggggtgagactggtctccgaatttccctacatcgaggcagaggtcaaatatggaatcaaggaatatgcctgcacagcagttgatatgatttcacgcaggacacgactggcatttttaaacgtgcaggcagcggaagaggccctgccccgtatcgtggaactcatgggcagagaactaaactgggacgactacaagaagcaggagcagctcgaaactgctcgcaaatttctatactatgaaatgggctataaaagcagaagcgaacagctcactgatcgctctgagataagcttgttgcctagcgatattgacagatataagaagaggttccataagtttgatgcggaccagaaaggctttatcacgattgtggatgtacaaagggtcctggaatctattaatgtgcagatggatgagaatactctccacgaaatcctgaacgaggtggacctaaacaagaatgggcaggtcgagctaaacgagttcctgcagctaatgtccgccattcaaaaaggaagagtgagcggctctcggctggccattctgatgaaaacggccgaggaaaacctggatcggcgtgtgcccatcccagtcgaccgaagctgtggtggtctatag

SEQ ID NO: 28802 - DNA, 2184 bp, Artificial Sequence
  Description of Artificial Sequence: Synthetic coding sequence
atggcgtttcagaaagccgtgaagggcacaatcctcgttggcggaggcgctctcgccaccgttcttgggctttctcagtttgctcactatcgtcgtaagcagatgaacttagcttatgtgaaagcagccgactgcatcagcgagcctgtcaaccgggagccaccttctcgcgaggcacagctactgaccctccaaaacacgagtgaatttgacatccttgtgatcggcggtggcgctaccggttccggctgcgccttggacgccgtgaccagaggcctgaagacggcattagtggagagagacgatttttcctccggtaccagttcccggtctactaaactgatccacggaggcgtccgttacctgcagaaagctatcatgaaactagacatcgaacagtatcggatggtgaaagaggcactgcacgaaagggctaaccttttagaaattgctccccacctgtctgcacccctgccaattatgttgcctgtttacaagtggtggcaactgccatattactgggtaggcattaaattgtacgacttggtggccggatccaattgcttaaagagttcctacgtgctgagcaagtcaagggctctggaacactttccgatgctacaaaaagacaaactcgtgggggcaatcgtgtactatgacggacagcataacgacgccagaatgaatctggcaatcgcgctgacagcagccaggtatggtgccgcaaccgcaaactacatggaggtggtctcactgctgaaaaagaccgacccccagaccggaaaggtgcgtgtcagtggcgcacgctgtaaagatgtcttgactggccaggagtttgacgtacgtgccaaatgtgttattaacgcaacaggaccgtttaccgattccgtcaggaaaatggacgacaaagatgctgccgcaatctgccagcccagtgcaggggtccatattgtcatgcctggctactacagcccagaaagtatgggtcttctggacccagccaccagcgatggcagggtgatcttcttcttgccttggcagaaaatgactatagcaggtaccactgatacccctaccgatgtgacccaccaccccattccctctgaggaggatatcaactttatcctcaatgaagtgcgcaactatctgagttgcgacgtggaggtccggcgaggggatgtgctcgccgcttggtcgggcatacgacccctcgtgacagatcctaaatccgccgacacccagagcatttcacgcaaccatgtcgtggatatctcagagagcgggctaataactatcgctggcggtaaatggacaacttaccgaagcatggctgaagacacgatcaacgctgccgtgaagacccataatctcaaagccggtccatccagaaccgttggtctgtttctccaggggggtaaggattggagtcccaccctctacatcagattggtccaagattacggactggagagcgaagttgctcagcatttagccgcaacctacggtgacaaagcctttgaggtggccaaaatggcatcagtgacggggaagcgctggccaatcgtcggggtgaggttggtttctgagtttccatatattgaagctgaagtcaagtatggcatcaaggagtacgcatgtacggccgtggacatgatttcccgcagaacccgtctcgcctttctgaatgtccaagcagccgaggaggcccttccccgtatcgttgaactgatggggagggaactcaactgggatgattataagaagcaggagcagctggaaaccgcacgaaaatttttatattatgagatgggatacaaaagcaggtctgagcagttgacagaccgatcagagatctccctgctccccagcgatattgaccggtacaaaaagcggtttcataaatttgatgccgaccagaaagggtttatcactatcgttgacgttcagcgagtactggagtcaatcaacgtacagatggatgaaaacaccctccacgaaatactgaacgaagtagacctgaataaaaatggccaagtggagttgaatgagttcctgcagctgatgtctgcaattcagaagggtcgggttagtggcagtagactggccattttaatgaagacagctgaagaaaacttagatcggcgtgttcccatcccagttgatcgaagctgcggtggcctttag

SEQ ID NO: 28803 - DNA, 330 bp, Artificial Sequence
  Description of Artificial Sequence: Synthetic coding sequence
atggcattccagaaggccgtgaaaggaaccatccttgtgggtggcggtgctctcgccaccgttctgggcttaagccagtttgcccactaccgacgtaaacaaatgaatctcgcctacgttaaggctgcagattgcatttcagagcccgtaaatagggagccgcctagtcgcgaagcacagctcttgacactccaaaatacctcagaattcgacattctcgtaattggtgggggtgcaaccggtagcggttgcgccttggacgcagtgactagggggctgaaaaccgccttagtagagagagacgacttctcctctgggaccagtagttag

SEQ ID NO: 28804 - DNA, 2184 bp, Artificial Sequence
  Description of Artificial Sequence: Synthetic coding sequence
atggcctttcagaaggcagtcaaagggaccatcttggtgggtggcggtgcccttgccaccgtgttgggtctgtcgcagttcgcacactaccgcagaaagcagatgaacctggcctacgtaaaggctgcagactgtattagcgaacctgtcaaccgtgagcccccttcccgggaagcccagctcctcacattgcagaatacttcagagtttgacattctggtgatcggtggcggagcaacaggaagcggatgtgccctggatgccgtgacgcgaggacttaaaacagcattagtcgagcgggatgattttagcagcggaactagttcaaggagcaccaaactgatccacgggggagttcggtatctacagaaagccataatgaaattggacatcgaacagtaccggatggtaaaagaagctctccacgagagagctaacctgcttgagatagcccctcacctttctgcccctttgccaatcatgctacccgtatataagtggtggcagctgccctattactgggttgggatcaagctgtatgaccttgtagctgggagtaattgtctcaaatcctcttatgtgttatcgaagagccgcgctctcgagcactttcccatgctgcagaaggataagttagtcggggcaatcgtttactacgatggacagcataacgatgctaggatgaatttggctatcgcattgacagctgcacggtacggcgctgccactgcaaattatatggaggtggtgagcttgctgaaaaagacagacccccagacgggaaaggtgagggtttctggagctagatgcaaagacgtcctgactggccaagagttcgacgtgcgcgctaaatgtgtaattaacgccacaggcccattcacagatagcgtccgcaaaatggacgataaggacgctgcagctatctgccagccttccgcaggcgtgcacatcgtaatgccagggtattattctcccgagagcatgggactgttggatcctgccacaagcgatggcagggtaattttttttctgccttggcagaaaatgaccatcgctggaaccactgatacccctacagacgtcacacaccatccgatccccagcgaagaggacatcaacttcatccttaatgaagttcggaattacttgtcctgcgacgtcgaagtgcggcgaggggacgtgctcgctgcctggtcagggattcgacccctggtgacggacccaaaatctgccgacacccaatcaatatcgaggaaccacgtcgttgacatttctgagagtggcctgataactatcgccggtggtaagtggactacataccgatctatggcagaagatacgattaatgccgcagtcaagacccacaatcttaaagctgggccaagccgtactgtggggctgtttctgcagggtggcaaagattggtctccaaccctgtacatccggctggtgcaggactatggcctcgagtctgaagtggcccagcacctggcagctacctatggcgataaagcttttgaggtcgccaagatggccagtgtcaccggaaaacgatggcccattgtaggcgtgcggttggtatccgagtttccttatatcgaagccgaagtaaagtacggcattaaagagtacgcgtgcaccgccgtcgacatgatttcccgtcgcacacggcttgcattcctgaacgtgcaagcggctgaggaggctctgccgaggattgtagagttgatgggacgcgagctgaactgggacgactacaaaaaacaggagcagctcgaaacagcaagaaaattcttgtactatgaaatgggatataagtcccggagcgaacagttgacggacaggtctgagatctccctgctgccatccgatattgatcggtataaaaagcgcttccacaagtttgatgccgatcagaaaggattcatcaccatcgtcgatgttcagagagtactagagtcaattaacgtccagatggacgagaacactctgcatgaaattctgaacgaggtagacctaaataagaacggccaagtggaattgaatgagttcctgcagctaatgtctgctattcagaagggacgagttagtggatcccgtttagctattctaatgaaaacagcggaggaaaatctcgaccggagagtgccaataccagtggatcggtcttgcggcggactgtag

SEQ ID NO: 28805 - DNA, 1140 bp, Artificial Sequence
  Description of Artificial Sequence: Synthetic coding sequence
atggcgtttcagaaagctgtcaaggggaccattctagtgggcggaggggctctagccactgtgctggggctctcgcaattcgcccactatcggaggaaacaaatgaacctcgcctacgtgaaagccgctgactgcatctccgagccagtaaatagggaacctcccagccgggaggcacagcttctgacactgcagaatacatctgagttcgacattctcgtcatcggcggtggggcaacgggtagcggctgtgctctggacgcggtcacacgtggcctgaagacagcgctggtggagagagatgatttttctagcgggacatctagtagaagtactaagcttatccacggcggtgtgaggtatctgcagaaagctatcatgaagcttgacattgaacaataccgaatggtcaaggaggctctgcacgagagagctaacctcctggaaattgctcctcatctgagtgcgccacttcctattatgcttcctgtttataaatggtggcagctgccctattactgggtcggtatcaagctttatgacctggtcgccggttctaattgtctgaagtcgtcatacgtgctgagcaagtcaagagcgttggaacatttccccatgttgcaaaaggataaactggtaggggcaatcgtgtattacgatggccagcacaatgacgccaggatgaatcttgcaatcgctctcaccgccgctcgatatggggcagcgactgcaaactatatggaagtcgtgagcctgttgaagaagacagatcctcagaccggcaaagtaagagtctctggcgctaggtgtaaggacgtgcttactgggcaggaattcgacgtacgagcgaagtgtgttatcaatgccactggcccatttaccgattccgttaggaagatggacgacaaagatgctgctgctatatgtcaacccagcgccggagtgcacattgtgatgcccggttactattcacccgaaagcatgggtctgctggatcctgcaacatcagacggacgggtaatttttttcctgccttggcagaagatgacgattgctggcacgaccgatacacctacagatgtcactcaccaccctattccaagtgaggaggatatcaactttatactgaatgaggtgtag

SEQ ID NO: 28806 - DNA, 1263 bp, Artificial Sequence
  Description of Artificial Sequence: Synthetic coding sequence
atgagcggcagacctcggacaacctcattcgcagaaagttgcaaaccagtgcagcagccttccgcctttggatctatgaaggtctctcgggacaaagatgggtctaaggtgactaccgtggtggccacgcccggtcagggtcccgatcggccacaggaagttagttatacagatactaaggtgattgggaacgggagcttcggagttgtgtatcaggctaaactgtgcgactccggtgagctcgtcgctattaaaaaggtgctccaggataagcgatttaagaaccgcgaactgcaaattatgaggaagctcgaccattgcaacatcgtgaggctgcggtactttttttattccagcggcgagaaaaaggatgaggtgtatctgaatctggtgctggattacgttcctgaaaccgtctatcgggtggcgagacattactccagggcaaagcagacactgcccgtcatctacgttaagttgtacatgtaccagctgttcagatcactcgcctacatccactcattcgggatatgtcatagagacattaaaccacagaatttactcctagatccagacacggcggtgttaaaactttgcgacttcggcagtgccaagcagctggtgcggggtgagcctaacgtgagctacatctgctcacgctactacagggcccctgagctgatattcggagctacggattacacctcctccatagacgtctggagcgcaggctgcgttttggctgaactcctgctagggcaacccattttccccggtgactccggcgtagaccaacttgtggagattattaaagttttgggtactcccactagagaacagatcagggagatgaacccaaactatacagagttcaaatttccccagataaaggctcatccttggacaaaggtctttaggccacggactcccccagaggctattgcgctctgcagtagacttctggagtacacccctactgccagactgacaccgcttgaagcctgcgctcactcctttttcgatgagctccgggaccccaacgtcaagctacctaatggtagagacacgccagctttatttaacttcaccacacaggagctgtcttccaatcctcctctagccacaatcctgatcccaccacatgctcgtatccaggctgcagctagtacgccaactaacgccaccgccgcatccgacgcgaataccggcgatagaggtcagactaataacgccgcaagcgcgagcgcctcgaactccacttag

SEQ ID NO: 28807 - DNA, 1302 bp, Artificial Sequence
  Description of Artificial Sequence: Synthetic coding sequence
atgagcgggcgtccgagaaccacgtcctttgccgagtcctgtaaaccagtgcagcagccatcagcctttggttccatgaaagttagtcgcgacaaagacggctccaaagtgaccactgtcgttgctacacctgggcagggacccgacaggccacaggaggtgtcatataccgataccaaggtgatcgggaacggatcttttggagttgtataccaggctaaactgtgtgatagcggcgaactggttgcaatcaaaaaggtcctccaggataagaggttcaagaaccgggagttacaaatcatgcgaaaactggatcactgtaatatcgtgcgattgcgctatttcttctatagcagtggggaaaagaaggatgaagtgtatttgaacctggtcttggattatgtgccggaaaccgtataccgggttgccaggcactattccagagccaaacaaaccctgcctgtgatatacgtcaagctctatatgtaccagctgtttcgcagcttagcctatatacactccttcggaatttgtcacagagatatcaaaccccaaaatctgttgttggaccccgataccgccgttctgaagctgtgcgatttcggaagcgctaaacagctggtaagaggggaacccaatgtgtcttacatttgtagtcgatactatagagcgccagaattgattttcggcgctaccgactacacttcatcaatcgacgtgtggagtgccggttgtgtgctggctgaattgctcctgggtcagccaatcttcccaggcgatagtggggtggaccaactagtggagatcattaaagtgctgggcacccctaccagggagcaaattagagagatgaaccccaattatacagagtttaagtttccacaaatcaaggcacacccgtggactaaggacagctctggaacaggacattttacctctggcgttagagtgttccggccaaggaccccacctgaagcaatcgcactgtgctcacgacttctagagtacacacctacagccagattgacccccctggaggcctgcgcgcacagttttttcgatgagttgcgggatcctaatgttaagctgccaaatggacgggacacaccagctcttttcaattttaccacacaggagctcagctccaaccctcccctcgccacaatattgatccctccacatgccaggatccaagctgcagcttctacaccaacgaatgcgaccgctgcaagcgacgcaaacactggcgacagaggccaaaccaacaacgctgcttctgcatccgccagcaactcaacgtag

SEQ ID NO: 28808 - DNA, 315 bp, Artificial Sequence
  Description of Artificial Sequence: Synthetic coding sequence
atgaaccccaactacactgagtttaagtttccccagatcaaggcccacccatggaccaaagttttccggccacggactccgccagaggccatagcattgtgcagccggttattggaatatactcccacagcaagactgacccctctcgaagcctgtgctcattcttttttcgacgagcttagggacccaaacgttaagctccccaacggccgtgatacacctgctctttttaacttcactacccaagatgcaaacacaggcgaccgaggccagaccaataatgccgcttcagcctctgccagcaattccacctag

SEQ ID NO: 28809 - DNA, 837 bp, Artificial Sequence
  Description of Artificial Sequence: Synthetic coding sequence
atggaggaaaacatggaagagggccagacccagaaaggatgctttgaatgctgtatcaagtgtctgggagggatcccctacgccagcttgattgcaacaattctcctgtatgcaggggtggctctgttttgcggatgtggccatgaggcgctgtcaggcaccgtcaatatcctccagacatacttcgagatggcgaggactgctggtgataccttagatgtgttcacgatgatcgacatcttcaagtacgtcatttacggaatcgcagcggctttcttcgtgtatggaatcctcttaatggtagaggggttcttcacaacaggggctattaaggacctatacggcgatttcaagattacaacttgtggacgctgtgtatccgcctggttcataatgctcacttatctgttcatgttggcgtggctgggagtgacagcttttacaagcttgcccgtgtatatgtattttaacctctggaccatatgccgaaatacgactctcgtggagggagctaacctatgtcttgatctgcggcagtttggcatagtaacaatcggggaagagaaaaagatttgtacagtatccgaaaacttcctcagaatgtgcgaatccactgaactgaatatgaccttccacctattcatcgtggccttagccggagcaggcgcagccgtgatcgcaatggtccattatctcatggtactgtcggccaattgggcttacgtgaaggatgcctgcaggatgcagaagtacgaagatatcaaaagcaaggaggagcaagaactgcacgatatacactccacacgatccaaggagaggttgaacgcttacacctag

SEQ ID NO: 28810 - DNA, 837 bp, Artificial Sequence
  Description of Artificial Sequence: Synthetic coding sequence
atggaggagaatatggaggagggccagactcagaaaggatgcttcgagtgctgtatcaagtgtctcggtggcatcccatacgcctccctgattgcaaccattctcttgtacgcaggagtggccctgttttgcggctgcggacacgaagctctcagtgggacagtaaatattctgcagacctattttgagatggcacggaccgccggtgatactctggatgtgttcactatgatcgatattttcaagtacgtcatctacggtatcgctgccgcatttttcgtgtacgggatcctgttaatggtggagggcttctttaccactggagctatcaaggatctgtacggggattttaaaatcaccacatgcggcagatgcgtgtccgcttggtttatcatgctgacataccttttcatgctagcctggttgggggtcacagccttcacaagtctccccgtatacatgtacttcaatctctggaccatttgcagaaacaccactcttgtggagggggctaatctctgtttggatctacgccagtttggtatcgtgactattggggaggagaaaaaaatatgcaccgtatctgaaaattttcttcggatgtgtgagtctaccgagcttaatatgacctttcatctgtttatagttgccctcgccggtgctggagccgctgtcatcgcaatggtgcactatttgatggtgttaagtgctaactgggcttatgtgaaagacgcatgtcggatgcagaagtacgaggatatcaagtcaaaagaagaacaggagctacacgacattcactccacccgatctaaggagcggctcaatgcatatacatag

SEQ ID NO: 28811 - DNA, 33 bp, Artificial Sequence
  Description of Artificial Sequence: Synthetic coding sequence
atggaagaaaatatggaagaagggcagacgtag

SEQ ID NO: 28812 - DNA, 804 bp, Artificial Sequence
  Description of Artificial Sequence: Synthetic coding sequence
atgggatgttttgagtgctgtataaaatgtctcgggggaatcccatatgcctccttgatagctactatcttgctctatgcaggggttgctctgttttgcgggtgcggtcacgaagccctgagcggcacagtgaacatcctccaaacctactttgagatggccagaaccgcaggagacaccctggatgtgttcacaatgatcgatatctttaaatacgtgatctatggcatcgccgcagccttttttgtgtacggaatcctgttgatggtagaaggcttttttacaacgggtgctatcaaagacctatatggggacttcaaaatcaccacctgcggcagatgcgtctccgcgtggttcattatgttgacatatctgtttatgttggcctggctgggggttactgcgttcactagcctccccgtgtacatgtacttcaatctgtggaccatttgccgcaataccactctcgtagagggagcgaacttgtgtctggacctccgccagtttggaattgtgacaatcggggaagaaaagaagatctgtactgtgtcggaaaacttcctgcgtatgtgcgagagcaccgaactgaacatgacctttcacttattcatcgtagctctggccggagctggggcagccgtgatcgcaatggtccattacctgatggtactgtctgccaattgggcctacgtcaaggatgcatgtaggatgcagaagtatgaggacattaagtcaaaagaggagcaagagttacatgacatccactcaacccgcagtaaggaacgcctcaatgcctatacttag

SEQ ID NO: 28813 - DNA, 390 bp, Artificial Sequence
  Description of Artificial Sequence: Synthetic coding sequence
atggaggaaaatatggaggaagggcagacacaaaagggttgtttcgagtgctgtattaaatgtctgggaggtatcccctacgctagtctgattgccaccattctgctgtacgctggcgtggctctgttttgtggatgtggtcacgaagccctctcaggaacagtaaatattctccagacttactttgagatggctcgcacggccggagacacgttggatgtcttcaccatgatcgacattttcaaatacgtcatctacggcatagccgctgccttcttcgtatacggaatcctcctaatggtggagggatttttcaccacaggagcaatcaaggatctgtatggggactttaagattaccacctgtgggaggtgcgtgtctgcctggtag

SEQ ID NO: 28814 - DNA, 816 bp, Artificial Sequence
  Description of Artificial Sequence: Synthetic coding sequence
atgacagacttagaggggtgtttcgagtgttgtatcaagtgcttaggaggaattccatatgccagcctgatcgccactatactactgtatgcaggtgtggctcttttctgcggatgtggccacgaggccttatctgggacagtgaacattttgcagacatattttgaaatggcaagaacggccggagacacactggatgttttcaccatgattgacatcttcaaatacgttatttacgggatagcagcggctttctttgtgtacggcatcctcctgatggtggaaggtttttttaccaccggagcaatcaaggatttatacggggacttcaaaattacgacctgtggtcggtgcgtgagcgcctggttcatcatgctgacctatctttttatgttggcatggctgggtgtgacagccttcacatcactgcccgtgtatatgtacttcaatctctggacaatctgtaggaatactaccctagtggaaggagcaaacctttgcctggacttaaggcagtttgggatcgtgaccattggagaagagaagaagatatgcactgtgtccgagaattttttgcgcatgtgcgagagcaccgagttgaatatgaccttccacttgtttatcgttgctctggcgggagccggagcggctgtcatcgccatggtgcattatctgatggtgctctcggccaactgggcctacgttaaggatgcatgtcggatgcaaaaatacgaagacataaaatctaaggaggaacaggagctgcacgacatccattccactcgcagtaaggaaaggttgaacgcctacacctag

SEQ ID NO: 28815 - DNA, 1206 bp, Artificial Sequence
  Description of Artificial Sequence: Synthetic coding sequence
atgatgggcttaggcaacggaaggaggagcatgaaatcccctcccctagtgcttgctgctctggtggcctgcattattgtgctcggcttcaattattggatcgcatcctctcggagtgttgacttgcaaacacggattatggaactcgaaggcagggtgagacgagctgcagcagaaagaggggcagtggagctgaaaaaaaacgaattccaaggggaactggagaagcagagggagcagctggacaagatccagagcagtcacaactttcaactggaaagcgtgaacaagctatatcaggacgaaaaggcagtactggttaacaacattaccactggcgagaggctcatcagagtgttacaggatcagctgaagacgctgcaacgaaattatggccgtctacagcaggatgtcctgcagtttcagaaaaaccaaacgaacctggaacggaaattttcctatgatctgtcccaatgtataaaccagatgaaggaggtgaaagagcagtgtgaagaacggatcgaggaagtcactaagaagggaaatgaagcagtggcttcaagggacctatccgaaaacaacgatcaaagacaacagttacaagccctgtcagagccacagccaaggctgcaggccgctggcctcccccacaccgaagttccccagggaaagggaaacgtcttaggaaactcgaaatctcagacaccggctccaagcagcgaggtggtgcttgactctaaaaggcaggtggaaaaagaggagaccaatgagattcaggtggtgaatgaggaacctcagcgcgataggctaccccaggagcccggtcgggagcaggtcgtggaggatcgtcctgtgggtggacgaggctttggtggagcaggggaacttggccagacgccccaggtccaagctgcgttgtctgtgtcacaggaaaacccagaaatggaaggaccggagcgggatcagctggtcatcccagacggccaagaggaggaacaggaggccgctggagagggcaggaaccagcagaaactcaggggcgaggatgactacaatatggacgaaaatgaagcggagtctgagacggacaaacaggctgcgctggcaggcaatgacaggaatatcgatgtcttcaacgttgaagatcagaaacgcgacaccattaacctgctggaccagcgcgagaaacgcaatcacactttgtag

SEQ ID NO: 28816 - DNA, 1206 bp, Artificial Sequence
  Description of Artificial Sequence: Synthetic coding sequence
atgatgggtctgggtaacggtaggaggagcatgaaaagtcctccacttgtccttgcagcgctggtggcttgtatcattgtgcttggattcaactactggatcgcttcgtcacggagtgtggatctgcagacaagaatcatggagctggagggcagggtcaggcgcgctgccgcagaaagaggcgctgtcgagctgaagaaaaatgagttccaaggggagctcgaaaaacaaagagaacaactggataaaattcagagctcgcataactttcagctggagagcgtgaacaaactctaccaagacgagaaggcagtgctggtcaataatataacgaccggggaacggctcatccgtgtgcttcaggatcagcttaaaacgctccagaggaactacggacggctgcagcaggacgtgctgcagttccagaagaaccagacaaacctggaacgtaagttttcatacgatctatcccagtgcatcaaccagatgaaggaagtgaaggagcagtgcgaggagcgcatcgaagaggtgactaagaagggcaacgaagccgtcgcctcgagagacctctctgagaacaatgatcagagacagcagctgcaggcccttagcgagccccaaccgaggttgcaggcggcaggtcttccccatactgaagtaccacagggaaaaggtaacgtgcttggaaacagtaaatctcaaacacctgccccttctagtgaggtcgttctcgactcaaagcggcaagtggagaaggaagagaccaatgagatccaggtggttaatgaagagccacagcgtgatagactcccccaagagcctggacgagagcaagtcgtcgaagatcgaccggttgggggacgaggctttggaggtgccggagagctggggcagacacctcaggtgcaagccgcattatccgtgtcacaggaaaatccagaaatggaaggtccagaaagggatcagctggttatccctgatggacaggaagaagaacaggaagctgcgggagagggcaggaatcagcagaaactgaggggagaggacgattacaatatggacgagaacgaagccgagtccgagaccgacaaacaagccgcactggccggaaacgaccgcaatatagacgtgtttaatgtcgaggatcaaaaaagagacactatcaatctcctggaccaacgcgagaagcgcaaccacacgttgtag

SEQ ID NO: 28817 - DNA, 243 bp, Artificial Sequence
  Description of Artificial Sequence: Synthetic coding sequence
atgatgggcctgggaaacggcaggcgaagcatgaagtcccctcctctcgtgctcgcagcactggtggcctgtatcatcgtactcggattcaattattggattgcaagcagcagaagtgtggatctgcagacgaggatcatggaacttgagggacgagttcgccgagccgctgccgaaaggggagcggtggagctgaagaaaaatgaattccaaggggaactggagaagcagcgcgagcaatag

SEQ ID NO: 28818 - DNA, 366 bp, Artificial Sequence
  Description of Artificial Sequence: Synthetic coding sequence
atgatgggcctggggaatggaagaaggagcatgaaatctccccctctcgtcctggcagcactggtggcctgtattattgtcctgggtttcaactactggatcgctagttcaagatccgtggaccttcagacccggatcatggaacttgaaggaagagttagaagggcagctgcggagaggggagctgtggagctcaaaaaaaatgagttccagggcgagcttgagaaacagcgagagcagctggataaaatccaatcaagccacaactttcagctcgaatctgtgaataaattatatcaggatgagaaggccgtacttgtcaacaatatcacaacaggcgagcgcctgatccgagtgctgcaatag

SEQ ID NO: 28819 - DNA, 279 bp, Artificial Sequence
  Description of Artificial Sequence: Synthetic coding sequence
atgaagccaattcaaaagctgctggctggcctgattcttttaacttggtgcgtggagggatgcagttctcaacattggtcatatgggctgaggcctggtgggaaaagagacgccgagaatctcatcgatagcttccaggagattgtgaaagaagtcggtcagctagccgagacgcagcgctttgaatgtacgacccatcagcctagatcaccattgagggatctgaagggagccctcgagtctctcatagaagaggaaacaggacagaagaaaatctag

SEQ ID NO: 28820 - DNA, 279 bp, Artificial Sequence
  Description of Artificial Sequence: Synthetic coding sequence
atgaaaccgatacaaaaactactggccggactcatacttttgacttggtgtgtggagggctgttcctcgcagcattggagttatggattgcgtcctggcggaaaaagggatgctgaaaacttgatagactctttccaggagattgtgaaagaggttgggcagttagctgagacccagcggtttgagtgtaccacccatcagccaaggtctcccctgcgagacctgaaaggggctctggaaagcctgatcgaggaggagactggccagaaaaaaatatag

SEQ ID NO: 28821 - DNA, 774 bp, Artificial Sequence
  Description of Artificial Sequence: Synthetic coding sequence
atgcccgcatccatgttctccatcgacaatatcctcgcggcaagacccaggtgcaaggactcagtcttgccggttgcacatagtgccgctgcccctgttgtgtttcctgctttgcacggggatagcctatatggggcttcgggcggtgcaagtagcgattacggggcattctaccctaggcccgtcgccccaggaggagccggtctgcctgccgctgtcagcggcagccgtcttggctacaataattacttctacgggcagttacacgtgcaagctgcacctgtggggcctgcttgctgtggcgcagtgcctcccctcggcgcacagcagtgcagttgtgtccccactcccccaggctatgagggacctggttccgtactcgtgtcacctgtgcctcaccaaatgctgccatacatgaacgtgggcaccctgagccggaccgaactgcagttgctgaaccagcttcattgcaggaggaagcggaggcacagaacaattttcacggatgaacagcttgaagccctcgagaacctgtttcaggaaaccaagtaccctgacgtcggcacacgcgagcagctggcacggaaggtgcacctccgggaagaaaaggtcgaagtctggtttaagaatcgcagggccaaatggcgtagacaaaagcggagctctagcgaggaatctgaaaacgccgagaagtggaataagacttcctcatccaaagctagccccgagaaaagggaggaggaaggcaagtcagacttggattctgactcctag

SEQ ID NO: 28822 - DNA, 654 bp, Artificial Sequence
  Description of Artificial Sequence: Synthetic coding sequence
atggcttacccgggttatggtggaggtttcgggaatttttcgattcaggtgccagggatgcaaatgggtcagccagtgccagaaactgggccagccatcttattggacggatattctggtccagcctatagtgacacctactcatcggctggcgacagtgtgtatacatacttctccgctgtcgcaggccaagacggagaagtggatgccgaagaactccagcgttgcctgacccaaagcgggataaacggcacatacagcccctttagcttagaaacctgtcgcataatgatcgcaatgctggatagggatcacaccggcaagatgggctttaatgcgtttaaggagttatgggctgctctgaacgcgtggaaagaaaactttatgacagtggatcaagacggcagcggtacagttgagcaccacgagttaagacaggccatcggcctcatgggttatcggctgagtccccagacgctgacgactatcgttaaacgatattccaaaaatggcaggattttcttcgacgactacgtggcttgttgtgtgaagctgagagcgttaacggatttcttccggaagagagatcacttacagcaaggctccgccaacttcatctacgatgactttctgcagggaaccatggccatctag

SEQ ID NO: 28823 - DNA, 438 bp, Artificial Sequence
  Description of Artificial Sequence: Synthetic coding sequence
atggccacgtgggctttgctgctgctcgccgcaatgttgctggggaatccgggactcgtcttctcaagactaagccccgagtactatgaccttgcaagagcccatttaagagacgaggagaagagttgtccatgtctcgcccaggagggaccacaaggggacctgctgacgaaaacacaggagttagggcgagactaccggacttgcctgacaattgtgcagaagctcaagaagatggtcgacaaacccacacagagaagtgtttctaatgcggctactagggtctgtcgcaccggccgaagccggtggagggatgtttgtaggaactttatgaggaggtatcagtcacgagtgacacaggggctggttgctggcgagacagcccagcagatttgcgaggatctgcggttgtgcataccgtcgacagggcctctctag

SEQ ID NO: 28824 - DNA, 393 bp, Artificial Sequence
  Description of Artificial Sequence: Synthetic coding sequence
atggagggattggtgttcagccgactgtctccggaatactacgacttggctagggcacaccttcgtgacgaggagaaaagttgtccctgcctcgcacaggagggacctcagggtgaccttcttacaaaaacccaggaattgggaagagattaccggacatgtctgactatcgttcaaaagctcaaaaagatggtcgacaaaccaacacaaaggtccgttagtaacgcagctacacgcgtatgcagaaccgggcgttcaagatggagagatgtttgtcggaacttcatgcgcaggtatcaaagcagggtcacccagggattggttgcaggagagacagctcagcaaatttgcgaagatcttcgactgtgcatcccctcaacagggccactatag

SEQ ID NO: 28825 - DNA, 555 bp, Artificial Sequence
  Description of Artificial Sequence: Synthetic coding sequence
atgagtagaaccgcttataccgttggcgctctcttacttctattgggtacactcctacctgccgctgagggcaagaaaaagggctcccaaggggcaatcccccctccagacaaagcacagcacaacgattccgaacagacccagtccccccaacagcctggctcacggaatagagggcgtggccaaggaaggggtacagcaatgcctggcgaggaagtcctcgaaagctcacaggaggctctgcacgttacagagcgtaaatatctcaagcgtgattggtgcaaaacacagcccctcaagcagacgatccacgaggaaggctgcaattctcggaccattatcaatagattctgctacggacagtgtaattctttttacatccccaggcacatcaggaaggaagaggggagtttccagtcctgcagcttctgtaagcctaaaaaatttacaaccatgatggtcacgctgaattgtcccgagcttcagccacccacaaaaaagaagagggtcactcgagtcaagcagtgtcggtgtattagcattgatctggactag

SEQ ID NO: 28826 - DNA, 432 bp, Artificial Sequence
  Description of Artificial Sequence: Synthetic coding sequence
atgtctcgtacagcctacacggtcggggcactgctattgctcctgggaacgttgctgccagctgctgaaggaaaaaagaagggttctcagggtgccattcccccaccagacaaggccctccatgttactgagcgcaagtatctcaagcgggattggtgcaaaacacagcccctcaagcagaccatccacgaagaggggtgcaacagtcgcactatcattaacagattttgctatggacagtgtaacagtttctatatacccaggcatataaggaaagaagagggaagcttccagagttgttccttctgcaagcccaaaaagttcacaaccatgatggtgacactgaattgtcccgaactgcagccaccaaccaagaagaaaagggtaacccgggtgaagcaatgtcggtgtatcagtattgacctggactag

SEQ ID NO: 28827 - DNA, 432 bp, Artificial Sequence
  Description of Artificial Sequence: Synthetic coding sequence
atgtctcgcactgcatacactgtgggagcgcttctgctgttgctaggtacattactgcccgcagctgaaggcaaaaagaagggcagccagggcgctatcccaccgcctgacaaggccctccacgtaaccgaaagaaagtatttgaaacgggactggtgcaaaacacagccactgaagcaaaccatacacgaggaaggctgtaattcacgtacaatcattaaccggttctgctatggacagtgtaattctttctacatcccacgacatattcggaaagaagaagggtcatttcagtcttgtagcttctgtaaacctaagaaatttactacaatgatggtcaccctgaactgccctgagctgcagcccccaacgaaaaagaaacgggtcactcgcgttaagcagtgtagatgcatctcaattgacttggattag

SEQ ID NO: 28828 - DNA, 396 bp, Artificial Sequence
  Description of Artificial Sequence: Synthetic coding sequence
atgacattggaagagttttctgccggtgagcagaaaacggaatcagatcccgataacgttgtgctgtgtctcttggccgctgacgaagacgacgatagagatgtcgcccttcagatccacttcaccttaattcaggccttctgctgtgagaacgacattaatattctgagggtctcaaatcctggaagattggccgaactgctgttgctcgagaccgacgccggtcccgcagcatcggagggagcggaacagccccctgaccttcactgcgtgctggtaacaaatccccatagcagtcagtggaaggaccccgctctcagccagctgatttgtttctgtcgcgaatcccggtatatggaccagtgggtccctgtcatcaacctgcccgagaggtag

SEQ ID NO: 28829 - DNA, 498 bp, Artificial Sequence
  Description of Artificial Sequence: Synthetic coding sequence
atgacacttgaagaatttagcgccggtgagcagaaaacagagaggatggataaggtgggcgacgccctcgaggaggttttatccaaggctctctctcagcgcacgataacagttggggtgtatgaggcggcaaaactcttgaacgttgatccagataacgtggtgctgtgcctgttggctgccgatgaagatgatgacagggacgtagccctccagattcatttcacactcatacaggccttttgttgcgagaacgatatcaacattcttcgcgtctctaacccgggaaggctggccgaacttctgctcctcgagaccgacgccggacctgccgctagtgaaggtgcagagcagccccctgacttgcactgtgtgcttgttaccaatccccacagctcccagtggaaggatcccgcactttcccagcttatctgtttttgtagggagtctcggtacatggatcagtgggtcccggtgatcaatctaccagaaagatag

SEQ ID NO: 28830 - DNA, 3693 bp, Artificial Sequence
  Description of Artificial Sequence: Synthetic coding sequence
atgtctgctctctgttgggggaggggagctgctggtctcaagagggcactccgaccttgtgggagacctgggctccctggaaaagaagggacggcaggcggtgtgtgcggcccaagacgctccagtagcgccagtccgcaagagcaggatcaggatcgccgaaaggattggggacacgtcgagctactcgaagtgcttcaagcacgagtgagacagctgcaggcagagtcggtgtccgaagtggtcgtgaacagagtcgacgtcgctcgccttcccgaatgtggttccggagacgggtcactgcagcctccaaggaaggtgcaaatgggagctaaagatgctacccccgttccgtgtggcagatgggccaagatcctggaaaaagataagcgaacccagcagatgaggatgcagagactgaaagccaaactgcagatgccgtttcagtccggagagtttaaggcactcacacgcagactccaggttgaacctagactgctgagcaaacagatggcagggtgcctcgaagattgcacgcgccaggcacctgagtcaccatgggaggaacagctcgctcgcctgctgcaagaggccccaggcaagctcagcctggacgtggaacaggcaccaagtggccaacatagccaggctcaactcagtgggcagcagcaacggctgctggcgtttttcaagtgttgtctactgacagaccaactgcccctggcccatcatttgctggtcgtacaccatggacagcggcagaagaggaaactactaactctcgatatgtacaacgcagtaatgctgggttgggctcgtcaaggtgccttcaaagagcttgtctatgtcctcttcatggtgaaagacgcgggactcacccccgacctactgagttacgccgctgctttacaatgtatgggccgacaggaccaagacgccggtaccatcgaacgatgcctggagcagatgagtcaggaaggacttaagctccaggccctgttcaccgctgttctgttatcagaggaggatcgagccaccgttctgaaggctgtgcataaggtcaagccaacattttcactcccccctcagctcccacctcctgttaacacttcaaaactgctgcgcgacgtgtacgccaaagatggtagagtctcttatcccaagctccacctccccctaaagaccctgcagtgtctgttcgaaaaacagctccatatggagctggcaagccgggtatgcgtggtgagcgtagagaaaccaaccttgcctagtaaggaggtaaaacacgctaggaaaaccctcaagaccctacgggaccaatgggagaaagctctgtgccgagctttgcgtgaaaccaagaaccgactcgagagagaggtttacgaagggaggttttccctgtacccctttctgtgtctgctcgacgagagggaagtcgtgagaatgctgctacaggtgctacaggctttaccagcacagggggaaagttttacgaccctggccagagaactgagtgctaggactttttctcggcacgtcgtgcagagacagagagtgtctggacaggtacaagccctgcagaaccattacaggaagtacctgtgtcttttagccagtgacgcagaagtgccagaaccctgccttccacgtcagtactgggaagagctgggagctcccgaggcgcttagagaacaaccatggcctttgcccgttcagatggagctgggtaagctccttgccgagatgctcgtgcaggccactcagatgccttgctctttggacaaacctcatcggtcttcccgtctggtacctgtcctttatcatgtgtatagcttccggaacgtgcagcagatcgggatcctgaaaccccacccagcctatgtgcagctgcttgagaaggcagccgagccaactctcactttcgaggccgttgatgttcctatgctatgcccaccgcttccttggactagcccacacagcggcgcatttttgctgtctcccacaaagctcatgcgcaccgtcgaaggggcaacccaacaccaggagctcctggagacatgtccacccacagcgttacacggggctctcgatgcactgacgcagttgggcaactgcgcctggcgtgtgaacgggagagtgctggatttagttcttcagctgtttcaggctaaaggctgtccccagctcggggtaccagcgccaccatctgaagcccctcagccgccagaagcgcacttaccccattccgccgcacccgcacggaaggcagaactgaggcgtgagctggctcattgccagaaggtggccagggagatgcattccctgcgcgctgaagcactgtatagactctccctagctcaacacctgagagatcgggtcttttggctcccgcacaacatggattttagaggacgaacttacccatgccccccacacttcaaccaccttggcagtgacgtcgccagggccttactagaattcgcccagggcaggccactcggccctcatggtctggattggctgaaaatccatctcgtgaacttgaccggcctgaaaaaacgtgaaccattaaggaaacgcctggccttcgcagaggaggtgatggatgacattttggactccgcagatcagcccttgacagggagaaagtggtggatgggagcggaggaaccttggcagacactcgcatgttgcatggaagtcgccaatgcggtacgggcttccgatcctgctgcctacgtttcacacttgcctgtccatcaggacggcagctgtaatggactccaacactatgccgctctgggcagggactctgtgggcgctgctagtgtcaatctggagccttccgatgtgccacaggacgtgtatagcggagtggcagctcaggtagaggttttccgaaggcaggacgcccagcgcggtatgagagttgcacaagtcttagaaggcttcatcacacgtaaagtggtgaagcaaacggttatgaccgtcgtttacggggtgaccaggtatggagggcgtctgcagattgagaaacgcctcagggagctgtcagacttccctcaagaattcgtatgggaagccagccattacctggtgcggcaggtgtttaaatccttgcaggaaatgtttagcggcactcgggcaatccaacactggctgaccgaatccgccagactgatttcacacatgggtagtgtggtggagtgggttacaccattaggagtgcccgtgatccagccgtacagactcgacagtaaggtgaagcagatcggtggtggcattcagagcattacctatacccacaacggggatatctctcgcaagcctaatacccgaaaacaaaaaaacggcttcccacctaacttcatccattccctggactcttctcatatgatgttgacagcattgcattgctaccggaaaggtcttacctttgtttccgtgcatgactgttactggacgcacgcagctgacgtctctgtgatgaatcaggtctgtcgggagcaattcgtaaggctccattctgaaccaatactccaggacctttcccgattcctggtgaagcgcttttgttccgagcctcagaagatattggaggcctcccaattgaaagagactttgcaggcggtgcccaagcctggagccttcgacttagagcaagttaagcggtccacctacttttttagttag

SEQ ID NO: 28831 - DNA, 480 bp, Artificial Sequence
  Description of Artificial Sequence: Synthetic coding sequence
atgactctcgaagaagtacgaggccaggatactgttcctgagagtacagctaggatgcagggcgctggcaaggctctgcacgaactgctgctgtcagcccagaggcaaggctgcctgaccgccggagtctacgagtcggccaaggtcctcaatgtggacccggataacgtgacattctgtgtactggccgctggggaggaggacgagggggacatcgctttacaaatacactttacactgatccaagccttctgctgcgaaaacgatatcgatattgtgagagttggcgacgttcagcggctggcggcaattgtcggagcaggcgaagaggccggagcccctggggacctccattgcattctcatctcaaatcccaacgaggatgcctggaaggatcctgccctggagaaattgagcctattttgtgaggagtctcgcagtgtaaatgattgggtcccgtcaatcacgttaccagaatag

SEQ ID NO: 28832 - DNA, 426 bp, Artificial Sequence
  Description of Artificial Sequence: Synthetic coding sequence
atgcagggcgcagggaaggcactgcatgagctcctgctatcggcccagagacaaggatgtctgacagccggagtttacgagagtgccaaagtgttgaatgttgacccagacaacgtgaccttttgtgtgttggctgctggagaggaagatgagggtgacatcgccttacagattcactttaccctgatccaggctttttgttgtgaaaacgacattgatatcgtaagagttggggacgtacaacgacttgccgcaatagtgggagcaggtgaggaggctggtgccccaggcgatcttcattgcatcctgatcagcaacccaaatgaggatgcctggaaagatccagcgcttgaaaagctctctctgttctgtgaggagagcaggtcggtcaatgattgggtgccaagtatcacattgcccgaatag

SEQ ID NO: 28833 - DNA, 2085 bp, Artificial Sequence
  Description of Artificial Sequence: Synthetic coding sequence
atgcagcctgccatccaggtttggtttggagaggatctaccactgtcgccgcgttcccccctgacgcctaggcacggacccggtcttgctaacgtctgtcagtacgacgaatggatagcagtgcgccacgaagctacgttattgcctatgcaggaagacctatccatctggctgtcaggactcctggggattaaagtaaaagctgaaaagttgctggaggagctggacaacggcgttctgctgtgccagctgattgatgttctccagaacatggtgaagacatgcaattctgaagagtctggaaatttccctatgaggaaagtcccttgcaagaaggatgccgcaagtgggtccttctttgcacgagacaacacggcgaactttttgcactggtgccgcgacataggcgtcgacgagacctacctatttgaatctgagggccttgtccttcataaagatccaaggcaggtttacctctgcctgctagaaatcggcagaatcgtttctaggtacggtgtcgaacccccagtcctcgtcaagcttgagaaagaaattgagctagaggagactttgctgaacaccagtggacccgaagactcaatttcaatccctaaatcctgttgccgccacgaggaacttcatgaggccgtgaagcatattgccgaggaccccccttgcagctgcagccatcggttttccattgaatatctgtcagaggggcgttaccgactgggggacaaaattctgtttatccgcatgctgcacggtaagcacgtgatggtgagagtagggggtggatgggacactctgcaggggttcctgctgaaatacgatccatgccgcattctgcagttcgccaccctggagcaaaagatactggccttccagaagggtgtgagtaatgaatctgttcctgattcccccgctcgcaccccccagccaccggagatgaatcctctttccgcggtgaatatgtttcagaaacagaattctaaacccagcgtaccggtgtcgatacctaaaagcaaagagaaacagggtcgtcctcccggagcgctcgtgcctgcatcaagcttgaaaggcggaaatctgggctcaatgagcgttagatccaaactgcctaactccccagccgcttcatcccaccctaagctgaagtcttccaagggaatcacaaagaaaccccaggccccatccaataatgcaagcagctccctcgcttctctcaacccagtcggaaagaatacgtccagccctgctttgcctcgaactgcaccatgtatttcagagagtcctagaaaatgcatctccagtcccaacactccaaaggctaaggtgattccagctcaaaacagtgcggatctccccgagagtacgctattacctaataaatgctccgggaagactcagcccaagtacctgaagcataaccatattagctctcgggataatgcggtgtcccatctggccgctcatagtaatagcagctctaaatgccctaagctaccgaaagccaatattcctgtccgaccaaagcctagttttcagagtagcgctaaaatgacgaaaacaagctcgaagactatcgcaaccggcctgggaacacagtcacagccaagcgacggcgcaccacaagcgaaacccgtccccgcacaaaagctgaaatctgcccttaacctgaaccagccagtcagcgtgtctagcgtttctccggttaaggcaactcagaagagcaaggacaagaacatcgtttccgcgacaaagaaacagcctcagaataaaagcgccttccagaagactggtccctcttctctcaaatctccaggcagaacaccactttctattgtgagcctcccacaatcatcaaccaaaacccagacggcccctaagagcgcccagaccgtagcaaaaagccagcatagcactaagggccctccaagaagcgggaaaacccccgctagtataaggaaacctcccagctctgtgaaagacgccgacagtggggataagaagcctaccgccaaaaagaaggaggatgacgatcactacttcgtcatgacggggtctaaaaaaccacggaagtag

SEQ ID NO: 28834 - DNA, 2085 bp, Artificial Sequence
  Description of Artificial Sequence: Synthetic coding sequence
atgcaaccagctatacaggtttggtttggcgaagacctgcccctttctccacgctccccccttactcccagacacggtcctggactggcgaatgtgtgccaatatgatgagtggattgcagtgcgccatgaggccactctgctcccaatgcaagaggacctcagtatctggctaagcggactactggggattaaggtcaaagctgaaaagttgcttgaagagctcgataacggagttctgctgtgccagttgattgacgtgctgcagaacatggtgaaaacctgtaatagcgaggaaagcggaaattttcctatgagaaaggtcccttgtaaaaaggatgccgcttcagggagtttcttcgccagagataataccgcaaatttcctgcactggtgtagggatatcggcgtcgacgaaacctatttgtttgaatctgagggcctcgtgctgcataaggacccaagacaagtgtatctgtgcttgctcgagataggtcgaattgtgagccgctatggagtggaacctcccgtgttggtgaaactcgagaaagagattgaactcgaagagacattactcaacactagcggcccagaagacagcatttctatccccaaatcttgctgcagacacgaggagctccatgaggccgtcaagcacattgccgaggaccctccttgttcatgtagccatcgattcagcattgagtacctctcagagggcaggtatcgactgggagacaaaattctgttcattcgaatgctgcacgggaaacatgtcatggttcgggtcggaggcggatgggatactctgcaggggttccttttgaagtacgatccctgccgaattctgcagttcgccaccttggagcaaaaaatcctagcgttccaaaaaggtgtgtccaacgagtccgtccctgactcccctgctagaacgcctcaaccgccagaaatgaacccgttgagcgcagtcaatatgtttcagaagcaaaacagcaagcccagtgtgcccgtttctatacctaagagcaaggagaagcaaggccgaccacccggagccctggtgcctgcttcgagtctgaaggggggaaacctgggcagcatgtctgtccggtccaaacttcccaattccccagcagcatcaagtcacccgaagctgaagtcaagtaaaggcattacgaaaaaaccgcaggcgccaagcaataatgcctcgtcatccctcgcgtcactgaatccagtgggaaagaacactagcagcccagccttacccaggacagccccatgtatctccgagtcgccgaggaaatgtatttctagccctaataccccgaaggcaaaggttattccagcccaaaactcagcagatctgcccgaatctactctactaccaaacaaatgtagcggcaagacgcagccaaagtacctcaagcataaccatattagcagcagggataatgcggtatcacacctggctgcccacagcaattcctccagcaagtgccccaaactcccgaaggccaatattcccgttagaccaaagccgagcttccaaagttccgcaaagatgactaagacatcatctaaaaccatcgctacaggccttggaactcagtcccagcctagcgatggcgctccccaggccaaacccgtccccgctcaaaagctaaagagcgcacttaacctgaaccagcctgtgtctgtatcctcagtctcgcccgttaaagcaacccagaaaagcaaggacaaaaatatcgtgagcgcgactaaaaaacagcctcaaaacaagtccgcgttccagaaaacaggcccatctagcttgaagtcccctggacgaaccccgctgtctatagtgtccctaccacagagtagcacaaagacacagaccgcccctaagagcgcgcagacggttgctaaaagccaacattccactaagggccctccaaggagcgggaaaacacccgcttcgataaggaagcctccaagctctgtgaaagacgccgactccggcgacaaaaagcctaccgctaaaaagaaagaagatgacgaccactatttcgtgatgaccgggtccaaaaagcctcggaagtag

SEQ ID NO: 28835 - DNA, 2085 bp, Artificial Sequence
  Description of Artificial Sequence: Synthetic coding sequence
atgcagcccgctatccaagtgtggtttggcgaagatctccctctgtccccacggagcccacttacaccacgccacggtcccggacttgccaatgtgtgccagtacgatgagtggatcgcagtgcgccatgaggccaccttgctgccaatgcaggaggacctgagcatctggttgtccggtctgctggggataaaggtaaaggccgaaaagctgctagaggagctggataacggcgtgctgctctgtcagctcattgatgtgctgcagaacatggttaagacctgcaatagtgaggagtcaggaaactttcctatgagaaaagtgccttgcaaaaaggatgcagcgagcggctcgttttttgcgagggataatacagccaacttcctgcactggtgtcgcgatatcggcgtggacgaaacatatctgttcgagtcggaggggttggtgcttcacaaggacccgaggcaggtatatctgtgcctgctggagatcgggaggattgtttcgcgctatggtgtcgaaccgcctgtgctcgtgaagctagaaaaagagatcgagcttgaggagaccttattgaacaccagcggacccgaagattcaatttcaattcctaagtcttgttgtcgacacgaagagctgcatgaagctgtgaagcacatagcagaagacccgccatgttcttgcagtcaccgtttctctatagaatacctgtccgaaggcagatatcgattgggcgacaagatcttgttcattcgaatgctccatgggaaacatgttatggtaagggtggggggtggatgggatacgctgcaagggtttctgttgaaatatgacccatgtcggattctgcagtttgccaccctggagcagaagatcctcgctttccagaagggagtgtcaaacgaatcggttccggactctcctgcccgaacacctcagccaccagagatgaacccactctccgcggttaatatgttccagaaacagaattctaagcctagtgtccccgtgtccattccaaagtcaaaagagaaacagggcagacccccaggtgcactggtcccagcctctagcctcaaggggggtaatctgggtagcatgagcgtcaggagtaagttgcccaactcgccagcggcttcctcacaccctaagctgaaaagctctaagggcattacgaaaaagccacaggccccatctaataatgccagttccagcctagcctctctcaatcctgtgggcaaaaatacatcttcccctgcacttccgcgaaccgcgccttgcatatctgagtctcctcggaagtgtatatcttctcccaacacaccaaaggccaaggtgataccggctcaaaacagcgccgatctacctgaatctactctgctgcccaacaagtgctcagggaaaacacagcccaagtacctgaaacacaaccatattagtagccgggacaacgcagtcagccatttggcagcccacagcaactcaagctctaagtgtccgaagctgccaaaagccaatatcccagtgaggcccaagccttccttccagagtagtgccaagatgaccaaaaccagtagtaagacgatagctacagggcttggcactcagagccagccaagcgatggagcaccccaggctaagccagtgcccgcacagaagcttaaaagcgctttaaacctgaaccagccagtgtctgtgagctctgtgagcccagtcaaagccacccagaagagcaaggataagaacatcgttagcgccaccaaaaagcagcctcagaacaaatcggcttttcaaaaaacgggcccttcttcgctcaagtccccaggcagaacccccctatccatcgtaagcttacctcagtcttccaccaaaacacagacagcccctaagtccgcccagaccgtggctaaaagtcaacacagtaccaaaggaccaccgaggagtgggaagactccagcaagcatcagaaaacccccttcatccgtgaaggacgctgattccggagacaagaagccaactgccaagaagaaagaagatgacgatcactactttgtgatgactggctcaaagaaacctagaaagtag

SEQ ID NO: 28836 - DNA, 150 bp, Artificial Sequence
  Description of Artificial Sequence: Synthetic coding sequence
atgcagccggctattcaggtctggtttggagaagacctcccccttagtccccgttcccctctgacccctcgccacggaccgggtctcgctaatgtttgtcagtacgatgaatggatcgcagttagacatgaggctacattattgccatag

SEQ ID NO: 28837 - DNA, 1611 bp, Artificial Sequence
  Description of Artificial Sequence: Synthetic coding sequence
atgaacgcgtctctggagtccctatacagtgcctgtagcatgcaaagcgatacagtacctctgctgcagaatggccaacatgctcgttctcaaccgagggcgagtggcccaccacgtagtattcagccacaggtaagtccacggcagcgagtacagaggtctcagcccgtgcatattctcgccgtccgcagactgcaggaagaagatcagcagttccgtacatccagtttgccagctattcccaatccgtttcctgagctgtgtggacccggaagcccacccgtgcttaccccaggttcccttccaccttctcaagccgcagccaaacaggacgtcaaggtgttttccgaggatggaacctcaaaggtagtggagattctcgctgacatgacagcaagagatctgtgtcagctgttagtttataagtcacactgcgttgatgacaatagttggacgctggtggaacaccaccctcacctgggccttgagcgctgtttggaagatcatgaacttgtggtgcaagtagagtcaactatggctagcgagtctaaatttctgttcaggaagaactacgccaagtatgagttcttcaagaaccccatgaacttcttccccgaacagatggtgacttggtgtcagcagtctaacgggtcacagacccagctgctccaaaacttcctgaattcttcatcttgtccagagatccagggcttcctgcacgttaaggagctggggaaaaaatcttggaagaaattatacgtctgcctacgtcgctctggattatattgttctactaaggggaccagcaaagaaccacggcatctgcaactgctcgctgacctggaggattcgaatatcttcagtttgatcgccggacgcaagcagtataacgcccctacagatcatggcctatgtataaaacctaacaaagtaagaaacgagacgaaggaactcagactgttgtgcgctgaggatgaacagactcgcacctgctggatgacagccttccgcctgctgaagtatgggatgcttctctatcaaaactaccgaattccacagcaaagaaaagctctgctgagcccattctccacccccgttcggtctgtctccgaaaattcgcttgttgccatggacttttccggacaaaccggtagagtgatagaaaaccccgctgaagcacaatccgctgccttagaggaaggccatgcatggcgtaagaggtccacccgcatgaatattcttggttctcagagcccactccacccctcaacgttaagcacagtgatacacagaacccaacactggttccatggaagaatatcgcgagaggagtctcacaggatcatcaagcagcagggcctagtggacgggctgtttctactgcgtgattctcaatcaaaccctaaggcttttgtactaaccctgtgccatcaccaaaagatcaaaaactttcagattctaccttgcgaggatgatggccagacctttttctctctggatgatggcaatacaaaattttctgacctgatccaactggtggatttttaccagctcaacaagggtgtcttaccttgcaagctgaaacaccactgcatccgagtcgctctctag

SEQ ID NO: 28838 - DNA, 1647 bp, Artificial Sequence
  Description of Artificial Sequence: Synthetic coding sequence
atggctctggccggatgtcccgactcctttctccaccacccatactatcaggacaaggtggaacagacaccaaggtcccaacaagatccagcaggccctggtttacctgctcaaagtgacagactggctaaccaccaggaggacgacgtcgacctggaagctctggtcaacgatatgaacgccagcctggagagcctttacagcgcatgctcgatgcagagcgatacagttccactgctccagaatgggcagcacgccaggtctcagccaagggcttccggcccacccagatccatccagccacaggtgtccccccgacagagagtgcagaggtcccaacccgtccatatcctggccgtgagacggctgcaggaggaagatcagcagtttagaaccagtagtctccctgcaatacctaatcccttccccgagctatgcggccctgggtctcctcctgtgcttactcctggtagcctgcctcctagccaagccgctgccaaacaggacgtcaaagtgttttcggaggacggaacttctaaggtggtggagattcttgcagatatgacagctagagatctatgtcaactgctagtatacaaaagtcactgcgtcgacgataattcatggacattggtcgaacatcatccacacttaggcctcgaacgatgtctggaagaccatgaactggtggtacaggttgaaagcaccatggcgtccgagagtaagtttctgtttagaaaaaactacgctaagtatgaattttttaagaaccctatgaacttcttccctgagcagatggtgacgtggtgccagcaatctaacggcagccagacacagcttcttcaggaaccaaggcacctgcaacttctcgccgatctcgaggacagtaatattttctcattaatcgcaggcaggaaacaatataacgccccaaccgatcatgggttatgtatcaagccaaacaaagtccgaaatgagacaaaagagttacggctactctgtgccgaagacgaacagacccgaacatgctggatgactgcgttccgcctgctgaagtatggaatgttgctgtaccagaactatcgaatcccccagcaaagaaaagcattgttgtcacccttctcaacccctgttcgctccgtcagcgagaactccctggtagccatggatttctctgggcaaactggtagagtgatcgaaaacccggcagaggcccagtctgcagccctcgaggagggtcatgcgtggcggaagcgcagtaccagaatgaacatactgggtagccagagtcccctccatccttctaccctatctaccgtgatccaccgcacccagcactggtttcacggcagaatctcccgggaagagtctcatcgcataatcaagcagcaggggctggtcgacgggctctttctgctccgggatagtcaatccaacccaaaggctttcgtgctaaccctgtgtcaccatcagaagatcaagaactttcagatcctgccatgcgaagacgatggccaaacattcttcagtctagacgatggtaacaccaagtttagcgacctcatccagttagtggacttctatcagctgaacaaaggggtgttgccatgcaagctgaaacatcattgcattagggtggcactgtag

SEQ ID NO: 28839 - DNA, 381 bp, Artificial Sequence
  Description of Artificial Sequence: Synthetic coding sequence
atgaacattctgggctctcagtcccccctgcacccttccaccctctcaactgttatccacagaacccagcactggtttcacggaagaattagccgcgaggaaagtcaccggatcattaagcagcaaggacttgtagacggtctctttttgttgcgagactcccagtccaacccgaaggcctttgtgctgacattatgtcatcaccagaagattaagaatttccagattttaccctgtgaggacgacggccagactttcttctccttagacgacgggaatactaagttttcggatctcattcagctggtcgatttttatcagttaaacaagggggtgctaccttgcaaactcaagcaccactgcattagggtggctctttag

SEQ ID NO: 28840 - DNA, 1611 bp, Artificial Sequence
  Description of Artificial Sequence: Synthetic coding sequence
atgaacgcaagcctagaatcactgtattccgcatgttcaatgcagtcggacactgtgcccctcctgcagaacggccagcacgcaaggagccagcctcgcgctagcgggcctcctaggagcatccagccgcaggtgtcccctaggcagagggttcaacgctcccaaccggtacacattctggccgtccggcgactgcaggaggaggatcagcaatttagaacttcaagccttccggcaattccaaatccatttccagagctatgtggtcccggaagtccacctgtcttaactccgggaagcctgccgccttcacaggccgctgccaagcaggatgtgaaagtgttttctgaagatggcaccagcaaggtcgtggagatcttagcagatatgactgcccgtgacctgtgtcagttattggtttacaagtcccattgcgtggacgacaacagttggactcttgttgaacatcaccctcacctcggcctcgagcgttgcttagaggaccacgagcttgtcgtgcaggtagagtctacaatggcaagcgagtctaagtttctgtttcggaagaactatgcaaagtacgagttctttaaaaacccaatgaatttctttcccgagcagatggtcacctggtgtcagcagagcaacggaagccaaacccagctgctgcaaaactttctcaactcaagcagttgcccagaaatccaggggttcctgcacgtcaaggaactgggaaagaaatcatggaagaaactgtacgtttgtcttcggcgatctggactctactgttccacgaaaggcacctccaaggagcctcgacatttacagctcctcgcagatctggaggacagcaatatattttcactcattgccggtcgcaaacaatacaacgctcccaccgaccatgggctctgcatcaagcccaataaggtccgtaatgagacgaaggagttacgtttgctgtgcgccgaagacgagcagacacgcacctgctggatgaccgccttcaggcttctgaagtatggcatgttgctgtaccaaaactaccgcatcccccaacaacgtaaggccttgctctctcctttctcaacccctgtgcggagtgtgtcagagaactcgctagtcgcgatggacttcagtggccaaacaggcagagtcattgaaaatcccgctgaagctcagtctgccgctctagaagagggtcatgcctggaggaagaggagcaccaggatgaacatcctgggctcacagtctcctttacatccttcaactttgagcacagtaattcaccggacccaacactggttccatggacggattagccgtgaagaatcccatcggatcatcaagcagcaggggcttgtggacggactctttctattacgtgatagtcaatcaaacccgaaggcattcgtattaactctgtgtcaccatcagaaaatcaagaactttcagattctcccttgcgaagacgacggtcagacgttctttagtctggacgacgggaacacaaagttttcagatctcattcagctggtagacttttaccagctgaacaagggtgttctcccttgtaaactcaagcaccattgcatccgggtggctctttag

SEQ ID NO: 28841 - DNA, 1785 bp, Artificial Sequence
  Description of Artificial Sequence: Synthetic coding sequence
atggcattggccggatgccccgacagttttctacatcatccttattatcaggacaaagtggagcagacacccagaagccagcaggaccctgctggcccaggcctccctgcccagtctgatcgcctggcgaaccaccaggaggatgacgtggatttagaggcgttggttaacgacatgaacgcctcactggagtcactgtactcggcctgcagcatgcagagtgacactgtccctctgcttcagaacggtcaacacgccagaagtcagcctcgcgcttcaggtccacccaggagcatccaaccacaggtgtctcctcgccagcgggttcaacgctcccagcccgtgcacattctggcagtgaggagactccaggaagaggaccaacagttcagaacctcctctctaccagcaatccccaatcctttccctgagttgtgtgggcctggaagcccaccagttctgacccccggatcccttcccccttcccaagccgcagctaagcaggatgttaaggtgttctctgaagacggcacctcaaaagtcgtcgagattttggcggacatgacggcaagggacctgtgccagttgctcgtgtacaagtctcattgtgtggacgacaattcgtggaccctagttgagcaccacccacatttgggcctcgaaagatgtttggaggaccacgagctagtggtccaagtggagtccaccatggcatccgaaagcaagttcctgttccggaagaattacgccaaatatgagttcttcaagaatcctatgaactttttccccgaacagatggtgacctggtgccaacagtctaacggttctcagactcagcttctacaaaattttcttaatagctcgagttgcccggagatacaaggattcctccacgtcaaagagctgggcaaaaagtcctggaaaaagctgtatgtgtgtctgcgcaggtctgggctgtactgctctactaagggcacctcgaaagagcccaggcacctccaacttctggccgacctcgaagattcaaacatattctcgctgatagccggacggaaacagtataacgcacctaccgatcatgggctttgtattaaaccgaataaagttaggaacgagacaaaagagttacgactgctatgtgccgaggatgaacaaacccgcacttgttggatgaccgcgtttcgtctgctgaagtacggaatgctgctgtatcagaattaccgaatcccccagcaaaggaaggcattactgagtcctttctccactcccgtcagatcagtcagtgagaattcgctggttgccatggacttttcagggcaaaccggccgagtcatagagaaccccgctgaagcgcagtccgcggcactagaagaggggcacgcatggaggaaacgttcaactcggatgaatatactgggatcacagtcccccctacaccccagtactctgagcaccgtgatccatcgcacacagcactggtttcacggcagaatctccagggaggagtctcatcgaattataaagcagcaaggcctggttgacggcctgtttctgctccgggatagtcagagtaatccaaaggcctttgtccttactctttgtcaccatcaaaagattaagaattttcagatcctgccttgcgaagatgatgggcagacatttttttcacttgacgacggtaatactaagtttagcgacttgatccaactcgtggatttctatcaactgaacaaaggcgttctaccgtgtaagctcaaacatcactgcatccgagtcgccttgtag

SEQ ID NO: 28842 - DNA, 1785 bp, Artificial Sequence
  Description of Artificial Sequence: Synthetic coding sequence
atggccctagcaggatgcccagactcgtttttacaccacccttactaccaagacaaagtggaacagacaccacgttctcaacaggatcctgccggacccggactgcctgcccagagtgaccgtctggcgaatcaccaggaagatgatgtggacctcgaagcactggtgaacgatatgaacgctagtcttgagtctctatattctgcttgctcaatgcagtccgataccgtgcccctgctccagaacgggcagcacgccaggagccagccgcgagccagcggcccacctcgcagtattcagccgcaggtctccccaaggcaaagggtccagcgctcccagcctgtgcacatcttggcggtccggagactccaggaggaggatcagcagtttcgcacctcctcactcccagcgattcccaatcctttccccgaactttgcggcccaggaagtcctccagtgttaacacccggttccctacctccgtcccaggcggcagctaaacaggacgtgaaagtctttagcgaggatggcacttcaaaagtggtggagatcctagccgatatgaccgcccgtgatctgtgccagcttctggtgtacaaaagtcactgtgtggatgacaacagctggaccttagtcgaacaccaccctcaccttgggctcgagcggtgtctcgaggatcatgagcttgtagtgcaggtggaatcgacaatggcctcggagtccaagtttctgttcaggaaaaattacgctaagtacgaattttttaagaaccccatgaacttctttccagaacaaatggttacatggtgtcagcagtccaacggatcacagacacagctgctccagaacttcctcaacagtagcagttgccctgagatccagggcttcctccatgtgaaagaactaggcaagaaatcttggaagaagctgtacgtgtgtctgcgaaggagcgggctttattgctctacgaaaggtacctccaaggagcccaggcacctgcagttactcgccgacctcgaggactccaatatttttagtctgatcgctggacgcaagcaatacaatgctcccactgatcacggcctgtgcatcaagccaaataaagtgcgtaatgagaccaaggaactgaggctgctttgcgctgaggatgagcagacacgcacctgctggatgaccgctttccggttgttgaagtatggcatgctactctatcaaaattaccggatccctcagcagcgaaaggcactgctctccccattctccacccctgtgcggtctgtctcggaaaattccctagtagcaatggacttctctggccagaccggacgtgtcatcgagaatcccgctgaggcgcagtccgcagcactcgaagagggacatgcgtggagaaaacggagcaccaggatgaacatactcggttcccagagccctctccacccctccaccttgtcaacagttatacatagaactcagcactggttccacggccgtatttcccgcgaggagagtcaccgcattatcaagcagcaggggcttgtggacggcctgtttctgctgagagattcccaaagcaatcccaaggcctttgttttgacactgtgccaccaccagaaaattaaaaattttcaaatcttaccctgtgaagatgacggacagacattctttagcctcgacgatggcaatacaaaatttagcgatctgatccaattggtggacttttatcagctcaataagggggtgttgccttgcaagctcaaacaccactgtatccgagttgcactttag

SEQ ID NO: 28843 - DNA, 1611 bp, Artificial Sequence
  Description of Artificial Sequence: Synthetic coding sequence
atgaacgcatctctcgagagtctgtattccgcctgcagcatgcagagcgataccgttcccttattacagaatggccagcatgcccgatctcagcctcgggcatctgggcctccgaggtctattcaaccgcaggtttcccctagacagcgggtgcagagaagtcaaccagtgcacatcctagcagtgcggaggcttcaggaagaggaccagcaattccggaccagctccttgccagcaattcccaacccattccctgaactctgcggacccggatcccctcctgtactgaccccgggtagcctccctcctagccaggcggctgcgaagcaggacgtgaaggttttcagcgaggacgggacctccaaagttgtcgagatactggccgatatgacggccagagacctctgccagctgctcgtgtacaagtctcactgcgtggatgacaattcctggaccctggtagaacaccaccctcatttagggcttgaacgttgcctcgaagatcacgaactggtggttcaggtggagagcacaatggctagtgaaagcaagtttctttttcgcaaaaactatgcaaagtatgaattttttaagaaccccatgaatttttttcccgagcagatggtgacttggtgtcagcaatccaacggttcacagacccaattgctacagaattttctgaacagctcatcatgtcctgaaattcaggggttcttacatgtaaaggaactgggaaagaagtcttggaaaaaactgtatgtgtgcctcagacggtccggactctactgcagtaccaagggtactagtaaagaaccacggcacctgcagctgcttgcagatctggaggatagcaacatattttccttgatagccggtcgcaagcagtataacgctcctaccgaccacggcctatgtataaaacctaacaaggtacggaatgaaacaaaggagctccgtctcctctgtgctgaggatgagcagactcgcacatgctggatgacggcttttcgcctgctgaagtatggaatgctgctgtaccaaaactatcggatccctcagcaacgtaaggctctactttccccgttttcaacacccgtccgcagcgtttcagagaattctcttgtcgccatggactttagcgggcagacaggtcgggtcattgaaaacccagcggaagcgcagtccgccgcattggaagaagggcacgcatggagaaagcgctccacccgaatgaatattctcgggagccagtcccctctccacccttccaccttatccactgttatacacagaacccagcactggttccacggcaggatttctcgtgaggagtcacataggatcatcaagcagcaagggctcgtggacgggctgtttctcctgcgcgacagtcaaagcaacccaaaggcatttgtgctgactctctgccaccatcagaagattaagaatttccagattctgccttgtgaggacgacggccagaccttcttcagtctcgatgacgggaacaccaagtttagtgatttgatccagctcgtggacttttaccagctgaataaaggtgtgctgccttgcaaactgaagcaccattgcatccgggttgccttgtag

SEQ ID NO: 28844 - DNA, 1611 bp, Artificial Sequence
  Description of Artificial Sequence: Synthetic coding sequence
atgaacgcatccctggagtcgctctacagtgcttgctctatgcagtctgacactgtgccccttcttcaaaatggacagcatgccagatcacagcccagggcttctggcccaccacgatccattcagccgcaggtcagccccagacagcgcgtgcagcgtagccagcctgtgcatatactggcagtacgcaggcttcaggaggaagatcagcagtttcgtacgtctagcctgcccgctatccccaatccttttccggagctttgcggacctggttctccccctgttctgaccccaggctccttaccaccaagccaagccgctgccaagcaggatgtaaaggtgttctcagaagatggcacttctaaagtggtcgaaatcctcgctgatatgactgcccgagatctgtgccagcttctggtgtataagtctcactgtgtggacgataactcatggactcttgtcgaacaccatccgcatctgggactggaacgctgtttggaagaccacgagctcgtggtccaggttgagtccactatggccagtgaatcaaagtttctattccgaaaaaactacgccaaatatgagtttttcaaaaaccctatgaacttctttcccgaacagatggttacctggtgtcagcagagcaatggcagccaaacccagctgctgcagaactttctcaacagtagctcatgtcccgaaatacagggatttctgcacgtgaaggaactcgggaagaagtcttggaagaagctgtacgtctgcctgcgccgaagcggattatattgttcaaccaaaggcacttcaaaggagccacggcatttacagctgttggcggacctcgaagacagcaacatcttctccctcattgctggacggaagcagtataacgctcccacagaccacggtctctgcattaagccaaacaaagtccgcaatgagactaaggagctgaggctgttatgtgccgaagacgaacagacgagaacgtgctggatgacagcatttcggctcctaaaatatggaatgttgctctaccagaattaccgtattcctcagcagcggaaggcactacttagcccgttctcaacacccgtgcgcagcgtatccgaaaactcccttgtggcgatggacttctcagggcagacgggcagggtcatcgaaaacccagctgaagcccagtccgcagccctcgaggagggtcatgcttggagaaagagaagcacaagaatgaatattctgggctcccaatccccgcttcacccaagtactctgtcaacagtcattcacaggacccaacattggtttcacgggaggatctcaagggaagagtcgcaccgcatcatcaaacagcagggtctggtggatggactctttttgctccgcgacagtcagtctaatccaaaagcatttgtgctaaccctctgccaccaccagaaaatcaagaattttcagatcctgccatgtgaagatgacggacaaaccttttttagcctggatgacggtaatacaaagttctcagacttaattcagctggtggacttttaccagttaaacaagggagtgctgccatgcaaattgaagcaccattgtatccgtgtggccctgtag

SEQ ID NO: 28845 - DNA, 1767 bp, Artificial Sequence
  Description of Artificial Sequence: Synthetic coding sequence
atgcaggctgccggtccactcttccgctccaaagataaggtggagcagacgcccaggagccagcaggatccagcagggcctggactccccgcacaatccgatcgcctggccaatcaccaggaagatgatgtggaccttgaagcgctggtgaatgatatgaacgccagcctcgaaagtctatattcagcctgcagcatgcagtccgataccgtcccactgctgcagaacggacagcatgctagatcgcagccccgagcaagcggcccacctcgaagcatccagccacaagtgtccccaagacagagggttcagagaagccagccggtccatatcttggctgttagaaggctgcaggaggaggaccagcagtttaggacgagcagtctccctgcaattcccaatccttttccagagttatgtggacctggctcaccgccagtgttgaccccgggttccctgccgccaagccaggccgcagccaagcaggatgtgaaagtcttcagcgaagacgggaccagcaaggtcgtagaaatccttgcagacatgacagccagggacctgtgccagctgctggtgtataaatcccattgcgtggatgataacagctggaccctggtcgagcaccacccccacttaggtctggagagatgcttggaagaccacgagctcgtcgtccaggtagagagcactatggcatctgaatctaagtttctcttcagaaagaactacgccaagtacgagttctttaagaacccaatgaatttttttcctgagcaaatggtaacttggtgccagcaatctaacggttctcaaacccagctcctgcagaatttcttaaattcttcttcctgtccagagatccagggattcctgcatgtgaaggaactcggcaagaagtcttggaagaagttgtatgtatgcctgagaaggagcggactgtactgctccaccaagggtacctccaaggaacctaggcacctgcagttgctggccgacctcgaggactccaacatatttagcttgatcgctggcaggaagcaatacaacgcaccaacggaccatggactgtgcatcaaacctaacaaagtgaggaacgaaacaaaagaattgaggctgttgtgcgcagaggacgaacagactcgtacgtgttggatgactgcattcaggttgttgaagtatggtatgctcctctatcagaattataggatacctcaacagcggaaagccttgctgagccctttctcaacacctgtgcgcagtgtttcggaaaactcactggtagccatggattttagcgggcaaaccgggcgtgtcattgagaatcctgcagaggctcaatccgcagcgctagaagaaggccacgcatggaggaagaggtctacgaggatgaacattctgggctcacagtctcctctgcatccgtctacgttgtctactgttatccaccggacacagcattggttccacggtaggatctcaagagaggaatcccaccggattattaaacagcagggccttgtcgatggactgtttttgctcagggactcccagagcaacccgaaggcattcgtgctgacattgtgccaccatcaaaaaatcaagaacttccagatcctcccttgtgaggatgacggacaaaccttctttagcctggacgacggaaatactaaattctctgacctcatacaactggtcgacttctatcagctgaacaagggcgtattaccctgcaagttaaagcaccattgcataagggtggcattgtag

SEQ ID NO: 28846 - DNA, 1611 bp, Artificial Sequence
  Description of Artificial Sequence: Synthetic coding sequence
atgaacgcaagcttggaatccctctacagcgcgtgcagcatgcagagcgatacagtgccgctcctccaaaacgggcaacatgctagaagtcaaccacgcgctagtggcccaccacggagcatccaaccacaagtctcacctaggcaacgtgtgcagcgcagccaacctgtccatatcctggccgtgaggaggttacaggaagaggatcaacagtttcgcactagcagcctccctgccattccaaacccgtttcccgagctgtgcggacccggatctccacccgttcttacccctggatcattgccgccttcccaagccgcagcaaagcaggacgtgaaagtttttagcgaggacggcacatcaaaggtggtggaaattctcgcagacatgactgctagagacttgtgccagctactcgtttataaatctcactgtgtggatgacaactcctggacactcgtcgagcatcacccacacctgggactcgagcggtgtttggaggatcacgagttggtagttcaggtggagtcaacaatggcttctgagagtaaatttctgttccgcaaaaactatgcaaagtacgagttcttcaagaatccaatgaacttctttccagaacaaatggttacctggtgtcagcaaagcaacggcagtcaaacccagttgctccagaacttcctgaacagcagttcttgtcccgaaatccagggatttttgcatgtgaaggaactgggtaagaagtcgtggaaaaaattgtacgtatgtctgcgtagaagtggcctttattgcagtacaaagggaacatcaaaagagcctagacatctgcagctgctggccgaccttgaggactcaaatattttctccttgatcgcaggtaggaagcagtacaacgcaccaactgaccacggcctgtgcatcaaaccaaacaaggtgcggaacgagactaaggagctccgcctgctgtgtgcagaagacgaacagactcgcacctgttggatgacagcatttagactgttgaaatacggaatgcttctgtatcagaactataggatcccccagcagcgcaaggcactcttatctccgtttagtactccggtgaggtcggtcagtgagaattctctcgtggctatggatttttcaggtcagactgggagggttatcgaaaacccagccgaggcccagtctgcagcattggaggaaggccatgcatggcggaagcgttcgacaagaatgaatattctgggatcccagtccccactacatccttcaacgctgagtaccgtgatccatcgcacccagcactggtttcatgggagaataagcagggaggaatcccataggatcatcaagcagcaaggccttgtcgatgggctcttcctgcttcgggacagccagagtaaccctaaagctttcgtcctgacattatgtcaccaccaaaagatcaaaaatttccagatcctcccatgcgaggacgatggccagacatttttctccctggacgatggtaacacgaagttttccgacctcatccagctggtggacttctaccaactgaacaagggcgtgctaccctgtaaattgaagcaccactgcatacgagtagccctttag

SEQ ID NO: 28847 - DNA, 1611 bp, Artificial Sequence
  Description of Artificial Sequence: Synthetic coding sequence
atgaacgcttctctcgaaagtttgtattccgcgtgttccatgcagagtgacaccgtgccattgctccagaacgggcaacatgcccgatcgcagcctcgtgcttccggaccccctagatctattcaaccacaggtatccccacgccagcgcgttcagaggtctcagcccgttcatatcctggcagtgcgccgacttcaggaagaggatcagcagttccgaacgagttcccttccagctatacctaatcccttcccggaactttgcggaccagggtcacccccagtgttgacccctggatccctccctccttcccaggcggctgctaagcaagatgtcaaagtgttttcggaggatggcaccagcaaagtggtggagatattggccgatatgacagcccgagacctttgtcagttactcgtgtacaagtcccattgtgtggacgataattcttggaccctcgtggagcatcaccctcatcttggactcgagagatgccttgaggaccacgagctggtcgtccaggtcgagtcgacaatggcttccgagagcaagtttttgttccggaaaaattatgctaagtatgagttctttaagaacccaatgaacttttttcctgagcagatggtaacatggtgccaacagagcaacggatcacagacgcagttgctgcagaattttctcaacagctcaagttgcccggagatccaaggatttcttcatgttaaagagcttgggaagaaatcctggaagaaattgtatgtgtgcctcaggcgttcgggactttactgcagcactaaaggaacatcaaaggagcccaggcatctacaactactggctgacctagaggattccaatatcttcagcttgatcgcaggtcggaaacagtataacgcacccacagatcatggattatgcattaaacccaacaaggtgaggaacgaaacaaaagaactgaggctgttgtgtgcggaggatgaacagacccgcacctgctggatgaccgcttttagactcctaaagtacggcatgctcctttaccaaaactacagaattccgcaacagaggaaggccttgttgtcacctttttctactccagtgcgttcagtgagcgaaaatagtctggtggccatggacttctctggacagacaggtagagtgatcgagaaccccgctgaggcgcaatctgccgctctcgaggagggtcacgcttggaggaagcgatcaacccggatgaatatcctggggtcgcagagtcccctgcacccatccaccctgtcaaccgtgatccatagaactcagcactggtttcatggtaggattagcagagaagagtcacacagaattatcaaacaacagggcctggtggacggactgtttttactcagagattcgcagtcaaatccgaaggcattcgtcctaaccttatgtcaccaccaaaagattaagaactttcaaatactgccatgtgaggatgacggtcaaacatttttctccctcgacgacggtaatacgaaattcagcgacctgatccagctggtcgacttctaccagctaaacaaaggcgtgctcccatgtaaactcaaacatcattgcatccgagtggccctctag

SEQ ID NO: 28848 - DNA, 345 bp, Artificial Sequence
  Description of Artificial Sequence: Synthetic coding sequence
atgcaagcagctggccctcttttccgctctaaggataaggttgaacagacgccacgttcacagcaggatccagccggacctggtctccccgcacagagcgatagactagccaatcaccaggaagatgacgttgaccttgaggcactcgtaaacgatatgaacgctagcttggaatctctgtactcagcttgctcgatgcagagtgacacagttccccttctgcagaatggacaacatgccagatcacagcctcgagcaagtgggccaccaagatccatccaaccgcaagtgtcaccacggcagcgagttcagaggtcccagcccgtgcatatattggccgtctag

SEQ ID NO: 28849 - DNA, 1767 bp, Artificial Sequence
  Description of Artificial Sequence: Synthetic coding sequence
atgcaggcagcaggccctctgttcagatcaaaggataaggttgaacagacccccagaagccaacaagatccagctggccctggacttccagcgcaatctgataggttagccaaccatcaggaggatgatgtggacctggaagccctggtgaacgatatgaacgcttcactggagtcactgtattcggcctgcagtatgcaatccgatacggtcccactgctgcaaaacggacagcatgctcgtagtcagccacgcgcaagcggccctccacggtcaatccagcctcaggtgagtcccaggcagcgcgtacagaggtctcaacccgtacacatcttggccgtccgccgactacaggaagaagatcagcagttccggacctctagcctccccgctatccccaatccttttccagaactttgtggacccggttctccacctgtgctgacgccaggttcactgcctccgtcccaggctgctgcaaagcaagatgtgaaggtcttttctgaggacgggacctcaaaagtggtcgaaatactcgcggatatgacagcacgggacctgtgccagctgctggtctacaagtcccactgtgtcgacgataatagctggaccctggtggaacatcatccccatcttgggcttgagagatgtctcgaagaccatgagctggtagtccaggttgagagcacaatggcttcagagtcaaaattcctcttccggaagaactacgccaaatatgaattcttcaagaaccccatgaacttctttcccgagcagatggtgacttggtgccagcagagtaatgggtctcagacccagcttctgcagaacttcctgaattctagttcctgtccagagatacaaggatttttgcacgttaaggagcttgggaaaaaaagctggaaaaagctgtacgtgtgtctacgccgttcagggctatattgttccaccaagggtacttctaaggagccccgacacctgcaattgctcgccgaccttgaagacagcaacatcttttctcttatagcagggaggaagcaatacaacgcacccactgaccacggactctgcatcaagcctaataaggtgaggaatgagaccaaggaactgcggcttctctgcgccgaggatgaacagaccaggacatgctggatgactgcattccgattactaaagtacggaatgctcctctaccagaattacagaatcccgcaacaaagaaaagctctgctgtcacccttctctactcccgtacggagtgtaagcgagaactctctggtcgcaatggatttctccggacagacaggtagggtgattgagaacccagccgaagctcagagtgccgcactcgaagaagggcacgcttggcgaaaacggagcaccagaatgaacatcctcggtagtcagtccccactgcatcctagcaccctgagcaccgtgatacacagaactcagcactggtttcacggcagaatttcaagggaagagtcacacagaataatcaagcagcagggcttggtggacggtttgtttttgctgagggactcccaaagcaatccaaaagcttttgttctgaccttatgccaccatcagaagatcaagaactttcaaattctaccctgcgaggacgacggccagactttcttctccctcgacgatgggaacactaagttttctgatcttatccagctggtggatttctaccagctaaataagggcgtcctcccatgtaaattgaaacaccactgcattagagtcgcgctgtag

SEQ ID NO: 28850 - DNA, 531 bp, Artificial Sequence
  Description of Artificial Sequence: Synthetic coding sequence
atggaagccattgctaagtatgatttcaaagcgactgccgacgacgagctgagttttaaacggggagatatcttgaaggtgctaaacgaggagtgcgatcagaactggtataaagccgagctgaatggtaaggatggattcatccccaagaactatatcgaaatgaagccacacccattcggtaacgacgtgcaacatttcaaagtactgcgtgacggggcagggaagtactttctgtgggtcgtgaagttcaactctctgaatgagctggtggattatcacaggtcaaccagtgtctcacgaaaccagcagattttcctgcgcgatatagagcaggtccctcaacaaccgacctatgtgcaggccttatttgactttgatcctcaagaggatggggagctgggcttcaggcggggtgatttcatccatgtgatggacaacagtgatccaaactggtggaaaggggcttgtcacggccagactgggatgtttcctcggaattacgtgactccggttaatcgcaacgtgtag

SEQ ID NO: 28851 - DNA, 654 bp, Artificial Sequence
  Description of Artificial Sequence: Synthetic coding sequence
atggaagccattgccaagtacgattttaaggctactgcagacgatgaattgtcctttaagcggggtgacattctcaaagtgttgaacgaggagtgcgaccagaattggtataaagccgagctgaatggtaaagacggatttattcccaaaaattatattgagatgaaacctcacccttggtttttcggaaaaattcctagggcaaaagccgaagaaatgctctctaaacagcgccatgacggggcattcctaatacgggagtccgaatccgcccctggtgatttcagcctctccgtgaaatttggtaacgacgtgcagcacttcaaggtcctacgagatggagcaggcaagtactttttgtgggtcgtgaagtttaactccctaaacgagctggtggattaccacaggtcgaccagtgtatcccggaatcagcagatcttcctgcgcgatattgaacaggtcccacagcagccaacctatgtgcaggctttgttcgatttcgacccacaggaagacggagagctcggattccggagaggcgatttcattcacgtcatggataattccgaccctaactggtggaaaggtgcatgccatggtcagacaggtatgttccctcgaaactacgtgactccagtgaacaggaatgtgtag

SEQ ID NO: 28852 - DNA, 654 bp, Artificial Sequence
  Description of Artificial Sequence: Synthetic coding sequence
atggaagcaatcgcgaaatacgactttaaggctaccgccgacgatgaattgtcattcaagaggggagatatccttaaagtcctgaatgaggaatgcgatcaaaactggtataaagccgagctgaacggcaaagatggcttcatcccaaagaattacattgaaatgaaaccacacccctggttctttggtaaaatccctagagctaaagctgaagagatgctcagtaagcagcgccacgacggcgctttcctgatccgggagagtgagtcagcgcctggcgatttttcactcagcgtgaaattcggtaatgacgtgcaacatttcaaagtgttgcgtgatggagccggaaagtacttcctgtgggtggtgaagtttaattctctaaacgaactggtggactaccaccggtccacatccgtcagtagaaaccagcagatcttcctaagagacattgagcaggtcccgcagcaaccaacgtatgtccaggccctcttcgacttcgatccccaggaggacggagagctaggctttaggagaggagatttcattcacgttatggacaactcagacccaaattggtggaagggagcctgccacggccaaaccggtatgttccccaggaactatgttacacccgtaaacagaaatgtatag

SEQ ID NO: 28853 - DNA, 654 bp, Artificial Sequence
  Description of Artificial Sequence: Synthetic coding sequence
atggaggccatcgcaaagtatgattttaaggccacagctgatgatgagctctcttttaagcggggtgacatcctcaaggtgctcaacgaagagtgcgatcagaattggtataaagcggaattgaatggaaaggatggcttcattcctaaaaattatatcgagatgaaaccacacccatggttctttgggaaaatcccccgagccaaggccgaagagatgctctctaaacagcgtcatgatggcgcatttctgatccgggaaagcgagtccgcgccaggcgacttctctctgtccgtaaaattcggaaatgacgtacagcatttcaaggttcttcgtgatggcgctggcaagtatttcctttgggttgtaaagttcaattctctgaatgagctggtcgactaccaccgaagcaccagtgtttcccggaaccaacagattttcctccgagacatcgaacaggtccctcagcagccaacctacgtccaggcattatttgatttcgaccctcaggaggatggagagttgggcttccgcaggggagacttcattcacgtcatggacaacagtgatccgaattggtggaaaggtgcatgccatggccagacaggcatgtttccacggaactacgtgactcccgtgaatcggaacgtgtag

SEQ ID NO: 28854 - DNA, 222 bp, Artificial Sequence
  Description of Artificial Sequence: Synthetic coding sequence
atgccagccctacacatcgaagatctcccagaaaaagagaagctgaagatggaagtggaacagcttcgcaaggaagtaaaacttcaacgccagcaagtgagcaaatgttctgaggagatcaaaaattatattgaagaaaggtctggcgaggatcctctcgtgaagggtatccccgaggacaaaaaccccttcaaggagaaagggagttgtgtgataagctag

SEQ ID NO: 28855 - DNA, 432 bp, Artificial Sequence
  Description of Artificial Sequence: Synthetic coding sequence
atgagcggccgaggaaagactggtgggaaagccagagccaaagccaaatcgcgttctagtagagccggtctccagtttccagtgggaagggtacacagactgttacggaagggccactatgctgagagggttggtgctggagctcctgtatacttagctgctgtgttagagtaccttactgcagagatcctggagctggcgggtaacgccgcacgagataataaaaaaacccggattattcccagacacctgcagttagcaatccggaacgatgaagaattaaataagcttcttggcggagtgaccattgcgcaggggggtgttctgcccaatatccaagctgtgctactgccaaaaaaaaccagtgcgacagtgggtccaaaggccccaagtgggggtaaaaaggccactcaggccagtcaagagtattag

SEQ ID NO: 28856 - DNA, 432 bp, Artificial Sequence
  Description of Artificial Sequence: Synthetic coding sequence
atgagtggtagaggaaaaaccggcggaaaggccagggctaaagcgaagtcacgcagcagtagagcaggactccagttccctgtgggtagggttcacagattactgaggaagggccattacgccgagcgggtgggggctggcgcaccagtttacctggctgccgttctcgagtaccttaccgctgagatcctcgaactggcaggaaatgcagctagggacaacaaaaagacacgcatcatccctaggcacctacagctagccattcgcaatgacgaagagctgaacaagctgctgggtggtgtaactatcgctcaaggcggtgttctgcccaacattcaggccgtcctactacctaaaaagacgtctgcaaccgttggtcccaaagcacccagcgggggaaagaaagcaacacaggctagccaggagtattag

SEQ ID NO: 28857 - DNA, 276 bp, Artificial Sequence
  Description of Artificial Sequence: Synthetic coding sequence
atgtgcccatgtccgctgcaccgtggccgagggcctcctgccgtgtgcgcctgctccgctggcaggttaggactcagatcctccgctgctcagcttactgcggctcgccttaaagcgcttggtgatgagctgcatcaacgcaccatgtggcgaaggcgcgctcgatccaggcgcgctccggctcccggtgctctaccaacgtactggccatggctgtgcgctgctgcccaggtggcagccctcgcagcatggctactcggacggcgaaatctgtag

SEQ ID NO: 28858 - DNA, 618 bp, Artificial Sequence
  Description of Artificial Sequence: Synthetic coding sequence
atgacggagagaagggtgccctttagcttacttcgaggcccatcctgggacccctttcgagactggtatccgcatagccggctgtttgatcaagcgtttggcctcccccgactccccgaagagtggtcacagtggctgggcggtagctcttggcccggatacgtccggcctctgcctccagcagcaattgaatcgcccgctgtggctgcacctgcttacagccgcgctttgagtcgacagttgagttccggggtctccgaaatcaggcatactgcggacaggtggcgcgtgagcctcgatgttaaccatttcgcccctgatgagctaactgtgaaaacgaaggacggtgtcgtcgaaataacaggaaaacatgaagagaggcaggatgaacacggctatatcagccgctgctttacgaggaaatacacactgcccccaggtgtggacccgactcaggtgtctagtagcctgtctccggaaggcacactcacagtcgaggctcctatgcctaagcttgccacgcagagcaatgaaataaccatccccgtcacgttcgaatcccgcgctcaactgggaggacctgaggctgccaaaagcgatgagacagccgctaaatag

SEQ ID NO: 28859 - DNA, 513 bp, Artificial Sequence
  Description of Artificial Sequence: Synthetic coding sequence
atgaccgaaaggcgcgttccattctcactcctgcgtgggccttcttggcccggttacgtccgacctctgcccccagccgcaatcgagtctccagccgtggccgctcctgcttattctcgggcactctcacggcaactgtcatccggcgtgagcgagatccgccacaccgcggataggtggagggtctccctggatgtcaatcatttcgcccctgacgagctaaccgtaaagacaaaagacggcgtcgtcgagattaccgggaagcatgaagagcggcaggacgagcatggatacatctcccgctgcttcacgcggaagtacactctgcctccaggcgtggacccgacgcaggttagcagttcccttagtcctgagggcaccttgacggttgaggccccaatgccaaaactggctacacagtctaacgaaattaccattcctgtcacttttgagagcagggcacagttaggcggtcccgaggctgctaagagcgacgagactgcagctaaatag

SEQ ID NO: 28860 - DNA, 1926 bp, Artificial Sequence
  Description of Artificial Sequence: Synthetic coding sequence
atggcaactgctaaggggattgccattggaatcgacctgggtaccacgtattcatgcgtgggcgtgttccaacacggtaaagttgaaatcatcgccaatgatcaaggcaacaggactacgcctagctatgttgccttcacggacactgaacggctgattggggacgcagcgaagaatcaggttgctatgaacccacagaacactgtgttcgatgccaagagactcattggcaggaaatttaacgatcctgttgtgcaggctgacatgaagttgtggccttttcaagtcatcaacgaaggcggtaagcctaaagtcctggtatcatataaaggtgagaataaggctttttaccccgaagagatcagctctatggtcctcaccaaattgaaagaaacagcagaggcttttctggggcaccccgtcactaacgcggtgattactgtgcccgcttatttcaatgacagccagaggcaggctacaaaggacgccggtgtgattgctggcctgaatgttctgcgaatcatcaatgagccgacagctgccgcaatcgcttacggcctggacaaagggggtcaaggggagagacatgtgctcatcttcgacctggggggtggcacatttgatgtgagtatcctcacgattgatgacgggattttcgaggtgaaagcaaccgctggggacacacacctcgggggagaagacttcgataacaggctggtatcgcactttgtcgaagaattcaaacgcaagcataagaaagacatcagtcaaaataagcgcgctgtgcgacgcctccggacagcatgtgaacgtgctaagagaactctaagctccagtacacaggcaaatctggagattgactctttgtatgagggtatcgatttttatacctctattacccgggcacgcttcgaagagctgtgcgcagatctttttcgtggaaccctcgagcccgtcgaaaaagccctgcgggatgccaaaatggacaaggccaagatacacgacatcgtgctcgtaggaggatcaacaaggatccctaaagtccagcgattactgcaggattactttaacggccgagacttgaacaagagtatcaatcctgacgaagcagtcgcttacggcgcagctgtgcaagcggctatcctcatgggagataagtccgaaaaggttcaggatctgctcctgctggacgtagcaccgctgtcacttggcctggagaccgcaggcggagtcatgacagcactcatcaagcgcaactccactatcccaacgaagcagacacaaatatttacgacgtacagcgataatcagcctggagtcctgatccaggtgtacgagggagagagagccatgactaaagacaacaatctgttaggcaggtttgacctaacagggatcccaccagccccaagaggtgtgccccagatcgaagttacttttgacattgatgctaacggcatactgaacgtgacggcaatggataagtctaccggaaaggttaataaaatcactatcactaacgataaaggcaggctaagcaaggaagaaattgaacgtatggttctcgacgctgagaagtacaaagccgaggatgaggtgcagcgcgaaaaaatcgctgccaaaaatgctttggaatcctacgcatttaacatgaagagcgttgtaagtgatgagggccttaagggaaaaatcagtgaatcggacaagaataagatcctcgataagtgtaatgagttgctgagctggctcgaggtgaatcagttagctgaaaaggacgagttcgatcataagcgcaaagagctgaaacaaatgtgtaatcccatcatcacaaagctgtatcaaggcggttgcactggccctgcgtgtggcacaggctacgtccctgggcgtcccgctaccggacccacaattgaagaggtcgactag

SEQ ID NO: 28861 - DNA, 1599 bp, Artificial Sequence
  Description of Artificial Sequence: Synthetic coding sequence
atggcaacggcaaaggggatcgccattggaattgacctaggtaccacatacagttgcgtcggagtgtttcagcatggcaaggtcgagataatcgctaacgaccagggtaatcggaccaccccatcttacgtcgctttcaccgacactgagagacttatcggcgatgcagctaagaaccaggtggccatgaaccctcagaataccgttttcgatgccaaacgtcttatcggacggaaattcaatgaccccgtcgtgcaggctgacatgaagctctggccattccaagtgattaacgagggtggcaagcccaaggtgctggtaagctataagggggaaaataaggctttctaccctgaggagatctcgtccatggttctgacgaaactcaaggaaacagccgaggccttcctcgggcatcctgtgacgaatgctgttattaccgtacctgcgtatttcaacgacagccagcgacaggcaacaaaggacgccggagtgatagcagggcttaatgtgctcagaattataaacgagccaacagccgctgccatcgcttacggcctcgataagggagggcaaggtgaacgacacgtactgatcttcgacctgggaggaggaacttttgatgtgtccatccttacaatcgacgacggaattttcgaagtgaaggcaactgctggtgatacgcacctgggaggcgaggactttgacaaccggctggtgtcccattttgtggaggagttcaaaagaaaacacaagaaagatatctcacaaaataaacgggctgtccgaagattgaggaccgcttgcgaaagagcaaagcgaacattgagttctagtacacaggccaatctggagatcgattccctgtatgagggtatagatttctacaccagcataacccgggcacgctttgaggagctgtgtgctgatttgttccgaggaaccttggagcccgtggagaaagctctgcgggatgccaaaatggataaggccaaaattcatgacatcgtgttggtcggaggctccactaggattcccaaagtgcagagactgttacaagattactttaacggtcgggatctaaacaaatcaataaatcctgacgaagctgtggcctatggcgctgccgtgcaggcagcaatacttatgggagataaatcagagaaagtgcaggatctgctgttactggacgtggccccactgagcctcgggctggagacagccggaggggtcatgacggccttaatcaagcggaatagtacaatcccaacaaaacaaactcagattttcactacttacagtgataatcagccgggagtcctcatccaggtgtacgaaggagagcgggctatgaccaaggataacaaccttctggggagattcgatcttaccggcatacccccagctcccaggggcgtgcctcagatcgaggtgactttcgacattgacgctaacggtatccttaatgtcacggcaatggacaaaagcactggtaaggttaacaagattaccattacgaatgataaagggagattgtccaaggaggagattgagaggatggtcctggatgcagagaagtacaaggcagaggacgtctag

SEQ ID NO: 28862 - DNA, 1926 bp, Artificial Sequence
  Description of Artificial Sequence: Synthetic coding sequence
atggcgaccgccaagggcatcgccatcggcattgacttgggcacaacatactcttgtgtgggtgtgttccagcatggcaaggtggagatcatcgccaacgaccagggaaatagaaccacaccttcttacgtggcatttacagatactgagcggctcatcggtgacgcagccaagaaccaggtggccatgaatccacagaacaccgtgttcgatgctaaacgactcatagggagaaagtttaatgatcccgtggtacaggccgacatgaagctctggccctttcaggtgatcaatgaggggggaaaaccgaaagtcctcgttagctacaagggcgagaataaggctttctaccctgaagagatcagctctatggtgctgaccaaactgaaagaaactgccgaagcattcctgggacatcccgtcactaacgctgttattaccgttccggcttacttcaacgatagccagaggcaggcaaccaaggatgcgggtgtcatagcaggtcttaacgttctccggatcattaacgaacctactgcagcagcaattgcgtacggtttagacaaagggggacaaggagagaggcatgtgcttatctttgatctgggcggaggtacctttgacgtaagcatcttgacaattgacgatggtatttttgaagtaaaggcaaccgccggtgacactcatctgggcggagaggactttgacaatcgtctggtaagtcattttgtggaagaattcaagcgcaagcataagaaggacatttcccagaataagcgagccgtgaggagacttcgcacggcttgcgagcgcgctaaacgaactctgagcagcagcacccaagcaaacctcgagatcgatagcctttacgaaggcattgatttttacactagtattacccgcgctcgcttcgaggaattgtgtgcggacctttttagaggcacgctagagcccgttgaaaaagcactgagggatgcaaagatggacaaagctaagattcatgatatcgtgctggtgggaggaagtacacgcatacccaaggttcagaggttgttgcaagactatttcaacggtcgcgacctgaacaaaagcattaacccggacgaggccgtggcttacggagcagctgtgcaggccgcaattttaatgggcgacaagtctgaaaaggttcaggacctcctgttgctggatgtcgcgcctcttagtcttggtctggaaacagctggaggagtaatgacggctctcattaaacggaactctaccatccccacaaaacaaacccagattttcaccacttacagtgacaaccaacccggtgtgctcatccaggtatatgagggagaaagagccatgaccaaagataacaatctccttggcaggttcgacctgactggcataccccctgctcctcggggagtaccacaaatcgaggtgacctttgacatcgacgcaaacgggatcttgaacgttacagcgatggacaaatctaccggaaaggtaaacaagattactattacgaacgataaggggagacttagcaaggaggagattgaaagaatggtgctggatgcggaaaagtacaaagctgaggacgaagtacagagggaaaagatagctgctaaaaacgctctcgaatcctacgcattcaatatgaagagcgtggtgtcagacgaggggcttaaagggaaaattagtgagagcgataagaacaaaatattagacaaatgcaacgagctgctgagctggcttgaggtgaaccagctcgcggaaaaagacgaatttgatcataagcggaaggagttgaagcagatgtgtaatcccattatcactaagttgtatcaggggggttgtacaggaccagcttgcgggactggctatgtaccaggcagacccgctaccggacccacgattgaggaagtagactag

SEQ ID NO: 28863 - DNA, 699 bp, Artificial Sequence
  Description of Artificial Sequence: Synthetic coding sequence
gccaaaggcattgctattggcatcgacttgggaacgacttactcctgcgtaggcgtcttccagcatggaaaggtagaaatcattgctaacgaccagggtaatagaacaacccccagttatgtagccttcacagacaccgagagactcattggtgatgccggagtcatcgccggtctgaacgtgctccgcattattaatgagcctaccgccgcagccatcgcctacggattggacaaagggggtcagggcgagcggcacgttctgatattcgatcttgggggaggaacttttgacgtgtcgattctcactattgacgacgggatcttcgaggtgaaggcaaccgctggcgacacccatctcggtggtgaggacttcgacaatcgcttggtttctcacttcgtcgaagaatttaagagaaagcacaaaaaagatatatcccaaaataagcgcgctgtccgcaggctgcggaccgcctgtgaacgggctaaacggaccttgagtagtagcactcaggcgaatctagagattgattccctctacgagggcatcgacttttacacctccattacgagagctaggttcgaggagctgtgcgccgacctgttccgtggaaccctggaacccgttgaaaagggagctcccccagcatcccctcgctgctcaggatgcttcaggacaaccagcatggatgtcatctag

SEQ ID NO: 28864 - DNA, 1074 bp, Artificial Sequence
  Description of Artificial Sequence: Synthetic coding sequence
atgaaggagaataaggaaaactcctccccatccgtgacaagtgcaaacctggatcacaccaagccatgctggtattgggacaaaaaggacctggcacacactccctcgcagctggagggattagaccccgcaacagaggccagatacaggcgggagggcgctcgtttcatttttgacgtgggcactagactggggctacattacgatactctggctaccggcatcatctacttccaccgtttctacatgtttcacagtttcaagcagttccccaggtatgtaaccggcgcatgctgtctgtttctcgcgggaaaagtcgaggagacccccaagaagtgcaaggatatcataaagacggcacgcagcctgctgaacgacgtacagtttggacaatttggcgacgaccccaaagaggaggtgatggtgctggagcgaatcctgttgcaaaccataaagttcgaccttcaagtcgagcacccttatcaatttttacttaagtatgcgaaacagctcaaaggggacaagaacaaaatccagaagctggtacaaatggcttggacctttgtgaacgatagaacaagtctctgtaccacactctcactgcaatgggagcctgagataattgctgttgccgtcatgtatttggcgggtagactctgtaaattcgagattcaagagtggacctccaagccaatgtatagaagatggtgggagcagtttgtccaagacgtcccagtggatgttctggaggatatatgtcaccaaattctggacctctatagtcaaggaaaacagcaaatgccccaccataccccacaccaacttcagcagcctccttccttgcaacccacaccccaggtgccccaggtccagcagtcgcagccctcgcagtcctctgaaccgtcacagccgcaacagaaggaccctcctttgatcctcctgcaagggtgggcctgtcgtcagcctgcaacccatcttttacctagtccgctggaagattccctgctgtgtcctcgcccatttccccaccccgcttgcctgcagctggggggatgggggggtcagcccggatag

SEQ ID NO: 28865 - DNA, 2565 bp, Artificial Sequence
  Description of Artificial Sequence: Synthetic coding sequence
atgcccccttgcagcggaggtgacggatcgactccccctggaccctcactgagagatagggattgtccggctcagagcgccgagtatcctcgagaccgcctggatccacggccaggatcgcccagtgaagcctcgtccccaccattcttgcggtcaagagcgcctgtgaattggtatcaggagaaagcccaggtcttcctgtggcacctcatggtgtcagggagtacaacactgctgtgtctgtggaagcagccgttccatgtgagcgcctttccggtgactgcttctcttgccttccggcaatctcagggagcaggccagcacctgtataaggaccttcagccatttatcctgctgcggctgcttatgcctgaagaaactcagacacaggaccagcccatggaagaggaggaggtcgaaacttttgctttccaggctgagattgctcagttaatgtctctaattataaatacattttattctaataaagaaatttttcttcgggagctgatctctaattctagcgatgcactggacaagattaggtacgagtctctgacggatccaagcaagctggactccggcaaggaattgcacataaaccttatacctaataagcaggaccggaccctcactattgtcgataccgggatcggtatgaccaaggcagacctgatcaacaacctcggcactatcgcaaagtccgggacaaaggcctttatggaggctctccaggccggagcagacatatcaatgatcggccagtttggagtggggttttattctgcctatcttgtggctgaaaaggtgacagtgattactaaacacaacgatgacgagcagtatgcttgggagagctccgctgggggaagctttaccgttaggaccgacactggcgagccaatgggcagagggacaaaggtcatcctgcacctcaaggaggaccaaaccgagtatcttgaggaacggaggataaaggagatcgtcaagaaacattctcaattcatcggttacccaatcacactctttgtggaaaaggagcgagataaagaagtctccgatgatgaagcggaggaaaaggaggacaaggaagaggagaaagagaaggaagagaaggaatccgaggataagcccgagatcgaagatgtgggatcagatgaggaggaagaaaaaaaagacggagacaagaaaaagaagaagaagattaaagaaaagtacatcgatcaggaggaacttaataaaactaaacccatttggactcgcaaccctgacgacataactaacgaagagtatggcgagttctataaaagcttgactaatgactgggaagaccacctggccgtaaagcacttctcagtggaaggccagcttgaatttagagccctcttgtttgtgcccaggcgagccccatttgatctgtttgagaaccggaaaaagaagaataacatcaagctgtatgttaggcgcgtctttatcatggataattgcgaggaactgatcccagaatatctcaatttcattcggggtgtggtggattccgaagatctgccactgaacattagccgcgagatgctgcagcagtctaaaattctaaaggtcatcaggaagaacctggtaaagaaatgcttggagctgttcactgagctcgctgaagataaagagaactacaagaagttttacgagcagtttagcaagaacatcaagcttgggatccatgaggatagccagaatcgtaagaagctgtctgagttgctccgttattacacatccgccagtggcgacgagatggtgtccctcaaggattactgcacgaggatgaaagagaaccagaaacatatctactatattaccggggagactaaagaccaggtcgccaactctgcgttcgtagaacgccttaggaagcatggcttggaagtaatatacatgattgagcccattgacgagtactgcgtgcaacagttaaaggagtttgaaggtaaaacgcttgtgagtgtcactaaagagggactggagctccccgaggacgaggaagaaaaaaagaaacaggaggaaaagaagacaaaattcgaaaacctatgtaagatcatgaaggatatcctggagaaaaaagtagaaaaagttgttgtgtctaatcggctggtcacttcaccctgttgtattgtgacttctacgtatggatggactgctaacatggagaggatcatgaaggcgcaggcactgcgggataattctaccatggggtatatggctgcgaaaaagcacctggaaatcaaccccgaccatagcatcatcgaaacgcttagacaaaaggccgaggctgataagaacgataagtcggtgaaggatctggtgattctcctgtatgaaaccgctttgctgtcaagtggtttctccttggaggatcctcagacacatgcaaatcggatttatcgcatgatcaaactggggttgggtattgacgaagacgacccgaccgctgacgatacgtccgcagcagtgacggaggaaatgcccccactggaaggggatgacgacacctcaagaatggaggaggtggattag

SEQ ID NO: 28866 - DNA, 1242 bp, Artificial Sequence
  Description of Artificial Sequence: Synthetic coding sequence
atgggacggggaaccaaagtaattctacacctgaaagaagaccaaaccgaatacctggaggaacgacggatcaaagagatcgtgaagaaacactctcagttcatcggctatcccataacgcttttcgtggagaaagaacgggataaggaagtgagcgatgacgaagcagaggaaaaggaggacaaggaggaagaaaaagagaaagaagaaaaggagagcgaagataaaccagaaatcgaggatgtcggtagtgatgaggaggaagaaaagaaggatggcgataagaagaaaaagaagaagatcaaagagaaatacattgatcaggaggagctgaataagaccaaaccaatatggacccggaaccctgacgacattaccaacgaggagtacggcgagttttataaatcactcacgaacgactgggaggatcatctcgccgtgaagcacttctccgtcgaaggtcagctagagtttcgggcactgctattcgtgcctaggcgagctcccttcgacctttttgaaaaccggaagaagaaaaataatataaaattatacgttcgcagggttttcattatggataattgtgaggagttgattcctgagtatctgaacttcattagaggagtcgtcgactctgaggatctccccctaaatatttcgcgagagatgctccagcagtccaagatccttaaggtgattagaaaaaaccttgtgaagaaatgcttagagctgttcacagaactggccgaggacaaggagaattataagaagttttatgaacaattctcaaagaatataaagctcggcatccacgaggactctcaaaaccgcaagaaactgtccgagttactgagatactatacgagtgcttcaggtgatgaaatggtcagcttaaaggattattgcacccgaatgaaggagaatcagaagcatatatattatataactggcgagaccaaggaccaagtcgctaacagcgcattcgttgaacggctgcgaaagcatggccttgaagtaatttacatgatcgagcctatcgacgaatactgcgtgcagcagctcaaggagtttgaggggaagaccctggtgtccgtgacaaaagaaggtctggagcttccagaggatgaagaggaaaagaagaagcaggaagagaaaaagacaaagtttgagaacctgtgcaagatcatgaaggacatcctggaaaagaaagtggagaaggtatgcgagtactccattagctag

SEQ ID NO: 28867 - DNA, 2412 bp, Artificial Sequence
  Description of Artificial Sequence: Synthetic coding sequence
atgcgtgccctctgggtcctgggcctgtgctgcgtcctgctcacctttggctccgtccgagccgatgatgaggttgacgtggacgggaccgtcgaagaggacctgggcaaatctcgcgaggggtcacgaactgatgatgaggttgtgcaacgtgaggaagaagccattcagctggatgggctcaacgcctctcagatccgtgagctccgggagaagagtgagaagtttgcgttccaagccgaagtgaatcgcatgatgaagctgatcataaatagcctgtataagaataaggagatcttcctaagggaactgatctctaacgcgtcggatgctctagataaaataagattaatcagccttaccgatgaaaacgctctttcaggcaacgaggaactgaccgtcaagatcaagtgcgataaggagaaaaacctgcttcatgtgactgacactggagtgggaatgacacgtgaagagctggtcaaaaacctaggaaccatcgccaagtccggcacttccgagttcctaaacaaaatgactgaggcgcaagaagatggacaaagcacctctgagctaatcggacagttcggtgtgggtttctactcagcatttctcgtggctgacaaggtcatcgtcacttctaagcataataatgacactcaacatatctgggaatccgactccaatgagtttagcgtgatcgccgaccccaggggtaacaccttaggacgcggaactactataacgctggtgctgaaggaagaagcatccgattacttggagctggatacaattaagaacctggtgaagaaatatagtcagtttatcaacttccccatttacgtctggagctccaagaccgagacagtagaggaaccaatggaagaagaggaggcagctaaagaagagaaggaggagtccgacgacgaagcagctgtcgaagaagaagaagaagagaaaaaacccaaaaccaaaaaagtggaaaaaactgtgtgggactgggagctaatgaatgacatcaagcctatttggcaacgcccttccaaggaagttgaggaagatgagtacaaggcgttctacaaatcattcagcaaagaaagcgatgatcccatggcctacattcactttaccgcggaaggcgaagtaacatttaagtccattctgttcgtgccgacatccgctccaagaggattatttgatgagtatggctcaaagaagtccgactatatcaaactttacgttcgacgggtgttcataacagacgactttcacgacatgatgcctaaataccttaattttgtcaagggcgtagtggattccgatgacttacccctgaatgtttctcgtgagactctccagcagcacaaactgctgaaggttatcagaaaaaaactcgtgaggaaaacgctggatatgatcaagaagatcgctgatgataaatacaatgacaccttttggaaagagttcggcaccaacattaaactgggagtgatcgaagatcattccaatagaacccggctcgccaaactgctgcggttccagagctcccatcatccaaccgatattacatcactggaccagtacgtggagcgcatgaaggagaaacaagacaagatctattttatggctggaagttcacggaaggaagcggagagtagtccttttgtggagcggctccttaagaaaggctatgaggttatctacctaaccgagcctgtcgacgagtactgtatacaggctttacctgagttcgacggaaaaagattccagaatgttgcaaaagaaggggtgaaatttgatgagtctgaaaagactaaggagagtcgtgaagccgtcgagaaagaattcgagcccctccttaactggatgaaagataaggcactcaaggataagattgagaaggctgtggtgtctcagcgcctcacggagtcgccttgtgctctggttgcctcgcagtacgggtggagtggtaacatggagcggatcatgaaggcccaggcctaccaaacaggaaaagatatatcaacaaactattacgcctcccagaagaagacctttgagatcaatcctcggcatccactgatcagggacatgctgaggcggatcaaggaggacgaggatgacaagacagttctcgatcttgccgtagttctcttcgaaaccgctactctgaggtcggggtacctgttgcctgacaccaaagcctacggggaccggatcgagcggatgctgcggctttccctcaacatagatccagacgccaaggttgaggaagagcccgaggaagagccagaagagactgctgaagacacaacagaagacacagagcaggacgaggatgaggagatggatgtaggcacagacgaggaggaggaaacagcaaaagaatcgactgccgaaaaggacgaactctag

SEQ ID NO: 28868 - DNA, 1662 bp, Artificial Sequence
  Description of Artificial Sequence: Synthetic coding sequence
atgcgcgcactctgggtgcttggactgtgctgcgtgctgttaacttttggcagcgtacgcgctgacgacgaagtcgacgtggatggaaccgttgaggaggacctgggaaagagccgcgagggttcccggaccgatgacgaagctgccaaggaagagaaggaggagtccgatgatgaggcagctgttgaagaggaggaggaggaaaagaagcccaagacaaagaaagttgaaaaaaccgtgtgggattgggaactgatgaatgatattaaaccaatctggcaaaggccatcaaaagaggtagaagaggatgagtacaaagcgttctacaaaagcttctccaaagagtcagacgaccctatggcttatatccactttacggccgagggagaagttacatttaaatctattctctttgtcccgactagtgcgccacgaggccttttcgatgaatacggaagtaagaagtcagattacattaagctgtatgtgcgcagggtgtttatcacagatgacttccacgatatgatgccaaaatacctcaacttcgtgaagggagtcgtggactcagacgatctcccactcaacgtgtcgagggagacactgcagcaacacaagttattaaaagtgatccgaaagaagctcgtgaggaagacactggacatgatcaaaaagatagcagatgacaaatataatgataccttctggaaagaatttggaaccaatatcaaacttggagttatagaggatcactcaaatcgaactaggctggcaaaactgctgcgcttccaaagctcccaccacccaaccgacatcacttcgctggatcagtatgtggagaggatgaaggaaaaacaggataaaatctactttatggcagggtctagccgcaaggaagctgagtcctcccctttcgtcgagcggcttctgaagaaaggttatgaagttatctaccttactgagcccgtggacgaatactgcatccaagccctaccagagtttgatggaaaaagatttcagaatgtcgcgaaggaaggtgtgaaatttgacgagagcgaaaaaactaaagaatcccgggaagctgtggagaaagagttcgaacctctcttgaattggatgaaagataaagcactcaaagacaagatcgagaaggcagtggtgtcacaacgcttgaccgaaagcccatgcgcccttgtggcaagccaatacgggtggtccgggaacatggaaagaataatgaaggcacaggcctatcaaactggcaaggacattagtaccaattactacgccagtcagaagaagaccttcgaaatcaatcctcgccaccccttgatccgcgatatgctacggcgaatcaaagaagatgaagatgacaaaaccgtcctcgacctggcagtggtgctgtttgaaactgctaccttgagaagcgggtaccttctaccagatactaaagcctatggagatcggatcgagcgaatgctgcggctttcactgaacattgacccagacgccaaagtggaggaggagcccgaggaggaacccgaggaaacagccgaagacacaaccgaggacaccgagcaagatgaggacgaagaaatggacgtaggcaccgatgaagaggaagagacagccaaagaatctaccgccgagaaagacgagctgtag

SEQ ID NO: 28869 - DNA, 948 bp, Artificial Sequence
  Description of Artificial Sequence: Synthetic coding sequence
atgcgggctctgtgggtcctagggctttgttgcgtcctgctcacttttggatctgttcgggcagatgatgaagtcgatgtcgacggaaccgtcgaagaagacctgggaaagtctcgggaggggagcaggacggacgacgaagtagtccaaagggaggaagaggcgatccaactcgatggactgaatgcaagccagatcagagagttacgcgaaaagtccgaaaaatttgcctttcaggccgaagtcaatcgaatgatgaagctgataatcaacagcctgtacaagaataaagaaatctttctgcgtgaactgatttcaaacgcctcagacgctttggataaaatccgactcatatctctcacagacgaaaatgcactgtccggcaacgaagagctcactgtgaagatcaaatgcgataaggagaaaaatctcctgcacgtgacagatactggagttggtatgaccagagaggaacttgtgaaaaatctgggcacgatcgccaagtcaggcacttcagagttcttgaacaagatgactgaggctcaggaggatgggcagtcaacatcggagttaattggacagttcggagtgggcttctactcagcctttttagttgcagacaaggtcatcgtgacttcaaagcataataacgacacccaacacatttgggaaagcgactctaatgagttctctgtgatagctgacccacgaggtaatacactgggacggggaactacaataacactcgtacttaaagaagaagcctcagattatttggagctggacaccatcaaaaatcttgtaaagaaatactctcagttcattaactttcccatctatgtgtggtcaagcaagacagagaccgtagaagagcctatggaagaggaggaggcggctaaagaagagaaggaggagtcagatgacgaagcagccgctcgtagacgttag

SEQ ID NO: 28870 - DNA, 483 bp, Artificial Sequence
  Description of Artificial Sequence: Synthetic coding sequence
atgtcggaagtgcgccctctctcccgtgacatcttgatggagacactgctgtacgagcagctgcttgagccaccaacaatggaagtgcttggcatgactgatagtgaggaggacctcgaccctatggaggatttcgacagtcttgagtgtatggaagggagtgatgctctggccttacgcctggcatgtataggcgatgagatggacgtgagtttgcgagctcctcggctggcccaactatcagaggtggcaatgcattcccttggactggcgttcatatacgatcagacagaggacattagggatgtgctcagatcttttatggacggttttactaccctcaaggagaacatcatgcgtttttggagatcgcctaaccctggctcttgggtgtcttgcgagcaagtcctactggctctcctactcctcctcgctcttttactgccactcttgagtgggggtttacacctgttgctgaagtag

SEQ ID NO: 28871 - DNA, 564 bp, Artificial Sequence
  Description of Artificial Sequence: Synthetic coding sequence
atggaacgccctcagccagactccatgccccaggacttgtccgaagcgctgaaagaggcaaccaaggaggtgcacacgcaggctgagaacgccgaattcatgagaaacttccagaagggccaggttaccagagacgggttcaaactggttatggcgtccctgtaccacatctatgtagccctggaggaggagatagaaaggaacaaggaatctccagtgtttgcccctgtctacttccctgaggaattgcatagaaaagccgcactggagcaagacctggctttttggtatgggccaagatggcaggaggtcattccatacaccccggctatgcagagatacgtgaaaagattgcatgaagtagggcgaactgagcccgagctgcttgtggcccatgcttacactaggtacctgggagacctgtccggcggtcaggtactgaagaaaattgctcagaaggccttggacctgcctagcagcggagaaggcctagctttttttacttttcctaatatcgctagtgcaaccaaattcaaacagctctacaggtcccgcatgaactag

SEQ ID NO: 28872 - DNA, 1581 bp, Artificial Sequence
  Description of Artificial Sequence: Synthetic coding sequence
cttgggggaaggtcttcctgcgaagaccccggatgcccaagggacgaggaaagggcgcctcgtatgggatgtatgaagagtaaatttttgcaggtgggaggaaacactttttctaagacagaaacatctgcctcgccccattgtccagtatacgtgcctgaccccaccagcacaattaagccgggaccgaattcgcacaattctaacacgcctggtatcagggaggctggctccgaggacattatcgtcgtggcattgtacgactacgaagctatccatcatgaggacctctcatttcagaagggggatcagatggtggtcctcgaggaatccggcgagtggtggaaagcccgtagtctggcgactcggaaagagggctatattccctcaaactacgtagccagggtcgatagccttgagacagaggagtggtttttcaaagggattagtagaaaggatgcagagcgacagctgttagctcccggtaacatgctggggtcgttcatgatcagagattccgaaacgacaaaggggtcctactccttgtcagttagagactatgatcccaggcagggggatacagtgaaacattacaagattcgaactttggataacggaggattctatattagccccagatccactttcagtacattgcaagagttagtagaccattataagaagggaaacgatggcctgtgtcagaaacttagtgtgccttgcatgagcagcaaacctcaaaaaccttgggagaaggatgcgtgggagattccccgagagagtctgaagctggagaaaaaattgggcgctggccagtttggagaggtctggatggccacttacaataagcacaccaaggttgccgttaagacaatgaaaccaggaagcatgtctgtggaggcttttctcgctgaggctaatgttatgaaaacgttgcagcacgacaaactggtgaagctgcatgcagtagtcaccaaagaacctatttacattattaccgaatttatggcaaaagggagcctgctcgacttcctaaagagcgatgaaggtagcaaacagcctcttcccaaacttatagatttcagcgcccaaattgccgaaggcatggctttcattgaacagagaaactacattcaccgcgacctgcgggcagcaaacattctggtgtccgcttccctggtgtgcaagattgccgactttgggctggcacgggtaattgaggataacgagtacacagcacgggagggggcaaaattccctatcaaatggaccgcacccgaagccattaacttcggaagctttaccatcaagtccgacgtgtggtccttcggaatactgcttatggagatcgtgacctacggacgtatcccttaccccggaatgagtaatcccgaagtgatcagggcactggagcgcggttaccgaatgccgcgacccgagaactgccctgaagaactgtataatattatgatgaggtgctggaaaaataggcctgaagagcgaccaactttcgagtatatccagtccgtacttgacgacttttacacagcgaccgagtcccagtaccagcagcaaccgtag

SEQ ID NO: 28873 - DNA, 1578 bp, Artificial Sequence
  Description of Artificial Sequence: Synthetic coding sequence
cttgggggacggtctagttgcgaagaccccggatgtcctcgggatgaagagcgggctcccagaatggggtgcatgaagtcgaagtttctacaggtgggcggaaacaccttctccaaaactgagacctcagccagtccgcactgccctgtgtacgtgccagatcccacctcaacaattaagcccggtcctaactcacacaactccaacacacctggcatccgcgaggggtcagaggatattatcgtcgtagccttgtacgactatgaggctattcatcacgaggacctgagcttccagaagggcgatcagatggtggtcctggaagagagcggagagtggtggaaagcaaggagtctggccactaggaaagaagggtacatcccatcgaactacgtcgccagggttgattccctggaaaccgaagagtggttctttaaaggaattagcaggaaggatgctgagaggcaactcctcgcccctggaaatatgttaggctcattcatgatacgggactccgaaacaacaaagggctcatactcactatcagttcgggattacgacccgcgtcagggcgacactgtcaagcattataaaattaggacgctggacaatggaggcttttatatctcccctcgaagcactttctctacactgcaggagttagtcgaccattataagaaaggcaacgatggtttgtgtcaaaaattgtccgttccatgtatgagtagcaagcctcagaaaccatgggaaaaggatgcctgggagattccacgggaatcactcaaactggagaagaaactcggtgcaggccagtttggagaggtttggatggccacttacaacaagcatactaaagtggccgttaaaaccatgaagcctgggtctatgtctgtcgaagccttccttgctgaagcgaacgtcatgaaaaccctccaacacgataaattggtcaaattgcacgctgtggttaccaaggaacccatttatatcatcactgaattcatggccaagggcagcctgttggactttttaaagagcgatgaggggtccaaacagcctctgcccaagttgatcgacttttcagcacagatcgcggagggcatggcctttatagagcagaggaactacatccatcgtgatctccgagctgcaaacatcttagtgtcggcaagcctcgtgtgcaaaattgccgatttcggcctggcacgagtgatcgaagacaacgagtacaccgccagagagggtgcgaagtttcctattaaatggacggcccctgaggccatcaacttcggctcttttaccataaaaagtgacgtgtggtccttcggtattctcctcatggaaatagtcacatatgggaggataccctaccctgggatgtctaaccctgaggtgatccgcgcactggagcgagggtatcggatgccgaggccagagaactgtccggaagagctttacaacatcatgatgaggtgttggaaaaatcggcctgaagaacgccctacttttgagtatattcaatccgtactggatgacttttacacggcaacggaatcgcaataccaacagcagccatag

SEQ ID NO: 28874 - DNA, 1515 bp, Artificial Sequence
  Description of Artificial Sequence: Synthetic coding sequence
atgggctgcatgaaaagcaagtttctccaggtgggcggtaacaccttctctaaaaccgagaccagtgcctctcctcattgcccagtatatgtgcctgacccgacctctactatcaaaccgggtcctaatagccacaactccaacacccccggaattcgggaagggtccgaagatattattgtggtggctttatacgactacgaggccattcatcacgaggacctgtccttccagaagggggatcaaatggtcgttctcgaggagagtggggaatggtggaaggcaagaagcctggcaaccaggaaggagggttacataccatctaattacgtggctcgggtggattctctggaaaccgaggagtggttctttaaggggatatctcgaaaggatgcggagcgtcagctgctggcccctggtaacatgctgggatcgttcatgatccgcgacagcgaaacgaccaaggggagctactcattgtccgtgcgggactacgatccacggcagggagatacagtgaagcattataagatccgaacccttgacaacggcggattctacatctcacccagatcaacattttccacgcttcaggagctggtggatcattacaaaaaaggcaatgatggattgtgccagaagctgtccgtgccctgtatgtcctctaagcctcaaaagccgtgggagaaggatgcatgggagattccaagggagagcctaaagcttgagaagaaactgggcgcaggacagttcggagaggtgtggatggctacctacaataaacacaccaaagtggcggtcaaaaccatgaaaccaggctccatgagtgtggaagccttcctagctgaggctaacgtgatgaagaccctgcagcatgataagctcgtgaagctccacgctgtcgtgaccaaggaaccaatctatatcattaccgagttcatggccaaaggctctctccttgacttcctcaagtccgacgaaggctccaagcaaccgctgccaaaactgatcgattttagcgcccaaattgccgagggaatggctttcatcgaacagagaaattatatccatcgagatctgcgcgctgctaacatactggtttccgcaagtcttgtgtgcaagatcgctgactttgggctggccagagtcatcgaagacaacgagtacacggctagagagggggcaaagttccccattaaatggaccgcacccgaagctatcaacttcggatcattcactatcaagagcgatgtttggtccttcggaatcctgttgatggaaatagttacctatggccgtatcccctatccgggaatgtccaaccccgaggtcattcgggcactggaacgcggttaccggatgccaaggccagagaattgcccggaggaactctacaacatcatgatgcgatgctggaaaaacaggcccgaggaacgccctacctttgagtacatccagtcagtgctggacgatttctataccgcgacggaatcgcagtaccagcaacagccatag

SEQ ID NO: 28875 - DNA, 1518 bp, Artificial Sequence
  Description of Artificial Sequence: Synthetic coding sequence
atgggttgtatgaagagtaagtttctgcaagtgggtgggaacacattttcaaagaccgagaccagcgcctcccctcattgcccagtgtatgtgcccgatcctaccagcactatcaaaccgggtcccaacagccataacagcaacacacccggtattagggaggctggtagcgaggatatcatagtcgtggctctgtacgattacgaggcaattcaccacgaggacttgagtttccaaaaaggagaccagatggtggttctggaggagagcggtgaatggtggaaagctagatccttggccactaggaaggaagggtacatccccagcaactatgtagctagagtggattcgttggagaccgaagagtggttttttaaaggaataagcagaaaggatgctgagaggcagcttctggcgcctggaaatatgttgggcagcttcatgattcgcgattccgaaaccaccaaggggtcctacagtttaagcgtaagggactatgacccgaggcagggcgacaccgtgaaacattacaaaatcaggactcttgacaacgggggattctatatcagccccagatctaccttctcaacgctccaggaactcgtggatcattacaagaagggcaatgatggactatgtcagaaactctcagtgccatgtatgtcctctaagcctcagaagccctgggagaaagacgcgtgggaaattccaagggagtctcttaaactggagaaaaagctcggcgctgggcagttcggtgaggtgtggatggccacttacaataagcacaccaaagtggccgtcaaaactatgaagccaggcagcatgtctgtcgaagcttttctggcagaagctaatgttatgaaaacgctgcagcacgacaaactcgtgaagctccacgctgtggtgaccaaagaacctatctacataattaccgaattcatggctaagggctcgctgttggactttctgaaaagcgacgaggggtctaagcagccccttcctaaactgatagatttctccgcacagatcgccgaaggcatggcgttcatcgagcaaagaaattacattcaccgagaccttcgggctgctaatatcctcgtttctgcaagtttggtttgtaagatcgccgactttggcctggcaagagtgatcgaggacaacgaatacacagctagggaaggggcaaagtttcctattaagtggaccgcccctgaagcaatcaatttcgggagttttactattaagagcgatgtgtggagtttcgggatcctactgatggaaatcgtgacctatggacggattccttaccccggaatgagcaatccagaggtgatccgggctctggagcgcggttacagaatgccacgcccagaaaactgccctgaagaattgtataacatcatgatgaggtgttggaaaaaccggccagaagaacgccctacgttcgagtatattcaatccgtgcttgatgacttctacactgccacggagagtcagtaccagcagcagccctag

SEQ ID NO: 28876 - DNA, 1521 bp, Artificial Sequence
  Description of Artificial Sequence: Synthetic coding sequence
atgatgggatgtatgaagagcaagtttttacaggttggcggtaacactttctcaaaaacggagaccagtgcgtcacctcactgtcctgtctatgtgcccgatcctacctcaaccattaagccaggcccaaactctcataactctaacacccccggtatccgggaggctggcagcgaggacattatcgtcgtcgccctatacgattatgaggcgattcaccatgaagacctgtcctttcaaaagggcgatcagatggtcgttctggaagaatctggagaatggtggaaagcccgttccctcgcaacgcggaaggaaggttacatccctagtaactatgtggctagggtggacagcctggagacagaagaatggttttttaagggcatctcgagaaaggacgccgaacgtcagctgctggccccaggaaatatgctgggcagcttcatgattagggactcagaaacaactaaaggcagttatagcctgagcgtcagagactatgatcctcggcagggagacaccgtgaagcattacaagatcaggactctagacaacggtggcttttacatttcaccacgcagtactttttccactcttcaagagctagtggatcattataaaaaggggaacgatggcttatgccagaagttgagcgttccttgtatgtcgtccaagccacaaaagccatgggagaaggatgcctgggagattcccagggagagtttaaaactggaaaaaaaactgggagccggtcagtttggagaagtttggatggccacgtacaacaagcatacaaaggtggccgtgaaaaccatgaagccgggatccatgagtgtggaggcattcttggccgaggccaatgtgatgaagacactgcagcacgacaagcttgtgaaactgcacgcggtcgtgactaaagagccaatttacattattacagagtttatggctaagggatcgctgctcgattttctgaaatcagatgaaggaagtaagcagcccctccctaaacttattgacttctcggctcaaattgccgaggggatggctttcatcgaacagcgcaattacatccatcgagacctgcgcgctgccaacatactggtaagcgccagccttgtgtgtaaaattgccgatttcgggcttgcacgcgttatcgaggataacgaatatactgcaagagagggggcaaagttccctataaaatggaccgcgccagaagccattaacttcggtagctttacaatcaagtccgacgtatggagctttggcattcttctaatggaaattgtcacctatggtagaatcccgtaccccggaatgagtaatcccgaggtgatcagggccctggagcggggatacagaatgcccagacctgagaattgtccagaggaactgtacaatattatgatgagatgctggaaaaatcgccctgaggaaagacctaccttcgagtacatccagagcgtgctggatgatttctacaccgcaacagagagtcaatatcagcagcagccatag

SEQ ID NO: 28877 - DNA, 1518 bp, Artificial Sequence
  Description of Artificial Sequence: Synthetic coding sequence
atgggatgcatgaaatcaaaatttctacaggtcggcggaaatacattctccaagaccgagacctctgcctccccccactgtcctgtctatgtacctgaccccaccagcactatcaaacctggacctaatagccacaattcaaacacacccggaatccgggaagctggttccgaggacattattgttgtggctctgtacgattacgaagccatccaccacgaggacctgtctttccagaagggcgaccaaatggtggtactggaagagtccggtgagtggtggaaggcacgctcccttgcgactaggaaagaaggttacatcccttccaattacgtggctcgtgtggattctctcgagacagaagagtggttctttaaaggaatcagtcggaaggatgcagaacgccaactcctcgcaccaggcaatatgcttgggtctttcatgattcgcgactcagaaacaaccaagggctcatatagtctcagtgtacgcgattacgatcctaggcagggcgatactgtgaagcattacaaaatacgcactctggacaatggtggtttctacatctcgcctcggtcgacattcagcacacttcaggagttggtggatcattataagaaaggcaacgatggcctctgtcagaagctgtccgtaccctgtatgagctctaagccacagaagccttgggagaaggatgcatgggaaatacccagggagtctctcaaactggagaagaaacttggcgctggccagtttggggaggtctggatggctacatataataaacataccaaggtagccgtgaagactatgaaaccgggttccatgtccgttgaggcgttcttagccgaggccaatgtaatgaagacactacaacacgacaagctcgtgaaattgcacgcggtggtgaccaaggaacctatctacattattacagaattcatggcaaaggggtcactgttagactttcttaagagtgacgagggaagcaagcagccgctccctaaactcattgatttcagtgctcagatagcagagggcatggcatttatcgagcagcgcaattatattcatagagacctccgagctgcaaacatacttgtctctgcatctctggtatgtaaaatcgctgatttcggcctggcgagagtcatcgaggataatgagtatactgcacgagagggggcaaagttcccaatcaagtggactgcgccagaggccattaacttcgggtctttcacaatcaagtcagatgtctggtcctttgggattttgctgatggaaatcgtaacatatgggagaattccttaccctggtatgtccaaccccgaagtgatcagagcattagagcgtggctaccgtatgccccgtcccgagaattgtccagaagaactgtataatattatgatgaggtgctggaaaaaccgtcccgaggagaggcccaccttcgaatatattcagtccgtcctcgacgatttctataccgctaccgagtcacaataccagcaacaaccctag

SEQ ID NO: 28878 - DNA, 1632 bp, Artificial Sequence
  Description of Artificial Sequence: Synthetic coding sequence
atgctacttcggtcaaagcctgctttgcccccacccctcatgcttctgctcctcggacccctcggccctctttcacctggtgccctgcctagacccgcacaggcccaggatgttgtagatctggattttttcactcaagagcccttgcaccttgtgtccccatcatttctgtcagtgaccatagatgcaaacctggcaacggacccacgttttctaattctcctcggttctccaaagctacgcaccttggccagggggctatctcccgcatatttgaggttcggaggaacgaaaaccgacttcctgattttcgaccctaagaaagaaagcaccttcgaggagcggagctattggcagtctcaagttaaccaggatatttgtaagtacggaagtatcccgccagacgtcgaggagaaactgaggctggagtggccatatcaggagcagttattgctgagagaacactatcagaaaaaatttaaaaactcaacttatagcagatccagtgtggacgtactttacaccttcgctaactgctcaggccttgacttgatattcggtctcaacgcgctcctgagaaccgctgacctgcagtggaactcatcaaatgcacagcttctcttggattactgtagcagtaagggttacaacatcagttgggaactgggcaacgaaccgaactcattcctgaagaaagctgacattttcattaatggaagtcagctcggcgaagacttcattcagctccacaagctccttcggaaatccacattcaagaacgctaagctttatgggccagacgttgggcaacctcggagaaaaaccgccaaaatgctaaaatcgttcctgaaagcgggaggtgaggtgatcgacagcgtgacctggcaccactactatctgaacggcaggacagccaccaaagaggatttcctcaacccagatgtcctagatatattcatatcatctgtgcaaaaagtgtttcaggtggttgagtcaacacgtccaggtaagaaagtatggttgggcgaaactagctcagcctacggaggaggggcacccctcttatcagacaccttcgctgccggttttatgtggctggacaaattggggcttagcgctaggatgggaattgaagtcgttatgaggcaggtattctttggtgccggaaattaccatctggtggacgagaacttcgacccattaccagactattggttatccctcctattcaagaagttggtaggaactaaagttctgatggccagtgtgcagggctcaaagagaagaaagctgcgtgtctacttgcactgtaccaataccgataatccacgatataaagaaggtgatctaactctatacgcgatcaacctgcataatgtgactaagtatctacggctcccatacccattctccaacaagcaggtagataaatacctactgaggcctttaggacctcacggattgcttagcaagtctgtccaactcaacggacttacccttaagatggtggacgatcagactctcccacctttgatggagaaaccattgaggcctggaagcagcctgggactaccagccttctcgtattcatttttcgtgattcggaacgcaaaggtggcagcgtgcatctag

SEQ ID NO: 28879 - DNA, 1632 bp, Artificial Sequence
  Description of Artificial Sequence: Synthetic coding sequence
atgctcctccggtccaagcccgctttgcctcctccacttatgctgctgctgctgggccctctgggccctttgtcccccggagctctgccaagaccagctcaggcacaggatgtcgtcgacttggattttttcacacaagagcctctccatctggtgtctccaagctttttatctgtcacgattgatgctaacctggctacagaccccaggttcctgatcctgctgggctctcccaagctgcgtaccctggcacgtgggctctccccagcatacctgaggttcggcggaaccaagaccgattttctgatttttgatcccaaaaaagaatccacctttgaggagcggtcttattggcaatctcaggtcaatcaggatatatgcaaatacggctcaatccctccggacgtcgaggagaaactgcggttagagtggccgtaccaggaacagctactcctacgggagcactaccagaaaaagttcaagaacagtacctactcaaggtcaagtgtggacgtactgtatacgttcgcgaattgctccggactggacctgatttttggattgaatgcgttgcttcgcaccgcagacctgcagtggaactcttcaaatgcccaactcctgctagattactgcagctccaaagggtacaatatctcctgggaattggggaatgagccaaactcctttctgaagaaagctgacatttttatcaacgggtcacagcttggggaggattttatccagctccacaaattactcagaaagtcaacctttaagaatgctaagttgtacggcccagacgtgggccaaccccgaagaaaaacagctaagatgttgaagtcctttttgaaggccggaggggaagtcatagattccgttacatggcaccattactatcttaatggcagaaccgctactaaggaagacttcttgaatccagatgttctcgacatctttattagcagtgtgcaaaaggtgtttcaggtggtggagtccacccgccctggcaagaaagtgtggttaggcgagactagctctgcatacggtggaggggctccgctcctcagcgataccttcgctgcgggattcatgtggctcgataagctgggtctgtccgcaagaatgggcattgaagttgtgatgcgccaggtcttttttggcgctggaaactaccaccttgtggatgagaacttcgatcctcttcctgactactggctgtccttgctgttcaaaaagttggtgggcaccaaagtgcttatggccagtgtccagggatcaaagcggagaaagctgagggtgtacctgcactgcacaaacacagacaatcccagatacaaggagggggatctgacgctgtatgccatcaatctgcacaatgtgacaaagtacctccgacttccctacccgttttctaacaagcaggttgacaagtatttgctgcggccactcggtccacacgggcttctgagtaaaagcgtgcaactgaatggactcactctgaagatggtggatgatcaaactctgccgcctttgatggagaagcctcttagacccggttcctcccttggcttacctgccttcagttatagcttctttgtaatccgcaacgccaaagtcgccgcttgcatctag

SEQ ID NO: 28880 - DNA, 294 bp, Artificial Sequence
  Description of Artificial Sequence: Synthetic coding sequence
atgctgctgttgctcgggcctctgggccctctatctcccggagcattgcccaggcccgctcaggcccaggacgtggtggacctggatttttttacccaggagcctttgcaccttgtgtccccttcttttctctctgtgacccgccctggtaagaaagtttggctgggcgagacaagttctgcttacggcggaggagcacctctgctcagtgacacctttgctgccggattcatgtggctggacaagctgggtctgtcagctagaatgggcatcgaggtggtaatgagacagtag

SEQ ID NO: 28881 - DNA, 1410 bp, Artificial Sequence
  Description of Artificial Sequence: Synthetic coding sequence
atgctcctacggagtaaaccggcactgccacccccacttatgctgttactgttgggaccactgggccctctgagcccaggtgccctgccacgcccagctcaggcgcaggatgtggttgatctagacttcttcacacaggagccattgcacttagtcagcccatccttcctgtccgtgaccatagacgccaatctcgcaactgacccacgattcctgattctgctcggctctcctaagctgcggactctggcccgaggcctgtcccctgcctatctgcggttcggaggcacgaagacggactttctcatctttgatccaaaaaaggaaagcacctttgaagaacggagctattggcagtctcaggtgaatcaggacatttgcaagtatggcagtattcccccagatgtggaagaaaagttgaggcttgagtggccttatcaggaacagctgctcctaagggagcattaccaaaagaaattcaaaaatagcacgtactcgagatcatcagttgatgtcctttataccttcgccaactgctccggactcgaccttatctttggcttgaatgcgctgctgagaactgcagatctgcagtggaattccagcaatgcccagctgctgttggattactgttcatcgaagggttataacattagttgggagttgggtaacgaaccgaacagcttcttaaagaaggccgatatctttattaatgggtcccagctcggcgaagattttatccaactgcataagcttctgcggaagtccacatttaagaatgctaagctttatgggcctgatgtaggacaaccccgaagaaagactgccaagatgctgaaaagtttcctaaaagcaggcggtgaggttatcgactccgttacctggcaccactactacctcaacggacgaaccgcaacaaaagaagactttctaaatcctgatgttctggatattttcatttcaagtgtgcagaaagtttttcaggattattggttgagtctacttttcaagaagctagtggggacaaaagtcctgatggcttccgtgcagggctcaaagcgacgcaaattacgtgtctatctgcattgcacaaataccgataaccctcgctataaggaaggtgacctcacactctacgctattaacttgcacaacgttacaaaatatttgcgcttaccatatccattttccaacaagcaggtcgataagtacctgttgaggccgcttgggcctcatgggctcctatcaaagtctgtacagctaaacggcttgacactgaaaatggtggatgaccagacacttccaccccttatggagaaaccactgagacccggatcatcactcggactgcctgcctttagctacagcttctttgtaattcgtaacgcaaaagtcgccgcatgcatttag

SEQ ID NO: 28882 - DNA, 1458 bp, Artificial Sequence
  Description of Artificial Sequence: Synthetic coding sequence
atgcttctgcgttcaaaacctgcactcccacccccactcatgctactcctgttaggacctctgggaccattaagccctggcgcactgccacggcctgcccaggcccaagacgtggtcgatcttgacttcttcacacaggagcctctacatttagtttccccttccttccttagcgtcacaatcgatgcaaacctggccacggacccccgtttcctcatactcctagggagtcctaagctccgcacgttagctcgcggtttatcgccagcctacttgcgtttcgggggtaccaaaaccgatttcctgatcttcgaccccaagaaggagtctacctttgaagaacgctcctattggcagtcacaggttaaccaagacatttgcaaatatggctcgatcccaccagacgtcgaggagaagctgagattagagtggccctaccaggagcagctacttcttagagagcactatcagaaaaaatttaagaactctacttactccaagccgaattcattccttaaaaaggccgatatattcattaacggatcccaattaggagaggacttcatccagttacacaagctgctacgcaaatctaccttcaaaaacgcgaagctttatgggccagatgtggggcagccgcgtcggaagactgctaaaatgctgaagtcctttttaaaggccggtggagaggttatcgactctgttacctggcaccattattatctcaacggccgaaccgcaaccaaggaggacttccttaacccggacgtgcttgacatttttatctcatccgtgcagaaggtgttccaggtggtcgagagtaccagaccaggcaagaaggtgtggctgggcgagacatcttccgcgtatggcggaggggctcccctcctatccgacacattcgccgcagggtttatgtggttagataaactgggactgagcgcaaggatgggcattgaagtcgtgatgcggcaagttttcttcggtgctgggaactaccatctcgtggacgaaaactttgaccctttaccagactactggctcagcctgctgttcaagaagctggtgggtacaaaggtgcttatggcgagcgtgcagggcagtaaacggagaaagctccgggtttacctgcattgtacaaacaccgacaatccaaggtacaaagagggagacctcacactatacgcgatcaacctgcacaatgtcaccaagtatctgcgcctgccttaccctttttccaataagcaagttgataaatatctcctccgcccactcggccctcacggcctcttgtctaagtcagttcaactgaacggcttgacgctgaaaatggtcgatgaccagaccctgccaccacttatggagaagccacttaggcccggatcttccctgggacttccagccttctcctactcgtttttcgtgatcagaaacgctaaggtggccgcttgtatctag

SEQ ID NO: 28883 - DNA, 1062 bp, Artificial Sequence
  Description of Artificial Sequence: Synthetic coding sequence
atggagaagacccttgaaacggtgcccctggagagaaagaagagggaaaaggagcagtttcgcaagctgttcatcggcggattgagcttcgagaccaccgaagagtcgctgcgcaattactacgagcaatgggggaagttaactgactgtgtggtgatgcgcgacccagcatctaagagaagtcggggtttcggcttcgttacattctcctccatggctgaggttgacgctgctatggcagcaagaccacactctatcgatgggagggtggtggaacctaagcgggctgtagccagggaagagtctgggaagcctggcgcacacgtgaccgtgaaaaagctttttgtggggggaatcaaggaagacacagaggaacaccaccttcgcgactattttgaggagtacggcaaaattgacacgattgagatcattacggaccggcagtccggcaagaaaagagggttcgggtttgttaccttcgacgaccatgaccctgtggataaaattgtgttacagaagtatcatactataaatgggcataatgctgaagtacgtaaggctctttcacgtcaggagatgcaggaagtgcagagttccagatctggtcgcggagggaactttgggttcggggattcaagggggggaggaggcaattttggcccaggcccaggaagcaattttcggggtggttcggacggttatggctccggtaggggctttggagacggatacaacgggtacggagggggacctggcggaggaaatttcggaggcagtcctggatatgggggaggtcgcggaggatatggaggtggagggccagggtacgggaaccaggggggaggttatggtggcggatacgataattatggcggtgggaattatggtagcggaaattacaacgatttcggcaactacaatcagcagcccagtaattacggccctatgaagagcggtaactttggcggatccaggaacatggggggtccttacggcggaggaaattacggccctggcggtagcggtggaagcggcggatatgggggaagaagtaggtactag

SEQ ID NO: 28884 - DNA, 1026 bp, Artificial Sequence
  Description of Artificial Sequence: Synthetic coding sequence
atggagcgagagaaagagcagtttcggaagctgtttattgggggactgagctttgaaaccaccgaagaatctctacgaaactattacgaacagtggggcaaactgacggattgcgtagtgatgcgggacccagcctcaaaacgcagcaggggatttgggtttgtcactttttcttctatggccgaagtggacgctgcgatggcggctagaccgcattcgatcgacggaagagtggtcgaacctaagagagccgtggctagggaggaatcaggaaagccaggagctcacgtgacagtcaagaaactgttcgtgggaggcatcaaggaggacaccgaagagcaccatctgagagattacttcgaagagtacggcaaaattgacaccatcgaaattattacggatcgacaaagcggtaaaaagcgaggtttcgggttcgtaaccttcgatgatcacgatccagtcgacaagatcgtactgcagaaataccacaccatcaatggccataatgcagaggtccgcaaggctctaagtaggcaagaaatgcaagaagtgcagtcttcacgtagcggcaggggcggaaatttcggctttggcgattccagagggggaggtggcaatttcggcccaggaccgggaagcaactttagaggcggttcagatggttacgggtccggaaggggtttcggcgacggatacaacgggtatggcggtgggccagggggtggtaatttcggcggtagcccaggatacggtggcggacgcggaggatacgggggtggtggccctggatatgggaatcagggagggggatatggaggcggttatgataactatggcggagggaactatgggagcggcaattataatgattttggcaattacaaccagcagccctccaactacggtccaatgaagagcgggaacttcggtggtagcaggaacatgggcggaccatacggcggagggaattatggccctggcggatctgggggatccggcggttacggtgggagatcccgctactag

SEQ ID NO: 28885 - DNA, 1062 bp, Artificial Sequence
  Description of Artificial Sequence: Synthetic coding sequence
atggaaaaaacgttggaaacggtgccccttgagcgaaagaagcgtgaaaaagagcagtttcggaagctgttcatcggaggtctgtccttcgagacaactgaagaatccctccggaattactacgagcaatggggcaagctaactgattgcgtagtgatgcgcgacccagccagcaaacgtagtcgaggattcggcttcgtgacttttagcagcatggctgaggtggacgccgcaatggccgcacgtccacacagtattgacggcagggtcgttgaaccaaagcgagccgtggccagggaggagtcgggaaaacccggtgcccacgtcacagtgaagaagttattcgtaggcggtatcaaggaagatacggaagaacatcacctgagggattactttgaagagtacgggaaaatcgacaccattgaaatcatcaccgaccgacagagcggaaagaaacgcggattcggcttcgtgacattcgacgaccacgacccggttgataagatagtgctgcagaagtaccatacgatcaacggccacaatgccgaagtgcggaaagctctgtcacggcaggaaatgcaggaggtgcagagtagcagaagtggcagaggaggaaatttcgggttcggagatagtcgagggggtggcggaaacttcggtccgggacctgggagtaatttcaggggtggatcggatgggtatgggtcgggaaggggcttcggggacggatataatgggtatggcggtggtccagggggagggaactttggcggtagccccggatatgggggagggaggggcggttacggaggcggaggtcctggatatgggaatcaaggaggcggatatggcggagggtacgacaactacggaggagggaattatggcagtgggaattataatgatttcggcaattataaccaacagccgtctaactacgggcctatgaaatctgggaacttcggaggctcacgtaatatgggtgggccttatggtggaggcaactacggcccaggcggaagcggcggttccgggggatacgggggacgatccagatactag

SEQ ID NO: 28886 - DNA, 750 bp, Artificial Sequence
  Description of Artificial Sequence: Synthetic coding sequence
atggagagagagaaggaacagttccgcaaactgtttatcggaggactgagtttcgagacgaccgaggagagtctgcggaattactacgagcagtgggggaagttgaccgattgcgtagtcatgcgcgaccctgcctccaaaaggtccagaggctttggcttcgtgacattctcgtcaatggcagaagtcgatgcggctatggctgcgcgacctcactccatcgatggccgagtagtggagcccaagcgggctgtggccagagaggagtccggcaagcctggagctcacgtcaccgtgaaaaaattatttgtgggagggattaaggaagataccgaagagcaccatctaagagattatttcgaagaatatggtaagattgatactattgaaatcatcacagaccggcagtctggcaagaaacgaggattcggatttgttacatttgacgaccatgaccctgtggataaaattgtgctgcagaagtaccacacaataaacggacataatgctgaggtcagaaaggccctgtcaagacaagagatgcaggaagacctggaagtggccattctcgaggtggctcccgtcatggaggaggaagaagaagacatggtggtggaagacttagatatggctacccgggtaggggctactgaggtggtcatgacaacaatggaggaggaaatcatggaggttgagatcaccatgatattggagatcatcacaagcaacttactcacaaccgtgcagtag

SEQ ID NO: 28887 - DNA, 846 bp, Artificial Sequence
  Description of Artificial Sequence: Synthetic coding sequence
atgagcgaagaacagtttggaggggatggggcagctgggaatggtggaggcagacgtgctggtgaacaggagggcgctatggtggccgcaacacaaggagctgccgcacgggaggccgagccagggccaggggcagagcccaggctggaagctcccaagggcgcagagtcagagggagccaagatcgacgccagcaagaatgaggaggatgagggcaagatgtttatcgggggactgagttgggacaccacaaaaaaagatctcaaagactacttttccaagtttggagaggttgtggattgtactctgaagcttgatcccatcacaggcaggtctcgtgggtttggctttgtgctctttaaggagtctgagtctgtagacaaagtgatggatcaaaaagaacacaaattgaatggtaaagtcattgaccctaagcgcgctaaggcaatgaaaaccaaggaacctgtgaaaaagatcttcgtgggcggactttcacccgacacgcctgaagagaagatacgggagtactttggagggttcggggaggtagagtcaattgaactccccatggacaacaaaaccaataagagaaggggcttctgttttattacattcaaagaggaagaacctgttaagaaaatcatggagaaaaaatatcacaacgtgggcctctccaagtgcgagatcaaggtcgcaatgtccaaggagcagtaccaacaacagcagcaatgggggtctcggggtggcttcgccggtcgggctcgcggtagaggcggtgatcagcaatcaggctatggaaaagtatcccggcgtggtggtcaccagaattcctacaaaccatactag

SEQ ID NO: 28888 - DNA, 1068 bp, Artificial Sequence
  Description of Artificial Sequence: Synthetic coding sequence
atgtccgaggaacaattcggaggcgacggagcggctgctgccgcaaccgctgctgtgggaggaagtgctggggaacaggagggggctatggttgcagctacgcagggcgcagccgcagcagctggaagcggggctggaacaggcggaggcaccgcctctggcggaactgaagggggaagtgcagaatcagagggcgctaagattgatgcttccaagaatgaggaagacgaagggcattccaactcttctcccaggcacagcgaggcagctacggcccagcgagaggagtggaaaatgttcataggcggactgtcctgggacacaaccaagaaggacctgaaggattacttctcaaagttcggcgaagtggtcgactgtactctgaaattggatcctataactggaagatcgcgagggttcggattcgttttgttcaaggagtccgagtccgtggataaagtgatggatcaaaaggaacataaactgaatggaaaagtgatcgatccgaagcgtgccaaagctatgaaaaccaaagagccagtgaaaaagatatttgttggtggcttgtcacccgacacacccgaggagaagatacgagagtactttggaggcttcggggaagtcgaatctattgaactgcctatggacaacaaaaccaacaaacggaggggattttgcttcatcacattcaaagaagaggaacctgtcaagaaaattatggaaaagaagtaccacaacgtgggcttatctaaatgtgaaatcaaggtagcgatgagcaaagaacaataccaacaacagcagcaatggggctcaagaggcggtttcgcaggaagagctcgcggacggggtggaggccctagccagaattggaatcaggggtattctaactattggaaccagggttacggaaactatggctacaactcccaggggtatggcggatacgggggttatgattacacaggctacaataactattacggctacggcgactactcaaaccagcagtcaggctacggcaaagtatcccggcgtggcggacaccagaactcttacaaaccttactag

SEQ ID NO: 28889 - DNA, 1011 bp, Artificial Sequence
  Description of Artificial Sequence: Synthetic coding sequence
atgtccgaagaacaattcgggggtgacggagctgctgcggctgctacagcggcagtcggcggatctgccggtgaacaggaaggcgcaatggttgccgctacccagggggctgctgcagctgccggttccggggcaggaacaggcggaggcaccgcaagcggtgggaccgaagggggtagtgcagagagtgagggcgctaagattgatgcctctaaaaacgaagaggacgaggggaagatgtttatcggcggtctgtcctgggacactaccaagaaggacctcaaagattacttctcaaaatttggggaggtggtggattgtacactgaaactggatcctattactggcaggtctagggggttcggctttgtgttattcaaggaatctgaatctgtcgataaggtgatggaccagaaagaacataagttaaatggcaaagtcatcgatccgaagcgggcaaaagcgatgaagaccaaagaacccgttaagaagatttttgtgggcggtctgtcacccgacaccccggaagaaaagatacgagaatatttcggcggattcggcgaggtcgagtctatagagctaccgatggacaacaaaacaaacaaacgccgaggattctgcttcatcacgttcaaggaggaagagccagtgaagaagatcatggagaagaagtatcacaacgttggattgagcaaatgcgaaatcaaagtggccatgtctaaagaacagtaccagcagcaacagcagtgggggtcacggggagggtttgcgggtagagccagaggcaggggcggtggtcccagccagaactggaaccagggctattctaattattggaatcaggggtacgggaactacggatacaattcccagggttacggtgggtacggtggctacgattacacaggatataacaactattacgggtacggggattactccaatcagcagtccgggtatgggaaagtgtcaagaagggggggtcaccagaacagttataaaccctattag

SEQ ID NO: 28890 - DNA, 921 bp, Artificial Sequence
  Description of Artificial Sequence: Synthetic coding sequence
atgtccgaggagcagttcggcggagacggtgcagcagcagcggcaactgccgctgtcggaggtagcgccggagagcaagaaggtgcaatggtggcagcaactcagggagcagctgccgcagctggatcaggggcaggcaccggtggagggacggccagcggcggaaccgagggcggttccgccgaatctgagggcgcaaagatcgatgcctctaaaaacgaagaagacgagggacactctaacagcagccctcggcatagcgaggccgcaaccgcacagagagaggagtggaaaatgttcatcggaggcctctcctgggatacaaccaagaaggatttgaaagattactttagcaaatttggagaggtcgtagactgcacacttaaacttgaccctatcacagggagatcaaggggcttcggattcgtcctattcaaggaatccgagtcggtcgacaaggtgatggaccagaaggagcataaactcaacggtaaggtcatagaccccaagagggcgaaggccatgaaaaccaaagaacctgtcaaaaagatcttcgtgggcggattgagtccagataccccagaggaaaaaatacgcgaatacttcggaggcttcggtgaggtagagtccatagagctgccaatggacaataaaactaacaagagaaggggattctgtttcatcactttcaaggaggaggagcccgtcaagaaaattatggaaaagaagtaccataatgttggactgtccaagtgtgaaattaaggtggcgatgtctaaggaacagtatcagcagcagcaacagtggggatcacgcggaggattcgctggcagggccaggggtaggggaggagatcagcaatccggctatggtaaagtgtcaagaaggggagggcatcaaaatagctataaaccctactag

SEQ ID NO: 28891 - DNA, 468 bp, Artificial Sequence
  Description of Artificial Sequence: Synthetic coding sequence
atgtctgaagaacagtttggtggggatggcgcagccgcagctgcaactgcagccgtcgggggatcggcgggtgaacaggaaggcgctatggttgccgctactcagggcgctgccgctgctgccggttctggagccggaacaggaggcggtaccgcctctggtggcaccgaaggaggctccgcagagtccgaaggagctaaaatcgacgcctcgaagaacgaggaggatgaaggtaagatgtttattggaggcctctcatgggacactactaagaaggacctgaaggattacttttctaagtttggtgaggtcgttgactgtacccttaaattagacccaattactggcagatctcggggtttcggattcgtgctgttcaaagagagcgagagtgttgacaaggtgatggaccagaaagagcacaagctcaatgggaaagtgattgacccgaaaagagctaaggcatag

SEQ ID NO: 28892 - DNA, 666 bp, Artificial Sequence
  Description of Artificial Sequence: Synthetic coding sequence
atgagtgaggagcagttcggaggtgacggcgcagccgcagcagctaccgctgcggtgggcggttctgccggagagcaggagggagctatggtcgccgctacacagggcgcagcagccgcagctggatcaggggctgggactgggggaggcacagcaagtggaggcaccgagggcggatcagccgagagcgagggtgccaaaatcgacgccagcaagaacgaggaggatgagggccactccaacagcagcccccgtcacagtgaggcagcgaccgcccagagggaggagtggaagatgttcatcggcggattgagctgggataccacaaaaaaggatctgaaggattattttagcaagtttggcgaagttgtcgactgtacactgaagttggaccccatcaccgggagatcacgcggatttggctttgtactctttaaagaatccgagagcgtcgacaaggttatggaccagaaggaacacaagctgaacgggaaggtgatcgatccaaaaagggctaaagccatgaaaaccaaggagccagtgaaaaagatctttgttggcggactgtcacctgacacccctgaagagaaaattcgcgaatatttcggagggttcggcgaggtggaaagtatcgaactgcccatggataataaaacaaacaagtag

SEQ ID NO: 28893 - DNA, 633 bp, Artificial Sequence
  Description of Artificial Sequence: Synthetic coding sequence
tgaaaaatgttcatcggtggcctcagctgggatacgacaaaaaaggatttaaaggactatttttccaagttcggcgaggtggttgactgcacgttaaagctagatcccattaccggtcgatccagaggattcgggttcgtgctgtttaaggagagcgagtccgtggacaaggtgatggatcagaaagagcataagttaaatggaaaggtgatagatccaaagcgagctaaagcaatgaaaaccaaagagcccgttaagaagatctttgtgggtggcctgagtccggacacacccgaagagaagatccgggaatacttcggcggatttggcgaagtagaaagcatcgagcttccaatggataataaaacaaataaacgaaggggattctgttttatcaccttcaaagaggaggagcccgtcaagaagattatggagaagaagtaccacaacgttggcctgtcaaagtgcgagatcaaggtggccatgagtaaagagcagtaccagcagcagcagcaatggggcagtcgcggtggcttcgccggtcgagccaggggcagaggtggggaccagcagagcgggtacggcaaggtttcccgacgcggaggccaccaaaacagctataaaccttattag

SEQ ID NO: 28894 - DNA, 606 bp, Artificial Sequence
  Description of Artificial Sequence: Synthetic coding sequence
atggatcaaaaagaacacaagctcaacggcaaggtgatcgatcctaaaagggcgaaggccatgaaaacaaaggagccagtgaaaaagatattcgttggcggtctgtcaccagacaccccagaggagaaaattagagagtattttggaggctttggcgaggtggaatcaattgaattaccaatggacaacaaaactaataagcgccgaggattttgcttcattaccttcaaggaggaggagcccgtgaagaagattatggagaagaagtaccacaatgttggcctgagtaagtgtgagatcaaagtggccatgtctaaagagcagtatcaacagcagcagcagtggggttctagggggggtttcgccggaagagctcgcggaagagggggaggcccatctcagaactggaatcagggatatagcaactactggaatcagggctatgggaattacggctataactctcagggctatggcggatatggaggttatgactatacgggttataataactattacgggtacggggattacagcaaccagcaatcggggtatggcaaggtctcgcgtagagggggacatcaaaattcctataaaccatactag

SEQ ID NO: 28895 - DNA, 912 bp, Artificial Sequence
  Description of Artificial Sequence: Synthetic coding sequence
atgtccgaggagcagtttggaggggacggagccgcagcagccgcaaccgctgccgcttctggcggtaccgagggcggtagcgccgagtccgaaggtgcaaagattgacgcttccaagaacgaggaggacgagggtaagatgttcataggcggactttcttgggacaccacaaagaaagacttgaaagattacttttccaaatttggagaagtggtggattgtacactcaagttggaccccattactgggagaagtcgaggattcggttttgtgctgttcaaggaaagcgagtcggtggataaagtgatggaccagaaagagcataagctgaatggcaaggtcattgacccaaaacgtgccaaggccatgaagactaaagagccggttaaaaaaattttcgtaggcggattatcacccgacacacccgaggaaaagataagagagtatttcggcggttttggcgaggttgaatctatcgaactgccaatggacaacaagacaaataagaggcgcggtttttgcttcattaccttcaaagaggaggagccagtcaaaaaaattatggagaagaaatatcataacgtgggactctccaagtgtgagatcaaggtggcaatgtccaaggaacagtatcaacagcagcagcaatgggggagcaggggaggatttgcgggacgcgctcggggtaggggcggagggccatcacagaactggaaccagggctactctaactactggaaccaaggctacggcaattatggctacaactctcaggggtatgggggatacggtggttatgattacaccggttacaacaattactatgggtacggtgattatagcaaccaacagtcaggctacgggaaggtgtcaagacggggagggcaccagaacagttacaagccctactag

SEQ ID NO: 28896 - DNA, 1974 bp, Artificial Sequence
  Description of Artificial Sequence: Synthetic coding sequence
atgccccgttacactgtccacgtgcggggagagtggctggctgtgccctgccaggacgcacagctcaccgtgggctggctgggcagagaggcagtgcggagatacatcaagaataaacctgacaatgggggttttaccagtgtcgacgacgctcacttcttggtgcgaaggtgcaagggattagggcttcttgacaacgaagatcgcctagaggtggctttggaaaataatgagttcgttgaagttgtgatcgaaggggacgccatgtctccagattttattccttcacagccggagggcgtgtatctctactccaaatatagagagcccgaaaaatatatagagcttgacggcgaccggctgacaacagaggacctggtgaacctgggaaaaggacggtacaagataaaattgacccccaccgcggaaaagcgagtgcaaaaatcaagggaagttatagacagcattattaaagagaaaacagtcgtatatggtatcactacaggctttggcaaattcgctcggacggtcattcctatcaacaaactgcaagagctgcaagtgaacttagtgcggtcccattcctcgggcgttgggaagcctctttctcctgaacggtgccggatgctgctagcactgaggatcaatgttctagccaagggctattcagggattagcctggagacgctaaagcaggtgatagagatgtttaacgccagctgcttgccctacgtgcccgagaaggggaccgttggggcttccggagatttggcccctttgagtcatctggctctcgggctcgtcggagaaggcaagatgtggtccccaaaatcggggtgggcggatgcgaagtacgttcttgaagcccacgggctgaagcccgtgatcctgaagcctaaggaggggctagcgctgattaacgggactcagatgattacttcactggggtgtgaggccgtagaacgcgcatccgcaatcgctcgacaagcagatattgtcgccgctctcaccttagaagtgttgaagggaaccaccaaagctttcgacacagacatccacgctctgagaccgcacaggggacaaatagaagtggcctttagatttaggtcactgttggatagcgaccatcatccctctgaaatagccgagtcacacaggttctgtgatagagtccaagacgcctacactttgaggtgctgccctcaggtgcacggcgttgtgaatgatacaatcgcattcgtaaaaaacatcatcacaacagagttgaactccgctacggataatcctatggtctttgctaaccgaggcgagacagtatccggcggaaacttccatggcgagtatcctgcaaaggctctggattacctggctataggcattcacgagctggctgccatatccgaacgcaggatagaacgcctttgcaacccatcattatccgaactgccagccttcttagtggccgagggtgggctaaactccggatttatgatagctcattgtacggccgcagccctggtgtcggaaaataaggctctatgccacccgagttcagtggatagcttaagcaccagtgctgccaccgaagaccatgtctcaatgggaggctgggccgctcggaaggctctccgcgtgattgagcatgtggagcaagtgctggccatagagctgcttgcagcctgccagggaatcgagttcctcagacccctcaagacaacaacgccgttggagaaagtgtacgacctcgttaggtccgtggtgcggccttggatcaaagatcgttttatggcaccggatatcgaggcagctcacagactgctgctcgaacagaaggtgtgggaggtcgctgctccatatattgaaaagtatcgtatggagcatatcccagagagtagacccctgagccctacagccttcagtctccaatttttgcacaagaaatccacaaagatccctgagagcgaggacttgtag

SEQ ID NO: 28897 - DNA, 1776 bp, Artificial Sequence
  Description of Artificial Sequence: Synthetic coding sequence
atgccgaggtacaccgtccatgtacggggtgagtggctggctgtcccatgccaagatgcacaactaacagtcggctggctcgggagggaggcagtccgtcgctacatcaaaaataagccagacaacggcggattcacttcagtggacgacgcgcatttcctggtccggcgatgtaaggggctgggtctgctcgacaatgaagatagactggaagtagccctggaaaacaacgagtttgtggaggtggttatcgagggcgacgccatgagccctgatttcatcccttcacaacctgagggagtgtatctttactccaaataccgtgaaccagagaaatacatcgaattggacggcgatcgattgacaactgaggacctggtcaacctgggcaaaggcaggtacaagattaaactaacccctaccgcggaaaagagagttcaaaaaagtcgggaggttatcgattccataataaaggaaaaaacagtggtgtacggtatcaccactggatttggtaagttcgccaggacagtcatcccaatcaacaagttgcaagagctacaggttaatctggtgcgttcccacagctcaggtgtgggaaaaccactgagcccagagcgctgtcgcatgttgctggccctgcgcatcaacgtgctcgcaaagggctactccggaatctcactcgaaacgttgaaacaggtcattgaaatgtttaatgcttcttgtctaccttatgttccagagaagggaacagtgggagcctcaggtgatttggcacctctgtcacacttggccctcggcctggtgggcgagggaaagatgtggtctcccaaatcaggatgggcagacgctaagtacgtattggaggctcatggcctgaaaccagtgatcctcaagcctaaagaaggccttgccctcataaacgggactcaaatgattacctccctcggatgtgaggcagtggagcgcgcttcagccatcgcgcgtcaggccgatattgtcgccgcactcacactggaggtgttgaagggtaccaccaaagccttcgacacggacatccacgcactgagacctcatagagggcagatcgaggttgcctttagattccggtcacttctggacagtgatcaccatccgagcgagatcgccgagagccaccgcttttgtgaccgcgtgcaagatgcctataccttgcggtgctgcccccaggtgcacggagtcgtgaatgacactatcgcattcgtcaaaaacatcataacaaccgaactcaactccgctacagacaatcccatggtgttcgccaaccgaggagagaccgtctcaggcggtaacttccatggcgagtaccctgccaaggcccttgattacctggccatcgggatccatgagctggccgctattagcgagcggcgaatcgaaaggctgtgtaatccatctctgagtgagttaccggcattcctcgtcgccgagggaggattaaactccggctttatgattgcacattgtaccgccgctgctctcgtaagtgagaacaaggctctgtgtcatccaagttcggtggacagtctgtcgacctcagccgcaacagaggaccacgtgagcatgggtggatgggctgctagaaaggcgctcagagtgatagaacacgtggagcaggtcctggcaatcgaacttctggcggcttgccagggtatcgaatttctccgcccacttaaaacgaccacaccactggaaaaagtgtacgacctggtgaggtccgtggttagattcgggaagtag

SEQ ID NO: 28898 - DNA, 1350 bp, Artificial Sequence
  Description of Artificial Sequence: Synthetic coding sequence
atgctcctggcgctgagaattaacgtcctggccaaaggctattcgggcataagcctggagaccttgaagcaggttattgagatgttcaatgcttcatgcctcccgtatgtgcctgagaagggtaccgtcggagcatccggggatctcgccccactaagccatttggcgctgggcttggtcggcgagggcaaaatgtggagccctaaatcagggtgggcagacgccaaatacgtcctggaggctcacgggctgaagcccgtgattctgaaaccgaaggagggtttggccctaatcaatggcactcagatgatcacttcactgggttgcgaagccgtcgagagggcctccgcaatcgccaggcaggcagacattgtcgccgcacttactctggaggttttgaagggtactacgaaggcttttgacacagatatccacgcactgaggccacacagaggccagattgaagtggcatttcgattccgatctttgctggactccgatcatcacccgagtgagatagcggagtcacaccgcttctgcgatcgggtacaggatgcctacactctgaggtgttgtccgcaggtacatggtgtggtcaatgatacaatcgctttcgtcaagaatatcattactaccgagctgaacagcgccacagacaaccccatggtctttgccaatcggggagaaacagtgtccggaggaaactttcatggggaataccccgctaaggctttagactacctcgcgattggcattcacgagctggctgccattagcgagaggcggattgaacggttgtgcaatccctctctgagcgaactgcccgctttcctcgttgccgaaggagggctgaatagcgggttcatgatcgcccattgcacggctgccgctctggtgtccgaaaacaaggccctgtgtcacccatcctccgtagacagcctgtcaaccagcgccgctactgaggaccacgtgagtatgggcggttgggctgctcgtaaagccctgagagttattgagcacgtcgaacaggtgctggccatcgagctgctcgctgcctgccaaggaatcgaattcctgcggcctctaaaaactaccacccctctggagaaggtctatgacctggtgagatcagtggtgcggccatggatcaaagacaggtttatggcccctgatattgaggcggcacataggctgcttttagagcaaaaggtctgggaagtagcagcaccatatattgagaagtaccgcatggagcacattccagagagccgccctctgagccctacggcgttctctctgcagttcctccacaagaaatccacaaagattcccgagtctgaggatctgtag

SEQ ID NO: 28899 - DNA, 1260 bp, Artificial Sequence
  Description of Artificial Sequence: Synthetic coding sequence
atggcaggctttggagccatggaaaagtttttggtcgagtataagtctgctgtggagaagaagctggctgagtacaagtgcaatactaacaccgcaatcgagcttaagctcgtgcgctttcccgaagatctagagaacgatatccgaacctttttcccagagtacactcaccagttattcggcgacgacgaaacggccttcggctataaaggcctgaagattctgctctactacatcgctggttctctgtcaaccatgttcagagtggagtacgcaagcaaggtagacgagaattttgactgtgtagaggccgacgatgtggagggcaagattaggcagattatcccccctggcttttgtaccaacaccaatgacttccttagccttctggaaaaggaggttgactttaaaccattcggaactttgctgcacacctattcggtactttccccaaccggcggtgagaatttcacattccagatttacaaggctgacatgacatgtagggggtttcgcgagtaccacgagcgcttgcagaccttcctcatgtggttcatcgagacagccagcttcattgatgtggatgatgagaggtggcactatttcttggtcttcgagaagtataacaaagacggggcaaccctcttcgccaccgttggatatatgaccgtttacaactattacgtttaccccgacaaaactcgcccaagggtaagtcagatgctcattctgacgccgtttcagggtcaaggccatggggcacagctgctcgagacagtccaccgctactacaccgaatttcctacagtgctggacattacagcggaggatcctagtaagagttatgtgaagttaagagatttcgtccttgttaagctctgtcaggacctcccatgcttctcccgagaaaagctaatgcagggtttcaacgaagacatggccatcgaggcacagcagaagtttaagatcaataagcagcacgcgagacgcgtgtatgaaattcttagattactcgtgaccgacatgagtgacgcagaacagtaccggagctatcggctggacatcaaaaggcgtttgatctctccttacaaaaagaaacagcgggatttggccaaaatgcgcaaatgcctccgtccggaggagctgactaatcagatgaatcagattgagatctctatgcagcacgagcagttggaggaatcttttcaggaactggtggaggattaccgcagagtcatagagagactcgcacaggagtag

SEQ ID NO: 28900 - DNA, 1005 bp, Artificial Sequence
  Description of Artificial Sequence: Synthetic coding sequence
atgttccgagtcgagtacgccagcaaggttgatgagaactttgattgcgtggaggccgacgacgtggagggtaaaattaggcaaattataccacccggattctgcactaacaccaatgatttcctttctctcctcgagaaggaggtggatttcaagcccttcggtacactgctgcatacatatagcgtactgtctcccaccgggggagaaaatttcaccttccagatatacaaggccgacatgacctgtcggggattccgtgagtaccacgagagactgcagaccttcctgatgtggtttatcgaaaccgcgtcttttatagacgttgacgacgaaagatggcattacttcctggtgtttgaaaaatacaataaggatggtgcaaccttgtttgccacagtaggctacatgactgtgtataactactacgtgtaccctgacaaaactagacccagggtgagccaaatgcttattctgaccccctttcagggtcaggggcacggagcacaattactggagaccgtccatcgctattacaccgaattcccaacggtgcttgacatcactgccgaggatcccagtaaatcctacgtgaaactccgtgattttgtactggtgaagctctgccaggatctgccatgcttttcccgcgaaaagctaatgcagggattcaatgaagatatggccatcgaagcacagcagaaattcaaaattaacaaacagcatgcgaggcgcgtgtacgagatcctgcgcctgctagttaccgatatgtcagatgccgagcagtaccggtcataccgactggacatcaaacggaggttgatatccccatacaagaaaaagcagagagatctggctaagatgaggaagtgccttagaccagaggaactcacgaaccagatgaatcaaatcgaaattagcatgcaacatgagcagctcgaagagtccttccaggaactggtggaggactatcgcagggtaatagaacgtctcgcacaggagtag

SEQ ID NO: 28901 - DNA, 870 bp, Artificial Sequence
  Description of Artificial Sequence: Synthetic coding sequence
atgaccgtgagcttccataagtatggggagtacttcccgggaacaggcgacctgcgagatattggtgccggaaagggcaagtattatgccgtcaactatccattgcgtgatggaattgacgatgaatcttacgaagccatcttcaagcctgtgatgtcgaaggtgatggagatgtttcagcctagcgccgtggtcttacagtgcggaagtgactccttgagcggcgaccgcctaggatgcttcaaccttacaatcaagggccatgcaaaatgtgtcgaatttgtaaaatcatttaacctgcctatgctcatgttgggcggtgggggatacacaatacgcaacgtagccagatgttggacttacgagacggcggtggccctggacaccgagatccctaacgaactaccctacaacgattactttgaatactttggaccggactttaaactgcacatcagcccatcgaatatgaccaaccagaacaccaacgaatacctggaaaagatcaagcagcggctgttcgagaatttgcgtatgttgccccatgctccaggagtgcaaatgcaagccatacccgaagacgcaatcccagaggaaagtggcgacgaagatgaggacgatcctgacaaaaggatcagcatctgctcatccgacaagcggattgcctgtgaagaagaattttctgattcagaagaggaaggagaaggcggacggaaaaatagcagtaacttcaagaaggcaaaaagagtcaagaccgaggatgagaaggagaaggatcccgaagagaaaaaggaggtgacggaggaagaaaagaccaaagaagagaaaccggaggcaaaaggagtgaaagaagaggtcaaattggcctag

SEQ ID NO: 28902 - DNA, 1449 bp, Artificial Sequence
  Description of Artificial Sequence: Synthetic coding sequence
atggcgcaaacacagggtacaaggcgcaaagtttgctattattatgatggcgacgtcggtaactactattatggccaaggacatcctatgaagccacatcggattaggatgacgcataacctgctgctgaactacggcctgtatagaaaaatggagatatatcgaccccataaagctaatgctgaagagatgaccaagtatcattcggacgattatattaaattcctgaggtctattagacccgacaatatgtctgaatactccaaacagatgcaacgtttcaatgtgggagaagattgccccgtgttcgacggattgttcgagttttgtcaattatcaacaggcggtagcgtggctagcgcagtcaaacttaataaacagcaaacggacatagctgtgaattgggccggagggctgcatcatgctaagaagtcagaggcctcaggcttttgttacgttaacgacattgtgctcgctatccttgaactgctgaaataccatcagcgcgtcctctatattgatatcgatatccaccacggggacggcgtggaagaggctttctacactacggacagggttatgactgttagctttcacaaatacggcgagtatttccctggtacgggcgaccttagggatattggtgctgggaagggcaaatactacgccgtgaactaccctttgcgtgacgggatcgacgacgagagctatgaagctatcttcaagcctgtcatgagcaaggtaatggagatgttccaaccctcagcagtggtgctgcaatgcggctcagattccctgagtggagatcgcctcggctgctttaacctgactattaaggggcatgcgaagtgtgtggagttcgtgaagtcgttcaatctgccaatgctcatgttgggcggtggtggatataccattcgtaacgtggctcggtgttggacttacgaaaccgctgtcgctcttgataccgagattcccaatgagctgccttataatgattattttgaatactttggccctgattttaaacttcacattagccccagcaatatgactaaccagaacacgaatgaatatcttgagaaaatcaaacaaaggttgtttgaaaacttgcgtatgttgccccatgccccaggtgttcagatgcaggccatcccggaggacgcaatccctgaagaatcaggcgacgaggatgaggacgacccagacaaacgcatttcaatttgtagttccgacaagcgtattgcgtgcgaggaggaattttcggactccgaggaagagggagagggcggacggaagaactcctccaatttcaaaaaagccaaaagagtaaaaactgaggatgagaaagaaaaagaccctgaggagaaaaaagaggtaaccgaagaggaaaagacaaaggaagagaagccagaggcaaagggagtgaaagaggaagtgaagctcgcttag

SEQ ID NO: 28903 - DNA, 636 bp, Artificial Sequence
  Description of Artificial Sequence: Synthetic coding sequence
atggctcaaacacagggcactcgacgcaaagtgtgttactattatgatggcgatgtgggcaattattactacggacagggccatcctatgaaaccccatcgaattcgaatgacacataaccttctactaaattacggactatacagaaagatggagatttaccgcccacacaaagccaacgctgaagagatgaccaagtaccacagcgacgactatataaaatttcttcggtctattcgacctgataacatgagtgaatactctaagcagatgcaaagatcaagtgctgtaaagctcaacaaacaacaaacagatatcgctgttaactgggccggaggactccaccacgctaaaaagagcgaagctagtggattctgttacgtgaatgacattgtgctggcgattctagagttgctgaagtatcaccaacgagtcctctacatcgacatagacatacaccatggggatggggtggaagaggccttctatacgaccgatcgcgtaatgactgtgtcctttcataagtatggagaatatttcccgggaactggtgaccttcgcgatattggcgctggtaaaggcaagtattacgcagtgaattatcctttgagggacgggatagatgatgaatcttag

SEQ ID NO: 28904 - DNA, 1044 bp, Artificial Sequence
  Description of Artificial Sequence: Synthetic coding sequence
atgcttcatacaacacagctgtatcagcacgtcccagagaccaggtggcccatagtttactcaccgagatacaacatcacctttatgggccttgaaaaactgcacccattcgacgccggtaagtggggaaaagttataaacttcctaaaggaggagaagttactgtccgattccatgctcgttgaagccagagaagcttcagaggaagatctgcttgtggttcatacccgcaggtacctgaacgaactgaaatggtcttttgctgtggctactatcacagaaatcccccctgtgattttcctgcccaattttctcgtgcagaggaaggtcctcaggcctctgcggacccagactggtgggaccatcatggctggtaaactggccgttgagcgtggatgggctattaacgtgggcggaggcttccaccactgtagctccgacaggggcggaggtttttgtgcatacgccgatattacactcgcaatcaagttcctgtttgaacgggtggagggtatttcccgcgctaccataatcgacctggacgcccaccaaggcaatggccacgagagagatttcatggatgacaagcgcgtgtacatcatggatgtttacaatcgccacatctatcctggggaccggttcgccaagcaggcaatcaggcgaaaggttgaactggagtggggtaccgaagacgatgaatatctcgacaaggtcgaacggaatataaaaaaaagcctgcaggagcacctaccagacgttgtggtctacaatgccggtactgacattctggagggggacaggcttggaggtctgtccattagcccggcaggtatcgtgaagagagatgagttggtatttcggatggtgagaggaaggagggttccgatactaatggtaactagtggcggataccagaagcggacagcacgcatcatcgcggactccattctgaacctgtttggcttgggactgatcggtccggagtcccctagcgtcagcgctcagaactcagacactcctctgctgcctcccgctgtgccgtag

SEQ ID NO: 28905 - DNA, 711 bp, Artificial Sequence
  Description of Artificial Sequence: Synthetic coding sequence
atgggccttgagaagctgcatcctttcgacgccggtaaatgggggaaagtaataaacttcttaaaagaggaaaaattgctgagtgactccatgctcgtggaggccagggaggcatccgaggaggacctcctagtggttcacactcgtagatacttaaatgagctaaaatggtcgtttgccgttgcaactattactgaaatcccccctgtcattttcctaccgaacttcctggtccaaagaaaggtcttaagacccctccggacccagactgggggaactattatgggcgtggcatctacaaccgcacccgctacagtggccggtgcctccgtgcccatgcgcacttcccgtagccctagctccttctgtttgagcgtgtggcgggcatcccctggactgccaagtctgatactgatgcccattcgggctatgggcatgtctgagaccagctggaccacaagtgtgtgcacatcttggatgagtactacggctacttctactcagggtacagccttgccgtcccgaccgtctggtggcagatggtcctggtccggagctcagcgcatgatgtctacatggataagatggcggggtacttcccggaacccgagccgctctacatgtcccacttggtggtacacaatgcaggcccctacatcgagcagaggcacagcactaggtggctgtccatcggcccagcgagccagttag

SEQ ID NO: 28906 - DNA, 960 bp, Artificial Sequence
  Description of Artificial Sequence: Synthetic coding sequence
atgggcctcgagaaactgcacccattcgatgccggtaaatggggcaaagtgatcaactttctgaaggaagagaagctgctgtcagatagcatgctcgtggaggctcgcgaagcttctgaagaagacctcctggttgtgcatactcgcaggtaccttaatgagctgaaatggtctttcgccgtagcaaccatcaccgaaatccccccagtgatcttcctgccgaactttctcgtccagcgcaaggtgttaaggccgcttagaacacaaacaggagggaccattatggcgggaaagctggccgtggagcgaggctgggccatcaatgttgggggtggttttcaccactgcagcagtgaccgtggtgggggattctgtgcttatgcagacataacccttgcaattaagttcttgtttgagcgagtggagggaatcagccgcgctacaataatcgatctcgatgcccaccagggaaatggacacgaaagggatttcatggacgacaagagggtgtacatcatggatgtatataacagacacatctatcctggggatcgcttcgccaagcaagccatacgcagaaaagtggaactcgaatggggaactgaagacgatgaatatcttgacaaagtagagcggaatattaagaagtctttacaggaacaccttccagatgttgtggtgtacaatgccggtacagacatcctcgagggggacagacttggcggactctcaataagccctgctggtattgtcaaacgagacgagttggtgtttcgtatggttcgcggacgacgcgtccccattctcatggttaccagcgggggttatcaaaaaagaaccgccaggatcatcgctgatagcatcttaaacctgttcggcttggggctaatcgggccagagtcaccaagcgtgagcgcccagaacagtgatacacctcttttacctccggctgttccctag

SEQ ID NO: 28907 - DNA, 468 bp, Artificial Sequence
  Description of Artificial Sequence: Synthetic coding sequence
atggacgacaagagagtctatattatggatgtttataacagacatatataccccggagataggtttgcgaagcaggccatccggaggaaggttgagctcgagtgggggactgaagatgacgagtatctggataaggtggagcgcaatatcaagaagtctctgcaggagcatctcccagatgtggtggtgtataatgccggaacagacatccttgaaggggaccgccttgggggactgtcaatcagtccagctggaatcgtgaaacgcgacgaactggtatttcggatggtgagagggagaagagtcccaattctgatggtcacttctgggggttatcagaagagaactgccagaatcattgccgatagcatattgaacttatttgggctcggcctgataggacctgaatctccctccgtgagcgcccagaactcagataccccactgctgccacccgctgtcccttag

SEQ ID NO: 28908 - DNA, 891 bp, Artificial Sequence
  Description of Artificial Sequence: Synthetic coding sequence
atggggcttgagaagctgcacccttttgatgctggtaaatggggaaaggtgatcaatttccttaaagaggaaaaattgctatcagattcaatgctcgtggaagcccgtgaagcaagcgaagaagacctgctggtggtgcacacgcgtcggtatctgaatgagcttaagcgaaaggttctacgaccgctgaggacacagaccggaggtacaattatggctggaaaacttgccgttgagcgtggctgggcgattaacgtcggcggaggcttccaccactgctcgtcagaccgtggcggaggtttctgcgcgtatgctgatataacgctcgccattaaattcctattcgaacgggttgaaggaattagccgcgctacgatcattgatctcgacgctcatcagggcaacgggcatgaacgagacttcatggatgacaaacgagtatatatcatggatgtgtacaaccggcatatttatccgggagataggttcgccaagcaggccattcgcagaaaagtagaactggaatggggcacggaagacgacgaatatttggacaaggtcgaaaggaacatcaaaaagagtctccaggaacacctaccggacgttgtggtgtacaatgcgggtactgacattcttgaaggcgatcgcttaggagggttgagtataagtcccgcaggcatcgtgaagcgcgacgagctggtttttagaatggttaggggaagacgcgtcccaatacttatggtgacatcgggaggttatcagaagcgaacagcacgcattattgccgattcgattttaaacctgtttgggctggggctgattgggcctgagtccccttccgtctctgctcagaatagcgacaccccccttctgccgccagcggttccctag

SEQ ID NO: 28909 - DNA, 1377 bp, Artificial Sequence
  Description of Artificial Sequence: Synthetic coding sequence
atgaaaccccacaggattagaatgacccacaatctgttactgaactatgggctgtataggaagatggagatctataggccacacaaagccactgctgaagagatgacgaaataccattcagatgagtacattaagtttctgagatccattaggccagataacatgtctgaatattctaagcagatgcagcgctttaatgtgggggaggactgcccagtgtttgacgggctctttgagttttgccaactcagcactggcggttccgtggccggtgcggtaaagctgaacagacaacaaaccgacatggcagtcaactgggctggagggctgcatcatgccaagaaaagcgaggcatccggattctgttatgtcaacgacattgtattggccatcctggagctgctgaaatatcaccagagggttctgtacattgatattgacattcatcacggtgacggcgtagaagaggctttctatacaacggaccgggtaatgaccgtctctttccacaagtacggagaatacttccccggaacgggcgacctccgcgacataggggcaggcaaggggaaatattacgcagtgaattttcccatgagagacgggatagatgacgaaagttatggacagattttcaaacctatcatctctaaggtgatggaaatgtatcagccctccgcagtcgtcctacagtgcggcgcagacagcctctccggcgaccgtctcggttgcttcaatctgacagtcaaaggacatgccaagtgcgtggaggtggtgaagaccttcaatctcccgctgctgatgctgggcggaggcggatacacgatacggaacgtagctcgttgctggacctacgaaactgcagtcgctcttgactgtgaaatccccaacgaactgccatataatgactattttgagtatttcggacctgacttcaaactccatatttccccatccaatatgactaaccagaacacacccgagtacatggagaaaataaagcaaagactctttgagaaccttaggatgctgccccatgccccaggcgtgcagatgcaggccatcccagaggacgctgtgcacgaagatagtggagatgaggatggggaggatcccgataaacgcatctccattcgggcttccgacaagcgcatcgcttgcgatgaggagtttagcgacagtgaggacgaaggtgagggtgggagacgaaacgtagccgaccacaagaaaggagccaagaaggctcggattgaagaagacaaaaaggagacagaggacaagaaaaccgacgtgaaggaagaggataagtcaaaggacaattcaggagagaaaaccgataccaagggcaccaaaagcgagcagttgtccaatccttag

SEQ ID NO: 28910 - DNA, 1749 bp, Artificial Sequence
  Description of Artificial Sequence: Synthetic coding sequence
atgcgctcccctccctgtggcctactccggtggttcggaggtccgctgctggcttcctggtgtaggtgccatctgaggttccgagcctttgggacgagcgccggatggtaccgcgcattcccagccccacctccgctacttccaccagcatgtccctccccacgggattataggcctcatgtgtccttgagcccttttcttagccggccaagccgtggagggagctcctcttctagctcatcgagacgacgctcacctgtagccgctgtggctggcgagccaatggcctattctcagggcggagggaagaagaaggtgtgttattattatgatggtgatattggcaactactattacggacaaggccatcccatgaagccccatcgaatccgcatgacacataatctcctgttgaactatggtttgtatcgaaaaatggagatttatagaccacataaagcaacggctgaagagatgaccaagtaccattccgacgagtatatcaaatttctcagatccatccggccagacaacatgagcgaatacagtaagcaaatgcaaaggtttaacgtgggagaagactgtcccgtcttcgacgggctgtttgaattttgtcagttatctaccgggggtagcgttgccggtgccgtgaagctgaacagacaacagacagacatggctgtaaattgggcagggggtttgcaccacgccaaaaagagtgaagcctcaggtttctgctatgtgaacgatatagtgcttgcgatcttggagttgttaaagtaccatcaacgcgtcttgtatatcgacatcgatattcaccacggtgacggagtggaagaggccttttacaccaccgatagggtgatgacagtttcctttcataaatacggcgagtatttcccagggactggggatctacgggacatcggtgccggtaagggcaagtactatgcagtgaattttcctatgcgggatggcatcgacgatgaatcctatggacagattttcaagcctattatttctaaagtcatggagatgtaccagccctctgctgtggttctgcagtgtggggcagatagtcttagcggcgacaggctgggttgcttcaacctgactgtgaagggccacgccaaatgtgtggaggtagtgaagacattcaaccttcctctgctgatgctcgggggtggagggtatacgataagaaatgtggccaggtgctggacctacgagacagcggtcgctctggattgtgaaatccctaacgagctgccatacaacgactattttgagtacttcggcccagacttcaagcttcatattagtcccagtaacatgacgaaccagaatactcctgagtatatggaaaagatcaaacaacggctgtttgaaaatttgaggatgctgcctcacgccccaggggtgcaaatgcaagcaatcccagaagacgctgtgcacgaggacagcggtgatgaggatggtgaggacccggacaaaagaatatcgatcagagcctccgacaagcgtatcgcctgcgatgaagaattctctgattctgaagacgaaggcgagggcggtaggagaaatgtagcggaccataaaaagggtgccaagaaggctcggattgaggaggacaagaaagagacagaagataaaaaaaccgatgttaaggaagaggacaaatcaaaggataactcaggggagaagacagatacaaaaggcactaaaagcgagcaactctccaatccctag

SEQ ID NO: 28911 - DNA, 1467 bp, Artificial Sequence
  Description of Artificial Sequence: Synthetic coding sequence
atggcttactcacaaggtggcggaaaaaagaaggtctgctactattatgacggcgatatcggtaattattactacgggcagggtcatcctatgaaaccccacaggatcagaatgactcataatctattgcttaactacggactctaccggaagatggagatctacaggccacataaggccactgcggaggaaatgacaaagtatcactccgacgagtacataaagtttctgcggagcatacgaccagacaacatgtctgaatactcaaaacagatgcagaggttcaatgtgggagaggactgccctgtgttcgatggcctgttcgagttttgtcagctgtcaactggtgggtctgtggccggtgcagtgaagctgaacagacagcagactgatatggcggtgaattgggccggagggctgcaccacgccaaaaagtcagaagcttccggcttttgttatgttaatgacattgtccttgcaatcctggagcttctgaagtaccaccagcgagtcttatatattgatatcgacattcaccacggagacggggtcgaagaggctttttatactaccgatcgtgttatgacagtgtctttccacaaatacggtgagtatttccctgggaccggtgatcttagggacatcggagccggaaaaggaaagtactacgcggtcaacttcccaatgcgggacgggatcgacgatgaatcctacggccaaatattcaaaccgatcatttccaaagtgatggaaatgtaccagccctccgcagtcgtgttacagtgtggcgcagactctctgagcggggacaggttgggctgtttcaacctaaccgtcaaggggcacgctaagtgtgttgaagttgtgaaaacctttaacttacccctgctgatgctgggcggaggaggctataccattaggaacgtggctaggtgctggacatacgagacggcggttgctctggactgcgagatcccaaacgaattgccttacaatgattattttgaatatttcgggccagattttaaactccacatctcaccttccaatatgactaaccagaacacccccgaatatatggagaagatcaaacaacggcttttcgagaatctgcgcatgctccctcacgccccaggtgttcagatgcaagccattccagaggatgcagtccacgaagattcaggcgacgaggatggtgaggatcccgacaaaaggatatctatccgcgcatccgataaaaggatcgcttgcgacgaggagtttagcgattccgaggatgaaggagagggaggcagaaggaacgtggcagatcacaagaagggtgctaagaaagccaggatcgaggaggataaaaaggaaaccgaagataagaagacggacgttaaagaagaagataaatctaaagataattcaggagaaaaaacagacactaagggaaccaaatccgagcagctgagcaacccatag

SEQ ID NO: 28912 - DNA, 1377 bp, Artificial Sequence
  Description of Artificial Sequence: Synthetic coding sequence
atgaaacctcatagaatccgtatgactcacaacctcctcctcaactacggcttatatcgcaaaatggagatttatcgtccgcataaggccactgccgaagagatgaccaaataccactccgacgagtatatcaaatttctgagatcaatcagaccagacaacatgtccgagtatagtaaacaaatgcagagatttaacgttggagaagattgtccggtgttcgatggcctgttcgaattttgccagctgtcgactgggggtagtgtggctggagcggtgaaactgaaccggcagcaaaccgacatggccgtgaactgggccggtggtctgcaccatgccaaaaagagtgaggcctcgggcttctgctacgtgaacgacatagtgctggctatcctggagctgttgaaataccatcaaagggtgctgtacattgatatcgatattcaccacggcgacggggtcgaggaagctttttacacgacggatcgtgtaatgactgtgtcatttcataagtatggcgaatactttcctggaacaggagacttgcgcgacatcggggctgggaagggcaaatactacgccgtcaattttcctatgcgtgatggcatagacgacgaatcatacggtcaaattttcaaacccattatctccaaagtgatggagatgtatcagccaagtgccgttgtgctgcagtgtggcgcagattctctctctggagacagactaggctgttttaacctgaccgtgaaaggccatgctaaatgcgtcgaggtcgttaaaaccttcaacctgccattactcatgctcggagggggaggctataccatccggaacgtggcccgatgttggacgtatgagactgcagttgctttagactgcgagattcccaatgagttgccatacaatgactactttgagtactttggtccagactttaagttacatatttcgccctccaacatgacaaaccagaatacacctgaatacatggaaaagatcaagcagagattatttgaaaatctgagaatgctcccacacgcccctggggttcaaatgcaggctattccagaggacgccgttcacgaagatagcggagacgaagacggcgaagatcctgataagagaattagtattagggcatcggataaaaggattgcttgcgatgaggaattttccgacagcgaggatgaaggggaagggggtcgcagaaacgtggccgatcataagaaaggagctaagaaagccaggatagaagaggacaagaaggaaacagaagataaaaagactgatgtgaaagaggaagacaaatccaaagataactccggcgagaagacagacaccaagggaacgaaatcagaacagctgtctaacccctag

SEQ ID NO: 28913 - DNA, 1287 bp, Artificial Sequence
  Description of Artificial Sequence: Synthetic coding sequence
atggctaaaactgttgcgtacttttatgaccctgacgtgggtaacttccactacggggcagggcaccccatgaagcctcaccggttagcacttacccattctctcgtattacactacggactttataagaagatgatcgtgtttaagccttatcaggcaagccagcatgacatgtgtcggttccacagcgaagattatatagattttctccagcgggtaagtccaaccaacatgcaggggtttaccaagtctctgaacgccttcaacgtcggcgacgattgcccagttttccctggactgttcgagttctgctcaaggtacactggtgcctcactgcaaggtgcaacccagctgaacaacaaaatttgcgatattgccatcaattgggccggagggctgcaccatgccaagaagtttgaggcatctggattttgctacgtgaatgacatcgtcattggtatcttggagcttctcaagtaccacccacgcgtcctttacatcgacattgatatccaccatggggatggagttcaggaggctttttatctgacagaccgcgtgatgacagtgtcctttcacaaatacggcaactacttcttcccaggcaccggggacatgtacgaggtcggcgctgagtcaggtcgctattactgccttaatgttccgttgcgcgacggaatcgatgatcagagctacaagcacctttttcagcccgtaatcaatcaagtggtggacttttatcagccaacctgcattgttcttcaatgcggtgctgattcgctcggttgcgatcgccttggatgcttcaatctgtccatcaggggccatggcgaatgtgtggaatatgttaagtcctttaatattccactgctggtcttgggaggcggtgggtatacagtgaggaatgttgcccgatgctggacctacgagacctctcttcttgtggaagaggctatttccgaggaactgccatacagcgagtatttcgagtatttcgcccctgattttacgctgcaccctgatgtgagcaccaggattgagaaccagaattctcgtcagtacctggaccagatacgacagacgatatttgagaacctgaaaatgctgaaccatgcgccttccgtccaaatccatgatgttcccgcagatctgttgacctatgacaggaccgacgaggcagatgccgaagagcgaggaccagaggaaaattacagtaggcccgaggctcccaatgaattctacgatggggatcatgataatgacaaggagagcgacgtcgagatttag

SEQ ID NO: 28914 - DNA, 3255 bp, Artificial Sequence
  Description of Artificial Sequence: Synthetic coding sequence
atgtcttcccagtcgcaccctgatgggctgtccggaagagatcaacctgtggagctcctgaatcctgctagggtcaaccacatgccctccacagtggacgtcgcaaccgctctgccgctccaggtggctccgtctgcggttccaatggatctcaggttggaccaccagtttagccttcccgttgccgaaccagctctcagagaacagcagttgcagcaagagctgttagccctaaaacagaaacagcagattcagagacaaatcctgatcgccgaatttcagcgtcagcatgagcagctctcccgccaacacgaggcccaactccatgaacatattaaacagcagcaggaaatgctggcgatgaagcatcagcaggaactgctggagcaccaacgcaaactggagaggcatcgacaggagcaagagttagagaaacagcaccgagagcagaaactccagcagctcaagaataaggagaaggggaaggagtcagctgtagcctcaacggaagtcaaaatgaaattgcaggagtttgtgctcaataaaaagaaggctctggcgcacagaaatctcaaccactgtatatccagcgacccaaggtattggtacggtaaaacacagcactcctcgctagaccagtcaagtccccctcaaagcggcgtaagtacctcctacaaccaccccgtgctaggcatgtacgatgcaaaggacgattttccactccggaaaacagcaagcgaaccaaatctgaaactgcgcagtagacttaaacagaaagtggctgagaggagaagttccccgctgctccgcaggaaagacggtccagtggtgacagctctcaaaaaaagaccgttggacgttaccgactctgcatgctcatctgccccagggagcggcccaagctctcctaacaactcaagcggctccgtgtccgccgagaacggaattgctccagccgtcccgtctatcccagccgagacgagcttggcccaccgtttggtggcccgagagggaagtgcggcacccctgcctttatataccagcccttctcttcctaacatcacgcttggtctgccagccaccggaccctccgctggtacagccggtcagcaagatgcagaaaggctgacgttacctgcactacagcagcggctgagcctgttccccggaacccacctcaccccctatttaagcacaagccctcttgagagagacggtggcgctgcgcactcccctctgctacagcatatggttctcctggagcagcctcctgctcaggcaccacttgttaccgggctgggcgcactccccctgcatgctcagagccttgttggggcagaccgtgtaagcccgagcatccacaaactaagacagcacaggccactgggtcggactcagtctgccccactgccacagaatgcacaagctctgcagcacttggttattcagcaacagcatcagcagtttctggagaagcataaacagcagtttcaacagcaacaactgcagatgaataaaattatccccaagccctctgaacccgctaggcagcctgagagccatcctgaggaaacagaagaagagctgagagagcaccaggccctgctggatgaaccttatcttgacagactcccgggacagaaggaagcgcatgctcaggccggtgttcaggtgaagcaggaacccatcgaatccgacgaggaggaagcggaaccccctagagaggtggagccaggccagcggcagccctctgagcaagagctgctcttccgacagcaggcactgctgttggaacagcaacggatacaccagttaaggaactatcaggcatccatggaggccgctggcatccctgtaagtttcggcggacacagaccactcagtcgtgcacagagttcgccagcgagcgcaacatttccagtcagtgttcaggagcctccaacaaagcctcgtttcactaccggcctggtctatgacactctcatgctgaaacaccagtgtacatgcggctcaagcagctctcatccggaacatgcaggaagaattcagagcatttggtctcgcttgcaggagaccgggctgagagggaagtgcgagtgtattaggggacgcaaggctacattagaggaacttcaaactgtccacagtgaggcccataccttgctgtacggcactaatcccttgaaccggcagaagctggactcaaaaaagctgctgggtagtctggcgagcgtatttgttcgtcttccatgcgggggagtgggagtagattctgacaccatctggaacgaagtacacagtgcaggcgctgcccgactggccgtggggtgtgtcgtcgagttagtgttcaaggtggcaaccggtgagctgaaaaatggcttcgctgtggtcaggcccccaggccatcatgccgaggagtccactcctatggggttctgttacttcaatagcgtggccgttgccgctaaactcctgcagcagcgtctgtccgtgtccaaaatcctgatcgtggattgggacgttcaccacgggaacgggacccagcaggctttctattccgatccaagcgtgctttacatgagccttcaccggtatgacgatgggaatttcttccccggaagcggcgcaccagatgaggtcggcacgggccctggggttggatttaatgtaaacatggccttcaccgggggtttagaccccccaatgggggatgccgagtatttagccgcattccgcacagtagtgatgcctattgcttccgagttcgccccagatgtcgtgctagtgtcttccggctttgatgcagtagaggggcacccgacccctctggggggttataatctcagtgcccgttgttttggctacctgaccaagcagctgatggggctggctggcggtcgcatcgtgctcgctttggagggaggtcacgacctgactgctatctgtgacgcgagcgaggcctgcgtgtccgcattgctgggcaacgagctggatcctttaccagagaaggttttacaacagcggcctaacgccaatgccgtccgatctatggagaaggtgatggagatccatagtaagtactggagatgtcttcagcgcaccacaagcacagctggcagaagtctgattgaggctcaaacatgtgaaaacgaggaagccgaaacggtgacagccatggcctcactctccgtcggcgtcaagcccgcagagaaacgccctgacgaagagcctatggaggaggagcctccgctttag

SEQ ID NO: 28915 - DNA, 1941 bp, Artificial Sequence
  Description of Artificial Sequence: Synthetic coding sequence
atgcttgctatgaagcaccagcaggagctgcttgaacaccagagaaagctggagcgccatagacaggagcaagaactggagaaacagcacagagagcagaagctgcagcagcttaagaataaggaaaagggaaaggaaagcgcggtggcatcaaccgaggtgaagatgaaactgcaggagttcgtattaaacaagaaaaaggccctagcccacagaaatctgaatcattgcatttcttctgatcccaggtactggtacggcaaaacccagcactcttcactggaccagagttctccaccccaatctggcgttagcacctcctacaaccaccccgtcttgggaatgtacgatgctaaggatgacttcccattgcgcaagacagcttccgagcctaatctgaaactgcggagccgacttaagcagaaggtggcggaacgcagaagttcccccctgttgaggcgcaaagacggccctgtggtgaccgccctgaagaagaggcccctggatgtgacggactctgcttgctcttctgcaccagggtctggtccatcttctcctaacaatagtagtggctccgtgagcgccgagaacggcattgcacctgctgtcccctccattcccgctgagacaagcttagctcaccgcctggtcgcccgagaaggtagtgccgctcccctccctctgtatacctccccatcccttcctaacattacgctgggcctgcctgctacaggtccctccgccggtacagccggtcagcaagacgctgagcggctgacgttgcccgcactgcaacaacgcctttctctgttccccggaactcatctgactccgtatctgtcaacctccccccttgagcgtgacgggggtgctgcccattcaccactcctccagcacatggtgctgctcgagcagccaccggcacaggccccactcgtgaccggactcggtgcactgccactccatgcacagtccctggtcggagccgatagggtttctccatcgattcacaagctgcgccagcaccggccacttgggaggacacagtccgctccgctgcctcagaacgcacaggccctgcaacacctggtgatacagcaacagcaccagcagttcctggaaaaacataaacagcagtttcagcagcagcagctgcagatgaacaagatcataccgaagccctctgaaccggcaagacaaccggagtcacacccagaagaaactgaagaggaactacgtgaacaccaggcgctgcttgatgagccttacctggatcggctgcctggtcagaaggaggcacatgcacaggccggagtgcaggtaaagcaggagcccatcgagtctgacgaagaggaagccgagccccctcgggaagtggagcctggacagcggcaaccctccgaacaggagctgctcttcaggcagcaggccttgctgctggagcagcagcgcatccaccagttgcgaaactatcaggccagcatggaggccgcaggaattccagtgtctttcggcggacaccgccctctctcgagggcccagtcctcacccgcatcggctactttcccagtgtcagttcaggagcccccaacgaagcccaggtttaccacaggtctcgtctacgataccctaatgctcaaacaccaatgcacatgcggctcatcaagcagtcatccagaacacgctggtaggatacagagcatatggtcccgactgcaagagacaggactccggggtaagtgtgaatgtatccgaggacgcaaggcaacattggaagagctccagacagtgcactcggaagcacacaccctcctatacggtacaaaccccttgaatagacagaaactggatagtaagaagctgttgggctccctggcttccgtcttcgtgcgcctgccttgtggaggggttggggttagtgtccctttgatgtgtaaatag

SEQ ID NO: 28916 - DNA, 2919 bp, Artificial Sequence
  Description of Artificial Sequence: Synthetic coding sequence
atgctggcaatgaagcaccaacaggaattgctggaacatcagcgaaagctggaaaggcaccgtcaagagcaagaattggagaaacagcacagggagcaaaagctccagcagctcaaaaacaaggaaaaaggtaaagagtctgcagtggcaagtaccgaggttaaaatgaagcttcaggagtttgttcttaataaaaagaaagcactggctcacaggaatctaaatcactgtatctcgtccgacccaaggtattggtacggaaaaacccagcactccagcctagaccagagctcgccgcctcaatctggcgtgtctacttcttataatcaccccgttctgggcatgtacgatgccaaggacgacttcccattgcgcaagacagcctccgagccaaacctaaaactccgctctagattaaaacaaaaagtggccgagcggaggtcgtccccactgcttcggaggaaggatgggccagtagtgaccgcactgaagaaacgcccattggatgttaccgatagtgcatgtagctccgcgccaggaagcggtccctcctcgccaaataattctagtggcagcgtgtctgctgagaacggaatcgcccctgccgttccatcaatcccagcagaaacctcccttgcgcaccggctcgttgctcgagagggaagcgctgcacctttgcccttgtacacaagcccctctttgcccaacataacgctcggactccctgccacaggaccatcggccggtacagccggtcagcaggatgccgaaaggttgactctccccgcactccagcagcggcttagtttgtttccaggcacccacctgactccttacttgagtacaagtccgctcgagcgcgacggaggagctgcccattcacctctgttgcagcacatggtgctgctcgagcagcctccagctcaggctccgctcgtgacggattggtatttgagcggcttgggagccctcccgctgcacgcccagtccttggtgggcgcagacagggtttctccgtctattcataagctgcggcagcatagacccctgggacgaacacaatccgcacctcttccccagaacgctcaggccttgcagcacctggtcattcagcaacagcaccaacagtttctggagaagcataagcagcagttccagcagcaacagctgcagatgaataagattatcccaaagcctagcgaacctgctcggcagcccgaaagccaccccgaggaaactgaggaggaactgcgggagcatcaggctctcctggacgaaccttatctcgacaggttgcccggacagaaggaagcacatgcgcaggccggagttcaagttaagcaggaacccatagaaagcgatgaagaggaagctgagcctccacgtgaagtcgagcccggtcagcgacaaccctcagagcaggagctgttgtttcgccaacaggcactgctgttggagcagcaaaggatccatcagctgcgtaactatcaagcctcaatggaagctgctggcatcccagttagtttcggcggacaccggccactgtctcgggcacagtcgagtccagctagcgctacgtttccagtgagtgtgcaggaaccccctacaaagccccgttttactaccggtttagtgtacgacacactcatgctgaagcatcaatgcacttgtggatcgtcatcctcacaccctgagcacgctggaagaatccagtcaatatggtcacggctgcaggaaaccggcttgagaggcaagtgcgagtgtattcgcggtagaaaggcgaccttggaggagctccagactgtacatagtgaggcacacacattgctgtacggcacaaacccactgaacagacaaaagctggatagcaagaaacttctagggtccttggccagtgtatttgtccgactgccttgcggaggagtcggtgtggatagtgacactatttggaacgaggtccacagtgcaggcgctgccaggctagccgttggatgtgtggttgaactggtgtttaaggtcgccacgggggagttaaaaaacggcttcgccgtggtgcgccctccaggtcaccacgcggaagagtcaacccctatgggtttttgctactttaattccgtcgctgtggcagctaaactcttgcaacaacgcctgagcgttagtaagatcctgatcgtcgactgggatgtccaccacggtaacggaacacagcaggcattctactctgaccccagtgttctgtacatgtctttacatagatacgacgacggcaacttctttcccggtagtggggctcccgatgaggtaggcactggcccaggcgtgggttttaacgtgaacatggcattcacaggtggccttgaccctcccatgggcgatgccgaatacctggctgcctttaggaccgtagtgatgccaattgcctccgagtttgcgccagatgtggtgctggtgagctcaggcttcgacgcagtcgagggacatccaactccactgggtggctacaacctgagtgcaaggtgcttcgggtacttgacgaaacagcttatggggctggcgggaggtagaatagtattggctcttgaaggcggtcacgaccttactgctatctgcgacgcttctgaggcttgcgtctctgccttgctcggaaatgagcttgatcccctgcccgagaaggtcctgcagcagaggccgaacgccaatgcggtgaggtccatggagaaggtgatggagatacattctaaatactggcgttgtttacagaggactaccagcaccgccggtcgatctctcatcgaggcccaaacatgtgaaaatgaagaggcagaaacagtgactgctatggcgtccctttctgttggagtcaaacccgcagagaaacgccctgatgaagagccaatggaagaagagcctccactctag

SEQ ID NO: 28917 - DNA, 2214 bp, Artificial Sequence
  Description of Artificial Sequence: Synthetic coding sequence
atggacgttgccaccgctctgcccctccaagtcgccccttccgccgtccccatggacctgaggctggatcaccaattttctcttcccgtggcagagcctgctttgcgcgaacagcaattgcagcaggagttattggcactgaaacaaaaacagcagatccaaagacaaatcctcattgcggaatttcagcggcagcatgaacagctgtcaagacagcacgaggcccagctgcacgagcatatcaagcagcaacaagaaatgctcgccatgaagcaccaacaggagcttttggagcatcagaggaaacttgagaggcacagacaggagcaagagttggagaagcagcatagggagcagaaactccagcaattgaagaataaggagaagggcaaggagagtgccgtggcatcaacggaagtgaagatgaaactccaggaatttgtgctgaacaagaagaaagccctggcccatcgcaacctgaatcactgtattagttcggatccaaggtattggtatggaaaaactcagcatagttcgctcgaccaaagttctccgccacagtccggagtttccaccagttacaaccaccccgttttaggcatgtatgatgccaaggacgatttcccattgaggaaaactgcctccgaacctaacctgaaactgagatcccgtctgaagcagaaggtggctgagcgaaggtcatcacccctcctgaggcggaaggacggtcctgtggtgactgccctcaagaaaagacccttagatgtcactgattccgcctgttcttctgcacctggtagtggacctagtagccctaacaattcgtcaggctctgtcagtgcggagaatgggatcgccccagccgtgccaagcattcctgcagaaacctctctggcacataggctcgtcgcccgagaggggagcgcagcccctttgccactctataccagccctagtctgccgaatattaccctgggcctccctgccacaggtccttcagccggaactgccggacagcaagacgcagaaagactgaccctgccagctctccaacagaggctgagcctctttcctggaacgcatctgacgccatatctaagtactagtcccctagagcgggacggcggagcagcccactccccactgttacagcacatggtccttctggaacagcctcccgctcaggcaccactcgtgaccgattggtatttgagcggtttgggcgcactgccgctgcatgcccaatcgctagtcggggcagaccgtgtgagtccgtcaatccataaacttcgccagcataggcccctgggcagaacccagagtgccccactgccccaaaatgcccaggcactacagcacctagtgatacagcagcagcaccagcagttcctcgaaaagcataaacaacagtttcagcaacagcaactgcagatgaacaaaattataccgaagccctcagagccagcgaggcaacccgagtcccaccctgaagagaccgaagaggaattgagggagcaccaggccctcctagatgagccctatctagaccggctgcccggacagaaggaagcccacgctcaggcaggagtgcaggtgaagcaggagccaatagagtcggatgaagaagaggcggagcctcccagagaggtggagcctggacagcgtcagcccagtgaacaagagctactctttcggcagcaagcgctgctgcttgagcagcagcgaatccaccagttgcggaattatcaagcttccatggaagccgctggcatacctgtgagcttcggcggtcacagacccctgtctagagcacagagcagccccgctagcgccaccttcccagtatcagtccaggagcccccaacgaagcctcggttcaccaccggattggtgtacgacactttaatgcttaaacatcagtgcacatgcggctcatcaagctcccacccggaacatgccggacgcatacaatccatatggtcacggctgcaggagaccggattacgcggtaagtgcgaatgcattagaggcagaaaagccacgctcgaggaattacaaactgtacattcggaggcccataccctgttgtacggaacaaatcctctaaatcgacagaaactggacagcaagaaattgctgggaagcttagcgtccgtgttcgtgagattgccttgtggcggagttggggtctctgtgcctctgatgtgcaagtag

SEQ ID NO: 28918 - DNA, 2007 bp, Artificial Sequence
  Description of Artificial Sequence: Synthetic coding sequence
atggtgctccttgaacagcctccagcccaggcaccactggtcactggcttaggggctctgccgttacacgcccagagtctcgtcggtgctgatagagtgtctcctagtattcacaagcttaggcagcaccgacctctcggtagaacacagtctgccccactcccccagaacgcccaagcgctgcagcaccttgttatccagcaacaacaccaacagttcctcgagaagcataagcaacaattccagcaacagcaactccagatgaacaagatcattccaaagccgagcgaacccgcacgacagcccgaatcccacccagaagaaactgaggaagagctccgcgaacatcaggcattgttggacgagccctatctagacaggctccccggtcagaaggaagcacacgcacaagcaggggttcaggtgaagcaggaacccatcgagagcgacgaagaagaggccgagcccccacgtgaggtggagcctgggcagcgccagccctcagagcaggagctcctgttcagacagcaagccctacttctggagcagcaacgcatccatcagctgaggaactatcaggcatccatggaagcagctggtatccccgtttcattcggcggacataggcccctgtctcgcgctcagtcctcacccgctagcgcgactttcccagtctcagttcaggagccaccgaccaagccgcgatttacgactggcctcgtttacgacactctgatgctgaagcatcagtgcacctgcggtagctcaagctctcaccccgagcatgctggacgcatacagagtatttggtcccgtctccaggagaccggactgcgcggaaaatgcgaatgtattcgcggaagaaaggccaccctggaagaattacaaacagtgcactctgaagcccatacactcttgtacgggacaaacccactgaacagacaaaagcttgatagtaagaaactgttgggaagtcttgcaagcgtgttcgtgcgtctgccctgtggtggtgtcggggtggattccgacaccatatggaatgaggtgcatagcgcgggagccgcaaggctcgccgtgggctgtgtggtggaattagtattcaaagtcgccactggcgagctaaagaacggattcgccgtggttcgtccacctggacatcacgcagaagagtcaaccccaatgggcttctgctactttaactctgtcgccgtcgccgctaaactgctgcagcaaaggctgagtgtgagcaaaattcttatcgtcgactgggacgtgcaccacggaaatggcactcaacaagctttttactctgatccttccgtcctgtatatgagcctgcaccggtacgatgacggcaacttcttccccggttcaggggctcccgatgaggttggcacagggcctggggtggggtttaatgtgaacatggctttcacaggcggattggatccaccgatgggtgatgcagaatacctggcagcatttaggaccgtggtgatgccaattgcaagcgaattcgctcctgacgtcgtgctagtctcctctggttttgatgctgtggaggggcatcctacacccctggggggttataatctgagcgctaggtgtttcggctacctcacaaagcaacttatgggactggctggaggaagaattgtgttggcactggaggggggtcacgacctcactgcaatctgcgacgcatcagaggcttgcgtgagcgccctgctggggaatgaactcgatcctctgcccgaaaaggtactgcagcagcgaccaaatgcaaatgctgtcagaagcatggaaaaggtcatggaaattcatagtaaatattggaggtgtctccagagaaccacatccacagcgggaagatctctgattgaggcacaaacgtgtgaaaatgaggaggccgaaactgtaaccgccatggcaagtctaagtgttggggtgaaacccgctgagaagaggcctgatgaggagcctatggaggaggaacctccactgtag

SEQ ID NO: 28919 - DNA, 90 bp, Artificial Sequence
  Description of Artificial Sequence: Synthetic coding sequence
atgtcttctcagagccacccagacggcttgagcggccgtgatcagcccgtggaattgctgaacccagccagagtgaatcacatgccttag

SEQ ID NO: 28920 - DNA, 3648 bp, Artificial Sequence
  Description of Artificial Sequence: Synthetic coding sequence
atgacctcgacgggacaggattccactactacccgtcaacgacgtagtaggcagaatccgcagtcgccaccgcaggactcttctgtaacctctaaaaggaatatcaagaaaggagcagttcccaggagcatcccaaacttggcagaggtaaagaagaaaggcaaaatgaaaaaactcggtcaggccatggaagaggacctgattgtcggcctgcaaggcatggatctgaatctggaagccgaagcccttgcgggtactggcctggtgctcgatgagcaactgaacgaattccattgtttatgggacgatagtttcccagaggggcctgagcgtctgcatgctatcaaggagcagctcatacaagagggcttgcttgataggtgcgtcagctttcaggcaaggtttgctgagaaagaagagctgatgctggtgcactccttagaatatattgatcttatggagactacccagtacatgaatgagggtgagttgagggttctggccgacacttatgattcagtgtatctgcacccgaacagttactcatgtgcctgcctcgctagcggcagcgtgctgcggctggtggatgcagttctgggcgcagaaatccgcaacggtatggccattatacggcctccagggcaccacgctcagcatagcctcatggacggatactgtatgtttaatcatgtggcggtggctgctaggtacgcacaacagaagcacagaatcaggcgcgtgctcatcgtcgactgggacgtacaccatggccagggaacccagtttacattcgaccaggatccgagcgtcctgtacttctctatccaccgttatgagcaggggaggttctggccccacctcaaggccagtaattggtctaccacgggcttcggccagggccaagggtacacgatcaacgtgccgtggaaccaggtgggtatgagggacgcagattacattgccgcttttctgcacgtgctcctacccgtggccttggaattccagccacagcttgtgctggtggccgctgggtttgacgcactgcagggcgatccaaagggagaaatggcagcgactcctgccggatttgctcagttgactcacctgctgatggggctcgccggagggaaattgattctcagtcttgaaggtgggtataacttgcgtgcccttgctgagggcgtcagtgccagtctgcacacccttctgggtgacccttgccccatgcttgagtcaccgggagcgccttgtcgatctgctcaggccagcgtgtcctgcgcgttagaagccttggaacccttctgggaagtgctggtacgatccaccgagaccgtggagcgggataacatggaagaagacaacgtcgaagagtcggaggaagaaggcccttgggagccacccgtacttccaatccttacctggcccgttcttcagtctagaaccggcctggtgtacgaccagaacatgatgaatcattgtaatctctgggattcacaccacccagaggtgccccagcgaattctgaggatcatgtgcaggttggaggagctgggtttggccggtcgctgcctgacactaacccccagacctgctaccgaagccgaattgctgacatgtcacagcgcagaatatgtgggccacctccgagcaaccgagaagatgaaaaccagggagctgcaccgggaatcaagcaattttgattccatttatatctgtccgtcaaccttcgcgtgcgcacaactcgcaaccggggcagcctgccgcctggttgaagctgttctaagcggggaggtgctcaacggggcagcagtggtccggccaccgggacaccatgccgaacaggatgcagcctgcggattttgcttttttaactctgtggccgtggccgcacgtcacgcccagacaatcagtggacacgctctgagaatcttaatcgttgattgggatgttcatcatggtaacggaacacagcatatgtttgaggacgatccctctgtcctttacgtttccctgcacagatacgatcacgggaccttctttcccatgggtgacgagggcgcttcttcccagattggacgcgctgccggaaccggatttacagtcaatgttgcatggaacggcccacgaatgggtgacgctgattacctcgccgcatggcatcgactggttctgcccatcgcttacgaatttaaccctgaattggtcctggtgagcgccggattcgacgccgctcggggagacccgctcggagggtgccaggtgtctcccgaaggttatgcacacctgactcatctcctgatgggactcgcgtcagggaggatcattctcattctggaaggtggctacaatttgacctcaattagcgaaagcatggctgcttgtaccaggagccttctgggcgaccccccaccgcttttgacgctgccccgacccccactctccggcgctctcgccagtattacagaaacgattcaagtgcaccggaggtattggcgctcgctcagagttatgaaggttgaggatcgcgagggcccttctagctccaaactggtcaccaagaaggctccccagcctgcaaagcctcgccttgcggaaaggatgactacccgggaaaagaaggttctcgaggccggaatgggtaaggtcacttctgcctccttcggtgaggagtccaccccaggccaaactaatagtgagaccgcagtcgtggcactgacgcaggaccagccttctgaggcagcgaccggcggtgcaaccttggctcaaactatttctgaggctgcaatcggtggcgcaatgctggggcagactacctctgaagaggcggttgggggagccactcctgaccagactacaagcgaagagactgtgggtggagccattctggaccagaccacatcggaggatgcagtcgggggagctacgctggggcagacaacctccgaagaggcagtcgggggagctaccctggcacagaccactagtgaggccgctatggagggtgcaacactggatcagaccacctccgaggaggcacctggcggtacagaacttatacagacccccctcgcctctagcactgaccaccagacgcctcctacgagcccagttcaggggactacaccacaaatcagtccttccaccttaatcggcagtctgagaactctggaattaggcagcgagtcacaaggggcttcagaatcgcaggcaccaggggaggagaatctactcggagaggctgcaggcggacaggacatggccgattcaatgctgatgcagggcagccgtgggttgaccgaccaggccattttttacgccgttaccccgcttccatggtgtccgcacctggtcgccgtatgccccattccggctgccggtctggatgtaacccagccttgcggagactgcggtaccatccaagagaactgggtgtgtctttcttgctaccaggtctattgtggtagatatatcaacggacacatgctgcaacatcacggcaacagcggccatcctcttgtgcttagctacatcgatttgagcgcatggtgctattactgtcaggcctatgttcaccaccaggcactgctggacgtgaaaaatatcgcccatcagaataaatttggtgaagacatgccgcatcctcattag

SEQ ID NO: 28921 - DNA, 633 bp, Artificial Sequence
  Description of Artificial Sequence: Synthetic coding sequence
atgacttcaactggccaggattcaacaaccacaaggcaacgaaggtcacgccagaacccacagtctccgccacaggattctagcgtcacttccaaacgtaatatcaaaaagggcgcagtgcctaggagtatcccgaatctcgccgaagtgaagaagaagggcaagatgaaaaagctgggccaggccatggaagaagatcttattgtaggcctgcaaggaatggaccttaacctcgaggctgaggcgctggcgggtaccggactggtcctcgacgaacaactgaacgaatttcattgtttgtgggacgattcctttcccgaaggcccagaaagactgcatgctatcaaggaacagctgattcaggaggggttgctggatcgctgcgtcagcttccaggcccgattcgctgagaaggaagaactaatgctggtgcatagcctggagtacatagacctcatggagactacacaatacatgaacgaaggggagttgagagttctggccgacacctacgactcagtttatctgcacccaaacagctactcgtgcgcttgtctggctagtggatcagtcctgcggctcgtggatgccgttctaggggcagagatacggaatggtatggcaatcatatag

SEQ ID NO: 28922 - DNA, 3648 bp, Artificial Sequence
  Description of Artificial Sequence: Synthetic coding sequence
atgaccagcaccggtcaggacagtaccactacgcgtcaacggagatcaaggcagaatccacagtcccccccacaggactccagtgtgacttctaagaggaacattaagaaaggcgcagttccaaggtcaatccccaacctggcagaggtgaaaaaaaagggaaagatgaaaaagttgggtcaggcaatggaagaggatctgattgtgggcctgcaagggatggacctgaatctggaggcggaagccctggctggcaccggcctggttctagacgagcagctgaacgagtttcactgtctgtgggacgatagctttccagaaggtcctgaaagacttcatgcaataaaagagcagctgatccaagaaggtctcctcgaccgctgtgttagctttcaggcacgatttgccgaaaaagaagaactgatgttagttcacagcctggaatatatcgatcttatggagacaacgcagtacatgaatgagggcgaactacgcgttcttgccgacacctatgattccgtttatctgcatcccaattcctatagttgcgcctgtctggcgtccggatccgttctgagattggtggacgcagtattgggcgcagagatacgtaacggcatggcgatcattagaccgcctggtcatcacgcccagcattccttgatggatggatactgcatgtttaatcacgtggccgtcgctgctcggtatgcacagcagaagcaccggatcagacgggtcctgatcgtagactgggacgtccaccacggacaggggacacagtttacattcgaccaggatccttcagtcttgtacttctccattcataggtacgaacaaggaaggttctggccccatctgaaggcctccaactggagtaccaccggtttcgggcagggtcagggctacaccataaatgtgccctggaaccaggtgggcatgagggacgccgactacatagccgctttcttgcacgtgctactccctgtagccctcgagtttcaaccacagctggtcttggtagccgctggcttcgacgccctccaaggagatcccaagggcgaaatggcagccacgcccgcagggttcgctcaactgacacaccttttaatggggctggcgggaggcaagctgattctttctctggagggcggttacaatcttcgcgcactagcagaaggagtgtcagcgtcactccacacattgctgggcgatccttgtcccatgttagaatcacccggagcgccatgtaggagcgcacaggctagcgttagctgtgccctggaggccttagagccattttgggaggtccttgtgaggagtacggaaactgtggagagagacaacatggaggaggacaacgtggaggagtctgaagaggaagggccatgggagccacctgtactgcctatattgacctggcctgttctgcagagcaggacaggtttagtctacgatcagaatatgatgaatcactgtaatctctgggactcccaccaccccgaggttccgcaaaggatacttaggatcatgtgccgcctcgaagaactggggctcgctggacggtgtttaacccttactccgcgacccgcaactgaagctgagttgctcacctgccactcagcagagtatgtcggtcatctacgtgccactgagaagatgaagactagagagctgcatagagagtctagcaacttcgactccatttacatctgcccctcgacgttcgcctgcgctcaactggccaccggagccgcatgcaggctagtggaggctgtgctttcaggggaagtgctaaatggcgctgccgttgtccggccacccggtcaccacgcagaacaggatgctgcctgtgggttttgcttttttaatagtgtcgccgtcgccgctcgacatgctcagactatctctggccatgccttacgaattcttatcgtggactgggacgtccaccatggtaatggcactcagcacatgttcgaggacgacccttccgtgctttacgtgtccctccatagatatgaccacgggacttttttcccaatgggcgatgagggcgcaagctcacaaataggcagggctgcgggaaccgggttcacagtgaacgtagcctggaatgggccacgtatgggggatgcggactacctggctgcctggcataggctggtgctgccgattgcatacgagtttaatcccgagcttgtccttgtcagcgcaggattcgacgcagcgaggggtgacccccttggcggttgccaggtgagccctgaaggctacgcccatttgacacatctcctgatgggcctggcctccggcaggataatcctgatccttgaagggggatacaacctaacttcaatctcggaaagtatggctgcttgcaccaggtcccttctgggggatcccccaccattactgaccctgcctcgcccaccactatccggtgcattagcatccattacagagacaattcaagtccaccggagatactggagatcactgcgcgtcatgaaggtagaggatcgagaggggccatcatcctccaagctcgtgacaaaaaaggccccacagcctgccaaaccaagactcgcagagagaatgaccacacgtgagaagaaggtgctggaagccggtatgggtaaggttacctctgcaagttttggagaggagtccacccctggacaaaccaatagcgaaaccgccgtggtcgccctcacccaggaccagccctcggaggctgctaccgggggagccaccctagctcagacgatctccgaagcagccatcggaggtgccatgctcggacaaacgaccagcgaagaagccgtcggcggagctacccccgaccagaccacaagcgaggagacagttgggggtgcgatactcgaccagacgacttcagaggatgctgttggtggggctaccttgggtcagacgacctcagaggaagcagttggaggagctacattggcgcagaccacatctgaggctgccatggagggcgctacccttgaccaaactacatctgaagaagcaccaggcggaacggaattaattcaaacaccccttgcaagtagcacagaccatcagactcctcctacctcacccgtccagggcactacgccccagatctcaccttctacattgataggttctttgcggaccctagagctgggatcagaatcccagggcgcaagtgaatctcaggctcctggggaggaaaatcttctgggagaggccgcaggtggacaggacatggccgactccatgcttatgcagggcagccgagggctgactgaccaggccatcttttacgccgtcacccccctgccatggtgccctcatctagttgccgtgtgcccaattccagctgctgggcttgacgttacccagccatgcggcgactgcggtaccatacaagagaactgggtgtgcctgtcttgctatcaggtgtactgcggacgttatatcaacggccacatgcttcaacaccacggcaactctggtcatccactagtattatcttacatcgatctcagcgcctggtgttactattgccaagcttacgtacaccaccaagcactgctagatgtgaaaaacattgcccaccagaataaatttggagaagatatgccacatccgcactag

SEQ ID NO: 28923 - DNA, 633 bp, Artificial Sequence
  Description of Artificial Sequence: Synthetic coding sequence
atgacgagcactggtcaggactctactaccacgagacagagacgatcccggcagaatcctcaaagtccgccacaggattccagtgtcacaagcaagcggaatatcaaaaagggcgctgtgcctcggtccatccctaatctggccgaagtgaaaaaaaaaggaaagatgaaaaaattgggacaggcaatggaagaagacctgatcgtgggactccaggggatggaccttaatttggaagcagaggcactggctggaactggcctcgtgctggacgagcaattaaacgagtttcattgtctgtgggatgattcttttccagagggcccagaacgcttacatgccattaaggagcaactgattcaggaggggctacttgatcgctgcgttagcttccaggcccgattcgctgaaaaggaagaactcatgctggttcatagcctggagtacatagatcttatggaaacgacacagtacatgaatgaaggtgagctgagagtccttgccgacacttatgatagtgtgtacctccacccaaactcctactcctgtgcctgtctggcctcagggagtgtactgcgcctcgtggatgctgtgctgggggcagaaataaggaacggtatggctatcatttag

SEQ ID NO: 28924 - DNA, 891 bp, Artificial Sequence
  Description of Artificial Sequence: Synthetic coding sequence
atgaaaaaactgggacaggccatggaggaagacctcatagtggggctgcagggtatggaccttaatctggaagcagaagcccttgcagggactggcctggtgcttgacgagcaactcaatgagtttcattgtctttgggatgactcttttcccgagggcccagagcgtcttcatgcaattaaagaacagctcattcaggagggtttgctggatcgctgtgtttcttttcaggctcgctttgcagagaaagaggaactgatgctcgttcattctctcgaatatatcgacttgatggaaaccacgcagtacatgaatgaaggcgagctaagagtcctcgcagatacgtacgactctgtctaccttcatcctaacagttacagttgtgcctgcctggccagcggaagcgtacttaggctggtcgacgctgttctaggcgctgagataaggaacggtatggcaatcatccgccctcccggacatcacgctcagcattcccttatggatggctattgtatgtttaatcacgtggctgtggccgctcgttatgctcagcagaaacatcggattcgcagagtgttaatcgtggactgggacgtccaccacggccagggcacacagttcacattcgatcaagaccccagtgttctttatttttcaattcacaggtatgagcagggtaggttctggcctcatctgaaggccagtaactggagtacgaccgggttcggtcagggacagggctataccattaatgtcccctggaaccaggtagggatgcgtgatgccgactacatcgcggcattcctccatgtcctgctgccagttgccctcgaggtgctgggaatttggggcgttttaggtgggggagtcgccctgaaggtcaggttgtag

SEQ ID NO: 28925 - DNA, 429 bp, Artificial Sequence
  Description of Artificial Sequence: Synthetic coding sequence
atgacttctacaggtcaagactcaaccacaactcgccagaggaggtcacggcagaacccacagtcgcctccacaagactcttccgtcaccagtaagcgcaacattaagaagggagcagtgcctcggagcattcccaatctggccgaggttaagaaaaaggggaagatgaaaaagctgggtcaggccatggaggaggacctgatcgtcggtttgcagggaatggacctcaatctggaggcggaagcccttgccggaactgggctggtcttagacgaacagctgaacgagttccattgcctttgggatgacagctttccagaagggccagaacgccttcacgcaattaaagagcagctgatccaggaaggcctacttgatagatgtgtctccttccaggctcggtttgccgaaaaggaagaactgatgtag

SEQ ID NO: 28926 - DNA, 810 bp, Artificial Sequence
  Description of Artificial Sequence: Synthetic coding sequence
atgaccagcacgggtcaagactctacgacaaccaggcagaggcgtagcaggcagaaccctcagtcacctccccaggacagcagcgtgaccagcaaaaggaatatcaagaaaggggcagtcccccgttcaattcctaatctcgcggaagttaagaagaagggaaaaatgaaaaaactgggccaggctatggaggaggacctgatcgttggcttgcagggtatggacctcaatttagaggccgaggctttagccggaacaggcctcgttttggacgaacaactgaacgaattccactgcttatgggacgactcttttcctgagggacccgaaaggctgcatgctataaaggaacaactgatccaggagggcctgctcgaccggtgcgtatcttttcaagcccgattcgcagaaaaggaagaactgatgcttgttcatagccttgagtatatcgatctgatggaaacaacccagtacatgaacgaaggtgaactgcgcgttctggccgatacttatgacagcgtatacctgcatcccaatagttatagctgtgcttgtctggcctccgggtctgtactgcgattggttgacgcagtccttggcgctgaaatccgcaacggtatggccattattaggccgcctggccatcacgcccaacactccctcatggatggctactgcatgttcaaccatgtcgctgtcgcggctaggtatgctcagcagaagcatcgtattcgtagggtgctgatcgtggattgggacgtccatcacgggcaggggactcaatttacctttgatcaagaccccagatag

SEQ ID NO: 28927 - DNA, 2454 bp, Artificial Sequence
  Description of Artificial Sequence: Synthetic coding sequence
atgaccagcaccggacaggactccacaaccaccaggcagcgaaggtccagacagaacccgcaaagtcctcctcaggattcctccgtaacaagcaaaaggaacattaaaaaaggggcagttcctcgaagtattcccaacttggctgaggtgaagaaaaagggcaagatgaagaagctgggccaggcaatggaagaggacctgattgtgggcctccagggtatggacctgaacctggaggctgaagcacttgctggcactggattagttctcgacgaacaacttaacgaatttcactgcctctgggacgactccttccctgaaggccctgaacggttgcatgccataaaagagcaactgatccaggaaggactgctagatcgatgtgtgtctttccaggcccgatttgccgagaaagaggaattgatgcttgtgcattccttggagtacatagacctcatggaaacaactcaatatatgaatgagggcgaacttagggttctcgcggacacctatgactctgtctatctgcatccaaacagttattcctgcgcctgcctcgcatctgggtctgtgctccgtctcgttgacgccgtgctcggcgcagaaatcagaaacggaatggctataatccgcccaccaggacaccacgcccagcattcattgatggatggctactgcatgttcaaccatgtggcggtggcagctaggtacgcgcagcagaaacaccgtatccgcagagtgctcattgtggattgggatgtccaccacggccagggaacccagtttacattcgatcaagatccttcagtcctgtatttcagcattcacaggtatgagcaggggcgtttctggcctcatctgaaagcttctaactggtccactacaggatttgggcagggtcaaggctatactattaatgtgccgtggaatcaggtgggaatgcgcgatgctgattacatcgctgcctttctgcacgtattgctgccagtggcgctggagtttcaaccccagctggtattggtggctgccggattcgacgccctgcagggcgatcctaagggcgaaatggcagctacccctgccggttttgctcagctgactcacttgctcatggggttggcgggagggaagttgatactcagcctggagggtggctacaatcttcgggctcttgctgaaggggtatctgcaagcctgcacaccctgctcggtgacccgtgccctatgctcgagagtccgggagcgccttgtaggagcgcacaggccagcgtctcttgcgcactcgaagccttggagcctttctgggaagtactggtgaggtccacagagaccgtagagagagacaacatggaggaagacaacgtagaggagtctgaagaggaggggccatgggagccaccggttctgcctattctcacttggcctgtactccaatcccggactgggctggtctacgatcagaacatgatgaatcactgcaatctgtgggatagccatcatcccgaagtgccccagcggattttgaggataatgtgccgccttgaagagctaggtcttgctggcagatgtttgacactcaccccacggccagctactgaggccgagctgctcacatgccacagtgcggagtatgttgggcatctacgcgctacagagaagatgaagaccagagagttgcatcgggagagcagcaacttcgactcaatttatatctgcccaagtacattcgcttgcgcccagctcgcaaccggggctgcatgtcgactcgtggaggcagtcttgtcaggtgaagtgttgaatggcgctgcagtagtgcggccacctggtcatcacgcagagcaagacgccgcttgtggcttctgcttctttaattccgtggccgtcgccgcacgccacgcccagactatctctggacacgccctaaggatcttgatcgttgactgggacgttcaccatgggaatggaacccagcatatgttcgaggatgacccatcggtgttgtacgttagtctgcataggtacgatcatggcacatttttcccaatgggagatgaaggagcctccagtcagatcggtagagctgccggtacaggattcacagtcaacgtcgcatggaatggtccccgaatgggcgatgcagactatctcgcagcctggcaccgtctggtcctgccaatcgcatacgagttcaaccccgagctggtgttagtgagtgcgggattcgacgctgcgcgtggggatccacttggtggatgccaagtgagccccgaggggtatgcccacctcactttgccaatcgcatgtctgagagggactaccactcccgcacagaaggagcggggtgcagctcaatggccacaggagggcgcagatatcatgcggattacgctggctggcggagaactcaccggtcgtcacgggaaggtggcatacgtcatcaagtacaagctgtag

SEQ ID NO: 28928 - DNA, 156 bp, Artificial Sequence
  Description of Artificial Sequence: Synthetic coding sequence
atgacttccacagggcaggattcgaccaccacccgacaacgcaggagcaggcagaaccctcagagccctccacaagacagtagcgtgacctcgaagcggaatatcaagaagggagctgtgccgagatctatccccaatctcgctgaggtgaagtag

SEQ ID NO: 28929 - DNA, 516 bp, Artificial Sequence
  Description of Artificial Sequence: Synthetic coding sequence
atgacctctaccggccaggatagcacgacaacacgccagcgtaggtcccgccagaacccgcagtccccaccccaggattcaagcgtaaccagcaagcgcaacattaaaaagggagcagtgccccgatccattcctaatcttgctgaggtcaaaaagaagggtaagatgaagaagctaggtcaggctatggaggaggatctcattgtggggctgcagggcatggatctgaacctcgaggctgaggctctcgctgggacaggcttggtactggatgagcagctgaatgaattccattgcctatgggacgacagcttcccggaggggccagagcggcttcacgccataaaggaacaactcattcaagagggcctcttggataggtgtgtgtcatttcaggcaagatttgcagagaaggaggagctgatgctggtccattctctggagtacattgatctgatggagaccactcagtacatgaatgaaggcgaactgcgtgtactggccgacacctattag

SEQ ID NO: 28930 - DNA, 486 bp, Artificial Sequence
  Description of Artificial Sequence: Synthetic coding sequence
atgacctcaacgggccaggactccactactactaggcagcgcagaagtcgccagaaccctcagagtccccctcaggattctagtgtcacctctaagcgcaacatcaagaaaggcgctgtcccaagaagcatccctaacctggccgaagtgaagaagaaaggaaaaatgaaaaagttaggacaggcaatggaggaagacttaatagttgggttacaggggatggacctgaatcttgaagcagaagctctggctggtaccggactggtgcttgatgagcaactcaacgaatttcattgcctttgggatgactcttttccagagggtcccgagcgactacacgccataaaggaacaattgatccaagaaggcctactcgatagatgcgtgtcttttcaagccagattcgccgagaaagaggaactgatgttggtacactccttagagtatatcgatctaatggagactactcagtacatgaatgaatag

SEQ ID NO: 28931 - DNA, 504 bp, Artificial Sequence
  Description of Artificial Sequence: Synthetic coding sequence
atgacctctactggccaggactccacaacaacgaggcagcggagatcacgccagaatccccagagccctccccaagactcttccgttacctctaagcgcaacattaaaaagggggctgtgccgagaagtatccccaatctcgccgaggtgaaaaagaaaggcaagatgaagaagctgggccaagccatggaagaggatctcatagtggggctgcaaggaatggacctgaatttggaggcagaagccctagccggtactggtctggtgctggatgaacagttgaacgaatttcattgtctctgggacgatagctttcccgagggcccagagaggcttcacgccattaaggaacagttaatccaagaagggctgctggacaggtgtgtgagttttcaggctcgcttcgcagagaaagaggagctgatgcttgtgcacagcctggagtacatagacctgatggagacgactcaatacatgaatgaaggggaactgcgagtcctttag

SEQ ID NO: 28932 - DNA, 3690 bp, Artificial Sequence
  Description of Artificial Sequence: Synthetic coding sequence
atgtcaggcgctaacaggggaagaggacaggcatcaagtactatgacaagtacaggacaggactcaacaaccacgcggcagaggcgctcaagacagaacccacagtctccgccacaagatagttccgtgacctccaagcgaaacatcaaaaagggcgctgtgcccagatccatccccaacctcgccgaagtgaagaagaaaggaaagatgaagaagttgggccaggctatggaggaagatctcattgttggcttgcagggcatggatctgaatctcgaggcagaggccctcgctggtactgggcttgtcctggatgagcaactgaacgagttccactgtttgtgggacgactcgttcccagagggtccagagcgacttcacgccattaaggagcaacttattcaagagggccttctcgatagatgtgtgagttttcaggcacgctttgcagagaaggaagagctaatgttggtccacagcctggagtatatcgacctcatggagactacacagtatatgaatgaaggcgagctcagagtgttggccgacacttacgactctgtgtacctgcatcctaactcttactcctgtgcatgtctggcatcagggagcgtgctccgcctagtagacgcagtattgggcgctgagatcaggaacggcatggccatcattagaccccctggccatcacgcacaacattctctcatggacggctactgtatgtttaaccatgtggctgtggctgccaggtatgcccagcaaaagcacaggatccgtagagtcctcatcgtggattgggacgtgcaccacgggcagggtacccagttcacctttgaccaagaccctagtgtgctctacttctccattcatcggtatgaacaaggtaggttttggccacacctcaaagctagcaattggtccacaaccggcttcggtcaggggcaagggtacaccataaatgtcccatggaaccaggtgggcatgagagacgctgattacattgctgcttttcttcatgtcctgctgcctgtggctctggaattccaaccacagctcgtcttggtcgcagctgggttcgacgccctgcagggcgaccccaaaggcgaaatggctgcaacgcccgcaggatttgctcagttgacacacctcttaatggggttagccggaggtaaacttatcctgtctttagaaggaggttacaatcttcgggcacttgcggagggagtaagtgctagtctgcatacactattgggggatccctgtccgatgctcgagagcccgggagcaccctgtaggtctgctcaggcaagcgtgtcatgtgcattagaagccctcgaacctttctgggaggtactggtgcggagtaccgaaactgtggagagggataatatggaggaagacaatgtcgaggaatctgaggaagaaggaccttgggaaccacctgtgctcccaatattgacctggcccgtcctgcagagccgcactggtctcgtttacgatcaaaatatgatgaaccactgtaatctctgggactctcatcaccccgaggtgcctcaaagaatccttcgcatcatgtgcagactggaagagctcggtctcgcagggagatgcctgacgctgacgcctagacccgctactgaagctgagctgctcacttgccattcagcagaatacgtgggccatctcagagcaacagaaaaaatgaaaaccagagaactgcaccgagaaagcagcaactttgactcaatttacatctgcccctccacttttgcctgcgcccaactggcaaccggcgctgcctgtcggctagtagaggcggtactgagcggcgaggtcctgaatggtgccgcagtcgtacggcctccgggacaccatgcggaacaggacgcggcttgtggcttttgtttcttcaattctgtcgctgtagccgctcgccacgcccagacgattagcggccacgcacttagaatcctcatcgtggactgggatgtgcaccacggcaatggcacacagcacatgtttgaagatgacccttccgtgctatatgtgtccttacaccggtatgaccacggaaccttcttccccatgggagacgagggtgcttcaagtcagattgggagggctgccggaacgggcttcactgtgaacgtcgcatggaatgggcctcggatgggcgacgctgactacctcgcagcgtggcatcgactcgttctccctatcgcttatgaattcaaccccgaactggtcctcgtgtctgcaggatttgacgccgctaggggagatccactggggggatgtcaagtgtcacctgaggggtacgcccacctcacccacctcctcatgggccttgcgagcggtcgcattatcctgatcctggagggtggatataatttgactagtatcagtgaatccatggcagcctgtacaagaagcctccttggtgatcctcctcctctccttacgttgcctcgcccaccactgtctggtgctttagcctccattactgagactatacaggtgcacaggcgttattggcggtcactgcgcgtgatgaaagttgaggatagagaagggccaagctcgtccaaactggtaacaaagaaggcaccccagcctgcaaagccccgacttgccgagcgtatgactactagagagaaaaaggtactggaagccggaatgggcaaagtgacgagtgcaagctttggcgaagagtcgacacccggtcagaccaatagtgaaactgccgtcgttgcgttgacgcaggaccagccttcagaagccgctaccgggggagcgacattggcacagaccatttcagaagccgcaattggcggtgcaatgctcggccaaaccacttccgaagaagccgtaggcggagcaaccccagaccaaacaacttctgaggagacggtcgggggagctatcctcgaccagaccacctcagaggacgctgtgggtggcgcaacgttagggcagacaacgtccgaagaggcagtgggcggagctacacttgctcagaccactagcgaagccgctatggaaggggctacactggaccagactacgagtgaggaagcgcctggtgggacggaactgatacagactccccttgcctcctcgactgatcaccaaacccccccaacgtcccccgtacaggggaccacaccgcaaatctccccatccacactgatcggaagtttgaggaccctcgagctcggctctgagtcccagggtgccagtgaaagccaggctcctggcgaagaaaatctgctgggcgaggcggctggtgggcaagacatggctgatagcatgctgatgcagggatcaagaggactgacagatcaagcgatcttctacgcggtcactcccctgccctggtgcccacacctagtggctgtttgtccaatccctgcggctggcctcgatgttacgcaaccctgtggcgactgtggcaccatacaagaaaattgggtgtgtctgagttgttatcaggtgtactgtggcaggtacatcaacgggcatatgctgcagcaccacggcaattcaggccacccccttgttctatcgtacattgacttgagcgcatggtgttattactgccaggcctacgtgcaccaccaagccctgctggacgttaagaacatcgcccaccaaaacaaattcggtgaagacatgccccacccccactag

SEQ ID NO: 28933 - DNA, 2976 bp, Artificial Sequence
  Description of Artificial Sequence: Synthetic coding sequence
atgcattcacctggcgcagacggcacacaggtctctccaggggcacattactgctccccaactggggctggctgtcctcggccttgcgccgatactccaggacctcagccacagcccatggatttgcgtgttggtcagcgtccacctgtcgaacccccacccgagcctactttactggcattacaacgccctcagaggttacatcatcacctgttccttgctggattgcagcagcagcgaagcgttgagcctatgaggctctccatggatactccgatgccagaacttcaggttgggccacaggagcaagaattaaggcagctgctgcataaagacaagagtaagagaagtgccgtggcctcttcagtggtaaagcagaagctggcagaagtgatcttaaagaagcagcaggccgctctcgaaaggacagtgcatcctaacagcccaggcatcccttaccgaactctggagcctcttgaaaccgagggtgctacaaggtctatgctgtcatcattccttccacctgtgccttctctgcctagcgacccgccagaacacttccctctgagaaagaccgtctcagaacccaacttaaaactgagatataagcccaagaaaagcctcgagagaagaaagaaccctctgctgcgcaaagagtcggcacccccatcactgagaagaaggcctgctgaaaccctgggggacagctcaccgagtagttcatctactccagcgtccggttgcagctcccccaacgattccgagcacggtcctaaccccatcctcggaagcgaggcccttttgggtcagcgccttcgactgcaggagacatctgtcgccccattcgccttacccactgtttccttgctcccagccattacgctgggattaccagcccctgccagagcggattccgaccgcagaacacacccgacactgggccctagaggccctattctaggatcgccgcacacccctctgtttttaccacacggcctggagccagaggctggcggtacgcttccttccagactgcagcctatactcttgctggacccgagcggtagtcacgcccctctgttgaccgtgcctgggttaggccctctgcctttccacttcgcgcaatccttgatgacaacagaacgcctctctggctcaggactgcattggcctctgtcacgcaccagatcagaacctttgcccccatccgccaccgccccacctccaccaggacccatgcagcctcggctcgaacaactcaagacacatgtgcaggtgatcaaaaggagcgccaagccctccgagaagcctcgcctgcggcagatacccagtgcagaagaccttgagaccgacggaggcggaccgggacaagtggtcgacgatggtctggaacaccgcgagctgggacatggccagccggaagcacgaggtcccgctccgctccaacagcacccccaggttctgctatgggagcagcagcggctggcaggccgtctccctcgtgggagcactggcgatactgtgctcttgcctctcgcccagggaggacaccggccactgtcacgtgcacaaagctcgcctgccgctccagctagcctaagcgccccagagcccgctagtcaggcacgggtcctgtctagctccgagactccagctcgaactcttccgttcacgaccggactgatctatgatagtgtcatgttaaaacaccagtgttcctgcggggataactctagacatccagagcatgctggccgtatccaatctatctggtcgagattgcaagagaggggactacggagtcagtgtgagtgtttgagggggcgaaaagcgagcctggaggagctccaatctgtccacagcgagaggcacgtgctcttatatggaactaacccactttctcgccttaaactggacaacggtaagttagccggattgcttgcacagagaatgtttgtgatgctaccctgcggcggagtcggcgtggatactgacactatctggaatgagctgcattcctccaacgcagccaggtgggccgctggatccgtcaccgatctggccttcaaggttgcttccagggaactgaaaaatggattcgccgtggtcaggccgccaggtcaccacgccgaccattctacggcaatgggcttttgttttttcaactccgtagctatcgcatgccgccagctccaacagcaatctaaggctagcaagatccttattgtggactgggatgtccaccatgggaacgggacacagcaaaccttttaccaagatccgagcgtgctttacatctctctccatcgccacgatgatgggaactttttccccggtagcggggcagtggatgaggtaggcgcaggctctggggaagggttcaacgtcaatgtagcctgggccggtggactcgatcccccaatgggtgaccccgaatatctggcagcttttagaatagttgtgatgcctattgccagagagttctcacccgacctggtgctcgtgtctgcgggattcgacgccgctgaaggacaccccgcacctttaggaggctatcacgtgagcgccaagtgtttcggctacatgactcagcagttaatgaacctggcaggcggtgctgtggtgctcgctctggagggtggccatgacctcaccgcaatatgtgacgctagcgaagcctgtgtcgccgcactcttgggaaaccgagtcgatcccctgagcgaggagggatggaagcagaaacctaaccttaacgcgatccggtccctggaagctgtcattcgcgtgcactctaagtactggggctgcatgcaaaggcttgcctcctgcccggattcctgggtccctagagtgcccggagcggacaaagaggaggtcgaggctgtgactgccctggcgtcgctctcagttgggatactcgcggaagatcgaccctctgaacagctggtcgaagaggaagagcctatgaacctctag

SEQ ID NO: 28934 - DNA, 2865 bp, Artificial Sequence
  Description of Artificial Sequence: Synthetic coding sequence
atgcacagccctggcgctgatggcacacaggtctcccctggggcacactattgttctcctaccggtgcaggttgtcccagaccctgtgccgacacaccagggcctcagcctcagcctatggacctgcgggtggggcaacggccacccgtcgagccccctccagagcccactttgcttgcgctgcagcggccacaacgcttacaccaccatcttttcttggcgggactgcaacagcagcggtccgttgagcctatgcgcctgtctatggacaccccaatgccagagcttcaggtcggacctcaggagcaggagctccggcagctcctgcataaggacaagagtaagcggtccgccgttgcaagcagcgttgtgaaacagaaactagccgaggtgatcctcaagaagcagcaagcagctcttgaaaggacagtgcacccgaattcaccaggcattccttaccggactctggagccactggagacagaaggcgcaacacgaagcatgctgtcctcttttctgccacctgtcccctcacttccttcagatccccctgaacacttccccctccgcaagaccgtaagtgagccgaacttaaaactcaggtataagcccaagaagtccctcgagaggaggaagaatccattgttgaggaaagaatctgcgcctccgagtctaagacgacgtcctgcagagaccttgggtgattcttcaccttccagctcctccactccggctagtggctgtagctctcctaacgactcagaacacgggcctaatcccatcttgggctctgaagccgactcagacaggcgaacccatccgactctgggaccacgcggacccattctgggatcccctcacacgccactctttctgccacacgggctggagccagaggcagggggaaccttgcctagtaggctgcagccaattctactgctggaccctagcggcagccatgctcccttattgacagtgcctggactgggcccattgcctttccactttgctcagagcctgatgaccaccgagcgcctgtctggatctggcctccactggcccctctcccgcactcgcagtgaacccctgcctcccagcgctacggccccaccacccccaggacccatgcagcctagactggaacagctcaagacccacgtgcaagtcatcaagcgcagtgcaaagccaagtgaaaaacctcgccttcgtcagataccatccgctgaggacttggagacagatggaggaggcccaggccaagttgtggatgacggcctcgaacatcgtgaactgggccacggtcagccggaggccagaggaccggctcccttgcaacagcatcctcaggtcctactgtgggaacagcagaggcttgcgggtagactccccagaggtagcacaggtgacaccgtgttactaccattggcacaggggggacacaggccattgagtagagcccagagctcccctgcagcccctgcctctctgagtgccccagagccggctagccaggcccgagttctgagtagttctgaaactcctgccaggaccctgcctttcacaacggggctgatctacgattccgtgatgcttaaacatcaatgctcatgcggcgataactccaggcaccctgagcacgcgggaaggatccaaagcatttggtcaaggctgcaggagcgcggattgcggtctcaatgcgaatgtctgcgtggccgtaaggcgtcactggaagagctgcagagtgtgcattcggaaagacacgtcctcctgtatggcaccaaccctctgagcaggcttaagctggataatggaaagcttgccggactgctcgctcagcgtatgttcgtgatgctgccttgtgggggtgtgggagtagacacagacactatctggaacgagctgcatagctctaatgccgctcggtgggcagccggaagcgtgacggacttggcctttaaggttgctagccgagagctgaagaacggctttgcggtggtgaggcctcccggtcatcacgcagatcacagcactgcgatgggtttctgcttttttaactccgttgccatcgcctgccggcagttacagcagcagtctaaggcaagtaaaatcttaattgtcgactgggatgtgcaccacggaaatggaactcagcagacattctaccaggatcctagtgtgctgtacatttccctgcacaggcacgatgatggtaatttcttcccaggtagtggtgcagtcgatgaagtcggcgcaggtagcggtgaaggttttaacgtcaacgttgcctgggccggaggcttggaccctccaatgggtgaccctgagtatttagccgctttcaggattgtggtgatgccaattgcacgagaatttagccccgacctagtcctagtgtcagcgggatttgacgcagccgaagggcatcctgccccactcggaggctatcatgtctctgccaaatgcttcggctatatgacccagcaactcatgaatctcgctgggggagccgtggtgttagccctagaaggcggacacgatctgaccgccatctgcgatgcctctgaggcgtgcgtggcagcactactcgggaaccgtgtagaccctctgagcgaagaagggtggaagcagaagcccaacttaaacgccatccggtctcttgaagccgtgatccgggtgcactctaagtactggggttgcatgcagaggctggctagctgtccagatagctgggtgccacgggtgcccggagctgacaaggaggaagtggaggccgtgactgcactggcctccctctcagtggggattctagcagaggaccgcccttctgagcaattggtggaagaggaggaaccaatgaacctctag

SEQ ID NO: 28935 - DNA, 3045 bp, Artificial Sequence
  Description of Artificial Sequence: Synthetic coding sequence
atgagtgatctcaggaagcgagagctcggggctctatttactagccgtggtaccgggggagtggagtgggacgggactcaggtcagtccaggcgctcactattgctcacctaccggcgctggctgccctaggccttgcgccgatacacctggccctcagccgcagcctatggacctgagggtggggcaacgtccccctgtagagcctcccccagaaccaacgctgctcgctttacagaggcctcaaaggctgcatcaccacctttttcttgctggccttcaacagcagcgcagtgtggagcctatgagattaagcatggacactcccatgccggagcttcaagtcggacctcaggaacaggagcttcgccagctgcttcacaaagataaatctaaaagaagcgcggtggcctcatcggtggtcaaacagaaactagcggaggttatccttaagaagcagcaagcggctctggagaggaccgtgcatcccaactccccgggtattccttatcgcaccctggaacctctagagacggaaggagcaacacgatccatgctgtcatcattcctccccccagtgccatctttaccttcggacccacccgaacatttcccccttagaaagactgtctctgaaccgaatttaaagctccgctacaaaccgaagaagagtctcgagcggcgaaagaaccctctgctccgcaaggaaagcgcacctccttctcttcgaaggaggccggctgaaacactcggggatagctcaccttccagcagcagcacccccgcatccggttgctcaagtcctaatgactcagagcatggccctaacccgattcttggttcggaagccctgttgggccaacgcctgcgcctgcaggaaacatctgtggctccgtttgccttgcctaccgtttcactgttaccggctatcactctgggcctgcccgcaccagccagggccgattccgatagacggacacaccctacattgggccctcggggtcctattctaggatctccacatacccccctgtttctcccgcacggactcgaacccgaggccggtggaaccctgccctcgaggcttcaaccgatcctgttattagatccctcgggcagccacgcccctctgctgacggtcccagggctcggccctttgccatttcactttgcacagtccctgatgactacagagaggctcagtgggagcggcctgcactggcccctctcaagaacccgctccgagccactgcccccttccgccactgctcctccacctccgggacctatgcaaccccgacttgagcagcttaagacacacgtccaggtgattaaaagaagcgccaaaccatctgaaaaaccaagactgaggcagatcccaagcgctgaagacctcgagaccgatggcggaggccctggacaggtggtagacgacggtctcgaacaccgggaactgggacacggacaacctgaagccaggggacctgcgccactccagcagcacccccaggtgctcctgtgggagcaacaacgtttagccggaaggctaccaagggggtctacgggagatacggtgctcctccccctcgcccaggggggtcaccgccctctgagtcgagcgcagagctcacctgctgctcccgcatctctcagcgccccagagccagcaagtcaagccagggtgcttagtagcagcgagaccccagccagaacgctcccttttacaacgggactgatctacgacagtgtgatgctaaaacaccagtgcagttgcggagataattcccggcacccggaacatgccggaagaattcagtctatatggagtcgcctgcaagaacgcggacttaggtcacagtgcgagtgcctaaggggacggaaagctagtctggaagaactgcaatcagtccattccgagaggcatgtgctcttgtacggaacgaatcccctctccagattaaagttggacaacgggaagctggccggactgctggcccagcggatgtttgtgatgcttccctgtgggggagtgggcgtcgacaccgacaccatttggaacgaacttcatagctccaatgcagcacggtgggcagcgggtagcgtgactgatttggcctttaaagtcgcctccagggagctgaaaaatggttttgccgtggtgagacctcctggccatcacgcagaccactccaccgccatgggattttgcttctttaattcggttgcaattgcatgtagacaactccagcaacagagcaaggcttctaagattcttattgtggattgggacgtacatcatggcaatggtactcagcaaactttttaccaagatccctctgtcctgtacatttcattacatcgtcacgatgatggcaatttctttcccggttcaggcgcagtggacgaggtcggagccggatctggagaaggattcaatgtcaacgtggcatgggccggaggcctggacccgccaatgggggatccagagtacctggctgcctttcggatagtggttatgccgatcgctcgcgaattcagtcctgatctggttctcgttagtgcaggttttgacgcagccgaaggacaccccgctcctctcgggggttaccacgttagcgcaaaatgctttgggtatatgactcaacagctcatgaatctggctggcggagccgtggtgctggccctggagggtggccacgacctcactgcaatttgcgacgcatccgaggcctgcgtagctgccctactgggtaacagagtcgatcccctgtcggaggaaggttggaagcagaagcccaatttgaatgccatccgcagcctcgaggccgtcatacgagtgcacatgggagctctcactctgtctcagatccctggtcacggcagcagccagcagcaagctggaggcgcattcagctggccaggacacccttgtagggctgccgtggtcatggttaatacgggcgctgcctgcagcgcttggcctcctgttcaaactcccggatgtctagaatgccaagggctcactaagaagaagtggagacagtag

SEQ ID NO: 28936 - DNA, 402 bp, Artificial Sequence
  Description of Artificial Sequence: Synthetic coding sequence
atgcattcgccgggagccggttgtcctaggccatgcgctgatactcctggtcctcagcctcaaccaatggacctaagggttggacagcgacctcctgtagagccaccgccagagcccacgcttttggccttacagaggcctcagcgtctccatcaccaccttttcctcgcgggtttgcagcagcagcgtagcgtggagcccatgcgactctcaatggacactcccatgccggagctgcaggtgggccctcaggaacaggaactccgtcaactgctgcacaaggacaaatctaagagaagtgcggtggcttccagcgtggtgaagcaaaagctggctgaagtgatcctcaagaaacaacaggcagccctcgaaagaactgtgcatccaaatagcccaggatag

SEQ ID NO: 28937 - DNA, 2859 bp, Artificial Sequence
  Description of Artificial Sequence: Synthetic coding sequence
atggatcttagggtgggccagaggcctcctgtggaacccccacctgagccgacactccttgcactccaacggcctcagcgtctgcaccaccacctgttcctggccggtcttcagcagcagcggtccgtggagccgatgagattgtcaatggacacacctatgcccgagcttcaagtggggccacaggagcaggagctgcggcagttgctccacaaggataaaagtaagcggagtgccgtcgctagcagcgtggtgaagcagaaattggccgaagtgattctcaagaagcagcaggccgctctggaaaggactgtgcacccaaacagccctggcattccttacaggaccctagagccgctggaaaccgagggcgcaacaaggagcatgctgagctccttcctgcccccagtaccaagtctcccttccgacccgccagaacactttcccctgcgcaaaacagtcagcgagcctaatctgaagctccgctacaagccaaagaagagcctggagaggaggaagaacccacttctgcgaaaagaaagcgctccaccctccctccgtaggaggcctgccgaaactctgggtgatagcagcccctcatcatcctcaactcctgcatccggatgcagttctcctaatgattctgagcacggtcccaaccccattctgggctccgaggctctgctcgggcagcgcctgaggcttcaggaaactagtgtggcgccatttgccctgcccacggtcagcctgctcccagctattacactcgggttgcccgctcccgcaagggctgattcggatagaaggacccatccaacactgggtcccagaggacctatcctgggcagtccacacaccccattatttctcccacatgggttagaacccgaagcagggggaactttgccctccagattgcagccaatcctgttgctggatccttcgggctctcacgctccattgctcacggtccctgggctaggccctctgccatttcacttcgcacagagcctgatgacaacagagcggctatctggtagtggcttgcactggcccttgtcgaggacacgatccgaaccccttcctcccagcgctacggcaccccctcccccaggccctatgcagcctcggcttgagcaactcaaaactcatgtgcaagtgatcaaacgaagtgccaagccctctgaaaaacccaggctgaggcaaataccttcggccgaggatctcgagactgacgggggtggccctggccaggtggtggatgacggtctggaacacagggagctggggcacggacaacctgaggcaaggggaccagctccccttcagcagcatccacaggtgctgctatgggagcagcagcgacttgctgggagactccctaggggatctacgggtgataccgttctactccccctggcccaggggggtcaccggccattgagccgcgcacagagcagcccagctgcaccagcttctctttcggctcctgaaccggcttcacaagcacgcgtgcttagttccagtgagacgccggctcgcacactacctttcaccacaggtctgatttacgattccgtcatgctgaaacaccagtgctcttgcggcgataattcccgccaccctgaacatgcaggccgtatacagtcaatctggtcccgactgcaggagcgaggtcttcgctctcagtgtgaatgcttgcgtggacgaaaggcaagcttggaagagcttcagtctgttcattcggagcggcacgtcctgctctacgggaccaatcctctttccagactgaaacttgacaatggcaagctagccggactactcgcccagcgcatgtttgtcatgctgccatgtgggggagtgggagtggacactgataccatttggaatgaactccacagctccaacgccgctcggtgggcagcagggtcagtgaccgacctcgcatttaaggtagcttctcgggagcttaaaaacggtttcgccgtggtgaggccacctggccaccatgccgaccactccaccgccatgggattctgtttttttaatagcgtggctatcgcttgcaggcagcttcagcagcagtctaaggcctctaagattctgatagtcgactgggacgtccaccatgggaatggtacgcaacagaccttttaccaggacccatctgtgctctacataagcctccaccgacatgatgatggaaacttttttcccggatccggggctgtagacgaggttggggctggttccggagaaggcttcaacgttaacgtggcctgggctgggggactcgacccacctatgggtgatccagagtatctggccgcttttcggatcgtggtcatgccaatcgccagggagttctcacccgacctggtgcttgtaagcgccggattcgatgccgcagaaggacatccagcccctctgggcggataccacgtttcggctaagtgctttgggtatatgacccagcaactgatgaacctggctggcggtgccgtggtgctggcactcgaagggggtcacgacctaacagctatttgcgatgcatccgaagcttgtgtagcagctctgcttggaaatcgggtggacccactgtctgaagagggatggaagcagaagcccaacctgaacgccattcgctctctggaagccgttatcagggtccacagcaagtattggggctgtatgcagagactcgctagctgcccagactcttgggtaccaagggtcccaggagccgacaaggaagaggttgaggctgtcactgccctggcctcacttagcgtgggaattctggctgaggacagaccgtcggaacagctggtggaagaagaggagcccatgaatctctag

SEQ ID NO: 28938 - DNA, 2925 bp, Artificial Sequence
  Description of Artificial Sequence: Synthetic coding sequence
atgcacagcccaggggctggatgtccacggccatgcgccgataccccagggcctcagccacagccaatggacctgagggtagggcaacgtccaccagtcgaacctcctcccgagcccacactgctggctttgcagcggccacagaggttgcatcaccacctcttcctcgccggactccaacagcagagatcggtcgagccgatgcggctgagtatggacactccgatgcctgagcttcaggtgggcccacaagagcaggagctccgacagctgctgcataaagataaatctaagaggagtgccgtagccagcagtgtcgtcaaacagaagctggccgaagtgattctcaaaaagcaacaggctgcgctcgagaggaccgtgcatcctaactcacctggcattccttatcgcacgctggaacctttagaaaccgaaggggctacccgctccatgttatccagcttcctgccacccgtcccaagtcttccctctgacccaccagaacactttcctttgcgaaagaccgtgagcgagcccaacctcaagctgagatacaagcccaagaagtccttggagaggcgtaagaatccgctgctgcgcaaggagagtgcccctccaagcttgagaaggcgcccagcagaaacacttggagattcttccccgagtagttccagcactccagccagcgggtgcagctcaccaaacgattccgaacacgggcctaaccccatattgggttcggaagctctactggggcaacgtttgcggcttcaggagacatcagtggctccatttgcactgccgactgtgagtctgctgcccgctatcaccctcggtttgccagcccctgccagggcagacagtgaccgtaggactcatcctactctcggtcccagaggacccatacttggttcgcctcatacacccttgttcctgccgcatggcctggagcccgaggcgggtggaaccctgccaagtcgccttcaaccaatcctgttattagatcccagcggttcccacgcaccactgttaaccgtccccggacttggacccctgccctttcacttcgcccagagcctgatgacaacagaacgcctgtccggcagcggtcttcactggccactctccagaaccagatctgaacccctgccaccatctgccacagcccctccccctccaggaccgatgcagcccaggctcgagcaactcaaaacacacgttcaagtgatcaagcggtcggctaagccctctgaaaagccgcgacttcgccagatacctagcgcggaggatcttgagaccgacggcggaggcccaggtcaagtagtggacgatggcctcgagcacagggaactaggtcacggccagccagaggctagaggaccagcgcctctccagcagcacccccaggtgctactctgggagcagcagcgactggcgggtcgattgcctcgagggagcaccggtgacactgttctgttgcctctggctcaggggggacacaggccccttagcagagcccagagcagtccagccgctccagcctcattatctgctccagaacctgccagccaggccagagttctgtcaagctctgaaacccctgctcgaacgttaccctttaccaccggactcatctacgacagtgtgatgcttaaacatcagtgctcctgcggggataattcacgtcaccctgaacacgcaggacgtatccagagcatctggtcacgactgcaggagcggggattaaggtcacagtgcgagtgcctccgagggaggaaagcctctctagaagagctccagtctgtgcacagtgagcgccatgtcctgctttatgggactaatccactatccagactgaagctggataacggcaaattagcagggctcctggcgcagagaatgtttgtgatgctcccctgtggaggggtcggagtggatacagacaccatttggaacgagttgcattcgtctaatgctgctcgatgggcagctggttcggtgaccgacctggcctttaaggtggcaagtcgagaactgaaaaacggttttgccgtcgtgcgaccacctggacaccacgcggatcactccaccgccatgggcttttgcttcttcaattctgtggccatcgcttgcagacagctgcagcagcagagtaaggcctctaagatcctcatcgtggactgggatgtgcaccacggcaatggaacccaacaaacgttctaccaggatccttcagtgctttatatttcccttcacaggcacgacgacggaaatttttttcccggttccggggcagtggacgaggttggcgctgggagcggtgaaggctttaatgttaatgttgcgtgggctggcggattagatccgcctatgggggatcctgaatacctagcagcttttcgcatcgtcgttatgccaatcgctagggagttctccccggatttagtccttgttagcgccggattcgatgccgctgagggacacccagcacctttagggggatatcatgtctccgccaagtgcttcggatacatgacccagcagcttatgaatctggcaggcggagcggtggtactcgctctggaaggcggtcacgacctgacggctatatgtgacgcctccgaagcctgcgtggctgccctcctcggaaaccgggtcgatcccctcagtgaagagggctggaaacagaagcctaacctcaatgccattaggtcactggaggccgtcattcgggtgcattccaagtattggggttgtatgcaacgcctcgcctcttgcccggattcatgggtgccacgtgtgcccggagcagataaggaagaagtggaggccgtaaccgccctggcgtccctctctgtcggcattctggcagaggatcgcccatctgagcagctcgtggaggaagaggagcccatgaatttgtag

SEQ ID NO: 28939 - DNA, 819 bp, Artificial Sequence
  Description of Artificial Sequence: Synthetic coding sequence
atggaggagccggaggaacccgctgatagcgggcagtcacttgtaccggtttacatttacagtcccgagtatgtatctatgtgcgattccttagcaaagatccccaagcgcgcaagcatggtccactccctgattgaagcttatgccctgcataagcagatgagaatagtcaagcctaaagtggctagtatggaggagatggctacattccacacagatgcatatcttcagcatctacagaaagtttcacaggaaggggacgacgaccaccctgattctattgaatatgggctggggtatgactgccctgcaacagagggcatctttgactatgccgcagctatcgggggagccactatcacagccgcacaatgccttatagacggcatgtgtaaagtggctatcaactggagcggtggttggcatcacgcgaagaaagacgaggctagtggattctgttatctaaatgacgcggtgttgggcattctgagactcagaagaaaatttgaacgtatcttatacgtggatctagatttgcatcacggcgatggggtcgaggacgcattttcatttactagcaaggtgatgacagtgagtctccataagttcagccccggattctttccaggaaagagcgacgtgtcagatgtgggcctggggaaggggaggtactactccgtgaatgttcccattcaggatggcattcaggacgaaaaatactaccagatttgtgagagtgtgcgcacttcgtgccccaagagtagacccgtggaagctgctgcagcggcatgcctacctcacctccattccttggtgtag

SEQ ID NO: 28940 - DNA, 1134 bp, Artificial Sequence
  Description of Artificial Sequence: Synthetic coding sequence
atggaggagcccgaagaaccagcagacagcggtcagtcactggtgccagtatatatctactccccagaatacgtctccatgtgcgactcattggccaaaatcccgaaaagagctagcatggttcattccctcatagaggcctacgctcttcacaagcagatgagaatcgtgaagcctaaggtagccagcatggaagaaatggctaccttccacactgacgcatacttacagcacttacagaaggtgtcacaggagggagatgatgatcacccagattccattgagtacggcctgggatacgactgtcccgctacagaggggatatttgattacgctgcagccatcggtggcgctactatcaccgccgcacaatgcctaatagacggcatgtgcaaggttgccataaactggtccgggggatggcaccatgccaagaaggacgaggccagtggattctgctatctgaacgacgcagtcctggggatcttacggctgagaaggaaatttgaaaggatactttacgttgatctggacctgcaccacggcgacggtgtggaggatgcattttcctttacttcaaaagtcatgacagtgagtcttcacaagttctctcccggtttttttcctgggacaggcgacgtgtctgacgtgggactcggaaaaggtcggtactactccgtgaatgtgcccatccaggatgggattcaggacgagaaatattaccagatttgcgaaagtgttttaaaagaagtctatcaggcattcaaccccaaagcggtggtcctgcagttgggcgctgataccattgcaggcgacccaatgtgttcatttaacatgactcccgttggcataggaaagtgcctgaagtatatattacagtggcagctcgccactctaatcctggggggtggcggatacaatctagccaatactgcacgttgttggacttacttaacgggtgtgattctcggaaaaaccctgagtagtgagatccccgatcatgagttttttaccgcctatgggcctgactacgtgctggaaatcacaccctcatgtagacctgataggaacgagccccaccggatccagcagatcctgaactacatcaagggcaatttgaaacacgttgtctag

SEQ ID NO: 28941 - DNA, 861 bp, Artificial Sequence
  Description of Artificial Sequence: Synthetic coding sequence
atggaggaaccggaggagcccgcagattctgggcagtctcttgtccctgtgtatatatattctccagaatatgtgtctatgtgtgactctcttgccaagataccaaaaagggcttcgatggtacacagtctgatcgaggcttatgctctgcataaacagatgagggatgaggccagcggattctgctaccttaacgatgccgtcctcggtatactgaggctgcgacgtaaatttgaacggattctatatgtcgatttggatcttcaccatggcgacggagtggaagatgctttttcatttacatccaaggtcatgacagtctccctgcataaattcagtccgggattttttccaggcactggcgacgtctcagatgtgggattgggaaaaggcaggtactactccgtgaacgtgccaattcaagacggaatccaagatgagaaatactatcagatctgcgagagcgtactgaaagaggtgtatcaagcctttaaccctaaagcagttgtgctgcagctgggagccgacacaattgctggcgaccccatgtgttcctttaatatgacccctgtgggaatcgggaagtgtctaaagtatatcctccagtggcagctcgcaacgctcattctcggtgggggaggctataacttagctaacactgcaagatgctggacatatctgaccggggttatccttggcaaaacgctctcctctgagattcccgaccacgaattttttacggcgtacgggccagattatgtgctggagattaccccttcctgtcgcccagatagaaacgagccccacagaattcagcagatcctaaactacattaagggcaatcttaagcacgttgtgtag

SEQ ID NO: 28942 - DNA, 549 bp, Artificial Sequence
  Description of Artificial Sequence: Synthetic coding sequence
atgaccgtatcactgcacaaatttagccctggctttttccccggaactggcgacgtgtcggacgtgggactaggaaaaggcaggtattactccgttaacgtcccaatacaggatggtattcaggatgagaagtactatcagatatgtgagagcgttttgaaagaagtgtatcaagcattcaacccaaaggcagtggtcctccagctgggcgcagataccatcgccggtgatcctatgtgttcattcaacatgacccccgttggaatcgggaagtgccttaaatacattttacaatggcaattagccaccttgatcctgggcggaggaggatacaatctggcaaacaccgcacgatgttggacctacttgacgggcgtcatcctgggaaaaactctcagcagtgagattcccgatcacgagttcttcaccgcttacggcccagattacgtccttgagattaccccttcctgtcggcctgacaggaatgaacctcaccgcatccaacagatcttgaactacatcaagggcaacctgaagcatgtggtgtag

SEQ ID NO: 28943 - DNA, 441 bp, Artificial Sequence
  Description of Artificial Sequence: Synthetic coding sequence
atggaggagcccgaagaaccagcagactctgggcagagcctggtgcctgtgtatatctactccccagaatacgtaagcatgtgtgactccctcgccaagattcccaaacgcgcaagcatggtgcacagcctgatcgaagcctacgcactgcacaaacagatgaggatcgtgaagcccaaggtcgcatccatggaagaaatggctacttttcacaccgacgcatacctgcagcatttacagaaggtctctcaggaaggagatgacgaccacccggacagtatcgagtacgggttgggctacgactgtccagccaccgaaggtatattcgactacgccgcagcgataggaggagccaccatcacagccgctcagtgcctcatcgacggcatgtgtaaggtggccattaactggtccggtggatggcatcacgccaaaaagtag

SEQ ID NO: 28944 - DNA, 477 bp, Artificial Sequence
  Description of Artificial Sequence: Synthetic coding sequence
atggaggaacccgaggaaccggcagattcaggccagtctctcgtacccgtttacatctactctcccgagtacgtttccatgtgcgactccctggcaaaaatccccaaacgggctagcatggtccactcgctgatcgaggcctatgccctccacaaacagatgcgaatagtgaaacctaaagttgcctctatggaagaaatggctacattccacacagacgcgtacctccagcacctccagaaggtcagtcaggaaggtgacgacgaccatccggacagcattgagtacgggctcggatacgattgtccagccacggaaggcatcttcgattacgctgctgctatcggcggtgctaccattaccgcagctcagtgcttgatagacggaatgtgtaaggtcgctataaactggtcgggcggatggcaccacgccaaaaaggaaacatgtgtgtatgtagcactatacaaggccttttag

SEQ ID NO: 28945 - DNA, 420 bp, Artificial Sequence
  Description of Artificial Sequence: Synthetic coding sequence
atggaggaacccgaggaaccagctgacagcggccagtcactggtacccgtttacatctattctccagagtatgtttctatgtgtgactccctggcaaaaatcccaaaacgggcaagcatggttcactctctcattgaggcctatgcgcttcataaacaaatgagggacgaggccagcggtttctgctatctcaacgatgcagtgttaggaattctgcgcctgcgcaggaaattcgaacggattctgtatgtggacttagatctccaccacggtgatggcacgggggacgtttcagacgtggggttaggtaagggccgttactactcggtaaatgttcccatacaggacgggatccaggacgaaaaatattaccagatatgcgagcggtacgagcctccagcccctaatcccggattatag

SEQ ID NO: 28946 - DNA, 771 bp, Artificial Sequence
  Description of Artificial Sequence: Synthetic coding sequence
atggaagaacccgaggagcccgcagattcaggtcagagtctggtccctgtctacatttattctcctgagtatgtatcaatgtgtgacagtctggctaagattcccaagagggcctctatggttcatagccttatcgaagcttacgctcttcacaagcagatgcgcattgttaagccaaaggtggcaagcatggaggagatggccaccttccacacagacgcatatctccagcacctccaaaaagtgtcacaggaaggcgatgatgatcatcctgattccatcgagtatgggttgggttatgactgtccagcaacagagggcatttttgactacgctgccgcaattgggggagccacgatcacagcagctcagtgccttatcgatgggatgtgtaaggtggctatcaactggtctggaggttggcaccatgccaaaaaggacgaggcctccggtttctgctacctgaacgacgccgtcttgggaatcctccggctgagacgcaaattcgagagaattttgtatgtcgatttggaccttcatcacggtgatggggttgaggatgccttctcttttacatctaaagtcatgacagtgagcctgcataaattcagccccggtttcttcccaggaaccggcgatgtgagcgacgtgggactgggtaaaggcaggtactattctgtgaacgtgccaatccaagatgggattcaggatgaaaagtactatcagatctgcgagcggtacgaaccgccagcacccaaccctggtctgtag

SEQ ID NO: 28947 - DNA, 831 bp, Artificial Sequence
  Description of Artificial Sequence: Synthetic coding sequence
atggccggacccgctgccttgtccgccgctgccgctgctgcgctcgcagccgctttacttttgctgcggagagaggatcctggccctggcgctggaccgtcaatggccgaaactgaagctctgtcgaaactgcgggaagacttcaggatgcagaataagtcagtgttcatccttggagcatccggtgaaactggacgcgttctgctgaaggagatcctggaacaaggccttttctcaaaagtcaccctgattggacgcagaaagttaactttcgacgaggaagcgtacaagaatgttaaccaagaggtagtcgactttgaaaagctggatgactacgctagtgccttccaaggacacgatgtaggcttttgctgccttgggacgaccaggggaaaagctggcgcagaggggttcgtgcgcgttgatagagattacgttctaaagagtgcagagctcgcaaaggccggtgggtgcaagcactttaacctgctgagctccaagggagctgataaatcgagtaattttctttaccttcaagttaaaggcgaggtggaggccaaggtggaggagctaaaatttgatcggtatagtgtctttcgcccaggcgttctgctatgtgaccgccaggaatcacgacccggagaatggctagtacgtaagtttttcggaagtctgccagattcatgggcgtccgggcactctgtgcctgtcgtgaccgtggtcagagccatgttgaataatgtggtcaggcctagggacaagcaaatggaactcctggagaataaggccattcatgacctaggcaaggcacatggcagcctgaaaccgtag

SEQ ID NO: 28948 - DNA, 729 bp, Artificial Sequence
  Description of Artificial Sequence: Synthetic coding sequence
atggctgagaccgaagctctctccaagctgcgtgaagacttccgcatgcagaacaaaagtgtgtttattctgggcgctagtggggagactgggcgagtgctgctgaaagagatcttggagcagggtctcttctcgaaagttacccttatcggaaggcggaaactgaccttcgacgaggaagcttacaaaaacgtcaatcaggaagtcgtagactttgaaaagctggacgactacgcctccgccttccaaggacacgatgtcggcttctgctgcttaggcactacccgaggcaaggccggagctgaaggcttcgtgagagtcgatcgggattacgtgttgaaaagtgccgagctcgcaaaagctggcggttgtaaacactttaatctactttcatcaaaaggtgcagacaaatcctccaatttcctttacctccaggtgaagggcgaagtcgaggcaaaagtagaggaactaaagttcgataggtattccgtgtttagaccaggcgtgctgctgtgcgacagacaggagtcgagaccaggggagtggctcgtgaggaagttctttggctctctgcccgactcatgggcgagtggccattcggttccggtggtcacagttgttcgggcaatgcttaacaacgtggtccgaccccgtgacaagcagatggaactgctggagaataaagccattcacgacctgggaaaggcccatgggagtctgaaaccgtag

SEQ ID NO: 28949 - DNA, 729 bp, Artificial Sequence
  Description of Artificial Sequence: Synthetic coding sequence
atggccgagactgaggcactgtcaaaattgcgggaagacttcagaatgcagaataaatccgtttttatacttggagcctctggcgagacaggccgagtgctgctgaaagaaatcctggagcagggtctttttagtaaagtgactctcatcggtcgtcgcaagcttacattcgacgaggaggcctacaaaaacgttaaccaggaggttgtggacttcgaaaaactcgatgactatgcctcagcctttcagggccacgacgtaggcttctgctgcctcggcaccacaagggggaaggctggagccgaggggttcgtccgggtagatcgcgactatgttctgaaaagtgccgagctagctaaggctggtggatgtaaacatttcaatttactgtcgagcaaaggagccgacaagagttccaacttcctgtatctccaggtgaaaggagaggtcgaagccaaagtggaagagctgaagtttgatcgttacagtgtgttccgcccaggagttctcctgtgcgataggcaggagtcaaggcccggagaatggctcgtgaggaaattctttggctcccttccggatagctgggccagcggccactctgtccccgtcgttactgttgtacgtgccatgctaaataatgttgtcaggccgcgagacaagcagatggagctgttggagaataaagctatccacgacctgggtaaggcgcatggtagcttgaagccatag

SEQ ID NO: 28950 - DNA, 729 bp, Artificial Sequence
  Description of Artificial Sequence: Synthetic coding sequence
atggcagagaccgaagcattatctaagctgagagaggatttccgtatgcagaacaaatctgtgttcatcttgggggcaagcggcgagacaggcagggttctgcttaaggagattctcgaacagggtcttttttccaaggtcacccttattggccgacgcaagctgaccttcgacgaagaagcttataaaaacgtcaatcaagaggtcgttgattttgagaaattagatgactatgcctccgcttttcagggccacgacgtgggtttttgttgcctggggacaacacggggtaaggccggtgcggagggattcgtgcgtgtggacagagattacgtcctgaagtcagctgaactggccaaggccggtggatgcaaacactttaaccttctgagttctaagggggctgacaagtcctccaacttcctgtatcttcaggtgaagggggaagtagaagccaaggtcgaggaacttaaatttgaccggtacagtgtattcagacctggtgtccttctttgcgatcgccaagaaagtcggcctggcgaatggctggtaaggaagttttttgggagtctcccagactcctgggcgtccgggcactcagtcccagtggtcactgtcgtacgggcaatgttgaataacgtggttaggccaagagataagcagatggaactgttggaaaataaagctattcacgaccttgggaaggcccatggcagcctgaaaccatag

SEQ ID NO: 28951 - DNA, 402 bp, Artificial Sequence
  Description of Artificial Sequence: Synthetic coding sequence
atggccgaaactgaggcattgtccaaactcagggaggattttaggatgcaaaataagtccgtgtttatcttgggcgcatctggggaaactggacgagtactgctgaaggaaatcctggaacaggggctgttcagcaaagtcactcttattggtcgcagaaaactgacctttgacgaggaagcctataagaacgtgaatcaggaagttgttgacttcgagaaactggacgactacgcctcagccttccaggggcatgacgtgggattttgttgtcttggtaccactcgcggaaaagctggagccgttcggaaggcgtatgccctctttcccttctgctggcctgttatttctaggattctgtttctcctgacactgtttctgtgcgcctgctgcaacgcgtag

SEQ ID NO: 28952 - DNA, 402 bp, Artificial Sequence
  Description of Artificial Sequence: Synthetic coding sequence
atggcggagaccgaggctctgtccaagttgcgggaagatttcagaatgcagaataaatcagtcttcatcctgggtgccagtggggaaacagggagggtgctgctgaaagagatcctggaacaagggctgttttccaaagtaacactgatcggcagacgcaagctgactttcgatgaagaagcctataaaaatgtgaaccaagaggtggtggattttgagaagctggacgactacgccagcgctttccagggacacgatgttggcttttgctgcttgggtaccacccgaggcaaagccggagctgtgaggaaagcatacgcccttttccctttctgctggcctgtcatctcccggattctttttctcttaaccctttttctctgcgcctgctgtaatgcatag

SEQ ID NO: 28953 - DNA, 402 bp, Artificial Sequence
  Description of Artificial Sequence: Synthetic coding sequence
atggccgaaaccgaggcgttgtctaaattgcgggaggatttcagaatgcagaataagtccgtgtttattctgggcgcttccggcgaaacgggcagggtgctgctgaaagaaattctggagcagggcctcttctcaaaagtaacgctgattgggagacggaagttaacttttgatgaagaagcctataagaatgttaatcaggaagttgttgacttcgaaaaacttgacgattacgcgtctgcctttcaaggccacgacgtgggtttttgctgtctgggcactaccagagggaaagcaggcgctgtccgaaaggcttatgctttgttccctttctgttggcccgtgatttcccgtatactttttctgttgaccctgttcttatgcgcctgttgtaatgcctag

SEQ ID NO: 28954 - DNA, 1080 bp, Artificial Sequence
  Description of Artificial Sequence: Synthetic coding sequence
atggcggagcacggggcacacttcacagcagctagcgtggcggatgaccaaccctctatctttgaagtagtagcacaggactcacttatgacagcagtgcgtcctgccctccagcatgtggtgaaggtcctcgcagagagtaatccaacacactatgggttcctctggcgttggttcgatgagatcttcacattactggacctgcttctgcagcaacattatctgagtaggaccagtgcatctttcagcgagaacttttacggactcaagagaatagtcatgggtgatacccataagagccagagactcgcaagcgcaggtctgcccaagcagcagctatggaaatctatcatgttcctggtgctattgccctatttgaaagttaaactggaaaagctggtttcgtcactgcgtgaagaagatgagtacagcattcaccccccaagttctcggtggaaacgcttttaccgagcattcttggcagcgtacccctttgtcaatatggcatgggaggggtggtttcttgtgcagcagttgaggtacatcctggggaaggcccagcatcactcacctctactccggcttgccggagtgcagctcgggaggctgacagtccaggacattcaggcgctggagcacaagccagctaaagcttcaatgatgcagcaacctgcacggtccgtgagtgagaaaataaattctgccctgaagaaggcagtgggcggtgtcgctttatcgttgtccaccgggctcagtgtgggcgtgttcttcctccagtttttagactggtggtattcaagcgaaaatcaggaaacaatcaagtctttaaccgcactcccgacacccccaccccctgtccacctggattacaacagtgactctcctctcctccctaagatgaagactgtgtgcccactgtgcaggaagacacgcgtcaacgatacagtgctggctaccagtgggtacgtgttctgttacagatgcgtctttcattacgtgagaagtcatcaggcgtgtccaatcactgggtaccctactgaagtgcagcacttgatcaagttgtactccccagaaaactag

SEQ ID NO: 28955 - DNA, 1374 bp, Artificial Sequence
  Description of Artificial Sequence: Synthetic coding sequence
atggtaagtaagctgacctccttgcaacaggagctgctctctgcgttgctatcttcgggagtgaccaaggaagtgctggttcaggccctggaggaactgcttccaagcccaaatttcggggtcaaactagagacgctaccattgagtccaggaagcggcgctgaacccgacaccaaacctgtgttccacaccttaactaatggacacgctaagggccgtctgtcaggcgatgagggatccgaggacggagacgactacgacactcctcccatcttgaaggagcttcaagccttaaatacagaggaagccgcagaacagcgggctgaggtggacaggatgttgtcagaggatccctggcgagctgccaaaatgattaagggatatatgcagcaacataatataccacagagggaggttgtggatgtgacgggcttgaatcagagccacttgtcccaacacctgaataaagggactccaatgaagacacagaagagagccgcactttatacctggtacgtacgcaaacaacgggagatcctgagacagttctcccaacaaagtcatggccctgggcagtccgacgacgcgtgctctgagcctactaataaaaagatgcgacgaaatcggttcaagtgggggcctgcctcacagcagattctttaccaagcctatgacaggcagaagaatccgtctaaggaagagagggaggccctcgtcgaagagtgtaatagagctgagtgccttcagcgcggagtgagcccttccaaggcccacggcctgggctctaacctggttactgaagtcagagtttacaattggttcgccaaccgacggaaagaagaagcattccggcagaaactggctatggacgcatacagttctaatcagacgcactcactgaatcccctgctcagtcacggtagcccccaccaccaacctagcagttcacctcctaacaagttatccggggtcagatactctcagcagggcaataatgaaataacttccagctcaacaatttctcatcacggtaatagcgcaatggtcacatctcaatctgtccttcagcaggtgagtccagcaagcctcgatcctggtcacaacctcctcagtcctgacgggaagatgataagcgtgagcggaggcggtctgccacctgtcagtacactaacaaatatacattccttgtcccaccacaacccacagcagtcccagaatctgatcatgactccactttcaggggttatggccatcgctcagatgagctccacttcccttgttatgccaacccaccatttactcagggctcagcaacaggggccatgcttccctcaccatcaccctctgggctcgtgtcacggcaaagctcagtag

SEQ ID NO: 28956 - DNA, 1338 bp, Artificial Sequence
  Description of Artificial Sequence: Synthetic coding sequence
atgctctccgaggacccctggcgcgctgcaaagatgattaagggctacatgcagcagcataacattccgcagagggaagtcgtggacgtgacgggcctgaaccagtcccacctgtcccagcacttaaataagggaacacccatgaaaactcaaaaacgcgctgccctgtatacatggtacgtacgaaagcagcgcgagattcttcggcagtttaaccagaccgtgcaatcctccggcaacatgactgataagtcgagtcaggaccaactgttgtttttgtttcctgaattctctcagcagagccacggaccaggccagtcggatgatgcttgttcagagccgaccaacaagaaaatgcgcaggaatagatttaagtggggacctgcttcccagcagattctgtaccaagcctatgatcggcagaaaaacccgtccaaagaggagagggaagccctcgtggaagaatgtaatagggcagaatgtctccagcggggtgtctcaccctctaaggctcacggtctgggtagtaatctagtgactgaagtccgcgtctataactggttcgctaatcgcagaaaggaagaggccttccgccaaaagctggccatggacgcatacagctcgaatcaaactcatagtctcaatccgctgttaagtcacggtagcccacatcatcagccctcatcgtcccccccaaataaactgagtggggtgcgttactcccaacaggggaacaacgaaattactagttcttctaccatctctcaccacggcaatagtgccatggtgacgagtcagagcgtcctgcagcaggtgtctcctgcctcactggatcctggccataacctgctgtctcctgatggtaagatgattagcgtctctggaggaggtttaccaccagtatctactctcactaacatccatagtctgagtcaccacaacccacagcaaagccagaatttgataatgaccccactgtcaggagttatggcaatcgcccaaagtctcaacacctcccaagcccagtccgtgcctgtgattaactccgtggccggatccctcgcggctctccagcccgtgcaattttctcagcagctgcacagtccacaccagcaaccactgatgcagcagagccctggctcacatatggctcagcaaccttttatggcagcagttacgcagctccagaactcccatatgtacgcccataaacaggaacctccccagtatagtcatacctcaagattcccctccgccatggtagtaaccgacacctccagcatttctacattaaccaatatgtcgagcagcaaacagtgccctctgcaggcctggtag

SEQ ID NO: 28957 - DNA, 1278 bp, Artificial Sequence
  Description of Artificial Sequence: Synthetic coding sequence
atggtgagtaaattaactagtcttcaacaagagttactgtccgcactcctgtcgtcaggagtgaccaaagaggtactagtccaggccctggaggagttgcttccgtcccctaacttcggggtgaagcttgaaactctcccactgtcccccggttccggcgcagaaccggatactaaacctgttttccacactctgacaaatggccacgccaagggcaggctttcaggcgatgaagggtccgaggatggcgacgattatgacaccccacccatcttaaaggagcttcaggcccttaataccgaagaggccgcagagcagagagctgaagttgacaggatgctgagcgaggatccttggagggcagccaaaatgatcaagggctacatgcagcagcacaacattccccagcgcgaagtagtggacgtcacagggctcaaccaaagtcatctcagccaacacctgaacaaagggacccccatgaagacgcaaaagagagccgcactttatacttggtacgttaggaagcaaagggagattttaagacaattcaaccagacagtgcaatcctccggcaatatgaccgataaatcgtctcaagatcagcttcttttcctattccccgagtttagccagcagtctcatggccctggccaaagcgatgatgcgtgttccgaaccaactaacaagaagatgcgtcgcaaccggttcaaatggggacctgcttcccaacagatactgtatcaagcctacgacaggcagaaaaaccctagtaaagaagagcgagaggctttagtagaagagtgcaatagggcagaatgcctccaaaggggtgtgtcgccctctaaggcccatgggcttggaagcaatttggtgactgaagtccgcgtctataattggttcgctaaccgccgtaaagaggaggccttccggcaaaaactggccatggatgcttacagctctaatcaaacccacagcctcaacccgctgctgtcccacggttctccccatcaccagccctcgtcaagccctcccaataaactcagtggtgtgcgctacagtcagcaggggaacaacgagatcacctcctccagcaccatttctcatcacggcaattcagccatggtaacatcccaatcagttctgcagcaggtgagccccgcttcactggacccgggacacaacctcctatcacctgatggtaagatggatttgtctctccggagaagattcgcccctagccaacacctcgacgagtacccccagcctcttccaccatag

SEQ ID NO: 28958 - DNA, 1596 bp, Artificial Sequence
  Description of Artificial Sequence: Synthetic coding sequence
atggtgtcaaagctcacctccctgcagcaggaactcctcagcgcccttctgtcgagtggggtgactaaggaagttctggtgcaggccctggaggagctgctcccctcacccaatttcggggttaagctggagaccttgcccctttctcctggcagcggggctgagcctgacaccaaacccgtgttccacaccctgaccaatggccatgcgaaaggccgtctgagcggcgatgaggggagtgaggatggcgatgactacgacacccccccaatcctgaaggaacttcaggcccttaacaccgaggaggctgcggaacagcgggcagaggtagatagaatgctgtcggaagatccctggcgcgcagcgaagatgattaaaggatatatgcaacagcataatatcccgcagcgagaggtggtcgacgtgacaggtctgaaccaatcccacctatcccagcatctgaataagggcacaccaatgaaaacccagaaacgggcagcactctacacatggtatgtgaggaagcaacgcgagatccttcgacaatttagtcagcagtctcacggacctgggcagtccgatgacgcctgcagtgagcccactaacaaaaaaatgcgaagaaatcgcttcaaatggggtcccgcaagccaacaaatcttatatcaggcttacgaccgtcaaaagaacccgtcaaaggaggagcgggaggctctggtcgaggaatgtaaccgggcagagtgtctgcagcgaggcgtgtctccaagcaaagcacatggactaggatccaatctcgtcactgaagttcgcgtttataactggttcgcgaataggcgcaaggaggaagcattccggcagaagctggctatggatgcctatagcagtaaccaaactcattccctgaaccccctgctgtcacatggttccccgcaccatcagccgagtagcagccctcccaacaagctgtctggcgtgcggtactcacagcaggggaataacgagattacatcttcgagcaccatctcccaccacggcaacagtgctatggttacaagccagtctgttctccaacaggttagtcctgcctcacttgaccccggacataatctactttccccggatggaaagatgatttcagtgtccggcggtggactgccgcctgtgtccacactcacgaacattcattcattaagtcatcacaatccccagcagtcccagaacctcatcatgaccccgctgagtggcgttatggccatagcacagtcactgaataccagccaggcacagagcgtgccggttataaatagcgtagctgggtctctggcagcgcttcagcccgtgcagtttagccagcagctgcactctcctcaccagcaaccactgatgcaacaatccccgggatcccacatggcacagcagccattcatggctgcagtcactcagctgcagaactcgcacatgtatgcccataagcaggagccgcctcagtattctcatacatcccgctttccaagtgcaatggtggtgactgatactagcagcatctctacgttgacaaacatgtcgagctccaagcaatgtcccctccaggcctggtag

SEQ ID NO: 28959 - DNA, 843 bp, Artificial Sequence
  Description of Artificial Sequence: Synthetic coding sequence
atgaagttccgcgctaagattgtggacggcgcttgccttaaccacttcacccggatctctaatatgatcgccaagctggccaaaacctgcactctccgtatcagcccagataaactgaattttatcttatgcgacaagctcgccaacggcggagtttccatgtggtgcgagttggagcaggaaaactttttcaacgagttccagatggaaggggttagcgccgagaataatgagatttaccttgagttaaccagtgagaatctgagcagagcattaaaaacagcacagaacgcgagggcactcaagattaagctaactaataagcattttccatgtctgaccgtgagcgtggagctactcagcatgtcctccagctccagaatcgtaacgcacgacattccaattaaagttataccacgcaaactctggaaggatctacaggaacctgtggtgccagatccagatgtctcaatctacctgccagtactgaaaaccatgaaatccgtcgttgagaagatgaagaatatttccaatcacttggttatcgaagcaaacctcgacggggagctgaacctgaagattgagacggaactggtgtgtgtgacaacccactttaaggacctcggcaatccaccgcttgcctcagaaagtacacatgaggaccgaaacgtggagcacatggccgaagttcacatcgatattcgcaaactgctccagttcctggcagggcaacaagttaatcccacgaaggctctgtgcaatatagttaataataagatggtccattttgacctccttcacgaagacgttagtttacagtattttatcccagccctttcatag

SEQ ID NO: 28960 - DNA, 780 bp, Artificial Sequence
  Description of Artificial Sequence: Synthetic coding sequence
atgatcgctaagttggcaaaaacctgcaccttgcgcatctcaccggacaagctgaattttatcctctgtgacaaactcgcgaatggaggagtgtctatgtggtgtgagcttgagcaggagaactttttcaatgaatttcagatggaaggcgttagcgcagagaataatgagatctaccttgaattaaccagcgagaatctgtctagagctctgaaaacagcccagaacgctagggctttgaagattaaactcacgaacaaacacttcccgtgtttaactgtgtcagtggaactgctgtctatgagtagctcgagccgcattgtcacccacgacatccctattaaagttatccctcgaaaactctggaaagatcttcaagagccagtagtccctgatccagacgttagcatttacctgcctgtgctgaagactatgaagagcgtcgtggaaaagatgaagaacatctccaatcacttggtcattgaagcaaatttggatggcgagctgaacctgaagatcgagactgagctcgtgtgcgtaaccacacatttcaaggatctcggtaatccaccactggctagcgagtcaacacatgaagatcggaacgtagagcacatggccgaggtgcacatagatattcgcaaattgttgcagttcttagccggacagcaggttaatcccacaaaagcactctgtaatattgtcaataacaaaatggttcatttcgacttactgcacgaagatgtatcccttcaatactttatccctgccctctcgtag

SEQ ID NO: 28961 - DNA, 843 bp, Artificial Sequence
  Description of Artificial Sequence: Synthetic coding sequence
atgaaatttcgggcaaagatcgttgatggggcatgcctgaatcactttacacgcataagtaatatgattgccaagctggccaagacatgcaccctaaggatctctccagataaactcaatttcattttgtgcgataagctggctaatggaggggtgagcatgtggtgtgaattagaacaggagaatttttttaacgagttccagatggagggcgtgtcagccgagaacaacgagatctacttggagctcacctccgaaaatctgagcagggccctgaagaccgcccagaatgcacgggctctcaagatcaaactaacaaataaacattttccgtgtctgacagtgagcgtcgaattgctgagcatgtcctcgagttcacggatagtgacgcacgatattcctatcaaggtgattccgagaaaactgtggaaagatttgcaggagcctgtggtgcctgatcccgacgtgtcaatttacttgccggtgttaaaaaccatgaagtcggttgtagagaagatgaaaaatatctccaatcaccttgtgattgaagcaaacctggacggagagctcaacttaaagattgaaacggagctggtttgcgtgacgacacactttaaggatctcgggaacccaccacttgccagtgaatccacccatgaggaccgaaacgtagaacacatggccgaggtgcatattgatatacggaaattacttcaattcctggccggtcagcaggtaaatcctacgaaggctttgtgtaatatcgtaaacaacaaaatggtccattttgatttacttcatgaagacgtgagcctacagtatttcatacccgcactgagctag

SEQ ID NO: 28962 - DNA, 780 bp, Artificial Sequence
  Description of Artificial Sequence: Synthetic coding sequence
atgatcgctaagctggctaaaacatgtacactgcggattagccctgacaagctgaacttcatcttgtgtgacaaactggcaaatgggggtgtcagtatgtggtgcgaattggagcaggagaatttctttaacgaatttcagatggaaggtgtctctgctgaaaataatgagatatacctcgagctgactagcgaaaacctgtcccgagccctgaagaccgctcaaaatgcacgggctttgaaaatcaaattgactaacaagcattttccctgccttaccgttagtgtggagctgctttcgatgtcctcatcctcaaggatcgtaacgcacgatattcctattaaggtaataccccgaaagctctggaaagatctccaggagccagtcgtaccggaccccgacgtctccatctacctgcctgtgcttaagaccatgaaatccgtcgtcgagaaaatgaagaacatctctaaccacctcgtgatcgaggccaacctcgatggcgaactgaatctgaaaattgagacggaactggtatgcgttacgacccatttcaaagaccttggcaatccccctctggccagcgagagtacgcacgaggacagaaacgtcgagcacatggcggaggtccacattgatattcgcaagctcctccaattcctggcaggccagcaagtgaatccaactaaagctctctgcaatatagtgaacaacaagatggtgcactttgacctcctacacgaggacgtgtccctacaatattttatccctgctctgtcctag

SEQ ID NO: 28963 - DNA, 2130 bp, Artificial Sequence
  Description of Artificial Sequence: Synthetic coding sequence
atgtcattccctaaagctccccttaagcgctttaacgacccgtctggctgtgctccatctcctggcgcttatgatgttaaaacactggaagtcctcaaggggcctgtgagcttccagaagtcccagagatttaagcagcagaaagaatctaagcagaatttaaacgttgacaaagataccacgctgcccgcatccgctcgtaaggtcaaatcctccgaatcaaaaatccgagtgcttctgcaggagagaggggcacaggaccggaggatccaagatctcgagacggaactcgaaaagatggaagcgagactgaatgcggctctgcgcgagaagacaagtctgagcgccaataatgcgactctagaaaaacaactgatagagctgacacggaccaatgagctgctcaaatcaaagttcagcgagaatggcaatcagaagaatctccgcattctgagcctggagctgatgaaactgcgtaataagagggaaaccaaaatgcgaggaatgatggccaaacaagagggaatggagatgaagcttcaggtcacccagagatcacttgaagaatcccaaggtaaaatcgcccagctggagggcaaactcgtgagtatcgaaaaagagaaaatagacgagaaaagcgaaacagagaaactgctggaatacatcgaggagatctcgtgcgcctcagaccaggttgagaagtacaagctggacatcgctcagctggaagaaaatctgaaggagaaaaacgacgaaatcttatcactcaaacaatccctcgaggaaaatatcgtcatactgtctaagcaggtggaggatttgaacgtgaaatgccagctgctggagaaagaaaaagaggaccatgtgaatagaaaccgcgagcacaatgaaaacttgaacgccgagatgcagaacctgaagcagaagtttatcctcgagcagcaggagagggagaagctgcaacagaaagagctgcagatcgatagtctactgcagcaggagaaggaactgagttcgagtctgcaccagaagttatgttcgttccaggaggagatggtcaaagaaaaaaatttattcgaagaagagcttaagcagacactcgacgagctcgacaaattgcagcagaaggaagagcaggcagaacgactggttaaacagctcgaggaggaagccaaatcccgcgcagaggaattgaaactgctggaggagaaactcaagggcaaggaggctgaactagaaaaatcctctgctgcacatacccaggctacgttgctgttacaagagaagtatgatagcatggtgcaaagccttgaagacgtaacagcccagttcgaatcttataaagcactgactgcctccgagatcgaggatctcaagctcgagaattcctcactgcaagaaaaagctgccaaagcaggtaaaaacgcggaggacgttcagcaccaaatcctggcaacggaatccagcaaccaggagtatgtgagaatgctccttgatctccagacaaaatcagctctgaaagaaacagagatcaaggaaattaccgtgagttttctgcaaaagatcaccgatctgcagaaccaacttaagcagcaggaggaggacttcaggaagcaactggaggatgaagaaggtagaaaggctgagaaggagaataccactgcggaactcaccgaggaaatcaacaaatggcgtctcctctacgaggagctttataacaaaaccaagcccttccaacttcagctcgatgcctttgaagtcgagaagcaggcgttacttaatgagcacggagcggcacaggaacagctcaacaaaatccgcgattcttacgcaaaactgctcgggcaccagaacttgaagcagaaaattaaacatgttgtcaagctgaaagacgaaaattcacaactgaaaagtgaagtcagtaagttaagatgccaattagcgaagaagaagcaatctgagacgaagttacaagaggaacttaacaaagtgcttggaatcaagcactttgatccttctaaagcttttcaccacgagtcaaaagagaactttgctctcaagacaccactaaaagagggcaacactaactgttatcgggctcctatggagtgtcaagaatcctggaagtag

SEQ ID NO: 28964 - DNA, 2175 bp, Artificial Sequence
  Description of Artificial Sequence: Synthetic coding sequence
atgtcctttccaaaggctccactgaagcgcttcaacgacccatctgggtgcgcaccctcaccaggcgcttacgacgtaaaaacactggaggtactcaagggacctgtgtctttccaaaagagtcagagattcaagcaacagaaagagtcaaagcagaacttgaacgttgataaggacaccacactccccgcatccgcaagaaaggttaaatccagcgaatctaaggagtctcaaaagaatgataaagatctcaaaattctggaaaaggagattcgtgtcctgctgcaggagagaggcgctcaggatcgtcgtattcaggacctggaaactgagctagagaaaatggaagccagactgaacgccgcactaagggagaagaccagcctgtccgcaaacaatgcaaccctcgagaaacagctcattgagctgacccgcaccaatgagctgttgaagagtaaattttcagaaaatggcaatcaaaaaaacctgagaattttgagtctcgagctaatgaaacttcgaaacaagcgagagaccaagatgcgaggcatgatggctaaacaagaagggatggaaatgaaactgcaagttacccaacgctccctggaagaatcgcaagggaagatcgcccaattagaaggaaagttggtttcaattgaaaaagaaaaaatcgacgagaaatcagaaacggaaaaactcctcgaatacatagaggaaatcagctgtgcgagtgaccaagtcgagaaatataagctcgatatcgcccagctggaagagaatctgaaagaaaaaaatgatgagattctcagccttaagcagtctcttgaggagaatatcgtgatcctttccaagcaggtcgaagatctcaacgttaagtgccagctgttggagaaagaaaaagaagaccatgttaaccggaacagggagcataacgagaacttgaacgcggagatgcagaacctcaaacagaagttcatcctcgagcagcaggagcgagagaaactgcaacagaaggagcttcagatcgattctctcctccagcaggagaaagagctctcctcctccctccatcagaaactgtgttccttccaggaagaaatggtgaaggagaagaacctctttgaagaagagctgaagcagaccctagacgaactagataagctgcagcagaaggaagaacaggccgaacgcctcgttaagcagctggaagaagaggccaaatcccgcgctgaagagcttaagttactagaggagaagctgaagggaaaagaggcagaattggagaagagtagtgccgctcatacacaggccaccctgcttctccaggagaagtatgactcgatggtgcagagtctcgaagatgtcacagcccaattcgaatcttataaggccctcacagcatccgaaattgaagatctaaagttggaaaattctagcctccaagagaaggcggctaaagccggtaagaacgcagaggacgtgcaacatcaaatccttgcgacagaatccagtaaccaagagtacgtgaggatgctgctcgatcttcagaccaaatcagcactgaaggaaaccgagattaaagagataacagtgtcttttctgcagaagattaccgacctccagaatcagctcaagcagcaggaggaggactttagaaagcaactcgaagatgaagagggcaggaaggccgaaaaggaaaacacgaccgctgaactgaccgaggagatcaataaatggcggttactgtacgaggagctatataataagaccaagcctttccagctgcaactggatgcatttgaagttgagaaacaggctctgctgaatgagcacggggctgcgcaggagcaactgaacaagatcagggactcttatgccaaactcctcgggcatcagaacttgaagcagaagattaaacacgtcgtcaaactgaaggatgagaactcccaactgaaatccgaggtgagcaagctgcggtgccagctggctaaaaaaaagcaatccgaaaccaagctgcaggaggagctcaacaaggtactggggattaaacactttgatccttctaaggcattccatcatgaatctaaagagaacttcgccctgaagactccactgaaggaagggaacaccaattgttatcgggcacctatggagtgccaagaatcatggaagtag

SEQ ID NO: 28965 - DNA, 2178 bp, Artificial Sequence
  Description of Artificial Sequence: Synthetic coding sequence
atgtctttccccaaggccccactgaaaagattcaatgatccctctgggtgtgctccttctccgggtgcctacgatgtaaagaccctggaggtcttgaaaggtcctgtctctttccaaaagtctcagcgttttaaacaacaaaaagagagtaaacagaacctcaacgttgataaggacacaacactgcctgcctctgcccgtaaagtgaaatcttctgaatcaaagaaggaaagccagaagaacgacaaagacttgaagattctggagaaggaaattcgcgtgctgctacaggaacggggagcccaagatagaagaattcaggacctggaaacagagctggagaaaatggaagctaggttgaatgctgcactgcgggagaagaccagtctgtcggctaacaatgccacgttggaaaagcagctgatagagctcacacgcacaaacgagcttctcaaatctaagttttcagaaaacggaaaccagaagaacttaagaattctgtcccttgagttgatgaaactgaggaacaaaagagaaaccaaaatgcggggtatgatggccaagcaggaggggatggagatgaaactccaggtgacacaacgatctttagaggagtctcagggtaagattgcccagctcgagggtaaactcgtgagcattgagaaggagaaaatagacgagaagagcgagactgaaaagctgctcgagtacattgaggagataagttgtgcatccgaccaggtagaaaaatacaaacttgacatcgcccagctggaggagaatctgaaagagaagaatgacgagattctgtccctgaaacagagccttgaagagaacattgtcatcttatccaagcaggtcgaggatctgaacgtgaaatgccagctccttgagaaggagaaagaggaccatgtcaaccgtaatagggagcataatgaaaacctcaacgctgaaatgcagaatcttaagcagaaattcatcctagaacagcaggaacgggaaaaacttcaacagaaggagctgcagatcgatagtctgctgcaacaggagaaagagcttagcagcagtctccaccagaagttgtgtagttttcaagaagagatggtcaaggagaagaatctgtttgaagaggaactgaaacagacgctcgatgagttggacaaactacagcaaaaggaggaacaggccgagagacttgtaaagcagctggaagaagaggcaaaaagtagagcggaggaactcaaacttctggaagagaaattgaaaggtaaagaggccgagctggagaaatcgtccgccgctcatacacaggccacactgctcttgcaagagaagtacgattccatggtacagtcacttgaagacgtcaccgcacagtttgagtcttacaaagccctcacagcctccgagatagaggatctgaagctggagaattcttccttgcaggagaaagcagcgaaggcgggtaaaaatgcggaagacgttcagcatcaaattcttgccacggagagctctaaccaggagtacgttaggatgctactggacctacagactaagagtgcactgaaagagactgagatcaaggagattaccgtgagtttcctccagaagattactgacttacaaaaccagttaaagcagcaagaagaagactttcgcaagcaactggaggatgaggaaggccgaaaggctgaaaaagagaatactaccgccgagttaactgaggagatcaacaaatggcggctgctgtatgaagaactttacaacaaaaccaagccttttcagctgcagctagatgccttcgaagtggaaaagcaggcactcctgaacgaacacggcgcagcgcaggagcagttgaacaagatcagagatagttatgctaaactgttaggccaccagaacctgaagcagaagatcaagcacgtcgtgaagcttaaggacgaaaatagccagctcaagtctgaggtcagcaagctccgatgtcagctagcaaagaaaaagcagagcgagacaaaattgcaagaggaattaaacaaggtactgggtatcaagcacttcgacccatcaaaagcatttcatcacgaatccaaggaaaattttgcactgaaaaccccactaaaggaggggaacacaaattgctaccgagcacccatggagtgccaggagtcctggaagtag

SEQ ID NO: 28966 - DNA, 2106 bp, Artificial Sequence
  Description of Artificial Sequence: Synthetic coding sequence
atgtcgtttcccaaagcgccactgaagaggtttaacgatccaagcggctgcgcaccaagccccggtgcatatgatgttaaaacgttggaggtgctgaaaggaccggttagtttccagaaaagtcagcggttcaagcagcaaaaagagagcaagcaaaatttaaacgtcgataaagatacaactctgcccgctagcgccaggaaggtaaagagctccgagtcaaagaaggaatcacagaagaacgataaagaccttaagatcctggaaaaggagatcagagtactgctgcaggaacggggagctcaagatagacggatccaagatctcgagaccgagctggaaaaacagttgattgaactgacccgcaccaatgagctgctgaaatccaagttcagcgaaaacggaaaccagaagaatttgcggattctgtcccttgaacttatgaaactgcgcaacaaacgggagacaaagatgcgcggaatgatggccaagcaagaggggatggagatgaagctgcaggttacgcagaggtccctggaagagtcccagggtaaaatagcgcagttggaagggaaattagtaagcatcgaaaaagagaagatcgacgagaagtccgaaactgagaagcttctagaatacatcgaggaaatttcgtgtgcctcagaccaggtggagaaatataaactggacattgctcaactggaagagaacctgaaagaaaaaaacgacgaaattctctcattgaaacagagtctcgaagagaacattgtaatactgagtaagcaggtagaggacttgaacgttaaatgccagcttctcgaaaaagaaaaagaggatcatgtcaaccgcaacagggaacataacgaaaatctaaatgcagagatgcagaatctaaagcagaagtttattctcgaacagcaggaacgggagaaactccagcagaaagagcttcagatcgactccttgctccagcaggagaaagagctctcttcctctttgcaccaaaaactgtgctccttccaggaagaaatggtgaaagagaaaaacctgtttgaggaggagttgaagcagactttggacgagttagacaagctccagcaaaaggaggaacaggccgagaggctcgtgaagcagctggaagaagaagcaaaatccagggcagaagagctgaaactcctcgaggagaaactcaagggtaaggaggcagagttagagaagtccagcgccgctcacactcaggcgaccttgctgctacaggagaagtatgacagtatggtccaatctctggaagacgtgacggcccagttcgaatcatacaaagctctcacagcatccgagattgaggatttgaagctggaaaattcttcacttcaggagaaggctgctaaagccggaaagaacgccgaagatgtccagcaccaaatcctggctacagagtctagcaaccaggaatatgtacgcatgctcttggatctgcagaccaagtccgccctgaaggagaccgaaattaaggaaattaccgtgtcattcctccagaagatcaccgatctccagaatcagctgaaacaacaagaggaggatttcaggaaacagctggaggatgaggaaggcagaaaagctgagaaggagaataccacagccgaattgacagaagagatcaataagtggaggctcctttatgaggagctctataataaaacgaagccgttccagctccaactggatgccttcgaggtggaaaagcaagccctcctcaacgaacacggagccgctcaagagcagctgaataagatacgtgactcttatgctaagctgttgggccaccagaatttaaagcagaagattaagcatgtggtgaagttgaaagacgagaacagccaactaaaatcagaggtgtctaagttaagatgccagcttgcaaagaaaaagcagtccgaaactaaactccaggaggaattaaataaggtcctcggcattaagcattttgacccctccaaagctttccaccatgaatcaaaagagaactttgcattaaagacaccacttaaggaggggaatacaaactgctatagagcgcctatggagtgtcaagaaagttggaaatag

SEQ ID NO: 28967 - DNA, 1917 bp, Artificial Sequence
  Description of Artificial Sequence: Synthetic coding sequence
atgacactgttgatcagagtgctgcttcaggagcggggagctcaggatcggcgaatccaagatctggagacagagctggagaagatggaagcacgcctgaatgctgctttgagagagaaaaccagcttgagtgctaacaacgccactctggagaagcagctgatcgagctaaccaggactaacgagctcctgaagtcaaagttctcagagaacgggaatcagaagaacctgagaatcctatccctggagctgatgaagctcaggaataagcgcgagactaaaatgcgcggaatgatggcaaagcaagagggaatggagatgaagctgcaggtcacccaacgctctctggaggagtcacagggcaagattgcgcagctggaaggaaagctggttagcattgaaaaggaaaaaattgacgagaaaagtgaaaccgaaaaactactggagtacattgaagagatttcatgtgccagtgaccaggttgagaaatataagctagacattgctcagctggaggagaacctcaaagaaaagaacgatgaaatcctttcattgaagcaaagccttgaagagaatatcgtgatcttgagcaagcaggttgaagacttgaacgtgaagtgtcagctgctcgagaaggagaaagaggaccatgtgaacaggaatcgtgagcataacgaaaatctgaacgccgaaatgcaaaacctgaagcagaagttcattctggaacagcaggaacgcgaaaaactgcagcagaaagagctgcagatcgattcgcttcttcagcaggagaaggagctgtcgagctcactccaccagaaactgtgctccttccaggaggaaatggtcaaggagaagaaccttttcgaagaggagttaaagcaaacgctggatgagttggacaaattgcagcagaaggaggaacaggctgagcggttggttaagcagctggaagaagaggctaaatcgcgggctgaggagctgaaactgctcgaggagaagctgaaagggaaagaggctgagctcgagaaatcttctgccgctcatacacaggccaccctactgctccaagaaaaatacgacagtatggtgcagagtctcgaggacgtaaccgcccagttcgagtcatacaaggcgcttacagcgagcgagatcgaagaccttaaactggagaacagtagcctccaggagaaggctgcaaaagccggtaaaaacgccgaggacgttcagcaccagattttggcgaccgaaagttcaaatcaggagtacgttcgcatgctgttggatctccaaactaagagcgccctgaaagaaactgagattaaagagattacagtctcctttctgcagaagataaccgacctacagaaccagctcaaacagcaggaggaagatttccgaaaacagctggaagacgaagaaggaaggaaagccgagaaggaaaacacaactgcagagttgacagaagagataaataaatggcgcctactctacgaagaactttacaacaagactaaaccgtttcagttgcaacttgatgccttcgaagtggaaaagcaggctctgctgaatgaacacggcgctgcacaggagcagttgaacaagatccgggatagctatgccaagctgctcggccatcagaacctgaagcagaagataaaacatgtcgtgaagctgaaagacgagaatagccaactgaagagcgaggtgtctaaactcagatgccagctagcaaaaaagaaacagagcgagactaaactccaggaggagctgaataaggtcctcggaattaagcactttgacccgtctaaagccttccatcatgaatccaaggagaattttgccctgaaaactcctctgaaggaaggcaataccaattgctaccgggcacccatggagtgccaggagagttggaagtag

SEQ ID NO: 28968 - DNA, 996 bp, Artificial Sequence
  Description of Artificial Sequence: Synthetic coding sequence
atgagttttcccaaggcgcctctaaagcgttttaacgatccctccggttgcgccccaagtcccggagcttacgatgtcaaaaccctggaagttctcaaaggtcccgtatcatttcagaagagtcagaggttcaagcagcagaaagaatccaaacagaacctgaacgttgataaagatacgactttacccgcatctgcaaggaaagtgaagtctagcgaaagcaaaataagagtgctgcttcaagaacgaggggcacaagacaggagaatccaagacctggagaccgaattggagaaaatggaagctcgcctcaatgcagccctgcgtgagaagacctcactcagcgccaataatgccaccctggagaaacagctcatcgagctgacaaggaccaatgagttactgaagtcaaaattcagcgagaacggtaatcaaaaaaacctgagaatcttatcactggagctcatgaagctgagaaataagagagagaccaagatgagaggcatgatggctaagcaggaggggatggaaatgaaacttcaagtcacgcagagaagcctcgaggagagtcaggggaagattgcgcagctcgagggtaaactggtgagtatagaaaaggagaaaatagatgaaaaaagcgaaaccgagaagctcctggagtacattgaagaaatttcatgtgcttccgatcaggttgagaaatataagctggatattgcccagctggaagagaatttaaaagagaaaaacgacgagatcctgagcctgaagcaaagtctcgaggagaacatagtcatactgagcaagcaggtggaagaccttaacgtcaagtgccagctcctggaaaaggagaaggaggatcacgttaataggaaccgtgagcacaatgaaaacctgaatgcggaaatgcagaatttgaaacagaagtttatcctggagcagcaggagagggaaaaactccagcagaagaagaaacaaatgcgtcgcaaaaaatag

SEQ ID NO: 28969 - DNA, 537 bp, Artificial Sequence
  Description of Artificial Sequence: Synthetic coding sequence
atgcacgtgaacggcaaggtggcattggtaactggtgcggctcagggaatagggcgtgcttttgcagaggcacttctcttgaagggcgctaaggtcgcgctcgttgactggaacttagaagccggtgtacagtgcaaggccgctctcgacgaacaattcgagcctcagaaaactctcttcattcaatgtgacgtcgccgaccagcaacagctgagagatacatttcgcaaggtcgtagatcacttcgggcgtctcgacattctagtgaacaatgccggagtcaataacgaaaaaaactgggaaaagacactccaaataaacctcgtttcagtgatttccggtacctatttggggttagattacatgagcaagcagaatggaggagaaggcggtatcatcatcaacatgtctagtctggctggtctgatgccagttgcacaacagcccgtgtactgcgccagcaagcatggcattgtgggctttactcggtccgcagcaccaaccatcgactgccagtggatagacaacacccattag

SEQ ID NO: 28970 - DNA, 801 bp, Artificial Sequence
  Description of Artificial Sequence: Synthetic coding sequence
atgcacgtgaacggaaaagtcgccctcgtgacgggggctgcgcagggcattggtagggcctttgcggaggccctcctcctcaagggtgccaaagtagccttagtcgattggaacttggaggctggggttcaatgcaaggccgctctcgatgaacagtttgagccccagaagaccctcttcattcagtgcgacgtcgctgatcaacagcagctgcgcgacacctttagaaaagtcgtggaccacttcggcagacttgatatactggtaaataacgccggagtcaataacgaaaaaaattgggagaaaaccctgcagatcaacctcgtgtctgtgattagtgggacctatttgggactggattatatgtcaaaacagaacggcggagaaggtggtatcattattaacatgagtagcctggctggtcttatgccagtcgctcagcagcccgtttattgtgcctcaaaacatggaattgtgggctttactcgttctgccgcattggctgcaaacttgatgaactctggtgtacgtcttaatgccatatgtcctggctttgtaaacaccgctattttagagagcattgaaaaggaggaaaacatggggcagtatatcgaatataaggaccatattaaggacatgataaaatactatggaatcctggaccctccgttgattgcaaatgggctgataaccctgatcgaggatgacgctctgaacggagctatcatgaaaatcactacaagcaaaggaatccactttcaggactacgatactacgcctttccaggctaagacccagtag

SEQ ID NO: 28971 - DNA, 438 bp, Artificial Sequence
  Description of Artificial Sequence: Synthetic coding sequence
atgagtaagcagaatggcggtgagggcggaatcataattaatatgtcctccttggccggactgatgcccgtcgctcaacaaccagtgtactgtgcctctaagcatggcatcgtcgggtttaccagaagcgcggcacttgccgcaaacctaatgaatagcggagtgcgcctgaacgcgatctgtcctggctttgtaaatacagcgatcctcgagtctatcgagaaggaagaaaacatgggtcagtatatcgagtacaaagaccacataaaggatatgattaagtactacggtatactcgatccaccgctcatcgccaatggactcatcactcttatcgaggatgatgctctgaacggcgcaattatgaagattactacaagtaaaggcatccatttccaggactacgacacaaccccatttcaggccaaaacccaatag

SEQ ID NO: 28972 - DNA, 438 bp, Artificial Sequence
  Description of Artificial Sequence: Synthetic coding sequence
atgagtaagcagaacggcggagaaggcggaattattatcaacatgtcatctctggcaggcctgatgcctgtggcccaacagcccgtatactgcgctagcaagcatgggatagtgggatttacccgttcggccgctctggcagccaacctgatgaacagcggtgtgcggctgaatgctatctgcccgggatttgtcaatacggccatactcgagtcaattgaaaaggaggaaaacatgggtcagtatatcgagtataaggatcacattaaggacatgattaaatactacggaatactggatccgccacttattgctaacggcttgatcacactgattgaagatgatgcacttaacggcgctattatgaagatcaccaccagtaagggaattcactttcaggattatgatacaactccgttccaggctaagactcagtag

SEQ ID NO: 28973 - DNA, 432 bp, Artificial Sequence
  Description of Artificial Sequence: Synthetic coding sequence
atgcacgtgaatggtaaggtcgctttggttaccggtgctgcccagggcataggtcgcgctttcgccgaagccttgcttctgaaaggcgctaaggtcgctcttgtcgactggaatctggaggctggagtgcagtgcaaggccgctctagacgagcagttcgagcctcagaagacactgtttatccagtgcgatgtggccgaccaacagcagctgcgggacacctttaggaaagtagtagaccattttggcaggcttgacatcctcgttaacaacgctggcgtgaacaacgagaaaaactgggagaaaacattgcagatcaatctggtttcagtaatttccgggacttatctgggccttgattacatgagtaaacaaaatggaggagaagggggtatcatcattaatatgtcatctctggcagcccaccattag

SEQ ID NO: 28974 - DNA, 2202 bp, Artificial Sequence
  Description of Artificial Sequence: Synthetic coding sequence
atgactttcccagaggcggatatactgttgaagtcgggtgagtgcgccggacagaccatgctggatacaatggaggctccaggacattctcggcaactgctgctgcagctgaacaaccagagaactaaaggcttcctgtgtgatgtgattattgttgttcaaaatgccctgttcagggcacacaagaacgtgctggccgcatcatctgcatatctgaaaagtttagttgtccacgataacctgctgaatctggaccatgacatggtgtctcctgctgtgtttagactggttctcgatttcatttacacaggacggttggccgatggcgcagaggccgcagcggctgctgccgtggccccaggagccgagccttctctgggggcagttctggccgctgcctcataccttcagatcccagatctagtggccctgtgtaagaaacggctgaagcgtcacggaaagtactgtcacctgcgaggaggcggaggcggaggtggcggatatgcaccatacggccgaccaggtcgaggtttgagggctgccactcccgtgatccaagcatgctatcctagcccagttggacctcctccccctccagctgccgaacccccttctgggccagaggcagcagttaatacccactgcgcagaactgtacgcctcaggccctggacccgctgcagctctttgcgccagcgagcggagatgttcccctctctgtggactggacctctcaaagaaatctccccctggatccgccgctcccgaacgaccactggcagagcgagaacttcctcccagacctgatagtcccccatcagctgggcctgccgcatataaggagcccccattggccctgccgagtcttccgcctctcccatttcagaaactggaagaggctgccccaccctccgacccattccggggtggtagtgggtcaccaggcccagaaccaccaggcaggcccgatggaccatctttgctctataggtggatgaagcatgaacctggcttgggctcttatggagacgagttaggtcgagaaaggggctcaccttctgaaaggtgcgaggagaggggaggtgatgctgccgtgagcccgggagggccaccgttgggcctggccccacccccaagatacccaggatcactggatggcccaggggctggtggggatggggatgattacaaatcgtcttccgaggaaaccggatcgtctgaggacccttctccccctggaggacaccttgagggatacccatgcccccatcttgcgtatggggagcccgagtcctttggggacaacctttatgtctgtatcccatgtggcaaaggcttcccatccagcgagcaattgaacgcacatgtcgaggcacacgtggaggaggaggaagcgctgtatgggagggcagaagcagctgaggttgccgcaggtgcagccggtttaggccctccattcggtggcggaggcgacaaggtcgccggagctccaggcggattaggcgaactgctgcggccatatcgatgcgccagttgtgacaaatcctacaaggaccctgccaccttaaggcaacacgaaaagacgcactggctaacccgcccttacccttgtactatttgcgggaagaagtttactcagcgcggaactatgactcgacacatgcgcagccacctggggctcaaacccttcgcgtgcgacgcatgcggtatgcggtttacgaggcagtacagactcaccgaacacatgcgcattcactccggcgaaaaaccttacgagtgccaggtttgtggcggaaagttcgcccagcagaggaatctcattagtcatatgaaaatgcatgcagtgggcggagccgcaggagctgccggtgccctggcaggccttggtggcctgcctggggttcccggaccggacgggaaaggcaaactcgactttcccgagggagtgttcgctgtggccagacttaccgctgagcagttatcccttaagcaacaggacaaggcggctgcagccgagcttttagcacaaactacacatttcctgcacgaccccaaggtggccctggaatcactgtaccccctggctaaattcaccgccgagctggggctgtctcctgataaggccgctgaggtactgtctcagggggcacacctggccgctggtccggatgggaggaccatcgatcggttctctccgacctag

SEQ ID NO: 28975 - DNA, 2145 bp, Artificial Sequence
  Description of Artificial Sequence: Synthetic coding sequence
atgttggatactatggaggcacctggacactctagacagctgctgctacagctaaacaaccagcggacgaaagggtttttgtgtgatgtcataatcgtcgtgcagaacgcgttattcagggcgcacaaaaacgttctggctgcttccagcgcctacctgaaatcactggttgtccacgacaatctcctaaaccttgaccacgacatggtttcgccagctgttttcagactggtcttggatttcatatacaccggccgtctcgcagatggcgcagaagctgctgccgcagctgcagtcgcccctggagcagagccttccctgggcgcagtcctggccgcagcgagctacctccagatccccgacctggtggcactgtgcaagaaaaggctcaaaaggcatggtaaatattgtcacctgcggggtgggggaggaggtgggggtggctatgctccctacggccgtccaggtcgtggcctacgggcagccacaccagtaattcaggcttgctacccctcccctgttggccctcctcccccaccggcagctgagcccccttcaggcccagaagctgccgtgaatacccactgcgcagagctgtacgcctccggccctgggcctgctgctgctctctgcgccagtgaaaggcggtgctctccactgtgtgggttggatctatccaagaagagtccccctggttccgccgcaccagagaggccgctcgccgagcgcgaactgccacccaggcccgattctccaccctccgctggacccgcagcctacaaggagccacccctcgcactgccctccctgccgcctctgccttttcagaagttggaggaagcagcccctcccagtgacccgttccgaggtggatcgggatcccccggacctgaacccccaggaaggccggatggtccctcccttctctaccggtggatgaagcatgagcctggactgggtagttacggagatgagctgggtcgcgaaagagggtccccaagtgaacgttgtgaggagaggggcggtgatgcggcagtgagcccgggaggtccacctctgggcctggctcctccaccacgatatcctggctcgctcgacggcccaggtgccggtggagacggagatgattacaagtcttctagtgaagagaccggttcctcagaggacccgagtcctcccggagggcatttagagggatatccatgcccacatctggcctacggggaaccagaatccttcggcgacaacctgtatgtgtgcatcccatgcggcaagggctttccctcctcggagcagttgaatgcgcatgtcgaggcgcatgtggaggaggaagaagccctgtatgggagggcagaggctgcggaggtggctgctggcgcagccggtctcgggccaccctttggcggaggaggcgataaagttgctggggctcctgggggtctgggggagctgctgcgtccctaccgatgcgctagctgcgataagtcttacaaggaccccgctacgctccgtcagcacgagaagactcactggctgacgcgcccttatccgtgtactatttgcggcaagaaatttacccagaggggtacaatgacgagacacatgagatcccacctggggttgaagccattcgcatgtgacgcttgtggcatgaggttcacacgacagtatagactcactgagcacatgcgcatccactccggcgagaagccttacgaatgccaggtgtgcggaggcaaattcgcccagcaaagaaacctgatatcccacatgaaaatgcacgccgttggcggtgccgcaggcgctgccggagccctggccggtttgggcggtttgcccggagtccccggtcccgatggcaagggcaagctcgattttcccgagggagttttcgccgtggccagacttaccgcagaacaactatccttaaaacaacaggataaagccgctgccgctgaactgctcgcccaaacaacacattttctccacgacccaaaagtggcacttgagagtttgtacccgcttgctaaattcacagctgagttggggttgtcgccagacaaggccgctgaagtcctttcccagggcgcacatctggctgcaggaccagacgggaggactatcgataggttctccccaacatag

SEQ ID NO: 28976 - DNA, 2208 bp, Artificial Sequence
  Description of Artificial Sequence: Synthetic coding sequence
atggagggcgctggcggagcaaacgataagaagaaaatttcatccgaacgacggaaagaaaagtcccgcgacgcagcgaggagccggaggtcaaaggagtcggaagtcttctatgaactggctcaccagctgcccctgcctcataacgtgagcagccatcttgacaaagctagcgtgatgcgattaaccatttcctatttacgcgtacgaaaactgttagacgccggagatctggacatcgaagacgacatgaaagcccagatgaattgtttttacctgaaagccctcgacggattcgtgatggttctgacagacgatggggatatgatttatatttctgacaacgtcaacaaatatatgggcctcacacagttcgagctgactggtcattctgtgttcgactttacacatccctgcgatcatgaggaaatgcgcgagatgctcacccaccgcaatggtctggtgaaaaaaggtaaagaacagaatacccagaggtcattctttctgagaatgaagtgcactttaacctcacgtggtcgtaccatgaacatcaagagtgctacctggaaggtgctccattgcaccggacacattcacgtgtacgatacaaactccaatcagccacaatgcggttataaaaagccacccatgacttgccttgtccttatttgcgagccaataccacacccatccaacatcgagattcctctcgattcgaaaacgtttctgtcacgacacagtctggacatgaaatttagctactgtgacgagcgcatcaccgaactcatgggatatgaacccgaagagctgttggggcgaagcatctacgaatattatcatgcactggactcagatcaccttactaagactcatcatgacatgttcactaaaggacaggtgacaacagggcagtatagaatgctggccaagcgtggtggatacgtgtgggtagagacacaagcaaccgtcatctacaacaccaaaaattctcagcctcaatgcatagtgtgtgtaaactatgtggtttcaggtattattcaacatgacctgatctttagcctgcagcagacagagtgcgtcctgaagccggtcgagtctagcgatatgaagatgacacaactgttcacgaaggtggagagcgaggacacttccagcttgtttgataagctaaagaaagaaccagacgccctcacactcctggcccctgccgcaggcgatacaattatcagcctggattttggatcaaatgatactgaaacggatgaccagcagctggaggaggtccccctgtataatgacgtgatgttaccttcaccaaacgagaagctgcaaaacatcaatctcgcaatgtcgccacttcctacagcagaaacgccaaagcccctgcgcagtagtgcagatccggctcttaatcaggaggtggcactgaagcttgaaccaaatcctgaaagcctggagctcagtttcaccatgccgcagatacaagaccaaactccttccccttctgacgggagcacaagacaaagctccccagagccaaactcaccaagcgagtactgtttctatgtagactccgatatggtgaatgaatttaagctggagctggtggagaagctctttgcagaggataccgaggccaagaaccccttctctacacaggatacggacctggatctggagatgctggccccttatatacccatggatgatgattttcagttgcgctcgtttgatcaattgtcaccccttgaatctagctccgcttcacccgagagcgcttccccacagagcacagtcaccgtgtttcagcagacacaaatccaagagccaactgctaatgccacaacaactactgctaccaccgatgaactgaagactgtgactaaagaccgcatggaggatatcaaaatcctgattgcgtctccttcacccacacatattcataaagaaacaacatccgcaacgtcctcaccatatcgggatacgcagtccagaacggcatccccgaaccgcgcagggaagggcgtgatcgagcagacagagaaatctcatcctcgctcccccaatgtgttgtccgtcgctttgtcccaacggaccaccgttccagaagaggagctgaaccctaagattctggcactgcagaacgcacaacggaagcgcaagatggagcatgatggtagcctgtttcaagccgtgggaatcatttag

SEQ ID NO: 28977 - DNA, 2481 bp, Artificial Sequence
  Description of Artificial Sequence: Synthetic coding sequence
atggagggtgcaggcggagccaatgataagaaaaagataagctctgagcgaagaaaggaaaaaagtcgagacgcggctcgcagtaggagaagtaaggagtcagaggtgttctacgaattggcccatcagctacccctgccacacaacgtgtctagtcacctggataaagcttccgtgatgcgattaacgataagctatctcagggtgcggaagctgcttgacgctggcgatcttgacattgaagatgacatgaaagcccagatgaattgtttttacctgaaagccttggacgggtttgttatggtactgacagacgacggcgacatgatctatatctctgataacgtaaataaatacatgggcctgacgcagttcgaactaacgggacatagtgttttcgattttactcacccttgcgatcacgaagaaatgcgcgaaatgctgacacacaggaacggtttagttaaaaaagggaaggaacagaacacacaacgttccttcttcctgcggatgaaatgcacacttacgtcacgaggacggacgatgaatatcaagtcagcgacttggaaagttctgcattgcaccgggcacatacacgtgtacgataccaacagtaaccagccacagtgcggatacaaaaagcctcccatgacttgcttagtcctcatttgcgaaccaattcctcatcccagtaatattgagatccccctcgactccaagacttttttgagtaggcacagtctagatatgaaatttagttactgtgacgagcgcatcacagaactgatgggatacgagccagaggaacttcttgggaggagtatctacgaatactaccatgccctggacagcgatcatctcaccaaaacacaccacgacatgtttacaaagggtcaggtcacaaccggacagtacagaatgctagctaaacgagggggttatgtgtgggtggagactcaggcaacggtgatctacaacacaaagaattctcagccccagtgtatagtctgtgtcaattacgttgtctcgggtatcattcaacacgacctgatcttcagcttgcagcagaccgaatgcgtgctaaagcctgtcgaaagctccgacatgaaaatgacccagctctttacaaaggtcgagagcgaggacacaagcagtctttttgataaactgaagaaggagcctgatgcactaactctcctcgcacctgccgcaggcgataccattatctcactcgacttcggtagcaacgatactgagactgacgaccagcagctggaggaggtccccctatacaatgatgtcatgctcccatctccgaatgagaaattacaaaacattaatctcgccatgtctcccttgcctacagcggaaacccccaagcctttgcggagttctgccgacccagctctgaaccaagaggtggctttaaagctcgagccgaaccctgagtcgctggaactttccttcacaatgcctcagatccaagaccaaacacccagtccttccgacggaagtacaagacagtcttcccccgagccaaatagcccgtccgagtactgtttctatgtggattctgacatggtgaacgaattcaagctcgagctggtggaaaagctttttgcagaagacactgaagccaaaaaccccttctccacacaggacacggaccttgacctggagatgctcgcaccctacataccaatggatgatgactttcagttgagatcattcgaccagttgtcgcccctcgagtcctccagcgccagcccagaaagtgcgtcgcctcagagtacagtgaccgtctttcagcagacccagattcaggagccgacagccaacgccactactacaactgctactaccgacgagctaaaaactgtcaccaaagatcgaatggaagatatcaaaatcctgatcgcctccccatcccctacccatattcacaaggagacgacttccgccacttcaagcccttacagagatactcaaagccgcacagcgtcccctaatcgagccggtaagggtgttatagaacaaactgaaaagagtcatccaaggagccctaacgttctgagcgttgctctctctcagaggacaactgttcctgaggaagagttgaacccaaaaatcttggctctccaaaatgcacagaggaagcgcaaaatggagcacgacggctctctgtttcaggcagtggggatcggcacactacttcaacaacctgatgaccacgcagccactacatctctctcatggaaaagggtcaagggctgtaagtcctctgaacagaatggaatggaacagaaaacgatcatcttaatcccctctgatctggcttgtcggctactgggccagagcatggacgaatccgggttaccccaactgacgtcctacgactgcgaagtgaatgccccaatccagggctcccgaaatcttctgcagggcgaagagctgctgcgagccttggatcaggtgaattag

SEQ ID NO: 28978 - DNA, 2304 bp, Artificial Sequence
  Description of Artificial Sequence: Synthetic coding sequence
atgaggctcaccatatcttacctccgagtgcgcaaacttctggatgccggtgacttagacatcgaagacgacatgaaagcgcaaatgaattgcttttacctgaaagctctggatggcttcgtcatggtgttgaccgatgatggcgacatgatttatattagcgacaatgttaataagtatatgggcctgactcagtttgagctgaccggacactcagtgttcgacttcactcatccgtgtgatcacgaagagatgcgcgaaatgctgacgcataggaacgggctcgttaagaaaggtaaagaacaaaatacgcagaggagtttttttctacggatgaaatgcaccctcacgtccagagggagaacaatgaatattaagtcggcgacatggaaggtcctgcactgcacagggcacattcatgtctacgataccaactccaatcagcctcagtgcggatataaaaaaccacccatgacgtgcctggtgctgatctgcgagccaattccccacccctcaaatatcgagattccactcgactctaaaaccttcctatcgaggcactcacttgacatgaagttctcatactgcgatgaaaggataacagagctcatgggctacgagccagaagaactattgggaaggagcatttatgagtactaccatgcactcgacagcgaccatttgaccaaaacgcaccacgacatgtttacaaagggccaggtcacaactggacagtaccggatgctggcaaaacgaggcggatatgtttgggtcgaaacccaagctaccgtgatctacaacactaagaatagtcaaccccagtgtattgtttgcgtaaactacgtagtgtctggcattatccagcacgacctgatcttctccttacagcagacagaatgtgttctgaagccagtggaatcttcagacatgaagatgactcagctttttacaaaagtagagagtgaagacacaagcagcctatttgacaaactgaagaaggagccggatgcacttacactgttggccccagcggcaggggatactattattagccttgactttggttccaacgacaccgaaactgatgatcagcaactggaagaggtcccgctgtataatgatgtcatgcttccctcaccaaatgagaagttgcagaacattaatctggctatgagtccattgcctactgcagagacccccaagcccttgcggagctctgctgaccctgcccttaaccaagaagtcgcattaaaattggagccaaatcctgagagtctcgagctgtctttcaccatgcctcaaattcaggaccaaactccatctccatctgacggctccacacgccagtcatcaccagagcctaactctccctccgaatattgtttttacgtggattctgacatggtaaatgaattcaagctggaacttgtggaaaagctcttcgccgaggataccgaagcaaaaaatcccttctcaacccaggacactgacctggatctcgagatgttagccccttatatccccatggatgacgactttcagctgaggagctttgaccagctgagcccacttgaaagcagcagcgcttcccctgagtctgcttcacctcaatcaaccgtgaccgtcttccagcaaacccagatccaggaacctactgctaatgctactactacaacagccacaactgacgagttgaagacagtcactaaggacaggatggaagacataaaaattttgatcgctagcccaagtcccacccatatccacaaagaaaccacttccgcaacgtccagcccttatagagacacccaatcaaggaccgcctcccctaacagggccggtaagggggtaatcgaacaaaccgagaaaagccacccacgctccccgaacgttctgtctgtcgctctgagtcagcgcacaacagtgcctgaggaggagcttaacccaaaaatcctggcccttcagaatgctcagagaaagagaaagatggaacacgacgggtccctctttcaggcggtcggtattggcacgttgctgcagcagcctgatgatcacgccgctacgacttctctgtcctggaagcgggttaagggctgtaaaagttccgaacagaacggcatggagcagaagacaataattctgatacctagcgatttagcctgtcggctgctgggccagtccatggacgagagcggactgccccaactgacttcctacgactgtgaggttaatgctcctattcagggctctcgcaatctgctgcaaggtgaggaactcctgagggcgctagatcaggtaaattag

SEQ ID NO: 28979 - DNA, 2484 bp, Artificial Sequence
  Description of Artificial Sequence: Synthetic coding sequence
atggagggagccggaggtgcgaacgataagaagaataggatttccagtgagagacgaaaagagaagtcccgcgatgctgccagatctcgaaggtcaaaagagtcagaagtgttctatgagctcgcccaccaactccctctgccgcataatgtaagttctcacctggataaagccagcgtgatgcggttaacgataagctacttgcgcgttcgcaagctgctggacgcgggagacctggatatcgaggatgatatgaaggcacagatgaattgtttttaccttaaagcactggatggattcgtaatggtcctaaccgacgatggcgatatgatatatatctctgacaacgttaacaaatacatgggattaacccagtttgagctaaccgggcattccgtgtttgatttcactcatccctgcgatcacgaggaaatgagagagatgttgacgcatagaaatggcttggtgaagaagggaaaggagcaaaacactcaaagatctttctttctccgtatgaaatgtaccttgactagtcgcggacgtaccatgaatatcaagagcgccacttggaaagtgctccactgcaccggacacattcacgtctacgacaccaactccaatcagccccagtgcggctataagaaacctcccatgacctgcctcgttcttatttgtgagcctattcctcacccctcgaatatcgagatcccactggactctaagacctttcttagccgtcacagccttgatatgaagttctcctattgcgatgaacgtatcacagaactcatgggatatgaaccagaagaactgctcggccgtagtatttacgagtactaccatgcgcttgatagcgatcacctcactaaaacccaccatgatatgtttaccaagggacaggtcaccactggccagtatagaatgttggcgaagcgcggaggctatgtgtgggttgagacccaagcaaccgtcatctacaacacaaagaattctcagccacagtgcatcgtttgcgtcaattatgtcgtgtctggtattatccaacacgatttaatcttctcactgcaacagacagagtgtgtactgaaacccgttgagtcatcggatatgaaaatgacccagctattcactaaggtcgagagcgaagatactagtagcctctttgataagttgaagaaggaacctgatgcactgaccttgctggcccctgcagctggcgatacaattatttccctggattttggaagcaatgatactgagacagatgaccaacaactcgaggaggtgccattgtacaacgacgttatgctgccttcgccaaatgagaagctgcagaacattaacctggcgatgtcacctttaccaaccgctgagaccccaaaaccattgaggagcagcgctgatccggcactcaatcaagaggtggctctgaagttggaacctaacccagaatcactcgagctatcctttaccatgccccagattcaagaccagacacctagcccatccgatggcagcaccaggcagtcttccccggaacccaactctccaagtgagtattgcttctacgtggacagcgacatggtcaacgagtttaaattggaattggtggagaaactatttgccgaagacacagaggcaaaaaaccccttctcaacacaggacacagatctagatctcgagatgctcgctccttatatccctatggacgatgattttcagttgagatccttcgatcagcttagtcccctagaatctagtagcgccagccccgaatctgcttctccccaatccacagtaacagtgttccaacagacccaaatccaggaaccaacagcaaatgcaaccaccactactgcaaccactgacgagttgaagactgtgacaaaggatcgaatggaagacattaaaatactgatcgcctctccaagtccaacacacatccacaaggaaacaacatcggcaacctcatctccgtacagggacacccaatccagaacggctagcccaaatcgcgctggcaaaggtgtcattgagcagacagaaaaatcacaccccagatcgccaaacgtgctgtcggttgccctctctcagagaacgaccgttccagaggaggaactgaaccctaagatcttagctttgcagaatgcccagaggaagcggaaaatggaacacgacgggtcgttgttccaggccgtgggcattggtaccctgctgcagcagccagacgatcatgcggctaccactagtctgagttggaaacgcgtgaagggatgtaagagtagcgaacagaacggtatggagcaaaaaactatcatacttattccgtccgatttggcttgccgcctgctgggacagtccatggacgaaagtgggcttcctcagctcacaagctacgactgcgaagtgaatgctcccatccaggggagccgaaacttgctgcagggggaagaattgttacgggctctcgatcaagtcaattag

SEQ ID NO: 28980 - DNA, 2553 bp, Artificial Sequence
  Description of Artificial Sequence: Synthetic coding sequence
atgagctcacaatgtaggtccctggagaataagtttgtgtttctcaaggaaggccttgggaactctaaacctgaagagctcgaagaaattagaattgagaacggccgtatatcctcggaaaggcgaaaggaaaagagcagagacgctgctcgaagtagaagaagcaaagaatcagaagtgttctatgagcttgcccatcagttaccgttgccccacaatgtctctagccaccttgataaggctagcgtgatgaggctaacaatttcttatttacgcgtgcgcaagctgctggatgcaggagacctggacattgaagacgacatgaaggcccaaatgaactgcttctacctgaaagccctcgacgggttcgtaatggtcctaacagacgacggagacatgatctatatctccgataacgtgaataagtacatggggttaacccagttcgagctcaccgggcattccgtctttgattttacccacccatgcgatcacgaagagatgcgtgaaatgcttacccatcggaacggcctcgtgaagaagggcaaggaacaaaatactcagcgaagcttctttctgcgcatgaaatgcaccctgacatcgaggggacgcacgatgaatatcaaatcggctacctggaaggtcctgcattgtacaggccacatccacgtctacgataccaactctaatcagcctcagtgtgggtacaagaagccccctatgacttgtctcgtcctgatttgcgaacccattcctcaccccagtaacatcgagatccccctagactccaaaaccttcctttcacgccactcgttggacatgaagtttagctactgtgacgaacggatcaccgaattgatggggtatgaaccagaggagctgctcgggcgatccatctacgagtactatcacgcactggattctgatcacctcactaaaacacatcatgacatgttcactaaggggcaggtaaccacaggccagtacagaatgcttgctaaaagaggagggtacgtgtgggttgaaacacaagcaacagtgatttataacaccaaaaacagccagccacagtgcatagtctgcgtcaactacgtggtgagcggtatcatacagcacgatctgatttttagcttgcagcagaccgaatgcgttctgaaacccgtggagtctagcgacatgaagatgacccagctgtttaccaaagtggaatccgaggatacctccagtcttttcgacaaactcaagaaggagcctgatgccctaacattactggcgcctgcagccggtgataccattattagtttggactttggcagtaatgataccgaaacggatgatcaacagctggaagaagtaccactgtataacgacgtgatgctgccatctcctaatgagaagctccagaacattaacctcgccatgtcgcctctgccaactgctgagacacctaagcctctgcgaagttcggcggatccggctctcaatcaggaagtggcactgaaactcgagcctaatccagaatccctggaattgtcattcactatgcctcaaatccaagatcagacaccttcaccctcggacgggtcaaccagacagagctcacctgagcccaactcgccatccgagtattgcttctatgttgacagcgacatggttaatgagttcaaactggaactggttgaaaaactgttcgctgaagacaccgaggccaagaaccctttctcaacgcaagacactgacctcgatctcgagatgttggcgccatacattcccatggacgacgattttcagctcaggagttttgaccaactgagccccctggagtccagtagcgcctcgccagaaagtgccagtccccagtctaccgtcacagtgttccagcagacacaaatccaggagccaactgccaatgccacaacaaccactgctacaaccgacgagctaaaaaccgtcacaaaggatcggatggaagatattaagatacttattgcatcccccagtccaactcacattcacaaggaaacaactagcgccacttcgagcccatacagagatacccagtctcggacagcaagccccaaccgcgcagggaagggcgtgatcgaacagaccgaaaaaagccaccctcggtctcctaacgtcctgtcagttgctttgtcgcagcgtacgactgtgcccgaagaagagttaaatcccaagatattggccctgcagaatgcccagcgcaagagaaagatggaacatgacggaagtctcttccaggcagtgggcattggcaccctcctccagcagccagatgatcacgccgcaacaacatcccttagctggaaacgggttaaaggttgtaaaagtagcgagcagaatggcatggaacagaagacaataattcttatcccaagcgaccttgcttgccggttacttggccagtcgatggacgagagcgggcttccccagttaacatcctacgactgcgaggtgaatgctccgattcagggttcccggaatctgctgcagggcgaagaactcctccgcgcattggatcaagtgaattag

SEQ ID NO: 28981 - DNA, 1734 bp, Artificial Sequence
  Description of Artificial Sequence: Synthetic coding sequence
atgaaattttcttattgtgacgaaaggattacggaactgatgggatacgaacctgaagagcttttgggcagatcaatctacgagtactaccacgcgctggatagtgatcacctcaccaagacgcaccacgacatgtttaccaagggacaagtaacgactggtcagtaccgcatgctagcaaaacgcggaggatatgtctgggttgagacccaggcaacggtgatttacaacactaagaatagtcagccccagtgcatagtgtgcgtgaattacgtcgtgtctggtataatccagcacgacttaattttcagcctccaacaaactgaatgcgttttgaaaccagtggagtcttccgatatgaaaatgacacaactttttacgaaggtggagtccgaggatacttcatcactcttcgataagttgaagaaagagccagatgccctcacactgctggccccagccgcaggggatacaatcataagtttggattttggcagtaacgacactgaaacagacgatcagcagctggaggaggttcccctgtacaacgacgtgatgcttccgagtcctaacgagaagctccaaaatatcaacctcgcgatgtctcctttgccgaccgcagagactcctaagcctctgaggtcttcggccgacccagccttgaatcaggaggtggccctcaagctggagcctaacccagagtccttggagctgagttttaccatgccccaaatccaggaccaaaccccctctcctagcgacggttcgacaagacaaagcagtcccgagccaaacagccccagcgagtactgcttctatgtcgattccgatatggttaacgaattcaaactggagttagtggagaagctgttcgcagaggatactgaagccaaaaaccccttttcaactcaggacacggacttggatctggagatgcttgctccttacatccccatggatgacgatttccagctgagaagttttgaccaactgagcccgctggagtcctccagtgcgtcgcccgagtccgccagtccccagtcgaccgtcactgtattccaacagacacagattcaggaacctacggctaatgccaccacgacgaccgcaacaaccgacgagctaaagaccgtgacaaaggataggatggaggatatcaaaatcttgatcgccagtcctagccccacacacattcacaaagagacaacaagtgctacttcctccccgtatcgggacacccagagtcggaccgcaagccccaatagagccggtaagggagtaatcgagcagacagaaaagtcacatcccaggtctcctaacgtcttgtcagtggctctgtcccagcggacaacggtgcctgaagaggagttgaatccaaaaatcttggcactgcagaatgcgcagagaaaacgtaagatggaacacgatggttccctcttccaagctgtgggcatagggactctgctccagcagccggacgatcatgctgctactacatccctatcttggaaaagggtcaaaggctgtaagagtagcgagcagaatggtatggaacagaagactattattctcatcccaagcgacctggcttgtcggctcctgggacaaagcatggacgagagcggccttccacagttgacatcgtacgattgcgaggtaaatgctcctattcagggtagtagaaatctgttgcagggggaggaactgctacgggctttggaccaagtcaactag

SEQ ID NO: 28982 - DNA, 2304 bp, Artificial Sequence
  Description of Artificial Sequence: Synthetic coding sequence
atgcgcttaacaatcagttacctgcgcgtccgcaaactgctggatgccggagacctggatattgaagatgacatgaaggcgcagatgaattgtttctatttgaaagccctggatggctttgttatggtcttaaccgacgatggggacatgatctatatttctgacaacgtgaacaaatatatgggactcactcaatttgagctgaccggccacagtgtattcgacttcactcatccgtgcgatcacgaggagatgcgggaaatgctcacacacaggaatgggctggtgaagaaagggaaggagcaaaatacgcaacgctcattttttctgagaatgaaatgcacacttacctcacgagggagaaccatgaatatcaagagcgccacatggaaggtattacattgcaccggacatatacacgtatatgatacgaattccaatcagccccagtgtgggtacaaaaaaccgcctatgacttgtctggttctgatttgtgagcctatcccccacccctcgaacatagagattccactggacagcaagacatttctgtcacgacattctctagacatgaaatttagttactgtgatgaaaggatcacggagctgatggggtacgaaccggaggagctgttaggccgttcgatttatgagtattaccacgcgctggacagcgatcacctgaccaagactcatcatgacatgtttaccaagggtcaggtgaccacaggacagtatagaatgctcgccaaacggggagggtacgtgtgggtcgagacacaggcaactgtcatttacaacactaaaaacagccagccacagtgcattgtctgtgtgaactatgtggtaagtggaatcattcagcacgacttaatcttctcccttcaacagacggagtgcgtgctgaaaccagtggaaagcagcgacatgaaaatgacacagctattcacgaaggtagagagcgaagataccagtagcctcttcgataaactcaagaaggaacctgatgcccttacactgctcgccccagccgcaggagataccatcatcagtctggattttggctccaacgatacggagacagatgatcagcagctggaagaggtgcctctctacaacgacgttatgctgcccagtccaaacgagaaactgcagaatatcaacttggcaatgtcccctttgcccactgctgagaccccaaaaccgcttcggtctagtgccgaccctgccctgaaccaggaggtcgctcttaaactggagccaaaccccgagtctttagagctaagtttcaccatgcctcagatacaggatcagactccttcaccaagcgacggctccactaggcagtcgtcacccgaacccaacagcccaagcgaatattgcttctacgtcgactcagacatggtcaatgaattcaaactggagctggtcgagaagctgttcgccgaggataccgaggctaagaacccgttttctacccaagacacagacttggacttggagatgctggcaccttatatccccatggacgacgactttcagttgcgttcgtttgaccagctatctcccctcgagagctcctctgcatctcccgaatcagcatctccccagagcaccgtaaccgtgttccagcagacccagattcaggagcctacagcgaatgcgacaaccaccactgcaacaaccgatgagcttaagacagtgactaaagatcgcatggaagatattaagatcctgattgcgagtccatcccctacacatatccacaaagagactacttccgctacctctagtccctaccgggacacacagagccgaactgcctctcccaacagagccggtaagggggtcatcgagcagacagagaagtcccatcctcgcagtcctaatgtgctttcagtggcgctgtcacaacgtactaccgttcccgaagaggagttgaaccctaaaatcctggctctacagaatgcacagcgtaagcgcaagatggaacacgatggatcgctcttccaggccgttgggatcgggacgctcctgcagcaacccgacgatcacgcggcaaccactagcttgagttggaagagagtgaagggctgcaaatccagcgaacagaacggcatggagcagaaaacgatcattctgataccctccgacctcgcctgcagattgttgggacagagtatggatgagagcggtcttccccagcttaccagttatgactgcgaagtgaacgcacccatccaggggagccgtaaccttctgcaaggagaagagctgctccgcgctctggatcaagtgaattag

SEQ ID NO: 28983 - DNA, 1296 bp, Artificial Sequence
  Description of Artificial Sequence: Synthetic coding sequence
atggaggacattcagactaatgccgaactgaaatccactcaggaacaatctgtccccgctgagtctgcagccgtgcttaatgattactccctgacaaagagtcatgaaatggaaaacgtggatagcggagaaggaccagcaaatgaggacgaggacatcggagatgattctatgaaggtgaaagatgagtattctgagagggacgagaatgtgctgaagtccgaacctatgggcaacgctgaagaaccagagatcccgtactcctactcgcgcgagtataacgagtatgagaatatcaagctggaaagacacgtggtgagcttcgacagtagccggccaacctccggtaaaatgaactgcgatgtgtgtggattgtcatgcatcagttttaacgtcctcatggtccacaaaaggtcccacaccggtgagcggccatttcagtgcaaccaatgcggcgcatcttttacacagaagggtaatctcctccgtcacataaaactccacacgggtgagaaaccatttaagtgtcatctgtgtaattacgcatgtcagaggagagatgccctaaccggacatttgaggacacactctggcgagaaaagacactgttttgacgtcaattataacagtagctatatgtatgagaaggaaagcgagttgattcagacgcgcatgatggaccaggcaatcaacaatgctatctcctatctgggagccgaggcgttacggcctcttgtgcagacccccccagcacccacctcggaaatggtgcccgttatctcctccatgtaccccattgcgctgacccgggctgaaatgtccaatggcgcaccacaggagctggaaaaaaagtccatacacctgcctgaaaaatctgtcccatcggaacgaggtctgtctcctaacaattccggccacgattccaccgatacggatagcaaccacgaggagaggcaaaatcacatatatcaacaaaatcacatggtcctgagcagagccagaaacggcatgccgctccttaaggaggtccccagaagttacgagttgctcaaaccaccaccgatctgtcctagagattcagtaaaggtgatcaacaaagagggcgaggtaatggatgtgtataggtgtgaccactgcagggtgctcttcttggactatgtgatgttcacgattcatatgggatgtcatggctttcgcgacccatttgaatgcaacatgtgtggctatcgctcacacgaccgatacgagttctcctctcatattgcacgcggagaacacagagctcttctgaagtag
